United States Patent 9,909,131 (OPTIMAL SOYBEAN LOCI) - sequence listing, part 3

SEQ ID NO: 3925 - DNA, 1000 bp, Glycine max
  Soy_ogl_633 Gm02:43631801..43632800 Cluster 15
tcttaattttgatttaacttatttaatcctgggagtcatgtaaggtggtttggtggttgggaaggatcacataaggattggagtaataaggatgatatgaatttgaattttctcactaacataatatattaattactaacattttcttataaaaataaaaaatatttaacttaagataaattatacaaaatagtgatgaatttagaaattttaagttgtaacaacgatacttttatacataaatttgtgggaaaatattcatattaattatgatttttttgtattttaaattagggagataatttataattatacatatctattatattgataattattaaaaaatattctggggatagctgcccacaaaatgtgccaagtgtggagtcatatacatttgataaaatttatttcgtaaaattattatctttaattataatttgttgaaatagatggtgtttaatagttagcatatttttctgtgttctcagatataagcaaataagtaagttccagttaataaaaaatgtagttaataatatttaattatacgaatctcattaactttttttataatatatactattactgttgtgaaacttgacataaaaaaataagagagagtgattaaaattaaatctcaatcaaacaaaggctattttgggaataataatcttattaaataagacaaaattaataaaaaattgttaagaacacattatttcaaagacaccttctttaataaaaattaaaaattagaaaagataatcgttaaatacgtacaacatgagactcaacatatttttatcctattcaataaatttcaatcaattaaaagtaattgtgttcaaaatagtatataagagagaatatcgttaatatttctctttaaatttagttatatttgagccaacacacaagtgatttttttttttgtttatattcaatactggaggaagtatagaagaaaccttggcagcaatacatgagattatggaat

SEQ ID NO: 3926 - DNA, 1000 bp, Glycine max
  Soy_ogl_1288 Gm04:7842201..7843200 Cluster 15
aatttattatatatttattagtcttttttatgatgtttatcaacattttttatacaaaaatttataaatatattttatttataagataaacgtgtcactttaaataatcaaattccatatttgttgttgtaaataaaccgtattcagaaatcagagcagaaagttagaaccgcacgaagaggttcctctctttctttaggtaaatttttcatacaaaacgttaggaaattggcatttttttttatcattctggtgtacttttttaaaaataattaaattagtgtaattattaataaaaatattaattcatagtaagttatatttcatgagcacgttttttttatgtgaataattttttagttataaaccttcataaatgcagttgtacttgtgaagtgtgatttatcatatattggtactttttttttaaaaaaaaactattgatttagtaattttaaaagaaaaatgtactaaatcggtaaagatccaactgacaaactataatcttagaagaaatgactacggcccattaaatcctgacgagtcaattttaaaatgtaattttacattcacaaatgactatttcaaaagagaaaaaggaaatgttggaagcaattgggaagtagagaaagcaataacccaaaataaactaaattccaacgtcaataaagcccacataaatttttttcttttatcagtgaagaacgaaagacatttatttgttacacttttactatttcatcctgcacctcctattatattcgaaaaaattcattctaagataaaaattagtataccagatggactttttggaatataataaaagatttaaggtgtaggatgtaaagtggaggatccaatagccaaaacaaaattagagaatttgaacttgtaccaaccctttagtacacatgggatatttcatataagacatttgtaacttattaaataaataaatcttaaaagttttattgtaaaaaaaataatctttaaaatttgt

SEQ ID NO: 3927 - DNA, 1110 bp, Glycine max
  Soy_ogl_1590 Gm05:4539091..4540200 Cluster 15
cagttatctccacaataaatacaaaaaggaaaataaagtatttatctaaaaaaaacaaaattttccttacaataaaaattataaaaggagaataaaatattttataaaaaataaaagagaaataaacaatatcataattgtattcactataagattttctatactattaattattaattttaaactttgaaactattttttaaagttggttatttttaattgttaatgattttaaatcatttgatgaacatagaataactatttgattaaaagtaatttttagttattattatagatagttttacgttaatactaagtttttgcttttaataacattagtagttatggctaattttttacattaataatacctttcacacaagaactattccattatttaattgtatttttataatattttgtatttttcaaacttactttacttttatattatcattttgtataagaaagtttatacaatataacttaaacttgtaaatttttcttatttgcagatttttcttgtgggttttttgaaccattttttaatataaattttatgattttcttacacaaattttcttcaagttttgctaagattttggcaaaaatatgatatttttcttgaatatgttgaaaatccaccgaaaccccttcaaatattttatgggtattcttgtacaaattttattttgtataaaagttcaaaattatccatgaagatgatattataaaaaaattacatttaatttattttatatatgcttaattattttggtccctccaaatttttttgttaagctctgtcattgcatattcttttccacaaattcaatatgtgttgtcaaattagtaaaaaaaacacggctagttttctctttgacaaattttaataaatagtattaatttcttattccattttttagtgtccttatatagtgttaatttttaattttagactatagcaaacttgtatatgaaggaatcagatttgtttttttaagccaacaaaaagatacatcagagattacatcgagcaaaaagagattacatcagagatgctgtgtgtaatgacagcactgcatcacaaccccaaataatgcagcatag

SEQ ID NO: 3928 - DNA, 1024 bp, Glycine max
  Soy_ogl_2718 Gm08:15865277..15866300 Cluster 15
catgattctgaactgacttcatccccactcagttaattcttgcatacaattttagtctccttttttatttatatccaattaatgtatttaattagcaaaacaagacaagtaccggccaaagttgttttgtgtgtgtgtgtgtgtaatgattgtatttatgcttcttctttttttcatactacggttgtatgtaaaatagggaaaaaggtattcaatcaaatattaacttttcgtagtgcttattacaaattctattttcaatatttgataattgatttgaaatatttaaagtaacaatttattataatggcattatgatttcaagttcaaaattatgattgaataaatatgaattatgtataatttaataattaattgttataaaatgcttgattgcagaggcttaaatttagaaaatgagtaatttattaaatctaaaagaaaagtcaaactatatgtttaaaaagggatgagtgcatttattgtgatttatatcttcaatatcaatatgatacattaactggaattttgaaattaaagtcaattaaatatcaaataaaaatgctttcaaaaaatcaaataaaaacaaaaaaatggggaaaaagtagatgttttataattttgagaatagatatttgaattttctgatgttataacaaaataattaattatacgagaaaaaatttgttttgtttggtcatttgatttatttacaatgtgcttgttattacaatgtatatttgtcgagataaagaaacatgtttatgaatttagacatttcgtattgataattttttttaaaaaaaatcacaaatataataacagggttactgcatttttttacttatcattaacggcaaattctactgtgccttcaaattttaaagggtttatgaatgaaattgagttcgaaatcctaaaacagagttttaaattcaaattttgtgaataattaaaaaaaaaactcattaaaagttaagtttctcaacaagtccagtaatattttacaccaaaattatggtaa

SEQ ID NO: 3929 - DNA, 1063 bp, Glycine max
  Soy_ogl_2752 Gm08:18059001..18060063 Cluster 15
tttgtttcatcatctgtcatttctatcaaatgaatcataaggatagatttgataaagaaaaaacatacgataaaaggaaataaaatttttaaaaactaatgagtcacatatttattattttactttaatttaaatatttattatttttttccactcaactaaatttaccctaagttttgtgttggaaaaatttgtcccatcatttgacaattttaaaataaaactaaactgagatggatactaatgcatggagtatttttttattttttttataaaagtttaattttcatgctttgtgaataagaaaaaaaaaattacattgttaactaattaagaatcataataaataacctttaacataattattgaaaaaattaacaaatttattgtaaatttgtgattaaatgacaatattaaactttttacaatgtttgtatataaactatttcttctatgtttttatttatacaatttactaatattaattaattttctcattttcattggaattatatattattttttaatatattatctatctatctcatttattactttagcattccatatttttttaatttctttataaatttataattaagataataataattaattttgtctcataatgttaaaattgtagataaataatacagaataaattctaaaaaacaacatatataaagatatttgtatttttctttaataaaaagtaaataggtcctacctatcaattgttgacaaagaaagagatacatatgtgattcaaacatcaccttctttcgttaacattcaacacaagagcaataatattgttcgacacatttaataaatagttgaatttcttaaatatattaatcatcattttttagggtatataactagaatcttattaactactactatatgaatgaaaaatttaaggatattttttttagtaattaatagtcttgtgacatttacaatacttaataatttttaagatagtaaattttataaatccattttttctgtttaaatttattttagtgtattatatatttttaagatataaaaatgttaa

SEQ ID NO: 3930 - DNA, 1011 bp, Glycine max
  Soy_ogl_2756 Gm08:18305401..18306411 Cluster 15
atacataaaaataaaaggtgttttagtttgaatttcaaacaaaattaagctagtcttttatcatgttgtttgaattgatttaatgtgttttgtttttctttttaaatttgtttatatgattttaaaaagaaaatagtttgacaactaacgtcatatataattggttaaaaataaaattatggtccattaaagtttatctatcacgccaatttgatctttctactactattaatttaggtttcaatttgatttcttatatttaaatttgtttactttggtccattaaagtttatctatcacaccaaattggtctttctattcatttatcacgttaatgtctttgaacatataaataattgacaatttagtttctaaaataataaaaattttaatttattttttaatgtataaaatatatgataattatgttctacagttaagtttcataagattattataagattattatgtcattaatatgtaatgttgaaacttcgttcaaagatcaatttaacataaagagtatttatatataaaaaaaacttacattaccatgcaagaacttattttgttcaatttcatcaacctctaaaaattattttgtgtgtttcattaaataaattatcattatgttttagttttaattcacctcagaccattaattttttaaactttttatgtgaaagtattttttcacctcaaaattattattatcttagactttttatttcaaattttttgttgttttagaaatttgataattaatatcgtcattaataaaacttttgttatatgcacatcttttcttttaatatcttaaatttcaataatagcttacttaaagaaatctaactatttaataattttctcttatatcataaattagaatatatagtttgaaaagtaaaattttcactttttcattctcttatttatatattatacatattttatctttatccatgtacttaacttaatattatctatctcttttcatcctccacttttatc

SEQ ID NO: 3931 - DNA, 1100 bp, Glycine max
  Soy_ogl_2823 Gm08:38938101..38939200 Cluster 15
aaattaattttaatcatttatgaattaacctaatattaagattaattccttttaaaaaaagatgaagattaattgttttcacaaaaataattttcacttgatatatataaatcttgtaatgaatattaaaattattacctataatttaaatataagtctttttaatgtaggcatgacacatattttaacgctgtatttaattcaacatattaataataacttatattttagcacaccttttaaatattttttttaaaaaaaattacctaagaagttaaaaaaacatgtgaattcccttttctatttattctcctatattttttcttctttttatataatcctataattttccgtacaaaaaacatatattgtaaataatatataaaaatatatatgaaaaaattactcatttaatcattgtatattcataaatttatttccttctgtccttattataaaacacaaattagaaggaattgatgaacttttttataagatattttacaatttttatgaaatattttttttcattagttgccttattaaatgctcttttaaactttaatattttcatatctcttgtaacaagttaatgattattaataagtacaacattggtaattagtaatattttttaaaataataataataaaataaacagagttgattatttttattgatttgtgtgattaatatcgaaagtgtcttaaggataggataaaatgtattttagttcctacacttacaagtcgtcccttgtagcattctataataacttttgaatttcttttagtttcaatcgttacataatgataaagaattaaagagaatataaaggaattgatagaatgaaatatggtaagatctcgcactggattataggttcgaatgtcctcttatttcctttaagtgaggtaaatgtaagtatttatataaatattttttgaatttaaaagttttctctgctttagattggagcatcattttcttatcctaaattttcatttatcgaagtcaacaactaaaaagtaaaaatttaataaagcaagagccaagtaaataaaaaagtgtttatataaagattaaaaaggataattttt

SEQ ID NO: 3932 - DNA, 1008 bp, Glycine max
  Soy_ogl_6453 Gm19:39414293..39415300 Cluster 15
gatgatttagattatattctcaaatttattcaaaacatatggattctaatttttgtatatttaagtaattgtaaataatgataacaagtttaaataatatcataaaattttgtttataattcaagggtggttcaaaatataattcaaacttgatttttatttctattatgcttattaaatattaaaaatgtttcaaaaaatatatacaaaattgattaatacattaataaaatataaaattttgttactttatatattaaataattttataaagtacatttcatttaatgaaattattttataatatttttaccattcaatttttaattaatttcgtgcgtgcatattaactcgaaatggaaccattataattatataaacaataaccatccttggactgaaactattgttttaggcagtaaaaagctaaatgaaaaggggtgcaatgaccattcttggattgaaagttgaaactatcgtgttaaagcatttcaggatattaagttttctcaatatataaatatgattgtccgaagagttccaaaagtttttcaatatttaaaatccaacaacaaaataaattgaaaaaataagatgctttcaaattaacctattaattaattaatataattatgaaaaacaaaatcgtttatagaaaatgtatggctttcaaatactagagaaaagggggggaaaatacgtcatttattgactttcaattgaatctttctccaaagttatgggcaaatgagttcaaggtactccatataccattaaagtcaaatgaatgaatttaaggagtcaagttgaagaaggtactctataactacataccattagattcaaactccaagccctaattcagcacctgaaaatgtaagagaaaaaagtagtaatgaatgaaaacccacgaaatcgaaaatcctcaagagcgcgcacaaaacacacttcaaagttttgtatatataaattgatgaagaaagagtgggcctatgaaattaatgaaaa

SEQ ID NO: 3933 - DNA, 1100 bp, Glycine max
  Soy_ogl_491 Gm02:11401201..11402300 Cluster 15
tgattataaacggctactaacccttgctttgtctgtataaaaaatatatatggcaaaaaatgatgagaacatcattttctcgatttgtccatgataccaaaaatctcaaagtcaaactctgatagtcattttacataattttaagtacggaaaaaggctttagactacaagaataagatcaggtgtttgatttataatagtgctttgctgacatttgtaaaaatgatatttctttttcaaacttgtgcaactttaaaatgaaactttccaattatcgtaaagtcaaatttcaaaactacaattatcaattgctaatttgtcggttaacctcagttagtggaaacacacatgacgttacaaccataattaagatcgtacaatattttatgataattattccattgataacctcgaatctttaactaaacaatcactaggagtgaatcattaggatcaatctaatcattggaggatttgtataatatgtttgaagttataggttggaatcttagtataaccattatatactaaaaacaaacaatcacagagattatttgttatttagtcttttgttttttgttgcaagtggaaattattatatagtattgtaactgtacatttttaagttataaatagttataggaagatgacgttatttttactttttttatataaatatttatacaaaaaataataatgttctttttactatttactgatagaatatgttttaaagtaaaataatttaaggtgtacaaataaccccacttactcaaatttatattcatcacgctgttccataataaaaaggtttcttaaaagtcctcatgcaattatatttgtaaattgtaatgcaaacatttttagtacataacataatgaattgattaagtacgtgttgtgtttggttataggatagatagattcttcgtaatggcattaaaatattagttaaaatgtgatttcaaataaattttatagtttcatgttgaagaattgattcttgattaaaaaagttataagtttaaattattttgagtaacttttgcattatataaaaaataagttactaccgattagtttttatagtaaggtacgtt

SEQ ID NO: 3934 - DNA, 1000 bp, Glycine max
  Soy_ogl_5744 Gm17:37421201..37422200 Cluster 15
ttttttgtggttgtaatagtagatttctaagtttatatgtattaattaagtagaatgtacgtagaaactataatacacttaactttcgtttccaatttttgaagttgttataacattttttaagagagttcttgagttcaacaatctttgttcattaaatttattattatttttatttttgagtttttcatgttatatattgaattctagaagaagaattctcaaaaacttttttctaaataatgttttttaatgtgcctctccttaactttttattttttattttttattgagcaagtaaaattcaagaacttaaattaaattttaccattagagtaaaaaattataaaagttcttccatcttatgtcactggtcaatacttttaggcttttttcttcgactcgtgtgaattcctaactagaaaaaccaaaagctagctttatcaaaagccttcggttactttctagtaaaacacttccaatttttgtattgtttagatttcttgtactaggtcatttagacttttaaagctttaatttaatcatggacaaacggtcaaaattcttgatatttttattaaataaaaatatttgaaatctcaaccaatttccattcttttcccagcagatcccttcaacattggataaagatgcttgctatattaaaacaattttacgttgcgtgaaccgaagtcacatcaatggcaacaagccagttttaaaaaataatagaccaaacaatcaagtaaatacaatatataatacgacattcaattttttttaataggttacaatattcaactttattaacaattctagactaatataacattcaactttgttagcaactttaaaaataaaatatattatataacttgtatactgattttgaacaatatttgcctttattagcaatgtcaacacttattcaccttccatttggatcccattattcaatatctgttgctttaaaatgttcagcgggttgccatggttacaa

SEQ ID NO: 3935 - DNA, 1140 bp, Glycine max
  Soy_ogl_138 Gm01:41488101..41489240 Cluster 15
ctcatcttttatgaatttatatttttttactttaatatatgttttttaacttatttctttttaaaatttttactttttcaaactttttattacttattgaatcactatccaaatagaagttattataaaaataacctaacaccccgctaatattgatgctttttatcccgcaaagctattttctagtacgcaagcatgtttggaataatttataatctaaaattgcagctgttttcttttttcaaaaataagttatttccaaaataagctagatgtttgagatcttaggttaaatttattaaaaaaattatttaaaaaatttatttttatgaaactcgaaatttgttatttatgattatttttcaacagtttatttttcctttcaactgttttatactattttactttgtaaaacctaattttttattgcatccaaataaaattaattattttcaaattacttttcaataaacttacctaaacagaaattaattatgattttaatcgattattataataatctattttcacggttgtctcaacacacaccctaaatctaacacaggtttgaattttaagaatatgattaattttaatttttctcccattctttttgcaacccctttcttctatctcaatgatcacctaagagctagggatttcgctaggcccaccaaggctatgtgtggatactgactagtctttactcgatcacaaaacacaagtattaggcaaatgaattttttatttaagataacaaaattagagtttgttctatttttatttttatcattaatattttaataaaaattctcctttatcctttttttaattcagaaaaaaaacctcatgcttaccaccataattgataatacccacctctgaacttcaatacaccgcccccatgctttcctcccttgcaattacatttactatttttcgggttattttttaatattttttagagcgggttatattttttactaatacactttaattttaattattatgttacttatattatttttttcaaaaaaataatttaatattaaaaaatggataagagttaaaaataataaaattataattatttaaaattatcttttatatgcaaaataaaacaaattttatataaaaatc

SEQ ID NO: 3936 - DNA, 1040 bp, Glycine max
  Soy_ogl_159 Gm01:44203801..44204840 Cluster 15
tagataggaggggtggggtcgggaaaggcttcccttgttttgttttttttaatctaaattttttaatatatacaatatataatattttaataataaattaattacttttatttgaagagtttgattataagaataataatatttaaagtgtgtttgtttcctggattaaaagcctattcacaagaaatgtaaacatgagaatataacatttatatgttttattacaagttttgaaaatttattcccaaagtattattgatttttaggaatgtagtaactttctttttattgtgtttttctgtacttttattctcatgaagagaaatgggatattcttattggaaatataaaaaatattcatttaatacatgtgtaacttttatttttactttttttagttaaattattttgaatcttaacaaataatctctgaaataatatatgtaacaaaaaaacatcttaaatatactcaaaaataacattcctagttatcatattcctaaaaatataaatatgatttttgtaaatataatatcattctatgaaacaaatgtctccttgagtattagttatctattttattttttttattttactttgtgacaaaatatttatctcttttttatagtactcattgtgaaaataataacatttttcctcctttaagacaaatatacttcttttttatcgtcttcattgtaaaaataattatctttcttttttaaatcaaaatattcaagtgttatttatttcttttttaaatattttttccttttctaatctattttcaagatataaatatttatatttacaatcaaatgactttattatccatgtaaaaaaaggtaccaaaaaaatgacttcattatccttctttattgatttaataataattgatttgaaaaattaaatggtatttgcactcaaaaaatataacattgagacaaataattattactccctcccctggtttattataattgtcgtgtaagcaacgacaaagctttgtaggagtggaagggggcatggccccccaagac

SEQ ID NO: 3937 - DNA, 1017 bp, Glycine max
  Soy_ogl_576 Gm02:30103184..30104200 Cluster 15
tgaatcaaaattacattttattttagtgatttctatttttatcttaataattaaaatgacaacaattattatataataaatagcaattttaattaaaaataaaacttaaatatgtttttagttctttaaatttagataattaattttgtagtccttaaaaaaaatatttttattagtcttttaaatttgaaaaattacttttaatttctctcattctttatggtgttataattttaagctatttttcaccatcaaacatgtaaatatggaaaaaattgcaacaatttcatatccatatttttatttttccttttataaacggctagaatatataaaaaaaaacggccatcaagctatacaaatcaattattttgtcggtttaaaataatcagaaatcatttttaaaaaaaataaaaaatttctgttaaaaattactataaattgtgaaaacatgaagaaattaaattattataaagaaactaaaagtaactttcaaaaatttaaagaactaataaaaattattttttaaaaaagactaaaaatccaaatttaaagtactagaaagtaagcctaaaaataaccataacttattctatacttggatctaaacttcatcgtaagttatttttttcaacaagagttctaatttttgttcattaattggttatccacataaacaatcccaatcatgcaggaaaaaaatggttgcagcagacaggcagtagtaacatttgtcagtgtgactctattgtagatttagtatgggtttggattacaattaagaaaataaagtttggttgaaattaattttgtaaatataaatttaattaaaagtaggtttaataatataagttgatttatatttaaaactttttacatttaacggaaaagtgagagaggaataattttaaaatacactttgattttgatgaaaattaaccaaaaaataaataagaaatgagtctcaattgagtgtctataattaaacgtgaaaccaaactcacttttagaatttgg

SEQ ID NO: 3938 - DNA, 1000 bp, Glycine max
  Soy_ogl_1614 Gm05:25924301..25925300 Cluster 15
accaaaaaattatataaatgataatttgaatatgcatgttattcctcgtccccggttccatcctcagtcaataaaatattaaatatttcaaaagtttaatgcatctttttttattaattttattatctatttaaatgtgaattaatgtcatgttttaattgtaattattacctttttaattatatcaattaatcactgtttttttatcaactactccattatatttgattaattatccttattacatgttattgttactagttttttgacctgtatgatataaggggtaattttttttaagattttaaatttttggtttgttttgtatgtactttgactgcaaaaaataatatttggagaattttatttattttgaaaaatggaattaataataaactaagaacatgtgacaacttaaaacagaattaaaaaatattcattatttaaacatcatgaacacatgacaaatgaataattaaattttttgtatattaataattaaatgttcattacttaaaaaatataatttttttaaaatttaaaatagttatatgtattaattaattataaatctgaagtatctagccatttatcattcaaaaaagttgtgaaaatttaatcataacccatgaccgtcttaatattcaaaactgaaaaatagctatttatatcattttttgaaatataatcaaaaccgaaaatttcgattaacaattgttgggttttaatattcaccctcaccatgtctcaataatataaaactggaaaaaaaggaaaatatataaaggcacatgacaagagtcttttctaggaccaaatttgacttttagtggagcatcattccgagattaattataaaagaattttagcgtatgcagtgattataaaaatgtaaaacaacaaaaacatgcatttaacaacatgaaactaatttattttaaacaaaaatacattgtttttaggataataaaaataaattgaagaaaagtgttgataatag

SEQ ID NO: 3939 - DNA, 1124 bp, Glycine max
  Soy_ogl_2033 Gm06:38103701..38104824 Cluster 15
atgtaatgtaatcaatcctgcagcaaggacttttttttcatgctatattgttatagattagtgcatgtactcgagtgcacaggaaatgctatttttaattttatttcttttagggacatgtatatggataacatattaatttgttttataatttaatatgttttcttaaatacataagtaaattttcactgaaagagcataaaatgttagaattactttagttaaatttgattttaaacattatttttaaatgtataacttagattcaatccaaagaaaactaaccctttataactgtttatagtcaacatacaacaatagaattggattttattaatttcttttaagaatattgtctttaaaaataggtttgaaagtccatagtatttcaattgatataaaatgataaatttaaatttatatcattctgtatcaaaataacttattgaattcttcagtaaaattgttaacttattaaattgttaaataatataatgttatattcatcagtaaaaatattaacttataagtatttattctcttatagatttagttagaacataaaaaatccgaagaattaattttagttataccatatataaaaattaaaattggttttgctgatattttcttaattatgcatgtcgcgcactgatttatcacacgatgtaaattctatattaattaatatctaggacggttagttattaattaagagtaaacatcttcgtgcctttatgattttctttatacttttgatttaaattatgagtttatttttttatttagacagaaagatgaatttgagtgaaaagttttgaaggaaagaagaagtgagaaacgggaaaggaagaagggtacgtgtcacctttattagctgtattttaagaaatttttaaatcaaataaataattctattgttttaattaaaaaattgatatagttttaaaatcagaaaaattggtagttttaattatcaaattggaatattttgaaaataaaaaatatggacagttttaattaacatattttgttatttttaaaatgaaaaaaatgagcaagtttaattaataattggtagatttttaaaattcaaatttcaagccactcttcaataactatat

SEQ ID NO: 3940 - DNA, 1033 bp, Glycine max
  Soy_ogl_2806 Gm08:35170868..35171900 Cluster 15
ctctaataaaaaatacatgcttgtgatctaaaaaaaagttatccaaaaatatataataaaaagtatatttacataaaagataaattaaaagttattttaaagactcaacattgcaattgtcaataattagtttctcatgcaaccaagaaaatttatgaatttataataaaaaaaatggtatttatgttgatcatcattttttaaaaactattgctttgcaagaaaaaaatggtagactcttggtgtaaccctcattcaattagtttttctaacatttacacagtatcatgtctgaacccatgcacttaagaccagccgttggagctacacaaatatataatgataaaaagaacaaagatgagacaggaaaagtaagaagaatatgggaagaatagttatatgaattaggaaaaaaaattgtttgatgtgtctcaaattctaagttatcaattgcttagtgtttgtaagatcggtcattgacaaaggttaataaatggttcaaggcttaatatatttttggtctctcaaatatagattaatttttctttaaaaaatttggattagttttatttttgttcccaaatttaaatttattttttttagaaaatattattttttaacccctctccataaaaaaatctaagattattttggggcaattgtgatttttttttataaaaagggactaataagaatatttttaaaaattgagggactagaaaagaaaatttaaatttggaaaccaaaaataaaagttcaaatttgcaaaaaaaatcatatttaaatcacaattttaattctcaaagaaatttagaaaaactagtaaagtcatttgattgcaaatatgcaatcatttagaacttttaaataaaaatattaataaatattttgaaagaaaagtattaagaaaataaattatacttaagcatttaattgaaaaggagaaaaatatacacccttgaacccacacccttatgatttaagataaagactataaaaggacacaattagttaaaaatttaaaaaatataaa

SEQ ID NO: 3941 - DNA, 1000 bp, Glycine max
  Soy_ogl_4209 Gm13:22811601..22812600 Cluster 15
tacatatttgacttaattatactttttttattgaatattataattgtgtgattttaattttttcagattttaattatataattgagttgtttaagtatcataattatatagttttagtctctttctatcattttttgttaacaaatattgatgtgacattaatttgataatataataactaatatatgttgatgtatttctcacgattataattcttgagagataaaaaaaatgttattaaatcactacaatatgtattatgcaatgcattaatttttacatcattgacatgtcataattcaatgtccgaaaaaattgttaaaatctaagaaatcaaaattacaaattataatacgtaaaagataaaactggaattaaacctaaatattttcttgcttctacctatatttagtgttcaaacattgataaaaagtaggagctaacattactttatggaatttgataacaacattgatgatatttcaatttattaatattatacaaaagattattatgattaggataaggcttaaaatatggtaaatatccacttatgcaaatacatcataatcttttcttttgttccctcttttgtatttggtatctctgatataccatgttggtttatttataaaatattctagttgtcaatattacattatcaaaagtgtcacaccaatattttatttttagatttatgatgattttacaccaccaattttgattttgtgacaatgttagaggacctaaaactagtggagctacgcatggaaattaactaatgacaaagattaaaacatagaatgctagttgattattaatgtacacgcaattagaccatatattgtgtaccttgtgagatacattagtatttttaggtgtgttacaataataaattaatggtaatttattatatgcttgatcatgtaagtcttcttgctttgttagcaaggtagctgtttttgtttggagaagattgttcgttgctcgtactcaaacc

SEQ ID NO: 3942 - DNA, 1222 bp, Glycine max
  Soy_ogl_4265 Gm13:25664332..25665553 Cluster 15
ttatcaaattttagaattatttatttaatgataaaaaaaattgaaaatataatttacattttttataacataaaggatataatgaatcaacaagtcgttggtctgattactactagactcgatcttcttaaacaaagattcagatttaagtcttgtagatgaaaaaaaaagtgattgataaagaacaaccccactaaagattgtcaactaagttttctgatgaaaattaatcattaacaaaattgatgaatacttcgtatcaatgacatgattaccaaacaataaaggatataatgatccttatatcttatttattcttcttttgttatttcttttaaatttggagagaaagaatcttgaagtgagacccatattatattttctttcttattcttgatttcttctctaccaaatgagaaattttttttgatagaaaatgttaaatgttcaccccatttaggggttaattaggatagaaggaaaagaaagatagagagaaaaaataagataaatagaaaaaatgatagatatgatatatgatgagatgaaaaaaggtaaaaaaagattgtgacacaaatggaatgaaagtgaattataagagagtgagatatatgaatataattattctttttcaataactatgtttacttttcattcctttcaaacaaagtcctaatatttactattagaatgagtataagtaataacataactaactacattaagccgcacactataagcatcttttaataataaattgaaagactatactacactaagaaattgatgaaggttatatcctttatagatattctcttaatacttatataaaataattgtattttttaaatccttattaaaaaaataattattatttttactatgctataaatatgaagtattcataactttgtcatttattaattttcactaaaaaaattataagtgactcatctttaatagagtttaccatttttaatcattttctattatttttgttgataattaattttgaatgagaaatttaagctcaactccactgggatcgatgtaataaatatttgtaattactaaaatgtattgtctccatcttgtaatagtgtcatgttaaaaagaaaaagcttcaaaataagtattacattttgttattattatgaggtcaaatgattaattcatcatgattatgaagttttaattattttattaatttagttaaaaacct

SEQ ID NO: 3943 - DNA, 1100 bp, Glycine max
  Soy_ogl_5124 Gm15:43869001..43870100 Cluster 15
acttaaaaagatcataaatatgataaaaatcatctgacaaataaatccaacaagtgataagaaaattagaaaatcgaatatttagtttttttaattgtccgtgagactcactgttcacattctcattatgtttatgattctttattgttcaaacattagttgtgttacaaagtattcatgtaaataaaaataataaataagtttaatgtcttgaattaataaaaaaagattagaagaattctgtcccaaaataaaaaaaaaaactattttaactcactttaaaattaaactcactaaattgattttttaaaatataaataaccaaattgaatatcattgaaaatataaaagattataaaagaataaaagtgtactttatcttattattttcgtcaaatgtttttaaaatagttaaattttttaaaaagccaaatttgttgcaactctcacaaacgacggccatgagtcatcatcacactttcaatttgcaaccatgaatactatgtattaatgaaacatacttcgtagttcccatctcatctcatgaaaactgccttttgctgtcaaacgttaagtttaggtgtcacgttgataacactctttcccttcattacattcattattaagcgtgcaaaagagaaatggtgaaaacaatttttttctatttaacacgaaagctatgcacaattgatggactctccttctcaaaattgagtgtgaaatacaagttaacgtttattaaataattttgtttctttttgaagttaagtgtaagtttttaaaaatatttttatatctttttataagtcaattaaaatatttagacaatatttttttattttttagtcaattgtaatttcttttggaatctaaggaaatgaaaaaaaaataataaaggaaaaaatattcaataatttaaataaatagtataataagaaatcagataacaattttaacaaaaacaagaatgttaatatatttttttaattgacgtgtcacaaccttaaagacactaagaaaggaatgaaggtattttgaaatatttaaattaaaaaaatctttgtatttataaaaagaaaatatttgaaataactccaaaa

SEQ ID NO: 3944 - DNA, 1100 bp, Glycine max
  Soy_ogl_5708 Gm17:23325901..23327000 Cluster 15
ttaattagttactatatatgaatttgtgtaaattttattttcatctatccaaatctttttttatttttttatttttcttgactcttgtaattttgaatattttctagatgaattgttcatgcaattctttaaaattttataaatctataaattcattttaatcctttaaattcttagaatataaatatattgaaatccaattaatcataaaaaaaatcttatatgtcataatatttctaagttgtcttttaaaatttacaagccttgaaagaatcataatccaagacacccttttagttataaataactatcaactattgatttgtacgttattaaattaaaatgttattatgttaataatgatttatgatttaatgagtgtatataattattatatactattagtatataatccttaaattaggtatcaagagtttatcataactactatactactcaatccagctctacgtacgtacagttactacaagagaatttgtattgccaattaattgaaaatcatttttgtaagtgaaatatatgattaatagctgattcgattaaaattttaaaaagctaaaatacagttttcatatcttttatttatttgttttcttaatttggtcttttaattttaagaagaaaaaaattcacgttgatcaacatagtaacatgtgaaaaaatgacatatgtcacattagatagacgtttgacacgtcacctaatttggtctagtatgatcattttaaagaactaaaaatattaaacatataagattaaattgaaataaaaaataagataaggaataaaaatatatttttattatgagaaatattaatgaccccttatatttaatactctctttctaacttttttttagttaagattgattgaaaatcattaattttttttatcaaatttacacttcatttaatttaatggctctttctctcccttagtttagccctgtgtgtgttttttttatacttgagaaagcaaatttagtcgtgtgttagagatagatttgctaacttgctactatcacctttggtcattataaaaacataaattaaaagaggaatttttaaataaaataagaa

SEQ ID NO: 3945 - DNA, 1000 bp, Glycine max
  Soy_ogl_5711 Gm17:24174501..24175500 Cluster 15
taaaaaaaattcaaattttgtgatatgcacgtgttctcgcatatattcttcgtcatcaacgtttattcttcttaatagcctcgacataaaggtaggcaaagtcatcttgacaattataaaatgttcactcatttatgtaaattattgtaagatttgtcattactttgcataaatttatctatttttataagccaatgtgtatatatgccaatagagtaacatataaattttggataataatcaataactaaatcctgaaaaaaaaattaatcattcactaaacagtagcttcaaatgttaaagaagttattgattgtagtagtgtattttagtttaaagaaaagggataaatttttttgataaaaacccaaagtgtaacattaatgattaactaaaggttacctcttcgaagttttcaattctttctaatctttcttttgcaaattttaaatgattaaaaaatcgacagcatttcacaaatagaagccagaaacatgatgatttattcaactgaatatatatggagttttgagcttctatatatttcctaaggaattaagagttatatatattgtcaagtagttgttagatataatgatcatgggaaagatgtaattgtttttataaaaagaaactcataaaaattataaaacataatcagctagttaaattaactttttaagattataccatacccttaccatagaaaagtgtatattatgtgaataccaataaaaatttagagttttcatttactttttcacacaccaaaaaaatggaggtgaaggaaaatcagagttctactaagatttttgggattttttcaaaagaggaagatgatcttttcttaaaaagtaatcggaaaggtataattgtttttataaaaaagaaactcttaaaaactatataacagtataaactagctaaactaactttttaagattataccagacccttaacatagaaaagtttatgttatgtgaagaccactaagaatcta

SEQ ID NO: 3946 - DNA, 1069 bp, Glycine max
  Soy_ogl_6003 Gm18:8999832..9000900 Cluster 15
cttgactctttgcgtagctgaacatattcaacacttgaaatgttaaataaatgtatgattttatacaaaaaaatttaatataatagattctaagcatgcttgacaaattattatttatatttacttaaattgatgttttagtcctaaacgatttttgaataacctagaacttgactggtttaatcaaatactatagattttgaaaaaaaaaaaaaaacttttgacatagtttattttcatctaaagactggcttagtctgatgtaagttagaatataagttcttatcgaataacctaacatatttctacccatgcaagcaactgagaatatttttaaaagaataattcgttttggtacggaatttgaaagtaggaacacacacgaacacaggatgatgatttttttcattgggtgattaacaaactataagtaacgatacaacaaagaaaaagaaattaaagagtggaaacaatactgatgtgaaactttcgttttattcagaaatttcgatttaaaaaacaaagctacatatattgaaaagtaatgtgttatgttgtagttcatatttctataaatgaaaaatgaaaaagaaacaatttttttataaaggacagtcccaccctttatataaaaagaggggagggtcaaaaggaggattagttttttaaactaaaaatggacatttttatatttataaaaactaaaaaacatatttaatctgaaaatagatagcattgattctgtttatttgctttttatatatctcacaattttcctttgaaatccacccactataagaagattcggagcacgttccttgtttttctctccctcacaattctctcacgcttatcatacaggacttttaatgtctttgatcttcaaatcaaaacgcctagactatagaatgttttatgtgccatatatcattatataatacacaaataaatatagtacaaagtagcatgcatgtaaaaatatactaaaatgaatctatatatatataagagaagctaagagaacagaagatatttggatggccatataccaacaagaggcaagaaatta

SEQ ID NO: 3947 - DNA, 1030 bp, Glycine max
  Soy_ogl_6056 Gm18:17085703..17086732 Cluster 15
ttttaaactctaaattagcagttttagactccgaattccatgtttaaaataaaaattggtcaaatcctaaagaaaactctatgatgagtttttttcttcttataaattaataaaaattatgtgtctgtaaaattatgataatactgaatttttttcatttttaaaattcaaaagtatttattcaatttttgtagtgaatattatttaataattatttttaactaataataaagtcaaataatgttttacctaatttgttggatgctattaactgagtgtttttttttttttgtttcagtggatatattttattcattacacgtttcaagaaaaaaaaaatccttttctatttaactgacgctagcctcccatctttttataaaagaaataaagggaagtgttttttatgtcctaataagaaaacatcatatcactttcaaatctactaatgaaatatccacgtgttttctataaacatagatgcatttattggatattaacaatataagtcatactcattaattgaaaatcaatacaactaataagtattaatcttttaatttttaggcattttgaaataaaatttaaatttatgatataattaattaaagttaaataatctaattattttcattagtcttgataatttgggtatttatttattatgtacaaatctgcagacaatattatttaatattaaatttttaatgtttctaaaaaattagaaaagctacgtgaataataaaaatggtatttaatggtatataattaataaattcaaatgtcaaagcaattttgtgagacctatagtgtattggtataattatcatgcttaattcaaattatgtgtgaatcactagggttaacctggtgggagtttacgttgtttgcacaagattttaaattctaaccttgtcatcatcatacaccaaaaaaattaagtatttctatatgcaacggacatattttgcaaattaacatcgtgttcatatctaattcaattaaaaaatgaaaatcgaattcttttgga

SEQ ID NO: 3948 - DNA, 1021 bp, Glycine max
  Soy_ogl_6096 Gm18:47705201..47706221 Cluster 15
tgttaaattatgtaaatttaatttatttagtatctaaaaagctaagaaataaacacaagaaatagggtttaattttgttgtcgaaccttttaaaaaaattgactttttttttgtaaaagatagaaaagtataaagaatcaagatttaaaaaataacaaattaaaacacaattgtatgataaaatagataatcgtattatgaaaacactgaagaacaaatttcttagaacttttttattaaaaacttaatttataaaatcaaaattctagactagttgttagcataagatataaacgatagacgataataaataaagaggaattatactatgtcatctttaataatttgggtacatataatccttgataagatactattagtttcactaataaattattcaagtacatggaattctttatagaaaaattaagtattattgtataattttctgcaagctcaaatcttttagcattattttatttaagtatcttcagattctacacttttctcgtgtttatgaagaaaattcaatgtcatactcgaggatttgaatgatgaattgtaatagttatatatattttctctaaaagaataactaataggataaagaatgaaaggatgaactcaatgaaagctcaagaaaaaattgtgattagacagtaaaattaattattcattcctatatattaatagtgcataaacttttttttttttaactacaatagtgcataaactcttaatagatattaaaaacacaaacttgggataatgtcttgatttgttttaacattggtttttagctttaatgcatattgaggttgaagttagatttttatacataaaacttgttttcatcttttaaataagaaatatattagtatgacattatcacttttagcttataaatatttagttttagtgataaaaactcataaatttacaataatgttataaaattccaattttattttctcaatatctatgatagttaaggtttgtatttttatcctaaaaactaaca

SEQ ID NO: 3949 - DNA, 1087 bp, Glycine max
  Soy_ogl_2015 Gm06:19089401..19090487 Cluster 15
gtgattattgatgtttattaaaaaaaatactacattatattattattatgaggtcaaattaaaagtgtagtttaatcatttttataaggtttaatctaaaatgtttcacccattaattgtttttaacaaatatgttattcattaaagttagtcttacaatgatgtgatagtaacaaaaatataactcattaatatttattgtattaattttgttcaaataaataattttaaaagaaaaaaataatttaaaataaatttaatactttcaattaatacacaaaatcagatgagtccaagtgaagttctgatatttaacaatgtagaaacctactttctaaatattaatcacataatttatcttttgtacagagacaacaagttaatagtgttgttaagttatctagagcaacaccattttttttttcatctttcagttttctatcatgttactactgaatgcattatcaataaatgtcataagtatcttttcgtaaaaaaaataaaaaattattgagggctacaacctctaaactaagattgaaccgtgaaagtggaaattcattgtccatggagattgcatccatttttctaattcacatcacccaatgatccaatctacacctatggtatttttttatataaaacaccgatggtatgttaaacgtttaaagtcgctagtataattatctaaacgtttaagtagatagcttatattaaatcattgttgtacatgatattaacgtgtaaaattttcaggttatatcttttcatctttttctcttatttattttatgacattttttataaccttcattgttgtctttttatttcattttattcttttactccatagaaatgtttaaagaagttaacattcttttctaaatgcatgcaaagtttttcataagaaaaatgcatccattatttatagaatattattaataataataataatcattgctacaattgaataaagtttttcaaaaataaattttcttaaatcctatttaagatcaacaatactattacacgatatattaaatgaattagttattttatgtattagaaatgaaatattaaacttact

SEQ ID NO: 3950 - DNA, 1000 bp, Glycine max
  Soy_ogl_2345 Gm07:15372001..15373000 Cluster 15
taaatcttgtactacaacctgttcacacataaacaaatattccaatttaaattatttgaagttgttgttaatgtaagatttatttatttatttgttgtaacatgacacgtcggtaaataacatgggaatgtccaaaactcatgtacacaaaaacctatacgcgtttaaatcaaataatgtttccattattttcaatgtttgggagatcttttcttaattacaacttcacccgaaggcgaagacttaaatcttcttgtctcaacttctatcaaaatgaatttataatatagaataaattaattttttattttaaatgctatatcaacacttttaatctttctttccattctccttccatcacatcataattcttatcacaactttataacatatttttttaactctctaaatattgaaaaagtcattaagtgtctatcaaatatttttcatttagtataagatacacacttgccaatcgttcaaatcatttttttttatttgctttataattctgatattgtaatattttttttatccatgaaaatgttttagtgtgtttagtttaatgttaaggtacacacatattctcgtgggcgttttgtgaaaaataaaaagtcggagttttttatttaacaactgttaaataagttgtgaataaaaagtcggagttttttatttaacagctgttaagtaataaaaacctttcaacaataaatcaaatattaatatgcaatgaatgaattattagtattttttttaacttcaaacaagttgtgttaaccgtaaaaattataaataagttttcgaaaacaacttcactttctaaaagttgattttcactatattctattaataaataatttttttaagagtgatagatataattcattctcaattatatggtcttttttatcaaacaaataattataatcttcaacttaaaataattatctaataacttatgaagataataataataatttcgataatatatctatat

SEQ ID NO: 3951 - DNA, 1032 bp, Glycine max
  Soy_ogl_2766 Gm08:19225501..19226532 Cluster 15
ttctaacttttttatattttattcaatttttatttttaaaatatttattcaattttctcattaccatttttaatttatcattttatatttttcaactaatttagcaattcattttattcaaaacttgtgctttaataaactagtttaaaagtttacaattactaagttttgagcttttaattattaattaatttttcaattttcagtaaattttgccaaatataactttgatagcaacatatccatcaataaattatgaatttaatttgcaaaaaaaaatcaaaattcacttttgcaagaatttcgacccaaaaaagaaaaaatcagggggcattccataagtagatcagtctctgactgtttgaatagttgtcttgtttgcctttttgttgctttccagatgatggtcacttccatcgccgtctatatatttttagtacattaagaagaaaatggttgttgtttgaattgtctctttctttcttttccaaatttcacaactttaagcctttaaactacgttatccgtgacacaaaggataatgttgtatgtagttttaaaaaaataaacacgtgtgactactcaccaatgtttttctaaactagataggtaaatcaactacttattttcttctaaagaactagtgcatttttaacgtcatttgcgattgaaaaaagtaataattaatttttaaaaatttatgcaatatattaaattatacactaacatcatgataaaatatatgaaatcatttttatatgcaatatataatcatgtattttgacaataaaatataaagatgttgaattgaaattgtattttctgattctttttagcaagtggcaaataagaagttattttttgacaactagattattgattattgattatggtgactaatatgtcaggatggtgacatataataagttgaaattaagaaatcacacggtgtttggtacaaggaaaatatttccgtgatcagaaatcatgcaaagaattatgattggtaaaaataactaaatttatttaatt

SEQ ID NO: 3952 - DNA, 1000 bp, Glycine max
  Soy_ogl_3114 Gm09:35704901..35705900 Cluster 15
aaactataaaataaactgtataataatgactcgagtaatatctttaccacaacaaaaatattattgttcgacttcgttgacatgcaatgtggtagatagaaaggcatctcgcaaatataccagagcataaataacagaactaggattccaatcaaaaccaccatctctctctacaattaagttatagttttaaaactaatatattaactttaaccggccagtaactaaaatattcatgataattaaccttgtatttagaaaaaaaaagtattaattaaaccaaaaatacaatattataagactataaaaggataaaagatattcaatttaagaaaaaaaaaacaagcaaacaattttaattataggaaactttattatattttgaaatcatatttcaattttttaagcataattaatcctttaaaaaaaatttatttttaatatgagaaagataagaataagaagttaatttttatacactattaatattagtgtcaactaattagaaatcaccttagctagatattatttttgaagtagttactaaaaaagttaacaatttaacgtacacaataatgtatgattacataatgtaaaaatgtttatattgttggtatatttaaattaaattttaaaaataattcattttctacttaaaaaaaggatatcacaataaaataatatttctttaatttatttttaaaaaaatatttgaagaaatatagacatgccttaaaaaattatgaaaaatgatggttgtgtatattttgggaagtgcatctaacttgggttataagagagatataatagatgatgtaaccaaaaataaaatgaaagatagaaaaaattgtgaaaatggtggataaattattaaagtaaatataattagaaattatcttaaaacatgttaacatgtattttaactaaaaaaaagtgtatgttagtcaatttcatgatctagcttgctaaatacaatcacctagtgcattaaaaagttata

SEQ ID NO: 3953 - DNA, 1000 bp, Glycine max
  Soy_ogl_4214 Gm13:231171..23141500 Cluster 15
ctgatgctagttttacgtttcatttttacgccttgttttctgctgatgcagtaggcgcagcttttattcggatgtagtttttgcttctttttttttgttctgaagcataaaaaaaagtttcatttttataataatgtattatctatttatatctactaaataatattagaatattatatatatatatatatattgttaagagtagttaattggtttagaagaaatattagttagttactattggttgttagaaataatagttaaatctaataaatattataaatagaacatcttggagcatttttagcttcattgcttaataagttatttattttaagatattgttacttagttttttttaatcttgagaagatttaggcatgtgatgttgggttatttaaaattattcttccttatttttatgtgtaaatttatcggaattaaaaatgataaaaaaaaactaacaatgaccaaaattaaaaaaaaaaaaacacaaacttacataaattaaattaatatttaagcgacaacataaatcaaaactactcttaattaatatttagtgggagtagtatataggaaaagtaaatcaataattaattaaagagataaaagacatattaaaaagttaaataatattttatagaaaattcaacaaattaattacgcatttgattcatcaaagattatggttttaaacaagtcaaatatttcacgtttgtttcgaaaaagaggattaagagacaacataaatcaagccaatgattatgggacaacataaatctaacatagatattattttaatatatctttctctttttatcatattatttattttatcatatctatattttttcttttttcactctcttaagagtattgaatactccttttgtcccataataattaacaagtaagaaaaaaattattctaaaataataattattttaaatttttaatataatattaattatgttttcactcgccatcgcttgcagtt

SEQ ID NO: 3954 - DNA, 1000 bp, Glycine max
  Soy_ogl_4258 Gm13:24933201..24934200 Cluster 15
aaatcttcaccttttagaagaattcagatgacaagaaaaatgaataactcactttttttgtcacgcctatgcctttttcttcctccattcatgcgtctcaaatgcaacattaatgaaaggtaagaaaatattcaatgtataactacttagtattataaataataaaatagaagtacatattttagaatattgcaactaaagacgagcaatccagtttttttttgtcactttttcattttttcttcctcctttcatgcgttccagacataacattaaagaaaggtaaaaatatatttgatgtataattaatattaaaaagaataaaatataagtatgtgttttgaaatcttcactttttagaagacccaagatgataagagaaacaaataacttactttttctctctatcacttctacacttttcttcctcttttcacacatttcaaatgtaacattaaataggggcaataatacattaaatataaaattactattaaaaaaataaaaaaaattaagtatattgtttgaaatcgtcactttttagaagactacaactgaaaagagaaatgagcaattcattttttcctaatttcatacattttagacgtaacattaaagaaatgtaagaaaatattcaatgttggcgaggggaaatgatgaatcctttaaatacaattcaaaaaatactaacactttagtgaaaattcgctcgctttaagccaaaaaatgttaactttaagcgatttttgtagctaaacattttgtgcgatttttgcttaagagtctaagttttttttttggcttaaccaaattcttgactctaaatccctccaaaaaggtaatttctcttatgccaaagacttttagcttaagtaaaatttgctttgaggatccttcttcaagctttaacactccttgtacaaagttgccttttagtctaatattcatttcctacaaaaaaaattcatcaataattaatcgtaatctatcaaaatgatta

SEQ ID NO: 3955 - DNA, 1160 bp, Glycine max
  Soy_ogl_4753 Gm14:34318732..34319891 Cluster 15
tagtatattatagttgatttttataatatataaaagtagacaaaaatgaatgattgatcgattaattaaattattaaaaataataatttcgcataaaatactacataattgattgattacttctaatattattattattttcacttttaaatatataaactatatatcaatataaattctgtaaaaaaaaacaatcaatataaatctaaatttgacattttcaattgagtagacaaaaattgtataattgattgattacttatattcttattattttcacttttaaagatatgtattatccataaaaataataagacatgcatgtactctatagcactaagtctattcctatatgatcaggttgaaaaatttaaaatactcttaagggaaggaacctgctacgagattagaaatctaacaatagatttgaataattatatatacaaagccatcaatcatcaatatcggtcatattttaagtcaactacctctctaaagtcgattgttgattcatctatttcgttttatgagtttatcttcgcaacttatattgatatttttgaagcaagcacgtaattaacaattttcttttattttttaattagcaacaaaatattattaattatcattttaatatcattcttatattattctatttatttgtagacattattggactgattactgctaggggagaattagttcaatacaattgatatgaaaaaactacatatattgttgttgaattagacaatgatgtgtgagatgcacctgtagtaatgattttgcaattagaaaaaatgaaattgctcaaagataactctttataaaaatatattatctaccatctaccatattatagaaaggaagattttataaatatggaatgatctcacatggtagcaccgtattcattccccaaaaaatataataatataataataaatacaatcagtgtcatttttatttattaataatagctatttttaaatagttatcttaattataatatatttgtttcaaccgaattaataaaaataagaaaaaatactttgcaactaagttttaaactaactatgtgtttaattttattttattttcttatataagttttatgtggtatatattttagttcaacaataatatgacattattgtatc

SEQ ID NO: 3956 - DNA, 1100 bp, Glycine max
  Soy_ogl_6693 Gm20:2374401..2375500 Cluster 15
cttttatttttcaacaatcttaattaagatggacttttggttttctaatggaatccgaagcatcccacatgtttcagttttaaagattaattatgggactggtttttaatttaaagtttagttttggttctctaatagaatcctaaagtataccaaatgtttccattctttagattaattatgagattaatcttcaattttagaatttaactacacttacagttgtttgccacttcccatcattttttctattactctaattctccacgtggatttttctacggcttgttttgaagctaattattatacgtttaactacatactataatttattaatgactaatgaatgaataatcagtattttacaagttcagtcattgatctaataaatttaaaatatattgctgaacgaagaagtttaaaatatataaggtttacaaaatgtacatcgatatattactaatacaaatgaattgatgtttaattatcatgtattaatagtgtaaaatttttatactattaactaataaaaaattaattttaaaattattttaaagaaaattattataaaaacaacaaacttattatacaggagatatatatttagatgacaatgtaaataggttatcagtaaatttcaattaaaaattcaatattttttccataaccgcttgcaacatgatattatagaaattatgagtgaaggatccatgttaaaagcctcgaacctcaaaatatatattttgtataaaaaaaagtaaacctcagtatatttgcacatagtatacagttttcataaaccaaagactttgttttgaactctatctaaataaataaaaaagagtaatgttatttataaaaaaacgattcttataatcatttatatacaagaaagaagtatgaaataagataaccaatataatataaataaatatagagacaagtaaatatataaaaatattgtaaagattagttatataaataaacattactcggaaaaataaaaattttcaacctttgattccaaattcccacacacatgtaaaaatattgtaaaaattagtagcatccctttgagttggatctgatttctctgcagc

SEQ ID NO: 3957 - DNA, 1398 bp, Glycine max
  Soy_ogl_1667 Gm05:32849003..32850400 Cluster 15
gtgaaatctcattcttatgattaactaatagtatctttataaggctaaatttggaattagtgcatgtgggtgcactctggatgaggcaatcagaaccgaccctgaggtcctgtctcctagcgtgccacagttgaattcaaagtagaaagacattaatgacccgtggcaaatgcgtgaataggaatgatagggagggcattaaatggaaggaaaacttgaaggctccgaaggaatgagaattgcgtgggccagcgttcaaaattcggcgcctcagtgagctcgccacgcgccacccaatcaaaatgcatgattcatatacatgtcagttaagcataagcttagctctaagcattatgattttatggagtatgaagttcatgatcaaaataattttaagtcctcttattatatcttattacagtaattctttttaccaaattaaagaatattaaataagtagcctctatacaaatttataaattataaattattactgcttaattagttcaattataaagttattgcatgtaagaaaatgaaccaatagttcatttttaattaagagatatgtttatatttaacgtctaattatatttaacaaaatatttcttttgaaacaatatacacatttgtatcataatcattgcaaaaatcatgtttataataattcctaattaagtaataatgtagatttttttcatgtcaacatcattaaaattgaactcggtttactttatgatttattcatctcatatcatatatctatttgcatgtactaatttgtttcaaaatatttgttaaaaacaattttaaaatattttttactttaaaaatttaagaatgtactaataatttgccataataatattttgcatttattagtatcactaaatttcttaaatgaaattataattatgttttaccttttcaataagaataattataaattatgaaattaatggcttcttaaaaatatactaaattatgtaattaataactaaaacatattaataagataaacatcatagtaaaataaaaagaaaagaaaaaacattaaataagaagagagaatgttttacgaattgagttttaaaactcaacagaaaagaacatattttaagatttattgagtttataaaaaaatatataaactatgcgtcaacataattcttgcataaacaatgaaatttaaactcatagggtataagtttaattcttataagatgggcaactttcattttcatgatcattaaattcagtctcttacaactaattatatttcattttacttttttttagtattgtgtttgacagctgacatacatgctgtctcctctataccaggtcatcacccaaatagccgttacccgtgttggaccccaccatccacttcaattc

SEQ ID NO: 3958 - DNA, 1000 bp, Glycine max
  Soy_ogl_4301 Gm13:27304001..27305000 Cluster 15
atatagtttagaagtgtgcagcttcaaatatgacaaatttgggttttagtttttacaagatactttttgtttgattttagtctttatgaaattttcaagttttaaaaacaattcttattattaccatccatgatgttgtgacatgtatttacagtttgacatatcatgtcatatgccatctcaaagtgattcttaatgtgatatatatttaaatgtaagttacattgtcactaaataaaaatagacacgtttaaaacaatattataagaaccaaattaaactaaaaaaataaaattgaaggactaacacaatttggtaaaaatatttaaagcaaactcaatttgaaactataaaatttggtaaaaacatatctagccgtgtataatgtttttttttaaggtaaaaacatatctatccctgtagaatgttaacatctcaattatgcggttgtatgctgtaactttttcttttccttaattaccggcattcgaaccggtggaatataaaattatcatacaacaattgtcatacaaaccaggaatgccagtatattgcaagttgatctaggagtagcatccttgtttgtatgtatttgagtgatgacatattaaggtaaaaaatgatcgagaaaatataaagagaaaaaaaaaaggaattagtagaactaaaacactgttttgcgacatgaatgaatccatggtttaccaaaacaatagcttgatatgggatcatatccctgtttgagaaatcaaagtaaaatactgttcaaaggaaatacgaggaatcacttgatgtatgaagcgttaacacttttaagagttatgctcacgtcttaatatttcgaaaagggacaaattttactatatcgcactgttcaagtctcaaatctctgtatatttgttgacaagcaatgcatgcacgtacatattcgagtacgaatgatatgtagatgtaaatattgctgattgctcgaaactatagttaattatttttcccattt

SEQ ID NO: 3959 - DNA, 1008 bp, Glycine max
  Soy_ogl_5667 Gm17:13130693..13131700 Cluster 15
tcacacattaggaaattcatctcaaaatgagatgtaaagagatgaaaaactcagaaaaaagtttgtccttttcgtgattttttaacttagaaaaaagtcaccctttcacaaggcacctcgtggaactttatcttgtcaagtgtcttattttttcctctttgttcttgttgctcattctccttgttggtgttttttctttgttgttgttggttgttcacttgttctcctttgcttgtggttagttactatacacctttactaatgttcaaatgttttttttttttttttatggatgctttacaatcaagtccgtaattgaatatttttgaactttttgacgtacaagttatcttttaagtttagattttattttatcctcatcttgtaagttttatctcttgcagaatttctctcatgaaattctaactcaaagttttcaattgattttccttaagacatataatcaattatgtcttatgtatagtcgattatatgccttcaatttgtaaaaaaatgtaattgaaacatatgattgattatgtctaaggcataacgatcgtgtatatctttaatttatataaaatcattgaaatgggagtatttttttattgggataaaatgaaaattttgttaacggtttatttttcttttcttataataatttttttttcttacttacttaatcattttaattaaatattttatctcttttacattatttttttcttatctctgtccaaaacagtgttagttttttttttttttttttgtgaagtaactaaaagccctgtaagaagcatagtatgagctgaatcagctcttaaaggcatataatagacaaatgaatcttgaaaattttctttaaaattattcaacatcaaatttagaattgcaccgaatgcaattcagttatcaaacgtaaaggatccagttccacacctcattgattattttcgaatgtttctttactcctgaatgccttgcaggatatcgtaactttgaataaag

SEQ ID NO: 3960 - DNA, 1042 bp, Glycine max
  Soy_ogl_2081 Gm06:45272459..45273500 Cluster 15
atttttattaatcaaatcaatttaaagaatggagggaaagaaaatagtgtgagagaagaagagaaatggtggggtgtgatgatgtagagtgaaagagaaagtaataaagatgggggtataagaaaactcaaaagggtaaaatggtcatatatggacgtagtagtgcgaaattgcaaatagcaattctggtagtataataacattgttcttaattgttttagcttttcattggtgaaagaatgtattttgaatttttggatcactttgggtcttataatatcatataagatgtaagaattttatcattttttactctagtgggagaatttaatttagattcttaaattttacttagagagaaaaagaaaatagaatcttttttttctctcaaatgacattaaaacactatatatttttttgaaaaataaagttgttttggaactcaacctccaacccaaagaactgttaattaaaaaagtaatagatataataaacaagagttcttgaactaggaattttttagctctagatctactattaaaatgctggtagtatcttaaagtatatataattttagctcttacttattattggtttaagtatgtcccgtttcatttgatttcacagtttgaaattaattagaaattttgaaatatgctatgattccctttcacgggatagattatttatcttaccaaccaaaaaaagtatgaatatgtttagaaaaatttttcatgtaaaaaaaggatttttaagagaaaaaatcagaaaaataaataaatatttttttaaattaaaattaattcatgcataagttaaaaatagacaaaaatctttcaaaacaattatacgaacagtttttataaattaaattatgcataaactcattatattttattttcttattttttttacttgttatagtgaatgcataaatttttacactgagaaaaataagctctaagaaaaaagagaaaaaagtataaagaaaacaataaatgatatagaaaaatcacaaaaatgaactaaaaataacagtaat

SEQ ID NO: 3961 - DNA, 1000 bp, Glycine max
  Soy_ogl_3110 Gm09:35177401..35178400 Cluster 15
gaaaaattatgtgtaactatcgaaggttgttttggttaaactaccccctaaatatcaaacagatcacaaataattcaataacacacatgaatgaagtttagattttagatagttttgaaacttattatatatatggacattttgttttggtaaagttcatattttttggtatgtatgaaactatggataatttattaaagaacaaactatggatacgtacgtagtataaatagcttaatcaattttttatttaataaagtttgtcaaataattaaaaactgctataacttgaataaagataatatataagttacttttattaacttaatgaacttcatagaggctcctttaaaccccttaaaattataatattgatgagatttgaacatataatttgagctttgaacatataatgtgacataattcaagtggtaagtaaatttgaacttattaaggaaaatgtagccttggaataaaaaatagttccacattcaactaataatttttaactattaaacagcttttcgactatcaattactgtattttttttatccatgctcgtttgttttagtgaaaataagatgaaaccaatcagaaaagaaattagagtaaaaattttgcatttcactttcctataacgatcacaaaagtgttccaatcatattaacaaaagaaacatcaaaatttttatagataaaattttaaatagggatattactttctaaaatatgagatatattttttttgttttttgaatataggatgaattattttattaaatgcaataataatgaatacttgaaataattaaatagtaattaataaatcttgagtgttagaatctaattaaattgatagttttattggaatatattaaattgtacatgtctaaccaaccatggatcagaacttaaaaataattggtaatatatagcttaaaatataattaaatgcaacaaattgtaataaaattatatttatttgtttgaaaataacttg

SEQ ID NO: 3962 - DNA, 1000 bp, Glycine max
  Soy_ogl_5970 Gm18:6728401..6729400 Cluster 15
tgttagtctaaattgatgaaaagacaacattgataatttttaaaaatttgagcatctatttgagatttttaaaatataaaaattcaattcataattttaataagacttgagattaagtttttctttttttatccatagattggtgggctgacctttgacccatatatcttaccgaatatggatcctatgttcctttttattttttcttccatgtatagagatgattctattcaaatatgtagttaaaaatcaatgtgatctttttttttagagaatattcaaatcttagtttatcttaaaagactttatgagagcatttctaaaggggttttttaaggatttcttaattgtaaaaattatttcttataattttttccattgcggttaacaaaaagagtttcttaaaaataagtaacaagaaattattttttaacaataaaaaataatatttatttaacacataataacactaaaattaaatcataattaaatgaaaataaaaaaattataaaagtgtaaatttcttgaagtttcttagaatattttacattaaaataaaattatatataaatttctgacatgacatcatggacaaaaaaataatttcaagaaacccactttaaaaattttcattaaagatgttatcagtgcaggtgttctccggtagaggtcttcatagaatataagtatataaaccacgtgtagagtgtagacccttttataattgcatgcactcgtttctctttgccaatccttacgtgataccattttcccccttcaattattgtccaaacttctaattgaaggtctgggaggctgacccacttgcgtcctcttgattcgattcaaagggaatatagtcctaatcctagattgaaattttcaaaattttaaacaattttaaatgcataggaatttaatagttttgactgaaaaattaattttaaaaatattatttagataaagtaatatattttttttgtattttaaattttttatt

SEQ ID NO: 3963 - DNA, 1145 bp, Glycine max
  Soy_ogl_2034 Gm06:381356..38298200 Cluster 15
ggcacttttaggatcaaaatattttaccctaaaaatcaagggacgtagcacccgaattgctggaaactttgcgttgcagacgccacccgtgacattcacccattgtctccagcgctctatctacactgaaatctgaaccatacattttatatgcttgaagtatgttcgaaatttttgtaggtatattaattttgttttaaatttttacaaatttttttttgaactttaatttttttacagaatctttaaattatttgttgttacttgttttgagccccattgtgagactattgatagtaataactaataacatattttacattctcataaatatagtagttttgtttttattttttaaaatataagtattttaattttttagtccatataaaaaattaatatattttatccttttaaatcctattatcatgtcatacttttttaaattataataatttcactaaatttataatctctatactcttaaaataaattatatcgtaaatatatcataaaccctcaaatatctagatagaaaacaataataaaaatttaacatagaagaaaataattaaaaaatccagtttactcaattaaaatatattaaaagattcaaattatacataatttcaatttaaaagcctaaaactataactagtatttttaaaaaaatattgacaagatcaaatttacttaactttgaaataaaaaaactaattaatacaaaaaactaaaaaaaaattatacacatctcaaaaaaataaaaagagtttaattttcttacatgtaaatttaaagagttagtgttatattattaatcagttaaaaatcatcaactatatgaattttgaagtaattactataaaaatcaataattgtatcatacatatagataaaaaaataaaataaatttagttatttaaaaattatattaaaaaaaatttgatagatttttaaacaaggtgtacatgcatattaaattcagataaatagtttttttcttaacattaagaatagtagttaagcttatacttttgattgatgcttatgttgcatgtgatggaaacgcgccgctaaatgcgcgtgggtgaagtcgaaaacgaatgcagggtctctttcctccgcattgaccggctataacccca

SEQ ID NO: 3964 - DNA, 1000 bp, Glycine max
  Soy_ogl_3849 Gm11:16481601..16482600 Cluster 15
ttgggctaatagcaactccccctaaccattgagggatttcaaaactctaaagaatttgacatagtggactgaaataatgaaaaatcaattcgtataagaggaagcaataacaaacgaacttaaaaaatagttttaatttatagagggatagctttggcaatataatgaaattttaacctagggatatttaaagttcgagcaaaattttgcctgtaaatttaatttttttaaagaaatatgacttgaaatacttttgcaaatacaatttgtaaatttaagtttatcccaaaacttatgtttacaaattttaatccaaacacatacattatttgatgggttttgttttgattaggctaaccttgatttcctgaaagttacttttgttaaatactacgaatagagattatcttatatgatactaatgaactattgccacataacataatgacactaatagagttagcatttcgagaaactagagttctttgatttatcggaaaaaatttagagtaaaaatgtactaccttttatgaagcaatatttgaaaaaataatgagaaatattatttaaatataattaaaactaaactaaaagtattttaaataatcattaacatatcttaattaccgtaaaaaacatctcctatttttcttttttttttgttttaaaataaatattccgaccgaatatatatgaaattaagaaagtacatcgatatttaaataagaattgaaatttaaatatgtatctctttattatatttcaaaaagttataaatatgttcagattaatgtattccacactaaagaaattttagccaaaatattcttttgaatattttttattatgaagtttttcttcaatagccatgcaacctttctagttttttttttaaaataaagatacaattcaattcccacgctagtactaaaacgcgatctagataggtggcattttcaaagaaaacttctgatctgcctgtgtataatttatttataag

SEQ ID NO: 3965 - DNA, 1400 bp, Glycine max
  Soy_ogl_4242 Gm13:23867701..23869100 Cluster 15
aattgaaattgtttactactagtactactatagtagttgttttgtcaggattgcagcaactgaacccatgcctttatgctagtaatataatagttatattattatgttggttttagagctccaatcccaaggtatattaaatgttctggctttctttgtttagtttttattaacacctatatttgtctacttcctgccctctcacgtgtttagagattataaactcataatcactccttcgtgatggggattgagcttatatgtataaaaattcatgtgaacctcccgcatgcttgcatgcgcatttaaaagcatatttttgtgtgtttgtgatttttcaaacgatttttctattcattatcctagagaaaaaggttagagaaaaggttagaaattaatatctactatgttcggtctagtagtggggaattaaaatagatacataaagtcatatattcgatcttcattgtcactaatatacagttaaaataccacacagtacaaacacaaaattgttaagaaattaataaatataccatcttattaaaatacgaaagagtgactttttttcgttagttatattttaattaaactatattatattttgattaaaagaaatgttattaatttcttaaccatttttctgaagacgataaataatcggtactccaaagttcgaaactagtgtcaaattgagcctaatttattgatggtaaaacacaacaaggacagtaatccaaggcaattcaccagggattttctaaaacacttcttcagtgttctcgaatttaaattaatattttgtctaaaacacttcttcagtgttctcgaatttaaattaatattttggttgatatatagataaaaaaaaaatttaaaacatatcagttattatgtcttcaagacatatagtggaaaatcttagaaaatactgaattaatattatagaagtaaaatatttgttgccctaaactgagactaggaaaagtagagagcagttaatcaatggcaaatcttaaaattgagggagaaatgttttaatccaaaaaagttaatattgccctttagaggccttaggtaccatattaaggagttcaacccatctcaaacccctataaataccaccaacatcaaaccactattgattacacattgccaaaattgctattcaaatacattgtcaaaattactatttttacataagaaagtagcgtcattgtttatacacttctgaccttggtccccaaaaggcgtacttcaattaaagccatatcaaaatccggtctaatcaacctttctcacattagacacacacaaaaaatgtaatttttttttaatgtaattccacaaagtctcttcaatttttttaggaaaaccataattcatttttatttcctttt

SEQ ID NO: 3966 - DNA, 1037 bp, Glycine max
  Soy_ogl_3790 Gm11:7972864..7973900 Cluster 15
aacatcaaattttatcctaaatactttcacaattatatatgtaataaaacacgtacgaatttaaaaatttaatgtctttttttttaatggccaaatattacaaatgttaatcgttcatattaccaaaaagccttcataagtttataataaaaattgatatttatgttaacaataacttttttatgaaaaaaatcacattaattatgttctaaaaatttattaaattaaaatgaattgttttacttacaaactatgttttaaaaagtcatataaacaaatactagacaagaaataaaaagaatagtaataaaaaaatatttaatattttgtctcaaagttcaaattgtcaaatccttatattgtattcataagcttacccaattgataaagattattaataaatattctttaattcttgaattatttataattaaatcaatgtaaaaagaaggttaacaaattaagttgtttaattaaaaatgcaaacatttatagcctttaaaataacaaaaatagtttctaaaaagaaaaaatgatactataatattttatctaaaaagataaatatataatagaagactataaaaaggaaaataatatattagccttaaaaataaagaatgacattatctttacaataaatgtattaaaaaggaacacaacattttaaaaatagaaaaataaataaataacacttaaatatattgtttctacaactaaatcctccaaataaaataaaaacaacctagaattaaaatattttagatattaaaaaaattataataataaaaagttaatgagaaattataattctggtgatatggttgtcacattcatgctaataaactatatatatgagacatgcatgtataggcaagaaaacaaacctactaaaaggatgacacacaccagaagcgcgagactcatgttttcttttcaaacctgcaaagttacgccagttagttttcttgaaccaaaaagaagagaaacaatgtgagaagaagatcttgaaatatgttaccaagatgcattcaagt

SEQ ID NO: 3967 - DNA, 1100 bp, Glycine max
  Soy_ogl_6181 Gm18:55072301..55073400 Cluster 15
ggtgatgggagagtatttggtgactttggggcgtcaaagtcactgtgacattcttatttttagtacattatattaatctgatggttcaaattaaattttgtcatttgttttgaaagatattattaatttattttttagatttttataatttaaaataataataaatattactaagtggataaataactagcacaaaattattttattttaatgtattctttagtgttgttcagattgtcaaaaatttcatatagttattaaactgttagaaatttttttagcaagaaaaaaatctacaatttaagaattatcataaaatatttgatgatttttttatacacttctttgttatctttcttcgaaagtaatccaactttaactgaattacgactgttataggcaggctctaaaatgatttttagagaacattggttaaactataataattctgtaccagttaatttatacattcaaaagtattttttatgattttaaagtataaaaaacataaaagctaagttaattattaaattaaaaaatattttttaaacaaatgataaaatctaatctgttcaaattaaatttaatctaatggtctaaaatgagggagaccttcacaaagtcactgaatccgaatgaatattatttaagactgatatttttccaacaacaaagcataaaattaaataaagcatagaagtataatattgaatattaaagcataaacagatatgaaaatatgaaaatgagttcatagaattcaatttccttacattcaaccctaataatagggagcttagcttttcctagacatgtgtaacataaaaaaggtgaagaaatgaagaaggtgtcataagagagctccatttatatttcttttgtttcaaactttctctgatgacaacttattaattttgcactaatagaaatcacgcgcaaagcacagaagcatgaattaataagggttatcccacgcttatcgcaaaaatgatgacgcttagtcgaacataaatacacaaaactttgcccagtgaaattctctatgctaagcgtgaaaagcaaaatcacttcttttagggtgtgtttgatttttaccttta

SEQ ID NO: 3968 - DNA, 1136 bp, Glycine max
  Soy_ogl_898 Gm03:36350901..36352036 Cluster 15
aaaagtttccgagactgtgcttcgctctagttaatggattaacctctgttaccttcatgcattcagattgttttcaattttcaagatgaatcaatctaagattaaattcattatgttctttgttaattcattgacttcccgaaagattaaacttatttatgtgatttaaaacctaagttattttcctatgagtataacttttaggttcacattttaattcatccctaaaacgcctatggttatgcaaaaaggtgaccaaacaattcatgtaattaagcttattaagaaaagaataaaaaagaggaaaacaaactttacatataaaaataaacataacaaattgattaaaaacatgagttacgcctaatcgatcatagtcatggagaaaataaaataaggaagaaagaacatcaaaactcaggtagaagaagaaaaagagaagagggagaatcatcttcaatcctccacatagagtccctgtcccccgtgggattcaatacctttttctaatcctaaaaggtttatttatagttaagacacaatcaaggttcaagcccaactaaaataaaattagaagaatacaactttaaattcattgcacatgtgtcgcgactacggaattttaccaagtctagcaacggtgaattctcattgttattttttatttcttgtagtctgtcacgcttgtgtcgattgctacaagtaccctgtcacactcattgattgcaaaattcgccacttttattaatttttcgtcaaatgtagttgtttgtggtcctttctctgcttgatccaagtcttaacaaagttccaattgccttgtctttggatccaaatcactccaaatctacatctctaagattcaaggccaaatcaattaatgacaaacttcctaaaatccattgacaaacaaaaactcacctaaagagttccaagtgactaacaaaggaaattaatgataaaactaatcctattaaacataaaatttatgcgagtaaatctacatgaattaatatgaaaaataaggaacaaattgcaacacatcaacaatgaatatgtaacaaaatataaactaaaaaatatagcaattttattacaataattttttatcacaataaattaaaaattaatgagaa

SEQ ID NO: 3969 - DNA, 1133 bp, Glycine max
  Soy_ogl_2590 Gm08:10230201..10231333 Cluster 15
ttattgttttatttaacaaagtcaaagattttcattaaaaataataagataattttaaactatgagatgtggttaaaacttgtctaatgcctacaattattacatgtgacatgtcaccaaaactttttaagtcccgaaaatagtctttatttttgttactcatccttatacataacaattattgatgctatcaaaactttgttgataagcttcggacagttaaaaaaaaaaattgaacagtggaaatataatattatctaaaacgttttaataacaaaaaacaaaacaaacacgtcttgtcacgattaaaatgaaaaaaaaattatgaaaacaaaaatgaaaagggctaaattggagagatggaaaatgtcgatctattccaaacattaaaaggatttaaagcatcaaacccctaaaatactttcatttcattaaaataattataatattatatatcataataagaataatatttttattaaaagtaatgttgttgctaatcaagtctaatctatcaaacttaatagacagtttatgatatgacctatttaactaaaaagctcgagacaaaaaaaaaatataaagggatatatcaatagtgaaggagggtatagttatcaatacccattaaacaaaaccttttttatggaccattaaaatctgtattgagcccatcatgacttacatatacctattagaccaaaaaataaataaaagttgcagcatgatgacattttcgtcaatcatcaccggatactaactaaatctctattatatcaaatgggtcaaaacctgtagaaaaggggagaaataaaattaaatcagattaaagtgaaattagtcattttgacttaccattttttatgtaaatgataagtaaaaaaaaaaaaacaataggaactagaataaacaatacagtaataataaacgtgagaatagttacttccctaatctttatttgttatttatagtatcatgataggaaattcatgcattaatttatatttcaaattccaatcaagtttaatttcacacactaaggataaattatgttatccattatttcaatgtataagagacatttgattgataaacttatgtaaaataatttgaacatggataataaagttgta

SEQ ID NO: 3970 - DNA, 1100 bp, Glycine max
  Soy_ogl_6344 Gm19:2470601..2471700 Cluster 15
tctcatatccctctcacaattctagcctctatccgctttttgtcttttttattttatttttaaaaaatgaaatgaaatgaaaactatatatcaaagcttctaatttacttttaaaactttttattgttaatttttaactttagagtagtttccaagtaacttcaatttttaagtatgcattcttaaatttcttaaattagtacactagcaacataatgctacatgacaaataatggggaattactaaaaaaaatctgtcaactttaaccacaccttaaccaaaccaatcctcactataagatccattttagtgaaagcgtttcataaacccaacttttttgaacatcaagagctccattaatatattacattaaaattaaattgcatagaaaaaaaaatataactatcatattagaaagttaaatcaatgtttcatatttgatcattttacaagttaatgacgagaaagcaaagtcaagcgcatgttaaatagtttcgaaactggattttaaatcaaaagttcacataaaattgaaatcaatttaaaaaagtattttctaatttttatttcaaaccagtgtttaatagtctggattaattttttttgagtttatgtgcacgctggtgcgcatattcatatatttagactgcataatcttattaatgaaattacaaacaaagaatatactaacagaatttatatctttatctaaaaaatactagtatctaataactgtaatactaaataattttttaaggatataaaagtttttcacactgttctgtgtgcttacccttttcatatttgagagccaattgtggtagaataatggctggaatcgtagaaatggccctcagcctaaataatcaaaagtggtatgcaagctcacttgggtttggttttttttctttcccttttttttgttgaccttttccttggtgtttttggtcaagtgtatggtaaattgcttcttgcacctcatgttttgcttcctgcacccatagaaaacactaatgtacaaaattatcttgtgtttctttttattattattttcttttctgaatctagttatcattccagattcaaaaatccagaatag

SEQ ID NO: 3971 - DNA, 1168 bp, Glycine max
  Soy_ogl_2023 Gm06:20671433..20672600 Cluster 15
caggtatacatctatattaaatagttagaagaaacaaaatgaagaaaattttgctatagtactagtggttttaccaagttcaaatacaattacgtgaaagatatataggatctaaaaaacttatatgaatgtgtatatatctttgctcacaagttttaaactactccttgtcgacccggcccttatgtaatttttgttttaaagtttaaaaagttatacatttataataaaattactaacttatatattgaggtgtgtttaaaagaattccaaagagaatgttttatttttctctattcgcacattctgaaagcatcgttattttcaaagtcaacacaagggtgtatgtaaatcatgtactataggattaaaagtaaataaactttgacatataataattgcattattagtaatgtacaagattaaatttttataatcaaattattgattcttataattgtgttaattttaagttttaagtaatctctatataaaagtttataattttgtctatattgctaaaatcataaaacatttttagactgcataaaaatcataacaattttttctgactttaataaacttttgaaaaacaaaatagtagtagtaactaaaatttacaattttctcatatatggactaaaatttaaaataggaataactattggaattaaataaatagtttaatcaatttttaatttaaatactatagtcaacatatattattttttaaaagtaaattcaaggtacaaccatatatatgtcacggtagccttcccataaattagtcattgcttcaacctttttaattatctttaatcataataatagaagatactattaatataatataatatttaacaaattttttaatatatatatagataatttttaaataaatatcataaaatataaaataaattcaagttattactaagaggtataattcatttggtagaacataatatttgagaatatttgagtgttttaaatttctaattttcaattcctacgaataaaattttttatttataacattctttttgaaattaatgttaagaaaatgcagtaatatttatatttcatatccatatatatatgtctttaccgggcttgcattgcactttgtgatctacagtgggaggcaatgctcctttgacagggtttt

SEQ ID NO: 3972 - DNA, 1100 bp, Glycine max
  Soy_ogl_3079 Gm09:29366701..29367800 Cluster 15
ttgaaatagaggtcgtagaatatgtagggatttctttcttttttgaataagtattattaaaataaaaatttatttaatttatttaatatgattattttaatattaaggataaaatatttatttactaataaaaggtaagaaaaataacaaaaggatttatttgaagataagtggataaaatttagagtagacaaaagttgtatttaatataggaaataacaaaaggatttattttctagttttttctattttactaataaaacagcaaactgatttaacttagtcggcatgtatttaatataggaaataacaaatttagagtaattactggtaatactaattattcaacaaacttttctttccgtattttagacgacaaagtttaattggatcaaaacaatttaactattaatttggttttaatgaaaactaaacgttaatgatgttgatcatgattaagtctattaaacgtctaattgggttcattttttattctaacaattccttctaggagcagccacattgattgtttgggtcatgtcgtaataattatgaaaattcacatgggttaactaaattcgactactttattgggcatacattgtactagtaattaattaactaccaatgtagtccaaattcttgaagaaaggggagagaaagcagccactcgcgcgtgagagatttaaatattacttccattaaaatctggtgtaaacggtccacagattttgagtaaatgaaaaaaaaaatattctctttaaaatgattaattatcagaactttttcaataatattattttaagacctaaattaaaaaaaattgaaaaaaaaacatgaaataatttttaactaatattttaaaacactcattaacaaaaataatttatttaaaatttctggcagttaaaaaaaatacttctatttaattacatagattgtcgtgtataatttaattggtagtttttataataattacattaattatcatatttaacataatttataattatttaatagtttaaaatatatttgcattaatagtgtatgaaaatttaacttaaataataaacacaactttattatgaaataaaccactg

SEQ ID NO: 3973 - DNA, 1261 bp, Glycine max
  Soy_ogl_3433 Gm10:37348508..37349768 Cluster 15
gaatccctaaaatttatatattatttgttattagtccctattaagtattttttaatgggactaatgcaatatgcaggaatagatttggatagacttacttaatgttgactgcagagacttagaccctcaagacctttttaagtagagtaaggttcacttgggaatgtcctattaaagatttttttaatgaaactaatacaaaataaataaaatattttaacaactaaaaagaatatatatatattagaatgactaaaacaaaataacaatgccaaaaaatatttttttttgtttcattaattactccatgcaatagatattttacttattagagactcaaaataaaattgactaatttatcatggatggaaacatatttaagtttttttaattatctttatgattaatattctcatacctcttttaattgcatgctaggatatttaattagagatattttaatctaataataataattaatgtaaaaacattatttattgattcttataaaaaaagattgaattactttttttgtcatttaattcatctgttagctgagtttttatctctttttttagtgtgctactttttatcttaaaaattattttatatattaactcaactcaaaatttacaggggtattccacatcttatatgatcataaaaaaatatcacctcaaagttcaacatataaacatttattcttcgttaaaaaaaacaaaaaaaaaaccagtgtacacaggcagaaaattactattttaccttttttaaaatatcaaatttactctattttaacaagaatttacggagaacatctccacatgtcaattatcatatgtaattttctcaaagccaataaattatttcaaatatttttctataaatgaatatcacaaccgcccaaaaatagagttttcacaaggaaaattgtcaataaatttaaaacaattttctaaatttgccaaaaatatttaaagtggtttgatactgtagcatattgattacgcataaaacataattttataatggaccattgtttgaaagattatcttataatggaccattattttttgtttaggagtaatgggccattattttattgagccattatttgcaatatcatacatgtggcaattccttcctgtaatatgatcctctcccaggcgacaagttaacagattcgattgattggagataagagggagccattactagagtaaaacaaaaagaaaatgcggtatgccttatcattatttttctg

SEQ ID NO: 3974 - DNA, 1072 bp, Glycine max
  Soy_ogl_24 Gm15:70901..71972 Cluster 15
aatgatattgcaagaggtataaacaaaagaaattcatatttcactaaaaaaattaatcatttaaaaaatgtatgttttttctttcgtatacatgcattgtttctaaaatgttatggataatacttgtaattattgttattgttaaaaatagtttttaaaaatagaaacttcttaaattatagttttaatatataagaaacaaatgagaacatttttaaaaaatatagaattatatgagcactttcaaatttattaattattacttttttttatactcttatttattgtaaaatgtattaatgatcgagataagttatagtcattgttaaaaaaatgttatctcttgaaagatgagtactgttattaaatataaccatcacttaaattatttaattctatggatatcttttgaataagatttaaatttatgataatattaattaaaattaatcagcttaacttttttatttaggaattgaggtagtatttaatattaactatgttaaaagataaattaaatgatttgatcatcttatacgttcatagtaaaatgttaagaatacttaattataaaatttgatttaacagttttgtagttgaaagaaaaataatatgagatttgaaaaatcgtactaaattaatttttaaatataaatttcgcgtaagactttaaaacgtctaaacacagctctggttacttgaaatgttaataaagagaataaattgctttttttttttttatagttctttaccctaaagttatgaatttgatgaataatattcctgacaattatttgacttttaattgaacccaaaagagtcataaaatttatataactgacgacctcatcctataatggataatatttttgttgtttttttttttatttatttattcaaatgaacaacgtaatgctgggcaagcctataaaaataactgttaggaggtggtctagagagggagcatagtatagtatataaaaccgccaaactatgatatgcctcagaaccatagagaaacattttgggggaaaaaataagaataataaaaaagaaacttgatttaattata

SEQ ID NO: 3975 - DNA, 1000 bp, Glycine max
  Soy_ogl_908 Gm03:330001..36575000 Cluster 15
gaaaagaaaagaaaaaattggtgacctaatctaaactcgttagttaacttagtgtaaaatggtggatccacatacgggagcatttgtccggacaagatattttattttgcttgaatatatttcataattttttttgccccttaaaaaatattgatatttgcatccatgaaatcgtaaaagaaagaataaattggtattaatgttatcactttatctttttaatttttatacataaagtgaaattataagcatgagcgttttaaatttttttgtcataacaatttttatacataaagtgaaattataagcatgagcgttttaaattttttttgtcatgacataatgcattttataaaagcttgaaatattttttctatgacaatattataaatttcttttttaccctcattaaagatatgattcatggatttgccaccagcttagtgtatcgactatgtcaattgtcaaaataatccaatactgataatatcttttaaaatagtctcattttagtatttataaattttttaaaggtatccgacattaattgattttaatcaattgtgtatttaaattatgaattccaacaattttattttggtctttggccccgttgggcctatgagatagataggagacctagttgaaaagcatttaagagtgaaagtataatatgtccaatgcctaggtaaaatgttaagttatataccacccttgaccgtatcaaactgaattccaatttttcggggatgatttctcatttatagtctaaaccattattagatcctcggatgcacatcttgcatgggtggttgctctggagttgggcaacacggcctagatataaggtgtttagagctcgattagtaacgaaaacaataaccaaaggataggtcagattttgacaactgaggtacaaaatcccttaatcttaagtgtgtagttgaaagagactttgcttcaagagtcatcggattttgagataatcaatcttatttta

SEQ ID NO: 3976 - DNA, 1000 bp, Glycine max
  Soy_ogl_2231 Gm07:6252901..6253900 Cluster 15
gtctaacccctgttaccgtgaagagaaaatctgcgtagctattggaggtaacttggtaacattctataaacaggatagaatttagaacaagacatataatatatatgtttggtgtattcaccatgaatattcagaacaagacacatattctgacgttgtagattgtgtgtttgtattttagtttacatgtttgtaaatagcaattacttaagttaacttagtccctaaaatctatatacttactaaataactctttaatattacagaaaaaatttagtcttttcgtttattaaaatatcctatagtttcttaaatgctcttttttaaaggtcaaagtattctcaatattttggtgttagttaattaatgagaattggagccgctcaaagcattaataataatgaaaagaaaggtatggaagaaataataaaattaagagaaaaggctaacttgggaaacgtggtttttgacgtttagttgtgggaaaatctctgattctctgagcagcaagagcagaagatacaatgattgatgggtttagttgactacagatggcgacattcttttcttaagaaagctggcacgcagtcatattctaagagtatggaaaatgcatggaatcaagacgaagaaatcatttttattttctagaattaattatcacagctcaacttattttgacaactagataattaaaaatgggtatagtgagtatttaattttttttatgaattttaattatatgaaaataaatatatatttcctgtgcaatgttgaagttaaaatactagttataaatagatattaagttgtatgtcattaattaaaaaaataaaataaaatttaatgaatatctcaatcttaataacatttttattttatgtataaaacatgcaaatcatctaaacacaaaattaacgtactattcttgcttcattatgaataaataaacggataaaaaataagagaaaattgtattttgatcgtatatatatttttg

SEQ ID NO: 3977 - DNA, 1198 bp, Glycine max
  Soy_ogl_5370 Gm16:29614803..29616000 Cluster 15
caaaattgactcctacatggcatagactataatactagttttagtgtaaccattatcaatataatttgaatatacaataagatgtagttttagagcacacatgtaggattcgtttcaataccaggacgatgcaaatctaaatgtaaaggtttaaaaagtattttattttaaaaatgaatctctttaatgtctgcttaaatcaacgacaactaattcgatgtcaaacttgaaccaggttgagccggtcgaatttattttgagctgcaaatttgttggtccattttgaatctatgttgagctagtgagccaaatcgatcctaactaaaaataaattaaattaaatgtgttaaaatataaaatcatacatatatgacttaaatgttatatccactcccttttttttaaatatgctctcctttcctattttaatttcgttatgacttaaatgactttttttaaaaccttattctttctctcacgttgtcgcacattcttcctctttttcattagattgtttatctctaacattaggttttttcatccttcaagctctcaaacacaatatgtttatgctctttttttgtgatttatgcataattaaaagacataaagctatgaaggaaagaattaaaaattaaatttgatgcaatgactttttgaaatgtcatttgttttcaatttcaaaaagtactctctagaatactattttatatttttatttcagaaagtatgttccaaaacacaaaatctaaaaaaaaaaaaatccggaaagtagtttcctatattattgttgtattctagaaagtaagttctagaaggctgttctagattttgcactctaaaaattaatttctaaaagtaaaaaattaaagcaacattttgaaaattactttttgaaataatgattaaacaacggatattttggctatagagagtaataatgacagtaaaaaattgaaattaaaataaaaggggagtgtactttagggaaaaaaggaaagggaatatagcatttgccaaataatttaacaggtaaaaaaacaagtccaatttttgtcaggcttacattttactagtccatccagatcgctatgggtagtctaattggttttttcaggcctaactcgaccttaattatggatgtttggatcaacccattcaattaggctcaatttgtcctctaacagctgctttgatt

SEQ ID NO: 3978 - DNA, 1828 bp, Glycine max
  Soy_ogl_6401 Gm19:36554401..36556228 Cluster 15
ataagcataaaccaaaaacattcgtgttagaaatcatgctccagtgttcaaaagcactaaacctaaagcaacaagctcgagaaaagacctacaagtattcagaagcacaaacttgaagaagacataagtcctcatctaatcaaagaaaccacaaagcacttcaacaatcttcataagacaaatataaaaagatatgtcatacggcaaccactaagacacaacaactatcaccaacgacttcaattcaaatttaaattatgcaagctgtcaatggtagaaaaaagaagaagaacgttttcgaattatgcaactgtcaacaatacaaaaaaaaaaaaaacatgaaatctaaattagatgtaactctgttaaggtggaccaatataacttttttgtgttgtatccttctatattgcttctcatttgcttattcttgccccatacatattataagttttggaaaatcttattctataaaagtataacttcaatattttatcaaaatatttttacaaagtcgttttaactttcaaaagtggcattcactttacactgaccaaatctggtataacaatatgttattttctgaagcagaatttcatatgtctaaacttgaagtctcttcattagattatttgttttatccaagtatcttagaaggaaagtcttgttcctaaccaaacttcttatcaccaagcaatagcttgagaaaaataatcaaaaataagttatttttgcttgtgcaaagaaggccatgtgagttcgtttgtcattattcatctcctttctagtgactagatgatcacttaagaaagcacctcatccaaatttaaaagataaatgataaaaaaataagataaagaaccaaaaatataatttaatcctttttatataaacaattgaactataggaagctgatttttgtttttgtttattttcaaatatttcagttagttcattttctcttatctcctacatttttttttatcttttttcttttctaacaatttctcttgacatgcaaataaattatcagagttttaaaattgttgtgaggttatgttttgcataaattccttctcaattcccgtccattacattttataattctacaccttgcttcatcaagagatgtgaatagtgtgaaacgttaaggaagtcttgcaggattttgagatcaatgcaataagtcctccagaaatgtgatcttatctttgttgcgttttgatttattttttttgtgtgtgtgaatgagtgtgatgttatcttcaacaagcattattgagtgtttaaattatgcgattcctaccgtttgatttaagtcaggtttagagctactctcagtagctttcaccttttttttttcttcattttgatgtgaaaaaacaactcatacttatgttataacaacgttgaaccaaatactctgtttaactgttgttctaacttaatataatcattatatatttttatgtacttccttactttaaattttaggataatttcatcaggctcacttacttgctctcctaaggtcctagccatagtaggtgagaagcaatacgacttaatcaactctaacattattactcggatttgtcacagatacgtgattagagtttaatttcatttttttttttttaactggcgactggtgagttatgagggacacaaaagtgctctcaccgttatcccaaaaattttagatgcataagtatgattcatgaaaattatcaaacaaaaatttactctttcgagacattactagcaattttttttcttaaccattgacaacttatcaaacattattaattattgattttgacaatag

SEQ ID NO: 3979 - DNA, 1356 bp, Glycine max
  Soy_ogl_3412 Gm10:8666545..8667900 Cluster 15
cccaaataacatatttgatttggaatattaattctaacaattatgctattaagtttagtgaatttttctttgtattagaagagtataatattactaaccagatatatattttagaccaaacaaaatccactattaattatgtgtttatatttggtggtcatgcaattacttatagattaactaatcaaagaataattattaaatcaacaattaagtcgaagtttataactctaaaacatggttgataaagaggcctagtgattcttaggaaacattccttcaggaatgaaatcaaagtgaatctcactaatgtttatgcatggtaattacaaagcaacaatagttattgtaaagaaaaaaattcaatggtaatgataagaatagacacatacaattgaaatataacgtgaaatttttttttcaaaaatggaaaaatatatattaattatgtgaaatgaaaaagaaatttggtgaatcctctaacaaaactcttagtttcgttttcatgatagaattcgaaatgattttatttaatcttaaagaacttaaacaccatgcaaatatataaatacttaaacaacattgtgaagttatacattttaaattatttttattcacaatcaattttactcgtggttcaacaaattgtattcctaacttatggatctagtctttatagttgcacaattttttttctttttagtttatatactttaaatgacctattttaatccctacatttttttttatctctttagtctttatacatacataactatttttaaccccctttagtctttaccctctaaactagcaggtaataaaatggattaaatataatacatataagaactaaagagatgattttgagtataaagattaaaagaataatgtttgaataactataaaaattaaataaataagtaaacgtataatattacatataattcaatatgtatagtccttgtcagtctattttatgagttttccagtttagtgttcaataattctacaattgttcgatcacttgtcactttacttgtctctcatttcatatggcaactatgaactccacttgtccgtttgacggtgcattcaacatatggtgtggtgaggtagaaaagcaattatattacttggtttataggaagtctgcattgttccttctttaacgtgagttgaaatattttcataactgatatcaagtcacgtttactaaagatattgccaaaaagagagtttatagataagagattctaagattaagttaagtttaaatttatactttaaataatattagagtgcattttaatgattgttaagtatattatgtcatttattattgaattttatcag

SEQ ID NO: 3980 - DNA, 1093 bp, Glycine max
  Soy_ogl_449 Gm02:9067308..9068400 Cluster 15
caggtatacatttatcatgttttttttttttatttaaaggagaacataaacatttattaagattcacctaatggttggagataataagaaaaactaaatgcataaaaacttaggtcggatctttaataaaagagagggggaatgagatgtttatttgatttggttaaaagaaagggaaatgaccaatttggttaaaagaaagggaaatgaccaatgggagatcctggtcatcttattttgttaatagaaaatagatatatgaatataatataattttatacttttatacaaaatggaggagaggaaaagtatataagataaaaaaaaaaaaaaaaacattctcataacaatttagttttcaaaattgaaaaattataaagaatatttttcctccaaatgcctcaaaagacaaaaataagagtgggggagttttaattggctctccaatgcaaaacgtaggaagacacatttgtagctgtctcggatactttgacgtgtggtccttttgtttgtagttatacataatttttttttggaagtttgttgtgaccatattagatcattataattggctctccatttagaactaactcaaatctgaaatttttaaataagttaaaataatcttatattagttaattattcatgtttagtggtgtagtaatacatactgctaagggatccagtaatgtaggaataaatgttagaattttttcggttaatttttctctctccctctctttgtagcttgattcagtttttgttttgtaattaggttggatatcccttgtactcttttaatatatttttctatttggctgataaagaaaacatatatttttcccctctcatttaaatttaatttcaaaccaaatggtatttttcttatttaagaaaaaaaatcctttcttcgctttcatttttctcctccaaatatacacactcttaaataaactaacagaaagaattttatgaagactaatttattttaatctattaataagttaacaatatataatttctaaataataaataaataaataagtaaccaattcattatatatctacatgatttaaaaagaaggacttttcc

SEQ ID NO: 3981 - DNA, 1100 bp, Glycine max
  Soy_ogl_2346 Gm07:15606401..15607500 Cluster 15
aacttatttatccaacaattaaatgaaattttcagttcataaaacaaaaagttaaatactaacttaattgcgttaccgattataaccttgagcaatttattttgaggttcttatttcctattaattggcttcaatggtaattgaagcaacccggaaatgattcgcactgttatatttacacttatttttgtttcaattaaaattttagttacaaccggtaaatgattcgcacttttatatttagactaattttgtttcaattaaaattttagttacaaccggtaaatgattcgcacttttatatttacacttatttttgtttcaattaaaattttagttatactataagtaggaatattttttaatagtaagcaattgttgcttatagaagaaacaaaatttaattttaaaggatctaatatgacacgtaaatttctttgcaaaattaagaaaattaaataataatatcttaaaataaataattcataaaaaaattataatcctattacttgtcggactaaaaaaagagtttaatgtctatatattaatagtaaaataagtttacattattatcctatcaacgttaaaaatgatgatgatgactttttaaaactttagcctagtcttacattaaaatgtttattttaaattgtaataaatttggacttactattaattgaactagctaattcctttcgcatattatctgctttatcatggacttggatagtaatttctgctaaatttttttgaccaaatcaatgaatattacccatatcacataaagctaccaaaaagaaaaaggggtcaaacacaaagcttttgcatatattcatcttccatcatttcttttttcggttacactgacaacgagaattcataatagcctcatataaattactcaagcatatttatcactaactcaatggtgtaacaacacaattatcttggattatcactagtgttccaagaaacccttcaaaccttgtgttaaagattcgtacatgaccatacttcctttaaataagattgaatttgactcttattattgaaaaaattgattgagaagattattttttttaaaaaaagtgatccattaa

SEQ ID NO: 3982 - DNA, 1515 bp, Glycine max
  Soy_ogl_3845 Gm11:13797686..13799200 Cluster 15
acattgtcatctattaaataatatttgctaacacatgtgtagcattaccgtatcctgtatagttatggatgccttttcttaaagtaaataagttcaatcctgaagcaaatattagtccactattattcaacgttcgaacaagtctaaaacaaagagacaattctcaggcaccaacccataaaacttagcatgggtctagaacatagtaaattttacgtatacgcacgaagggaatgtttcaaattagaaaattttataatatgaaaatgagaattaagagtaataatccttagattatagttaaagaaaattaacgattaagattaaaactcggttaagtaaaatcatgacttttatatttatctattcttccttagcacttccggatagtcatttattgtttcatcatgattaagtatataaaaatcgaaatagaaattgctcacggttttatcattaatctgccacacaggttaatagaatatgtattttatatgctttaattatttaatttgtggtagaaatccagatgacatctttgttttggcacccacgtcacaatttcatcttgttgttaattttcgttttcagtgggtttgattgcaatcttgcgtttattttgtatatataaatctcttttctagtcattgtataaatctcatcatgtattgtgatttacacgaacaaaacactccctgctacgacgtgaacaaaagaggaggaaggggagattggaaacgactttgcgcaagttgttgaatatgaaagtcatgtgatttcacttgatcggattttaatcataatcgttaattttttttaatttctaattataatataaggattgttattcttagttcttattttctcatttaaaacatctacacatgaaaacatttataaattttacttgctctgtttctgttaatgacttttatattttattttttaatttaatattcaatcaatgacatttggacatgtacatttataactgcatttgtaatcatgtttttcgtactataattataatgattactgttttctactgcataatctaaaaggcccacttttgtttgattggatttattttttccaaaattacctatttggctatcagctgtccattaaagttggtcatttctgttttgataattatagaaacttgataaacgtttgtggtgtaatccaatggtataattaggagacaagaaggaaagacaaaataataatatgataagtaatctaataaaaaaaattgaaaaataataggatacaaatggtatgcaagaaaaaatagataaacaattctaatttttcttatatttactcatatcttaaattacctttttataacatagctcttgtttttactttaattttttgtattccatcacttatcttattttttttataattaaacttggaggtgtagaaaacttcatggttagttacttgtttaaatataaagaaaaaagtcataaaatgttagagtaaaatttttctattaaaaattta

SEQ ID NO: 3983 - DNA, 1084 bp, Glycine max
  Soy_ogl_6042 Gm18:15302701..15303784 Cluster 15
cgtcaaaaagacaaatcaaggtatagcagctttgccgaaaaaacatattcaatttcatccccctatagctgtgtttcgtgaagaattagactgccattgcttgattggtgtgtagctattttataatattagttttattagctctattgttatatgattaattttttggttggttagtatttttttaaactcaattcttatatgattatttttgtcactttcaaattaatataatggagtccttaccggtgtagcaaatgagcttgaatatacaaaagatgagattaaatcctagattccaatcagacataccaaccttacgcacaaatgaaaaaaaaaaaaaaatcaatttgacatacaacttataattggttttattttctttactccacagttagtgtttcaaggtcactctgtttggagctttagtgtatgagttaaactcattagttgcataaggcgaatcaacaaatattgtagttgtgcttttctccaaagtcaagacttggaaaggcaaatatgattattataaaaatagcatgctacattttatttaaccaattcatgttgtccctaatgttttatttatatttgtatttgcaacaaaaacattaacaccttcagttcacaattgatgttgagcccagaaattcctaatgtcactaaattgacatgaaagatagtgggtgcaatggaaactcctatgaagggattaagccaattgctatatgaacctgaaatgagtctggacattgaatttctacaatttacgaaaaggactactcttcaagcaatgaatgaagtgtaccgaaaaaattatatgaaggatgctaaacaagtgtttgactttgatataaaagtaagaaaattgtcataaaatttcaaatttattaatagttcctaattgatataatttttctgtttttaggatttgacttttgtcatacaggctactataagttgttttgttgatgaagataattggtattacaaagcatgtcattgtcacaagaaggtgtccccagactctagaatatacttgtgtggtaaatgtaacagactcgtcaatgatgttacaaaaagg

SEQ ID NO: 3984 - DNA, 1000 bp, Glycine max
  Soy_ogl_2631 Gm08:12410901..12411900 Cluster 15
actgcgcccttaattaagtcaatcctttagataaaagtttatgcgtttgcctttccttgtagagaaactttcaataggctagggcaagagtgtccccacttttgagcttctcatagaagaatggagacgattttcttaattaattaccttgagaaaaaaaagatttccctctagatgccgtaacgaccagagatgaccaagaaaataataatataataaaatcactcctaattaaaatttatttaaaagctaacaaattaaaaaattaaatatgtaacaaccatttttatttagtgataacttgttagcagaacaaattttgcagtgagcaattctaacataaacaggaacaactatattctcaaaaaaaaaaaaaagaacaactatataatacaaaattcaacataatattaaaattaattgtaagcatgtgattacacaaaaaattgcccgcttgaagaaagggcctaattttgaaaaaaataatattaaaaaatagttgttaacatttcacacacacagcacattacagtgtattaacacacacgcatacctacttatgatgttgtaaaaaaaataattaatagaaaaatatattagaacaagtgcgtgttagaaatgtgcaatgtataagcaaaaagatacaactcaacaattaatcaatcaaaaaccatatgtaataaaagttaactgtgggcttgattgccttgtaaatgatcgagcacccgtgttctaaattacagttgcgattgcagttatgttaagattttttatactgaaaaaactatatgaatcgatgtaagtgatgagagggtgatgcggttataaagtgaaaattattaagtagtctaaaaaaaatatatcatagtctcaattaatttttatgcatataacacataattattactatttatttcttgtaatatattgaaaacttaaatacatattacataagagattattagttaggattaaggatatctgatgattcaaaattatc

SEQ ID NO: 3985 - DNA, 1000 bp, Glycine max
  Soy_ogl_6601 Gm19:46925301..46926300 Cluster 15
ttatttaaaaagttccttttaaactacaaataccatttcattgttatccattagttcaggatgtgtgtgtgtgtgagagagagagagattagagtatatatagttttgaagcattcttcgagttcaatattagttcgagacttccgcctaaacccattcattattttccaattgaaaagctccaccaatatgctgttatttcccaattccagaggatcgtgtggtccaaaaccaaggataccattgttgtcattataatcacataccgaatatgacaaccctcagttgacaactattccctttttattggttttcccccttccatgttatatttcagagctaaatcagctgaaagcgtaaaattattccattaaaatatatcccaagagaccaatcaaatttaattatgaatgtcgacgtaacatttttttacataaaaattagtacctatatgcatagttggagattaatttttctaagttataaaaattatcaaagtgagtaatattatttctctaaatagagtcttttacagtatatacaaatgactaggagtcaaatatctaacaacacatttaaagaacttaattattttggttggtgtaaacgtcacactattaattatctaataaaatttgtcatataattgaaatgtattttcatatttaaattgatatctactatataaaattgatggatcagaatttattgagatttcttttctatcaaattatgtgtgtttgaatacctccaaaatacataaagaatgcaaacaaatcacataaaatatttgaattttctgaagcatctatgaatagcttaaaagatagagtgattttaaaatcgaatttgattcactgcatgttattccaaaaacatatcatgagtaagtctttttttatgataaatgttaattattaatatttattagcatataaattaaatttgtaattttattttcttaatcttatatctcttagaaagttcatatatgagggta

SEQ ID NO: 3986 - DNA, 1185 bp, Glycine max
  Soy_ogl_581 Gm02:37827601..37828785 Cluster 15
tttgtagccacaaagttaagctaaattcagatattttcaaaagtggaaagactaaattcatcaattaaagaagagaatacagtaatattcaaaattaaaacataaataatcctatttatgaaaattcattcttatttactattaaaaataatatattaaaatccaaccatcaaataaatgtttccattggtaaaggttaataaaataaaatatgatgtattcatatgtaattgattttaatttaatataataaaaattacattgtgagttgataatgaaaaatatgaatagataaatgcatgtagatagtcatatcctattttttagtatcttattcaatcattagtatacaggaataaatttttagtgattaatgcattctaaacatcctttaaaaaatatgtattctaaaataggcacaacctagcttatacctacttaatgttgaatgagaaaaatatgataggaattgcttactatataagagtttagacaaaattaaattcaaattttaattgattgggtataacggaagaagggatttttttatttgtttatagtgaaacaccaatttattttctaaaattgtattggtcggtcaaattaattagttcttaaagttaattaggtggcaaaattattcatgaaattgtacattatcaatgaattttgtctctataactacaatagaaaatcaaattggtacttaaaataaataaaatgacaaaataatccatgaaaatataaattatcaatcaatttagtccctaaaattataataaccgattaaattgattctaaaattaaaattaaaatgaattacactttttcccaacttttcaaaatgttgcaaattattcccctaaagtgctttttctcacacattaaacactaaatttacatttcaacgttttgggcattttgattctaaattgcaattaaacctataaaaaaagtagtaaaaatagtcgatggtgggcttgaatgcctgaccccttccacaaccactaaatccactaaataaaacttttaatgacagtttttcccaacattaattattgcatttattaatggtattgattccctaattgtatgattaatttgcatgaaaaaaatattaaaagttgagatgatacatttatttattaatatttttattttaatcataaaatcttataaatgata

SEQ ID NO: 3987 - DNA, 1000 bp, Glycine max
  Soy_ogl_2707 Gm08:15678601..15679600 Cluster 15
atgaagataaatgtcattttttaaaatattttgaatttgaaatctttgcgtgcctcattaatgggtatcatcccctaaccttaacattgaaaaaaattgcaatttgacgaagactcagattgaagagcattaatcgttgtcacatacttgattaattgaaaatgatggaatctaagggatccagtaaaggaattgtcacgaataagtgctcgtgaatgaggtcgttttcgtttatatagcttacatatgaaggcaatttcacatggaaaagtctaataatttgtatatattaggtaatttgtcctagtaagtgctaagtactggtaatatacggcatttatccctttcacatgcgtattttacaaaaagtcttcgattataagtttgagctgtacaagttaatagcttacaatataataatcttattgaatatttagtataattattttgagtaaaagatgatttatgataatattttcctcttaaaatagaattatttcctataaaagatatttgtggtttataacaattttttttcttttgtaaaaaaagtaacagtttttttcccttaaattaaatagttacaagcgggaaagaaacataaatttatgtacgttagatatgtgcacggaagcgttgaggtcaacttttttggtataaaattagcatactaattttcatatcaaaattatgtgaattactatttgtattactgttgctatatatcttgcttgtatacaaatctttaatcttactatttctgtgagatttaaagtatcttgaataatttgttaagctttgcatatacaaaatctagttcggaaaaaaataataaaaacatatttttgttgtaaattaaatacaacacattagtaattatccctgtgatgcctcaacacaagtgattagtgatgcagagacataatagtaatagtttggctttcttacagggtccaccctaatagtaatagtgagacgctccactattttttttttaatt

SEQ ID NO: 3988 - DNA, 1200 bp, Glycine max
  Soy_ogl_3405 Gm10:7372701..7373900 Cluster 15
tttgttttacccttatatttgtattagtataaaccatatattaacattgatcaacaaagaggaacgtataattgacagataacaagattcttttatattattcagagattagtaacctgtaaaaagtttcgtgaaacaattaaagattatagttattataataaacttaccatagatagatgataagttataattagataatagtataaatttttttatattatcaatgcatatattactttttctattctttaaattgtatatacagtgaatattatgttgaaaaagataaattttatcttgatgttatttacatcttgaaaatgaatgtgttttgaaagcttaattaagaattaaaaactaaaattttaataatttaggaaaaaaaaagataattttacagggtctaaattataaaggtgacaattttatagagattaaattcaaatttcaaatttttctaaagactaaaaatgacacaaatgtaatgtgagtatgtgactaccatgtgtgttgcttatgtgtactgttgttggacatgtcaacacttattggtttccatttaatgtcaatgactaaaattgctaacaaaacataaatgaaggattgaaattggacatttttttttttacagaaattaaaaaacgaattctaaaatagttgtggaatgaaaaacttattgaatcttcattttcttgcaaacttaatctatcacatataaggaaaagttgtacaacaatgttaaacattgcctaaaaagaaaaaaaaaatttggggaaagtatatactacttttgcactatgttttcttaagatgaaaataaagagaatgaataacagaagaaatagtagaaaagaatttttttttggtttggttccactgaaagaggaaaataaattaataagtatcaactattgactctacacataagtgtttctccccaaattaggaagaaagagggaagtaagcacattttaaccaacatgcaactccttgcccctaaagaaaataagctatttaaacttttatgtaatcaatttgtttaaacttttaatgtaatgagtggaaaaacaaggacgtatatacttcaatactacaagtcatgcgttgctaatttattatttcaaccagttaataaatttcgatcagtaaaattttattgtctattcaagtaagatgatttacacacacatgaattga

SEQ ID NO: 3989 - DNA, 1000 bp, Glycine max
  Soy_ogl_5125 Gm15:44063901..44064900 Cluster 15
gaaatatacaagcgactccactggggatcgaacccagaatctctggttccgtagaccagcgccttatccattgggccatggagtcaatttttaagagtcagctcttaagagtatctttttctatcctttccgttttgtctttctttcttttctgtgcttctgatattattaaccagctgttagcttgagttaaagccaaattatggtagcagatgctgctcataagatgataagggaaggatttaatttgacttttacctaattaaaaattatagtaagttcgtgtgtttaaattcagttttaacttaaactaaaatttgattgatgactcaaattgttttcatgatatataaactttaatatcatgtataattaaaattgaggaacatttattgtatatattttaaaaaaaattatcaaaaatttaattctaatgcactgtgaatattttttttataattgattagtgtgttagttggttcttaaatttatttagatatcattttgaaaagtgattgagatagtgcttgcaaaaacaaaataaaaaaatcatcagggaccaaaaaagttaaaaataatattatagattaaaaaaatatatttaagtcattatttgtttaaattcagttttaacttgactagaacttttttataaaaaacttgactaaaacttgattgatataaaggacactattaagttaactcaaattgttttcatcatatataaatttgaacattgtctataattaaattctaaaatttaaactaaggtatattttatagtatatgttttaaaaatgataacataaaaaattaattttaatacattgggaatataaagatttttacatgtgtataacttttaaaagaagtattgcaaaaattaatagaagttatgattaattagagtgcaaaattgtaatttaagatgacctccaattccattttaaggtaggtgtaattatgagttaggttgcatagggtttgagtaaaaacttta

SEQ ID NO: 3990 - DNA, 1000 bp, Glycine max
  Soy_ogl_2676 Gm08:14196701..14197700 Cluster 15
tttaaatgactaaaatcgtattaagtaaaaaaaattatattgaactttacttcaaaatcaattctgattaaaatcaccataaatcacaactttaaaatcaattctaaccaaaatcaattatattaacacacatttaaccaaccttccatcctttttctagaaataattgtttcaacatgttgagtattacactaagtactatttaatacctctcaaaatgtgaatactctgaattttttcaggacataagcatatatacacatgtaaattcaactacgtgttacgggaagtgtatgtttattttgtttacagtttttattcagcgatcacaattgtatagtttttatcttcacaagctcttcatagtctctcaagcaagttcccaaataatactttcacatcactattttttttttttaatggttcaagtgatattgattcgacctttggtctacatattcaagtatcatcggtgaatcttttcaagaaaaaatatttacgagaattattatgaacagcaatggctttttcagcagcaaatgtttcggtgaagaaactaatatatttcgaacatggtggactgaaaattcaggggaaaatattagacaaacccaagatttaaggaacaaaattatgggccatgttaaacgcacccctcccctattgcactccccccatttgcacccatccactctcctctcatttttatcttttttttttttttttcctttctacaaaaccatctttggtcatctctatcttacattctcacttttcgactgtgttcgtcatctttgatgagcatcaattcttttttgctttttctgaaccttgtgaaactattttttgtaatatattctaatatttcagaaactagattttgtaatatatttttacatacttgcggaaattagtttccaaaggcctcaagtagattccttaaaattatagaaactagcttccgtgatattattcttatcattacggaattagtttccat

SEQ ID NO: 3991 - DNA, 1275 bp, Glycine max
  Soy_ogl_3877 Gm11:18045401..18046675 Cluster 15
tatttagtgaaataattcatgtttgattttttctatatataaaatttcattagaccaataataattacgtatgaaagattaatttttaatccaataagttaaaaaatactcaatgatgtttctgcatgaggaaaaaaaatccgttatctaaaagtatgaactaaactattctgctaattaaactacaaattcctatcacatcacgtctgggaattgtttttgtagtgatatgctagaatccctgtaaatttaatgttcaaataaaaatattgacgggacatcgggaaaagagttcgctctcaaaatcacaatttagcgtatgaaatataagttgagttgaatatacaaatacggttgactttttatgtaaaacttgtcatttgaaccattatatattagtggcatataaaatataaattgagtagaatatacaaatgcgacataaaaaaattattcacttttctaaacaataaacactcctcctgtgtctattactgagtttggatgtcaggtggctaaggaaagttaatatattaagagaatatgttttttatgtttgatagcttaagggcagaaatcagcttaatatcactttatgtttaccaaaatgatcttcacccacccccaaaattgggatgaaacggggaaaaaacttcagaggttgtattcgggtatttttctttcattttgctgctttatgatttatcaaacaagataaaaataaataaatagttctgtgaggttactagtcctacaaagtgaaaacacagctttagtccttcctctctttatcacacacaccaggaatgcataaaaaacttaaataagttataaattctccatcggtaattatttcttcagcttggaaagagtagagaaagatatgacaagtatgacaaattttcactgaagatcaaaagcctcattttataatataggtttgattatggtgatctacattcagtggttgtcattggtatagagtgagcaacactttttaaacttctaaattcatattttcatttcacacgattttttttttaccctaaagtattttgttttctaaacttcaaaactttaaaggcttaaacgcaatattcaataaaattagctggaaagttaaaaagttagccaaaaattaacaaattagaaaactagttagaagttgaaaagttaaccgttaaaaactaaaaaattagtttataaaataagtttattaatttagaagtgttcagtaaaattaactattgaagtagctgaaaaatataaaatgac

SEQ ID NO: 3992 - DNA, 1000 bp, Glycine max
  Soy_ogl_5645 Gm17:12081501..12082500 Cluster 15
taattaactgaagcaacgttgcttcatgcctgctccgtacgttacttgcagcaccaattgcttctgaagcaccttagaatttttgttgcataaggaaaataactttcaaacccttcaatgtcaatcttgggagtggagagagaaaaataaaagtaaagaatgcaaccaaataacgcggaggagatagaaagtggtgtgtctacagtgaaatgaacctggtggaacaaagtgaaaagagttaataatttttttaatatatttcggtgctgctatttctatggtagtcttgcacttatctggaaaaagtttatatcaaacgtaccacactagtttctcacgatagggggatttggtgaactttcccaccttagaattcgtctatgaaagtaaaatgaaagtgaggaaaatgaaataaaagtggatgataatgaaggttgtttgattaataaaaaaaaaattaaacctttttcccttttgttgtacagagggtattcccattttctagtcaagagtttagaaactaatttttcaaaatatagaagtcgagttaatatctcctaacaaatattatttcatatacacttacatgagaatcaatttttttacctcatagggcctgattacctataatttataatacaccaatgacgttttctttcctcttattttgttgtgtgggacagaaaaagaaagggaaaaaatacgtacacaaaattatataaatatctctgataaaaaaataattataaaaaaaaaagagtaacttatatttttttattttaaaattcagtttttgctatgccttttcgttcaatattggaaggattcaaaacatggacaagtcttaatacttaaataatttttgttgaaaatattaaaattatgttttaaaagaaattattaaaaatatattcaaaatattataaaattatttttcatttttttataagtatatgcaaatattaaaaaaatgcatatatccgcttaaaatgtaccccgc

SEQ ID NO: 3993 - DNA, 1178 bp, Glycine max
  Soy_ogl_4222 Gm13:23474923..23476100 Cluster 16
tttttttccaataaactcagtttgctattatgtttggttgttcctcagtacttttgtcaccaaagtttgttagtaaacttagtttcagctcaaagcaacatcaaccatgcttttcaggtaaaaatactattgatttgtttttttagttacaagaacattatgaattaaaagtacttgtattatttaaataaatatcattttatcaatataattttgaaaaaaaaaatctaaacacaaatcacatcatagtaaacttatcttcttcttttttttttatcaaacttgagttttcaacatacttttgattcaaacttatgtttggagactttaatccaatcatacactcaaattctagtccataataatcattaatttaattagattttgggcgaatataatttaatttagcactttttggaaatcttgttcagattgagcatgttttgacaactcttgtgttggatctggacaaacgtctatgggaattaaagctggaaatggagttggcattgctacatagtacacagaacaaactgccatctatatggttgatgaaacaccagtccttaaaattcagttattaacaccaaatatgcgtcgtatctagtttgtttctttgtacaaattttaataatttgaagttaaatatattttataacatctttaactcattgtatcttgatagtggttttgcatagtggcatttgatagtttagctttgaatgtgttcttaagcataagatgccaactgaggtgggaggcattaaggacgtgacacaaattttttttttttcttaaacacgtatgaaatgaaaatcaacatggcacacttaaaactgattatatatatgtaaactgacagaagcatactagcttgcatgtggcactctgttaatctgcgttgtttttagatataaatagatcatggttggctgctttgggatttcaacagattctctaatgaaaaggataatgtaattgataatatgaaacaagtaacataatatatggggcataaggagaacagccagaacagcatctaagcaagtatgccacaaacaattgcagaaagcaaaatcattaaccatatcagctaccaaacatattgcaaaatataaacttttgaactccctaactttcacaacaaatagaataaaaacaaactataactaggagag

SEQ ID NO: 3994 - DNA, 1000 bp, Glycine max
  Soy_ogl_1986 Gm06:16386501..16387500 Cluster 16
attatattaatatatgaatgatacatgcttctttcgttctgtttataattaacatctggcacacagccaatccaagctctatccaagtataaaatatatttccagcagcgcaagagacaggtacaaataactaaccaaacgcgacccagtgcacttcggatgacacaatgatgcttcttgcaacttgttcttttgttaacaaccttattgttggttttgttgtctgattacccagattaaggtcgatcattgaaacttactccatagtccattttctatttatttttattattcccataagtacaatttggacaattttccccgtaagaattttcaactaaataaggtcaaatgatttgtttttcttccataaattgaaatcttcttatgcatcttaactttataaaaaaaaaaacttccacttaatttttaaaaaaattgagatgcacaacttaattttaatttattttaattaactcttttttatttgttgtatatgcttgtcaaaaaaataatccaaattaaacttcattcttatatataatgtacacggattttttgactgaatataatgtacacagatgaaaatgaattatcctttacataagcaaaaaatatttaaatatattgttagcttttgtgagtaaaaataaatttaattttaaaatttaagtttctataaattataaatggaaataaataatatttatcactgctaaattgtgatgtgatatagaggaaaagatcctctctatttcctatattactataattttctaaaaaaaatgatattttttattacatgtgtatcatcttcattttatttatttctccaaaaccataataataaaagaaatgaagagaatcttgacccgtgatatacatctagctagattcgtgtttgtattaactagataaaatatatttataaaagtagttttttcaaattatgggacggttagaaatacaaaacagtgcactacaagaataacagaataag

SEQ ID NO: 3995 - DNA, 1100 bp, Glycine max
  Soy_ogl_5039 Gm15:13381901..13383000 Cluster 16
tctttgtagactttttgttcaagacaaaattggacacaagacaatataaaaaccaaaataaaatatcgttctttatataaaaacaaagaaaacatatataatctcacaaatatattactatattgtttttttatgaatatattactcgattgatgtaaactacaacgcgctgcgacaaaagaaaactaaaggatggattgataatgcatgtctgcggacaacaaagtgatgatggccaattattcaacgagcatgaaatagagagaggataaggtcaaaaggaaagattgacattgaaataaataataactaatacacgaacgagatgatctgttgattattttgaattgatgacttagcaagtttaagtggagagagacaggtatcagttttttttttttttttccaattcgtatttgtataaaatttaggaagaaaaaagcggtggaaatttctttccttttaattaattcctgaaaatccttctttatttaattaggcttaatttatatttatttttaactattattagttatgctagtgaagatgcaaactaagattcccaaaatacttttcatgcgaggcaaaagtagactcttaaagaacttaagacattattacattctacttactatttattaaacttagaaaattcatccataatcaagaaatattctgaattgattattaaaaaaagagttaaacaattttttttaaaatgtaaagtatgatttaattttgagtgaaggtacatatcatatttattttattctcttaacatatgaatcttttatttattattaaaaatgcttacaacgatccaaagccttccttttcttctctcgctcctcttttaagcttcccccaggtaaaccctaatcattcttccatttgatatgttttttagcccttttagttcagctgatattgggatttttatgctgttaaagagtttttcacttcgttctaaagggttccaaagtccaaatcatatatagtataagggctattattatccacttgcttcatgtcaattttttgccaactaacacgaatattctgagaactatatacacaatatccatttaattaaccatgtg

SEQ ID NO: 3996 - DNA, 1100 bp, Glycine max
  Soy_ogl_101 Gm01:4116201..4117300 Cluster 16
acactgtcaaagcagcggtgaataaacacaatgtgctaataacgtactaaaaatgcactatggaacagcaaaaaggaatagcgtgttgaggtagtatgaataaacaacagaacataattgctggttctggcatccccttacatgtgtcatgcataggctgaaacaacaaatacaaattgctggtttagaatgcagagccgttgcttgctgctataggtaagcacaagtccatttccccccctttttttccctttgcatttgtttcttcccttttttactttacctttatgatcaaattttatattcatggtgcatgttatttttgcacgcttatggcatatgctttaagctatagaagtaatttttttaaaaaataaactctaaaagtagttgcaatttgcaagctaatttaatggttaaagtctcttgatgtggttgtgaaaatttaattttgcatccgttaattaactcatgaaaaagcacatcaaataacaatcacattttgctacttttactatttgacatgacattgtacctcacgatgtcgaaccaataattctttttgttggtttttcctgtggtgttgatgtggcaagtcgggttgtcagtttgacataatctttggtcaaatcagatccattggtaataaatttcgtaacagatacattttaaaaataagtttgtaaatagatcaaaaagggtcaatcactctttgggctaaagtatgtgttcggtaatatgtttgttttggacgtgatttcaaacagttgttcctaagaggcatgggtattttcattaggaaaatattttatcaacacttaatatcttatccaacaaatagaaaaaaaaatataaatataatagaatttatgatatgataaaatgagagaaataaaaaataattcatatatcattactatttttatttggataaacattggcatgcattagcatatttaatcctttaacatgtgcatgccttttgaaccatgttcaaatttccatcagcagagggccatgacggcacttcccaactctaattagagcaaacagatcctttggccagatgattgattatatgtatatacacgttctcattt

SEQ ID NO: 3997 - DNA, 1047 bp, Glycine max
  Soy_ogl_4394 Gm13:31864154..318290 Cluster 16
taaaatttgagtatttattctttattcttaattcttaaaagtaaagacttctcttttccagctttatgtgttttattatgtgaggagtacttggagaattactttcatatcttttttacttgtcctactagtatttcggtttgggctagtattagattatggcagttgattgattctctaatattggaggttgattcctgaaaagagttagtttctaaactctgcagggttttggatgatagcaaagtctgcacttttgttatgacaatgtggagtctttggtcgagaaggaacactgtaaatggtggaactctgtgatggagttcagccaattgcagtagcttcaatgttatgcatatggtagacaatattgtagctgttacttggtctaatccacctgtgttgaatagaaaaatgaaaaggcaccaagaatttttaatggccataaacaaataaatgagaagaccaagttataaaaagaaatactataaggcaactttagtgggggagactcattcatctcgtgcttagagataaaaaaaaatggaagttgggagttgaagaatgcatggtgaaagatgattatgatttatgaaggtctaacaaaggctacaaattttgcctcacttagaaaaataatcacaattaagaaattttgtggcagtttttctaaaaccattacaactatgatgattttgtgatgatttttttttattatttgtggcgggtttttttttttgcacagggagcaaaatttgcaatgtttaataaattggggagcaaaatttgaaaaaaaatggaatgaaaattgtgatattgcatgtgaaactttagagaccaaaaagtacaattaagtttataaaaattaataaatacctatctttcacaatgcacatcctaacgtactaattaaacttaaataatttggttgatataaaagctaactttgttttacaggaagtaaaagctaacttaaagcatatatattccgtaccgtataggagaagaaaacaaacaagaaaacaaattccggaagaagcgcatttt

SEQ ID NO: 3998 - DNA, 1034 bp, Glycine max
  Soy_ogl_827 Gm03:3543501..3544534 Cluster 16
tttttcgaagggattagttagcctatgtaactagcgtgtgttttgctagatgataaggttcaaccctaacctgtgcaaaaagttacgtttagttttgtgaagggtcttaatttttctattacgcgtttaggtcatcttttatttattaataatataatgttatttctctcctttaaaatacaatactatttttatattgtgagatctatttgaaaaattttagtaagtttttttttttattgaagtgaaagttaattgaattgcatagaataaaaaagtgatatgacattatagaaaaatatgaaataaaatatgtagtagaaaaactcatttgcatatgtttcttcaatggtgatatcctaatatcttcatgaaacatgatatatcgaattgttccttaaacattatatcactttttttttcctgaatagatattactttttctaaccaataaaaaaatggcatgtcatctaaatttttcaaattatccttaacgacatcttactgtggttcttgtaccaaattggtaggcacgttttcgtgagatttgagtgcatagttggtttccattatgtacatgctcttcttcctccttaatttataatcgatgcctttgtcatattttcacctcatttgtgaaggtcaggatgtcttacaactataggcgcatttgcaagactacaccacctccaacatttttttctcttcttcatgtccccattcgatcaacctcgatctccttcaattttctcctcactcttgcatgaattctcaaatatatttatctatgtttccatccatgcagaaattattaagaattaggtatctacagaaaaatcctgggctgaaaaactcatatgggtttattctaatttgggttttcttagcactaatcacagggtgtttaatcaatgttctctcttgaaaaccaaggattgcaatgccatgaagatagggttatgagaagaagaaaaagtagaagtcatatgtgatttttaataaataaaaaattgactaacacttactaaaaatga

SEQ ID NO: 3999 - DNA, 1200 bp, Glycine max
  Soy_ogl_6670 Gm20:1232501..1233700 Cluster 16
aatgaaatgtaaaagagaatgggatgaacaaaagtacataatatttttttttaaaaaatattgtgctagttcatctcacacgcaactctattattcttttatagttatattttgtctgagttgtgcttaatctcacacttaatttagtgaggattgtacttaattaatataacatgtgatagttataacaaaatcttgaatggcaaattttatatatatggtcagtctgagcattactttaaatctgcattggatgccctatgagactggaaattcttgaagctcacgtctactctctcttgttttggtattctaatcaagtgttttaaattaagtacgattatcactaagaccacaaattatgtgatgaaagattaatagaatcatatttcattaaagccaatgtatttagttcataacctttatattaagacaaatactctgtaccctcccccccattcttgttttttcctttcgtgagtctaaataaaatgtctcaaaaatataagaaaacttagctcatgcaaaagtttgtgatcgagagtattagaatgaaatagtgctttttgattgggattgaagaaagtttcaacatagaaggttgaggtcatatgggctactgaaagtgtgcttttcgggatggagaattattgtaaacagattcactttgaaaattgaaatgcctttgagaaatattattagtttacatatatactttaatttatttgtcattttagtccagacaatgtctaaggtgacgaaggctgataggtggtttagagtgacgaagtattttatgatcattagatatactagttaaatatttaatggttctgattgtttcagtttttaacatttaattttgttttgcatgttatttttcatattactttactacccctctgtctaatcttctgccatctttcagtctttacctttaaacaatattgttggggttcaactctcgtccaccacggtcatttgtcacaatccaaacactgctattcaggctaatgaaccaatccaagaaaaaaccaagagccccaccagattctactatatataatgcgtgaatcacaccctagaagacactgaagttgttgcctgatgcttcctccatttcaatttaaagatttgcttcacaattagatctaatttacacttagaacagctcctaaacgctgttacacacgccacgct

SEQ ID NO: 4000 - DNA, 1258 bp, Glycine max
  Soy_ogl_5423 Gm16:36979943..36981200 Cluster 16
tttgattcgataggcttaaaatggaggaattaatgtaaggctatacaagtcaatttgagaataatttaaagactttgattattttgtcaaaagataattaactatcttattacaaggaagataattactttatctcatatattttatcaaagaaaatgatgagtttaaaaactctacattatagatacaacctcttccccttgccttttgagactaggatccaattaaatggtccattcaatataaatctagctaaatcaaaggcttgtgagaagcatgtgttgcccagttcaggccgaatcaaacattaacattgtctacatatagctagttcatattctactacttgtactcatcattcttttggtgtcttgttttgatgaactcactgttttgtttgagtgtcccaacgattgctcgaggataaataaatttttaagtttgaaattgtttgatgcgttatattaatttttagttttttttagtctcattctagataggattttctgctttatttgtcaattaggacttagtatttgcattttcatgtcttttttcaccttttgttgaacttgttatattttttgtatttttgtgtttcaaaagaggattttaccatgacttgaggtgtctcaagagtgattagatgcattacgtacggatcttgtgggttgaaatttggagctttggaggtcttatgaaggcaaaaaaaaaaaagcttgttggaaacttggcacagctgttaaagtgattggcacatctaggcaagtttcaaatttgctaatttctgacattacaaaagttgcatacccatgtaagaaatccacacaccaatgcaacaacccctgcgtggaaaaactctaatttttcattttcttttcttttgggctcaaagcttttttggcccactagaccttgacctagggtttagaacttggtttttgatacaacttagaggagaacaggttggtgctccttcaatatgaactcaaaataacttaaggataattaatttattcattgtcatagtgtgaatccctaactggaaagtcttcacaatttgaatttctatcactttcaattttaattgtttgttctattttctattgtactcctaaacttttaatttactcaactctattaccattttatttttttaatttactcaactctatcatatggcaacaataagatttaaacttataacattgtacaaactactcaattaaacatcattgggacaactttttttgagatt

SEQ ID NO: 4001 - DNA, 1065 bp, Glycine max
  Soy_ogl_3448 Gm10:38916318..38917382 Cluster 16
taatttacaaatatttgagattggtttgatttctggagaaaaaaaataattggaccaagttttgaaatcgatttatttgaaaaaaaaactataaaaatgtttttttttaaaaaaaatttgcccaggaataaaaaaggaaaaactcataccaaaaaaaccaatgggcggtaaaacatattggctgaagttatttttgaaaacacatgaaatgatgaaaagcaagtaatgtattgaaatctcaatcattgatggagcaccatacaaacattatccaaacaaacgcatcataataatgttaaggtatcgatcaacaaagggggaaaaaccactgaaggaggaggacagaacgaaactgaagctgctagacctcatagtcatttatatatatatcattttcgtcgatctctgtatttagaatatgacaggtgacttggccacggtatgcgacacgaattgaagcaacgtagaacaacgacgcagggtagcataatgaaggtgcaatcgctttgagacacagtttctattaatttgcatgttgttgttctaaatagatatagatagtggtgggtgaatggtgatgggtcgtggactcacggtggtggtgaaaggtggcggtggtgagatagtacgtaagagaacagtgcgtgaaaaattaagaatagtgagttgagactaattacgtacgataagatacgaaggaaaaggattttatatatgaaagtccctaagataattacgtataatagtacaattctaaagaataatgacttaaattgttttaaactatcattttatgttttaatgtctatgttacaaatgataaatgtttattttaaaatttataataaataattttttaatatataaaatacaatttatatttttaaggaataatttaaactatgacataatgtcagttaaataattattgattttttttaaaatatttatatttaatttagaaatagagataagatattatagaatgaaaatcactagtattttttcccgaggaagcattgacaaggtttttgttttgtttttatatacctataatgcataatg

SEQ ID NO: 4002 - DNA, 1000 bp, Glycine max
  Soy_ogl_4176 Gm13:20982601..20983600 Cluster 16
aactacagacttgactttactgcactcaaagagtaaaacttccttgactccaaattatacagtatagattgagtatttggtaatgtaattggatgtgacgaaagcaactatctagtcctggggctggttgtgggttcaagcgaaattctgtccagtgaatgagcctccaaggtttgcagatttatgtaattgttggaaaaaacaagggtgtttggtaactagagagatgaacatgaatatatcacatatcacgtggatggaaagtagctgtccaaaggataaacaaacaacaagtgaaccacttccttaagactcagtcttcgcccgtgacacatccatcaaatgaataataattctttttgatagctcataagttatcaaattcaacacctccctacaaaccacatgtcccaacccaaccaactccccccttatcttctttttttttttacaagcagaccaaccccttacccaccatatgtcaaccaataatattattcttacattaatttattactctactttattctttttttaatttaatgtactattattttaatttcagcagctgattgaataagatgtgaattattgcaaaatttttaaaattatttttttatttctatggattaaaaaaatagttttttttaatttatgaactatattttttattcctactgttctaactttttattttattttttccaaaaataaaaagtaatgcaccagtattatcaatgagctatatttcttcaaaatacaactagctttcttttttttgtttcttttttaatagtaagctatgccttataagaagctgtgcggtctgccagtgttatttgcgcgtaccaaacaaactctggagcaccccaaaactccgcgttacacacacggatgtttttgctctcgatttccatttgtttaggttttcattggtattattatatttcatcattctttttctctgtattgatttttaaaaggtagctaattagctatc

SEQ ID NO: 4003 - DNA, 1093 bp, Glycine max
  Soy_ogl_1936 Gm06:14034601..14035693 Cluster 16
tcttttgctcttcattagtcctaatcttttaccttttatttctcttgtaaaatgcttggaaacagtagaaaaaaatgaaatatttcttttttacttgagtttcccaggctgattatatacattttttagcaaataaatagcatgctaaaaaaactacgagaaaagtagagagaatgagggggaaaacaaaacttaggaaataagaaccaataataagttgtcatatgctcgtgaaggatatatatttccaacttcaaactagaaggactccctaaacctcctactacatatagctatgaagcttgaaatgacctaaccaaattcatcacaaactcttttaaaagtaaaggttttgaattgaaggcaattgttttgagatgaattaattatgaatttcatctaaagttatataaaaaaaactattacttcactataatcttactatatttctaacatcaccaaggacaaaaagaacaaacaaaatataaatattcatggacttacacattccttttattaattcatgagattatgaattctgaccaaggaatagaagacaataccaactctccaattggaccaacaaggcatgtaagagataaaatgatggagtctttagctttcatgaaggagaaaacaataatggattaagttacatattgttaagttatgaaaaaactttgaaaaaaaaaaggtgttgaagtattcatatttgggccaaacgtgggttttttggacaaaaattgaagcattatagaaaaagaccaaaggagagatgaagagaggtatacggaccatgtttttcttctttaataaaaatgatgtcatgattgtcttttaggagaccacttttttttattattatcatttaatgttatttgcctcatcttttgcggagacgaaaataaaaagagttaatcttgtctcaacttatcttgttgccatctctaacttgagaattgggaatgaatggcatacataggaattgattaatgatatgtaagaaaatcatattaaaaatgtttaaaggataagttagcaatataaaataaaaaattatataaaatttccaaattactcatgcattacatag

SEQ ID NO: 4004 - DNA, 1148 bp, Glycine max
  Soy_ogl_3497 Gm10:42606401..42607548 Cluster 16
tatttcatcccaacgttatcttttaattgttaattatctttgacatgaagaaccctcatttgaatgataatttttttgactgcacgtaaacatttctattcagattcttatggagtctataaaaaaaatacatatggaatcaccgagtataagggagaaattaaagtacaaacgcaaacattcatatttttttaactgcacgtaaacatttctaataaacggaataaagcaagaaaatcttcaaggatctttgttcacatgcatgattcaaaaatagtttaaaataattatcctcattaataacaattatataattaatgagttcaaactagcttagataaaaaaaaagttatataataagtctttaagtattaaaaaagtgtttagtcaaaaatgtgtagcttaccgtgtcccgtcctcccttccttttcagccatgccatatagtatgaaccgttttcatacgaatttcaaatcaatcaatagtttatattttaaattaagagatctcttaatctgaaatagttatctaatttaaaaatttatttaccaaacatgacatacgagacgttaagacacttgtaaggagatccaaacattatttacattgataatatgtattgaataagtgtccaacacgtaccaaaattaaaaattataataagaaaagcagaatgaaagtccaaaagtctagaatatacacattaaaaaacaaagataagaggtcataactataagatggtagttagacttgtacttaaaacaaacaaataaagagtagaggacacacaaatggtagttaagaggtaacaacgcgatttcaaatatataaaaatacatacattaattcataaactccacatatcattgatttcgtaccgtcattatcctctactcaaatactatttcaactctaatactttgtctgagtttttaaaagatattaaaattaatcaaatgacgaatggtcattttgtctaatctattttcatatcataaattaaagggggaacttctcattctttcttatttttcgattaaatatttttactatttcatattttcaattaaatcataaatgtacgcatcacgcaccatttttatttttcgcaactagcacagaagaaaaactctcaactatttcagaca

SEQ ID NO: 4005 - DNA, 1000 bp, Glycine max
  Soy_ogl_5620 Gm17:9814701..9815700 Cluster 16
acaacttttaatgtactcaaacaaagaaggatgtgtcttgtggattggcttcaactaggatttgaacattttggtgtgtgcaacaagtatttacatatttggattaaagtttatcatcttaagttttaagtttgggataaatttaagttcacaaatttaggtgcgtttgaatttttagtggaagaattttagaagtacttttgaaagtaaaatgaatttgaaattatttttgattattcatcaaaagtatatttgagagtaattttgttcatagaaattcagtttgagaaaagtaaaacttgagatatttttagaaactcaatttgagaggagtaaggaaatgtatctacaggttttttttataaaaaatcataacgggcaattggctctggtgtatatttagctatgtctcgtgtttacattaacactattcgttatatttatttaaatatcatttctttaaagtttaaacaatatggttttatttaagcaatgtattaattttaagactttagcgaatcgtatcattgaaatcccattagtttttattgtttagtctcaattttaataattaacctatctgaaatttagaaaatgtacaaaggagtaaggactcaataataatttctttaatcttttaaccagtgaatttacttttgttgtcacctacggaattgtataatattctttagccacaattgtaaaacctaactattgatatattatgctcactcatgaaatcctttacaatattcgcagttgtagaacgtagtaaaaacgcttgccactaagtccaatagcaatatgaagcgtaaacaacatacaacccaccactgccacggtaataaataacctatactgtgaaatctatttgttgtattgagttttcatgaataccttggaattaattgatgggaaaattattgttgaatctcattctttttcaacggttcacatgggcaatgaaggttgcctttttttctaactagtgtatgccctt

SEQ ID NO: 4006 - DNA, 1100 bp, Glycine max
  Soy_ogl_1746 Gm06:568801..569900 Cluster 16
cttaattgcaatctgatccccattgtgggcctcctcgcatataaaggaaattcagatcccctggggcccactgtttcttttatttttctcgtcctactaacagctcttgtccattcctcgtggccctgcctcactctcaaaatgcacccaaaaaacaacacccaaaaagataatagaagttaaataaaataaaaaattcaaattttcaaacaatttgcattcgtactattctttttctttattatttacataagccagacatattaagattttcaaacagtaataataattaacgacccagtccgtgaatcaattttgatgaaattgtttcagctcaaggatgaatctagatgtatcaaaagaggggtcaatttttttttacataattatttgaacacttaatttctaaaaataattatttaataaattatgagtttcacagaaatatttattattaatgttatgtgtaaaactatacatgaaaattactatggaaaagaaataaaataaacgtcaactcaatacactaattttattcatttatctaatttttcttcttctcacatatacaaagagtcttgagggagaagagggacaagatccttgtttgcccacccttgcattcatcactattagtttaactaaagttatcaagtttaaatcttgagtacatgactgtattaatacttaaagcaagaattttactatctataatattgtgacccgactcaaacataactatgtaaagtataagatatttgtgatctaaatatttttttaccattaatatttaaaacaaaaaaaaaaaacaatgcgcatttgtgtgattcagtaaaaaggtatctcgcgtgaagaactctctctatttttatttatttaaaggatggaaatacctaaaataaaaataaaagataattttttgaattaaaataattgaatgtgtgagactcatatgagattatacattttttctctatttctgttctatcttcccttaaccaaacacaccttaacaagtttttagcttaattggcaagctttaagtatttaagatatatgaacgcaatgcgattgttcaaagaattcctccttttgtttac

SEQ ID NO: 4007 - DNA, 1000 bp, Glycine max
  Soy_ogl_5621 Gm17:9828401..9829400 Cluster 16
tggctagctggaagaaacacaaaagggaaagtattagagcatcttcaaccaagataaaatatgaagttagatgaaaaaatatgctttttattaggcgaattagaaaatcttttttcttcttctttggtttatcaggaaaaataaatcataattcgattggaaagtaaataaagtataattaaagaatatttttaaaatcgaattcaaataatatcaaaaataaaaaatctaaaacataaagttagattattaagaaaaagtgggagcatgaataagaactatttgaccaatacaaagaggacaagttgaagtgtatataacataacatagacaatagacctgtcaaacaaacaaactgttaaaattaaaatatttttctggtcacaatgatttcatcttttttgttttcttggtttatgattttatccacaacactgcggacaagtagtattgaactgtaaggatcttacgagaatttttttgccttttcttatctaagcatgacgtgaaaaaactaacctttaaacgtgtagtgcaataatttgattttaaccatgggaattatgaaaagttgagttatcgagctgaaaaattagaagaaaaaaatgtaactcgaaacatgtaataataacactattttcacgaaattgttaattggcctataatagaaaattaaactctcattttttatgatacaaaagactcttttgaattgaatttatttctaaaaatataattttattaattccaattcaaagagaatcaaagatagaagagaaaaaggataaagtgggtaaaaaaattgtaggaggggatgaggaacaacaaaatatgagataacatgaatataaacaaatattttaacatcatctatcttataagtaactacactcacatagtcaattcctatacccatgtgtaatatttaatactgtagctctttgagccacgactaccctaaaaaaaagctgagtcacgattcatgcaggttatgacttta

SEQ ID NO: 4008 - DNA, 1000 bp, Glycine max
  Soy_ogl_6808 Gm20:37408101..37409100 Cluster 16
tttacgtccccaaaagcaactttttccatctctaagctattcagaaacagacttagagacagtgcctcatccgttttggatctgggcgtcttggaatattttgagacggagttttatagtccgacttaaatcaaataagaaaagtcatatttagtctctgttaaagacagaaaaatccttctttaccgttatttgcacgtctctgactagaaagaataaatattcatttatgatgacactaattatatccgtctctaaaactgtgatggcctgtctctaatcagagacaaatataattccatctctaaacatgaatatttatttttacaactatatatatatatatatacctgtttctttttttttacataattacccaatttttttaaacttccattaatgaaaatcaatcctagtttttaagcatcaaataatttaaattgacacttgttaaatagacatgaaattgggaaaataacgcatcaataacaataagctaataccattaataggaagtcaagataaatcaatgacactcttaagataaagcaaccacactatatatattctaaatgtaattttcccttgacaaaagtagtaatagaaaaataactaagcccaaacatttacatactactatctttggttcctagtttctcattaagtcactcatttgacatccacttaggcctgggcaatagcttgttggtaccctatgaaaagataacacaaatattatattttttattctgtaaactgagttaaaagatgacatgatcagagggaaactaacttttttatgcaaactaattttactaaacatagccacaacacaatccttaatagccaaaatcatttgcttaattatgaagcaaactatatacaatgccgtgacagattatacatgcaaatcacacaaaaaaatgaagtacaaactcatataattgctaatggtaaccagctgaaagcacatgccatacaacactaaaatggtatgctc

SEQ ID NO: 4009 - DNA, 1000 bp, Glycine max
  Soy_ogl_720 Gm02:47617301..47618300 Cluster 16
aatttaattcgtttttacaaatcaatttagctaaaactcatttggtttgttctaattgctaatcggtttggtctgatcccatatttttggacacccttagtcgttgatatatgtatttatcccaaaaataaaaatgaattaacggaataaacattcacttggtctattgcctctaagtcaactttaataggttaacattatgtaaaattattgaaatatcccaacaacaaataaggctagggagataaaattaaatactttacttggtttaccattgctagcgacaattaatgtttgttggtatttacgtatctttttcgaacaactattaaagttataggcattgacttgatctaccgttccaggcaacaattagtatgacaaacctgtatatgtatgtgtcttttcttgacaattgttatacggcaataatattctcataattatcttaacaaagaataatgaagttccataaatagttgtgttgcctacatcgtatgtatgattttttttttttcacgacaagctaataattgtgtgctattttctatggattttaattatcgttggcatgagtctatcttttcctggcaagtttgttgcggagaaaataatcttttcatccaactaacttgtaaacatgattaaaatgtgtgcttaattatatttgacagcacatgcgatgtaattttacatatttatctttcaaacgttacttgaattccaaacaaagaaaatcaactcccctgcatatccttccctttctttgaaaattttcacttcccactcatggcattcacttaaaaatatccaacatatataacactgtgcagagactaaaaaggaaggaaaagttaaataacaaaaatactgacttgaacgatagatatcgaattttaggataaagcagaatcaaatggtcttcaacaaaaaagaagaaagaaagtagaatcaaatgatttttaaccctcatttgcaattacataattattttcatctt

SEQ ID NO: 4010 - DNA, 1000 bp, Glycine max
  Soy_ogl_1759 Gm06:1290501..1291500 Cluster 16
tttggaaaatcttctgataaaggaaattagacttcaatagactaaactaagaagttagaaaaccgtatgataaaggtaattagacttcagtgtaccatataaagaagttggaaaaccgtatgacaaatgcaagttagataagaaatgacaatctaatgaaaatgttggttaggaaaaaaaaactgcttggataatgaacttttttaggcagagaatatgcaccatgcaaaggttatgattaatatttctaaaattagaatcataaaattatcaatttacaagtcaaattacggttaaatcaattttccaaacaaatctcaattattaatgagaatatttacttttaaaagccatttgatcagttcaattgcttttagttatttacttaaagggatttggttcctccaaaatgataggcgcacattagaggataaaatataataataatcattaattaaaaaatcaatggtaaaatttatgataaaataaaatatagtgtacccttcactttagatgaatcaaatcacttgaaaaagctggtgcattttcgtgatagttacacgccttcggcctatgaaattatataatttgtaggggtgttttattttcacccttctaaatttaatatttattttaattttatttatttagaaaaggaagcaaagggggctgagggaaaaggttcattctatatgaatggtttgatttaggggttttaagtgtgtaaattggttcaagtttagaataaaattaaatccaaaataattatatttaattggtttggtttgtattttaaattgttttttggcaaaccaaaccaaaccaatattgaataaaaagattatgatatgaactatggtaagcttggtggatcacagcagctatgacatcttccacttgttcctcctttcacagtttccaccagtaacttgtagtattatccaactatccaagtatccttaaaggacagcttccacactttagtatcggttacatcatt

SEQ ID NO: 4011 - DNA, 1077 bp, Glycine max
  Soy_ogl_6813 Gm20:37518224..37519300 Cluster 16
cgcaaaagatatgattttcttcctttattatttaaaaaagagattggcacacttcttgtcttgtctcttgattgggtgatggaggaggaatgcatgaaggagtgcatacgtggcagagaaaggatggtgtgtcgtggacgagtaaataaggtttttgaaagaaacctttaagaagaatagtttaaaattagaaggatatctaagagaaaaaaaaatattttgaaaaacaagggaaagatgatatatttaagaatgaaggaaggtgtaattaacatttgtcaaagataaatccgaaaaccaatttggttgaaatttaatttgtgttgcttttttgctttccgatattttataaactaaactaacccaatctagtttagttaattaatttgattaaattatcaaactcatcggtaaatccaatctggtaaaccccgtatgccagcgcatcaaacaaagctacgttatttacgtcattttctgacactcgtgaaacaggatatattggaagtggtaaaagtgcttttgtcttcttccatgttttgtaacctcgggaatgggtactctctccacgtccgtttgaatagcattttcttcttttgtaagggctacatagacttgtaggcattgttcttgtttgcatacataaggacaacgtcaattgcatgcttgatgcttctatatatccatatgctttgtatacagggtgattatatttataacctattttgtgtttttcttcttctttaaaacagatccacctcttctgtcttttatagttttatgtcctctcatgtttcttttatgtatagtagtaaaaaaaaaaaacacatgcattatcggtgtggatgtgtctctgcatttttattgtcctattatatttttattatgttaaatttgaaatattataaatttatcctactatatatagatgtgtgttaattttagtttaatatttttttaatacatgtctgtctataatatatgcatttcaattaaatttttgacatatatgtcttagttttagtttatctatttaatatttaatttatctttttcctcaaaatgtgtatgtttatt

SEQ ID NO: 4012 - DNA, 1235 bp, Glycine max
  Soy_ogl_6804 Gm20:36974966..36976200 Cluster 16
gctcttgttgtactagtgttgtttactcaaaaacaaagaagtacgtgcaaatagaggcctacagaagggtgcaacaggaaaagtatacaaatttaaatggccgttagtagtagacccgccaaatccatgcccaactttccaaatttcatcactaccattctcactttcattaactattattagagaaaccaagtttggggcaagtccattttccaatgcctacacaatcttagattgtggaccagcttttgagcatggaacctttcacaatctaacgaagagggacactagttgaattgtcactttttaatacttgtaaggaacctattttactcgcctgtggttttgtgatgtaaaacgaacaacagtaataatcatgggtgctgcttctagtcttgtactctaatcaaaattgaagttttatctcgataatttatgtatgttgtcctttgatgtaaactttattccataaattataaatttaaatattttgattgaagacaacactaaaaattttatttaaagaactgcatctaagttttgtcgtgatataaactagtatattgcttcgaactaaggtgggtggggggccagctagaatcactctgatcaattggaagcaaattgattttttgtttgatgcactgcaattcaagaatatcaaccactgtcatgcaagcatttctttctaggaatggactttttgattggtgaagataaagtaataaacctgaagatgcacggaaattaacaatcagttgtttccttgacaaagaaacagacaccaaaatatatagaaatgctggtaactgttttagcttttacagtgaatcaaatgctctattggggtgccattgttaagaaacaattcaattttacatttcttttgtatctatctacaaatcaaaaaccaaattatgaaattttcttttggttttgggcgaccagtatttattctgcatctgaagtttctgactttatgatatgattgatttatacgatgtaactgaaaaaaaaaattgtgaagctcgttttttggttacgtttacgttctgctgaatctgcacatcaaattaatgataaaaaaatgataggtttaaaattgatgttgaagcacctactcaatttacaaggtggaccctttgatttacatatttaagagctatgttctgcaattacaaagcattgaagttgagtaccagaatatggttcgttgaaatataaatgcataacta

SEQ ID NO: 4013 - DNA, 1127 bp, Glycine max
  Soy_ogl_2938 Gm09:1764358..1765484 Cluster 16
aacttacttttaacatatctttacacaagagttagcaagtatatacatctaattttaaacatggaactttttgtttgtgttagaaaaagtaacattttcttaaattttttgctcgtctgttccaaccacatctaagagattttagaaattagtaacatttcaataagataatataattcctacccttgccgatcctaccatattaatacaagaaattcattcatgaatcaagaagtaatagtccttgagagtaatttaagactactttacatatatggttttgactagcctatatatatataatattcaattttttaaatttacgagaatattcaagttaatttttaattaaaaaattaatcacttaattatgcatcatgtatagaataataagaattattgataatcttaaactacttcctaatttctcgtggtcatggatatcatatcctaaataatacgtacttgatattaatttctgtcagttcactttctgagaatttattttcttaaaaaagttaatacaaacattagcaacatggcgatttacgagaaagaaacccaccaaattcttctctataaataaaggatcgagatgagatcttagcatacaaattaactcaggattcaagaacagtcaacatgcgtgtaggtgtgcatttatgatgcatgcagggttttatgctgagctgcgtcctacgtactacagcgaaacatgtccactgctatactatattgtgtatggagtcttctacgaagtgcttataaagaagattacacaaacagatccttttttcttttccccacaacttttcgtttgtttgatttgaaaaagaaattagagagagatcatgaaattagaaaaataaagtaatacaataattttttaaaaagttatttagtgtgagaagaatatgagctacatttttttaaaaatacatccaaaatgttacttactaaaatggcccttataaaaaaatacatcttggtttttgtgacagggttgtgatggatcaattttgctgaacaacactgctacaatagaaagcgatcgaacaagatgcaattccaaatgacaactgaatatggggcttggacgttgtcaataacatcaagacagcagtgga

SEQ ID NO: 4014 - DNA, 1196 bp, Glycine max
  Soy_ogl_6803 Gm20:36966601..36967796 Cluster 16
ctcaaagacaaataaaaaccatatgaaattaatctaaaatttattaaaggaaaaatgagattgatttaaattaatgaaacttacaaaatctcaaataccaaaagaaatcatattaaaaaataattcaacaaaaaaagcatattaaagtgataaaatatatattactaacatccatttatacattcttgggtcaccacattgttaatgtgatatttctattaatttaatcgatgattaatatcaagaatatacttaatgtttttttttcaaggatgactaatatggatggcaaaaagtttgattttaatgcattttaagaaaaaaagtgtaagcttctttatgataaagagtgcattttatacgttaattgataaaatatggtgactaaaagattacgctataaatattgcctttttaaaagaaatttctccgagaaaaggaaggacatacttttctttacaacagtaagaacatactttatgattaattaaaaataataatttattaaaaaatttaattgcaccaaaaattttaattttaaattattaattataaataagtgtcattaaatttctcgcactaatctttaaagagtgtaaattgataaaaaaaaatgaatatatgatgcctagaaagattacgcgataagtttcgccggctaattctataatttttccaaaaaagaaacaatataatttatcatttttactataaataaggctattacaatctttaaataaatataattaatgccttaagattacatgatagtcattacctatcaaaaaatcctttcaataaaaaaagaaaacataatttaagatcttccaaaaaaaaaatgagtttattaaaaaataaactacataaaagttttaattctaattcattaatatatgtattattgaaagcaaagattttaagataaggtttaagaatgtttttttatctttctaaaatatataaaatttggaattgatctcttcgatttttttatttcatttcaatttctttaaaattttaatatgttattatttgtttagtgttaattcgatatgtaaatccaatattttagttagtatcttaacatgccaaacatcatttttttaaattgttgtacaaatgtctcaaaatctccctttaacattttgtgtgtcatatgagcggattcattaatagagtttttctttttgcaaagc

SEQ ID NO: 4015 - DNA, 1200 bp, Glycine max
  Soy_ogl_5856 Gm18:1055501..1056700 Cluster 16
ggatcgctatcagagctgagtgtgagctcagcaggtcctccaacttggagaggtgggacctcagcgtccgtcagattacgttaaattttgtagttatcattacttatcattacgataatgatgtaatatggaactggggatctatagaaaacaaaacaaaacatggactcgttccaagcttctgcaatttcaattgcttttgcactctctctctcttttagtctgtgtgtggtttaaaggaataaaattggtgtaaaagtaaaatataaaggtttaagattcacattaattttaaaaattttggtttcaaattcggtcaatggaatttaaacaaatattatcttagatagtgttgggttaattatacgggatacatttgagataaaaaaatttaaaaattaatataaatttcacaattttatattttactttaatttaattattgtactttttttttttatctcaaatcattgtttcttcccttcctttaaatgaaacgaatacttaaatgaataatgaataatgatacataaaaatttatgttttttaaatatttaacaaacatatgttttttcgttctatgtttttcttcatatcaaatcatgctaatatttatatttttctcaattttatctttctgtcatcagatcagatgttaacggggatattagatgttcatgaataattttttcacttgcaagagtagccatggcctataggtgcggtaccactgaagcaaaaaatattattaaaagaaggaaagaatgtgtgggtccttccttccatgccgtattggtagagccatgtgatatgggtcccttacccaagagtacatggaatggaacacgtcaaattaaaacgggtcagcgtcgcgtagaaattggacagtattctgtttggacacaccgaataagcttaatcatttctatgtgcgcagatacaaatatctgtcctactccccaaattatgtattgccacctcggaaataaagggctttttcaccatttgggatatctttttcaaacttaacaaatgggaatattttttaaaattaattgttatttagcactaaattataaaaataattataactttataaacaaaagtcataaatcattatatgactttcaattttagaagatataactttaaagtcacatgtggtataaaaatttaggacttctatttaaaaaatcataa

SEQ ID NO: 4016 - DNA, 1058 bp, Glycine max
  Soy_ogl_2158 Gm07:3284343..3285400 Cluster 16
attgtttttatgaaatgaaattctcaaaatttacgacattataagttattgcaactttgattaaaagttaaaaaattaatttttttcactaatgatttaatatttataaattatgaaacttgttaacttttttaagaatgaattatatatattttgcttcttgagacataggagtgtttaactttaatggaagttatatatattgaatgggttttatttagtacattcacttcttgctttttgttttcactctctagttagagatgttatggatttttttcccatttagtctgtattgtaatttatttttttcgggattcagactctccacagcaaaaaaaaaaaaaaaaaatagaatggaagttatatatgttgaggaagaagagaaaacaatggaattgttactttcgtaaattatgaacatgcatgtgcattgagttttcaagtcgaaaacatataactagctatataatacctaatgcatatttaaccatgtcctgttattcaagttattgaatttacttaaaacgagttgaaattagttcatttaagtcctaaaagtattggtatcttcttgacgttagagagagtgtgttttaatcttaacatgctaaataagtagaatgacaataatctgaaccaacaatcttacaaatcacatctcacgtcccagatcctaatttagccccataatttattagaagtccttcatgcacctgtgaatgatattcttccgagtacacttgcaggaataagccaacaaaaaattacaaagagacttatatccataacctgtgaatgatgtgtttccacgacaccacccgagtataattcaaatggattaatatattgacattagtgagaggataagccacaaaaaagcatgaaaaattcaaatgtccacaatttttcagcaaagtcatctaggtgcacaacttaatttatatcaatcagatgagagaaatatgtgtattgtgttttaatctcaacatgataaacatgccaaaccacaataatctgaaccaatgaccttaaaagtgacatctcattcaacccca

SEQ ID NO: 4017 - DNA, 1000 bp, Glycine max
  Soy_ogl_982 Gm03:39773001..39774000 Cluster 16
ttcatagatatagccccttgctagctttcccttaccataaacaagtagaagtactttcataagagaagctatgactttgagtacatacaccacattttttaaaaagttcgacatcaatttggttttatttgctccttttctctttaactcatttgacaagttgtttgcattctacttaatcaaggtagacatctttccaagattttctttttcttggtgaatcttttccaagaaaagaaaagatgatgcaaatcggatgactgcatgtttcactaattctaagattgtaaataaagtcaagaagagatattacctgtttaattgacttgtttatattaaggaaagaaatgatacatgggagaaatatcccctttctattatatatatatatatataaaataggaaataaagggataagaatgatattttaaaaggggaatttttttcctcaatatagcaaaacaggttgcattttccttttgttttaagtgttagaaataaagtattttataacttaaaaattgaaataaatagctttatattgataaaaagaatatgataataaatttcaagacttcaagttaaatttacttttcctagttattataccatgtttttttgtataatttattctaagaagataattataaaaagttcaaacaagtgaaggattttttttccacctattttctttttatttatgttattttttatcctttatttcactttcgtcaatcttaaatcatccccagtccccccacaaagttaaaatgggttggcccttgggctcattccaatttccttataaaggtagcgcgtccttgggagaaataaaggtatttttttttctcttctttttgtggccaattaaaacgtatttcttttctttatcgtaggtaagattggaggcgattttattcagacatgagacacttgttaggaccattgttttttaacatctctaactatcttgtttggagaatagcagtaattgttgtcc

SEQ ID NO: 4018 - DNA, 1179 bp, Glycine max
  Soy_ogl_1250 Gm04:6922..6208300 Cluster 16
taaaaatatgaatcatatttcattttactgattatttcactctttttttttcttttttctagattcacctctaactaacggagggcaagctagcatttgccttatgtaagtagccttcaacccaagaataagaatccagcaagtgcacagaatttctgcaactccaaccattgatgaagcttcacgtgcttctttgttttcaaaagaagaatttgagataacaattaactcagagaaagacgaaaaagattgcacaatcatttctgtttttgtgttaatcatttcccgtattgcgtgattctactacgctcatgacatgtgtctaacgtttcatctttcctttctgacattcacttcttttaccattaacttttttcctcagtttttttttttttccgtaagtgcatgcatatttatttccgttaacattaattaatatacattgtattataaatacatacattcttccatttgttgttatgtttcttgtaaataaaagacaatatgaaaggtcccaatcaaattgctctctatatattccagggccaatgaatgaagcaagccaatggtatttttctgaataaattgaaccgaagaagaaaagcataatggataaatatttgttatttacttcaatattaacaaaagtggagaatataattcagtttagaatgcctgttgaaaccaaactaatatacagtactcattaattttatatattatgatgcaatataatatttgtgatttttttattgtatcagttggggatggaggagagaaagaaatggagaaccataacaatctgttatattccacttttttgccatcaatcattaagattagaagagtattttttgctgtactttgcactttgcagcttctgtttacaaagtatgtaagtatatatatatatacatatatctccagcgcacaaacgcatgtgacaattacgttattcccaagtttgcccttctttttttttgtttcatttttattttttcaccggtataaaatattaacatacatctttcttgttttttttaattgttaaatattaatttgttagttttattaaaaatatcaattgaggatttgaatccacaacctttctcccttcattttttcctaaccagccaaacttgatatctttcatgttaacctacttctcaattgagaaga

SEQ ID NO: 4019 - DNA, 1600 bp, Glycine max
  Soy_ogl_5675 Gm17:13765401..13767000 Cluster 16
actagtagtaagtggtgcatcaattgttgaggtgatggatgaacttgacaaaattaaagatattgtgagtgatgaggattggctcacccactgcaattaacttatgttgtccaagtctgctagggaaatgtttgtgcattgaaaagacgtgagacaaaactgttaggttggctgaaatatgcatcttagaatggattgccatcaatgagaagttagttcgatcattgtattaggctagtgttattttgggatactttgaattagactgctatatggtgttggattactgttatatagtagaaattaagaccttaatgttattttgttatgtttgaaactaggatcatagttgttttatattaatatttgtatatgacttctatccaacctatggtgacaatttaaatatagatcattcctccactgcttatgtgcgtatgtgttcgattgttatatgattttaaatctataaaaaaggatagaatgacatgtgattttcaatgcctccattgcctactgattttgtatgcatcacttgttctatttttggaaaatgcctctataaaaaagggatagaatgacaggtgattttgtatgcatcagttgttttttttttcctgcactgcaacttgtgcaaataactagtcctgtttgaagctctttatttcttatttgaccttttttaatctacaaactgaatataatattaaataagcaaaggtaccagggttaccaaaataacacatagaagactaagaagaggctcattgaacatgcttttactgctaatcgctagaaaaaaggttaccaagtagtaaaaattaaagggaaatcataactaaaattattaatagataataacaacttgtagataatcttttatccaaaaggtttatttatagattagttacattatgttacttgtttgtttatagattagttattggtacaccttttgcttttgacaccaaataatttaaatttgatcttaaataattcacattatatttcttttttgtaattgtacagtattttcacgaaaacttatgtatatttttttattaatttttatttgcttacgccaacaggtttagagcataaatggaggattgggatggagattttgtagaacaccaaaatgaagaatctaccttactttctattttacaagatgatctacaagaggttgaagatatcagtgcattaattagtgagtatgccacaaaatatttatgtaaagagccttgtggaattatcaagcatacatgtctttcatgagttctagacatctagcatgggcatcccgttcactgttatgagatgcttcgattggaaaaacatgtatttaatcaactttgcattgaattggttgaacatggtttaaaaggaagtaagcgaatgggtgttcaagaaatggttacaatgtttgtacacatgcttggtcattgagtaggaaataggaatattcaagaacgttttcaacattcagcagaaaccgtaagtaggcatttccatcacgtattagtttcatgccatagattaacctttaattatatcaagtcacaagattctagatttcatgttgcccataaaaaactta

SEQ ID NO: 4020 - DNA, 1012 bp, Glycine max
  Soy_ogl_559 Gm02:15020701..15021712 Cluster 16
ataaactaaatctccagggtctataaattaaggtaattaaggacttagcacttagcaggtatattatatatgtgacagattgattctgtgtggacaaatttatgctcatcgaattattgagttcaatatgtatttatagatgtacatataccacgatcgattatttggttttcttgtcgtctaccgtttgagaatctgcatccagtaactagtaattaggtgatgtttgaatttcagtttaaaatacgctatatgaattctcaagtaaataattgttcacaaatttaattttgtaagaagaaagatctaaatatttcaaactttattttattccaaaggtttatttataactgaaaaacacacatccactaaatcaaatcaaatgacaggacaatgttgcttgcaatcttggcagcgtcatttttcatgggtgcggattgaatatttctctttgggtttcataagtgtcctctaaatttgtcttaaaatattcatattttataactctaaaagttaatacaatattaagggttatttttaaatagtatcttttattttggtttatatctaaaattgaggggtactcgctcttgttactgaattgaactagaaggaaaaaaaaaatcatttgatttaatcacttcaattttttcaatccatcgtccgataaatgtgttttaaaatttaaattcactctaataatcaaatccaatttaaaactgtttggatgaaattgttttcaattttagtcctttataaaaaaaagtattaaataaataacaagctatgtaatcaacataataataaaaaataacaaaaaataaattcttttaaaaaaataaaaataccaaatatcccatctataagttattatataactttgtaaaaaaaaagtgatgatataactaataataggataatttttcagatatggactattaaaagtaaatttatacaacttgataattatatttatatacctttattcaaatagttactcaaataatatctt

SEQ ID NO: 4021 - DNA, 1152 bp, Glycine max
  Soy_ogl_563 Gm02:15204030..15205181 Cluster 16
taacttaaatctaataattctagtttcatgttaattcgtccgatacttgatggtgtttgtggcaggcatatgaattatgggataaggaagaattacaacagatatgacggtggcctctgtcctctcaatcgtaagggagacacttttctaaagggtactttaattttaacatgaacctctcttgtgtgacccaatctcttcacaaaaggatcatggtcatggtgactcccactctttcttattttttcctctcattatgtcttattttttaaggtcagcttagctctcaagagttacaagagatcaagaagactatagtcatgagggagcaactactttttaatcttattcttttgtctagttttatttttttttcaatacacatttcagttatgtttcatgtttgtcacctaaaaataaagaatctagtaaaaaacaaatgttctttgaattatattatcgatagaaaaagaatataataaagcgtataaagtcagcgacgggcaaatataaagaactaaaaagtgagtaggtctactttgtgatttcaagaataaaaattatttaccattcttttcgtattaaataattcgtaggtaaaaatacgactcccttctctttttaataattcatttgtcgtgaataagccaatacaaattttaatatgatttaggttaatagaaatttattaatttattagttatatatgtaacatatcaaaacaatttacattccataaaattagtttctctaccaaaagaaaaatcgttgagacttatgatatattttaagtttagacttttttcccttcaactttcctttttgtaaagtacgtgtctattgcgtgagctttagatcttcgatgcatttttgcttttttgtttcgtaatcgctttagatttgtacaaatagcaaaactaaggaggatatatagataaacgattgaacaaataaattgcagacacaccttatatacttttttactactttaatatcaattctttttaatatttactattaaaattttactgtaaaaattaaagtcagtggggttttagtttttatttatctcaattactactaacgaaataacactcaaatttaattctctcttttattcaactctaactcctctcctttctcatggctgat

SEQ ID NO: 4022 - DNA, 1077 bp, Glycine max
  Soy_ogl_3872 Gm11:17432001..17433077 Cluster 16
tagtaatagagggcgtgaattgaagacaaaagataaatatgttagagttgtttttgaaaattaattattgatatgaagatagtttatcgattttgttttttgtttactttggtatggttaaagttttgttatatgtgtcattttgtattgctcgttttttataagcttgaaggaaacatttggtgtcgcgttaatttctttaaaagtaagatgtggttaaaaaactttttaaaaaatttctataggtgtatataataagttttgtgtaggtgtatatcataagtttttttttttatttgtaaactggaatgtttagtcttgtgtcttattgtgtaggtgtatataataatttttttttttacaagaagagatgtacataataagtttttgaatataaagatgatatttcagtactataacatacaatcctagaaaaaaatatcttgaaccaaataatttgtttaaatattcctacgaatataaaaaagattcccaaccaattttaatagttaaacaaacataatttttcttgaaatatttagaaatatcattttcatataatattcctatgaataacattttcaagaataaaataaaatgatatgaaacaaacgttttcttagttttttctttttgagaatgttttagtaggtgtttgatttagtttattttaaaataatattcattaattttgtttattgtatgagagaattcttgaagttaagacatttatgtaggcatttttttgtacaattatggcgctgaagataacaaagactttaaatatacaatccagacctctcactactcaccgacttttgtggttttagaataggcatgatacgttttttatttatttgtagaaattaaagataagtataagaaaatttataatgatttatacattttatttaaccaatcgagttaaactcttttagtgaataagcattatttaacacaaataaatatcacacatattttttattccatttaattccacactttgaactgcaaactattttctcattctgctgcaaccttgcaccaaattgaaatatgtaattctaagcaagtcta

SEQ ID NO: 4023 - DNA, 1200 bp, Glycine max
  Soy_ogl_3803 Gm11:8767601..8768800 Cluster 16
gtgagatgagataaacacatttgtggaatacaacccactttactgataaaaataaaatgcaacccagtttgccaaaattatatgatcaaaatcaatgagttggacccgctttatcatctttatttttaatttaagtaaggaaaataaaataataggagagattttgggggcatagaaatcaatccaccgtcctttaaaaaaaagaaaagaaagtaatcaacccaccaaacacgctttacaaattagagtaaattacaataaacacatatagtttgcttttattatattattatattagacatttttgttcttttgactctgtgaaaaaatatttaaattattggttttttaatgattattttttgatgattttttagttaattacaacaattattcttgtgatttatttttattatacttatcattcttttatttttcgacattacttttaaagtaaattataataatcactcttataatttgcttttattacattgagaagtcctgttttttttttatcctatcaaaacattctaatagttgatttttcatttgactaaccatcgttaatttgatttttttaaagtcaccctttaatgttttagaggtgaaaaatattagtttgagactatcaaataaggaatagatggtttttaatgatttttttttgcctaaaatatttttattcgtttattttaacttcgtaatttctccacattaaaatgattgtgaaaaaatacatgtgcttaaaatgatttagttaaatttcaataaattaaatcaagatttaaagtttaattaagtaaataaaaaatatatataattgaatattaaaataactattgaaaaaattcttcatctcattatttaaacatcatttttttagttttattttttctttcataaataaatgtttttttaggattaaaaactaacaattaacatatttttttaggattaaaaaatatgaatgaccagaataataataaaaaatcacgggtggtcattctaatttactctacaaattatgggtcgttttactcgaaagtcgaaacacattttcttgcaccatttaattgtagcattaacacgaggaattataataaagacatcatcaaaaaactgcacttaggactgtataacattacaataataattctgtctattatatcatatgtgtttacgggtgcataataaaaa

SEQ ID NO: 4024 - DNA, 1185 bp, Glycine max
  Soy_ogl_3068 Gm09:20831816..20833000 Cluster 16
tggctctcagagaattcagttgaactcattttaccatgaaaaaagttttgaaaattagattatacaaaatatttttagttatatagagacctaattgaaatgaatataagtttacccttggaacttagttttgaagtcttcaattccaggtacaacttcattgatcagcagcttggaagaataccaagaatttgatatcgataaaggataagtgtctgtcataacaataaatgacagaatcaggcattatccaagtatatgatataccatagtaataagaaaataggtagtgtatgattgggtacctgaagttttcttgatctttgcatttgtcaataaaataatcattgattcgccacttgtcctttgattatcataatattaagcaaactctacaacatggtctgacctaagagtacaggaaacaaccttgccactatattgtacttgtaaatacaataattggaatgtaaacatttgtcatgttaacaaaatataaaattaatgaagtttgatttaatataaaaaatgacctcaaatctttgagattaaacacaactttctttttctcagcttgtagtgcccactgagtaatttggtctacaccacctattacatctatttataaaagtacatgatgttatttgatgggttatttgtaaaatgaaaacaactgaaaatgcaaagttattaaaaaattacctactaacacatcactctgataattttcactaagtatctacgagaaactcttaaatcgatacacattaacagggatatctgcaagaggttgctctattacaattgttgctcctgtgaaatgtagtttgaatggatggtcgttacttttgtattatctattgttagaaacaaccttgaaattatacatgatataagtagttccctgtttcaactttgcctcccatgacaacagctcatcttttcttcccacaacctcaattttgtcaccttatataataaagagaacaaaaaaagaaagaaatattcattacattaacaattctgccatcttacaacaaataaattatgcatgatataaatacctttccatccataattatcatttcaaaatgccttgggttatcctagtgttgcacaaaccaaagatcggttactcatatagctagcttcaatgtttcccttttcccatctatttctttgatt

SEQ ID NO: 4025 - DNA, 1200 bp, Glycine max
  Soy_ogl_6511 Gm19:42404601..42405800 Cluster 16
acaaataaatgtaaatttataaatagtttttataagtaaattgcataagaataaaaaataatagttcaacaattaaaagcttgcacataacttaaaaccacttctgttttatttagccaaaacaaaatttacttccgttttctgctaaataatattaaggataccaatttttctagaaaaaaagaaaagaaaagaaaacgtagaggtaatcttattgtgagacatacacgtactaatagaagatggtgaccttgcaaaatgaaaaaacaaaattttatttctctcgcataataaactatatatattttccctaccgagatatactaagagacatgtcgtcacaactcacaagctgataaagttatattaatacttattttttaaaagccttgtttacaggaacaaaaaagcgtactttaatccttaaacatcacataaacaatctatatattcatggttaacaaaaaattttaaacattctaccagctgaacatactagtagaaaagagaaaataaaaagaaaagaaaaaacaattctcctcactatttaacatgaaaccaagaccaagacttgtattaaataaaatcatgtagactacacaaatcaacttctacctgattgaaaatgaatttgttaggcagtaattagaggaaccacaagacaccaatggcaaaacatcaatttagcacggttatatatgcttcttgccatgtaataaaccagcatatatactgcatgtaatgatctttaactgaaagtagaggggagaactatgtatcttagaaccgagtccgagcccagcatagaaagcatataccagaccatatattgatgattgcctacgtgtagaaaataaaactgaataaaggattcttatcacagttaatcaagcaacacaaaaatgtattaggtacggtgcattaataatatattaacgcttatttaatttttatcgcctaacaaaaggaaatgttggtaatcgaaattgagtaaatgttacaaagaataaggaaaatatttccaaaacttgaacaaatagacggagtaccatatatgtgctcagactcttttaagttgttcaaaattttgaatttgacatcttaccctacttttgggaaagaatatgaacctgcgctatgttaaacattctgtcatggatgatggatgtcaaattcaattcttttttaaccttttatgaa

SEQ ID NO: 4026 - DNA, 1000 bp, Glycine max
  Soy_ogl_4499 Gm13:36966101..36967100 Cluster 16
aaaatatgtgcctttttcttttgtgttgattttgccttgcttctgagaaatctatgatcatttgttctacctaatgtatatgcaagtgggtttacgtaattaagaaggcctagtcagtttttttttttttgtggatttaggacactgttgctttcctctctgcctacacaactaacagtcttcactcttcaactatgaaaggagggtgagtctttgtccttttgtcaatatctcaaatctgaaaatttgggtggactggctttatgtcacatataatcatatatccaatattggtattgataaagaggacaaaattaagtaggtttgaaaatgttggtttattattattattaagaatgtatattttgctttttaaaattaccagagtagtatactgctatacttttaacctaaggttatattggtttgaatgatattgaatttatatttgttaaattaattcttgagtttaaactttgtgaataaaacaaagtgaatatatcttataaaaaattaatatgattaggtaagtttttaagtagagattaatcataaaaaaatcaataaatatttcgcaactataatatggtaatccaagaatgtagtataatataataaaaaaagttcttgtatgagttaattttagttttgtgaaaccaatttcggcaattaaaaaacgtcacagtttttttcggtgaaaaccgtccaaatttgtttttacaaaatcaaagtggattttcaaaaaatttattattgccatgaatttaatttttttaaaaagtatattactatagtaattttaaaagtaaaatataacattttagtaaaaaggcaaaaaatgagttgaaccctagacgtcaggtacaactgggcccaattataaattgaaaactaagaagaagaaaaacagggtcctatacatacctgcgaatggcccagacatacatctttttttttttttctgtaatcaagttcactttcaactgggacacaaaaagat

SEQ ID NO: 4027 - DNA, 1317 bp, Glycine max
  Soy_ogl_6256 Gm18:58770884..58772200 Cluster 16
aacgttgaaacgatgcattgaaactcacaaatgactaaatagtactagaggaagatgggatgtgggagcttcataaaaaacaaaaatgtgagagtgcacctgtgagtgagattgtattttaaaaaactatgttagcactacttatatattacattgatcttctttaattgtttgaaaaatagtattacattagaagaaattcatgtaaatgttaaaaaatcaaaaaagtatttatataatttcacaaaatcgtctaggtgattatcgtaatttattctagatttactaaataatgctccttttgttttaaaattaagcataattttacgttttgtccatataattttttaattgtacaattttggtcactaaattttttttattacacattaatttgatcttagcttaaaaggaattttcctaaagagcctttgatatacaaaatgaaaacaatatgtgacaatagaaaatcatagagttctaaacactacattcaatccttagaaaccaaccgagaattccatagaatgaatgactgaaaacaaaagttctaaattgttacatttatttttttctttaagcctcttcagtctctcatgcaagtatatattatttggtacttgcctcattagataactacaacaaattaatattctttctgaatcaagcctttaatatttaagcatatcacaaataaatgggtaaaggataaccataaactattgttttattagattgatatacaggtaaattgtctaagtgcccagagaatgttccaagaatttatataaaaaaaaaagaagttaaaaaggaattgaaatacatttttttgttgatataagttcactatatgttatgcttttaattatgtcttcacttcagttttttattggagcttaatatacccttggagcttttctcttttcttctaaaactttgaatgttggtggaataaaatgtaacaagttgagttttcaccaacttgcaacatatgagctaacaaaacattgtgtttataattcttcttagtcattacatcgtgtaattttttttttacacaagtgatcaactttactgaagtgttatctcatctgctttcttttattcttttttcacgccttgaggtaagagtaagtaaattctttgtcgtttatttcttccagatttagaaaaaggtgacgagacatcttaaatatgctctgtagaatacttttttcatcaaaccgttctttatcttatgatcatctttaaatgaacaaaacatataataatagggcttggtgagtcttatattacaaaattatgtttataggatga

SEQ ID NO: 4028 - DNA, 1027 bp, Glycine max
  Soy_ogl_4658 Gm14:4903901..4904927 Cluster 16
atatttcaacaaattcttcatttttttttattttaagattaatataatgaggtcttttgagttccattttaagaatttcaaatgaaaaatatatcaaacataatatctttttatacggagttgtattaaataattaaaaaaattatcatttataatattcttacttgatttgatttgagaaagattatttattgtgaaaagtgaaggtggtcttgtaaaaaaaacataatattatttcttcacacaaaattcactcgttgttcttaacaatatttttagtttaaaatgaatactaacaagtgttcttaaaaaagcttttgcaagtgtaaaaatattaattaaaaatttaatacctttcttgattctcaatgtattaaatataatattttgttaagtattttctatttttataatttaattaaatgttcttaagatacttattggttgtattttttaattttaattactaaaatatttttttaataaacaaatgatgtgtcgaaatctaatatgtatcaaaactataaaaataattaagttcagtttctaaaaaaaaaaaaaaaactcaatttgcgacggataaggagagtgtttttctcaaatatttatatttaatgtttaaaattattttcatgattaatcacattttgtgttataatagatattatcaaaattactttcatttgaaattccaaatgatactgaattaagatctcttatataaagtattgaattcaaatcttaaaaatgaaaaaaatatgattaaaaagataaattttatgaataaatattatataaattattttaagaaagtcttatgttatagcgagagaaatagagaaaaaagagttatattttttttctagtattcatagttatattatttttattcatctttttatattacttttttatcacataatttatcttatctcatacttatatgtcttttaatttatgtatctatcttaattataaaaaggttataaaagtatccgtgtttcagtaaagagaaaagaaaagggat

SEQ ID NO: 4029 - DNA, 1309 bp, Glycine max
  Soy_ogl_188 Gm01:47753001..47754309 Cluster 16
tttgatttgattttactctaaacagtaaacagtatatttattttccaatttaatccattgcattttctgttacacttcattacacctactttgaaaacgtcagaaggaaaattggataaactcaaaacaaaaactaaatttcacaagtctaaactaaagtattatagataaaattatttaaaatattcaaattgaaaaatacaaagaataactgtgagaaaaaaaaaggaggactttgacgcgaatatccttagcgaaaatctccatcttaaaatgttaaaagaattaaaaaaatcaatgcgtcacaatcacaacaaagataatagaaataataataaaagttagggcgattaaaaaaaaaataacaacaaagaaaaactaggaccgaaaggctttctcataggtagattgtggtggaaaataaataaattaaaaaaaaaaccaatgttgcctgttagaacgaggtgttaaaattttcactttgaaatacgtgtaagtaaaatttacaatattcattatttatttatataaaaataccttcattatttatgcgtgtcaagtgtgtgtagatttttcatttaattacatttattcaattcttaattatgtttttttaagttacatataatttgctgatatgataaggtaaggatatgtgaaaagggatttttttttagagaggaaattaggcaaaggcaagtggggcttgcgttttggaaatcataaagcatataaatacataaaataataataattagtcactctaagccaaaatcattagattggatctatctatgtgattggcgaagcccgcaaaagttgacacttgaaacaactcaagttttcaaactgagttcactgccgacacttaattgtattgttagagagatgtggtgaagttgtttaagattattaattttcatacatcatatagttttttttaaacattagttatgtaaactatgttcaataagtttaaaaatattaaatacccgtatttaaagttatataacatactcaaccaaccatattattcaatcaactaatagtaaaaataaataaataactatcaaatgtattagatgtcttaacacttatcttaaaaatgatttttgaaaatgaaatggtaataactcggtatcatgactttgtttcgtaaaaaccaatacgaattcttttttggctgaagaaaaaaaaatgatgaaatattcgttgagcatttgaccaagcaaggagcatttcacgaaaatcataattgttaaaagcttatgaaataacttcctgtgtgtaaaaaataacttaaaagaag

SEQ ID NO: 4030 - DNA, 1010 bp, Glycine max
  Soy_ogl_4174 Gm13:20884391..20885400 Cluster 16
gcaaacttatcctttctaaattaagattgggataaaacatgttaaacatttaattgtaaccaaaccattattatgctaaatattttttattctatgtacttttatctcattttctaacatgaaaatatttatcaaatactaaactagtggacttataaaacacttaaaaagtatatttcataaatgaaaaaaaataaccaaattataaatattcaaaacaaatcaaattcaagctttatgtttttttttcatcctagcaagcaagcttaagggtgtctctttgaaaataaatgagtaacattaacacacacacatataacttaagttttttacgtctgtttaactctacttgtttacatcaccatgaaaacctataaaaagatactgtaaaaaataatgcaattttaattatgaagatttgaaaggtttacggatactttttttgattcataaagtttcatttaaataggaaaaaaaaatacttcactcctcttataatccactcttctcttaactcgattttttgcatttatttttctttatttaaatgtttacataataggagaaaaatgtgtaatttaaattaaatatgaaaaaagtagagtctcaaataaattgctcctaagtagggtgctagcaaagtaggtaacgaaattctagcatgaaagtttttttttttttttgaaagagtgacacctgttatggctttttagacttgaaaatggaagcatgttattgtggaagagccaatctagtctctcactgtgggaaaaacatcttagtcataagatgtattttttttcttgagataagtgtggatgtactataaaaatgatctttaaaaaaaaaaaaaagacctatctttcttgttgctttgcttatggattctgagacccctttccccatttctccattattgtatccatctgatttatgtcatcaatttggataagccacaatttattcaccagatcccaaattaaattacaaacaacaccataaaatatttt

SEQ ID NO: 4031 - DNA, 1051 bp, Glycine max
  Soy_ogl_3869 Gm11:17408850..17409900 Cluster 16
catttaagaccacttgtcatcttcaactatccataaattcataatattcaaatttcaaattatatagattaataattattgcacaaatgatggtttaacattttttaaaacatttttagataagttaaatcacccaacacgaaaatcagaaaaaatatgataagatgattttttttaaagttatgataagattctcgttgagttagccaaataatatgattatgaaattgaaaaaaattagagaaaacaagacttggattgattgactccttatctttaagccgataaagtcataaaaaataatcaaaagaaataaataattaaacaagtgtaaggaaggaaatgaaaggtaaaagaaaaaaactttcggtttgttcgcatattctatcctcaagacgcatattcatactcaaggaacatgaaggtgacggaacatgtgagattattttaggaaagaacagtcataatcatgcaatggttagctaagtatcttaagaagaaaaagtaagattctacctgttacttgggaagtctctcgaactcaaaccaacaacatattctcaaattttcttagatagtgtttgattattttcatcttggatatatttaagataaaaattttaaaaattaatgagttcttacatctttacattttatgttaattaaaaattttcatttcatttaattttttttcactttcatacctttattcttttaaactaagcatacccttaggcccacagatttaactataatgctggtaaaaaaatccttaaaagaagtttacatagataaaagatttgtaaaaagttaaaaacaaaaaatagtcaaactactatttgaattaaagtaaacatctattttctttctatagatttgtgttgtctaatagttttagaccatttcttgtattatttaatatttttattcatataccatatacgaggatgggagcatccagtggatggaagtgggtcaacggatggaaacatctattttcttcctaggaatttcttgtgttgtctaatagttttagatcattttttgtatt

SEQ ID NO: 4032 - DNA, 1047 bp, Glycine max
  Soy_ogl_5003 Gm15:11741201..11742247 Cluster 16
ttttattttgaaattatgttgaattaatggtctattttagaatgcttatagaagctattatatttagtatacagaaaaaagtattttttttaaaaaaagtataattattacacatttttcaatgtgttttagaatttaaaacaagtgttctaaataaaatgcaaacaaaaatttataaaattataacttctataatgcattgaagtttcatatttatacaacaaacttactttactttttatgcgtttttaataaaaagtatattaatatagaatgaaaaatatgagacacaagaataaattttaaattaatgaacttataattacatgaaaattataatatgtaaaccatagaaaaaaaatttaatattataatttcatagatgtatttttatatatgaattatatgctgatatatttatatacacacacattttggtttgccgtaggtttaaaattaatttctaaatctaatttaacttatgaaaaaatattttttatattcaatttattcaatctttattttttattcatttttatcatatttattggattgatttcgtttattaacattcctactgattattataacttaccctttgcttggtaaaggggaaatacagtggagatgagagaaaatggttggaaataaaaaaagaagttaatgtatttagttgaggggaaatgagagataaaagaaatttaaagttatagaacccattagtcattcatatttctactcatatatttgttttcctacttttcttaatccagacaccttcttaggatctgatttaactaaaaaactgaacatatatttataagagtgattaagggtttatttgatagttaagatatgattagataggatatgacaatcttatcatgttgtaattttttatttgttgcgccaaaagaatatgacagtgttatcatcatatcctttaccctattttattgataattatagtaatctttaacttattacatagtaaaatatatgaataatattattatgtaaaatactctcacacacacacacacacac

SEQ ID NO: 4033 - DNA, 1200 bp, Glycine max
  Soy_ogl_2760 Gm08:18906901..18908100 Cluster 16
atctaaatgaatatttattaattctttaacaagtattttttttagaggattaacaagtatttcatatacatactgattaacaaaacggtaaactaaaataggaacaaaaacattggattaagaattttgctgttaccagtttcatacaattcagtatttgaattccagaaaatatgaagaacaaattaattacgttattagaattccccttatggcatataaatctcctctgattagctgatatttcaaaacttttttttgtagaagccctgatatttcaaaactacgtaacattatctattacttttgttttttgcagtaaaaaaaaaaaaaaaaaaacctctattacttttttaaaatttaattgcgaattccgtataacatatagctatttatatcaaaagtatttcatttcacttttatatattctaaaatataaaattactagtttgaaacttaactggtaaagggatacgcatacatcaagagatacgcgatcttttcaattccaactttgcaaattacgtgctgttatatctaattataagaaatctttcataatttcttagtagctaagttgcctccttcaaataaaataatgtagccaagttgcctataatgaatcatacgggaaatttgaatttagtcaaggcgtttgcaatccagcgcaaaaaatacttgattgcgcataaaaaaaaactgaaatatttgttcagtgattctttaattagcaaaatcaattagatgataaatttaagttgcctacggtatagagatataaacacaaattatttgtttataaagcgtttaccaaaaaaattattataaattaaacgatacatcacgatgtcgccaaataattcagaaaaaaaatgtcaccaaacaatttcactggtaagcaaatgttttagataattttcttaaacaaaaatgtaacatacataatttaggctatgtctttaagaagtactatatgatctagaaaagaaattaaaaaatgaaattaatataaaactatatgaattggagataatcatatatagagagagatacaaagttgcaactcatttgcatatgatttaattaatggtcatgaatataaatcataaataattataagcgataaggggtaaaaaaaaatagcaggagaaattggaacacttactgataaatattcataacactccttttttgaatcta

SEQ ID NO: 4034 - DNA, 1000 bp, Glycine max
  Soy_ogl_4183 Gm13:21209501..21210500 Cluster 16
gctacactgaatcgtggtaagttttgtacattttggaatcgaacacaccagaagtgaatgaatggaaactgagtaataatttatagacaatgagcgcgaaacagaatgggaatttcaagaatgaaaaaaaaaagaaattaaataaaggaaatgattttatttttatttctaattaaaaaattcaccaaaggtcaaaagactttatctttcttctttcttactccaccaataggcatagaggtgaagaatgtcgcaacattcaacagtcgagattaaattttttggataaagatgaaccctaaacaatgtttatttgtatttgaaaaaaaggggtgatatagttcttttatataagactttccacatattggagaaagttggattcttaccctcctctataaaatatttttacaggaagttagaaaaaaattattctcatgaatcgtaattttttaaaataatttttttaaatatgtaccaaatatgagaaattaaatttttccatttaagattttttttaaaagttaaaatttcacctagaccaacacccccttgtagtattacattataaattttataatgtttgtcacaattacacatttaaaaatacttttcaaaatattgtttagattaagttatacttttggtacttttatcttttcgtttatatttaatttagttttttttttctttttacaaaattaatttagttctttatattattaaatttggttcaatttttgacaattttttatttaatttgtaaaaatggaagacaaatatcgaactacaaaggtccattaacctaaacgtgtttttatttcacaatcaatgatttgatatataaaaaaaaatcaatgatgagagagaaagattcaatatgtcaaaaagtaacaagctttttttgttcttgttcattttcaaacctaaacgtgtttttatttcacaatcaatgatttgatataaaaaaaaaatcaattgtgagagagaaagattcaat

SEQ ID NO: 4035 - DNA, 1300 bp, Glycine max
  Soy_ogl_5673 Gm17:13646501..13647800 Cluster 16
gcattagaatcttctttcagtttgttgtgatctcaggaagtttttggtaatatgtcttaaattccggcttttagcaagcttttttgggtttagacttttcaaaatgttgactaagacaatattaatagattagggaagcttactaaacatggtgattttggccttgacataattttgccagattaacacagcttgcaaaattgacaatgattgagcctgacactagtcttcttcgtatctctgagttgtatttcagttaaagttttacctggtgatgttagttggtgctccatttcttgcaatgtttgctacccatgaattttgttcaactttcacctccctataaaggaaaagaacactagtttctagccttacttgaattgccttttcccttacttagcctttttcactctggcagttagtggctttctgctaataattataattataaagtgtttttctaactttgtaaataagatagaaagaaaatacctgaaacgccaactaaactaactttaattcctgaatatcagtataaaaattttgacactattaataaataaaaaatcaatgttaatataatttttaatttttaaaataagaattataaaagttaataaatttatcatatatcataacttataactagataacatttatgcctactgattattcttaattcaacctggtttcccttcccctaaatttttacatacaaaaaaaatacagggtagttgaatgtaagtcggtagttgtttctgaaatgcaatgcggcgattctattaagttaagatctgaatcgatatctgaatgaaactttctgcacctccaaattttgctccaggcattccattacattatatggatgggacattccgtaatataatgaaatataaaggaggtgcaggaagaaacactcttgatattgtaagggaaaagcccattgggcaaagtagtgtttgccacaagcccttctcaacaagcatggaggcccaaaatggaccattttattttatttataaacaaaagaaaatgcatcgaaattaataaggacgtgcgtggagaaaacgccctgacaaaggcgttacacaatgattcatgtggctttatcacgatgcatcaggtttcaggcccatcagcatcagattggaactagagtttgtgacttgtttttctttttccacgccacaggatggggcatcatccttcataaccctgttgttgctgaatgctgatttttacagcacaaaaaaacttgaagtaaaagggcatgcataataaaagaatcagaatccccctt

SEQ ID NO: 4036 - DNA, 1260 bp, Glycine max
  Soy_ogl_2723 Gm08:16239001..16240260 Cluster 16
tattgtttattattttgaaatttaaaatcgccataaatcatattttaaacacacactaaaagttatttcaacaaatttttttaacagtgtcaaacattgagattaaaatgagttatttttaaattagagagattaaaagaaaaccacatttaaaggtcaaaaaatatatatatttaagcaaaaaaaatttaaatcaaaatttcactttatgttgaattctaaatttggagagatacccattgcatgaaaagcaagatttaccaaaattttttatttttaataaataagtttcagccggtaataaagagtgttataaggagtgtgctagcattcctcttacaatatatacagtcaaaattatcatatcttatttttatttaaagatattgatgtcattttataaataattattttctttttgcttctcttttgtcttcaattgaaccactatgtaataatttttctttttctcactttatttagtaaatcaaactaaacattagaaacaagccttcaattaaatacaacttaattaaaattttcaataaatttaataaaggaaaaaacttagatacaatatcataagtattgttggtgttgtttttaatatttaatagatttgaagttttgtctgaacaatatgcgaaacaaaatgtcaccacgtattatagagatgtgaacaatttggaaagaataaaagcaatttatttctcccttttcccaagggcaaccacaaattatttggttgagtgaaaaacataaatttgttatattaacattatttttgtttagtaggagagaaactataaaaaaagaaaaaatattttcttttgctttttctttaaatcaaaataaatgtgattaagatagcgatacatgctttatgagagaaaattttagtttgacctcatataacacatcctaaataaaaagagaaagaaaactttaaatataactaaattttaaacaaaacattaatcttagctcaaactcaaactactgaaatttgaaacaatatcttaaatctcagtgaaaagtcaaagatctaatttaaaaaatgaataatgcacgttcagaggtggtgacaaatgatctaccaaaaaaaaaaagcattgaaacctacagaaaagagatggtgacaaagggtggtgagtcaccgacatatatcttactgctacaagctaccatcatatcatctggatagatttttagaagataaaaaaaagtgttccccttattaatataatttactttgcctag

SEQ ID NO: 4037 - DNA, 1041 bp, Glycine max
  Soy_ogl_639 Gm02:44102701..44103741 Cluster 16
aataattcttctttaaggatcttttgaattaatacagttctctgttttagagtagttttggttgtttttaatgctttctcccaagtaagacttgctaagaatgatggatgtataaatataatgaggaatcatatgtttatgctcggattaatttcagttaaaattaattattatattttgccccgatggaatctcatatagctgcaaaagtgtgcacatggagattagttcaaagggatatattctatgctaaggaactagatggagtcttattttactgaaatttgaacttccaatacacatgaatttaacaagaaaatatgcacaaatctaaataactcaaatcttaaaattattgcacattatatatggaaaaaaaaaagtgttatggaaggatctttactttgtttttcatataaaaaaagtcttaactaattagtactatcgatataatgtggcaatatagtgttgtatattagaccgataattttatctttcactcatgtaattagaaattcaatcgttcatacgtatagaaaaacatatattagaagagataatttcttaaataaatcttaatatcttaagaataacctagagaatttagataagaactgtggagaaaacatctaacaccgtgcaaaaattaacaagataatatacacaaaataacgcctaaataactcaaatcttaaaattatcacacattattgggaaaaaaaagtgttatggaaggaccttaactttgttttgaaccaattaaggatgttaattttaattaaaaaagttttttttatcaattagaaaaaaaaaataggtcatatatgtatttattatgttcatataggagtacattatggagttttcatttatcattagtatctttgtggttttagtttatttttattaaaaatgaggtctttaattcgtaaggaacaaattaattttttttatatgtataaaaaatatttttcatccctaccatttaaaaattaattctgtttcaattcgaacctattaagggcattattttttataaaa

SEQ ID NO: 4038 - DNA, 1000 bp, Glycine max
  Soy_ogl_5324 Gm16:5558801..5559800 Cluster 16
actcgtgtaatttattaacatacacaaacttttatatatatatatatatcatttctaactttttgtttttttttttgcctatcataacatttactgtatttatcactaacttattttgcttttttttttttcttttctttaccacatttccctccaaaatgagtttatttcgtttagtctttctctttaatgactttggaacatatgtagccaatacaaaataatttaatttccgtccataccaagtcaagtatagcaaacgtggaaaaaataaataaattactgctagcttagaatttttaatttccgtttaaaaaaaaccttagattttttagtgttctttctacattttcctacaagtccaatggatgaatttttatgtgattagattgattatgaaatatcatgaccaaaactcttgacaacaagataatcaattgagcaagttggccatattcaagatcctcatacatcaatttgagggtatgtatattaggagaatcttataataaagtgattcaactggcatatgaagtgaaaatctctctgttgtctgagatcgagatcgatactgcataaagatatattgtgagagggtcgtctctgcatgtgaaagtaacgacatataattgataaagtgaaaggattacaagttttgatttcaatactatgggaaatagcttctttcgttttgtttgcttgcatagtactatgggaaatagttgaagaataaagagttatggatcaaaatattaataatctttgtaaaaattagaaaatagattattcattaattcctttggagaatatgaaaatttagaagtttgagtgatattgagttgtttgaattcctcttgacaattcaactctctatttactgataaactattaaacaatacatcaaattcttgttcactccattacagctcctatgcattttcccagcattgactaaggaaatataactagtcctagaatattaggatacttttgtataaac

SEQ ID NO: 4039 - DNA, 1000 bp, Glycine max
  Soy_ogl_4288 Gm13:26790301..26791300 Cluster 16
gtaaacagcgtgtttggatttgtgttgggatttaccttttttgtaataaatctacgttaaagtttaatttgtaataatgaatcaggagctaacaagaaatactagcttctccagcttcatacgcgtgtcggatcgttcattgatgcagaattgcagacgccaaatcaaacagacaaaaaattgattttaaattaaattaattgtaaatgatgtaacttattttaaatgttttgattctaaaaactagtaataaaattccgtataaaatctttttatcgaaggaaaaggttatgtaattgcttcaaaaactcaatcaattcttaaacgtgaatcatgttaaaatcacattaattgatattaacatgattttctttctattccaacgtatatattactagttacattattaattatctcttgtgtgcttttctaacatgcaggatatatacactataatttttagtatccacaaaacatttttttctctgtatagttcagatcaaactgttacagaatacaaataattctaaactgtaaaaaaaaaacctaaactcaacacttatataagcacatatcaatgtgtgcaacactcgtgtatctctgacaaatttgtacacctttaattacgtgcagaacaatatcgcatgtacgttgataggtagaatcattttttccctaatgatatgggcgactataaatcaggattgaggctaaccaaaagactactatctagaacattatcttctaaggttagaatctctggtcaaacaagagttcacatttagaatccccttatgtcgtttcgacatatctcaaataggattatttaaaaaaacagtaaaaaaagagaaaaacaataaaattacttgaatatttttttataaatgataattatcttcactatcaacaatcttattaagtagaagaagatgattatgtatgataaaatattttttgagcaattacttactcataatacaaaggtgagaactttaattaa

SEQ ID NO: 4040 - DNA, 1000 bp, Glycine max
  Soy_ogl_4177 Gm13:21041401..21042400 Cluster 16
cggcagtgctcttctaatggaaatttggaattaaatcatccatttatgatttttctttttctttttagttataaatattacgtagtacttcgattaaaaaaaagttaacgcttaattaataaattaataaaatgaatagtggtgctatttttaatcatgcgtcactttttaattgtagacgtaagaaaataaacaacataaacataaaaattcaatccatttctatcatgcataatttgatattttattttaggataaaacatttgtagacagactattatttttagataaattagtacgagtaacgttgctacctcttgagtaaattacatattttgtgaaattaaaatatataaggttaatatttgaatacttttctagagagaaaaaaattacacaagtttttggtaaaagagaaatatttggttagagagaattgacagatgagagaaacaaaaaggtctcgagcccgttatgtatgttcacaccatactttagtattttttttttttgttcatttattaatcctttttatatttctcctgtgttttgtttggtacagaacaaattaggaggaggaacactgataaaaattatttcattacttggtagaaaagatttatagggtaaataatttttaaaattatgagactaactgtactatttttttacatattctcattaatttttttatttctctctaacaaaacatttttattttacttttttatctttttttatccattcattttatttctctcatgtctattgagcaggacatcaaatcaaacattttattttcactttatttccatatttctatctattttattttatttccaacatcacggaggatgcctatttggatggttgctaaaattgttacagtggtcctcttgagacagttctaatgaataaataaggatagtattgctttgccaacgtacgttgccacgttagaaacggtgacacacaaacatgctagatacatgatagaagc

SEQ ID NO: 4041 - DNA, 1126 bp, Glycine max
  Soy_ogl_4246 Gm13:24270675..24271800 Cluster 16
atttttaaaattaaatatcaccattaaaggacagtataaaaaaacacaacaaaaaaactggtcctaaattttgtcacctacaactgcaacgtgcgttagtctgctcttcgttatcaatggtgtttttccctccagatctccaaccatggcgtcttcagtgtttggcttttgctttttagtgactaaataaaaaataagcaagagagataattgaagaagaaaagaacatatatgagataacgtttttataatttaggaataaaaaaagataagaaaaaatagttttcataataataacattcttaatatatgcatggatttttttttaaagagactcttataaatgtattattcttattattggttctttttataagatttaattaattaatttatacagattaattaaattagttaatgtagatagcaatattaaatttgccttgaacgtaaaaaaaatgtcttgaacttatatatttttcaaaattattcttaatattagtgagacggatttttatttcttttcaaaatatttttagttttgattccttttaatttctttctatcattaatatatttgttgcttcaatttttattggctataaatgtgaatagtgaaacaagtttccaaaatattttttatacaagataaagttagactactaacaactaaaaagcctaagacattaatgactttcacttgttattcagtaaactaattttttttataaaaaagtaataattaaaaaaatattttagatcgaaaataaatcatgttcattttgttaccggctctaaataattacaatgcgtaaccttttccatggggacgcgcttttccatgggacgcggttcgaaaaagttgaagattctaacgcggaaggcgcaatacatgtaggctaagagggtaaacatggaccccaaaccttgatgcattttgcaaattcgttggatagttagaaaatagaaattatgtcgcttgtgaagttgtgctataaaacgtagaagttataattattaatttttcagaaaatgaaaactcacgtctaagacttggatcaaacacgacattaatacatgcttactccctgtccgtgctaatttggtcttgacctagttatttact

SEQ ID NO: 4042 - DNA, 1000 bp, Glycine max
  Soy_ogl_6800 Gm20:36921401..36922400 Cluster 16
agtttgacagagctgtgtccgaataatggaatactagctattaaccccctagtcctaataatcaacctttatgattatcatactgtgtcatatttaattactaaacagagctgtgttatttgctcaaaattgttctagtttagggagagtaaaatacttggagtgaattgaaacatttagcaacatttagacaaaacaaagaagtacccataccatacaggtttcctttgtgtacttgtaggttatatgtcttaaaccgagaggagaagaagaaaaaattgaatgggggagaacgagtgaaacgctccaagcactaactacaacactagcatataccaaaatcaaatccaagttcaggtcatataccaaaataagggtaacaaaactcagctgtatatttgagaaaaataggtataaacctttttcaaccttaacatgaatggtctaatgttttttaagaataaacatagcaaacagtttacaagttgcctcaaattccaatagggatttttaagataagaaaacttcacgggggcttattcctatcctaagaaaacagtattggatgtgagttgtcacggagtagaatataatccattttatctttgagtgcaaccatttaaattgttttttagcagtgctatatttgaaaccaactcgtcctatgcccttaaggcatttcttatatgtataatcaaaatggtttacaaattcatcataagaaacgttgaagataaagacatttatatagaagcctattttctgaatcttaaaataacatacaaactatgaagaatagattcaatcatcttttgagtgtatgtcgttggtaaaaatgtgcaatctttggatcagcctagaatttacttgagtatcttgtggtcaaagtgtatagttttaagccttaacagattctctttcacgacttgcgttagttgtgttagaatgtccatcggatagttatatttgtgattggctttctatactctttatatttagt

SEQ ID NO: 4043 - DNA, 1100 bp, Glycine max
  Soy_ogl_2677 Gm08:14215101..14216200 Cluster 16
tttttttctttctaaaatcaagtagctatttatattaaagagataaaggttattttaaattaaatctttattttcaaaaaacttgaattcatatttcttaatcattataaatatgaacttttacctaagagaaaagtgcattaaacacaaactagaatattcaaatagagttgagagtctaagtttataataattagagaagttaggtgcctacacaacatggatcattgatgtgtgtgtaagttgagaaagatagaataatagagttttaattgatttgttattcccactattgagagtcattgttagcaaagatattgttgaaggcttgtagccttaaggtttatatatgagaaaaatggagtgtctttgttaggttgtcataggtgatggcataactagctcagtgtttctttgtcagattaagtaaaatgtgtgatctcttaggactaataagtttagggagggaaaaattttaggactacttaatattatttatatgtatacatatgcacgaacttcaatcctagggatgacaactgggtagagccaacacgaatagtatatcctcgctgcccgctatatacccgcttagaaaattactacatgtattcatggatattttgtaaaaaaataaaatattttttttaactattttataattattccatcattttaatatccagtgcaagagtgatgagtctttagaatcaaaatgaaattaacctatttaatattcagctgtaggaattacaagttaaagtccaaaattgattcagataacatgatgagtctatagtattagaaaacacagacgtgatatgatgacatataaaaaaagaagacttaaatgcaactttaaaattagtcaattaatgaacttttgatgcatcagtataatcctagaaatttgtataaattcattgttatgggaaaacaaatttttgcccaaatttctactaactatgcaatcaaagttgatatgatattacaaattaagttcaaaatagagttgagagcctaatactattttaaaaaaaattgaacaaatttactcatttgcaggtaatggatatttacggatatggatagtgtgatat

SEQ ID NO: 4044 - DNA, 1000 bp, Glycine max
  Soy_ogl_2994 Gm09:4531001..4532000 Cluster 16
caagtttaactttttgtatatatgtattttgtcactttctcattctcttagtcttacttttccaactttcctcctctttattatatgtattataagcctcatcaacataatttatgtgtttgaattagattcatagtgggaaataattaattaatttttcaaggtaaaagtaaaataaaaaatagttgcttttacttttttatggtgtcacaccatgattttatggagtataattaattcttgggttgtccaaagtccaaaattaacctaacaaataataaaacaaaatctaaaatgaacaatctaatcaattctattttattttggaacattgaggaatgaaaaagaaacagaagtccgattcggcaagaacgcatgaagagctgcatctgccatcctggctcgaaattgacacataaatttgtagattttatactagtattagaaaatgtcgtacctaacttttttttttgaggtagtcgtacctaataaccttaataatacatctaactttcaaaaataaataatatatgtatatttatttttacaatatcaactttctgatcatctctatatgaagtgaattttgtcaacacggtttttttataggcattttgttacacacgtttactataagttttttccttttttttttttagaaaaacacgtttactataagttttttcctttttttttgttgagaaaaacacgtttactataagttcttaagggaaattctaatcattcatcactcagggatgtcattttggaaaagtagcaacgggtcatgtatagtttggggtagcctggtccatacgagttgcaaagttatttagactcgggagctactattcttaccccaaactttctattttcaccacccccgtgagtaacttttctttattcaccccaaaattactattctcaccaccctcgtgagtgacttttctttattccaaaaatatccttcccatgcaatcatgaatcccttaaaaaaaaa

SEQ ID NO: 4045 - DNA, 1408 bp, Glycine max
  Soy_ogl_5401 Gm16:31914701..31916108 Cluster 16
caaaagtatattcaaacacacattcacacattgaattcaaatttcatacaagatatctctgatctagacgattgatatttttcaaattaaaatccgacgactcttaatttttggtccatgctagaatttacccataattgagttcacttaaacttaaaaaataattaaacttcatttaaaaatgaaaagcaatgtgaatgggaaaccaaaggtactttgattagcgaggatgaaattacatgtagcacgaacaaattaaagttgtctagaaaaagaaaacggtgggatttactttgagttcatggatagtatcttacaagcaactaaaaatgtacaaatgaatcatgcatgacaatgtggaaatatgcacacgtacgtgacattagaaaagagattaatgtttggtttattatattgaagctggtaagtgatactattattcttccacgcaggtggaccatgatgagttaattatgcatgggtcctgcaaacgctgcttggcacaaagaccaagcttgatgttaaaactacttcactcaaaaagttgccacgttgtatgattcgttatgattatggtgctttttcttttcattttggcaacatgtgcaggcaaggcttgatgatatttttgtcacgttcaaaactcaaaattgacgtgtttattttttgctgtttttctccttcgattgccatgttatagattttgattttgtattttgatagtttattctctagcataatttcttttgtaattaattgtaagaaaaatttatttggacacataaatttaacttaagccgatcaagtacgtacattcatgaatgagtgcatgtttatgtagacatttccaacccaatttacatcattccgagacataaattacaaaagatttcaaatttattacgtttgagtgttattcattggaaagaatgaaaaatggtggcaatgtggaaacaaacatatcctgcgttgagttgagttgagtccacatgttcaataaaataatatttgattaattaattccatccaactcaataagggtcttgataataagtagaacgtatatcaaaaaaatgtttctcgatctagcatcaaaagtgtataataaaaaattaattagcttcttttatttttgcaatgcgtgtttgtgaaaaaagtaaaaagtaaataaaaaaacatattcttatattataaattaaaatattcattttggacagtgaaatcctgactctttcaactcaatttacttattttcgttcgagctcttgcaactctatttaaatattataaatttacttattttcgagtataacatatagtgatctttacacacatttcaaattcaaattaaatcatattatattgtaagttcaaacaaacttattttatttcaattttactcattttc

SEQ ID NO: 4046 - DNA, 1300 bp, Glycine max
  Soy_ogl_1225 Gm04:5251901..5253200 Cluster 16
gattattattttatttttttacgtggttatttgttctagacttcttttaaatccacaaaaattactctccagtctcgatctacttcggaagattacaagaataaatttctctattatttagttagttattatcattcctaaaactgacacattcctttatacaattcttctgcatatttaacattttcaatttttaatggtggaattttttttcttgaaaatgacttgactatcaacggatcgcttaatctttgatgagtcaattagctgtttatcatcgcttggaatcttcaagagatatactaattatcaatatgatttgatctttgagatattcttaataagtggcccaggttgaggcaacattttttacaaataaccaaccaaatttccagtttgcatatggtttcctatcaatcattgtataattttttttaatgtttgtttacaaaggagtgaagacctgaagtgaggaagggaaaacgtagactaacggtgaagtaatgaaatttgaatccagaaattgtgcaaatttttcatcttcattttaataatactagttttcattttctcatttgcccacaattcgtgatcatagttttataaagtgtagcatatagagacaaaaaatgcgtactagaataataacaaataacaaaaaaaaacagtcctcttccctaagcctatttgtatcttgagtcccaagaattttttttttttctccgatcaatcgaaaaaacaaagaaagaaagcaagaaataagagtttcctaaagttttgatccgatagacaattaataaaatatgtgaacttaaattaaggagaaggaagcggtggtactccagttcaaaacaggaaaagttttcaggctcaaagagtgtttaattactattttaattttagttttatacttctttcatatgatttaattatacatagtattgagattgatatattataatagttgatcggattgatccgaacttgtccctaatttaccactgggtcttgatcgagtcgaggcctggttgaaaaaactagccttaataaagtttgaggtcgagtaaggacaaaaataaaaccttcccacaccctagttcttataatgtcattatccttggtaactaatgtagataagaggggtggtaataacttattctctaactcattatttataatacatacttattgaaaatttcaattacaaagttaagagacagagttataaaataaaaagcaagacttaccaaaaattatagtttttgataaattttagctaataatagaaagtgttagaaaa

SEQ ID NO: 4047 - DNA, 1000 bp, Glycine max
  Soy_ogl_4235 Gm13:23796801..23797800 Cluster 16
tatattataaattaatagccaaacgttttttttttaaattactaaaaaatgagattgtaatgaaagacttgaacattttatttttttcttatcacagtatctattgatagaaaatatctaatgtcgtaaaaaatagtgattagtctcaataaaaaattatggtcgtagacaaattaaatattctctttttaacatgttatattaaggcttgagcattttacgtaatgagataatttttaacatcaaagttatctactggtataatggtataccacttagtattctaatgttgaataaaaaaattaaataaattatctacgcttgcgtcatgtagatggataaaagtagttagggaaaatataaaagcttatgtgttgggcttacttaacgtgcgaccattaaatgctaacaaaaaaattgtttcaattactccaaaaatactattactatgtcactgtaggggggaaaaattagctgaacaaagaacaaataatattctttggtctggacttaatccacgatatcagtcaattatggatttaactttaatgcattaatcttcttcttcttcaaaataaaaactttaatgcattaataaacttttattgtgttataaattaattaaccattcatttctaactctttaaaaaatttaattgtcacaaccgttattattaattaaagttaatatcagatggtacatatcttaatttttaattaaggtttgggattcaaacattgtaaatactcttattaagagacctaaattcgttttttttttcagctaaaaagatgtagagagacctaagtttgttactatattgtgatttttttcaacttaaaacaattattcctcataaaaatatgtggttctggaaaaacaagctaattatatcgtacaaatcattaataatagcgtaaaagtttgactctaataacacacaaatttcaacataatagctattacaacccttgatccatcctatccaataatgttaca

SEQ ID NO: 4048 - DNA, 1028 bp, Glycine max
  Soy_ogl_4302 Gm13:27307973..27309000 Cluster 16
cacactagtcctgaaaattttcttttcttctgagagaatgttgtaaatgagatgagtactaattcttgtgtgcaatctttactaaaattgtcttttaagttacaatctgattagatgaattgttaaaaaaaaaaatagagaagaaaacaagtaggatttatgagggaattagaattggatttgccactactttttaacaaataaaaaaccaaaggagtagaaacaacaacaaaaagggaaactgtgattatgcaatctcatcgcataaaacacataatacggattttagttacaagcaattgtagtgtgtttatttaataaaaaaattgttctcaaaggcataattgttaatgagaaaatcagcgagtgatgtttcttacacatttataatgcaaatgaacactgatatatatagtacgaaggtaagttgcaagaaaaacgacaaattcaaatccagcggttaaaaaaaagtatgaccatatatacatatggtgaaattgaaaactgatttttttttttttaataaaatgacatgtatgaaaagtaagagtttgcgcataacctgttcgtactaatcaacaatctcgaatgcaaatttgatatattaatgacttcataaaccactttagtggtatgtttgatgaaaagtaagagtttgcgcataacctgttcgtactaatcaacaatctcgaatgcaaatttgatatattaatgacttcataaaccactttagtggtatgtttgataggaagaaaagaaaatagaaagaaagaaaaatacggataataataaattttcttttgtttggattaagagaaagtgaaaaaaacgaaagaaaaattgacttatagaataaaaatttaaaattttcttttttttccattccttctaattcaaatttcaaattttttctttcctccccagtctctttccctcattccaaatataggatgaatgtcccatttttatctttgaagtgaattattcacttcaaaagaagcaaatcttattagagtacgttgtcaaaa

SEQ ID NO: 4049 - DNA, 1300 bp, Glycine max
  Soy_ogl_5006 Gm15:11950001..11951300 Cluster 16
tttattattattttataactaatgttatttttactttctctgtctctctgtcacatcacacttctccttctattattatttctccttaatagacaaatattacgggcaagcaaagtttcatgtcgagtcaagtttagaaatttttttaacattacccaataaaaaaaataatttagtctatttgagtttaagtctcaattctacttaacacagcctaaacctactaattaacctgatttaggtcaagttaagttgttaggtttaaaatatgttatacccaactattagtaaatatacaatttatcaattattatgctataaaatttgaaatgttcattttttattccttttaaatttttagtatgtttatggtcctcttaaatttgaattattccaatgtttggcttgaagctagactctattagtccgaaacttgactaaaacttgttggacgattttttatcagtctatttttcaagtgctttgtcttaagtcttaactatttttgaaaaaaaattatctttgagaaaaatgttaaaaattttcactaacacaccatttaaccttcttataatatgtttcattcatttcacataaggcttgaataacaatactttatttaaaagatttggtccaattttacttggaccaatgacatattaataaataatgattatttttagccaaagtaattaatattatacattacttattgggatattattggaagaagaaacaaaatacgcaatgtacttacatgaatatgaattttggtgaaaaatattcttcagtggaaacacctttcttttgagacctcctctggcttgggtgttaacttctgtaaatcaaagatattcttcaatagaacgacccctaatgacaatagagaaaatatttctatgtctgtaggagtttcaaaaagcctaggcacaaggaagtatcttggagtcctttgtatgattggtaggaagaaaaaagctattttcaactacttaaaagatagaatctggaagagaattattcattggtctggaagacatctctcaaaagcaggaagagaagttcttatcaaatcaattgtcaagcaattccatcatattatatgagtactttcttgctccccctcttccttgggtgatgagattaaagttgaactctttttggtgggcccaaacaaaagttctaggaggggtataaactagttaagctggaccgtttaactatgaaaaaggagcacagaggaatgaaattttgtcatctttttgcctttaacttagccatgttaggaaagtaaggttgg

SEQ ID NO: 4050 - DNA, 2800 bp, Glycine max
  Soy_ogl_2543 Gm08:7532001..7534800 Cluster 17
cggtgcaaagttgtggggttggttgtgtgtgacctttaagaactttaggtccataagaaggttcatcacaagttatttgcctcataagttaacgcctttactaaagtgagcgaatgtattcattaaagagaaagacgggaaaaagaaaagagggagcgaatttctttggctttggcccaatttttccggttcgaaaggatcttgtaaggggcaccattcaataatgacgatactttttgtatagtttgctatagaagagtggatagctacaacttggttgttttgcatataatgataaacgaataagtacccatttcctcatattaagaggttcttatcaagctttcaattttgtaaattgaaattgcttcacgagtcaatgttacatacccttttcttatccaaacaatgatgccaaatttacttttagtcaatgttacacttattttattttagtgagaaatatactactagtatctgtcagtgtctggtgagcagacttcataataatttaagaatataatttttttttcacaattaatacatttgaaaataaatttctcttataattaagacaaaagaacactctttttattttttttttataaaactggacgtaatactaatttttttttacggaactgcaatcttatagtcaagtattagtcgatttttttttttttttttacaaatattagtcgagtcttattttacacagatgcgttactcataactcataagtttgaacattgttaattataatatgacactcatgcatttttttaattccaaatcaattaaagtcctatactactgttgcaaatattttttacacatatatagattaataaaattttattatatgcaaaattattatttttatttgaaaaatatgtaatgctatgaagattcatgaagtatgaacatctttaccctttaattaactctcttttctctttaaggaatatatatgtatacttgcggggttctcccttctatttgtatccctccagtagattaatttgtctatatttatccattcttatccaatactcccgtgaataggttgtcgtacacaagattcatgacttcaacttcaagtaattaatttaagatggtgtttcccatgttcgaaagagaaatttatactagttctttcccgaacattaattaattagatgcactttttgcatattactccaaatttaccacggttggtccgtgagtttcattttgtaaaatttcgattctacttttcctttctcggattttaagttaaaaatatttaactacagtattatattatctatactattttttttataaaaaaaaaaactgacatagcaattttcaggaaaatttcatcaccctataatgatatttgaaaattcagtgaacatatattcacgtcacgtagcacacaaaaactaatcactgccgcaggaggaagatctcatttctttagaccaaattcttggagaagactcgtgttggctaaaaatgtcataacatcgtcctttcagagacacgtggcaaataaaaatgtaattacacagtaaaggttgaaaaagaggaaaggaacaaacaaagaacgtgagaaatcagaaaacagaaataaattagaagataaaagttagggtataatataaatcaagcaaatttagtttttcgtgcttggaggtatttctaagatagggtatattatattatactgtatcgtatttgcttctgtgtagtgcgctccccttgtatttatgcagctaacccgcagtttttatgaaactaacttaccctgagggaattgcaggttgataatatcatgtcatgtttatttttgtttgctatgtagctatagagacctaaaattcctcctgatatagttaatgcagagctaagttcattttttttatcgtataaactagtacaagtctacaatgatggaaaattaataacaaatgatattatagcatgttcataacaaatagtaacaattgatcagttagaaaacatgtattgagaaaatgaaattcatctctattagctgatgagttaaatcaccaaatgaagaaatactactctctatctcgcggttaggttttccacgcacaatgtagtgtcacgttaaaatattaaatgagacaattgacactgaatggtagtatagaccccagggaccaggactcaacccaaagcacgttcatataataagcctaaataattaattaatattcattaactaatatatcgtgtattttattaacaaaattgatatgaataatctaaaattaagtccaataattaatcaaggtaaatccaaaaaatttcaacatacaaaagacattaatttatcctctaatatattttttaaaaaaatgacaaaatgcatcgcaatgataatttgtttactgatacaacactgacagagagtaatgcggtggtgctatttgcactgtgccggccacattcagagagggaaacacgtgtgcccataatggttacaatttggcgacgatcccgttggaatgcgtatccctaccacgtctccggtggataatttgaagaatgcattgtatgtttattccgaaggttttgctcctccatgtgttgtgccccttagatagagtttggtccctttcatacatgcatgatcatatgtgtgaaataatagcaatattactactatttgcataattattacacttacaattatgtatgtccttttagtgggttaataaaggcaaacgagaagcactttgtcagaaaagcattaagaaccatggagtgtttccactgtgaggct

SEQ ID NO: 4051 - DNA, 2825 bp, Glycine max
  Soy_ogl_753 Gm02:49919476..49922300 Cluster 17
tgctggttatgatttttaatttcagttgttagattttatgctttatggtatggtaaagtcatacttttattttttatttatacttttgtgaattaacattaaatttttccttagaaaaagttactactatatatatacaatcttataaacctgaatatatacatacatatacaggaaatatataaaagaaagttattttatgtcagagtaggagaaatgaatattgacttattatagacgattgagatcagaatataaaactcatgcgatttttttaaatggtcatgtgatattaagaaacttttcatcttaattatccacgcacatatagttatttgactaagatttgtttcgtatgtaacatattgtgacaactacaatatatctattagagaaaaaaagtcagacgcacgaaaagccattgaggtagctaatcaacccaaactcctttactcagtataaaatttgaattagttatgttaactagtcatccatgtttgcctgtgtcaactgttggatctcaaacgaactttagttttgaaattacttaatttaataaccttttttttttctttcaagttttcattagttttctattcaataccatattcgattaatccaagtcgacatgggtaagattaatatagccaacaaaaccctctctcaaagtttaatttaaacacaattacattttaagaatttccatcaattaatctatgcgctagtgatcaatataaataatttaagtgtgtctttactcaagcattgtgttaacccagatactgataaaaaaaaattgtgtcaacccagatccgcattatttagaagcaagatgttgtagcttaccgtattttgagttattggatgtggttttcatagttaacacttaatacatatcacaagcgtagtttgaaacacactaagtttctttgcaggtaattttttttaataaaatgtttaaattatattgtcctttaaactcctgactcctctttattaagagttgaaaacatcctatgccttttgttaatgagtaattatataaataaagttttcgggaccaattttcctttatctaagttttaatataagtaacttaaacacttgaaaaaaaaatgaaaatctgaacactttcactatcagatttataagcatatacaaactctttattttatgaggtctcaaaaatgataataggtgtgtttaaaattgtccatcaacaaagctgaagtgagaagataaatttactcgcgaaatactcatttacaataaaatgaacatatgtctcttgacaacaatagtataacttttggcaataataaaaactattactataatttaaacatctatgaaagcgacaaaagagtgtatatacatatattgaaacatagagtaatttcaactttcaagtaataaaagatcaaaaagagtatttacacaaaattacaatcccccctcttccctacagaaaggagagaaaaaaagtaaaagggagacataagtaactgtgccaatacagctcccaaaatggcacgcaagtaggaagaagttgtaagccaaaatgggacaacgtacgtctctctctctctcacactctccacatgacacttttcttacttgggttagattttgtacactacactttaactttaatattaaacatgtttaagatgtgaacacataataactattaactaagaatgcaattaacaatttccatatacaaacaaatgagacaccgaaaccgaagaaaagtaagatatatattagcttcgatatctgtctcaacctacacatccaattcacttttttattcccacttaagtttgtttctgagccagcttgtgattgtgttgtctggtacacaaatggttcatgaacataatttagaaatattaattaataatgaaagattttttacagtgtaatttaatctttggttattaattagtatataattgaaaatcattaaatttttagtaattacttcaaagtcttatttactaattaattaaatatcagtgtatcaaattaattaaattactaatatctcgaaaaagttgcattgtctttcatataactactaagttattctttttcttttcatttgtgtctggtgaatggtgatcgctttcaggttcactgtttgattcagattgtaccaaagcagaatatatggttgtaacatgtaattttggttgtcaggtgtgttgttgcagcggttaattttacttgtgaaaattaagaatgaaggtaacactagtatgtatgataatgattggtgtttcagaaacttggcaccgttaaaattttcgcatagaattagaggggaaagctttgtaatgcttaaattttcacttcaacccccattaagatatatttactttatctttcatcttatttagttatttatatattttttataatttcacctcagtttatcccacagtgagtggacgtatatatatcctttttataatatgatatgtaattttgtttataaaaaaatattaattattaatctattaatttttattagaaattgaattcacaatttttttttcttttttaatcacttaatcaatcttataactccatatgatagatatgtattttaactatcaaataggattgatatctgatatctccttatagatcgtgatacaaattaataaaatcacttcgtgatcaaattaactaacatctcattcaatttatttaaattacaaacgttcatctcatttagccttctatagttgggaaaggaagaaaaaataaataatattgaacgtgttgtttttttggtgcctaatgcttactgataa

SEQ ID NO: 4052 - DNA, 2519 bp, Glycine max
  Soy_ogl_4889 Gm15:3086780..3089298 Cluster 17
aaatttctaccacaattgataaaattgatatgcatatatggtatattaaataatcagctaacataaccattttgcacgcttaattaccttttactcttcccaaatcacaaatcgcaccgtttcatgctacacgcgtgttttccatttttatttcagtgttcccgaagttaaatctaatatgaaagctattactgtatatatgatatagcatttttgtggggtttatgtatgtttttttttttttttaagtgagaatgatatagtcgtacatgtcgtcccgtttcaaccatttaacttttctattgaacctaatcttttgttctataacaggaaagccattgcttgaagaaactaccccgttgaaaccaaattttctcaggaaggatactttgacaagttacctggcctcgtggcttcatcacacaagacaggtcctgattagatatagccaaaacagaagttgtgacttgtcacacagccaaaacaaaattcattttattcttcttatattaattatgtattcattttctttttcttactggataaattacacacaatctaaattaagaaaaataaaaaaatataattaaatgattcaattttgataaaaagctaaagcataagcattgcgattttaaaaaaaaagaaaaggtaagaaaatgcactggaggtgattttatgttccattttaaagaatattttatatagtaatcatatttttaaatcacaaacatcttttatataatgtagtcttactcaagtcaaaaacatttacaacatagttcagttaattctcgaagtagatttttttgtttctaaactcaaattcttgtttaaaaagatataaagcatacactacttgaactaatcacctttatatatatataagtgaactaaccacctttatttgtataaatttgactttaaacatattagatatcatttttaaattattatatacctttagttacatacaagttttgtttattgatagaaatgaaaaacaagtataagaagatttagagtaacttatgcatcacgttgaattaattaagttagatttcctgcataattacatacaatagttcatgattacttttcacacaataaacaatgatccatatgttttttttttaataaattacatattagttaatcactattgtccgttatttttaagtttagactgcaagaattttgtacaaaaaataatcttcttcatattggaacattcacaatattacgaaaatatttttatggtgatttttttcatacagaaagcttgcagctggaaatcttagttaagagaaagcatgtatcgcttaaattaatcacccactcattattttatattaatgtcaatcatcaactttttttttacaatattttttgcatttttaatttttaccttttaagcttgtcacgcttgtttctttcatcataaagtggcaagtgtccacaagaggatgcccctctcatctctaactatttacacgcacacgcaccaattaaataataaataaataaataatgctctcttactcgttggtctatgctttcacaattcataagcatgtatcttccaaccattggtcactgtcatctgtcattgctgggtatttgtagggcaggtataaaaaattaagaatcatctaaagaaaaatactagaaattaaaaatttggtttgctaatattcttataaacttagataagttagaggttattattttttttccctgaaaattaaagatatatgttaaaatatttataactattcatgcattttattcaactaagtctgattatatttttgtggtggtatggaatttcctaatatttctacttcttttggttcaactagtattactcaactttactgtatactgtaattgataagtacaatttgacatgattttgggccgtgtaagtaatgtcattgaattaagaatccctacacagtttcagtatccggtatgagagcaagtcacatttgggttataaagattttaaatgtcatctggattgacctaattagaaccatcttttactctttgtcaatatttcaagtcatattgcatcaatagaaaatcttactaaagattattaaccagattttttaacaaagattaattatcaataaaactaataaatattttatattaatatcataattataaaaaaaaaatttacactcttgcctccctcctcgaaaactaagacaagcgagctataattcaagaaatgaaggtggtggtgaaaggttagagatgatcatataataagataactattttcataaagtaacacaaacaaggaaaatgaggagatactctatctagcatcctttttaatttgttatttataattaaattacttttagaaggatgatattaacaagtaacttatttttaagataactgaactgatttttagataactaatgatgatattaaaaaaactaatttattaacagaataaagaacactaagttccaaaataacctccgtcactcataggg

SEQ ID NO: 4053 - DNA, 1360 bp, Glycine max
  Soy_ogl_3655 Gm10:49634941..49636300 Cluster 17
ataagaaaataaagagaacagtgagaacatttagtatatctattgatgccttcctttattgatgattaatctttagacacatatataattatttcttaatttatattttatatttctttatttatggttaatatgtacaataatatatactttaattacatattaagaattaatgtaatttaattaatatattatatattatacaaaacctaatcaaatttttatatatacaattaaaaaatacaagattgcaccaatatattgttcgtaaaaaaatattaatacaaaaatagtatatatttttgtttaagtctttacttgttaaataattatttcttagaagttatatatttaaataattttaaaataaggaaaaaaaattccccttacttgagtaactttttggggatccatctttgttggttgaccacttttaatagaattttttcttttaattgtgttttttttttcaactataaaattcaaatttaaagttttgtttaaagaatatgagttcaatgacacttaggctaacaatatattggtgcaaccttgtattttttaattgcatataaaatgtttgattaaattttatataatatataataattaaagtaaattaattcctaatatgtaattaaaatatatattattgtacatattgatcacaaataaagaaatctataaaataagttgttttaatttattttaatataaatatatattttaaaactgtatatttttagtttatgtaataacttaatattcaatattcacattacattctaatatgcataatgtgagtatatcagtattatactgtcacatttaacattttcgataaatatcaaatgttaaataaataaatgaatcaattttgcataataaaatttgtaggggccaaattcccgaaaaaaagagagactaaaattcaaaaaatatcaatggttagtggataaaaaacaatgcaattgtttatatattcttatcctactaaagtatgaattgctattcaatttaaaataaaaacaacttttcttactttatctaatgaaaaatatagaatactcgccaataattattaaagtggtaattctatattccatttggatggcactttaatttttttgagtgtacattttttcaaactatgccccttacttccattgcgtccctcatattttttacctaattaccttcttttttgcattgcggcagactttaagccatgctataagtcaattgttttttagaatccagaaggctagctaggcaacgcacgtgttcttcttatcgccattgtgtataatgcatagcctgctacgtccaaaatgcggtttgacattctttggcattgaaa

SEQ ID NO: 4054 - DNA, 1758 bp, Glycine max
  Soy_ogl_777 Gm03:736257..738014 Cluster 17
aatgaccactaaaagtaaattactgccaactaaaaccaaattattactattgctttagtatatatagccgccaaccaaattattacttcaacagtctttttaataacgtattcattttttaaaaaaactttaattaaataaaattaacagtggtctaagcattcataatttttcctaagcaatggatgaacatccagaccttgccaacacaccaaaaatgtttcatctcaatcctataaccagtagtaataatgcgatatatacaaaatacaggatcaacaactcaaaagtacaaatcagtgaagagtaaagttgaacgagcctccattgatctgagagtgaaagtcttactctccataattcatttctaggttctttcttaccttcaaaacttttgtcaagattcccaattcttttgaacagttggtttaaatgtggtaattctaagttgtagttctaagctgcagatacattaacctgttaacaaagttcattgtatgaatagatttaatacaccaaaagggaaagaagttcccatataatttgtcagtcttctaaaattcattataatgaaatcctggaaagaggaaaatgcttaattatataagacaaagacaagaggagaagaaaaacactataaaaagtgattataaggttaaaaataaaatttttgctaaaagagactataaaaagagactgaaatttgtcaaaaacagattaacatttttgctaattgattattacaatatgtatttcttagttgcatttacagaactagtagcatacatattgattcttgttccttacttacatatatatatagacataacgttattcaggcgaagaaatcgcggcagatgcggcatattaaaaacagaatgcttagatatgatgcatgttccccaagagaatttaatatattttataagttggcgagtttggtacgttaccacttttaaactttctaaaaggtttttatgggctttagcgttttgcccaaaatggcaattgctactgttgcctgttacccacccacaaaagaaaaattctcacgctagctagttaactatatataaaatatgtataaattttacgtgaataaaaagtaaaagtaatcaaatacgtattaattgatataaaatgaatgtgaaaaagtgtgcatgtaacagctttggtatttgtctagcatttcttatgaccaaatgatgcaacatagtcgacaataataggaatctctatgatgttaggttgtaaactgtgagccacatgttctcgtgcttctcgtacttcattttaaattctaacatttttgtattttacagccttgaactttttattttattaattatttaatatatattgacatggatagtttgaccataatctaattggtaaattaatacgttaagatgaatattaattgatctatatatatatatgacaggacaaaattatacagtacagggatcaaattcattttaaatttcttataattgtaatagtttgaccataatctaggtattctaattatatatactagttcgaagtaggcacccgtgtcttaaccaacaatatattttgttttttagtttttaattaaaattataaaatggttaaaagatataaataattgtcatgtttgagaacttatcttttataataacacggtctagtttagaggtagtttcaggattagttagaggataaaactgtttatgaaatatattcacaaaattgagtatttaatttgtctttata

SEQ ID NO: 4055 - DNA, 2053 bp, Glycine max
  Soy_ogl_4873 Gm15:2543601..2545653 Cluster 17
ttgaaaaaaattaaaagaataaataagttttttgtactcaattgaactgacccaatatatcattaattgggttgatttgttttgaatttaatagaaaaattgggagttaaattgggaatgaaacataaaattatagaaacaagttgaaaaattatataaaataaaataaaacatattttatctcaaaacttcgatctaaaacaataatatttttctaaagtctaaaataagaataagtaaataaaactgaagatttttttttatatcttaaacattttaaatttgctcctaatctgtaatcacccttattaccatgcatttctttctatatcttaaaaagatcatttttaggatattagggattcattttccacctgcattgttataattattttggcgatgtctaaattaaaacaccagtgacatttttcatcttaaaatttgacatattcttttcttgactcgttaacagatactctttctctctctgcgtgtgggagaaaaatattcctcagctaattaatgctatggtattatctatttaattacttgataactacagtttttctacttcgttagaaagtcaatttcaaataaaaaagaatattcttttttcatgtgcgaaattgcgtacgtggggatatccgaagaatcagactataatttataacctaaaaaaagtacaaatatattttaaagaccatcaaaccaatgtaaaaagagacagagagagcaaaaataatttaagggtataacaactttttgtggcatatcatttcaatacatgtgtgatctatgctcctcattttttttacgaaatgtgaaatatatattcagtaatactaaatgaattaaaagtgggggaaaaggctatgggagttgaaagaaaagagaagttgttaacttgttattgtatatttttaattaattatgaattataaaatatatacaaagaataaagttaaaagtaagtttttttatcattagttaaaagtacatttaaacaatccaatgagtcaggaatacaaaagaaatgaagaatttcttgtgggagctcttcagatcttgagttccaactccaaatctctctctctctctttgagaagagtgtgaagcaactccaaatttaagttactatgtgattaattagaatctatagctacacaataatgtatttgatttaattatttgaagaagaaaattagagcttctatctctctctcttcctataacatgaaagttttaattaaaaacaaataaaagtacataaaatgatgcaatgtcttttgcaagcgttgcccttgccaataggcaaacaccaaattaatagcattacatctatgatttttgtaatttttgttaaggattaatcaagtatcaactttatatttattatagaaatgtcattttcattaaaaaggaattatttatccttgtatttcaaattgaatctaattaattatttccgggtatatatggttgcagccatgctccagtcacggcggaagcgaaatcacaacggccggctgtactaatccagggattaaccccataattatctatattaacatgcattcgtaatcatcatttattgacttcttgataagctttacattacatcagcgctttcagaaaatcattttcagttgatcatatcaacaatattaacatttattaattcacaggctagcattgttaatacagtaaggattagtacatatttctacactctaaacttcattaattatttttttatcacgtcatatcactcttaaaataactttttatagttcactaataaaacgtcaataattatgttttttactcttgagttttttaacaaacattttattattaaggaaattcatataagaacatcaaagtatcattccatatatatgataagattcacgtcaaattctctcggagcattttctgatgctaattgcttattttaaggcactgttattttttttttcatcattaaaggaaatctatgtgtcaagttgagttgttttaacttaagcttcaattacttctataagtaatgatt

SEQ ID NO: 4056 - DNA, 2800 bp, Glycine max
  Soy_ogl_5206 Gm16:493701..496500 Cluster 17
aaactggtgagttgagtactgtacatgtacaatttcgttttgcatgcagcagcagatcatcaatcacatgcacattgcacctgacctccgtaagcgaagtggttaaattctagtcagtgctgtagattcctaaaagtgggccattctgacattctctaatcattcattattgttggttgaaatcaaatcatttgaaaacggctccaagagtcaaagttcatctcctgcacacattgtattagatattactctgacacagtaaaagtgcttaattcgttgccaaccactcccatatatatacttataaattaaaatttaagatagtagtacatatttaatcattttcggacatgcacacatttgagagcgacactcaatcaagttcgagagtgcaaaaaattataataattatgtgcaaggaaaattaattgttactagtaatttgcatgtgctgtaacactagggtgcaatatatagctagcatagaaattaattaatggggttctaattttaatatttaaattaaaagttctactatatgacccggatctaggaagacctagctaagggataagagtcatagagattgagatggccaagaattctacgtaggctaacatgaccgatggtaaatagtatgacaaagacaggttgttgaagcccacatttgaaggaaaatgccattgccatttgccagcaacggctgctatttcaactagctaataagtctacgatgtacctagctagctactagctataattatctttcggtctaaaagaaagaattaatgatcttggagtagataagttcatcaaggttgactatgagaatccctaattaatggaaggaaaaaaaaaagggaattgattctaatgaaaatcatgaagaggtgagatgaatctgggtgtgttgtcctaacacgtgagcatgcattttcaacgatgtgtgtataatttctactccccaaggcactatagaaacattcatattcggtgtgattaccaatttaccattgagaggaacaaaagaaagcacatgtatagaaaattatgactaagaaggtatctttattaaaaatctgtctggggtatatatcaatacgacatttttgggtggttcatagtatatgggattaaactaaatatgtgaatgaggtgactgttttctgtttgattattccttagtttgtcttgtttaatttattaatgaatcaatgaaatagtcacctacctgaatttgaccaaaaaaatagtagtcacccacccatttgaatatacaccaatttgtgcataatttttttttaactaaacagtacttctcatcaaatcaaatatgacttcaatggccaatttctcttcctaattaaggaatttgactttatattgaacacatggggatggatttggagaaaattacaattcaaaatgctaggtacgagacagtttgatttgatgtttttatatccatatgaatcaataactatgatgtgttataactcaaaactatttatgcactatgtgcaattcaaccctttttttttttttatctttattatcatcttctacttttaaccgaaggctgggttagaaataagaactcatcgattcaaatatccaacttgtccctatgagaaaactccaaaactaggctattaacgtactttgatactatctctcactcaccccacctccccaatataactgtcccgtcagtactctaggctattagctaaagatgtacattcaacttcataaaaaagttgaattgtgaatagtgcagaaactgatcccgcatgaaaggagttccatacttcaattccatgatatctatatatttgattatatgttgagaataaaaaaaatttaaactcgatttataactttttttctcttctttttatcacattacatcatctatcaaattagttacacatccctcatttcttcttttctctctcaagttatatataatttaagattgtccaaaaaatatttttcaggagaaaaagatagcaaaaaagagttattaattaagtatttaaaatttttggttgtcaaaatataatcactctatgcagtatatatgtttaccatacaagagtataccctatttccttgatttttaattaccttcatcgcatttttttttctttcttcttgaaatcaaaattttcatttgaaagtgttttggaccaaggcaccacctgtagtggcccatgaagctaaaacaacaagacggcccaacgtccgaagagtgggaagcataacccaaagttatagccacgcggaaaataatgaaaaaccatttaaactgcatagttgtcggcaatcactaattcaaatattccgaaaaatgaaataatcaatattcaacaatatttattgttaaaaataagttaatggaattctaaaatttctggatcaatgatagcaagatatgcattctccgactagctcattcattactagtgcctcttaactcgacatatactaacttaaatgtcaggtccttgctagtgatcccctaccattgttgaacatcaaaaggtctttcactaaaaagaccaccactatcacaacttgctaatgcaaaataaatgaatttttctttttatccttggacatagaagaatagaaaggaagttttatataggtagggtttaattgttatgcaccatcactacaattttattatactattaatcaattaataattaattttgatataaatttaaatttattattataaaatttagcaatcttactatatataacattttataactggactgtaaataat

SEQ ID NO: 4057 - DNA, 2300 bp, Glycine max
  Soy_ogl_5591 Gm17:8781901..8784200 Cluster 17
tgttcaatggtgcatctgtcaacaacttatttcatggttcatggtagaagccgccatgtttacttcaaatttatttgagcttcactctattaatttcccatttgctttattcaaaatcaactctactattcttattttcactttagttttctaaatgataaaaatgcataactgtttattcattagtttttaatggttgaacccatactattcttcattaaactctctaacttttgtgttccaaagataaaaatggtgttgtttttcacttttataacaaataattgatgtccatttaattcttcataatataaaatacaataactttagtccgtaaaaaaaataaactttgatttgattttttgatcatgtaaaacgccgctaaggcatctcaaaataattaatgaaatataatcaaattaatttataagataattaaaacttcgttacaatcatctctctctctggtttaattaaaaataataatatatttaatgctgctttatacaattaatgaactaattaataaaaaaacaattacagtttaagtaagaggaccttatacatttgattattcagcaaaaaaaaaaaaacctcaatacatttgattatttgaataatggaaacaagtttttttttcttctgtagaacaggacaaaacaaccgggagctctcaatctgaaggcttccacatgttttcccactcataaaaaaacctcaaggtttcgacatttaggaatcgatagttctgatctgaatgcataatccttaattataattcaattttaataatattttctattcatagaagaaaactcaataacacatatcacccaacaaattaaaaagtatctgtacttgtaaaaaaaaaaaagtatccgtaatagaaaaaataattaaaatcttatccaaattcagatatttgtatcttatagatacatctatcaactcgacacataggtggaacggttaaatgatagcgatcgtgaatccatgagccaaacctccactgataaacatttcactggtatatatcatttgcagacattcaccggttttaatttgttcacaaatcataagcatgcaaagacagcttaaccatatatacgtaaataatgttcattaaacttgtattccctttattcgctgttagttggcactttgtagtgtgatatactccaaatcatacataactaattattattcaatcaaataaataaaaaatgcttcaagtttcagcaatattaacaacttaatatataaacccaccttacataaaaaacacaaactgttgagtaagtgaagctaatatatagtgcgctgtcatgggtggtggagggaccaaagcacaggttgctatcgaagcccccatatgtttgttagctatggttggcagcatttgtaattggtaaaggtagatccaaaatcatcatttgtggaaaaaggattattggttcctttttaaggtttggttggaggaggtttccatgggattgggatcggatcaagacttgttattgtttacaaacagcatcgttcgcatgtgctgttgtgcgaatctacttccaaggactcgggtcggagcattattaattaatctttaattactttcccaaccatgtaacttcaaacaaaaggattttttcacacacaaataaatacagtatcttttatgaataaagaatgcgtaaaactaactaaataatatatttgaaagaaaagttcaaaataaaatattaacaattattataagaagagaaaaataattatatacttactatataatatttttacattgacatctaacaataaaatgtagaatattaattaagaagaaactcaactttccatatgtattactctattctcttaatcaaaaaataaattcctaacatatacttaaagaatctaagttatttattacttatatatgatatcttgtgagtaaatttgatgataatataatttttttttcacatgtgttgttttttaaacacaatcaaacattaaatctgaacatcttttataatgaatatttaaatgttgattcagcatcttatacaaaatcaaacccgcagactcattcccttttactatattggttaatacatagtcattagaatcttataaaaaaaaaagtatagtgagaaaaacgttacccattgttttatgtaagttgtaataaacaattccgtgcaattaggcttgcaatgtcccgcgtggaagcgttacttagatctcaccgacaattgtacataactagtgttatgagctcccaaattgacttctctctccttttt

SEQ ID NO: 4058 - DNA, 2111 bp, Glycine max
  Soy_ogl_282 Gm01:52126990..52129100 Cluster 17
ttcttttatttctgttttaaataaccataaaatggtaataatttggaaaaataaataaatgataaaacaggttagttgaataagtttttttaaaattttagaaaactgaaaattatttttaaaaaaaaaacatcaaacaaacaaaaccctgattttttttctttttcggtctgaaggagtggtgtgtcttgggcatgttcttgggcccaaggatttttttagctaaagtgagtgtagcccagaactcccatcaatttcactaaacaggcaaaccagacagtaggttggcccaataatttaaactcaaagttcaatcccaatggctcttcattttaatgtccccacgtggctaaaacttgtcaatttaggggtaacaatcctccagcaacagaggatctatatttgtagctacagccatcacttttatatgaaccttatagatgtatgtaggggagaatttcttgctacatgtttaacatcacatactagaattctcctagttctatccagttgtttctggaccaaaaaacaaatccagttgtttggaactatgatcgtaacaactaacaaataactattgacttctgattgcagtcgttttctttgatagttactcctcatgctattatgctttaggatattgtaacaaagagaaaaactaatttgacccaagtctatgagaatttattttatttctttagcacaagtttctgtttaacagctatatatatatataaaagtccccgcagataatatagataatgagaattttattcacgtggactttcaatttataaattttattataaactacgagtctactctagatattcaaaaactacgtacaaataatattttaataagaatttgaaagatgaaacaaaggcatagaaaaagagttggagataactatgatcgatgaactgaaaaaaaaaaaaaaaaagagtaaatgcaggagatctagatgatgatcaagttgaaagtgggcctaggaaaagactacaaaggttcgctttcatgttgggctggaggagtccccatttggaaagagaaggaaatacagactaattggggcttctcttcttgatttggacagctgatgcaaataattttccggaagaggttggtttgtaagtgaaaccctttgatatgcataggccacactgacttcattttctgtcttgatagttactcactatgacccacatgactttaataagacaatataacaattggactgtatggactatgtcggactaggaccagcttcatgatcctcactcttcacttcataaatatttgcttctgacttttttcttgagttaggttggcttctgatcactttcatctacgaacttggcttatacattaaaaatcattggtatattttgtgtgaattaattggtagcgaaattatttgtttaagtagtgatttcaagttcaaaacttaagtatccagttacataaaatgcttaaaataagttttgtcactttttttttttttgaaaaacttagttttgtcacctataattgtttatccaactcgagtagagttgtatttgtagaaaataattgtagtgtataaaaaaaatacaatttaaaacttattgcctttattgataaagaaaaaaaagcttggtactttaaccattttagttagttttgagtaatataaaatttaaaacttgttgcccttattgataaaaaaaaaaacttgttgctttaatcatttcagttaatttcgagtagcagtaataattaatgtataacttttctttgaattaaatgtataattatttcatgtactatgaaattaaacatttttttatgatttttttttattaagagtactgagacgtgccttagcagtcaaacttatgcattatatatcttatggattagtcttcactgaaatgccaatcctgctcgacagtaatggctataatagcactctttcaaactgacagatatatttttttttcatcaaaatatttgacataaatattttagttagtaaataaaatgctaagtatattttttttttttaaaaaaaacatataggactcgtattcaaccagctttaatcaaccattatttaaatatttaaaatt

SEQ ID NO: 4059 - DNA, 2700 bp, Glycine max
  Soy_ogl_1515 Gm05:1479101..1481800 Cluster 17
tggaataatttgtttgaaagttttaaaagcaaataaaaaagataactttttttagtgaatactaaaaagtaagcttaagtaatatacaaacttacaagttgtagttaaaggggtgtctgcaatattaaagtttgactctacaagaatacgaagaggaataactttacttaattgaatataatttgttattataacgaaggttaacaatatacaaccttttttttattatgagttaaaatttattgaatctcatgaaatgaagttaaattcgctccttttttcaataaaccttattcataaatttgaattattaaactaataacaaatactctattaaaaaaacgtgttagagaattgtttttttagcatctttaaaatagataagtgaaaatgtgtctaggcgcatttatatgtaagaaaaaatgcaaaagaaatacagggaacagtagagacacctccactttccagtctcaaccttttttgttgtcggagaatgaaaaccaggaagggggatgtatttggtgtttaaaaaggttcacatgtctcttcatcttcggaacatgaagatcaataaatgttttcttaatattctttcgacattctcgcacaatttgactttaatattatgtcaggatttgcaagattattttttcaccctgcaaatacgaaggtagttggtttagtactatagtggctcatgaaaattttgagggggtctttataggattggaaatcaaaccacgacacctttaataatcagggatcagatttgaattggtagatagattgtgacccacattcctggatcttaaatctaatcattgaccattattaaaactgacatagtacataaattaattagtgcgggtatttgttacttattaatttactacatgcatgctactgaaataggttatcaattcaatattaaaaaaataggttatgaacttttatttaaaacgggaattttaataacagtatatttagggatcaagttaagaaaacaataaattattaaatgtaaaaacaaatacatttttttaatttattaacatgcgacttgaaaaaaagcgttagcaagatccaaaatttaaattaaaaaacaaaatttatgcattaggaagatttttcattgaagttgcataataattttatgtcggaattcaattttaaagttttttttttctcaaagagacaagctaataaataggttgcataatgattttatgcataaagtttttttttttcaattttttatcttgctagggcaactccattttatcatagtctctatgtttgatcatgcaattctatgaattgaacacttgattgttaatgaaatgatatgagtattttgaagtaaaaaaaaaagttttttcattaaaataaagtcggaaaatatcaggtgttctggccaacctgattctgatatgcctagcatctgattaaaaaattctgattaaaaaatttaatggccattgtatccgctgcactcattttctctttgttctttgtactcatattattttttccctaagcactacttttaagttttaagtgtagtgggttcatgagccagcatggcccgagagagaatttattatacactttaacaacgctattgcttcatacgaaatggcaccaattataaccaaaaaaaaaaaaaccaaaaaagtggccaagtgttcgaaattaatggaaagagaaataattcaaaaccaactaggtttgatgatatatagatttgaatgttgtgttcatacattaagccaacttcctttaagattgttgtttcaattcgaattgtgaagtactgtttaaggttagtgtaccaaccatatacttttttttttaaacgtatgtgatgtgacatgtgatttgtattgaaaaaattgatagatataaacatcatcagtagcacatatttatgtatgaatgaaattgttagaattacttttctttacatattaaattagactcagaggtatcctcgcagttagaactcatcagtaataattctctaaaaaaatagagtattaattaaagaacaacttctttaatcataggtattgcaaacttgtgcaaatcctaattactgatgtcctgtgacttctccctccatatgagaatttctacctccacaggaggacttttctctcatactagggggttttctctctacatagtgtgagatttccctttcacctcttttttttccctcaccactatccccacctcctccttaattaaaacaccaactctatccctatctttccctcctccattatacaaccaccatttgatcttttgacaaaaagaaaacagaaaaaggattggaattaaactcctatcatatgcttaaagggcctaaactaatagtcacttgtgtcatactttgttagtgagactactaggtttttattatggtgcatattcattttttattgtatattttaatattaaaagggaagaaactagtggttcatagtttgtctattaaatttattgtttaaggaaataaattagaaaaatcctaatttgataaactttacgtgatctatttgaatcaaataaaaataatattgaaaggaaaaatttaaatgaacagaaacacagaaattatccatgacaaccaatcaatcgtttttttttctgggttgaaagagtattgatggatgaaatattctctcatccgcgcat

SEQ ID NO: 4060 - DNA, 2531 bp, Glycine max
  Soy_ogl_1782 Gm06:3231170..3233700 Cluster 17
ccaaccatcatgggactaaggtttacaatgtccatgttagacggagctaaattttttgtcgtcattgtgtatgacaatattctatattaataatcagctcatttttgttttataatgaaatttttgtttcgtgggaaagtgaaaacacaggtaaaaactgcaggaggtcatggaaattgagaaaggtcaaccccttgggcattatatgggctcatagtagttatgttacctcaccagcaattatgtactgttatgctattttatgattatggggaaaacattatcattaagctctgactctgtattgcggacaccatcttcaaccagctcgatcaagatacttgtgggccatcatttcataacccatattcttttagcactttcattttttttagtgtaggttcgataggtggaaagaaaaaacataaaaatataaaaatttgaattaaaataaaaagtaaaagtgtctttcaaattttagaagatgtttgatttgagtatttattttctattttattttttgaaaataatttttattttcaaatttttaagatttaaaaaatatgattattttgatttagaaagcaaatatttatcatgttatcattttcactttttttttagaaaaagttaaaaacattgattcattatttttcagttttaagtctgtttttgaaaatatttttagatttttttttttaaattttaacctaagtattttcacttttcattttttattttatttaaaaatgaaaaataaaacactataaccagatgtcaccttactgttcatttcacttgttttttattctcattacacactaccttaatacgggttgtcgggttgagatcgtgagtttaagaattaatttggagaaattaatatattgaaagaattatattaattattttcttatgtgttaatttcattaatttgttatttgattccccaaaactttaacattatagtaatgttttagttctttcaataactctagtcatacacgtttattatgtggaaattgagaatttaaattttaaatatttcttttaataaataagacataataaatctaacacttaaatatttttgtccggagcaatcatctaccttaagtccttaactataagaagatggacttgagaaatcacacctaaagagtaatattatttaattctacaagtctaaatactactgtataaaaatagtattaaataaaaaaaattaatgtttcataaatataaatcacctttagcatttaccatcacttttaaaaaaataaaaaattaaccctcttttatctcaaacaaacaatcctctttatttatttttcactcttttcatactatttcactttcattcttttctttttcactgcaaactaatggattgttagtgaaatcttctctatcattcatgttttttcatgcacatggaaaattaaagtttataattaattgtcaatagtgtttttttttcctttaaacattgttcgcaaatttgcaacaacttttttctttcagctttatttttttatatttaaacgaatataattgttttaaaattattttcaataaattaatcctaacaaaaaataattataattataattgattataacaataattaattatacatatgataaattcatgacagaatattatttttacagttattcattcttaaaattattaatatttttaagttatagcataataatcgaaaaggacgcaggcgatgctaagatgtttgttccatttttccccggatatgaatacgatcccgagttagatacaaatctaggtctgctagtacaatttgtagaaagggttcatgagtaccaataaagggatcttgctcctccgcgattcaaatgaaatggaagaaatcaccatcagccagagagtggacatgtctgactttgaccagtataaagcgcatgtcgctgtttttgtcttagaaatcatatgtagactttgcggagaaagttagaattagaaaaaagaaaactcataatgatcttgtcataacaaaataaatacttttgcatagcacagccagcgttaattgcaaaaaatggacattgctttggcccaaacgaataatcaaaattaattaattaactatacttaaacagtgaccaaatggtgacatttcgtactatagtttggtgcacaagagtaaagagcagtgagaaaaaaaaaaaaaaaaaaaggttgcttgttgagttagtggtgtgctggaaaccacgaacttagcttccagaatccacaaccaccacgatatctacattcacctttcaccaccatcactgattctgattctgtctcaactgcttgcactatgtggatgtagctatagctacccattttttctttctctttatctgcccccactccacccaacctcatttctcggaggtcgagcctacaaaagaggtagtagtagaactagaagaatttgaaaataaaaagaaaagaaaagagagaaagcaacatgtcatcacagaaaaattaaccccccctacacg

SEQ ID NO: 4061 - DNA, 2500 bp, Glycine max
  Soy_ogl_1783 Gm06:3242401..3244900 Cluster 17
aaagtgccaaaaattaattcagtgattataatgagaggtgcttgtagatatactatttattaagagaaagaaacgttttttcgacaaatctgactattggagagaatctatatgatcttgtgagtttcttcataataaaaataatttcttatacaagatataagatttttaatattaaaaaattattttctttccatcaacaaaattattcaagtacatgaaaaataaaataaaatatttaaaaaattatatatgaatatcttaaaaataacatatgtatgggaaacaaaataatcttgtatgtactaagaatcccacctaagactttaatttgggttataaaattgaagttcaaaattataatataagattacaatgaaattttagaactttcattataatatataacaataattttaaaattaatttacaatttttagattcaattataataaaactgaaataattttttttcaaattttaacttctatgtgttgaattggatttttatattttattcttatgttttgactctctgaaatgaagaaactaaataataaatgtatttgatttttaccaaaattataatcattgaattttaattaatgatgactataaggatgcattcatttgcagaaaaatataataaaaaatgagataactgaaaaataaaataatatgaactctgttttaattaaaaacttttattttaattacacttttttcattttgttccacggactactagttatcttctaaaatatgtacttccaattgctctcattattttgcaactccgatctagttccatcgtcgacacctctttgattgtgtgctattgtcattgttactaacatttcattcattatcactcctcactcttatcacctctacaatcaccattcactcaccccatctttaccacgcatgattttctataaaaaaaatgattatgcaataaagtcttacataatcttttaatcataattattttaaaataattcaaataataatttttatttgaatgacactataaaattattttatattattagtaaataaacattaaactcttatcaataaattaaacatttttaactgtatacccaactcaagtagtgtgtgaaatacgtattcaaatgagaaagttaaaaaaacattaaaaatgtttaagtaatattgtgtttagtcacacattatcaacgcacgtaaagccaataattcacattaaattgaacaagtaacgtagaagctgcttttagttacttcttgtttaatgcgggaagagaatatggatttgagtcccaaatttgttccaaacatactactcaaacattaaataaaatacaaaaaaataatatttaaatattcaaatactaaaaaggaaattcatatatactttttttttgctgaatgtaaattcatatgaaataataattatataaacacttaattacgcaataaaaatgaatattttaaaaaatataattaatccacaagctgacctatttactattaaaccccaactcgggagccaaataattaaattgacatttaaatagagtgtcattttagctaatcctgatctcacttgatccacgagttaagcacactatctggtatatatctgcatacctaaaccaaatatagccagtcctactcctcggtcaattgctgcgattaaatatggctttacactaagcaaaagcaatcatcagaagctcatggtcaatcataatcgacattttacctctccaatgttagattgttatgggcgtgccaacaggcttttctatgacctatctttattcatatgggatctagaattggtagtatttcctttgtttttattgttgttaatattattctgatattttcttttctgtctttctcaatttcttcttgtccagggagatgggtccacgaaaattggacccatgacttaaaagtgatttcaccgcgtgaatgcattaaaagtgtagaatgtaaaaattccagttccatactataattatatgattgaactcggggaaataattgatccgaggaactacagaagctcctttgattattataaattataaatataataataaatgagatgctcatcaacatcgaataacagaaaaaagaaaattggatggaatagatcgagggccccctatacttataatagaatctgattttggagcagaattgaagggacgagacaacaattcgaattgtcaagttaccaggagagatacacattccgtgcgtgactgttataatggtgaagggacccatgaatcctctgctgtcactcactcaataacaaatggaacgtgaattctttttatttctctttcattcaaaattagaaatcgtaaaggcttgttcacatggtgcacgggataagtatctaatgggcctgtgggcttgggctgctgcatggaagctgtcactatctcaacttgggtaatgccaacacactgctactcactcagacctcagtacagtt

SEQ ID NO: 4062 - DNA, 2630 bp, Glycine max
  Soy_ogl_3679 Gm11:1511401..1514030 Cluster 17
aacgtatatatagcaacatgttttaagaatgttaaaacaacttagaaataaaagtgtgcttgcatgcacatgagatcaaccaatgtggggaagtgcaaattgttttatttgccccttgcttgcccattaatgagacttctgaattttttattttatgttttggtatagagcataggtattcaacctctggaaaacaacattgctctctgtgtgcgtgtgtgtgttctggtatgctgtatgcacttttgttccaggaaaagtgggttttgtacaacatggtaactagtaagataggctttctctagttctttgtgaatatttgtgttccataggcattgtagcatattttaattgcattggattattatagcatatcccgggtgttttcatgacttcaaaagttcatgtactttcatatatgttcaatttcccctttaatttcctgttaaacttgacaggctcatggaattgaccatctggtgattccaagcacagtattgtacattaatctttaagaacaataagtttggaattgaaactcgaggagcattttatataacgttgggaaactcacatttatcggtgcaccatttgttgtttgcacagaagtcctttatatttgggattcaattatgacataaacactttaattttgagagcttgttctaaggttttaacttagattgtttttctagttgtgatagatatcacttatcagtgtgaagcttctcgatgaaactcatgttccctagaggtttttttgttaattttggggtgagattaaaaagaaagtgtttgtcaatttctaaataatgtctttgcctttgcattgaggactagtgcaatcgaaacttaaaatcacatgtgcatcacattgcatgtctgaatgcatttcttttgaagtttttataacccttggactctttcaatcttctctgagccatgattctggtcatgtttgaggcgtgagtcatgtgaacacattgctattgcagtacgtatatagaggattctgatcattttgtgttcccacaatgcagtattaagtggcggggaaaaggtgtcattttcttcacaattcggtactaattctatgtttgttttgtgatgaaaatctttctgggtcacggctttacttgatgatgacttcttttgagggttattgttccaccaagaacatggttcatattttgcacgtttattgtatgaaccttaccgctgcttgtgatttgcttcatccttgtgcaattgatgacacaaatcatgctgctataaaggtcttttaaataatgagtaaaccggaacatttgcagcatatttattattttttattcatttgaagaatacttattattataattaacttatgttgcactaacttctgctgtgctaactcattattgctactgctcctgatagtatttttgctcttgatatatagtcattttctggtcctgacagtatcacataacctctgattactagcacaacaactagaaaataattttgttgggcattataaggtttatctcaccctaggatgcagttccaggatttatatacgagtttaatggtttagttcactcaagctgaattgagaaaattagaagacttgagctatgcttcaaataatgtgttttccaattaattgtgtctccaaatgtgtcaaaatggtttatctggtccagtgcgagtcagttcaatacgagttcagattataatgataagagcaaaagatttaattcaggcttaaataatgaagttaaagtcttataaaagtccgacttttgcatacgtacttaacctgtattgcattatgattgggtcggactaaaaattcatgtttaatttagactaagaaatcactattaatagaaaataataaatactagtgcttgaattcactaaatcaagaagttttaaatagctgtggactttggttaaaaaaaatattataataaatgttgttgcgcaatatataagttattacaaaattataatattatttttttcatccataaaaaaataatttgaagagacaaattatatgtgaactaaatgtataatttggaggaaaaaaaatagcccaaactaatgataaccttattttaaatttccatctaaatacagaaggattataaaatactatcgaacgtacacgtaacaattttttcttagttttcctccccttctttctgttcgtcccaaatacatcctaacaaaccaatcattaaagttttttaaaaatataaataaaagaaaaaaaaaaaccaaccatgaaagactggtcaaatcataaatattaacgtaaattttattttgaatgaccttgtctttttttttaatgaccgttgttatttttaacatcaagaacgtatacgtaaatctctattctctgaagcttatttcactatagtatttgaaatttatattgtaatgtggaaaaacaataagtgggttttattatttatgatacaaaatattcttatgtgtgatcatttttttttaaatgtatttggtagtgttccaataaaaaaaatttaagatatattttacttaacaatacaagctattattctaatttgtaatattttaaaatttaaagcaaacttttatttaactaaaattta

SEQ ID NO: 4063 - DNA, 2717 bp, Glycine max
  Soy_ogl_5459 Gm17:2321485..2324201 Cluster 17
tgactatttaatttcgcttttatacgtatttaaaattttattaagacagttttctgaaaagaaaaaaaaattcacttaaattaaaacaaagtaaacaatcacttgaattgtaattatcatattaaaataatttcttatcgtctaccttttttctctactagtaatgaaaagtaattaactttcatattagagttaatagtaaaagtatttttactcccaactaattagaaatcattcttaatcagtgtttctttttaaagggttattataattaaattcaacagattatacatgataattgtgattagataatattataaaacaaatatactttttcaatacatgttattttcttgataaaatctaataaaaaatactaataacacattctctaatatattgagtaaattacactaattactattgaattttaataaaataacacaaatattttattttttaaaccattacaatcacttgtgttgtagggatattagtgtaatatataagaaatgtaatgtaatacttccaagaagtaaggagttgttagtgtaatgtttttaaatataaagaggattagtgtaaaagaaaaataaaaaagaatgttatatgtaatatgaaaaagctcaatgggttatatgagagtgtaatttactatactttctttacctgaaatttatcaacattcgcaaaattatgtgtgaattccttaaataacctacatgattctataagtcctcctgatgaaaagtttgttaaaaaaatgttattttcacttctctaacctaaacatatttgttaaattagtgaatttgtcaacatcaatgacacttcattcttggcaaattttatttaattggatcgcatgccacctagcataaggtgagagataaggctgtgcgacatgtccattttttttggcaaaagaatcagatagtgagtattatattgtacatatatagaaagcattcatgtagcgtagctagctgttcaataataaaagaaataaatgagcaaaagaagagtgctatcgtgtatggccatgcttcaagtggtcatagaacttgtcgactgtcgtagtaattgctgtgcctaacgtttacttactccaacccaaaaataaactcagtactacttacgtgattaagaagagtaggttctcctggtggttttgaagaatgttagtaattgaagatgtcacttactacaaatttgagcaatgaaatctaaagctttgttttctttggatgaaggcattaatcacaacaacttttagtattcaacatatatatggtttctccgaatcctagctcaccgtgtgatctttttaagagccgaagtagatgtcatttatatggacttttatgtggttgcaaattctttgttttattttattttttcgatttgatttcctctaccatatagaaatataatagtttggtacttacctatctcgggctgaacgactctgactgtgttgttattaaaatcaatatataataaaaaaatctcaaatacaatgagatgatgacacagtgtgtggatcacatttcatggtgattggctatctaagtctctccatagcgtcacacgaatctcccatttctaattttcaaaaacttcaagaaaaaatggaatgtgatgtcagaataagcaacttgaaacgagtatttaattacttaaaaaatatttcatcttttaataagaaatggaaatattaattttaatttttcaaaaatatttgtagcggcagttgtttttaatcattcacataaccacaactttacgatcaaagtctcgtagtaattgaatcggtttttgtttaagtatggatcacgtacgtagacaatttatttgaacaaaaactaaaaaacaatctctcttaacaactaattataataattttcaggaaaaaaaaaagaaagaaaactaattataatcatttatactctattataactgttacacagtaaagaatagttatttaaatgagagggaaaaaaagatacatttcgtgaagtctaaaattagctaagttttgaaaaaaaaaatggttcaattatttttcccttggaatattccgctggaaggcgtgtaggagtccaatggggaagggaccaatctagcaatttattagaggggcccgtttgagtacattagtcaaacatagaagaaacggatattaaatttttggagttatgatttctcttaaaatcttgctggcaatccatgaaactgcattaaaccctaactggagtatgtgttttcaataaatcttgatgaagaaaaatcattatccaaaccccatggctagtgagagctactaccgaaagtaattgtgtattttcctaacactacaagcttgcaaacatgcatgttccgtacaagtccctcatttaaacctacatttgcaccacacgagaattcaaaaaataacatttaaatcactcaaatttcaatatttctatgaaacaataattaaatctgacaaatttattttgattgattgtatcatatggagtaataataaaaggaggggagagcttaaaaaaataagataacaaataaaatataagtgtcggggtcaaactggatgtatataatcgaattattataaaacaattctttcttttgaggtttcaaaaatgattttccaattcgattgaatctaaaacacaaaataattggtttacagtataggagaaactcacgtatgt

SEQ ID NO: 4064 - DNA, 1200 bp, Glycine max
  Soy_ogl_6831 Gm20:38084501..38085700 Cluster 17
taattcactaataaatatatgatgacgtaaaaatacatatttgtattttttttgttttgcaagtgaaaatgtattattgtattattttttcattaactaataattatagttttagatttttagtaattttttaacccttgttattattttttaaaagattaaatattttattaaaaataaaaatataaagtaaaatatttaaaataaatactgtaacattaaaaaataaaaaaaaagggttaaatggaaaataaaggtgaagaattttcaccttctagatgcttggggtgatccatggtgtattattgtattatgtatgttgcttaggatagtatctggctatctgccacaacgcaagtccaataggagctgttattctctgtcactgtttttttacagcacacacctgttattctctgtcactgtttttttacagcacacacctctatatttttttacaaaaatactcttgatagaaacccacttttgttatatatctcaataaatcttgtttgtgtatctcgatcggatttttcaaattaaatatatcaatattgtcaagatacatgacaaaatgcattttcgtcaagagtatttttgtccaaatataaaaataaaaagtaaggtgatagagagcataagagctattcctaatttcctactatataactagaattataattaaaaactaaaaagttatgaagaagatgaaagtaacagttataaatatatttcttgatttcttgatacctcaacacattacaaaccatacattaaaaaaacaagttaataaatgacaatcctacatgtgtcatcatctaatattttggcaaacttaaaaaaaaaaactaaataatattaaaacaatatcataatattttattatcttaatctcacccaacaaagtcctttaacaattttggtttcaattttcaaggcatttttaggtcctcttaggccaatcaaaccaaaaggtgtgaacttaacaaaaaggagtctaaaaataacaaaaccaaggccagcttatgagataggatccaaatgaactgttagttagaaggagagaattgatattggctactccaaaagttaattttcatctctccctaccatcaatgtgtaaataccaaaatattctttgtcttctctcctttaatatttatctctccaagaaataaatatataacaaaaacataattt

SEQ ID NO: 4065 - DNA, 2023 bp, Glycine max
  Soy_ogl_745 Gm02:49321478..49323500 Cluster 17
tgagttggtcgaagagaaatgagatgaaatagaaaagatatttaaattaatatttataataaaatttacatctttattttaattttgctattgttttaaaggtttcgtttatttaaagttatctggcatataggttatttttagtgttagtttgagttttaaattttattttttaataaaataagcaaataatttttttaattttgtataattttaaatatttttaattttcttagatgttaaaaaaattataataatctattgaaaggcgtactgtttgtttgatagtactcgatatttttaaaacatggatgatattttggtaatattttattttacatatccaatcaatcatccatattttgtattatcgtttctttcttctcacatgatttatgataacaatgtttctgttttttgttgtttatttttctgaagctgttagaagaattatttttcttttgaaataagaaaaggaaaagttaaagtaaagagagagagtgaaggaaaatggatggttgggggtggctttaccgagggtgagaaggcagagaggcaaaaagaaagtaataaaatattaaagtttcagtaattaattaccagtggtagagtagagtagggtgaataggttgtatataaaatgaaaattttagtatagaaagaaagtaaggggatatgaggaggacgaggtgcctcgagccctgtaagtgacaaccatcaatcaatctaatctctcatctcacaaaaatactaattttcaagttagcatagaaattatcacaacaataccacttgtattttaggatgaagatgaagatattattcactgtgattctgaagctagttttcatattcatgggcaaaggcgattactaacaaacgagtgctgtgaaaaaaaaaaacaataacaattcaaacgagtatcaactagtcttgaatcaacaatattaggattagttatgtcactttccaatacacatcatgtcacaaaaaacaaagacgatgttgtggggatgtactttgacacttctaataggtactaattgggtccaaactacctaaaaaatctaagctctggatcaagttaccttaagtgggtcactatattttgatcatgatacgataggtcacccaactgattacaatactgatgatcatggcaacagcatatttcttaataagcagtgccaattacttgcatgtaaaacatgtatacatcaaaataataacctgtgaatttgcaaagttttgtcccggaagattagatatctttgggtccatgacaaattaatacatcatatattgatttataaactcaaaaaatcactacttacataaaatattttcaatgccgttccttataattaagcgtcacttcaagttaagcaacactatttaataaaatttattattgaaacacatgatttgacattacttatacaaacactattatttatataaataaaaatatgtttatttataaaaagagaaaaattaattgattgtagaacttataaattaagttaaatattgactctagctattttagaaattttgtataagtgcttaaatttatatgacattagaacacttataaaattgagataagctactcatttaagtatccatgtgttgtgaatgctctaaagaagatcatggctatattcctaaccaatatgaaaaatcttaccacactcttcatgcccaaaattgatgccatgttgtgctgaatcagttgctctaaaatcctaaaattcatttagttaatgcacaaataattttaacactcctccacataagagcccattaagtttaaaatacagataatgcataaacttgaatgaaataataacatgaaaacaaatttgtccttttcctcaaaaacttatcgaaatcaatttgccaacaagaatacaaaggaacgaggatttgtacccaaacaataaaagaacttgccaatttgcatggacattatgctacatcgagataaggtagttttgttggggaggcagggcatgtggtt

SEQ ID NO: 4066 - DNA, 1387 bp, Glycine max
  Soy_ogl_2107 Gm07:946514..947900 Cluster 17
gtaaatgtgagcataagattatataactacaaatatatcaagagagcttaattcgattgtttgagtataatgtgtgaattaatatcaattatttatatgtgtctttgattactatgaataaaacaatattcaatttatttaaaagttggtgtgcatgatcattcaataataagaaaatattcaacgcttctatatatataaagaattattaagtattttagatcgatcgtcctaaccctatgtaaaaaaaaaatactttttacattgtactaaaaatcattgaaaaaagtactttcaaaatcgattttaagaaaaataaaaacattttgagattttgattctaagtaaattaatttttattttaggataattttagtacaattatatgggaatttttaaaaagtgatttcttgatgaacttataaaaatcaacaaattcaataaaagatataatactttattaatcaataatattggataatagtatttcaaaggataaaatatatatattcttataagaaataacataaagaaagtcataagcgtgtattactctttatagagattttatcgtaaaagatattgagagaaataagaaataagtaggcaaaaaaatgtaaagaaaggtgtatttataaaagtgagtgaatgaatcttgataataataatactaagaacaataaagagaaagtaatttcataattattttcattatcttccttttaaaaaaaatatttgcattatattttttaaggttagcatattcttaaaaggaataaaatcaaatctaataaattatgaacatctacaaattaaaataaacatattgatttaaagcaattttactatttatgaatataatttcacgttatcaataaaggaacagggtaacaatcatgggtaccatatcccaggataaattactttacaattaagatatatcaccagataattagaaaataaatttttttcaaaattattacaaaaacaaaaccctcataacaacaacaacgattacttacttcaatagaaacttgttatatatatatatatgtaagcggctgttaataaccttgtaccactaaaacctactctgagcaaaaagactctccaagtttggaagcaattttgaaagcaaccaagataaaaaaaaataatggaaagcaatgttgaagcagaaagcaatcatggaaaagtttctgcttctgcatcaacatcaaataagtcaccaccaatgaagaatgatttaatttgcaagtattgtaacaagaagttcagcaattaccaagccttgggtgggcatcagaatgcacacaaggaagagagagcagcagcacaaaaagagaagattcttaacatggcttctgcttataacaaaaattcatat

SEQ ID NO: 4067 - DNA, 1543 bp, Glycine max
  Soy_ogl_1477 Gm04:47850358..47851900 Cluster 17
atttaattaaaaatcattctgactttgaaattaattattttaaaaattaataaatattatatatatgtgattaaataataggataaaattattgtataaggtgagtgtttgaccttttttctcaaatataaatctaacttatttctatagctaattagctattattcattattaattattaataataaaaatgacagttgaaaaaaaaaatctcaatgtacccaaacatgccgttgaatttcaaaagacttgcctgcaatactatacaaaataaatcatttggaagaccttgcccaaaagaacccgcagttcccctccatgatccccacaggccacaacgattcccattttcttttggcacaaaacagaatccgatttgactcatattaatgatacgtaattccgagattatttatctgatggtgtctcaactcagttgcatgttttacactgaataaaaaaactcaattacatgtttttgatttctctattgaaatatatagtgatttaaatatatatcttacacattagtcaaaaaaatattttaattatttcaaaattacttttattttatcttaatatgtatacttaattttaaaaaattatgttgatcagctatttttattattatttatggtagtcttaattacctcaaagaagtgattgaatatttagcctcaatgaaaattttaatagccataatgatataacataaaatatcagaaaactggtaagaaagcaacgtttcctccaatagcaagtatcactgtgccttataatgagagggaccgtatttcatgctttcatgttcgtatcccatcccgattttagggtttctgcaacttctgttcattcctccctgccgccgccatcgtttattcaattaatgaatattttgtggcatgtttttccctcgtacgaaaattcctttaggctttttttcttcttcataaaatagcaaatgttttgtgtatttatttttatactaaaattagcattcttagtttgaattttttattgttttcatcatctatcatccgtgcatcataatcaatttttgtatgtctacttaattttttcttaatttcctataggaatcaaaagatagatatcaaaattacaacaaacccacacactatattcaatcaaccaagtaaactatatctaatcttctccctatttcatctatatcaaacatttttataatattatttgatatactatatttctcgttcatctctcttaaaattaacaaacaacataatagtaaatatgatgatttcactctcaattatttctaacggtattttttgaaaaaactttttaattatggttaggtttagttccctagaatgaaaacaaaaatgctagacttctcaagttttgaaatttttgagtctttttcctttctttaactgcattcttgctatattgtaagtgctgtaaatctacagatttttatgtagataatgaatggacaaaaattatgtttaattataattttcagtttatgtgagatacagagtagtattttatgtgaagt

SEQ ID NO: 4068 - DNA, 1560 bp, Glycine max
  Soy_ogl_350 Gm02:3436241..3437800 Cluster 17
aatgggcacaaacgacagaaaagaatcaccaaactattcggcaaaattataaaataggaataatgacagacagattgtgcagacccgcggcttcaatttgcacgtcttttgttttcttctgaaaaagaaatgtttattattgcactccacacaaaaacaaataaataaagaaaaatatttcttgaatattatttattatgctataagataccgaatcgagaaaaatatggatgttataagatttacaatatgatataaaaaaaaattaaaaaattataaatattaataaaatattttttaaaaaatgaatatttatgtattgttactgtaaaataaaacaatactaaaacggaatatgcatgtgccactcaatcatcatatgacttttgaaagatgcgcagaatgactgactagttttattgaagccgtgcaagctacgctctaaccatttgtagatctaattgtagttcaacatctctctggtcatatcaaaattatgtttgggggagattaggaaaagaaacaaaagattctaatcctacttctaattaacaatttttttctgaattaaaaaaaattatatttacttccttttttaaaaaaaatggactcatcattcgtataactattatgaaaacaattaatgtcatttcaatagataatcatttattatgtgttagtttacttgagtattcacctcttaaacttttgtttatgtgaaggctcatttcaattaatatcaagcaaatatttagtcaaaatcaacaatctaatttctaaaacaattaaaagtattcaacaataaaaacaataaaaacattgaatatttttagccggttctcttaaaagttaaataattgttaataaaaaaaattatcgtgaattgttaagtctaaacttatcagttagttgctgttaaaaaaacttatcagttagttagtatcacttgatttaaaacctttgatggcaattactatgatatgattttgatggagagtttggggttgtccccaccccacgcctttatacttgtattaacatcctttaacaatataaattcgcatgcgttgattaacaaaaacatgtgttttgtcaataataatgtcagtataggtctcttcaatgcaaaagatttaggcattaggtatcatattactaatatattgttttagagagcttcatattactaatatcttgttttagttttaaaattacaacatgataagattaacttttcttacagtttttttataaaaaagatttaaaattgctagtattattgtattttatggaagtaaatatacatcaattatttatataagtgtttgaaagatgtgggaagctagcatgtttcttaacgaaaccctttatttctagcaagtgaggcatactaataacaaaacacaaatcacaaatcacatcaaattagctgcatttgatatgtacacaccactaaaaaatattacttgtacaacatctatatggttcttaacgaaagaaagaaattgggtaagaccgtaagggtaaaataaaatccacatttatgattggataagatct

SEQ ID NO: 4069 - DNA, 2313 bp, Glycine max
  Soy_ogl_4881 Gm15:2889988..2892300 Cluster 17
atcatgattattgactgcatgaaattaatttgaatgtagagaatacaggtatgatgacaattaatgcctacttttgttactacagaaaatctgaagtttattaattgtcatccaagttaattctccagcaacatcggaagtcacttaatatcataattaacattctgaattcctctaatcaacccttaattaaaaaatatttccaaggaaatttagtcaagataatactataaaatttgcaacactcacactttgtgtttaacctaccgaactagcaagttagagtcctttggtgtatgttctactcttgaaagcatgttgtgtgagtgtagatatatcctcagctaaggattggattgactgatcatttgaagtgcatggtacagtttaattagaaaataaaaatcaataatagttattgattattttttaactatcattattcaacatttatcttttaaaatgaacctgcatttaaacgagtcaaatctcctaaatataagaactagttgggtgagagagagggtccgtaacagaagaaagcataacaatgtgtttcaccttctagttcatctaattaaaatcaattaaactaaattcgagtgaaaaaaaatagggcttcaaaactttcaacttaaaatcaaaccaaatcagagttaaaaaaatagggcttcaacaactttcgacttaattaaaatctagctatattcgggctgttacccagatttgggctgagggaccaatatggggtttaatatgctactcaaatcaaagcataccttacactgtgcttgctacattaggcagataatcttaattaccaactcacgcaacgggttataaaatactagtactatttagcgcgtggttagaggggctcactgtactctaagattatctcattgtgctcaaagattaatcatagataaaattaataaatattttatattaatgtcacagtaaaaaaaaaaaaaactcatctaataaatattataatcacaagttaaactttctatctcatatactatcagtatggtatatatacttactaatctgggcgttaaaataactgacacctttgctcccttgttggactagtatcatcaccatcgttctcttcaacctaaaatagaacttatatatagacttaattagctagattaagtatatatgttattagatcaataaaatctatttttaataccaaaattaaatttacggtatagtatacctagtatggtttttatactctatttttttagaatatataagatagactatggttcattctttaaataaaattttagtaccgtaattaagctgatcaaattagatttataaactctagtaagtcacaacacacggactaggagattgtttctggtcctaattaattgagggaaacctcgctctgaacaagtatttatattctcaattaattttagaaagcactatttttattcactatatacctttcatttagcagctttattactatttcaactgaaaagaatttaattagcatcataaaagtgaagtaaatcaatattgatgcataatatagtttactttggctaccaagtctaaataacttcaacacataaataaaaacaggtatctaatattcatgtgtcaactgtgattctgtgcggaatagtgttaagatcatacttagataaacctttcgataagctaatgcttatataagacgagtaaataaaaaaataaaatgaattaatttttttttcattaaataaaatattttttttgaaaaagttgaaatgtccaaattaattttaatttattagaaaaattgaattcattttatcttgttttttttcacagtgtttattgaaaaatctatccaaatatcgaaatctaaataaaacaaacaagcttaacaacaaaagcatatatgcatgacatcttaaaggttttaagttagacatgtggtgttttgtttgtgtgattcttattacttgatctgttgatgaaattttccttagggttttacttttagctctcccctaactccttacttccaatattgtcgtattagtgtttatgcacacaaagcaaatagctagtgcatgctaaccatactttatttaattatctattctgatatcagttaaatcttctgaacatagttctccttacccatcctttcaaatttaaaataacaattatttatcttccacataaagaagccgacttggattataagctcaagtgtctagattcccttcatatgtttttctttatgttaattaattaaagagggacgacatgacaccatctttctgactagaa

SEQ ID NO: 4070 - DNA, 1518 bp, Glycine max
  Soy_ogl_2842 Gm08:41105801..41107318 Cluster 17
ataaagacagtggtggctggaatgggacccaaaataaggaaaatgaaaaataaaatactgaaagagtatgagtaaccaagaaataaaagataaatctagaggatcccatctcaatcaatcattgtctctttaatctttaattaccctttcttcaaattatttgattaattcccttcttttacctcatttctaatttaatttctattttctacagcttcaactgggaagttgtcacgccatattattattcttttttataaattaattttaactacaacttgtagagattaatttttttaaatcaatcaatataatcttaaatttataaaaaaaaaaggttaaattcttcaaaattatctttattgaaaaatttattaattctattaattatttttcaccttaattatgagtgtgtttaaataaataatcaaatgtttaattataaatttttaaataatataataatatattcttgtttatattttgtgaaagaaattaaagataactttattatttaaagtgtcttttattttgtgtaagacaaaattttaatttttcattttatattgttaatactttttttttggtaggccatattgttaatacttgtgtcacatgcattccggtctaattaccaaagagttgctataactctcccatgcctagatgaacaacacatgttgccatgcctagataaaactagtccatcactgtaattatatagtagtgtatgtatactacagggtttagtaaagataagctctaactaagatgtgcattttatttctttttttgtaaatgtcactaatacattattttaattccatagtgactagtgtagtctaacccatttttatctggaacttaattccagttgtgcttgtgatttgtatcacaattaactagctagattcaaaatccttttatacttaattggagcgatgaacttttcttgctttttctttttctttttcttttccaaagccaagccaacgattcatggtacattttttagtcctatttcacatgcaacaatttactctttcatttatgaaaaaacgagccaataatagttgtgaatattaatatatggctcatgcattgcttccatagctgaggactcaatcacgttacgatcgtctgcatatatgcatgttcaagtcacgaacaaattaacactgttgtaaccactaaccacatgcttaaatggttatacattaatcaatacataacaaacagttccacgtgtgagtttattaaaagcattaaagcaacatttcaccagcactacaaaagaaaatataatgaaaatgtattcattaggtattagaaccatctctattagtttaacatttatctaatgaaaattgatttttagcagaaaaataactgtaaatattaatattatatatgctaatgatatagtatatttttctatggtaaaaatatgttaatttaaataacactttgcttaaataatttatttaataaattcaaggctcaagtttaacttattgt

SEQ ID NO: 4071 - DNA, 1765 bp, Glycine max
  Soy_ogl_2462 Gm08:2147001..2148765 Cluster 17
ccaaagacaattgacctttaatataagcattagcttacaacaacaatattttttttattatcagccaaataaaaactttcattaaaaaggtacctgtggtaccacaacattgaaactaagttaccacaagagaaagcacttgacaacaaagccactttcccaacataactcagcccaagataaaacacaaaaactaaagatataaagaccagctgcacctatagtatataagagaagtttttcaccttgcatgataaccaaaatcaggatttcaacacaatcaaatcccatactaagtcaaaattcaaggctgacccactcaaaataatatcatttctatgtatccatatatagggtccaattcgttgcaaacagcaacactaatataaggcatcattccaagcgtcatgcacacaggttgggttataaccaattagctagctagatcttctcatcacggtatgatattgttgaaaataatgcatactactctatctcaaaaacctatatagctttttttatataaaaaaaaggaaatgaagatattaattattgcaaccaaactcgatcagcacgaaacatgccaagttggtaaattaatttggaatatcgaataacgtataatttttttttggtcaatttcatattgttattatccttaatttgaagataatatgtttaagatatagtaagatattagatatagacacttccttcaatagaaattaaaatcttgattcttcacattgtaaactactaatcgcatttaaatcatttatttagactaattcattcaacacgtacatggatgacatgatattttattaatttaattagagtttttgaaattaagttcttagtatgtaattacaataaatattaggagaaattttttaacattcataataattttatcatgcttaaatacaattctcccataaaaaatacattaatttagaaagaaagaaaaaactcaacttaaccctccttacggtacaatgcacgtattcattttcgaagggctcttgaaggaaattcatagcaaagcccgtcaatctcatttacaacgacaatgaatgatttgcattattttctactcgtattcaagatatgaagacgaggaatatcaatatatttaattatacaagaaacagactactccattaactttttgtccataagaaacactactccattaatttactgttggattgctttctatgtcaacggcacaagttatagtaatatctatctaaaattgatagttactaactagctagttagctagcataaagatatggatcgattggagagttagatgcaccataaaattaattcatcattgcgtccacgtcttcaattacgtgtattcatgtgtttgtagcctatctaatgaaagtcatatcctgcaaaaatagactaagatgataataaacctcttagttttattttcacttactgcaaaagaataatcatatattaacagtttggtattgggtgaaagagagagattaagttatagattttactatttgtatgaaaatgttttttgtattacatatatattttgtatttttgtatactaaaatggatagcattttgaaggagatcgactattctatcaataaatttatgataagtattttattatatatttattatggaaatgcgtaaaattttgttgatactgttaaattatttttgtaaattgtgaaattttcagttactgaattataaaaattaaatgcatagtttataaataaaa

SEQ ID NO: 4072 - DNA, 1598 bp, Glycine max
  Soy_ogl_286 Gm01:52194503..52196100 Cluster 17
attcggaatgatttataattaataaatcttactagtacaagagaaaaggagaagtggataaaaaataaaatacaattattgaaaatcgaattaaaaacactcacaattcatctcataatttaaccaattaacttaattaatgcaataaaaaatattaagcgaggtcaaaaggaatataaattatattaccataagccattttcctcttataaatagtataacaagaatgtttaaattagtatgtgtactttgatatatgattcaacgaatctgagttaaatactaaacgtgtagtaatcttaaaggcaaatcaaccctaaattggtctatagagagagaggctatgcttgaaaccacgtccgaaacttcatatacaagcatctctattaatacttctcacagtaattaacttttacatcaaacgctaaattgagacatgttttatcctctttaaacttgtttccaaatacgcatatagattctgtcagacaaactaataatctgatttctcaatccaaatataaataacatattattaattaaattgttttttagttaaatattttaaatagccatatgtttctatatgatttatatgtttgttataattaatataatacatgagaacctcattaacgaattaaaatcaagtttgtagattattactttattatgcatattatacaccaacttacatgtgcatagctagttttatatccgcattaatttaaatccattcgaactgaaatggtttactttacagactgaaattagagaataatagtgtaataaatagcaatatacacattactttatattcatttaattttatattttaattacattttatttcatttctttttaaatatttttacggtatattctggattctatactctgtttaaatgaaaagagaaatttttttaaattcaaaataaataaaaaccttaaaatagatatttttgtttcttgaattttctattctttttttcctcctatttttcattaattatacaacgttatttttaaaatttccattttttttacctttttgttatcattcaaaccttcttttattatctagaggaagaatagggaggataagaaaggaggtagagagaatattttgttaggaattaaatctcgtggttcttgttatatattctaactcttaacagattaaagaatgatccgggacttgacatctatggaaacaatgtgtaaaaacaaataaaaattgaatggacatgagaagagaagaagaggggtatcaaataatgttagggctaagacgtgtggcaaccggcatagtgtgccactactgcttagtggacccttcagtgtagtacagaggctgagtaagccattgtttccttgaataggacatttggtacgcacgctgagctgagacatatacttgaaaattgaagaagaaaaagaaaagaaaaccctaaagaagaagagaagaacacaccgagaaagcaacatggtcggttggccttaaaggcaggaacaaacaaacatcaccaaaaccttatcttaaattcgcatctctgatccctctatcgactttctacgctccacaatcatctagctac

SEQ ID NO: 4073 - DNA, 1900 bp, Glycine max
  Soy_ogl_4420 Gm13:33332901..33334800 Cluster 17
ttagatttatgcatcattatttatttaatttatgttgtttatgattttttttcttacactaggttgtatttttgtgattttaattagaaaagattatttgtggaatgaactaaagcaagagaaataaaatcagtcataacttgagctccaataatgtgattaaggttattttggtgtctattgtttatgaaaaacttaaacaaagactttccatgaggagactttgattgaattataaagggaccacagagaaaattagttatatctagacaacttgacataggtgtagtattttgaacatatcttaacttataaaaattaaaacgacatacaaatagtgcctaacatcaataaatatttatccacaatttttgtaaagagagacctttgctgaatttgatcacgccttgactgtggtgggtcccttgacaatattgactattggtaagagagatttttcaagttgagctcgtcacaatttcaccatggataatggtagccacaactgagatgtgcggttaagtactctattttcagcgattttttttttcttttaatttgtgttaggcttgagctcttttagccctaggtattaaatacttcttttagggatagtttgaaggtgtcgaaacctaagagattagagcatcatgagaatcaagttgaagataatttatctctttgtttttctttctaatttgaatgttctcgtttcatctttttggtttttcatgtctatatgaaaatatttgagtaaaccttttaatttttaggattggaatttggacataacccttgaccttaataatttgtaaattgttgttttctatgtttaattctctctatcagtcaaaaaaatgtttgattctctctacataagattttaaatgagtttcatgtgtaaataaaactttggataaaataataattaatttcatcgtattgtaaatatttttgggttgaacataaaataatgttatacaaactgtcatataaattattgtatgtatatcacatttctatattttatatggatcaaagtaatgtcaagttaattagattgaatcttattaccgcaaattgtcagttgtttgtatagaaagaagtgacataaaagaaatgaacagtgaacctaacacttgtatatgggaagctacacaatgatacaatatgtcaacgtgtacttctactagggagatgtttgctttaacattatgcttttaaggtccacaaatagtatgattattaatgacattttttaataaatatagaaatatgtttttaattagtgcttttcttaactaattaaacaaattaagacgttttatacgtacaacaatttaaaactatcttagtttcctgtgattttaacatctcagattttctagaaggtggctgactggttgttatgcgtcaattagtctagacatgactgactgactgttcatataggatgaaaatgggtaggattttccaaggaacgcattataccctaactatggttctatttcacacgtaaaaatgccataatatagagtccacgctttggcatttccattatcagcaaaatagaactttaattctaattttaaaaaaaatcatatgaaaacacttaaagaactgtatctaaattttatactcaaaagtattcttcagctcagtaattcacctaatacaacttttacattgaagatttctgtaaattgcgaagaataaactctaattatgatcaacagtacaaaagcacgtaattacttgcatttaagttttgtcccaagaaaaatcgttaaatatgagtcacggatctgtgttgcaccaccccaccccatggcctaaacatataccgaaagcccaaaaccttgtgtgtggttccaatctaggttattgtattctggacatt

SEQ ID NO: 4074 - DNA, 1894 bp, Glycine max
  Soy_ogl_6589 Gm19:45280107..45282000 Cluster 17
agacctttgagcatcatgtgtagaagttgaatattggaaggagcacctttaaaaaaaatagtttgagactattagcacctttctcactggagaagcaggcaaatgagctaggaaattggaaggtgctggataatctatcatggccgcaatacccaaagccatttgaagccaagataccagagcacctgcgcttatataattccttcaggaaaacaagaacaaataatctatcatccgttatatatggggaataatctgaataaagaatgtttttttttaaaggattaattagtaagtcatactctcacttgcatattctgaacgatttccatagttgttctagtcctccaggttttcgagctgtgtcttctatttgtttccaagaccctttaatcactttgtaacaattctcactctcgctctaaggatcatattttatgcaacaaaaaaaaaatatatcagcgcataattcttgactaatcaagagctaggactactagtgcatggagttggttagaacatctttaattaaattttaaagttaaattttttagctcaaaaatcaccctttactgatctaccataataaatgcatgttctgaaaaatctttggcatgaaggttggattctcttcaaaaactctcaagaaatgttcccattttcaaaaaaagtattttttaatatctctctccctaactgaatgataacatatatttaagtataatttattgtggaacttacaaaagtaaaattttgaactcaaaaatcacttttcaccgatcttccactatacatgcttagatgttgaaaatcttgggcatgaaggttggatcctctttaagaaaagtgttcccatttaaaaaaatattttttaatgtctttctctctaagtgattgataatatatatttaagtgtagttcgttataagacttgcaaaaatagttcaagaattcaaagtgaaatctattaaaaaaataatcttatatcatcatgtgtaatactatgagaatccaaaatgtaaaatcacatcttatatgtatatgtatagtaagagtttttcttaaaaagaaaaaacaaacgaattttattaacgaggaataacttaattatcaccagataagttattacagaaagcaaaacatagagaactacataacctccccaccacaacccgtataacaaagtacatgagagcaccatttaaccgttgcataatataatatccccccaaactacagaggtaccgtccatatgtatagtaagacgtgaatgaattaaattaataataaagatgaacgaaaagtaattcaggagtctatctttattttttgtcacacaaatagttatataaatatttcaaaacatttattttattccatgaaaataaaaaattaactatcataatatataatccaaaattaaatgaatttaggaaattatcacttttaaacaatatcaccaatctccatattggtgaggactagtacgtattgggttaaatttcagccataatgatatgatggagattggagagtggctaggcgaccttatagtcttgagtgatgatatcagtataggtattgggtgaaaccaaatccagaaattgaaggattggagcagaggatgccaaggctccaatggcaacatgtggatacttcattctaaaccatgcagtcagtactgcaaaacatccattcagactaattatctaaaagaggaaaacattattgtcacataaaatatagacattaatttttgataaaatatgatgtatagtataattcctccataggatcctccaaacactacaacaggggaatatgttgctgataaattcttcttgagatcaatgatgagtagtgtggagctcaagtatccaagtgtgctgctatt

SEQ ID NO: 4075 - DNA, 2800 bp, Glycine max
  Soy_ogl_814 Gm03:3144901..3147700 Cluster 17
tttaaatatcttcgctcaaaagcttgtaggtggaccccattttgcaggcatgataatcaaatccctggatgcattaaattcttgtaataccaaacacaagcgcatgtacatttgttcgaatctcatcttctcacttctctgttactaaatggaaacccatctccatactttgtaacatcttccatccatggctctctcagacatttccactcccaccaggtaaagttctcaccttttcccctctacattcatcattttccctccctcgtgtttggtaatgcaccattttctcttctctgttaaaagaaggccaagtttttgttttttggtttaaacaaccagctgatcaagaacaataagaatataaaagtcatgcatgcctctttttgttaactgttgaacctatttgggttattcatatcgatttcttaatttgtgtcccatgaagattcaatgaagatcttatgccatacccgtttagggtttaatgttaccatcgtgtttgaaaatcttggcacttctatataaacatgttttgaatgccatgatatttggattaacttattttaaaaagcatttttttaagaaacttcttttcccctcattaagaaaaattaggataaggctgttgataatgttgttgttgaagaagctgttaagacttaaaagagatttccatgaggcttttattgttgttgttttaaaaaagtgatggtttttaaatataatagattttctgactaggactttaaactactgatcattatggccttgtacacaacccttgattactgactccactcttccaattctcagagcaccgtgctgcataacataagcaagggtggtaatcaagatttagtgaccaagtaattattgaaaaatcatcatattttttcacggcacatctttcacattgcgagttttcgatgttttattttgacttgccggagtttgaaaagctagtctctcacttttgttgtttgactcatgcaacattttatgttaagcattaattgttaggccatggtcatgatctgtaacatatttaattagcttaatccctaagtaagtgatgaatgacgtcagcaacatttttaccttaatttgtatacacagtattttgtgatcacctttaaattagctggtttggctgaaacttgaacaatggaagtgacttgagtagtagggttgaatggacatacttttcagcagttgacactagacactgtcttgtgttattgcagttgtccggatgaaaaggaaagtgactgtgactctccgattgaaagcaatgcttttggtgatttgagtttgacaaaggagaaaacttttgatcttcaaactgtgtcacctcattcttttggtcaaggtttgccatatgcacctgaagggtggcctaatccaggtgatgtattgggctggaaagtattgaaaaggacctcccatgctggagacggagcttcagaaccgagctttatgtttagcaatacattgaatcaaattttcctaacttgggaattgaaacattctttgatttatttagctggcagatcccgctactgggaaaactcccagaaaaggttagcttaaaattacagttttgcaattttcttttcaaccgggtgattctattttctcatcttgcaacttttgttgtccctttttcattttatatatttcttattatttgatatatatggccttctagctgtactatctttgcccattactcctccagtgaagtccctggagaccgaagaaaatggcaattccacataatagattggcacgaagaagtagttaaaatggagaacacaaatctgcagtcaactaactcagaaattttccagactacttcatcttcgtcaatgcttagcgcctaatcaagatgcaaatatcgtcattgatttttgcgatcagaatgacaaagagacaagaattgattcaactgagatttcaaaaggcatctcagattctgaagaaggatctgctatgcagacaactgtaaagaaagatcccaatgcaaccactgttctagagaatcttgatgaggatcttgataccttggagaacgtgactgttgagcctcatactgagacttaataagatcatgccactttggataatgaaatgatacagcactgcaagaaaaagctttctttccttgttgatgtaggcttcccttctctgatctcatgtaatgatgttgtggtagaagttgcaacactcaattttgagcaactggcacaggtaaagtaaagttggtggaacaacctccattaatcagtgagacttttctggaggcacacagattcttagtagacttggagtcaaagaaacatagagttcttggtttgaaaaatgagtaaaaggacaaagtagctgggatagagttcgaaatggatagaaactcttcagcaatcgatgatcaaatttggcaacttgaatcaaaacggaacgaaatttctgaggctctagaaagcatgaaaaagagtaaagttgagtagacttctggggaagcaagtgttgccaaatcaattgtaacccttactggggagattcagcttggattatctaaaaactcaagatgggagctgaagaaagccaactttgcccggcgtgtagctgaagggggaggatggtgtattggcgtgggatgagcgtgggatgagtaagaggatttggaaagggcagtagctagtatcagtgatgtgactaatagaggacatgtcaacttatgccacatgaattaattcaaggtggtaggatttgctttcaaaatttgattatttaaata

SEQ ID NO: 4076 - DNA, 1336 bp, Glycine max
  Soy_ogl_2841 Gm08:41072865..41074200 Cluster 17
taaatatattttactagaatagtgtgtctttcattatattatcaggggtattttttccctataaactaaagatactttaggagtagttttttttttttttacccttctaagatattaagtgtgtcctcctaagaggtaagtgtgtattgagacattgaccaatacattctatcgattataatttattaaaaaataaattttaattagaataacatatatgcattatcattttatttttaaaaaagaaaaatgcaacagaagttaaattaatataagtctaatatttttatactgttattaataatatgctgacttattatgttaaaaatctttaaaaaaacattttataaataattaagttaaactttttaacaagttaacaatatataagtggatacagaacatcaaaactaaatccatttgaaaacggtgctataactattttctcatttgttggtagttgttgagtggtgtggcagacttcacactaaaatggaacaaagcatgttatatataggctttatttaatttcatgctttgtgttctttaaagcaaacataatagaatgtaagattgaatatatttttattctccaaagaagataaaactaaattaaatagagtataataaactgctacgttgctttctgtccgcccatgtgtcaaactttacataatttttttttatcaatgttgattattaatatttgtagaagaacattatagtttagagtaaataattaaacaactcagttttgggaagcacctttcacctgcgatttatcttctcaattgtttatgcatattaactaatttttaatttataaaaaccatattaaactttccttagaatctctaggtaaaaaaatggcataatactaattatgtaaatttttaagtgactattccatacattaagtaaatcttacgagtgaaaaataatttgagcgaataaatatttcctctttacttgtattttattccactgataatttgtctaatttataagaatcaaattcacccttcaagaatatgagtttgatttctacttaagacatgccccttagttcttgttctctcaaggaattcctgtatcaagcacatggcctatggtccagatggttgagagtacaattataagtggacctctgtgtaacgttgcaattccagccattggtccccactaacactaactcaactagcttctgtacattgtaccacgattaattaattaatggccaaatgatcctaacaaaaaaatctagattccacgtgtttttgtttaattttaatgatatgcacatttcatagcattcaagtacttgaatgctttaaat

SEQ ID NO: 4077 - DNA, 1498 bp, Glycine max
  Soy_ogl_3685 Gm11:2267401..2268898 Cluster 17
tatgtaaaattttgttaattagataacaattatgtagtatgaacgtattatgagatagattaatttttgaccaaataaatataaattaaatgagactctaagcttaaaaaataaaaatggttttgatggttgtgaaatgagaagttggaaggagtgcgggtggaaatgttggcaggctttgttgtcacgcctgcaaaatccattggagcttagcaccgggaaatgcgtacatgttgacgttggcgtgcctcaacttaaaattcggtattctatctagtattcaacatccacctccaaatatgtaccttttttaacataaaacagaagccctttttcgtaatttggttcctgtcccggtgaaccattttctttctactgttgaaaaggacgtttcttaaagagttagtaattaaaaaacattaaaaattacgttcaaaatcaccataaagtagtttttttttttatcaggcaccataaagtagattaaggtttataaaattaagtttgagttaaaattaaagtttgcaaaaataattcaaaccttacttctacaaattaattttttttatacaaaatttaaatgtataaaaatatttttttgaagataactacacacatcacaaaatttatttttcaaactaagtttaggacatcctaaatgaaaaccaaacataaccaaattgtattgataacgtttttagtaataaaaaaattgtttaggtttttaaataactttttagaaaaaaaaatatttatcaattgtcttttctttttctgacaaaatgattgcatgccgtattaatattcacagcttctgagagcaaattcaaatgacttaactaatgacagagaaaagacaatgagttgggataggccacttctgccagtgggacaataaattgaattataagaaaaattaaatgataccaataatgtagatatttttttttccactgctgtaccaaaaaaatactttagatattcttaacttaagattcaatttcaatatttcattcacgtaataaacatcagcgttaaaaattgatgcttaatagtagttattacaagagatatatgattattctatcagtaaagagataagtaaagaggtcatgctttcaaataccctattaataaatactaaaaaactagtaattactagtatcaaccaacatttattattgacaaaaaaaacaacaattactactatcagcgctataaaaatacttgtaattttggtgtattgaagtagtattaattattcctttggctgatagattcccaagtcacaacagtgttgttttttttctgacgttacgacataattattatatttgaacatctgggactttgggtggtattccccatggaacagcgaacccatatttggtgcctcagcgttgaaaaattactaactaagagcgttaaagattttaaatatcaaattcgataaataatcaaattctttcatataaaagtgaaaagtgtgagatattaa

SEQ ID NO: 4078 - DNA, 1628 bp, Glycine max
  Soy_ogl_7007 Gm20:45644701..45646328 Cluster 17
caaaagttagcacttgaaagagatccacgtacttaagagatccacgttagcacttgaaagatccactcagaattgtttgtaataatcaatgtacttaaaagattacctgaaagcatttactcgaagaaaatatatattgcaaaagtgattgtggccagattaggttggattgatcttgttaaaagaataaaagttgaactgattaaattttgtttagttgagttcaatttgatatttgttttaacttgatgactgagatcgggtgatcctattataaaaagaagccaaaatgggtgttggtttttatattaatgttgcaaacaactaaaataatagtattatttatattaaaacttcaaaataaatataatagattaatatttttttggtacagacatataattgattaatataatcaatgtattttgaattacaactgattttttaaagggtgttaattacaatttattaagctaagtagtgtttataattacgtaatgcttatgacttaaaacggttaaaatatcacatgtttcaattaattttttttcttgaaaggatgttacaattgatttttaattacaatcttttttttataaaataattacaatctttcaagttaaactatttgatttcagttatatataaatttctccctctatgaatatataaatttaagttttcataaacagctcaacacagaagctcttttaatttgactcgctcacaaaattcattaatatttagcgtcatggaaatagaaattgatgattaattaattattagcttagggttttcaagcgtttatatcaattattacctttgtaatagtgttttttcttttccaccaaaatattttccatacacataatcaaacactgaccaccttaaagaatttgtcgtggaaaattcataaaatatgatctttgatatgatgggttacaagttcaaggtcttactcattttttttttcatttgaaataaagtaaatgtaagtcttccagaagtatttttctaaattcaaagtagtttttttaccttaaacaaacagaaattatatcctttaaacttttaagagtgactattttagtagaagagattttgtgttgtgttagaaaaatatctccattctaattttttttactaaaaaaaagtcattttaacttaattatgtccaaaattaaaaatcgttttcaaatagatcaaatttctatacaagtatttaattgcctgatgatttaaaacgtacatgtagaccttttaaagccactcaattttcccaaatcgtctattgagaggaggagacagcatatatatagaatcatatctagggttgttcaaaagtatatccgctttacttaatcattcatttttttaccacttttatatataattgaagtgtgatcaatggaggccagggaaaaaaaataattcaaatttgaaataacgaagaactaaagagtgtaaaaggctaaaagctttgaccatcattgcacatccaactcaaccaaatggagtttctttttatcattatttacctaacggcacaaaaagatcgaaactcattttcccctgggggtcctcccgggcctttttaattttttcaataatgaaaaaagaaaaaattt

SEQ ID NO: 4079 - DNA, 1700 bp, Glycine max
  Soy_ogl_1803 Gm06:6425301..6427000 Cluster 17
attagatacgcagttacacaatttaggtgtcaaaatgatacttatctgagctaatcttcaaagtatgcatttggcattcccttgttaggagcaaataaagattataatggccacgcccaagggaagtacttttgcattaatttgttggatgtgagtatgtgatgttgagagcaaggtagtgttttagagggtggagtactcatgctgccatgaatggctaggaatatgatgaagcagttttgagccaattgtggggggttaacgtggatgcatgatatgatcatatataatgccggtgccccattgataatggtgacttgttagttaggtgggggcatttctatcaataaattaaataaaggcaatattgctttcatgggaaacaagaaattataaacaaattcaagtttcttgaaatgcaaaaagttacagtatatatatccttatgtgacgtttaataacataatcgaataggcatgaaaccatttacacaactttttttttattataacattagtacgaaggctaattatttttagtgaaatcacttcttttaattatatattttttttcttttcattctaacacaatatcttaattaagagattgaatccaattccgtgtcgattttggctgtgaaggaaatgtctatatagttacattattgccgttctagcaaactgatattttcagaaaccataaaaatataaaatacttgaaaaggcttactcacgtaaagttttattgttatcctctcttttaataaaattgattatctacttttacagattagttgtttgataacgttttttcaagtaaatttcacttttgttcttataatatatttaaataaaatagccctttcctattttaaaaaaattacattcacacattatacttcaatttattataatgtagcaagtttattattattattattaattactatgaatgaacttttaacattgccaactaatattaaacattgtgtaaaataaattgaacttcaatttaagatgaaatgatattttgaatgtttatattaatgactttgaaactttacttattttttaaagttttaaagttgactgtagttggagattcaaaattattattgacaatgctttttttaaaaggattactgacaatggtatgagtcataaaggtgtaaaatttgactttaagatgttcatttacattaaagtaggctaaattatgatgcatattaatcttttaaagatagagattactagtatagttcttaaattaagagggaagaaatgtataaaattaattatttgtttttccaaatccatatgttggaagcattttgtattatacggttagtcgaaaactagctacaaaccgtaaaatcaaatagaattattatttaatctatttgcttcttcttcttttttttacacaaggacggtatgacctttaataataataataataaaatagacggtacgacctaaaaaatgataaaaggtacaagtaaacaatcagcttagatataataattttaatatcaacaaatgaaagttcctcacatctgctgaatatggattggtgtctttgtctcattggttgtattgggattttatatagatagtataagtctatatgtgtattgggaatttatataacggttggagtgtaccttttatactcccctatgtaatatttgattgcctaaa

SEQ ID NO: 4080 - DNA, 1395 bp, Glycine max
  Soy_ogl_4382 Gm13:31171901..31173295 Cluster 17
agtattttctttaaaaaataattaaacaagctcatccattagtgtggtcaatatgatcaacaaaaaaaaggggagtgagaagagatgggtcagctgatttgctaagaggttgattgatgattgggaagtggatgtcttcgatcggaactaatttacaagtttgggtacgacattaattatcgtagagacttggcaaggacattgctgaaattgagtaatgtgttctttcacaattaaagatgagattcactatctttgacttagtggcattctattaataattgaaacttcaaagatgtgaaagaagagttataaagtgcaatataaaacttgtgatgagataagaaatgtaattcacatattttaaatgtatttttaatatacttaaataacaagattttattgaaactaataaaataatataagccgtattttatatttattaaatttgacacataattttataaatttaaattaataacaaattagagtttttaaaaaatgttattagttagggcgatagtcccttaggggttaggacatggaactaatgcttaactgcttatgggtacaacaaagtaaatctacaatattaaagtatgatgttttaaaaacacgcgtataaaaaatacaaaatataaacatttttatttaaaaaattccttggttttaatatttgtaacgagtgttgtatttttaatataaacacaatagtttattctttaagagaattgtggagagcgagagatgtctaaattttgtactgaaagcatgctaattgttgaaaaacaatgtttcttcaatttcttttagaaaatcattaaaaataatttttttgcaatataacctaatctaaatgcttaagtatcatcaccatattatattaaaaagaaaaaagtattttttttttatcaaattgaagttataaaatttttatttaataaactttcttttccattaacttagtggtggagcgagtactcatgtcatccgattcaataatcaatatatttttttataatgaaatcttcttatttgcttataaaaaaactacacaaagtcataaaaacaaacccaattgataaatgatttcaacctgcagtctcgaggttaaacttaaaacaacttaaacaagtatatcttaattccttttttttaatgttgctaggatcttttattttagatttccatttcttaaacatgctaagtagaatttaatttttacttaggtgtatgacgaatcattaaaaaaaataaaaggttactttaattatttatagacttaaaaaaagcttttgaagcatggaaaagaaaagaagaagaaaaattcacgacatataaatgtcgtaaacttctgtttaaaacctgattcgaggaatggagggacccctttat

SEQ ID NO: 4081 - DNA, 1788 bp, Glycine max
  Soy_ogl_4621 Gm14:3655701..36538 Cluster 17
aataagagaaggctctccaaagggaaaactttttaaactcttactataatgcaaatccacaagtggaactcaccaatgttggataacagggatccaccggtttggtgaaacatcgcattcatatcatcaccttgaccccatcttccatttctatctcagacaacaacacaattcaagttctacatatatttcccagcagccaggggtggaatatgctcaaagcaaacatccatgtgagtctgtcaggcatctgaaatttaggtctacaagtacaacattgtggagtttggacttcttcaatcttaggcaccgtccctaactttatatcttttgtttgttttgttactacaactttcacattttagaatgttgctagcttcctcctccctcaggaaacaatgcttaaagaaacaaaatgtaaaatacattggcatattagtcccattttccttgaccatgctcttcttgttgcagccaaggttttaaaaaatggtatccaatgacaatttctgctgcagtataaaatcaacgcagccacatcagttacatttatctgaaattttccacaacatcaaatactgcaatgaaactctaatgggacctgaccgtaatttaaaaccttggttgcatacaaccagtgcatacaaggcagcatgactaggcacatgccagttatttacaatgaaattgcctaatacgttaacccagttccatcagtttagatagtcatgtgactttagatacatttgtgtctgctcaagcagtaagcatattattgttaaatggtgttattttataggtcaaatcttgtttattttggactgtttctgtgtaagttctgtttcactcttcttttgcttatgaaatatgctcattgtatattcaataataccttgttgagcatcatgaccttttattatagagattgttggaataactaaaccagtaggaagtggcagatttgttaagatttttgctggttttatgatactagtcagtctttatctaagatgggtttgatatagacaaatcaaacatgagtcgcagtggggtgaagtttaaaacgttaaggctaaatatttgaaagatttgtataatttgccattcaatacaatcttcccaccaaatctgtatcaacttatctgtttgccttgaaaagacaccaacttgatcaggttttcttggagttgcatggtccaccattaaccaatcaattgcaatttggttcaatttgggtgagtttgagataataatcacactatattccaacggttgaaaataagaaggggctagttgattttcagttaatccaacagcacttcgattacttaattacttaattacattcatatatattggagttgcaagaatgctctaattgattggaatcaaggaagcaagcatgtgttgaagtaatgcatttgatttagcctattttactttaagtttttcaggaattatttcaaaaaaataaaataaaataaagaagactgctttaaaaaaatatagtaactcttcatttaccctaccaagtttaattactgtatctttttacttaaatttaatttgactgatttgttcatttgttaaagttcatttaactgtttatgaaaattcatagtagaccattgaagaaaaaaatattttaatcaattaaaattagttttatttaattgattaaaatttctttcaaacatgagttacaaatgttttcaattttttatatttgaaataaatttaatccatatatgctataattttgtctaaattatataacatatataatta

SEQ ID NO: 4082 - DNA, 1300 bp, Glycine max
  Soy_ogl_3264 Gm09:43266801..43268100 Cluster 17
gttataaaagaaaacatttgaaaaacaaaattgagcattccctcttcacaaaaaaaagaaaaagaaaaagaaagtgaatatatataataaaaaaaagatttaaattcaatcaacttagttcatttacggaatgaaagagttctcaaggccataccataatctttgacaatactccttttaattgatttcatatttaaaataagtaaatatagtatatccatcctttattcaatctaaagtgtatcaaaatattaacatatattgatcaataaaatttggcataataacaaatatttgagtctcctaaatatattcgacgaaagtttgattaaaattaaaagtgatagagtcgctacactttgaaaggagttattttcccgtataagtttaaaattataacctaagtacatattaataatatatcaacttactaaattttaaatacaccattacttattatatttattatagattcataattgttaacaatatgaatagtaattatagaaaaatagaatttatcaaaaaaaaaaaatcaaacaactacattgatcaactactatatagtgtgtgattttaggtatgaacgctgttgcgctaaatattcaaaaaagaagagtttgtcatctacaattattttatctgatttaatcataattgtttcttgtaaaagatgtatacattttgttttaaaaataaataaatgaattcagtaatgtgggactgtgtttaagcagttactcaggcaatagtatatcacaatgaaactgagttttctggcaataaaaaaagcattaaaacattatcaccattgctaaattagatattctatatttttatggctatacaataagtcagtggaagaatatttctttcaatgcagtaaatattggcatgtgacgaatacagctcgccatatccactcacatggcaattgttgaccttccgagaaacaagaacaagtactcataatctattgtctctcaaacacaatcttgccacatcaaatagtaagtaaaggaagatgctgacagttgagtgaaaacgtgagaaagaagaaacacacataagagggtattttgaccaaaatagtacaatattattttttaaaaatgtttataaagcatgagaaaaagactgtacactttatactattaacaactttttcttcctttttaaccactcaattaactttgtatctccaatttatgaataatattgaaaaaaaaactaattacttattccagatgaatttagatatgttggtccaattgatgtagtttaaaaataattagtctag

SEQ ID NO: 4083 - DNA, 1430 bp, Glycine max
  Soy_ogl_1020 Gm03:41574571..41576000 Cluster 17
taggtcgaaccctctcaaataaaccatttatttcacattaaattatactatttatataatgtattttataaaaaaaatcctgaatcacatcatccatctaatcatattcataagacaacactattaataatattgaaaattattcattagtattttgttatttatattaaaatgagtaagcattgattactaaatggataaaatgtgtgtgccactcaagcaaattttaatttacaataaagtcgacattgtttattttgaattttttaaaatatcttttttaataataactattttattaaaaagaaccagttcctaaacataaggagtgtatttgttaagaagaaaagaaacaagagagaaataaggtgaataaaaaaaaaatagagtgagctgaaataagtgaaaaataaacaaatttacgaatgtagtatgtttgattcaaaatcatacatgcacagttagagaaaatcatacatgcatgtatatggtgcattacggtgagacatggagtactagagttgaaaaagtatttaatgagtataattgagttaataatataaattgagtatgtgagaaatgatttgagtttatttttcacaaaatatatatttggaagcaatctgagaagttttaaatgtgattacgtttcaaaattgagtaattatgattgttattaatataaaaaaaaaaaaagttgaaaacgtgtaagaatgtgattaatggggcgactgaacctaacccctggcctgcgggtattaacgtgggtgggaaatgggaataaattacttacgtacacaagtaaggtaatatgtacgctacattatgaatttatgatattatgatatatatatggaaatgtgggagactgaaactcaaacaggaaagtcgtaaaatacaatggaaaaagtcacttctgatacacacttgtttcgacttttaaccacttcttgccaacgccatgcactgcatgcataaagagggtctgcaacaagttattcagtttgccaggataaaaatattttaattggtataagttttttttatctattcattcatgcatttattaggggtggactcgaattgaattgaatttagtaaatattttaaaaagaaccgatcaatgttaattaatttgattgtttcatttttttaaaaataaaataaaaataaattaacaacctatctcttgtatttctttggaccctagctatctctttcgatatccgaacaatgcattgaaaattttctaatattaacctttgttaatttatttcactttttagctaatttaattcctctttcaataccaaattagtatttaaagtttaattaaccccaaatatcaataattttgtgagatgataattgatgcattatcttcctttaaaaaatgatacttactcgttttttattacttgaaactacta

SEQ ID NO: 4084 - DNA, 1197 bp, Glycine max
  Soy_ogl_6167 Gm18:54214401..54215597 Cluster 17
ttgttttccacttcatcaaagaaattgaagttatgacgtccactcaagtactacaaataattgatttgaatcccatcatgattcatgaaagctaattaagggtattatataaggcatgaaatatggtgcgagggaccctttcctttacccccaaaccatgcaaccatcgttttgtcaataagaatgattgatgtctgaagatagaacgcatccacgtttgtcttcattctctctaatgtaaaggctcggccatccaatctctaacactacaaaaaaaatcgttatttttgccgaaatattttccaccaaaatataatcttgattttacatttttcctgtttaacgtgcaccattgcctaacctcgaatgatttcattcattttgccaacttaggaaagtggaatgaccagtaccttctgtctgcctaagcatttttattttatcttaaaatgattattactttaaaaaagtcttgaaaaatatttttaatagtatttttatttattaatattttacttaaatatttagtggtggtttaaacataaatttttaaaagctaaattacacttttagtcatttatatgttttttttatttagattcaatttagttatttatcttttaattttgatttagtttggttcttttactaattatgacaaaatattaagcatattaacatacataaatttatatgtcttttaattttaattaagttatactcgattcttataaagtctaactacctattcttgtctctatctcgtgcctttagtagtagtgattttaattttgaaagtttagaatgtgttttacataaaacttttttcctattagtggattaattagtctatttagggatatgtcctatctatttagtagatttaatatgaaatagacttttaaataaactaacaagtaaactttaaaaaaggacagggcaaatctaaaaaacaataggctatgcccgataattggttagatttaatcattgaacttctttaaacaaattagttgtacaaactgttcttttcatttcctaatctttctatttttcaaactaactttttatttttttttcttatttaaaaattgtctaatgtttactttttgcaaaattataattctaatcctcagacttttaaataaatatttaaaaattacatatgataaaaactaaattaatgtattaatacaa

SEQ ID NO: 4085 - DNA, 2000 bp, Glycine max
  Soy_ogl_1777 Gm06:3171601..3173600 Cluster 17
cttttcaaattattttgaaagtatttttaagaaaaaagaattcccttatgtaccaaaaaaaaaaaggaaaataattcttctatgtgttcatttcatttgtaagatttgaccttccacatggaccacaacaaacaatcgaaaacgaaaaacgtggtacagtttgaacgacaaattcttaagtgaattaatgagatctatcttgtacaaccaacctaaataaattttattaatctccctattcaaacatttgttccattctcctcccaatttggcaggatgctgttggaatcgattttcttcttgagttttgtaattagttttagggtttgactcctccggtggccaccattatctttaatggccacctaataagaatttcatctgttctgcttttgccttggggtgttggcaactgggaatttaacaacctataaattaagcatatcaatgtacccaaaaaaaatcaacatataataacgtgtcaaactgccaatccttagtttaaattcgtcaaaggtcagaataatgttttttactttctgagtggtcagaaacagaataataaaaccacttaaattttttttggacgatcgaaaccacttacctagttgatgcttgtgtcacctagctttaagaagagcaattttaaccgtggcttctctctcgttattaattttcccaaaaaaaaaaaagataaataatcatttttatttctaaatgtgtaatttactgaccaataagtctttaaaatgtgaaaatataaaatttaattttcgaaattataaaaaatgacaaatatatctagtcattaacttccgttcttcacggttaataaaataaaataatatacgtgacaattattataattttttaaaaaattgtaataattagtcacaatttactattaagggatatatttgtaacattttttacacttttagggattaaattttatattttcatcttttcggaatgtatttgtcaacaaagtataaagacgaaaagtcaaaaaaatattatatgataaatatgtttatatgtcgacatttaaagataactatgctgacattttagggacaatttcatctctctgcgacttaatatatttatcacactttttacaagaattaaatttatcagcgaattagccattctggaacaaaactagctatttaccaaaaaaatatttaggaatctttttatttttatttctttttaatatgcaccgttatttgtaaaaggttctatatatgtggttgttttttttcaacaatcgagggaagaattcctgttaatggtgttcttaaggtattcgtgtgcagtgtcatccacattagagggttcaaattaaacttgtgttgccttattaatcttggtctggtttcaatttacttttaataaaattaggttttagaaaatagtgacggaaactccaaattaagggcatctctccatcacacaacttctacagttcaagcttatattgtacccgtgaagaactgattatagaaaaagatgaaaaaattactaaagaaaccaatccttaatttccacacttgtggatggttccatacttggtgttctatactagcacttcgagtacaaaatcctccttctgtagctaatgcatgttccatagtggcactgtggcagttataatatctaacttctcaacctgaagtaaattaataaccataaatgacaaatataatagcaacacaattcaaaaaatatgcacactcgaatccattcgagtgtgtgaacatgcacgtccatgcagacataaaattttagcacatacaggaactccataatattctgagaccttttaatttccagaatttccaaagcacaacaactgagttcctctcatcaagcaaaacacgaaaacggtattaatttatctttcaatctaataacctcatctaatgatgctatctgaccagattaactctgaaaaacagaagaaataaattttatatagtttttatatttgacta

SEQ ID NO: 4086 - DNA, 1845 bp, Glycine max
  Soy_ogl_1912 Gm06:11945856..11947700 Cluster 17
attatctgaaatagttgtaacttgtatcaaccacgttatttttatctaattattttgatgctttttaagtccaactgcttttgggaacttctattctcgcttgtgtaacagcggtgcatcaaatgtttacagttaacttgtgttgaaagttataattatcagttaaactataattatctttaattaagtttacgtcgaattttgtggcattgactacttttagtcagactttgaccttgcttccagactttaagcataaaaaaatgtctaaatttagtgaactaaaatcttacaattttttttatcaattcaatccaatttaatatctttattccaaaaaatattctaaaattaatttaaatgtgatcactatcttcaataaatataattataagtaatttagaaaatatatttattttttatatgaaataaataaaattaaataaattaaactaaaatctttaatcagtgcaaaattaagtatttttttatatttaagttcataagagatattttgtttgttagtgtttatttttggacccaaaactatacaatttagttaaaacaattatcaatgtattttcttttttcaatcatttaatttaaatattttttctttttctcctcttgtcatccattcaaatatttttcacttcttctcattgtttctctcttatttcattccctattatttgaggacattcttcatctcccgtttgtcttctttaattgtttggttttttcttctccaacgacattctttatctgtgagattctctaatgagccaattggagggagagtctctcttctcatgttggagaataacatcagaggaagaacaacgttgctaaataagagagttaaacaaacaaagaaaaaaaaaagaaaaatagtgagaagtaaatggaagatgaaagataacagtagcaccgtcaaagaataagaaatatgggataatagcgagaagtaaatgaaagatggaagataacaatatttaaatgattgaaaagaagtaccaagggtatttgagtaaatttttttatttatttaaaaaagagagagagagagattggggacaaactattcttacacctgattaattaaaggggtagtttagcgattgccttaattaaagcataatttttctatccagatatataatttaattggggacaaactactcttacaccttataaattattttttttaatgatgggcttggttatactattaattgctttaattttttttggtattaactttaatttaaattgtgtgcttctttagctaatcaacattttattattaaaattatgtaaaactaatatctatgtcgattttattttatttaaaattttcattttccatcggaatattttggagtttatgatagatttgagatatcaaagttattctaaaattttagaagtaagattggtgaatttttttttataagatgtgatattaaggtttaaagtctggaaattctaaaacttcaggagtacgattagtgaaattttgaataattttataagatgctatattgaggtttaaaattggggaaataaattttgatggtttagttggtaaattttaagtagggggaggttttgttataaataatatttttattatcatcatagtagtttctactaaaaatgatgatgattgattaatttttttattagagattatgagcacacactaggtgaaaacacaagtcactactaatgtaaatcaatctttgatagtggttataaacaatgtaataattaaatttggagggttttaagcaaaaaaaataaataaagggtaataaatagacaaaaatcaatgaagactta

SEQ ID NO: 4087 - DNA, 1927 bp, Glycine max
  Soy_ogl_763 Gm02:51040101..51042027 Cluster 17
catatactaaattttggacatgtaattgtgttagatattcctaggaagaatttattatgtgtaataatattacttgatttgaatataattatgttttatgaaagatatatttagtacgaaaaaattaaaagaaataattataaaaaatgaaaagtttgaagtgagagtttcatataaaatcagtttttttaaaatacaggctcacacaatataattgtatttaaacttaaatacttaagaaaatgtacttttatgagttgtgtcacgaaaaaagaatgactgtgaagggggcatgagattacgttgtttggaggtatttaggatgagatatatatggctgacccttcacccaagagaaaagagtatagaatggaatttcaatttcccatttttaattttgttttttctcttgtggatgtggtattgctatacgtatgggtttcttcaagatttatgcaggatctaaagctgcctgagcggtaactttctgatacgtttctttgtcaatcaatatctttattttccattgtgtacctttgcttttctgggttttattcaattggatacgtagaactagaatataaaattttaaaaaaaatcaagtagatatacctattcttgttttcttttgaatttatacagcacttaaaaattctaatttttaaatatgacgtttattgatgaatgtgttcatcaatcatcaccactattttgagattaaatttttgaatggaatattttcaaacgcaagtcatgtttcaatggagtatctataagaactttgaggccagtatacaaaaagattataaatattagaggaagtactccatattctaaaggatatatttatatatagtgtagaatgcattgggggagatcgaggagtagatggaaattatttggttatatatcgactatatcacatcatatttagggtgttgcgctaatcatattagtgtgttgtgctaatagtattgctagtaatatccacatattgtttgtcatgacatgttctcatgagatttgaaggatgtgcatttacaaaacaactttaatattgagaggatggtacaatcgtagctaaatccacaaatgtatcgaaggtcattgcaagtaataattaaaatgctaaaagactttttagagattagttaaaggatgcttcgcaatttatcaagaccattctaataagaaccgaaatgaattatttataattgattagattaaaaaagaatttaaattaaaaaaaagtgttgaagttttaacttttaggttttctaatttagcgcgtacgaatacgagaaaaaaatggtttaattcaaatgggggaaacattgggattacagttcgttctatttcactataaactcctagctaatttgagttcttaattcaattttattcccccctttgtgtactaaattttttaatttattgaaatctcaattccttgagcgattaaacctttaccttagttaacaagtttaatatcttatgtaaaactacacgtgaataaatattaagattaaaaatcttcattcgtttagaacatctaataactatccttaaccaaaataattcgtaggtttgtatctcaaataaaaagtgtcaagcaagtatcagacttgactgaaaagtaaatggaaaaatgcaaattaaaggctgttagatagtaaccacactttttttttcctcagagaaactagccaaactttgacaaagaaacgtaaatgattgaagtgtataaagtactggagaggtctcaagttttgacaaaaaaatgtttgaaagtaaaaaaggtgtcaagcaggtaacgatttttgacaaacagatcaaatgaataaaatgaggagtttgcttgttaatatattttaatatacatttttttgtagatgaatgaaatttatattcgttttacttttcattc

SEQ ID NO: 4088 - DNA, 1800 bp, Glycine max
  Soy_ogl_5151 Gm15:48186301..48188100 Cluster 17
attttaaacaggacattgatctacttgaaatattcaaatattcaagttaacctgccacacctaatgtcactttgttaataaattagggctatttccgctatgtttaatataagttggtttccttttcttgtttgttttgagtttttacgatgtttctttgtttctagaaatgtcagactaattcttactagaagaataaaaactgttgtccccaccacaaatacaattttttctttgcatgtgggactctgatgttctatcaagttggttttccttaaaattttagaaattattccatactcagagagttatatattacatctattttttttttacagttaatgcataaattaaaaaataaataatatttttattcatattaaattacttatattttttttaatttgtattactctcttatttttacgtcatagtttttctcttccttttaacaaagaataaatgtaaggatatagttgaaaaaaataataattaatattttctaataagagatagaaaacaaaaggtttcttatcgaaaataatagaaactcatttgctgttgctttttttccctgtttgaagaacttatttaaacctatcttatgacaaaaataattatgtaagaaattgtgagattttataaaaatagcttataacatgttgatatgttgctttcaacatgtttcaacaaatctttcaaaaatattaatgaaaacaactttcattttacataaaaaaaacagttttaccctattcctccgttaattataaaatcaacttattctttaataaaagcttaattaaactgctgattcaaagcaaccttattaatttgcatctgagtttaggtgagaaatgaacctacccctttgcaccattaaagaaatcaattaagagacctacatgtatagggtccctaggaagtactaccatatatcctcttcattggagtccattgattgtggttgtgggggcaaagaaagagcaatggacgtgagacacagggaacttgagaagtaaataagtaggatgcaaaaaaccaaatttctcatgtcacatgattggactattttgtacaggccaggcccagtcaaaacatgtgggccagattttgcatccttatttgtcgcccacatggagttggatcttgaatttgcaacttccagttggaaaattgtgtggagatattttgtatgaaataaatgtagaaaattagtgtttaaagttttttagattgtgacgtgtgtttggaatggcgttgttttctacaacagaaatacttagtcattattatttttggattaatcaaaatgaggattcggaatgacaattcaaaggaaagaggggagaaagaagcaagtagatcgcttcaatttcttgtaataagttcttgtcaattttcgtaccgaaatttcatattatatggaatttctatttctgaaaataaaggatataacaatgaaatttcattttattggacatcgttttctttttaatttttctgaatacatttattcagcatctagatattgtttaattttgaaatcaaatttaagccatacatggagatcatggcgtaatgaaaacttttatatgatttgctcattcccgcgtcaagtcatgagcattgtagtactatagtgtcatttttgtatatatacgtatagaacaatacgttttgtactagtgtgaatcaataatttaaagtgtctttttttttttaagaaaaaactaatactttttctaattgaaagatcaaatatctattttttttaaaaaaaactataataatcatgtg

SEQ ID NO: 4089 - DNA, 2400 bp, Glycine max
  Soy_ogl_5982 Gm18:39601..7492000 Cluster 17
ttataaaaagaaaaaaaacttagtttaatttgtaattgtccactagttttgttttgttatgtgttgaagcttttgtttggtatctgacttggtctttattggtgagaagtggcatctagcatatatagagagaggggtattaatttcgtcctatctgcatgtaaccgtagggagtgtgtgggtgacttttttttttttattggaaaaagattttatacacccaatattaggtgacaactttgaagacaaagaggaaaaaaaaagagagaaatatagatgtaacggtaggtaatatggttttacactcaatacataaatatcttattatttgaaacatctatccctccaacatttcttattatctgtatttttttttcttttttttaggtgtcaattaacatattcaatgttgatataatatttttctatgatttgataggaagttaaaaagagataaaaaaaaaaacttaacaacgtcaatttatcttcctaggtgtaaaaaatcaaaactttttttatattagggattgaaacgtacatcactattagtacaaggtacaagtacggatacaagatataagtttatcaaaaacttagagtacatgtaagttaatttaatgttttttttaattatacatatgtacaagaacagcaatatataaacacgattaaattgtataaattgttaaaaagaaaaagagacaaataaacataacgcatagcataagagaagattaaattcgacatgacaaaaactaaatcttctaataaaaatatattatagataaatattcaacaatccatagtacagatcgataccatgcattactataacacctaatcatgactataacatcgcactttaacaatttctatatcatgatttccgtgtctattgtcatgaaaagaattgtctctaaactcatatcataaagagcacgaattgaacagcaacttcaataaagtcaaatccttaatatgaatcttattcatattcaatggttgttgatagtgatagatcgagttagaatcttcgtactcaatactcactatgataaattaaggagatcaagaatacaatctcgtacatcattggttcctcgtcctcacagtacccggtcaagaacacacgtgaaaaagcggcaacgtcatgtaaaaacattcaagtaaataaaatcacaagaaaaatctaatttttaattttgtttgttactaaagataatgcgcttatgtaccaaaccttggatacgagcatatttattttacaagaatgaaaaaaaaattacaaaagactaaaaaaatatttacacttatttctaatatatttttacattctgaacaagaaaacagcgttgtaaaatatttattttttctgtagtaaattgatttcattcaaagaataaaaagtattaaaaatatatttacaacataaaataaaattaaatacttattttctttctttcttttaaaaaaaactactacagaaattgtcatttaactttgaagaactaaaattagtttcgttagtataacattttcctaataaaaatttagttattattaattagtatagacattatgagttatatatgccatcaatatgatcaaaatcaacaaattaacagctaactttattagcatcgaatattaatatatataccactaaaattttagtcataataaatcaaattattagcttagtgtgagcgaccccagtggcaacgttagtcccaaggtagcttgcttacttcactagtcaacgaagtgcgtaaacaaataaaggatgacttgatcatttgctctgatcataggtccgaagttggctactgattggatagaaatatagtgcaaacacgattttcttattttatcacgtgacgaaaccccggaaatttgacatcaattgctcggaaaagctcttttggaggttagcttttcaactattatcgtagtaaaagcattttcgagaatcgacctttaaactatgccaaaaacccggttttttagccggcctagccgatttgtaaacaaacgtatggtcagacttaaaacaaacaaccaaaatatgaatcatcctgatcttcattgaacggttcaaatttgcaatttcgtgattgtgggaatgaagcaaatccaattccttaattatacaagctttttctttaaaaaatgttacagataagctggcagataaagcatgacattgtgagaattaagtacccatgtttcagtaagttatatttatcccccatgatcatgcatccatatatgagtgtggcagtggctatacaaatacacacacacgagctagcaccatgggcaatatacccagtacaaaacccatgattgaggtatacaattggtcaagtgcagagtttaccaaagagtgcgctttcatat

SEQ ID NO: 4090 - DNA, 1958 bp, Glycine max
  Soy_ogl_320 Gm02:1980343..1982300 Cluster 17
taaatggaatatgaaaaaaaattgaataatgacgtgaaaagaacgggtgaggaaggaaattgaagggtgtgggtgggagtagtgagatccttccctaaattccgagcgccactctgatagggactgatcggacaggctgcttttgtcttttttcccccacaccactgcactctcttcctccttctcatctaacccctatctccttattcttcctcttccaaatctgtccctatcctttcaatttttttaaaaaaaccttttttttttgtgtaagaaaaataaaataaaactgttgtctgttttatcaataatgatttatgaacattgcactgccacctggtgttgattttgccctcccattttcagtcactgcactttttcagagattcaattaacctaccatacaattttgtaaatgtttgttatcctttgggctttggggtctaaatttttttagatttttatttctaatctttaatttaaattttatgatcaaaacctcttaaatttttgaacaatttattgtcaaataataatacaataacaatattagtggcttaataacttatcacgtaatcaagttagttaacatgacactcacataatttttttatagtttgtgtttttaagttttcattaattaatttgatgttatcaattgttctaaataaatgaaaaattaaaatatagtttataaaaaaattacacgcaattattctgttgcaagttattggggtgcgaatatcattgttacttaatgttgttatttaacagtaaaaagatatttaagaacttttgacggttcaaaataaagatagcaaacctattttatatattcactttatttgttaagcataagggatttttttaacagggaagggggagagataaatatacatgagctagatttaatatgaaaaagcatgaggaactaatacaatataatgatgatacaagatcaagtcatctcttccagcaaaaagaaaagaaaagaaaatccagcaagaaaagatcaagtcatctcagacacgtgtttctgcgtgtatcatactatctgctttcaaattaaacaaacgacaatgaagtgtgcgtttggattcttgtcatgattcaccaaaaaaaaaggttaaagaattgaggactcagacaaatttaaaaaacataaagtttcatctatgtaaaatatactaagtttaacttggaggtaaaacacagacaatatataatatcgatcataatttacactatttgatgatgggagataaggagtgatgtcaataataggatctaagtctgatagacgaaatgcatgtggatgaatatttttttttatgtgatatgtgataaaaacaattacgactcaaagaaaaatgttaccgtaatattatacctacaagacttgtaattaaggcattaggttaagtttttggcattaaattaaagagccaaaaattaagaaagtaaatttaatattcaaactttgaacaaccagtgttgctttagtggcttggcaacaattaaccagcggtaaatttttttctttagtggttttttttttctctagtgtaatgttggtgctgctataatgatcagaaaactgggtatggaatgtgtaattcagagatgataatggctattgctatgctgcaagctatgtaatggtgttttgagttggatctccaaaacgttattttttgagactggcagtaaattatttggtggtggagagaataagtaaaccacaagttgtgatatgtctgagtttgcagctgtgacatgtcattgaggattgtaagaagttagtgcattttagtccaaactttaaaatttagtttgttagcagataagttaacgtgattcttcatactctacaacgacatctacattttaatcttatgctagccctcatgtatttcattacgtacctagttgtattgaaagtttaagagtaaaaattg

SEQ ID NO: 4091 - DNA, 2600 bp, Glycine max
  Soy_ogl_571 Gm02:15635001..15637600 Cluster 17
agaatagtaggccaataataatgacagaattggacttttaatattaaatctaaagacattcttcaacataagatgttggaccttgaaccttgacccaattatattttataaatatgagtgacactccttgatcatgccttaagttcacacattttactattttgttgcggactctatgactttaactttaggaccttctagatttgaacatcaacaacataatatatatataccaaaaaattgggaataaaagttgatggacactagactatatttaacattgagagagataaatgtagatataataagtgacataatgtaataaaaaagaaatataagtattgaaaaagtgttcaatatattttatatattagtaccgttaaaaatattttagcttagtggcatatgttaatttaaaaaagtgtcagatcctcagctcaagccttcttttgagtttgatccgttcttgttgaataattcaaatgtttaaccagactaattatgtctccaattttattttttaaccaaaccagttcaattaactgatctaattcgattttggatttctggtaacactgttttctacaatatgccacgaaaggtatgattttgcagtggtgtcaaacaatagaatgcttgctagacttagcataaactattttgttgggccatgggcttcattctagaacaatggaacgtcattaagcaggcagatgctttttacatcccgtgatttgctttttgcacctttcttacatgactaatcttagatgtaaaaggtgccgccaattaaatatgtaaaattacattttgaattaaccttttttaaatttgaaaaaggtgtaagaaacaattttattggatgcaagaagcatctgttcattaagcaactatcaatggccaataaaaaagatcaatttacaattcacaataaatgacccaaaaaaattgagttcataagagttcgaatatataaccaacatgtcccccaccatatcttttcaacaaagcatatattcactcgatttgctttttgctttaccccgacttttttctgcctgtgaacgataagctctttcaaaatttcatttttctgtggagcggatattttgtttcttgacctttggcagcttatataaagaaattattcgattttgttttgattccacgggtcagaaggagacgtcctccagtgcctgatttcatagttaatttagggcatcttagttagttggcatcctcaaaacacggttttcatgatgtttacattaggaatcaaatctcatctgaaatatacgaatttcagtataaatgcagcatcttctttccaaaataatcatgatacttgtgaatacattctacttcaacaatttcgtatatatgcatgtttaattgctctgcattttttgtgtgtgccaaaattgctattgtctaagcatgaaagtaaattgctattgtttaaatgcagagttctccctttcccatcttaattactacgtttggtatgcaagattcacgatagacccaaagagcagtactggagagaaaatttcaagttttacattcttttctttgtttgaaatatgcaagaaaataaaattacagatattttaagtgggtttcactaatttaaaaaaaaacattaatctgtccaagtgtgggcaggaaatgggagaaaaaacttatctttatacatacaattgaccaaataatctttattttcttgcattgctcatttttattaagagtgtgtatgttattttattctgtaaaaaaattgttattttatatgcatatatttttttttcttaatgaaagaggtatgatttaattggttggacaaatatatgtgaagtgtaataaacgtatgatactatcttccattcctattttataaaaaaaaagcatgcacatatttaattttattttcttctattttctgttttttcagacaacctaaaatattatattattttctacttctttgttttctttcctaaaccttgagtgccacgaggaggggaaactttgattgtgaataaaatttatctttgaagaatatgttaaattttcccaaatactaatcaagtccaattactaaatttgatctataatacatcatggactttttttttaagtcggctaaacagttaacactttgtagaaatgaatttttttatatcaaactttaaattttatttaaatattacattatattttaatttttaaaccaataaacttataattttaatgttaacttaagtagtaaaattttagcaataaattcattacatttttgttataaaaattggcatattcatccataactaaacagtttggttattttaaattttgattacatatttaaatatcaaataaataggtctgtaaaacttgtataaataagtccaagcatcttttgtaaaagccaaaagggtctttttaccagtatttaaaagcattaatttgttaattttttttactaaaactcatgttaattagaagcacaataaaatatatgatagaagtgtattaataatatttttaattaaaacttataaatttttatttcttactttaatgcacttgttaaattttcc

SEQ ID NO: 4092 - DNA, 1980 bp, Glycine max
  Soy_ogl_2737 Gm08:16937001..16938980 Cluster 17
atgtgtgatgttgcgaacagaccgagttcatgtctcatgaattatagtcatgtacgtacgagcaattacaaattacaagagtgccatcaatgtattcattatcagtatcaaattagtaatacattacatatacgtaacccgtggaaacataaagtaatcaaggaggtttatgtaatttaattttttgaagcaaagtaatttaatttttaaactttatcattcattattactctcttttttgatatatattttgtcatcataatattaatgggtgaaatatccatcaattttatcataattggactgatcacttttaataattttttctttctaattacatttttttaatctcaaaccaaaaccttacttaaaagatttaaattgagtattaatcggatcatcaacatgttatagtactctctcttcgtatacggtgccacaaatactacagcacagagagggaaattagagcaacctaataccttgtataaaggaataaaaggaagaaagtaaacgagtaccgttactgtacagaagcattgtgtttggtgatattatatatgggtacaacccaccaaattgttgtactgttttcaaaccattgctgatgccgaatatctataggcctactaaagggacatgggacagggaaaacaaaatcaccgccaaatacgaaataaatttcactgcttttcttgggagtgatcatatgtacgattaatacaagtggaagttaaagcatatagaacagaaatctcatccagtcccattttgtattttttattttccataatttatttatgacataaataagggacaatttgttacatattcgataaaagtgatttttatataaaatagtttagtgatgattttttcttatagatcaagaaaaaccagaaattaacttatatttgttttttcaggtataatttatgtttgtttggtatcataaagtaacctatttttttttaaaaaaaaaactggttttataagaagctatataaaataatttttttatcagcttttgattaatctgaatacctgaaacaaaaatggattttttttatagtgattgttattttttctaaaagtgattttttattaaaaaaaactgtaacaaatgagttctaattcgattttattaaaatcagctcttagagtgtaaatgagcaaatgacttttacatatatatgttgctcaattatgtgctatatattcttttcttctgtctaaatatacggaactcttaaaaaattagttcattttacttaaaaataagttgaagagtgcttatgctgcattatttcactccaatgcatggtgtaataaaaaaaaaaaattgtgtgtaaaatattaggtgctatttttttttataaactacaaatatttactgaaaacaaaaaaaaaagttgagacataaattattaaaatagattttttttttcttaattaacaaagcctttctcatatgttcacaaaataatcactataaaaaatacttaacaataatcacaaagcaatttacatgtaaattttaaaaaatcgttggtaaaattttagtgacaaaaagtttgtcagtaatattttaatttcgtgtagtgaataaataagtttcaccactcaaccaagttgattggttgacatataaataacaaatttaatatatataattagtgatggatgatactactatatcgatttgtgcagtttaatttttgactcatcggtctgactaatcacccaatgattttttttttttttggaaggcaataacccaatgatcttactatgttagtcacccgtttgagttgtaagatattgatagagaggagggatagagattctaactccgtcatttacgtaggattatagaattgtgacaaaacgatactaaatggtcttgtgttgggatttttttattataaataaggggttacaaaaatagataaattgagttttaaaacataaatttcattt

SEQ ID NO: 4093 - DNA, 2100 bp, Glycine max
  Soy_ogl_5962 Gm18:6403401..6405500 Cluster 17
caattaaaaatctcacagtttccaaacttggactaacaccatgcagccttttctccaaactaatgtacgcactctgcataccaaacagaggggtggctccatctagcttcgttcttaggagttaaattggaattaaataatcaaattattttaatactggcacactatgacactaatgcatatgcgtataattcagcgctcaaaaattagttgtagttgattaattttaaaatatctaaactactaatattgcttattgcgttcttgttgattaatggcatcaaaatcctcgtcttcttaattattcgtcaaagattttttaaataaagaattaaaaattctatgatgaaatcattaaatttaattaatttacaaaatgatggtaaataaatgatttttttaagtttaagaattaaccagaattttgaaagttgagaatttgtcttcaaatcattattttacaatcatgaattacgtatctcaattggtccatgattacgaacagagctgagctactgttgagcccaacaaaatgataatgtgctgatggaattaatccaacttttacagaaaatttaatttttataactagataagaatttttattttttcaagaataaaatttcatggatttacatatttaggaactaaaattgttatttatccttcaaaaattaattccataactcatttgtttgaagaagtgtttaatccatataaaaattgagttttaacctcaagaaaaaaattaagttatggtggcacatttgtgtgtgaatacattggagaagttttagatgtgcaggccaggaggaacgtgataggcgcaagaggtttacatttcttctagatgtaatacacattggttcccatccaattaatattaaaaaaaatgagcacgtatgttggtgcatgcactccttataaaaaaatatcaaaaatgaaaatgaaaataactgtgctcatcttttaatacactgggcatcacagtcggatggattctagcttgcgacaatgaaagtagcgagtttctgattcccttccaacagtcggatggaaagtaattgaggttaaaactcaatatagattttgaattagattgcaaactttaatatgattctatattttgaattagattgcaaactttaatatgataataaggattaaggagaaacataatataaatgatgtgttaattattcataaaagaaaaaattaaaaatattttttttataaaatttaaaaatagaatatatatatatatatatggaggagaaatataatataaatgatgtgttatgttattgttgtttgcttccaaatttacttttttattttattttatgaacttatgcccttaacatataagtgggttgagcagaaatgctccatctttgaccacaaagtggttggtcaacattcaaagcaaattaagcttcaaaacctaataccaccttaaagaaaaaaatttagaaattcaaactatttgaagctgttgggcccattaatgatgaattggtgcccttctagtctggcctaaaagattgtggggacataggtttttgatcgttaccaatttggagtgctctaaaattcaaactaattttgtctctttaccctctatcttagcagaatgtgtcttaatgggggccgtaaatccgtatctggtctcacatggggcatatgtttccccctccatcaatctattctgtttcgactttcccattcccttccaaccgtttttttattcctattatttctcgttatcttccacccgttttgtctctctcttatccctatgaatagtttattgatcccagtctttacactgtatatctcgaatccccttttcttggatatcaatgttggttctgtgaatgaaaaaaataagggttaaaaataatatcttttattattttaaaatatatcatttaaaacatgaaaagaatattaataaataaatttatttttatagaaattaatttcacattagaacatatttattttaatctctcgtttgtataacttttacaattactcgtattttttcaaattctcttttcaccaaatttgttttttataatgatttatttggaggag

SEQ ID NO: 4094 - DNA, 1521 bp, Glycine max
  Soy_ogl_2232 Gm07:6354801..63528 Cluster 17
taatcataagttataagctatttgaaaaaacttaaaaaaaaaaaagatataaactactgaaataaactcatttaattaccgaacattttgaagttagtcatgtaaactataaattaagttaaatattatatcaaacacactcacacattgtcttgatatttagtgatatagtttttttttatgttactcacatttttttacctctttacactatgtgcaacaataatatcttcaagaggaagatgatatctcatctttccatctctgtcattgtttataagttgcagcaattatatatgtctaattaataattcagaattagattccatgtttgtggtcccagaggatgacactgaaaccttttattctcttcacacaaaatcaatatcatatcgatggatccaacagatttcccaactttgatacaagggccatggctaggaagaagatatatggcattgaattgattgcctctataggtattatattattccatccattgttttctaccaacgaccatgaatgtatgtatgacataaactatgattacaaagggggaaaaaaacccttataatttaatggtatttttattatgaaaactatggctctttcctaaatacacattagttgaagtgccactgcatgtgtgtgacatggggaatgaactgagggtacacacgttttgcctcatacggtccctgacaatgtgggtgggcccaactgctttcattcagtgggggcccaactcaactgtttttaggcccaattgctcctcacatgcttcattgaaaaagcgttggtgtcccaaatgtccaaaatcaatttgcgtgcctagcagaaataagaagattaaaaaaatcagtgtcctaccaactttgtagttttgcatcaataatagatcatgcttctgcaactgaagcaagcagtattttactccgaggaaagaaagattaaagtgaaatgttgtatagtagaaataggaacagatggtgttaaatagggctggtaatggattgaataaattcgaaattgttttgaaatttaatttggtaattaatttgttaaattttatttgtgcactataccggttgaatttgaattgaaaatttagctcattaaataaattaattaaatttaaaatacgtataatttaacttatttaattcatgagctatctaattctctatttatataggttttactaacatatatgacacatccctttgtttagagttagaatatgttaacaggctacattttagatatattttaagaaaattataattataacttgttaacacattcttttttttaaaaagaaatgaacatacattaacaaacttttgttaatatatatgcacttgtgtgtgaatgtgtgtgtttttaaatctagttgatacaatcatatatgaatcaaaaattaactaatagtcacatgactacttgaaaaaaatcatattttttttcttttaatcgctatacaattccttcgaaaaacaattagttctattaaaaaaaagc

SEQ ID NO: 4095 - DNA, 2400 bp, Glycine max
  Soy_ogl_4414 Gm13:32703801..32706200 Cluster 17
aatcagagccaagcatgaaggcactcaggacttacgttaggaccatcctcgaatgtcgtccatgttaatgcaatatgctactttaattaagagcctatctatcctcctcaacctttctctacaaaggaaacattaaagttttttggtgaccaccggtgcggtataacatgtgaggacgtgagagacatattcatgagtaattaatagagttagaatcatatggtgtatagttgaaattcacggtgccacaatttggcgatgacttgtaaatcggaaagtagttgagagaggacttgatgaactacatgacgttgcctgctttgaacctttttcattggatgcttaatgctttagattcgtcggaggaattgaatgggtcgccggccgtcgcgcggtgcatgtgtgaaatttctagatttcattaatgatccaaaaatcacaaagaggacatgcaagaaagtgaatgaaccctagttcgatccagtgaaaagtttcattactagaccaggggttgggaagtattaaaacaaagaaaaagaagaaaagaaaatgttatatattgttgaaaaattagaaaacccaaaacatggttcagatcaaaattatacgcatagtttgcaaagaaatagagttgttaggttattgaggtatatatacttttttttggatatattctgttgtgagcttaattttcatacaaaaatgtatgtgatttattaccaactagtcagaaatcatcttgtttgattaaaaaagtttatactattagtgtgttattatataattaaattagatttacttattttagatagataaaaacgattttgattattttattgaagattttaagttttcatgagttgttttatcattatactttaatctctaatgacttagtagagtttgattatgcatacccgtctaaaaaaggataacaattaattataataattaaggtaagtaattgttgtgtgaatatatatagtatttacagacgtaaccaagcttaaaataatagtattaagaagttgttttgatattattttaagcttttgatacattagttgtatttatataacaaaattgcaatgcaaatgttttaatttatgatgtcttgtaaactatttaaaccttttactattttttttttacaaaatttaagtacaatatattaaatgtttttttaatatttaacttctaatcaaaattgaaatttagcataaataactataataaaggttaaaaaataacattatttgttaaaataaagctctgtttttaattaaaaaataatagttaactttttttacagttgaattttgtctttatcccaatacttactgttagtaaattttactttaggaaataaaggtttctttcttttcttttcttttttgaagagcaagaaataaaggtttcttagattcttatctaagaggtagaaatcattaccattatcgtaaccaaatcttaatttgactaatgcttaactttataatggccatgtcaccaaatcgtttaatttattaactcgttgaaagttacttcacgaaacttaatgaaaagaagtgctgattaaacaacgaaaccccccgtttaagtaaaatacgcttttactctggtagaaacgacaaaagataattagcacgccttttataactaatagtaataagacatttttcttatagaagaggtgcaaaaaaatagaagaggggctaatttaaagactaaagatgctaagccgtcctagacaagaagttgataaaatataggaaccatccacgtgtgattataatgaatttatctagatagcatattggtgcaccatgtgtgattaattataatttatattttcatatgatacggcctataaagagaaacacaaaggtttagctagcctcacaatttgattaattgaataatagtatatattctccttagttgatgattctgactatagataatgattcattataaacctttttcttttatgggaatacgagggactccaatagtttaaaaattaaatcaatggtggagagaatcatttgaagtcattgggaaagacccttcatgtctagttccggagaaacattaatataattatcgttccgatgtgtgcaatctcatcactttaaaaagccatttgagtgatgcaatctctctaaaatctaacatcgagaacaaaaacagctccgtgaatttggtttgcataggattttgatgagaggtaggtaggtgctcctttgcggcggggagttggggaatttaggttgcagcgcagggttaattgaactggaatcttaaaaacctacgggtcactagaagatgctacgacaaagtacacttagatctcagaaaatcaggtaacaaaactaatgcagctagaaaaaagttcaa

SEQ ID NO: 4096 - DNA, 1825 bp, Glycine max
  Soy_ogl_767 Gm02:51446201..51448025 Cluster 17
aaatttattttaatcatttaaacatcatttttagttcttataaattttaaattttaaaacagcaaagagtaaaataaaaaaaatgcaggactaaaataaaaaaaaaaacccctattttttagagattaaaaggttatttagtatttttttttaaaatacatgaatttggggaacaaatcttaaaatatgtgcttaagggtcatgttcatgtacccgtgccgtagaataactagtttttttttttttatgtagctctttatatggatgatttagatactgaccacgcactttagttgttttctccagtaaagcagcaacaaaaaagaaaatcatgtttagtgacaaaagtttcaaggaatacaatacatgcggcaatactgtggatgaaattgttacaaatctgaaatgaaatgaattctatgttcttgacttctcaaaattcttttcttgcatcgtatgttctttgtacctccttacaccaaactttgacactacttgtcccgtgtttggtttcaaataataatacatcatatgttcatagaaaaaatctcaaacttctttaaggattaaacatataatcatgaaaatccaataaaacaaatttaccttgttagttcataatcgggacaaaaactttcaaattggttatgcaaaatattctttacttttttaaaaaaaaaaattgtacagtatgttgtttgccagtttgatattattctcctcgatcctcagacggacaaaacatgtattcaatcaccttttataaaatatatggaagatagaatgtcatatcgagaaatctagataattattatttgctatgtcatgaagtttctaactgaaagaataattcaaaattaatttttttccccttttgttttacttgattaccgtatcactttatctaacaatataataaagtaagattaaattagtacctcatgagtttgctgtatggaaatattaatatatagtatagtcttttgagacaatggaatacctcaatctatacactccacatatcaaaaatcgatgttgctagatgcgatgcgtagattttgctgccaaactatataacagatagattactagagatagactattattggtattagatcttctggttccgccgctcagatcataaaatgggaaagtcctgctgaaaatacttcatcatttatgctgggaatacaatgagggtaaaatatttggaaagatttttattaacataatataagttaatttttttaagagaacataatacgagtataagttaattaattattcgacattgtatattttttttggtggacattcgacattttatatattaacataagatttaatctattcatctttatttaaagtgagatttaatacctaattataatttattgtaagaaaataatacatatttataattaaaaggtgtccatatatcacatatatattataggtaaagaagaaaactagcaagacaaatgtaatttatgctataagtaagaaagtgttgattaatggaatttatggtctttgttaccctcctttcctacacctcaatcctttcccttaattccctcgccattctctctcacaacacccccactcccttttctcccttcttttttcatgcactccaatccccaaatctttcaagtcaattttttttcataggaggaaggttttttgttggcaaaaattgtataccaagctatataaaatagacattataagctaaaattaaccatatgagtaaaaaattatgctcggtcaaacgaaccaatggaagcacagcattttaaaagtaaacaacaaaatcatattt

SEQ ID NO: 4097 - DNA, 2150 bp, Glycine max
  Soy_ogl_2091 Gm06:46291901..462917 Cluster 17
tcattacaattagtaaaataaattcttatatgatatctaaactaagggaatatgtggattttacctacctgatttctattagtcaagaagcaactgaaagattaagaaaaaaatagaataaaattgaaccatttttttaacgttgaaaacttgataaaaatataatttttatccttataaatacagaaatttaggagtatgtttttgcaaaactttcagcgtaattttttttattcttacaaaattaaaatatattattttttctccccaaataaatctaaactatgaccttttacctaagttatgtacataatcggcgtaaaaagtcatgtgaggatgaaatcatcccaacattaacattttacatagacagattctaaatattgcttatatttacgaggaataaaaacatattctaattgttaaacttttacatttaattaaatgttaatcagataaaccacattaaagagaaatggtcactggtgctcggtttgggcttttggcccatcatcacttcaaagtttaatctaaattcatattttagctacactagtattaattataaattcaattagagttattagaagaaaaaagatggggactgaggccctgtactggttttgggcttttgggccatcatgacttgaatctgaattctccctgcaatccgcgggtcaagtttgagtttccctctacccgaaaacaaattaacaataagcgccataaacaaatttctcagcttccatacccgaaaacaaaaaatttctcaaattttttgatttgttccctctttctagtttgaagctccattgaacaatgaatatatatgaacacacaatccatcatcacccccacctcttcctaaactacaatacaatacaaccttttatttgactaagagaatgcccaagagggtgcctctttctcacatcacaaacctcttcaacaattctcttacatcaactaccttcactctttcccaccaccaacaacaatttcgactttcttcgcctcttcctaggaggacatgtacacctcgtacctccaaaactttaaggaggggattcagatagataagataggcttcaattttttgtgtttcttgtgtagttcatttcaatttcaattgcaatcatagaatttgagaaaatgcacaaatacattggtcattcaaattcagaatttgaaaatgctggctacttttgtttcattgccaatttcgctccctgttgatggccttctagaggaaaatttattattaattggaagtaaatgcaaagaatcgcattctgtagcatgctggatctaaattttatatctcgatgcaatttgttgcatcgcatgattcgcatctatgtaggggtttttttgttttattatacatatagacacagtcacacagacaaaaaaaatagaattttatattactgagccaagtagccaagataggatcctatccttttgtaatttgctgagttgaccttttaatgtggggccgtgattcaatcaagtagaccccagtgatgaatcatcacttttgctcacttctgaaatgaacatggggccccacctctgatatcactatctcatttgcatctttctatggggtccatgtccagagttggtatactccccaaagacaatgttgtcctttagaccaccatttctttccaactgaacctctcgaggataaagtgggaatgtagggttcaaaaatatctcaagagtataatgtacctaagatgagcatgaaatgctaaagctgagagtatcaatacaggtatggtacatgagcggagcttgacctaattttttttggagttaacataaattttaatgtatatttttaatatgtaatatcatattaagttaaaatataaatacaaagttaagaaaaaaaaaacatgcataaacttttttagcattaagatagaaaaaaacattatatgctaaacattgcatattttagaaggaaaatgattattttatgaaaatttttggggaagccatgactccccctttccttgtatagccacgaaaattagggagaaggaaatgaaaatattcatacatgcattgtgatttttttttttttgtgttttttatttagttatctaattgcttgttaaaataaatcagggtggcca

SEQ ID NO: 4098 - DNA, 1300 bp, Glycine max
  Soy_ogl_6322 Gm19:1643101..1644400 Cluster 17
agttttgtattcatatgtcactgataatatgtattatataatttttggctaacatcaagggtagtgtgtattcttgtcagtttgtatattgttacgacttaagatattttcagctgtggggatgtctccttggcttttttatgaatgaatttgagtcttaaattatattctttattagattcaacttgggctacgagtctatgactacacattggtttgttggcaacaatttttggctgacttaatgtaattgacatgggggaatttatatgttgcttcttgagtgtttgcaacttagcatcatatagaagtggcaatggctggattacaccatatactgctgtgaaaatcaaagcaccttgataacatttgacaataaatcataattaatcttacagggttgaatgactttttatttgatgcttttctcccaaaatccagttttgataatggatagtaagtttccatcttatagaaatatctgtaaaatttcttaaccaaaattatttaatacttatattcaaaattccaaatatgtggatgaatcaattgattacagtaaaaatcaaaataatcttacaaggataaataactttctatcatatgcttttctcataaaatctatcattggatagaatattctcttaatatatagatatatagtattatgccaatgaatatgatatatcccacttcctctcctcccaaatgaattacaggtgaagttcggtttcaattgtaacccatatatatatatatcttagaatatttaatattttaacattttttaaacaaaatttttaagacgatttcttcaataatcaatgtagaaagaaataatcaaagacatcttgaaaatatcatagaaagtgttaattttttatgatgatagatttaaagataatttgggaatcgtcatgaaaaacttaaaacaactgtcttttgaaagttatttttttaatagtgacgtaaaattatatgattactgtgaagaaagttgttttatcgatacgtgcatccaaaaatatggagacacagcaattcatttctgcaatgaattgaatcagtgcatgtgttgttaccgatgttgagtgtttgaccttctctagtataatctttatgaatgttagtttatgttttttttttcgtctgaataaatattagtatatgtattagtatgcagttgtggactcaaccaaaataaaactaccattttcttgttatatcaatttgtttagattttcattattcttttcacatcgtgattattcgttccctgggtaatttcactttaatatga

SEQ ID NO: 4099 - DNA, 2500 bp, Glycine max
  Soy_ogl_413 Gm02:6131801..6134300 Cluster 17
cttctctttattatgtatataatattaccaacatgctttggtcgtatgtgtgaacgagactttttctttgtgacttaaatctggaaagcagagttttattcccactcacgcacggatatatagatatgaatgacacacttcctatgcgtggcatgccacttttagatttcattagtccattaaaatatgattatcggcaatcatatttgtattaactgacaagtttcttaactataatgacaaattatgagaacgatgttcgatcaattttgtactttctgtgctttatcgtttactattgtgttgtgtactcaaaagtagggttttcaagctacgtagtagagatagtaaccaccaattaggcgcagcttcgttaggtattagtctatgttgaagtttgaattttggtcccatgttttcacattcaggagaagtaataaagaaaaattctggttatgttatatttataaattagtcataaatttttgttaattattaatttttctcggataaaatacctataacttttaataaaaaaaattcagtcacacttttttttatcaactggtgactaatttatactaaataactagtctaacctttagtgaaaattttcttttcaacttatatttatttaatttagaagacttgaatatcaattataattatttcaagcacgattaagaaattcaagtttaattttgaactaatataatattataaagaaatctatatatgcataataaagatgataagaaaagcaataatagagacaaaataatctagttgagtgtcaaagtacgtgtgagctaatttggggtatatggttgggtacgaaaatggggagagaaaaaggttaaggtgattaagctttctgaattgaggctgtgtgaccatgaattagcagaaaaaaaataagctttcttgcccaaaaggttaaacatttaattaataatgtcatgtgtctgaatgaaagccaactgtctcaaactgtgaagcagtatttggtttagtgatgaagtgtccctacctggcctgatctctagattggtattcagatattgctgcgctttatacgctgctaaatcaccatatatataattaattgctctacccaaataattacaacctctctttaaataaataatagtattcatgtagttttaatatcagtaaattaatgtcaatattataaatagaactgatatttaaacaacaaaaaaatagagctactatggtttataaagcttaaatacaatcaatgaacactagcatataccgaataattataaattttcatactaatcttcttatatactatttttgaaatttccaagatattaaacatattctttttttgtgtttatattttcaataaaatattcgatcagagaatttgtagaagaatataattaagattactcttaatccaccttatatatgtgcgaattcatttggatcattaaaatatgttacaacaaaaatgaaatatttcaaggaaatttatataaaattttgcaaagagttttatgaaaattgtgcatataattttttctataaatatagatataataaaccaaagttttttttgtacataaaatttgttttgctttaatttcgtgtgtgtttgtgtgtgtatatataatatcttgaaatgtttccttaaaaaaatatcttgaaatgttttttcttttgctgaataatatcttgaaatgttaagtatatacagaatagttgggtttaaatttgtaatgtaattttatagctgattaattttgagatttatatatgtgcatgcacaaacaataaatgaaggttcttaattaagcagtaaagattttgagaattgtacacgtttgctttttaaactaagcattaatctcactcgagctacttttattagaagaagtttcatttaaactttaaagtattaatacctattaaagaaaaaagaaagaaaaataatagattaatttttaaggtgaaattattgtaaattaatttattaaaaataaaagtaactatactttttacattttagtaattggtcgagtatctcccctatcaataggtgacagacaatagttttttgaactacgtacgattaggtttttgtaatgaggattctccccaagagcattttcttcacccatgcacatgaatttggaaattgaatttaattacgtgcttaaagaattcgagccctctcacatatataaactaatacatgatcgagtacacttgattacttcaaagagaatgctgacaaacactagttaagaaattttaaattaaaaacagtaccacctgttattttcaatacaatcacataatatactctttatattcactaattctttaattaatatactctttatagctttaattaatatactttattaagatactaattttattttaaaaagtaattaagctttagtagatctcttctcttcagccattaatgctgttactttatcagattaattagcacaagaaa

SEQ ID NO: 4100 - DNA, 3500 bp, Glycine max
  Soy_ogl_4566 Gm13:39286101..39289600 Cluster 17
aaaattacattatagaataattagagattttaccttccaaaatgatcaatctaaaagatagaaaaaacatttttaaaaaagtgtaaaaaataactcgaaggtgcagaaagtataagtccttttcaaatcatatatctaaagagaaccggcctatctcaatccattttgaccaacggatggttggatagaccaaaatggactaattggcccattttatataccattctaaatttaatttagtttgattttaataagaggaacaaattaccgtattttttttaacttgttcatttaattgtaaaaatatcactgtctcccccccaaaaaaacgatgagcatattttttcacgataattaaattttcattctaaaaagtgtgccatcccaatctgcccctccataaaaaaaacagaaaagtgagcgtgtctaattattgattttgcccattcatgattattgaataagtgggaccgcgatataaatatgaatattctagaacaatccgtggtttgatcaattttttgggtaggggcacgtaataatttagtgtagagtacttcttttataattttttaaattttttctgtacaacattaattaaaatatttttatgatgacatttcttttgagaaagtaaaatatgaaatacctattaattttataatttattttaaaattgatgatttaatcatgcatattatctaaatttatatttctacacaaaatttacgcttttttagtttttgttgaatacggaacgattaggtaaaaatagagaaacgtgataacttaccacatgggtcctatataaaaatatgtttctccaattttgatggagaagggagagatggaaggtttatgtaggtataaaaataaatgattttctttaacgtgtttatgttaatttaaatgcatgattttttctttttcttttttcttttacttaatttttatataaacaaaccacagaaagatttttttttttttcattttgttttctttctttctcaaattgaacaaaccattgatgaattgactctacccaaatcataactggattaggtcaagattttaaaataattgaattaacatatcaaataagaactgtgttcgtttttctatgtcagcaaaaaagaaatcatcaatggaatacaaaggatactcaaacctatatacatacaaagatgttcacattaacacaaaaccataggttaccccatatttacacaaccgtagatgttcaaatatagtataactcaaggtgttcaaatatcccctgcatatgatccggccacaagcagattttacatctaacacaattgtccctcctatgtagacacggatccttccccctctatgtacctggactccttctatgtcaagaatcgtgtgtccgtgattaaattccgcttattagggttggtcttttttgtacaattctgttgggggtttactttgggttcgaggatagtttgctttcttagggtgggtacccttcaacgtatccatatcctctttcttaatgaaattatttttttctgataaaaaactaaatatctttgaatatatcacattttactgttaaagaaccatatatctttgaatatccaaaaaaaaactatatactctcatgtaaattatgaatcaagatgatttctactcgtgtaaagaacaatattgttcttagattcaagactatatatatactttgaatatcaagaacaatattgatattcaaagaactatatactcttatgtaaaatgtgaatcaagactctatattaactgttccttgagtatcacattttaacttgtgcaaagacttttcatcatagtagatgattcctttgaattaaataacacccagaccgtaaagataaataaaaaacgcatacccagatttgtatctataatatatatcaggtctgaagacatgtcgggtgagttcgaacaaattagcctacagttatatatgaagattattattgacactatattgttacaagttacaacacaaaaacgaaaagacctgcagggtgcacttgaaacaaaacttcaatatcataaagagttgggtttcactcttcctttcatacacatcccagcatatatatagttatggctgcaactgcaatattaatactcattagaccttaaaatatatgatatatatgtacataaaaatatatgatatagcaggtaggcactacactactacgccattaaatagtgctgcaagctaccatgcatatatacaccatgtcaatgagaagaaaaagggagggggctaattttcaaccttcgaattggtaatgatataacaccagtacctccacatattagaattttgaatctatttaaattgaaattaactattagagtggctagctaacatcaaaagtagggtttaaactttaaacgtttttactaataaaaaaatacaccttaattatcattatactagatcagctaacaattaataaaaacatatatagatattaatactgaatagtttcttttctaagagctaaagcaaggatttaaaccgcattatgcttaagccggcatgcaaaagcaccatatacaaaataatgagtcattcatattcgtgccagcacaataacatgactaggcatcttctgagtatgtaaaacctgcctctgtactctttcaacgtggcagagaatctccttcttccaatgctcgaacgtcgttgatgacctttctcaacacttgtagagatgcactgagccatttcctgcttcaaaagcagaagggttctcaaatctcacttctttacctctcctagctagatattgtgtatgtgtttacgtgcttgcttccgtgccacactcgctatcttctgcaggtttttatagagaactcactaaggagccacgttttttgattttttgaaacactataaagcaagtaagccacagaactagataggccccacaggtctacccaatgatacagcaaagaaaacatagtgacacaatttcttctccgatattatttattttccggcaataacacagaaattgtctatatataaagtctccacggaaatgaaatttttatgattatgaaataatattttgaaaaagtgacgacacaagtattagacatggaaataatggggtaagaaagagaagtgttataaggggtgtttcgaaaggactaggatgaggtgtaaggtgtaggattatggaggcatgactatacgaaaacttaccctacacttggcacagttggactattgtatttggaaataaacgatgcatgaaatatgaatgctcctccgcaggtttgaatagctagcatccacctgcagcttatttcactgttgcttcctaacatgatggacactcttccgccatggccgcacaagtggcacgtttcgattaagtaccttgggataaaatcaattagggtcaatattagcgtttagagaaaatgtattgcaccttttgtgttttcattttcattttttttaa

SEQ ID NO: 4101 - DNA, 2168 bp, Glycine max
  Soy_ogl_5594 Gm17:8943201..8945368 Cluster 17
gagaatacgacgccgtggattgctatcagccgcaattcaccaagaagaagcacaaattttatatttattaaaatataacagataattctccaagtaataccttccgtggcatttggaataaggataaactttaattttatacaatattcagatatttttagtatgattttaaattagaattaagatttaatttgttttgatcatttctaaatagaagtttgtattaaatattaatatatgttattgaagtaaaactttaattttgattagagaatagcacacaaaatatttatgaaactgcatttaaattgtgtccttgaaataatgattgttgaataaattctaaatttcattagaaaaactttaaaactttatcttattttgacatcagaacatatcataataaaaaccaaacctaaataataatgttattttacacacattatttttaacaaacaagtgcagaaaacaaaaaatgcttacagatagtagtatatggtaatgagaggaaaatggtaccgtgtgcacagtgaatgcttttaaaattgcctggtctgttttgtattaaatttcattaaaagtttcatatgatttactgaggatattttaaaaaaaaaagacatatatgaatggtaaagtaaattgtgtgtatcctaaggatgtatttaacaccattcaattacaaaacgatattcttaaaattatattaataatttatacttagatgacggtatttttttttacattaacattacataaaaattaaactctaacattcagtatacttttttaataaaatatttagtatattaagaacttaaaaaatattatttatttgattttattttcaaatctttaattataacaactattttaattagaacgaataaatggagagttgtgggatgttaattgtattttttagacagaccagtgcgcagtagtgtccttttaaaatagaaaagggaatcttaaatatgccatgtgatgtgcatgatcgggttcgggtgtggagatgccagttattgtcgatgaacagaacacaacatcgtggttggatgttcagaaatcacaagtcaatttagttgaaaggaatatcctaacaattatatatatacaaacacaaactaaatatttatatttagttggagagatatataatatatcctacaaaattaagtgacacaacataaatatttatctattttatatttacattttttgttgtcaaaatttaaaatttaatttaatttcacttcaaatttaaaatgtacaattctttcataatgtaaagttatttttgttaataataaagaatttgtgtttttaaataagattagttgctcaattttttttttgaaatatagcacaaatgattgaaatggtattttttttatattatgttattgagagatgggatattaagtgagaatgtgagattattagatgaaaaatttattatattataattattgaatattcagtatagataaagttataaatcaaggttatgctattttaaattgaacatgcaatctttatttaatttataatttcagtcatttatgtaaaattagatgttcaaacttttttctgtaaaaaaaaaagatgtttaaatttttagatgtatatccacatgtttcttcacttagatggttactattaactctcatttgattcagtcaaatactaaataatgttggtaaatgttaaagtagaaaggatgctttatatgagtttagaagtttattgccaaagccactttcgttaaaagcaaaatctgtggctacagtttttatttttgtatttttctaaagaacatgatatcaaagtctcattttaatagcgaaaacaaaagttctttattttaaaaaagtctgccagtttaactttttcttttacaagtgtagcttcagctttcatttttgtccataatcatttgcgtaagaataaatgatgcaagtaccaattcacagacacatacaatgcttttcatataattaggagaattgtttaatgatactttgatcttattattaatgtaacttatataactatttttgtttaattagtatttgcttacatgtaaaaaaaacaatgacagcttaaatatataattagttacacgtcttacctttttatagagttacactttgggtttaagtagc

SEQ ID NO: 4102 - DNA, 2500 bp, Glycine max
  Soy_ogl_1064 Gm03:43079301..43081800 Cluster 17
aaatttatttcaacctgtttcacaaatatccctataataacatatcacaagccctacgagagatatgcggaaagtgtccaatacttgccttcctagtttctcccaagtttctatctgccaaggttccagattgtccatttagaataaatgctaaatcttgaccgtttatatataggattaaatgttatataagagtgagaaaattaaattttgatctcataattaaagagttaaaatttaatgttacatatcatttaaataattatgtgacttaaactttgatccccaatattcaattatatgattcatctcatttttgtataaaatattttctatcgaaacatacatccattaaaattcatggcaccagaatgacaaggtcacaaggatgaaaaataattcaacaaaagaaaaaaaaaatgaaataatttggtctttagaactgtggtagcacattcactaaaaaaaagagaagaaacttgcgctcgtaaatattggatagaaattttattttcccatagggttgctagtgtttatttaaatcaattaaatagtacagattaaaatgttcatatattaaaataaaaaataacatgtataaatatattaaataaaataatattaattttaaaaataataattaaaaattcatgtataattttcaaattaaaaattacagattaaaatgttcaattataaaagttttaaaaatgattgataatatggtaagattctcgaactctttaatataaaaaagaattcaaagttttttaggatatttaacaatatatttcataatttatatctcttgaaatatatgggtggtttgtctatacggctgatttattcaaaaaagtttttgtttacctctttctttttgagcttgaacttggagtgcaattagccttgttatagaggggataaggttctggcgtgattgtgtcctttcctttgaggttaactgtaacatttcaatagaatcatatcagaatgaaaaaaatttaaaagctttgtaaatataaaattatacaatttatgatgatttaaaagaattaattgatattatttatatatctattttttttagcttaccatttaagaattttataattaaacttatttgacttaagacaaaatatacataaaggtcttatatattgatctgtgggatcctaaaagcaagtaaaattgattttggaaatataaaaaaatagactatctgttgaaagattccaaacaacaacaatatttaatgaaatattacggcataaaatatcatagtgagtttaaaaagaggaatgttatactaatttcaaatttatatcatcgttcactaatacaactacaagacggcctttatttttaacagtcaaatagaaataatattaattagaggatacaacaggggtaccacaactcaattgcaacgcctataaaaaaaaaaaaaaaactcaattacaacacaatgtcaatatttctgcagcataatgcagagacgccctccaaaaatctaagattagtccttacccattcatacacaaaaaaaaaaaaaaaaatctatattttatcgaatgtcatacatttactggaaaaaaaaaatctaatttctatgtagtcgtagagtcaaagttacagcaaaccaaacctcttggatcactgggagggcttctaatcctctagtctcaagtttaaaaggcaaatgagatcaaattaacttaaagatcaatatcaactgttggagatacaagtataaactctatattaatagattaattaatatatattagacagggacgtactatattaattgcattaatcctaatgtttattattcttctgtgaatccatataatttaacaatgaatttatgtttgttaaaaaacaatgaattatgttagtcatttgagactcgtcctaacaactggttcatcaactaacctaactagataaaccatcaatgtagctaaaatagacactaataacaactggtatcggttaaatttcatggaattagaaccagtatggtattttttcttcttctttctaatactgaaattaattgtcgttgttttccgtgacttgaatgttgcattttgattaactttgagtcatgatggattgagtaactttttttctccaaatggtgacttttacatatgtggaggacgagggcatggcaattccaacaaaacaataaaacaagcgggtggagtcatgtcaagaagattcaatgaacttgtcgacatggctctcaatttctatcagctagtcgatctcttgacttttgagtttcgacgacacgcaaaccatgagttgaggttggataatatcacaacaaaaggccaagtacgtaaagttggggcatagtagccgcctgctttagaatttcaggaccatagacataaaataattgaaaacattgtatatgctgatcttctcgtgaacatcaataatttaattcccttttagaaaattatcagagggatagtaaggaaaatct

SEQ ID NO: 4103 - DNA, 2000 bp, Glycine max
  Soy_ogl_2238 Gm07:6717470..6719469 Cluster 17
gtcgttttttgttatatttatactaaaaacaaataagattttgctagttattcaaaagtttaaaatttaattattttacttttaggtccaccatgattccaccccaaaaataagactaattaaccattaatttattcaacttctacttctagataattcttctgtacttattattttgttgcgtcaatccttcaaacaacaatgctttatattatatcaagaatgaattctacccatcagggtccactaaatggtagaaagtctgatagtttatatacaattttgaattttatgcttatttactacaatcgtacataaaaaatatatatattaagaaagaatcttaacaataatattattatgaaattttattttataaagtgggaattgtaggtggtagttaatgttgcagaattaaaaataaataaaaataaacaaatagacatgggaaatgttttaaaattaaatttatatatctatgttgaaatgcaagactttcaagggatactttataagagataaatctcactgtccacgttgattttgctcatcatattgaaataaattttactggtgaacttagatttttgttgttcacaaattttatatgtgaatttaaactttgaatttagataatattgatctaaatttaacttgtcacgtatatattttgaagtagggataatattaatgcaagtcttacctcaaaacatggcttttaactttacattaaaaataatcgttatttgaaatgaaaactcctcatatatgaaataaagttatcccaatttttaaatcatttccccatgtaattgtgattgacgaactagcacatccaattaccttaatgtataagcaccaaatcagcataattaaggagggcggggtagtgtttttccaactacactacataattcgggactatgatcgttcccctggtcaaagaaacacacaaaaaacaactttagggttgtagcacaattgaaaggttcaaatatataaaagtaaattactctgcaattaataatataagactgaatttacaaatgcaatatacataatcttaataatgttgttaaaaatagaacttcaaaagtctataccttcgttaatcacagctacgctagtccattaattatggtgcaacactttcaaggttgttccaactaattaaagtttgtatgaaatttctcagcccgtttgttataaagtcggcaaaagagggaatgatgcccgcgacattaagacactctcttctctcttagttgaataattctattgcttttaaggcgaagcattctgcttttaattctatgccaaaaacaaattacataatccataaattataatttattacgtataataaatttattgacttttaaaataatttaagtgataatttatgatatcaataaacattaacctccaattctattgttgtcaaaaaaagcatgtttaactttttaacataaaatcttgaattaaaattttaaactagatgtgaatatgtaatacttttattttatttattaaaccatattttataatttaaatattaataaacttttgtctcaattgaagtccttgaatttttcttcactacaagttttaatctctattattaaataataacattgactaaaaataaaacaatgacattgacaactcaatttgcttagaatctatagagataaacacatataattatttttttaaaacaatatttttaatctttcaacaactaattttatgtcataaaaaattaagagactttcatggatcaaattttggatcagcggctaaaagtagaaatccaaacatgtttaagaaaaaaaaaactactaatgccaaaaatattcactgataataaaaatgattatattcaaattaaaatatccttatttaattctttagtctacatcactaatagtgaatactattcctttgtatttatatataagaaaaaaaataatattatatattaaacttaaatataagtc

SEQ ID NO: 4104 - DNA, 2675 bp, Glycine max
  Soy_ogl_2544 Gm08:7639401..7642075 Cluster 17
atataattaaagcttataggtggtaaaacaagttatccaactcattacaagttaatccaatgcaggttgcatgttataatgggtcgggtaaaaaaagatcaaatttaatttaggcctaaaaataaaacttaactttataaaaagtctattttgttgggcttttaatggactttttgtggcttaacccgtattaagtcatcatatatttagactaaaaaatttaagttcttctacattttatcttatcagacagatttgggtttatccaattcaccgaattcattttgtcaactctgttaaaaactaattcctttaatttctaaaattcatttaatgaatcttacaacaaatacgttttcaatgcatgaatctaaagattgaattactaatcaaggacaaacttatttgctaactatgacacatcatatcggttgttttgttcttcattgtggcttatttttctacatttattatttgcttcgctgcatatttctctagttttgaaaaatctatcatccttttcattggtggattttcttccatttaaaaaagtcaatacagcggtgaactgtattagcttacaaaactttacgaagatatacttatgtgataaaagtataaaataaaacaagtggctatattttttcaatttaaaaatatattgcgatctaaaattcctttttttaacaagttataagaattatttttgaaaaatgtgaaagagatactcttcacttcttccccacctctattaatcccaatatgtttcaacaaaaaaaaaatgagcagaaaaatatataaaacatttagtatggactatggagtcattttcgatctgtacctgaattcaagtgtggaatttgaaggtggtcaaacgtgtaggcgaatcaatgagttcacataccaaaacgaatgcaaaatatataagacaaattggtcaaagcccctttgaagggcataaaaccataatacacctcataccaaaatcttcaaaagagaatgggccccacacaaaatgagaacacaccatgtgaagtgtgaagtagtaggcgtctatgaccggaattctctcttctttcattaacttttggttaatgaattgatgaaattaacactaataaaataatgtttcttgagctcctaataggagtaaacaatataaaagtgtaacgttacttaaatagaagcattttataggaccatataccttaatgaaaggcaaacaaaaagcgtagtataacctccctacttttcccattgggttttgagctttaaaaattttatttagatcttggataatgttaattatgttttcttagaccgcctttaaaataatgttttcttagaccgatacgggaagttaatatatttgcaaatagagttaaaagaatgaggagtacttactattcaattattcattggcaacggtctcctagctacgtttctaaatggcatcttaattaatgagccaaagaatagaagtgagggattattaaggaggtaaaaagagggctaatcagtttttctaatcaataaattataaatagtaaattgtgaaaaaagtagttaatattattaatactcttcaccttatcaatcagttttttcttaatcaaatgttatcagaaccttaaaaatatagatagagtatttgtaaaatgatagctaaaactgatttggatcgtgcatgtacgtcataaaaggacttatatctacttctcttccttatttgactactaagtgtagctcatttgcactttcaaattagtcaaaggaagttacggcttgtcgacaatctgaaataagatctcaacgacatctttgaatgtataattatacttatggttctttatattcatttaaaattttaattttttattttattattttaccatccgtcctttttaagttatttatttagacttgataacatgcaagatgagttttgtcttcttctttttcccctccattgaagtatgtttgcatgttctatttcttttcttttttgttatgtaacgataataaatttgagtataagattgtgtacaaattactccaacttattccaccattactctttttctaactttcttagtttgttgcatcaaaaagcttataatttaaaaaagaaatataaagaaaattgtttatatgttttgcacacacatgaatgattgataaatttaaataacattactttgtaaacatatttcacaaaaagttacatatagtttatttataaaacacacacccactgacacacacacaactgatacaagagtacattgcataataaaacgaaattaatatttcaatctatcaaattttccagtatatatctatatcaaatttgtctaaggtcttgaagaagatatcaactaattgagaatgactatatgagaaggaatataagttgcataaataatgtttttcagtatgtttcatccactcataaaatactatgctctttgctatttggctatttgcaatactgctttgattatgaaaataaaattgtatgacttttgattatagcgcatgtatcaactggataaaatctctttcaaccacttttaattcacatgttgtttttatcatttattgatattgactttttttatgattgtatatcatctgttacctgcgagccagctagtatcgcctgtttttgggcc

SEQ ID NO: 4105 - DNA, 3300 bp, Glycine max
  Soy_ogl_6115 Gm18:50740201..50743500 Cluster 17
gtgtaagtttcacaaaagaagacgcgtggcaattaaaacaagacaaattggtttcaaacttggacatcctaatattaattaatatatattgtgagaaaataatttttatatgatagtgagatatataggtaaattcaaaacatgtagttatatataaatagtaaagatttaaggtagcatgattatttaaaaaaagtcttttaacttataaaagacgcacataattttgtatttttatgatcatttgtgatgaagtttagtagttaatatttttttaaaaaaatatggatttaatgtcatgtttaggaattgtgagagcctagtggacttgatctcatagccacaacatatttctatcgagttaacttattgcgtacggaaggaaagttgaatttgacttttataattaatcataataattaataacatgaagtatataaaaattcgggagtgatttcttttaccaaaaaagtatataattttttcaaagatgatgtgactatttaaattaattcttaatttttaaatatatcaatatagtaaattaaaatttcaaacattttaatttatgcatttattgaaaaaaaaaatagatttcaaaatcagaggagccaaaataatacaaaaaaaatagagaggccaaattggatcattaataattttagagaaacctaaaacataatttacctttattattaataacaaggaaatttttttctaaataattattaaatacaacgtaaaaatataatcagtataagaattataattaaaaactaagtataacttagtaggaaacaatgtatgtattatttcttatcaaatatgtttaattccaacctatttgaaatatttatctcattaatatactaaattactaactagtttttttctttttgggtatgaaggagggcaaaagcccgaaactgataataaacttactaactagtttaaattaaaacacgtgtttaggttagttggttattcaatcgattgactaaactatcctttttttactggagactatgtataccggtcccttgtacctctagaaatgataattttctttggttgataaaaaaaaactcatgaaacaaaaggtaataatcacccatagtaaaatcgttaattacttccactatgtttttttacaaccattaattcttttaaccttctagaaataagttttattattttcatatattttgattattatcttactgatatgaagtattcatcaacttacgaattttattaatatttttattgaaaaatctagttaactacttttgctgttagagttctcgccctcccccctaggttttatagttatcctatgtaaaatatattgtaatgatatatgaaatatttagaaactaaaatagattatattaaataaatcaaatttatctttatatctttaattaagaaagtattgttctatttgtcaaactactattttcttaaatatttctgcttttttttcatttattcactgtatttatgagtattcatatacgcacgacagcccgagatatttgtttgttagttagttccaaaaaaaaaattctttactgaatttctcgcacgcacattcaagttttgtaattagttgttttcaaaatttacaataaaaagcataaagtttgtatttcacctatatatgacaacctagttggcccatcgataatgaagtatttaagcatgctctagacatcaattattgaagtttattccgtacttaacaaaatgaacaaatgaaaaatattgggtcttagaataatataaacagattagtgcatgtgattcttatattcaaatttgaatggtagagccaggaaacaaactggtacgcatatgcaagttcatctgggtaatttaggaagaacataaccaaggacatgcaagaacatcttacatctccatttaacgtaagagtccatctaagtcatctttgaaaataaagattaataacatgaagaatttatttttacttattacaagaaagaaatatttatgtttaaaacttttctcatatataaatatttaattttgagtaaattaattcaattagaacttaatttaagcatacttttcaaaaaataaaataacattttgaaacataaattaattccaataagtttttttgatgcaaaagttccaataagttcagatgagtacaaattgattgggatgccccacaaattcaatgaaggttttaaactcgaacattttcaggtggcatttttctcccttcagcttcggctattatttttctccttcttgtaaaggagaatttaaaagaaacaaattaacatccaatatccgtgcctttacaactataaataaactactaaaattccggtgcatactttacacttttctcgttaatataataacttcctatccagtttttttttttttttttccatcaatccttttaatcaaagaataaaactactaaaaagatttatgcttatacctttctcattaatataattatttggaatttgatttcggtcagggtggagtggtagattccccgtatgggctggcaaaacgacgtgcgtaaagggacaagcagtgaaactgcgaaggaaatgtcgttggccacgtgacctacctgtatctctcagtcactaaacccccactattaattttaaaaaaaaaatcaaaaaaaaagagggttggatatagtagagtacgtcttctgtttttgttttactgttaaaatggcatgtattttttttttgaagaaataatcttaattacttagttggatcggataagatgattataaagccaacaatacttttcttctaaatatttagcgtatgtttaggttaaaattagaaaacttaatcttaggatagtttctattttgtaaattaagtttgtaacttgtaagaggaaccttggccatacttttttttttattaaaacttattttaggaaaatataatggtctaacatatttttgaaaggtaattaaacatgtcatgaaactgaatttattccctaaactaagtttggaatactctcaaccgaaacccaaatatactcataatgcaactacatatttaaggttttccccaccatttagcaatgttattgaaatacaatgtcctattagtttgaggtgttatgtaaaaatgacttgatttttcttatttatgttcgatgacaacaataaaaaaattaaatttatgtctccatacatttatcctaatctcctgccgctaggctgatctgatagacacttggggaatttgtagttaccaattgctatgaaagcagtgg

SEQ ID NO: 4106 - DNA, 1200 bp, Glycine max
  Soy_ogl_275 Gm01:58201..51870400 Cluster 18
gtgctcaccgtgggtgttttcattttcttttcccccttgtcttagtttaattgactggtttggatttaaggacaaaaagacaaatggttagttataaacttgaagtcaagattggacggcattatttaattatgcatgtatagactcaatacttaacaattcatattcacttactcccttaatttttaaacagaccattcacattacttcaaaaactttaaagtttttaagcctcaattatggaaaatgtataaaaactaaattattttatgtaaaatacagtttttttattaatatcttatctcattttatttagaagaaataacaataaataatcataaagttaaaaaaatcaatgtattcttcaatttttctaaagttattagtaaaataaaattcattccctaaataataaatgttttgaattggatatagtagttattatatgcagtcaacttagtgcaaggaattctgagtctgattacacaaaacatgtatgaacgttgaatatacaaagggaatataaactgagtttaaacataaattactccgttaattttgtgcagctttgttagctattttcaagtcaaggacaagtgggaaattttctgttagcactgtctgtgtatatgataagtctgtttctttcttctgtctaaattaaggacaaaggaggccactgctgccgggaagataatgtcacaattacgtcctaattaatattaatattatgttttaagagaacccctgttttgaaatagtttacctaaaaagtgatttgtttgacataagaaacagaaggggaagaaagagagaaaaaatctgtatttaattactgaactctatgggattattggttaatctaattcagttgcatagctacctattattagtaattaaaaaaagggatatttttttttattgaaagagaggcttatatttatgctctccttagacaagagatgagacagagtgaagagaaacatggctaacacgaaatatatcaaagaaaaaaaatgcagtaacttttttctcagattgtttggattagttataaaaaatataaaaagaaatacaaatattttaaaaagttaaatttaacctcgaaaactacctcattaatttttaatacaaaatcattttttttatattttttatgttacaaaaattatttgatttctaaaaagttaaaacaacaat

SEQ ID NO: 4107 - DNA, 1175 bp, Glycine max
  Soy_ogl_349 Gm02:3432801..3433975 Cluster 18
aatttgtgtgtaaaaaaaaatcttaatttgaggatatcttagttaactaataatttcctaaaaatgagaataaaattactttaaaataaggaaatttttctattaaaaaatcataataactaactaacaaataattttggtgtgataaaagatgagtgttgttgcataaaaaaaaaagacttcctaattcagttgtatttgtggatattatatatgattgtaattcaaattcataataacgggtccaattgtaattgcaggaattctgttgaaaaaggaagctggtcacggtggaaataatgatggagaggtgggcctgaggtagtgaggtccattaagaacggccatgtacaccggctggcatcacaaattaatagtacctcatctcatgtatcattagcattaaagcgtgaatgataatctactaatttaaatttatgactggccatgggaacaatggcagagctttaaacgaagttttgagggagccaaaataaatttcaatttacatctttaatatgcaatatcatactaagttgagaaacaaaaattatcaattacataaaaaataaattatttacgtaattattacaaataaaaatagataaaatctatcaacatctacttgaacatacatgtaaattgtcttaactcaagaaaaaattattacgtaaatatatatataatgtaattaatatatattatatattaatatagcattgcataaacttttttgatattaagatagaaaaagaaaacattataggcttaagcattacatatttaagaaggaaagagtgattgttttttatcaaaacatagttgtacaacaataacatcaagatggaaaaggagagtaataacaatgcttaaaaagttagtggatcagtgaatttatatataaaaaaaaaacagaaaagtaaattgataacccaattgagataatatatatactttaaaatataactaaagaaaacgaaaacacatatatacttatgaaaataaatcgtgtaaatatgaaattaagtctattgaaattgttgaaactaagttgccgattaggtgttcatagaataaaaaatgagaaagaaagaaaacaactaatatgtaagttttttgattttctttgaaaaggaaaaaaaaaattgtgctaaattgtagattaattaagttaa

SEQ ID NO: 4108 - DNA, 2124 bp, Glycine max
  Soy_ogl_378 Gm02:4646001..4648124 Cluster 18
aagctacggatgtgtttgatttgacatttggagaatcaatgagatttatccttcatggaaaattatacttgcttgttccacaaaagaaattcagttgaattgaacatcattttcatttaaactaaagttgtaaagttacttttctcttacttctatgtggaacgtaaaaaaaaaaaaaacttcaaatataaatcaaactacattaaacacatttttaactaaatttatgtttacaaaattaaatttaactaaatttcacattttcaaccttaattcaaacacgcactacaagtagtaactttggttcatatgtgtaaaaacacgtttgcaatccatttccaaacacaccacaaggctagaagcatttagaaaatagaagcgcgcatacttttggaagcttgctttgtccaccatgcacaatcaagcggaaatcacatttgcccttacatattgatggtcatggaccaccacacactgagaaattttctagatttactcttcaattcattggtaaaaatggtatttttctcttccccaaattcatttaattttttattattcattgaattgttttagaaaacctatttacacatcagaaaaactttaattggccctttattatacaaattagctaacactatgatacttacaactaataaattgttggtcaattttcataatgtgaaaaagaactaaagtaaaaataaatttcccaacatttatagaacctaaaacatattaagacaaaaaaatgacaagtgaatgtcttataattatagaattatatttatagctaggtgaaatgatttaattacgaaaaacatttcatccaattaatttaaaagccacgagaattatgctaaaaagttatgagaacagtgctcaaatagacataattaatcaacatatacatgcatggaaatgagacatcgatagctaagacatgaagtgggtgaccaacaatcagatggagtgtgttagactaaaacctaattaaagcccccactttcatttgggatccaaattctaatcttcttccgctgttcccgccgttgaacaatgtagaaagttgaaattaggagaaaaaaagtgaaagaaatctaataaaaaataatgtactaaatataattctgaacaccattaatggagcggaactaactgggtggtttccttgagacaagcaaacatggtcccaagtgggggcttcttgacggatattatgaccaaccaagaaaccacagtaagctaccacattgggtgactttcttttttttttttcaagattatactattttttatgggagttaattctactcgagttgtgtaaaattagcccgaatgacaatttttaaaaatatttaacagttatatatcaagaatttaaactcaaaattatcaaaggtctttctggagaaactattacactcaaataattttacaccaataaaaattggagaaactattacacttatacattatattcaaacagacaattaaaggtctttctagtgagtagcgactacaatgtttttttttttaacaaaaactagtgaccacaattgagaagcacaagaaaagtgattattcaagctgtaattaacagttataacgcaaaatatgatttgcttttgacaatgtaactaattaaattatagggccatttgcacacacatgtacgaccgcaccatacttttttttttatttttggctttttactgttttttgtaaaagtgaagattcgtctatctttacctcgagccaagatactcagtagtcagtactcaccataacctacctagaagaataaaatcataatgacgattgaaatcaagaatcatatactataactataactataactataaactttttttaactaacaacaaaacttatctaatgtatttgttctattgtagtattcaatattaaattctaatttttaatgttattttactatttaaaataaaataatttcttttatccagcgcttaacataataaatgagctttggactatattaatattaggggacgaaaaaaaatccatgtgttgtatcttgcttgaatcttaccttatttatacacagatgaatagaagtagccaaataaaaaaacaataagacaa

SEQ ID NO: 4109 - DNA, 2300 bp, Glycine max
  Soy_ogl_384 Gm02:4930501..4932800 Cluster 18
caccttgagaaggttctgatagtgatagtgatttacagcattaaatttgaaggctaactgtctccaatagatgttaaaagctgtagccattgctgagtggacgagaattagggaccccactagctgaattaatggttgctttcagatcaatgttgatttgaactagggacttgcaatgagtgaggtaaatactaaatagctaatagagatcagagataattttacttgctaaaagtaaaatataatccatggcattaatcattctagctgttcacacatctttatattgcctatctgaattttatatttggtagtatgcttatccaaatttcaaatttggttacaaaacatccatcatgattttagtgcatgaattcaaaaggaaaagaacgcgtttcttcggttgcaatatactaatatttaatgaaagatttcagcatggcatgttttcttgctccggggattttaataatctgagatgaaacatcatgcactttttccctgctgcctaacacatatatataggcacattatttatttttatatatatgtgggtgcatgtttttcaattaattaaattatcatgaaacagtcaaacattgccggttgctgaagaattcttcaacatataagtaggtataataccattacttgtgttatactatatatgtttcttaccctatattaattaatagatatctttccaagatatggcaagcactaaacgcaattagtggtttttgtcatacatgaatcttgagtttgagaatacaatcatatgtttaaacgttatggaattaggctaacgatcgagattattaacattgtgtctctcattattaactaaagttcataaagttctttaatgtaaaaaaaaagtttataaagctttatcatgtttaagtttaataatataattttaaggacttttgtagttttttatgtgtccttagaaattattttacgtaaattaggaatgtcattgactaaaattactaaactattttataaaataagaaaatcgaaaaaataataaaataatactgatactcatcaatataaaaatgcacactacaaaaaaaaatactatgcttggagcttggaagagacaatgatggagcacaagtacactaaaaagaatgaacctggtcttgggaatctcaaattctgaatacaatttaatattaagtttatagtatgtataatttttttcgtggattgatcagccaaataacattgaggtgtcttctttaaatcttatcgtcactttcgtgtttgcctcccaataacctgtcaaggcacgaggcatcaacaatcaaccaccatataataagctacccacttccacaatttcatatgcaatattttatataaattattatatgcaaaattgtacatgtttttgttttatcaaatttatttgagtttttaaataaatatataatttaataaccataaaatacttttatcttcttaaatattatataagcaactttctgcacttattcttagttctgtgctttaaaaattaaaacgaattctttaataatttcatgttcctaagattcaaagggttcttctttctagtaactaaaacagattcaaagatgttaagcttatgtaagaaaagaaaagagaactaaagaaaagtaagattcaaatctaaccaaaacggtttcaatgttttttcactggtgaccaatcacattccagtgagctttccgtccttgtggttgttccgacattttggatgaacgagagtatctcttattatcttcagtcgaaaactaaaacttaatctttcaaaatattaaaatttatttgagagattaatatattttaatatattttttcatcataatcataaaaaattaaacttataaataattatatatctaagatataaaattatttatcaattatatcatatgaaattaatgattattctgtcatttaagtcaaatgatttttttcactgtttgtttaagaagatttgaattcaagaaatcatagaagataatagggtccacttgatggttgataccatataaccaaaaatccaaagaaaaaggaggggattagtgggtccttgtgtcctctactttaatattgagtcacgtataccaaagctcgtattcgcagactcatcatgctgccacttactactactcaatttctttgtttcatactactcaatttctttttgtttaataatgtgagtattaatcatactaccaccactcctatccatataagaaaacgttatacgtacacaaaaatcttagtcataatcttataca

SEQ ID NO: 4110 - DNA, 1441 bp, Glycine max
  Soy_ogl_1696 Gm05:37254360..37255800 Cluster 18
gataagagatagcaggaagaaagatattgtataaattttttttaatgattagatagacaaaaagtagaaaatagaagttaagttttctctccagttatacttggatagaaaaaaaaacaaaaattcttgtggaccttgtatggtagagaagaaataaatatctctcccttcttaccgaaggggatattatttttaaggtgattctctcgttagtttttctctgttgtttattcctctgtctaacaacaatataaaaatgcttttactctcgtacttggcaaatttataaaagtggggcaatttttttttaaaaaaatactgaatagattttgaaaatattacgtatatcactaagtggtattttaaaacataatatcatataaagaaattatgttttaaaacatgacttgtaattttatttttaaaaaatataaaatacttgaaatcgtgatttaaaatatgactttagtaattttttcaataaaataattaaaggtgtgttttaatcacgacttaaacaagatttcagtatttttttaaataaaaatgtagttctaaaatcatgttttaagacatgatttacctataacttgcaatatttttaaaaatgatcgattcctgtaatatattttttaatcgggttgaaaaattgccccatttgtaaatttgtcctcgtacttctctcttttcatttttttgttgaaccaatcaacctataattaagaactagtggaccaaagtccatagcagaaccaattttaaggtagagacaagtgcatctcaatcaagagtaaatcaacaatacactactctcgaatgggtcaaaaaatttcaattgtaaccattttccttacttaatccactgtaggatattcttataaattagtcaagttactttggtaatacacggatcaagagtttatttataatttaaatataattatttaattaaattatgtataaaaaatgattaaatactatcgaataaaaatattaaaaattaagtgtgcataagagtcgtatttatgatattcttataaatagataattctcaaaagcgttagacacgtatttatgatacttctggcaatgctagaaatcttatgtttagaagagataaattcagacatctagaaccgattcaattatatatacagtatatattatgattagaagagataaaaaaaaatatgtaaatgtgcagtaatttttataaaattttgttatatgcattgttatgtttttttattgaacttctaccgtgtagtcttttcttcgaaaaagcaatatgtcaattgtcaagcaagagaatggtccttctttctgaataactaattaaagagcgttgcagttattgctttatccgtaccatttctgaagaaagtttactgaagatcttttcaacgtctgaattttactgggagtgtgttggtagactttt

SEQ ID NO: 4111 - DNA, 1400 bp, Glycine max
  Soy_ogl_3207 Gm09:39836901..39838300 Cluster 18
taaaatcttaatcatgtaatcatttcaatagtatgtacatgatgctcatgaaaaccattcatattagacaaattgtacactaatgggtacaactttttttctttttacataacgttatacaataaagaaagatagaaatagatgggataagatgattgatgtgatgaagacaaacaaagagttattgtaaaaatattatacgacattttataaacaaatgatctattgatattaaattatttaaagcacatgcagatgagaaggtaaacaaaaatgcagatgagaatatatacttttgggatagttcaaatggtgatgaaaaccttattgaaaattaactaattaagaccccataaaatattagcaaataatctagaaaatttctaggttttttgtaaatatggtatattttatgtttctggtcttacgtatatgataagcatgagttgatttagcaggggaaactatcgagtatcgagtgatgaatgatattggggccagacgtttccgggtaggacaaggaagagaatgatgagaagcagtgtatagctagtttttttttttcttatgcacatgtcatgagcttcttgcacttgtaagttgtaaaatgagagtttgccacacacagaagtccagaaaaagtgtctctttccaactttatcacgttaatcacgcagtttcattttctttatttcccaactcatccctcctcttcctcttccaattctctccttctcttgccgtgacacgagctacagaagtcacatagaaaatcattatacttaggacaaagatttatagaaattataacattcacttgatgattttagaaaaaaagaaagaaaaagaagtctggagttcaaattcctttcaaaaataataaactaattactatttatcgataaaaaatgataaaagtttataatacactttgagaaaattaattattgatatttttttattttgaaataattgatacttccttgcttcatgcacataatgttttatttgaaacaagcggcgaatggatctgaaaatgaaaaaaaaaatgcaacttatttgtaagaaaagaggaaaatagaagaaagaagataaagcctaatcatacatgcatttggataccttttaatcaattttcactcccaaaatcatggtaaaataatgtgattggattagatttaattctatcaaagtcaatttcaaaataaacttaaaggtcaaagcaataaatagttgcttcaatttttaatttttattatgattttggaggaaaaaattaattctaagaggtactaaaatatattaataaagatttttttttatcccgtggttgatcctttcagggattggacactaattagatacctctccatatacttatttgaaccttgtttattttc

SEQ ID NO: 4112 - DNA, 1700 bp, Glycine max
  Soy_ogl_3208 Gm09:39844701..39846400 Cluster 18
attgttgtgttgtgacaacaagtgtgattgatcacacatgcagctaggtaggtagcagcaagttagagatggaaccaaaccaccgaccaattcttgtgttgtatggttgtgaagaaacgtgcacgccgtagtaggattactagctctatgcacgctgaaaaaacagacagagagagacacgtgagaggggtggctggattcccgtgagaccaccaaaccaaaaaccataacccatacatacattattacgtgcataggactaggaacaaggtttcctccaaaacgttaagtctcacgagctatatatcctctcgtataatctagctaactacttttatcgtctactccttcagcattaattcatatttttcagtctttttttggtatacataattttcagttatttgaatatgctgcgaaaaaaacaaaatacaaataataagtttaattagaggtggtaagtagctcatagggagagcatacgtaaagcagggaagactaaattacaaatatatattgcatactcttgtttcaaagtttttcttttctttttaagtgggatttgggctccactaaattattgagagggcactttcaaaaggaatgtacaatataataattaagaattaacatttgaaattataattaattttaaattttatcattacaataatataaaaaaactcatcagtttatctcagaaagaaagatgtttttaagttactgccgtgtatgaagatttataactaaaattaattaaaattaagaaatagtattttattaaaaattgtataataagtattcattgaatcattgtagaaaaagtatactgtgatataacgaggataagaataactgataaaaaatattaacattcttgttttagaaagaggactaatttgacgttgtcatataagcatttttgaaactgtgttgccacagggtaacagattaacagttaacaaagttatgaagtatgtttttaatataatgataagaaatgaaaattttaattattacgagagttgggtagagtaaatgacaccctccatgacctagcttgtggaagagttttgatcaccagtgaagaattctaactaaccaaaaaattgagtgaaatatcattggatgacgtgtcataaaatgtaaactgttaagatatcaattctgaagaatgctacacctcttatactattgatcgtctaagaaattgaacaaccataataatgagattttttttatagtgattagcgattcaacactttgtatttaagtgaataaaaatcatctatttttaatccagatacgagattttttttaatttcttaatgaaggtgttaaaaacactaattaatatttgtgtttctttttaacattacaaatatgaataaatggataaaggaaaaaagaaaagtaagagtagtaaatataataaagggtactcgtactagcaatacgataccattgattcgtacttcatttattatatcgatggaaaattaatgttaacgacaaaatccagaagcatacttttccctaccccaaatattaaggttcgtcaaatgaacaatcgctttcacttctgatacgaaacacggggttgactgaatctgaatgtcataagagaaaatattactataatataagaaaaaaggtaaaatacataagctgggtcctttaacttctctttgatgtcatgt

SEQ ID NO: 4113 - DNA, 1400 bp, Glycine max
  Soy_ogl_4535 Gm13:38064401..38065800 Cluster 18
tcatgatcagaaaataaagaggaaaagaataattaaagcgagaagaaagtaaagtgtttgatgtcatccttggctaatcgcttgtaaaagaagaataaacacattgtgtgttgctttcatgttttttagcatatgccttacacaaccttttatttttcattttttaggtgcttcactttaagtacaagattctagtcatatcctcaatgtacatttccgatcaatattagaattagctctaataaatatttcatttacctttttcttcatgtatttatgatgaaaaacaaaaacaacattgcctaggcatcaaggtttaaattacagttgcaatggtagtagttatggagtcttgccaaatcttaagattacaaacaattgtcgacaaatgatgtcaatgcagctataattgcaattatgatgaggtcacaaagacttcattaaccctgatatagaggccaattgcatgtatcccgaaccactatttaaaactttatttcagatcataatatagattaatggtacgctttaatttatatgtaccatggtaaaataattttatattattatttaattataaattattatttatatttttttaaaataactattttaaaaattatatgattaaaatgatagtgtaaattttttttaatacataatatttttttcttaatgatatacccaccaacaacaagctagaacaagtgtctaaaaagaaaaatgaaaacaacatgttgatgaagggtttgtgtggtactcttacaccatctatttatactagtgtgtttcttttgctgttatactagtgtgtttcttttgctgattaaaaaaaataaagcaatagtaaaaatagtatactataaaataactttgtacagtataccaaattagcttggaaaattataagtattggtcaatttaattcatgaaaatacaaaatatgtttttaaatttctaaaattaacaaataataatacaaataattataattttgaaaattaatataactattatttaatacttttaggaactagaataatattttttacaacttgagggattaaattagtttatacttataattttaagaactcatttggttattactcatttttctgttgactggtatataagaatataaacatgtgtcattactaaaagactttggcggctagtctcatcgatctatatatatcttagaagcagctagattaataaacttgcactaattatttatgaaacttgaaagggatttgtgggcatatccaccatatttaagtcatctcataaaccctacacgcccttttcggtaattaccgaacttggtgtaaactaaccgggatgaaagagtacccagttcaaattcttttttgttttccttgagatagagattaaag

SEQ ID NO: 4114 - DNA, 1700 bp, Glycine max
  Soy_ogl_4623 Gm14:3758701..3760400 Cluster 18
gtttccatatatcatgatttgaacataagatttgttttgctttgtttaagttttcactcgaattatgacttcaattgtttttaagggaaatccaaacacattattaaaagttttaccatttcttaaagtattaaaatacagtttattgtactaattaattaagaagccagtttgttattatttattagatgaggaaagaattaaactgaaattcgcatcttcggcatgcgctgcagtggctaatggcaacaatttttagaaatagagacgtccaaaagttgcccataaattatacttgacattttctgcatcatactatcaatttgacaacctaaaaagagcaccttcttccatataaatagttttccaatttgtccttggctgggccagggaacttgaacccatgcatgtgaataaagattcatacagttaacttgtgacattatgttatgtgtgcatgcatgctagtttatgtaaaaagaaaaaaactaaaaagtactaactttttaatacaaattcttatttagcgtttaatgggaaccctgttgcttaggtagatcctcacgttctggtctgtggtaaaagccttcattggatgattatttacatttgtatattgtgtcttcaacatgatgacgcaatcccattgacacagtcttttacaaatctcaaatgagaaattatctttttacattaaaactatgcaaaagattgtataatgatcagagagagacaaaaaggagaaaagatataagtgaaatatgttgaatgatatgatataataaaaagaaataaaccaaacaatgttatcaaaagtgttgtaaaaatatgaatataactcttctaagatgctgtcaatttagattaacttttgctcactaaaaaagtcaaccttttaatttatgagaagtctctgaataatttttttttttacttttaatttaggattttactaatttataactatgtaattgccttgttcttataaataattaaaatataaatttattttaatttatataagaaacttaaattattttatttctttaatggattttgtttttctatattaataattgttaaaagctttatcttattctcaataccatcggacaggcaacatactcctgccaatttaaggatccggacttaatcatttactccttttatttattatcgtgtttcttttttactgccacatttaggtatatatggtttgggttgtgtagaatgaaacataaagaaagttaagaaaaaaaaatatttaaagtgaagtagtgtaataaatgtatgtgtgagattcatattaaataatgaaaatttattttcttttttaatcaatttcatcttaactagtgagtaatattgactctcagacgtgataatatagttatttgacgagaattttgttatttataataatactcttaataaacttaaatatgattattttcatgaaatatatgattattcaggagaagaaaaagagatgtttcgggctatcaattcttgaagcttgaagcacgagctgagttacagaagtcggtttgtctctccagctgcaagtctgcaaccccaaattgtcatttagctcaaagtcacatgccatgttgtttctcacagtgattccaatttccaaatcatacaactctttgatgtcatcttgtggtttcggattctgtcactgtcgtagtatggta

SEQ ID NO: 4115 - DNA, 2400 bp, Glycine max
  Soy_ogl_6992 Gm20:44636201..44638600 Cluster 18
aaaaaataaccatatcatagttttcagcattgtagttcgcattttaaatttaaaaaattacacaaaagttttaggttcaatgtgttgcacacggagaaaaaggttggatctagtgatgaaaactgtggggcattcaacttggtaagttattatcttgtttaaaaagtcacattaataattaataatagttttaattgaaaagttattgttgttcaagtgagatccttcttagtttggcgtgggtgtgggtgggagcttcaaaagcaaaccaaacgaatgaacgaaaccagcctctagtagttccaatccaaaccaaagtcgtggctgcatagtatatcatcatattcatattacaaattcacaacacaacaaccaaacaaaacagaacacactcacttaattcttctttaatactacatgctcactcacgatttctgtttgtgacaacacaaaacgacatcactgtaattgtctcgctagagaacccaaccaaggcggcgatcgcatgcacagtggtggtggggtgaagatggactcctccagcaaagaattgcttggtgacacatgcctttcagctcttcgattgttcgttgtgccactgctccaactttttttgtggttcacaaagtgaagcgtgacattttggtaacccaatgcttcatgcttgattgattttggtgtctcattcgacttgattttggtgaccttattcatcgactctcaaggttggttcgtagaggaaaagcacaaaggagacataacagggttggggcttcgtctattgggtgcattgctcctcgagtattgcgatcatgacacaaatcttcatccctattatgactcttcaactccagctgaatacgtatcgttattttattgtgcttgtcagctcaaaagtttgaatgttttaaagtgccctaagcaccttacaacacacaaaagaaaggttttttagaactttttttaaaaactttttttattttgttggatttgtgtttgattttgatatgtatttgtgtctctacttattcttatttttggatttggatttgtctttgaactaactctgcagtgattgatggaggaaaaaggaaaatcctaaaaagcaaaaacaatttttaaagtttataatagtcataaattgtttaatttattttagtaaaaaaattaatgttacattatcaatattttttaacgtaaaaaactaaaagcattaacaaaataaaagtttagggattaagaaagataaaaaaatttattcaaaaattaaaagtaaaaaccttaaaaaatccagggttaaaaaacacagttaatccttaatttatctcaaacaaaaatatgtaatattttaatggattcataataaagattatttaatattgagaaaaatagttatatatcattatttatttttgtccatttgaaaataaatcaaattgtaataaaagtcacctgatcgtttaaaatctactgctctctccacatatatgaagttactcagtctatatataatttttttgtgagaataaaaatggtaataaaggaagtttttcataatgttatcaaacacggtgttagtggggatgtttgggataaaaaaaaagtgggcaaaagactattaagggattacgacacttttagttttgtcttatctaataaagttattcaactagttcctaaaagttgagagattttcctgtaaggtgtccaataatgcaagacttttaaaattagttggggagatttcaaatgaacccatcaccaccggcccgtacaatattggccatttttgtaaatactttacaatgatgggaaattaactttgtttttaattgggaatctaacaactaagaacacttggtcgcttggggtttaatttgtctacagtggagagaagtttcaactagtctatcgatggacccgttaattttacttacaataggaggtcaagtaccggttaatcttttatatatttaaattaatttttaattaacgttaattagttttcgttgttttttcaatttcctaacctaagtcttccacattactgtttgcaccatctgctgcctcccttcagagtgcatattgttcaaatcatcttagaaaactcaactacaatatacccaacttagattaaaattaaactcgaaacattccaactctaccattatcaaaaaacagaaatccaatcctgggtgatttccattgcaacaaaataaattaggcaaattccaacaacattcatagactgtagaaaaaaaatgctgcaaaattgatgcatgtcggtagtcgtcgcctgctgcaagcaagttggcggagccggcagatcctattcctctgctgtgaccgcttcaccggtgttgacatatgaacgtgtgggtcatagctgatgagaagatg

SEQ ID NO: 4116 - DNA, 1813 bp, Glycine max
  Soy_ogl_279 Gm01:52110701..52112513 Cluster 18
tctctaatccatctatacaattcaatatctaactcaggcaaaaaagaatagagtttgtcgaacattatgccgcctaagtcttattcagggatcaagaggtacaattttgattctcaaatcctttacacaaaaaacaagcagaatgcgactttgtcttccgttgcatccctatgctattggtagctatatatagttgctacattcctacatggaaaggctatttttgttgtcgctacatgtacaagtattttttttcttttcttggtatgtaagcttttaattaacatgttgaatatattagtgagaaaaaatacatagcatatatctcttaatttagttttaaaaactcaatagcagacaactaaaaagatagaagatatattcttttgggagtattaataacagaaaacttgtgtttgtactataattttcttttagaataaggaaagtgtgattaaaaaaaggagaagtgtgatataaaataattgatgtgatggctgatgaaaaaagatagaaagaaaaatagtcttataaatgtacaaattaatatcattatattaaaacaattttataaaaataaaagtagtaaaaatgttactccaattgttacattaaaaatgaaaggagaatctattgattctcttccaattggttagatggtagatgtgatgatttatttcacggacgaaatttctagttcaagtctaggatgactcaattacgtcaagaaaaagaatagaaacctgatttttataccaattaatttaagaagattgtgtatatttatatttatcattgtttacctacttatattttagaaaggaaaaaaatatttaggacttatttgtttctttttacaaaaacagtttttcagttttctaaaattaaaagactaaacatctcgtttgaatggtatcatcttatgttttgaagcagggtggtgggaggctcttgcctttgtttgccgagtatgggccttaatttttacatgaagttgatcggaacatcttataagattaatcggacaaggttaaggagatggcatctagcaggttgcgagagtcttccctgagttgctgaccatcgtgtggagaagaagtactgtggaccatgctaattcctaaacagtattgtgttttcttcacacgaggggataagaaaaattagattagaaaactttcttgagtagtttttgttttaaaatttttaaaatagttgttttaaattaatttacaaattttgataacttatgagtgtaaaattagctagtaagttgattaaaactgttttaaaaaacaatttttaatataaaaaatagaaagagaatgaccctaatactttttgggtattttaagaaaattaaagttataatttatcaatatacttctctagaaaaccaagttggttatgtcagtaattatgaaaactaatacacacttatccactttttaaaagaagcatattaacaagttatattttaaatgtatattttaagaaaactaaatttaacttgataacatgttttttcctattaaaaaaacgttggtgcatcctaacaaattttatatgtatttttataacctgtttctagctagaaacaactttttagttttttttataagattaataattatctatttttatattataaatcaaaatttatgatgtgtggagtgactagtgagatttctactttttccactttgcaaatagaaatttttaatattttatttcttctctcttttaaatatgaatgtcttttagatatcactcttacaattagtaaaaaaaaatatcttttacctatctcaag

SEQ ID NO: 4117 - DNA, 2700 bp, Glycine max
  Soy_ogl_390 Gm02:5147201..5149900 Cluster 18
tgaaaaattagactaaaacaccgctatcaatatcacatccacactagttttctggtcgacacggtaagtaacaaacacaagttggccttttaggccgtttatatctaccaaattgtttagtttctgggttgtattccactaagattcggatttcctttggatggtgctacaaaatcttgatctaccggtggagctgagtattgtaattatgatatttaaaaagatgtgtggttgtgattgaatgcgtaattagcttcacttaaatctgtaagaaaaaagataaataaacacctacaatgttattagatacataatgagagagaaaaagagaaaaaataatataaatattatgaaatttatgatgtaatagaaaaattggatttaaaataaatgagtattcaagtatcattcttcaatgattgataaaaaaataatattattactcaatttgtaaaaaattaataataaagtcttctattttatatcatatgagatttcatctttaccaccagcatgatactacatctttagagtttattatgtgaatatgattacacttagttcaaaactttaaaacattaactttttttgtcctttctaattatatgttattcaatttgcatattcttatttattatttatgtgggattacatgtttatacttgaactcgaaagtaaattgtataactgtcaaatgcttgagtaggatgatataggtcgtgtaccaagtaatgtgtttttgtaacagcggttaaaggtgacttcataggaagaagatttggcgaaatggttgttgatttggtggttgatttcatggatggaggaagaaggggttttgatttggtgtaacgaagaatggtttcttgtgttggtagatggtgatgtctattgtggattgctctgctccttgcacagttgattaggttttctttttatttattttttcattaacggtgaaattatgcagtaaaggtttgttcgtttgtttttgaagggagattgaaggttgactaaggaggagaaggaagggttgtgaacaatgaagggagattgaatgtcgattagtgtgattttagacatatttgattgtgattttttttatgtatgaaaaagttgagtgactcaaaataaaaattctaaaaaatttaaagactaaaaagatagtatactccctttttaagaggttgtaggataatgttgtaattacagaaactaaagtaaaatgtgttctaagaaatgaatctttttaactaaggtatcatctcaacgtggaagatatcacgaaaaggcaaatgtctctaaaaccaaacccgacaactttgtgacaatgtgctcttctcatacatgctgccttggaacagaattccccggtgtatgagggaatggctgctctccaacaagagcatagaagatctgacaaaaagtacaattaaaatgttaaactacgttaactatttctccttcataaacagaaaaatcaagttatgtactgaccactactgtgtccccacacaggcaaaagaaagaaaaagaaaaactaaaaaaaacctgacgttgcagatcggttgcagcaaacatatctctggcaccctgcattgacttaaccaacttctgtgggatttcttcaccagttgaacagtgtctcgcaaattttttcaaaactcgataatcccatgcatagtatcggtcataaaaagtattacctagtcaatcgcactcctccagattaatatcacagcatcagcaatgagcggcaaccaaatttattcagaagcaattcttccgtttttaaatcagcagatgattatattttagtatagcttatattaaatgccatatgccaactaggctgttttaggcaacaaatgagaactaaaacaaaaacaacttggtcctaaaattagatcaccaccaatttcatcattgaaaaaaaacacactttgataagtcactataatgttcaacacacattagagggggcggggggaattcccaacacattgacatagttatccactaacctttgtgtcaatattacaagaattctatgatatactttgtctagatcattcttatgttattgctagtattattattattattatataattctgaaggcaaattacgtaggccttaattataaattaagtgtgttcttcgtttagtaaatccctatccctgccatccaaaatatttggggctaaacggattaaaaagtgtaagtttagggactaaaacgaattaaaaagtgtatgcatgtaaggattaaaatgattagtttctaggtataaagactaaaacgtaaagattgtgcagatataagggtgtcaagagtaattaaacttatatttattctaccatctgatttaagggttaggacttgaagaccatagttcttgcagcattctacttactcaaagaggttggacggtatttctgcaaaatcaagaaccgttctggtgcccgaaaaatgctggtagtcctacaatgagaacatggtagtatcagattacaaaaatgtgagcagtaaccttttttaaaggtttctattatcaacaaatgcttgcaaaggtattttggttcattaaagaatatggtaagacagttcatataattacaatttcaaaactcaattaaaaaaatgtcattaaagtttaaatcaattagctcaaatcatgttcatactatcccttctttata

SEQ ID NO: 4118 - DNA, 1240 bp, Glycine max
  Soy_ogl_3573 Gm10:46263201..46264440 Cluster 18
gagccccaaaactgggtgcaagactgaaaacaactatgcttttggtatcgttgaaaagcatttttgatgatttatggaaatttgtattgtaggagacgacttgctataagaccttgaggattgaggggttggcagacttggagtaggagtttgggacaatttgaacaagtcatttgaattttgagtttatcaataaataaatagcattaattagttatttggcaccgattttattgcgtttaatgagccaaaagaaaagattgattcttcctcgatcacaatttgtactttgaacttcagcagcatatgttcggttgataaaaagatcacagagactttagtaagaagaaagtacattattaggttagatgtgacactgcaacctatgataggcggcgcaacgtctacttaccaacacacagagcatgtgtggaagatgttttttttaagaaattattttttatttgtgatagtatatgtggttgcggttaatttaagagaattttttaaatatgctaatttaatgttgtgggatagaatttattgttttgtatcatccaaataatagagtattagtatctaatatattcattctaatactgtttttattattaattcaaaattattaaatattataaaattatgagagagattattattaattaataaaggaaatctgaaatatttgttttttagtttaatctgaaatatacgtgaattcatgtaaaaaaaacatttgaaattaaagtaaattcatttaaggtttaaatatgtttttaatttgtataaaataaataaaatttgattttgatttctataaaaaaaaatctttatttgttatctctaaatttaaaagcacgcaccaggcttgcagattgttctgatccaaatcaattaaaacataaaagactttgcggttccaaaacaccaatataaggattcaaacgaaatatgtagaccaaaaaggttattctcattgtaattgttatagattatggataaaatatattataagtattttattaaaataacaaacatcaggaaatataataataaagtatcatagaatcttattctcaaaaaaatatattataaaatctaaaaataacaaatcatataataaatgttaaaaataaaaattatcgttttatactaacttaaatttaactcaagtaatataattaagttcttttagaaaataaggaaagtatggttttcttaattttatatatatttaacg

SEQ ID NO: 4119 - DNA, 2400 bp, Glycine max
  Soy_ogl_3724 Gm11:4279201..4281600 Cluster 18
ttaatatcattcaataaaaaaaaattaattatcattcacaaattaattgtctttcttaattccacaaaacatttaaggtagaaggaaatttaagattatctaaataggagttatcgtacacaaaaggaagatgattcacttttataagattaacgggcaaataattatcattaatatatatgttcatctagatcaatagattttatttgaagtatgtccgaccatctttgtgcatgtggcagttaaaattatcttcataagaacagaaagctaatggtttgagttgtggaattacgtaccttcctatatataaataacgggagctttatagtactagaccttttctttctcttgttattattttatgagatgattaacaaagaaaagaaaaggacctacagtcatatatagcatacaatactataactttccatgctctctaacgttggtagttgatgcacatacactttcaatagccagctagcacatgccagtgcagtgctccatagccacgaagaactttacaataatttttacaaggagatagctagtggtccaagatctgaaacattggaaagatatgatggagaaaagtcagaacagtcttagtcttatatgacttgataagtgaaacaaactggcacgacgatggaacatctaaaaaggtggatagctgaacccttcaggaccattattagctagcattctgcccaagctaaagggctaattaacaccttcaaagagcttaattaagtgctcccttatttagtaaaatcgatcaatttttaagtagttgaatataattatagtatttaaatcaaaatgtgcatagtgtgtgtaagtgtgtttgcatggggggggttggtttcacggagactcgagtaatttcaataggagtttctctccctattgagcaacccataagagttactcttcccattagagagcaacctagtggatcccacatatatattggaatgctttaaaaaagtaaccgatcgcgattatcctctaaaattctggggcgttcgattgtaatatatataatattatattacctttaattcatcgttgaaattctttttggatgaccgttgcctctcacattgacaatttgcaaaacaaatactaccaaggcatgcattaaacgattgcaccacgctgcaacatgagttaaatgaatgcaacagaatgaacgtgcatctcctgtgtaaaaactccattttaataatatattattttgtgtttttttatgtattttttacatattataaattttaattttttttatttaattaaaatgtagtatgtgtttatttgttatttaacaattgacattcaattatattaaatttaaattaatatgaataataaaatataaaaaaaatagataagttgtggtatctatttgagaactttcagtgaatttttttattaaactctataaaaaataattacgtcaatatgttgagcaataaattgtgataagtgaatatagtaaatatcttcataacttcaatcattaagataaatatattttcttatattatctttgtataaattgatttcaattaatgttcgtacaaaaaaaatgcatgtttcttgagttctctcttgtaaccaaaaaattaaaacagcaaaatcgtacttaaatttctaacaaaacaagtacatgtttttttttcctaatttgcacaaagtcgttgatagtagaagataaaattgtattttatataaatataaaatattattgaatgaaataatacaagtcacgttaatgacggctcaaattgcactacaccaatactagtatcttgcatgaaatgacccagaaacactggaagaatgggtgcgtggatttttgtgcacacgcagccaaaaagctcattgattacaggttgcaagtgcgtactaatgaaggcagccagatactaacaacacaacacaacacccacccgcaatccaatacctgcacggctgcaccaaccattgacattgttgctgactcggtcatggatttggtcccagcatcacattttaatggataaacttttttcaatggagtttttttattgtataaattaaaatgaagttatacatttttatatcaaaacctttcatttaatttctctaaaaacaaaaatgcataaattaattttaattttagaccatggaagaaacttatatttgtatgtgtgtgcataaattaatttataattctcgtttctttccaaaaaagaatttttatccgatatgtttcacacacatatacacataaaagttatttcttaacaaaatagtttctcttaatcttaattttcatttaatagaatgtaattatccatatttataattcttacttttgacatctaaaaaaaatattattatatataagaaaag

SEQ ID NO: 4120 - DNA, 1808 bp, Glycine max
  Soy_ogl_3909 Gm11:35798193..35800000 Cluster 18
catattcatgttaaacaaggaaacttgatcgagtaataactaaagaaattaaatacactcaagtcagtttggttaatttaaactataggacaggaattatttgtgtatatttttcttgagagagaaaagggagagaatgaaagaagagacaggaacaagatagctagagatgagagtgagaagggaaggaagtcatctcactattagagggtgataatctacacaaggatttgtcataaaggaatgaaatttgataaataccaagaggatgttctaatccaagaaccaaaatggctatgcctaattgtttttttctagagtttataatcatctcacactcacaataaagataaaacttcaattttattcaactcgtgaaatgagagatattgcatgcattactttttctagactttattccaagattgttaatcctaatttcctctcctactcgccaattaaggaggctacttcatgaagcaaggaggctagctaaacctaattgccgctatgtagtgctgctttcaaatcccatggagagtaagattttcattttttttctatttcttaattagactaacattattattaattatgctgctgttttctttcgcttacattgtaaattagactaacattcataaataggctaaaccttgcttatatcatttaagagtaaaccgttcaaattattaagaaataaattttaataaataattttacaattttaaaagtcaaaagaataaaacaaagatggataagatattgaactagatcttacataaaatttatctaaggtgctaaatttcttacccatgccttttaagaatgaaatatactttcacattataaattgaaataaatatttgggagggtaagattttttttctttctattttctttaaattagaatactaaaattcttttttggagggagcgggcaaaaggctaacaaaaacaaagaaactaaaatcgaaccaaacgtcggacagcaaatcccaaaccaataaattacaggagatacaaaagagaattgtttttttaaaaaaaatcaattcgtagccaatataatttcaaataatggaattcaaaactaacgtaatgacgtgacatattctaaaattatacaagaaagagtcgactgtctaaacttttttacaaaaatataaaaaaatgttttttaagaaacagatagaatttattttttttccaacaataaaaaactgattttttaagcaaaaataatttacacaaacatattaaaaaatgaaaatttacttattattttttaaaatattttttaacaaataagttaaaataaacagttcaaagcatatgaagaattttcaaatttcacttctaattaaacactttcatattaatgcaaagtccgttttttttagatccatacaaaccacaaactaagaaagtacgtgaattattgtccgagttttgcaactgatcatagagaatgacgtgcatcacacttccaccaaaggtggattctgacattcgtaggaaaaagtaagaagcaaaaatgaatcacccattattattaattatactaattgttttcccaacgctgatgaaaatgaccaaattaaaattaaatgctaattaatgagtgtcaattccaaggagagtagtcgcccaaaatgttggttcatttcatgttgtttgaactttgaatcagttaacgggtaagctacttctcttcaattttgtaagactctctcattattaatttgggtcaattgaaaataacaatatactagtagtattcaattgatataaatgctgtgtcaaat

SEQ ID NO: 4121 - DNA, 1497 bp, Glycine max
  Soy_ogl_4565 Gm13:39231504..39233000 Cluster 18
catttaagaactaaattagaggatataaaaatttaaagaccaaaaataagatttgataaaaatatagagaataaaaaatattgtaaatatttttttttaaaaaaaaaaaactttcagacattgctagattctagtggacgatacgaaaccttctcagttcaccaattcaggataatcgtgtttacacagcgcaattaagcttgttccactaaactttagttgatttaacaagtgtttgatagttatccatttagatatttaattatttttaaatgtttaaatactccctctaatcttaaatataattttttcaatttttttatctttttatactgtaacactttttcaaagtattaattatttgttaagacaaatattcttaattacattaataaattgtatatacttaaaaaaagaaatatattatctctcttataaagattaaatgagaagactaacttatattaattaattaaacgtgaaagtaatcaagtaaaaaaggaaaattatgagtcacaataattttaaggttaattttgataaaataatataaattgttaataaatttaatgttattaattatctttaagggtgttaactaaataaaaaagtattttatttagacaaaaagtaaaatgtattataacgaaaaaaatatttataaattatgagttaaacataaatatttcatagtttactctcaaaccttcaaagaatgtgttacacttatcataaattttggatgaactttaaacttatttaccatgtaagaaatgtttaataatgtattttaagggaattgattcctaaagctttaatgtgtacttcacacatcaattttaatggctgtaacatgtaaagctgtttaaagttattttttatgggagctgtttaaagttgatgaagaactaagtgtataatttatttaacttatgttcatcttcaaaatacttttaatcaagatcttttttcaggaagctttaaagaataacaatttctttaaaagtaattattgtaaaaaaatgcactaatgacagtcactcccatccaataggtttctaatctagggtatccttcatctttttcttttgcttattcgattagaagacatttatgtgtaatgtccctgctttttaaagtaaagttaatttgtacatttgctaaggacacaagaggtgggctacatgctcacaaataaatcgactttaaacaatcccgacatggatccattttcagtatttggggaaaagaaaagcggaaaatgacgggggcacgttccaattcaataattgaaacagaggggataagtagataacaaatgcatggcgtagtataagatttgtcaaagatctattactctctttttttcaccagccataataaatatctcacacatatataagaaaaacaactaagtaaattaaacatccttctttcatcgatgattaaattaggcaaccattctctttatttaaaaaaatatttgtttgtctcatc

SEQ ID NO: 4122 - DNA, 1875 bp, Glycine max
  Soy_ogl_5270 Gm16:3382626..3384500 Cluster 18
atcatctgttaagaaatgagtcccttaaaaagatcttcatttctcaacagattagcttatttttcgtctaaataggatatcatatgtaaaaaaaaaaatccaaagattataaagagaattgttaacagcagtagacaaagagagagagaactgtagacaaaataatatgtgtacaagaaccagtggctctcacttctcaaactttatgatcacaaagttacttaggatattcttatcctaattaattgataagtatcatcatcactacttgaatcttttgcctattttccacatccaatcgtatactccaattaaatacacataattaagaaaaaaaatgatcgagagtaaaagacaaaaatgatatattatttgatgtagtaggtagaattgaggataagaaaaggagggaaaaagaagggtaaatcccattgtcacccgcaccctatatgcatatgcactcagctaaagtttttcccatcatggagaacctctaataagtttaatcaaggaaacttcccaagaacaagaagatcgaagagaacaacatactggtaatatgttagcttgttctcaagcttccccgtctaggagtgccttttaataagtcaaggaaatttcctaagattgtacaacaatgtcaacattggattttatttatatacctcatactcttgttttgaatcatcatcatcatcatcaaacgttttatgtggcgttagttgctttttccggttacatacacaagcgacctaagtgtaaggagagaacgttgtcttctacgtaaaccacaaaatttgggcatacattggaattggatgatattttaatatttattgttttctacactcttttcatcacatagccacacaatttttatcatcttagctagcttgtctacctgtaaataattcaactaaggttgcacgtgggaggaagtggatcattgtacttttatatatacacgtttttatttttcgtgcaatagttataacttctactcattactagaatctcttttcttacagtttcgttatttcaacataaaaaattaacaccatatctaataattaatatcttgtataattttttttcatatacacgcatattagaaatacatcatgaaattaaagaaaaatatttttttattgcctattttaatgttcattaatcattttatttatttattttagatacaatcagaaaataagcaatgatgcacttgttcttgatttagtctttgactgtcaggatttctccatttatagcactttaaagaataaattaaagcatccctctattttaatccttctaattcacaagctaatatattaacggcataaccaagtacatccttaaataagacactagtgttcacccaaaaaaaacctactagagttggtcacttggtccagtagtgtggattagcttacataagatcttaaatttgaattttaatgtagtattaaattaaagtacacttttttttagaatgatttgccttaaaataaaaacattttgttgagaatgaagtattcttttattttttttaaatgtcattcctactttctcttttattaatttcttttttaaattatacttaaattaattaattatatgcaacttcttataactttgaatataattggcttctttattattatttttcttttaaactacacctttttaatgtattttgagtatacaaaatccatgcaagacatcctaaacacgatccaggtactctatccctgcaatatatactttcaaagagaataatttcatttcctgttcatatgcttgttaggaaaagccatagtgtttctcataacatatttgtttcattacagttttagttaactcttatctctcatt

SEQ ID NO: 4123 - DNA, 1500 bp, Glycine max
  Soy_ogl_6269 Gm18:59192901..59194400 Cluster 18
gattccgtaacaatctatttttatttaaagattttgcgtgttagggttaagtcatgcgtgtgcgaaatggtagggaacgtctgtttccaacttttttccctaggtggaaggttcgtagtgtctgtgttacacatcaaatttcgtcggcgcctgcaatacatcgcatgcaattcataaattgattgacgtgtatttattatcattcttatcactacttgcattcaaaataaatatacagtccacggatacctcatttgataattataagttagcaattcaataattgaggaaattttcaggtcagatcaaagtcaaggattatcttaaacaaatcatggcaaatttcattcttaaaaatgtgcataataataaaagtttgatttttaaacattataatgtaaacaaattcgtatcaaacgtaacgtagttggtccaaaataaatttaaacaaaaataaaaataaaaattccactacaaataatcaatatgagattttacagaaaaattatagtatatcaataaaactaatatatatttttgcatcaatacaatgaccccaaaaaatataattttttatactaataactaactaaaaatataattaaaaagtgtctttttaaaataattattataaaaatcaataattttattatatattaatttataattaaaaaataatacacaatatctttgcattatcagtatattttaattaagtttattaatagtaaatgggtcccaattctttatattattatttccttcgtgtgatccaaaatctttgctaccgtaataagccggtaatgacactgttgaaagattcctacacagtactcatttgtttccctcttcctctcggaaaagcaaagcaaaacagagcacttccacgtcttttttttttatataaaaaaaaactattaaagtttacaaaataatatatgattctcactttttattaagtgtctctcatctttaatttcatgatttcaatcattaataaagaatataatattactaatcacatcttccttaagcaagagaaatgagagaagaggagtgtttgaacatgttgtaaagaagaaagactaccataacccaagtttgtaagatgataaacctttcctcaaaacaagaaaatgataaacttatatatcagcctgttacggtaagctcattggagatttggattacagctaaatttcagatcggaaggggttagtgaaatgaaatggatggatcatgatcttttcctactttaattagttggaaaaaaataaaactaaattaaccacatgatcataatagaatgaaacatttgtcctattaatgattatgaaagaaccgaggctaaaagtaagttttaacttaatagttgaagagggctgaggtttgtaaatcatttaagggactaagttcttgttttgaacttgcagattgacttgttagaaaaaaaatttcttctagtgtatattttgttttattaaaatatggattggattt

SEQ ID NO: 4124 - DNA, 1587 bp, Glycine max
  Soy_ogl_6562 Gm19:44438201..44439787 Cluster 18
gcacaagatcatgcgttattgaataaaaaagaaccaaacagtgtcaaaccaaacaatgtagccaataggcaaacaatttaaaaggaaaattcaaaaattgcgatttgaagaaaccccattgctgtaacaaatgaagaaatatccttaaaacattaaactcacttttgggacagatggcgtttgattgacgaacacaccaattacgtcaaataaactatgaaaaattccaaaaaaaaaaaaaatacaattttaaaatcaagagaaataaaaagatgtgacagtgataaaagtctcaaagatcacaaaaagagatattcagacgagtgacactgttaaatttagtattgcaaagtttaaaaagaaattgactggactcttcattcatcatcgtggtccagtcaagaagctgatctttccttttgttatgctatttttcctaataaaagtaacataagattttttttttgatgatactgtagctataagctagttggcccagaaattaatatctttggtgaagcccaaaactgtgttgccgtttcattttcttttcctgttgttctttttaataccaatagagcgtcgtatttctttatagtttgaaacttgagtgttatcaaaatgtcaatcatcatcataggatgactactctagatggtttggaagatatcaatgaccttaccatttgtataataggattggtcataacaattatgaattttgactcttttgaacttgatcaaggataactatttcattactctcttttaaactgcgcaatactagagccaaaaaagagacacggggagacagatgaacaacatggagtcatcttcagtaatagaagaataaaaatatgaagaaaatagtagagaatgatactgaaaaatatgaacatctaaatatcaaggtttcatcacaagcactggcatcaatctgaaacgtgggctaatttcaccgagcattaatcccaaatccgttatatgcatattcaaacattggtaccactattagatcatcaaattaaacgcagtcaacaatttagtttgtatttggtgagtcatttacaaaattgattcgaaatgaatttgattttgtaaagataaagataagatacgaaagtaaccatataatattaagattatagtttcttctctctttccatagcacttagtaaaccatatattaattcatcaaacaatcaaatatcactgtcacagaaatcaaaatcaaataaaactctaaaccgtttacaatacccagtttagccaccgtataaaaaaaaagtccgcataaaaaaaatacccagtttaaccaaaatacatttttagtttactttggaggctgtacgaaatatagcaccattttcaacctttagcaaaacttttattcaattactggacaaaaaaatactattatttaaaaaaatattaatttgaaaatgaaccacaaatcggttaatttttttatttttcaatttttataattttttgtatgtgttgaattataatattaaaagtttgatatttatatttatagaagtgtttcttgtcatttctttcgtatatttcccttttaaaatattcc

SEQ ID NO: 4125 - DNA, 1500 bp, Glycine max
  Soy_ogl_6976 Gm20:44115501..44117000 Cluster 18
taactatccgagcatctttattataataaacatgttatatattttaatgttgttacatttaattttcgtttatttttttccaattattccttgcaaatttagtaatttaatatactgactaaactgcatgtttggaatgtttttaatttttgtgattttttggaggtaattaatttttttatccttgaatgttgttattgatacatttgaatgatttaaattctaaatttgagaattccattatgtatataagtgcctataccaaaatgataaaatttaattctaattgtattatctatttttaattctacaaaattaaaaataatggatataattatatcaagaaaataaaatttgcaactaacccgtgcgtccgcacatactagtttaaatctatattgtttgtcatatattaagattaatctagctctagtttcactaatttgaatctagcagtaaattaaggatacaaaaagaaagacactaagctgctcaattgcttgaattgaagttaaaataaattaatcaacaagaaaaactataacactaatatataacactttcctaacatttttttttgttggaaaggcactttcctaacattaaaaaagaacaaattaaacatctaacataataataacttattagaaggaagttgtttaaccttgagcaccgtgaaccgaaaaagagaatagttacttgttaggatgaaacaaactagcaacacaactttgaagtttctgtgagcacaacatgggaaaagtggctatggtgaaccttaatgtctcactttcttggacaacatcattaacatataaatcaccaaaacctgtgcttatgtcgtgaaggagcttggtggagtggacccatgtttgtgccagctttggctcccacctctgtgaaagtgtgagattctcttccctttctctttttgcttgttattttaattagcatatttgtcatacaataaactaatttataattgaaagtttatgaaaagtattgaaacataaaaaaaaaatcttatatatccatacaactcaagctcaaacgtgaatcataaaaatgattttgagctatttttaatacatcctaacataaaattaaatttgatcaaaagtgaattgcatatattaatccaaatatgtacataataaatttataagtaaaatattgatatcacatttctgatttcaatgtgaaaaacgttagccaaaagtggaattactaacagtaactattacttattttattttatattttactttgacgtggattttaagtgaaatttgagtaatagatgggaattcaaacacatacttttcacaattacttctcgtagtttctcagttaacgtgagaatgagatgcaagtattctaggaaaattaaacacatgcttcatgagtgtttaaaaattcattaaaaagtaagaaattatatttaagattatgaaactataactatagattaacttaataaatgtgaaaaatcacatctaa

SEQ ID NO: 4126 - DNA, 1293 bp, Glycine max
  Soy_ogl_1035 Gm03:42089215..42090507 Cluster 18
taatgaataaatgatcgaaggtaaaattcataagttttttataaattaaaaataaaatgtagtaaattaatttgttagaaaataaaatttataaaaaaattaaaataaaaaatacaactaagcctttaaaatacctccatcatcacactaataaaaaaaaatacctactccatcatcacaagcctctaacgtcttgagaatcttctttggggaacaaagagaatatgctatctataccaaacaatttcatattttattttgggggcagggtcaggggatgccattttctggaaccattatacccgttgccttgagatgtggtttaattgaatttaataattaataataaaaaatgttttccaatgcctacaggtgaaggattgaacttttatcacatagttaaggtataagattatttataaatcatgttatattttattggtaccaaaacatttaaatatagtttcacctcagaaaatgttaaaacatttgggttgatgaataaaacttaaacataatattgcaaatagtattgatattattttctaattgaaattactattttatttcaataatttttatacttatctcgatgactaaaattcactgtatttattaaggtaaactatagattgtaattaagaaaaacaccagtaatatctgacatactaattatagctaaattttgtcaaaatctaatttacgcttaaaaatattgctacatattagatttttttagggtaaatttatttgggtggaaattaaattttattataacaaataattaatgaataaaaaatagtattaggtgcattaataattaattagtttattattctcatgttcaatgtttaaaatagcttaggaataatttattaaaaagtttacaattttttttcttaaatttcaagttaaaccaaacgtgcaccaaaaaatatagtaaccgaaaaatatagtatttttttttctgaaaaatatatctatagtataattgctattcgaaaaacccaactcaagggtggtctatatcaacataaaagatccaaaaacgtcgggttggaaatggaatctcctcgaaaacctcggacctggctctttagatccctttcagactatgcgagataaaatgaatcatgcgatggattaaaaaaataaaaaaataatgaaacaaatttattaacacaaaatttacaccatgttaataacttggagataaaatagagtgtccttaatcatgctgttctaatttactaaaaaccttggccataagattggtttgttaatgttttctag

SEQ ID NO: 4127 - DNA, 1400 bp, Glycine max
  Soy_ogl_1242 Gm04:5642801..5644200 Cluster 18
caaagttttatatgggctagataattcaaattcaaactttaatttcatattttaaaacaagttagagttaaaatataaatttaatgtttttaaaataaatgagccaacattattgagtaatctctctttttagcctttttttttatcaaaatagctaaaattgcaacaatagggttgatgacatcccaaactaggttgacacctcaataatccccacacaagaacaacataacaagaaaataatataaataaaaagagaaaaaaaaaaacaaggacatcataaaggaatatagaccaatactcatgagatcaacaaactcctaacaaggctatctacacctattatagtaggaaagctgttgcctatcacttcttagcgttaaaaccaaattttaaacgtttgatttaactctgttcatttacatacttattatacatatgcaaggaaaaagtcaatgagcttaattggatattttacttcctgttttcaaattttcaccatttttatataattttttaaattttgtcacgacattaattttacagttaaatatttaactttgaataattttaagtgagtgacctcctgaaatattttctagaaaacatataaatgaaattaaaatacgctgaaaatttgtgttaaattatggaaacaatcgctatcttaacaataatcaaatgttataatgacttatctaaattctacttttctatctgcatctattttatttttaattgatgtcaaaacactttttagaacaattaaactgcaaatcgctataaaaagttttcatttaattttgaaaatgtcaccacttttttttataatttgattgctaagtatccattcaagaaactagacttcatgttttgcactactattttctacatttgttgttactataactaatacaaaaagtcactttctacgtctattgatacaaatgactgacgtacgttctatttctaactaaacccatgctttactcgtgtgatgcagtctttgttattttcaaaaatattaaaaaagtgttcatggatgctaaaatagttttaaaaaaaagggctttgcgtatagacccctagttatttcccacgtagctcatatatcgatctcaattatataacttttgggagaggttgtgtgtttgacctacatgtaaaccaaagctaaaaccatttatttcaaaggaaggaaaaggaaacctttaaacatgcttgcatgggttgaaaagaaaggaaaagggaaactaaagcttttgaaagtgtatctcattttttcgtgcattgaattggataaaaagtcctcttgtttttgctaaccttgactgccacagtatagggttttcaactagcactgatttagttttgatggtatttgggacccaactgacatt

SEQ ID NO: 4128 - DNA, 1800 bp, Glycine max
  Soy_ogl_2164 Gm07:3571601..3573400 Cluster 18
acaatatttaataactatacaagtcaagttcaccaactattgacgtcataaatgtgatgaagctgtaaataagatcattggataattagaagtgcatactactttttctctggccctaccaaattgttagcaaagacttatccatttaaaaggcattttttaaataaagaatcacaaaagagaaaaggcatcaaatagtccccagaaaaaattgcggataataataataataagaagaaagcgatagttactattttcagctataatgtttggtttctaacacctataaacagctagcacttgccacttaattggttgtactctttcaacatgttcctctaagcatttcgtcatgtttccttattgattcttcgttcgttgatatacaaacaaaatatgacgtacttacaaacatgataaggatagaaattccaatttaatttgttcttgataatttaaaaccaagcaatgtatatcaagtatatgcatatgtgacaataatgttgtacaattttgatgccctacacatatcacctcacacacaactagtaaactcaaatctatacccaaatcttatcaaatattattcgactctattgatgccgtgggcctaaactctgataccagccagcttatcacaattttggtctttaaaacattccacgaatcaaacaaagtggcgtgtgtggacatgatttttattttcttattttaatttttcagtgcatgggaattaggacaatggaaatgtttattatccgttcaaacttctaagtactatctcggtacaacacaaattaactttattcttaagcatccgttcgtttgaagaaaaaaaaaacacaataaaataatgtgaaacttacattttatattttactttaatttaaaaattttattttaattcactgtctttcttcttttttttcactttaccgaataatgctaagttttctctccgttaatcaacactagtgtcagttccccatgacgtgattttctttttcgcactaacatgtagggttgatatagaaatgcaataaatttcttgcttgtcgaaaaattaaaaaaatcatttacattttttaattatatctaactttaaaaatttcatactgctttatatgtataaataaatatgtatatgtgaatcagtgggcgaggagaggcccacagtaattgatcaaattaatgatctaatagatgaaaagacttaaaataaaataaaattgaaactctgcttaattactcttctggccttttctgtcaatgagtaagtaagacaggcttgttaggctgcatttacagctgtgaataaagttctgctgcttcgagacagaagatgaacaagaatgaatatgtccagaattatgcatacatccctacagtaaaataaactaaaaattaaattcaactccagctagaatttcggagaaaacgttgagagagaagatgcgttgattaatttaaattataattatgaccaaagtaaattttgatttgctaaacttgtgttgaacatctcaagttaacaagtaacatatatatgactaaaatagttatatagatcgaagaggcttattctataagttagtttttttatattgattttaagtttaaatttaaactttaagatgatattatggttatcttaaaaataaggaatgctaacaatatattttctaatactagaatattcatttaaacacactttttaattttagttaaaatttatcaattacaaaattacaagaaatgttcatcaaataagatatgagatatataaattttgtgattctt

SEQ ID NO: 4129 - DNA, 1800 bp, Glycine max
  Soy_ogl_2902 Gm09:368401..370200 Cluster 18
ttaaattgattatcttaaaagttaaaaaaaacttgtttcacgcatagtttatttgctttttaacttttgataaaaaaaaatatttttatttttttaatctgtattaacaggtttttattgaacctagtcttccaaccagctagtttattatgaaaatattaaggatgattttttgaagatgaaatgattcatgtagactacaatacatgcatggcatacatagcgtggacggatctttgtgagcacaccccacacaattaagtggaagtgataactaagggtagcggatagagagtggcgcgagtaggtgttgaagcatggattgcgtggggcaactgcaaagtttaaacccccaacaccacatttttggtggtatacatgagcatgtggagaatctatatgttctgtgtgtaggcacatatattctcttcttatatcgcatatcacataagtagttagtagtcatgttttccaagttgtttttgcttgcttttcttgctgcaattgccagctcccaggccagaaagcttgctggttttggtgaagagaagccaatgattcaccatttgcatgcctatgtggcggcggcggctatgagggtggagtaggaggtgggtatggtcatggatccggaggagctggtggtggaaatggaggatttggaggtggtgttggcagcggaaatggaggatttggtggtgctgctggcgccggaaacggagtatttggtggtggtgggatgggcgacggcggatatggaggaggcatttgtggagaattcatggatcagttacgaccctgactttaaaactagtttaccatttcacttttgttttgtttttatttgtagtgctgttgttagtatcaattgagaaataaaaacctgctatacgcctatgttgttacgtaccatgttcaatgaataatagaaagtaatgattttaggattaactatcttccacacaacacatattttagtcttatgttgtactaacattaccattttaattgtaaaacaaaattaagtgcaaataaaacaagcataaaaaattaatttgtagttaaaaaaataatattttaatggtaaaataaaattaagtgtaaataaaaaaataaaaaaaattagatttttaaaggcttaattattttttcctactatttatttattttattccgtttaatttcacttattaatatataatttaatttgattccaatttttttaaaattgagttgaagttatcctttgttacttcaattaagttacataatttcctaaatgtttaattttacttcaattggactgaaagagtaatatatattaactaatttttaaaaattatggagcctaattgaatcctaaatcaatagaatgtattgaataaattaataaacagttgtaccaaaaaagtaatcaagtcttttttaaaagttacagcattaaaatacaatataagtgaaatacttaaatatgacgtgacataataaaacttctttgaaactaaaaataaattatttaaatgagctctaagtgaccacgagctcaagccaaaatacataaggtctaggctagaagggtgacaatgtagaccctaatgcccaaaaaaaaaaatagacattttgaaaagaaaaaaaattaattttttgatacataattagttaattaattaattagattatttattttcttgacatattataataaaaataattttatcttaagtttctaaaactcaattaatgcttttaaattatcaaatttgtagtattttcaatttttcatttcgctaatagtttagg

SEQ ID NO: 4130 - DNA, 1617 bp, Glycine max
  Soy_ogl_3012 Gm09:5372992..5374608 Cluster 18
acatttataagtgataaaattctctctccaaacatttgatgcaagcatactcaagactctacctccaaatctcagattaaactaaaacaaattcacaccaattaatctacctattcggtaataataattaattaaatatctagtacaaatagattgatagagtgatagtgatggatctaaatattaatcttatcacaaaaaaacagtgcaaataaatacacttcctagtgattaggtgcacatgcatgtaccacattggcttatctttatccaattcacctttttcttgtgcaagttagagttggatgtttcccagatatgcaatgtgaagcaaattaaagacaattttacaggaaaagcaaagattagaaattttaaatctcgtcgaaataaagattgttttatactatcaagtaacataaacatattatatatacgaaataattgcttaatacaaaatgattaattcttttataagcaatcaatatgattaaatattaacaaatatacaacgtatatcaaaatgaataaattttttggcttatgaaaaaagtatatcaaaatgaacacttcgataaaaaaaaattgtattcataaatctagaaatcaagttattgtcacaatagacactataatttatagtatatgcgtgaatcaaatgataaagtagtaaaaatagaactatttttaaaaagaataaagtatacttcaaaaccccagtagttgtgagtttgagttaaaagttgagttgaagcgcacaaacacacacatcaatttgatagaactaatcaaagagccaaaatgaaaaaaaaaattaaaagtattactcaaattctaacaaataaaggtggagaaaaatactattatctatttttttttcctttaagtgtgtaagaacactgttttccttttcgtgcatgaaatgcttaagatcgtagggaaaaaaaatgttaccccatgaaaagcttaagaacagtgtacataattttacataagaagcctgtgattgattgtatacgaacgatagcatggggctgaataaattgtcggctgaacaatgtctttttctcgacttgttattgttagttagttgttattagttaaaaaatattaacttgtaccaaaaattctagaaccacaacatgtgcatgctactaattcaaccaaatgtcacgtcatttttcggggtattaaggttgtgctagtttccgaactcctgcatgaatgtttttgtctttttcacttaattgcgttttttatatttgtagttaatttggattacatataattttggtccctcattttttaagtaaataaaatgtctctatttttaaaattgagcaaatcagcagaatgactgagttgaagattatagagaatacatgcctcaaagtattgaattcaaactcatattagaaatttgtccagaaatgttgataataagagcaacgtatatataactccatacaagaagcacatgattctatattaaggatgtcatgggcacgagattgcgtaggtgcaaaacatcattgtctatgcctcgacttgttactagttaacatcatgcagatgatactgatagcttgtggatggattcttgtccaaaaacatgga

SEQ ID NO: 4131 - DNA, 1620 bp, Glycine max
  Soy_ogl_4646 Gm14:4318401..4320020 Cluster 18
gtgcaatggaatgtttgtcactaatagttcaaatgcgcaagttgctcactttgttaacattttccctttgtgcatgttaataatggccatagagtggagggatgaccctaacaagggagaaagattgattattcgtgataattaaaaaaaattaaacatctcacgcatccttgcctttttaacataaaaccttacattaaaaataaatactgattttaactgacactctaaacaaatttacaaagggtgttgttcttcatgcttcacgttaaactaactaatataaatataaaaaaattacttaattagctctcttgaatatttgtgaatattgattgagataagcctagtgtgtttacgccacctaactagtacttaggatttctccacaagcataatttggcttctataattcaaagtaaattaaatttaactgttaatatataaaataaaaaaaaattaagattcaagttctatatttattaaaatgattaattacatgagaaggacactgtgttataaaaatactatgcgacttgttatttgttgagacgagaaactgcatgcagctgccactatcttttttatataattgatatatagtttattgattattagtttatcctgaatttagtaaattaatatgttaactaactattcatcaataaaatatgatcatttttaattgatatataaattctcactaaaaaataaaaatatatgactttcgtaatttttaaaagttatctaataacgattaaagttatcgcatgatttagtttttaaatattaaaattcaatttaaagcctatataaagggaacataaaaatttaagcctatataaaatagtgtttagatttgcgttgtgttatacattaatatatattactatataatgtggaaggaacactataatgtaacttaactagagtctaatgcatagacaaaacgttttactagagaaggaaaagatttggaagtaaggaacagtctatatagtaaattatttcaaatcatgtgcatataaccgtttttcgatggggaaaatgctgaaagctatgttctgtttgataagggaatatatgaaaatagtaagtctgacagtttggaatataacttcaaatgttatcacactcggatacgcaattcagctcaaaggaaaggaacatggataggattggaccttgatgagttatcaatttttcatgattacgaacggtatatgccacgatgcatgcttgtattaagtgttttcttactctttttattgaccaatttaattaactttttttttatcattcatttgattacgacaatgttaagggtatgtttaacccatagaattaattagttgctgtaaaaaaacaaaaagcacatagaattagttaaaattaaaattaattaaaatcacaactcttctgtttacgttgtatagaaaactagtgagtacaattataaacttgaatttcatttggacatttttacttaagcgtagctatataaatggggtcaggtcaaatttgagtgaaaagaaattaatccataagtaatagtctaacaataattgttgtgatatgttcaaagatcaatggtggttggaatagttaagttagtgtggc

SEQ ID NO: 4132 - DNA, 1684 bp, Glycine max
  Soy_ogl_290 Gm01:52292201..52293884 Cluster 18
ttcgaattagatattatcaagtagcaactatcattaagaaatgagaagaatgtcagttgacgacgaagagaactagtcaagcttataaatgcatctttttgtcgttttggaccacacaaattctggttattcgttttcctacatgatgagcaatttctatcacgcaacaaaatgcacttgctttttgttcacaaattttaaactccaattagcatacagatttaaagttgactcagtttgtaacattaaataaattacattaaattatactgtctatttgccgtataataataatactattatatttttacataattttagcagggttcttacacgttggctataaatgtggactatctagtagtgtatttagtaaagtgtctggatttttgcccgaatttttggctttgatcatgttagctgactcttcactcttcagggtgtcatgttacataggtttttgagatgcggctttggctccattttatccattaaaaaaagtggcatattggatacaaatgatattattacaaactaaaattaatatgtgcccgtaagtcagttttatcaataaaatgcccgtttcggccctttgagcataaaaaaaaaagttttatcaataaaatttaataaacatatattaaggaataaggatttgatgttattggatttactttttaaaaaaaaacttcatggagaaaaaaaatattcataatttctctattctacgtactaaggagtccggaaactatacaaatggctctcaaggtgaaaaaaagtaatgaaatctgaaaaaagataattagtgaattaaaagagatatatttgtttcaatttaatgcattgttagtgtaattttttttttacatatacgcttagttaattgaaaatgatcttaaaaaatagttttaaagtaatagtttaagtataatgcattaacagtacgaatgtatttaaagatgaacctatgtttcttattgttaggatcaataaaatatttttatttatttcttatataaaaggtcaaatgtagtataatttaaataaattaggcttgtgtgtttatcagttaaaattaggtttgtctagattaatttgaagttgttagtagattaaatcctaagagctaaaggaaataataaaggtgcttcactgcctgaggttttttttccccccaagttttttcatgctcaaatattctttaataaaatcctcctcaagcttcggtctctgttttcagacgaaagaaataactgtgactcaaaataatatgtaggacagactaatcgcttttcattgaggaacttttttttttcagtctcaccattgttttttggttttttactctactaccataactaaacacgctctctttaatttctctctttctactcttttctttcctcaatctctttttctactgtaccaaacacaccagtaatgtcatatcgtcttaagttgatcctcttaataagcgcctttcgaaatggttgcttaaaaaattgttcatcttatactatttttgtacaattaaaaaattgttaactatcaaaatattcatctatttttttttatatcaaaaccataaagatgggtcgacttgaccctaacaatattgcttagttcctacttcctaccccaaagttttacagggaaacatcctaacacaatattattaagttga

SEQ ID NO: 4133 - DNA, 2500 bp, Glycine max
  Soy_ogl_353 Gm02:3503701..32200 Cluster 18
tcttaaataagaagttgggataataggatttgattccaactctttgtaaatagaaaaaaacttaaagtcaccccaaaaaaaagaagaaaaaacgacttaacttagaggactctaccctttttatcttccatacgtcagagaaaattatgccctacaatcagtgggagacatttcttacaaaagcaaaaatacaatgggccaataattaatgcttcaagaagttgcaaaggtgtgttggaatttgcatttaatttgtttctttagaaattggcctgatccttgcccttttttttttctttttcttgtttcaagctgtgaggataattttttttgcatttcaatccagatggataaaaagtcatttcttttccaaattggaaagcaatgggaatcgagatgtaaaaaaaggtattaagatatggaatatagggcatttaaaagtaaccttgttgcttaaagctgttgccgtttgtttttaattactccgttcttatccatatcgtctgatttttacccaagaaaacatctcattagctcctcaatcttttttataaataataataggaatgggaatctctcatatagacttgaagttgaaccaaagctactgaaacattcttagaatggcacaaaatagtcgtcttttgcaagcaagaaaggaaaaaaaattagaggttgatcatgtaatgaataatgttatctttatttatttatttattaataaatattaattattagttttattagaatattataagtgaaagaaattcgaaccttccaccactctcttctccccaaccaataataatgttatttatttatctatctatatttgctggggtgtttggagatgcaaagggcatcattagaatcaaacaagggtttggaggaagcatgggggattgtttgacaatgaaaaattccctccctcaaggctctgaattagaacgagagctcttcatgcatggagcgtcatgggggctgtaaacattgagactcatatctaacttcataactgtatcaaaaagtgaaggttgaagcggaggaagaggatgcaaaaaaaaaaaaaagagtaaaaaaaataaggctttggttaggtcaacgctaattcggactatttttttatttaaaaaaggaggtattgaattcttagtagcgtgtggcttaagcattgaccttgagactggcactaaaatagtcattagtgtcggaaagcattatgtaaaattacaaaacacaagaaacgtgttagattatattttaaatatttttcacaaatctttttgaaggactgtgtgtcgtaatttataagatgatatgcaaaattgttttaaatctctttatcaaaaccttttataaaaaaatatcaaataaaaatttgaaacatgattaaccacatatatgataagaaaataaagataaaaatacaaaaaaatgctttatattgttcgtctcatcccaaaattacgtctagatcttgatactcccaacttctagtcatataactttgaataagttataagtattcttcttatgtactagccttttcatgctcaaacccaaatagtatttcacttgcttctttaagcaaacatccaaatattctttccaataaagtctctttaggtagtttcaatcacagttacacaaaacttggttaagataaagttcactgatctctatcatcttattattagacaatgtacaagttaagctcaagattctacactcagatattttacatttacaaaaggttgctacaagattagaacataagtttgttaagcttcaacaactttgttgtcttgtacaaggcatcttgatatttataggaagtctttgaaagtatctattgagacttgaaaagagcttcattcttctatttccttcaaagagagaaaatgtttgttgaggcatttaatatctttcacctagtcatttggataagattaaagagtttgcttatgtctcatttctagcttgtatagaaaatcttgcggcaatgagcatatatatttgcttttgattagatactacagtgtaattctctttcttataggtagaaatgtattttcatgagttatgtagccttgtatctcattgacttagctttttaaactttttgagtgtacttctaagttctaagtcatataagattgtaagcacgttgtctttcttgtatggcatacaaactatataacatttagtataaacaatgtgtttttgtttttgtatggtatgttcttaagaaagagctaccgtcttgcttaaaaatagcattttatttgttactttgaaaacttaaatagttagtttgttaaatcaagacgttaggccgcactcttaattcgttctttatcctaaaatattacctagctaggcaatgagcatatggatcatctcttaaatttctagcatccatgactacgaagatggacaacacagcttcatgggtttctaccttgagttgtgatccttatcattattgtcttatttcttt

SEQ ID NO: 4134 - DNA, 2204 bp, Glycine max
  Soy_ogl_931 Gm03:37572397..37574600 Cluster 18
tgttgtttactaatttatgtacttaatacttaaatttgagaagataataatatataaatagattgcaatttatttcactcctaatatttttaatagacatttcactcctattattttaatttgatcaaattacatcaattaaaaactagactaattcatcaaaatacactgaataaaagtttaaatagattaataatataaattaaagtttatcgaaaagaagtgagaaaaattataataaaaagtgtgtggatcgattttaaaattttccgttgtcaaattcgatagtaaaaattctattaatttgtttttctaatagcattttttattttgatcgaactaatcttttaacattcatgaatgtttttgttgttcattatttaataattaaaaaaatgtcatattaaatatctaaatcatttgaagtgaaaaatgttttccgatatctataaaaataattaaaaatacaaaattaatttcaaatatttttttactttgcattttatttaatttgcctaaattttaaatacacgtgcagtgcacatcatctttttctttttgaacaaagcaaacttattatttcatttcataagagaaccacaatataattaggaatttgctcaaattcatgaatcttaacatacaacctagaagtctttaacaaagagtgagtgacttgatttgcttgcctccgtacaaaacttacctttaagtttggaatgaaacttataagattcttgcatttggagataagaaaatgaaatttagagctgcctttttctgttgagtacaaagtctaccacatttttgcagtccacttcaaagtttatgttactcaaatgtaaacgttgaacccattggagcgcctgaactaaaccttcagcttcagcttccctaggactcgagattccagttgaatatataccttgtcattgctgcatgtgataaatctgccatgatggtcccagatacaagcacccattccatgacagttttgttgttgaaacaaagccgcgtcgatggatatgttgcagttgtggatggttatggtgttggttcttcgaaggccgcgcatgagtccagtcattgagatattgcatggtcaaggagaaagatatttgaggttgtgtttcaatcccttcccaaagcttatcattcttgcacctccaaatgctccatagagtcatagcaaaaaaggttttatctccatagttgcagaaccaagaattcaaaaaattagttcattagtacactcaacatactggaaatgaggttctatcatagtccaaagtccagctacttcccacatggcttttgcttgtgcacaaccaaataaaagatgccatgcattttcgagattatcagaacaaaaacacataagctaggacaagacacacctttggtttgcaatctttgtctagtagaaagacaatttcgcagaattcgccaaatgaaatgctttatctttggtggaactcgtaaatcctagatgagggaccaatcaccttgctccttcctcattgtcagtttctcccagctaagccagtttatccccttgaagaggtgccttttgatccccaccagaaagaattcatcattttttggatgtcatcttccaatgatgagggcaaaaggtggacactaatacaataggaggggataaattatgcacaagatttgattaatatctccttctcagccctggataaatgcttgtctaaccagtggttgatgcacttccaaattctgtcttttaggaagccaaagacttatttcttcttccttccaatgatagatgggagctcgacctagttgcatgttccaattgttgatgatacacccagagagatcatggtccactgtctcaaagattgattggtgttggtactaaaaaagacctctgatttgtccaagttgattacttgactagatgctcgtccatatttgtctaagatggtgttaagacaatttgtttccttgtgtactatcttgcaaaatgaaaaacattcgttagcaaataataggtgtgagaggataggaacccctgaacacaccttaacaccatgaatctctacttttctctcagcatattttaataaagaaataagtccctcaataaagaatgaacaagtaaggtgacagtgagtcatcctatctaagttctctcccaagagatgttaatccttataaaataattcactgtt

SEQ ID NO: 4135 - DNA, 1499 bp, Glycine max
  Soy_ogl_1165 Gm04:1684601..1686099 Cluster 18
gttgaggaaagtttctgtctgccatattcttattccctcacttttaccaaatcctcaaaagaaggaaaaagcgtgctctgcaaatatttatggtccttttacgaattagttatactgatttttattttttttacaacactttttcccctctcttttcaatatcttacccttttattttatttttcattctattgaatatagttttatgaattaattatataatttgcgtacgtatttcttttataacattttatatttttttttctcttttcaatatcttatccactttattttatatttttctgaccattgctctcttaattgtaaaacaattataaaaatcataaaaatataatttcacttaaaatataattgggaatggaattttaaagaaaaataaaaatgatttaattaaacataaaatatttatataaaaattgcttggtttatttagtgcagattttgtatcaaattaattaatttctatgttgaaagattttcttaattaattttaattttaataaaaaaaactgttggagtatatgaaaggtattttgttaaggttattctcttatgaaaactcctgtttctattcattttataagtggcgaggaaaagaaaataaaataagaattgatcgtagtgtttggactatttttcaaaattagccaaaaggatagatcatatttcatagatgaagcatttcatgagaaatgaaagtaatgtggagcatagggtttttgttgttgtggttatctgattgttaataaatattaattattgtatttgttatagttaaatattacggtatatttgatttggttttattttttattctgaatgttatctgagaagttataaataatgacatttattagtaagatttaattttcaatactataaaattatgaatattatgttattttttaatattatttaatatattgcattaaaaatggaataaaagtattatttaattattatcaacttaactataatttatattaattccttaaaaaataagtttacaccattaaattttgaaacactaactttacccgttcaacaaccctcagtcttttttattttttacgagatgtatcttctgtgctcaaggtggatagcactaatatgaaagaagtctaatagatggccccggtttaataaaagctgaacagaaattaattacgaaagcaatccttaatccctttttagtacacagaatgaagagatttaaactagtttctgcggctttaatttttgagttttgttgacgtttcttttgctacagttgcaaatccgcttgaaggcactgcagcgcctcccaaaatgtgcactatgtatagaacctccacatctccattttgagaagcatcactcgcaacgcaatttgcaatttgcaatttgcaatttgcgaaggagtcaaaatttgagttttgctacattctgctccaacaagaacaactccctttattatctgaaattgggatattcgcggc

SEQ ID NO: 4136 - DNA, 2200 bp, Glycine max
  Soy_ogl_1402 Gm04:44781801..44784000 Cluster 18
tctaatgtgatgatgagagttgtcttacagctaatagttttttgtttattctattgagatcagttagttataaaaagggttagttagttgtcagtcgaattgcgtatgtaaatgtacatgacacttttaggatcattaatgaattctacattgagtttttattcttccactctacatatatacggcaaaatttaattttcccattagtatgtttggcactttcctcaaaacgtgatttaggttaacggacacaagtctgatttgaattgaagctacttctaatagcttatggatacagagaaaagtgagtctttgattcttcttaaatatacacccttatctttcatcacataaagaaagtcaggttcattcacaacttctgatatactcattaatgcagcaacacagaaacatagatgggtcggcagaaaatagaaatatatgaaaaggagaatgtaaatgttgcaacaacaatatgccacgagaacaacttgtgatacacccataaacatgttaataattatgttcggtttaataaggccaaataggattagttaaatccaaaatgaaaaaacaaaatgaaagaaaagagacaccaaaaagacagacttgtttatatcccaccaagtattgcatgtggcaacaccctcctaagtcctaagcagtgttctgtaaagtttaaatcaattgcatcactcaaaaacaaaaataaataactagttgcatcatcatggaaaattaaaagcaaacaactatatttccaattgttgtgggagtacatccaaacacgatgaatctgtccatggtgcgaatgcccccttatgtgataaattctgccagcacaaaacgtatacatcagaaagagggtattacaatagtgcctctaatttcctatgacttcattctaaactaatacggagatgtaaattttgtaaagctaactttgattctatgatacaattcaccaaaaaaaatcgataattttagatggagatgccacttttttggactaataaaagataggtgaatatcaagacctaggtgagttgtaacatacagaaggatatggaccctcatagtgttgcaaaatggggtaatgtggaccaattacaaaaggcacatatcttcaaatacgatgattattttacataatgaaaatattcagtcacaaagcaagagacttcctagaaaacttttgattcaatatggaccttcaaagtaaactgcagggcatagtgtaataattaatgactaatgaggcaacagaggcctatggagtagaagaaaatcaaaatccaactgcaaatcacatacccaacaattaacacgtgtggttagttggagattagttagatacacatgtgattagttaccctatctatttctcaacacaaaaatcttgaaatgccttgaaggttaactatttttaggtcaatatagaggcagacattttttcaattgaacagtgcaagaaaggctgtagaaagtaacatgtgtattaagatgcagaaataccataagatacttactttcaaccaatagaaaaatccacgcatgagattcagaactccgggatgatcatcacgagctgtttctatcttcttagcaagatctacaagacaagcacacatgtcatagtcatagttagtcttcttcctacaaaacatttagaaattaattcgaatgtactgagattaatgtaaatgatttttccactgttatctaattatagattgttatgtatggtaaaattgttggcttttataataattactttaaaaagtcacatttaagatgatttctaacagcatcatgcaaacataacaaggggaatatgaaagagaagggccatatcctacttagtacttaccaacatgataaccaagaaaagactttccaagatcaggtttctcatagattttgatacctccacgaaggtctctatggtgctggactggctttcgaacagtaatgtcatgtaaaagcctcttgtactcttcctcacagtaaggtgccttaagttcttccatgagtttttctctgaaaagtgtacttccattggcttcattatatatttcttgccaacaatgttccaccttcatcaaggaaagcaacacaaaagtgaacagtattgaacataaaacaagcaaaaacaaaaaactcgtgatttttttatatacatacaatctggcctcgcatg

SEQ ID NO: 4137 - DNA, 1780 bp, Glycine max
  Soy_ogl_6 Gm04:46950721..46952500 Cluster 18
tctatcaaattaattatctatgttttggaaatgaaaaaacagttgtgagtattttaagtttcgtcccgtaaaaaaaagtttcgtacgttgcacggatttttacaaaattaagaataaactatactaataaccttttacggtttaccgaatttatgtaaataattttaggaaattatacaaaaagcttcagtttttttatttactcattttctaacatacttgcttcatttgtaacttttttcagacataacattagaaatgaaaaagaccaccataatgtcaattgtcaaatcagaggttttttagttaagataatttactcgtaattttattgttaaagtaagtaaaataattttaagttcataagttagcagttaacgaactaaccttaacaattttatttttattatatactttgttcacattttggaagttgaaatttaagctataactccaagaaaatgctagttggccttggttttcctacaacttaccagaactcttgcttcttgtactcgttgacggttgaccttatcgaaacaatagaaaatgttccatcaaatctcagaagttaaagtttagcacatgcttctgttaaacgagcatatatcgattgattggtttatttgctcattactgaaaaacactacgaacatagttctctttgctaatagttcttccaagtaggcagatttccatagggtaaggtatttacgcattatatttaagtatcacaatttgtataaggttcaaatgaaaattgagagcaataggataaaaaggtaaacttacattgtgtttgattgtgaagagtggaaatgaataaaagtgaggaataaaaaaatgaaagagtaaaaaaagagtgaaaaataaaattgttcggttgaaatgaaattgagtgtaaaaaacaaaaatatttcaattaaaattggttaataggtaaaaaaaaaaagtgcattatttaactctatttagatcacttcaccgtccctcttctctctatttaaaaccttaagatgttttctggctatttagaacacttggaacaatggtattgatacaactgggcatgtgtaaaattatggagataatgtttttgtagccactttttcttttttctttttttaaagaaattgcatatggaaaaaaatctagaggtcctaccgtgtcaaattagaaatccagtgcaatgatcgacatgtgctggggttggaagtggccatcttgctagctagctctcatgatccactccatttgccttttcatacattaattaaatcgtacaaacaaaccttacctcaactcaacctagtgcaacagtgctacaacctctgagagattgactgaatgtttcttcttcttcttcccatcaacgaggccagaggcagacaattaacccgacattggctgataaggttttttctagtttgtaatcattttgtttataggtcttcaaaaaagcattaattcattgagccccatttggcattcttttctttcctcccacagtcccacttaaatcaatattcggcctgctctcttactagttccttcctctcacaattgtttggatgaggttaaagcctaactcataatatttaatattctccttgggttgcatcaataatgttgaaaaataatttttataacaaattatcgagctatttgtcacacgccattaagtattttagtgggttcattacaatatttattataaagataagattcttgataacacatcctagagatgttagtttaaaattaacaaataatttttatt

SEQ ID NO: 4138 - DNA, 2153 bp, Glycine max
  Soy_ogl_1500 Gm04:48825548..48827700 Cluster 18
agagtttatgtcccagtcaatttacactgacaagacaaaatcccactgcctacaaaatcgtatatcattcaaactaaaaaagagggctttaaaaaagttcataagataaaatcttcaaaagcaaaacttcaaataaaaattatttactatattgatcaatattttccttagatttctttttcagtgaacccctattactttaatcttccaatgatatagacgtcatctcattgttttcgctctccaaagtattttatcgttaatttagttcttaaattgagaaagtggcattaatttatttttttaactattaattcagctcctcaaataatcaattattgaaaaaacattagcttggtctttcaataatgtgaaattaatctcaattcaatctattaattataaatgtttgcattaaattaattttccagaagaattagcaactattttttcataattatacttatacattataaatgactaaagttttgttttctcgtttccttttcagatggattctgccggatttaaataggcgagtacgattgagctcgaagacaatgtcggtaaaaagttcagcatggagacgtaccaatttacgcctttctgtcgtcctattatgacgtattaccttactttagttttctattcccagttaatatgaaatgttgattattggttataatgtataaatataaatggtaaagaagataagatattattttcctctgaaggtgaacttgttcctcagatcaacatcaatattctaaacaagaattactatcaccctactgtaaagtaaataaatagtgacataaaagatataaagagacacaaacataattgattgatatcagcgatgtgtattacataagttaacaaaaaggtgtttacacttcaagagttacgtaaccaaaagtccaaaactaaataaaatccgaataagatacaactttgaatagttattcacatgtaagcttatttttaagattgcaatgcaaatggtacgattgagaagtacaaatttaatgcagttagtcctgggagccttactgatattatcatagtactgatcgctaagacatgggcccaaatcatatatcatcccataaattgtaggaaaataattcccaataaatctaaaagatgtaaccaaaaaatacaacactagtttcctttgttatgcaaagacattatacaaatactactataatttctcataatatacctaaattttggcacaatgcggtagtacaatatcttatggattcacattgatgttatttttcgtttgagcacaaatatgtgcatataggcccaattacaggaccatatgggtactggttaatgagaatacggcacccgaagattccttccaaatgaaagaaaatggacaaaagtttaatattttccttctatattcctatttatattttactattaacttttttcggggtgtttgactcttaacatttgaatattactaattacttcataaatcatactatttttcttatcatctggtttttattttattttcccagttaatataaatgttgattactactatataaaatataaatagaacagaggataagatattcttttgcgagaagttgaacatgttcctctgagatcgatattaacatcaacttaaaatttaaccagaaatcttgactgttagtcttaggaatgaagttgcattaaaattcagagaaggatttttattattcatggaaagttaatttatacttgaaccagattagtcatatgtttcgtatagttgcaagaatcttagacaaaaaaaaaattctaaacaaaggattactgtcacattaatgtaaaagtaataataaataataagcaacaaataacatgagaaaaagagacaaatataatatatgattatcaaaaaagtatttatacttcaagagtgagataactaacactaaataaatactaattaataagatggaaaatttcctataaatatcaataagatacaagttttctgataattaaatcccaactaaattaaagtcaagtaatatcctataaacattaaatatgtgtgtgtgtggatggttcaggtgggaactaaaatttaagcattgcagtaagtcctagaaacctttaccgatagtatatatgat

SEQ ID NO: 4139 - DNA, 1700 bp, Glycine max
  Soy_ogl_2457 Gm08:1786401..1788100 Cluster 18
agtagcaggtatccaaaagtgacccaacgggattcaatttagcagaacgaatactttaatttctcacaacatgaacgaattaagtttgaatttttgttgaaataattattcatgtttaattgttcaattaattaatttattagtttaacaagtataatgtgtaaattaaacgaattgatctataagttcgtcaaccaaatccatttaattcacaacctcaacaagctaatccatttaaataattaaataacaccaaattcgaactctcacggactacaagttaaatgaactagagctcagactaaattacatataagcagcttcaggttcatccacagtgattattttagtattggtttttcttaagatttggaagacatagcccgaaacattcaagttattatatctaataatttgaagtattagatatgcttaattacaatttgcactcttaacattttaattttttaaaaattttacatacaacaaattaattaatttgatgtattttatgactaacattttaaaaaaacacgtaaatatcttccgtagtttgttcattaaatattcactaaagttaggataaaactcaccgaaagtttactataaaaaaatgcaattacaacatgccactttagttaattttctgctttttattgtctgctttttgtattaatttttaatcaattgccatacatatttcgatcatagtactaacattaaggtaataataatcgtattaaacaaattgaaaaacgacggagcaacttatcgtcacttacaataatggaggggaacattatgcacgtaactcttactaactggtccagcattttttcaacaaaaaaaaaatggtccagcattcagacccaaaatagaataaagaataaaagaaaattctatttaatgtaagtagcagaggcagacacgaatacaaatttattttatgcgcactacataaggatcaaacagacaaatatggaattcaacaaaaaaaaaaaaattaaaaaatagacaaagatgggaatttctatatagcaaaaaaaaaaaaaaacaggggatgtaaaattcttttacaaatgaaaaaaatagtacatctactaacactaaattttacattagtatctaattatatattattatatatatatgatgtgattaccttaaaaaatcatattttctataactttttattagtttataatgtattattttttacactaactatgtagaattaaccaatttcaacaatgcttacattacaagtcaaaccgacgaaaaaggtttttttttaaaaaaatgtattggaacagcaatgtacttatgtacctgataataacaagtatctagcaatctaatttcacaaacaattcacaatacatttaccatatcacaaaactacatgttgacataattgtttaacaatccatagaacaacacatttaccaatttacagaactacatggaaagaaaacagagagccaacaaatacaagtaacaaacactacaaaaagcatgtggagacgacaacaaatagtaatgacagtgagaccaaacctgttcctgaacgataacaacattgcaatggaagcaacaaagcaaacaatgaatgaaggaatgagaacaacaacatccacgagaaccagagcagcaaaggcacaagaaaatgaatattggaatgtttgagagtgaaagtattt

SEQ ID NO: 4140 - DNA, 1900 bp, Glycine max
  Soy_ogl_2914 Gm09:702201..704100 Cluster 18
acccactaatattgatattctcacatattgattgatttaaaagaatcaactaataagaatcctaagttttttaatattattattaggcagaagttaatttttttctttttaagattttgatgtcattttctcacatataaagtagtaggacatatgaaaaatgagttctaccggggagactgggcttgtgggcaagggaagaaggccttatatcatgttctccatgcacaaatgatggaagattgaacggcaagatgtaacttccattggcccatcaccatattcatttgatggtgtgggaccaatcacacttactctctgccactactagtagatctacgatccccatcaagtgcccccaagtggaagctccttcagcttcttctgtgttatctacaacaagcttccaatggagcataccccaaccctagtaatggaccccctctttctaaatcaaatggtccccccttgttctattaaaaattcagatagatcattatcatctaattaatattttttgtaaatctgaagtaatcactctccagaatgttggggaatagctttttttcttctttctatttttaatatcgtgattctcctatagttatattttttaaaaatttgtatattactgaatttttgtcttactcacgtttggtgtttttatatgttttaatattttacctcttattatcactcctcactctccataacaatcaactatgtagcactgtttaacaagatttgagtatctttatggaagtgatttatttctcacctttatcaattatccataaatataacttggaagaaacaatgctacaaaatatgtttgagattaaattttaagtaaaaaaaagtcaatccttaaaaaaaatgagaatgtaatatatttatcttaacattctcaagcttgtaaaactaatctccgaaaaaaatgttttttcaagatttatcgcgagagaaaaaaattattgtgaagcctcaaatatttctttttgttgtccagaataatcctattctattcaaattaagttatactgttttcatcgtcaaaaaaaaaaataaaattgttttccaataaagatagatgtggtttttccctaaaaaaatgtatacatgtggctttaccaaagctgtattatgtaattaaattagattgtttttcaataaagatagatgtgatttttccctataaaaaaagatagatgtggttttaccaaaactgtattatgtaattaaattagatttattttttgtgacgaagatatgtggttttaccaaaacaagatgtggttttactgaaactgtattatataaagagggattgccgcgaaataagaaggattattagtgacagttagcagttagattcccgccatgctaatgtgaatgtggaggtcaatatagtaaatccgcatcctcgtggaagtcggtgctgggatagatgcgggcccaaggttttgaaaggactaaaatatccttttctattgaaggatgctgattcctatgttgttgtagttttcatgtgtgaaaaagatacctgcgggtaagaaaagataaaattctactgtatattttcttacaatttttttaaacaaatataaaataagatgattgatatgatagaaactagaaagagatataaaataaatatcataaaaatattatataaatagtgtaataaaaaaattgtgccaatttacatcataatttttaagtcaaaataagtattcaatttatttttgtgcaaaaaaatgaaatatttttttataagatagtaagaattatttttatagacaataagtattcttcaaaattaaaataccgtgatatatagtgtacgcacattaaacgtaaatggacatattatagtatcatttcattttatttttttgtg

SEQ ID NO: 4141 - DNA, 1400 bp, Glycine max
  Soy_ogl_3237 Gm09:40569501..40570900 Cluster 18
cagtattattgcaacattagagataataggatatgtagtggtgatgatggtgaacaaagtttcttccttttgggttatattgggaatctgggatcctgtcgtttcacactgacaacaggaaacaaaatagttcctctcctctcattgtagtccaaaaaataaaaatagaagcatacaaataatgaagagaaaaaaatggtgaaaaattgaagaaaaaagtgagacatccaaatagagaagctagagggagcatgagactggagagagtacgagcgagagaatattcaaattatagaagtagcacaatcacacagtagtcagagttagtgacagtgttacacaagagtagcagctagataaaaagtaaaacctatatatagtctacacttatataaaatctatacaaccactgtttttacatgtacaacagtacatgtgttaacattttttatatacaacatcctgtaaaaaaaaaaaaaaacattttataaaacatgagtccactactttttttgtcatctttaattttttttttctttccttttctctctctcctgctagtgcacgttctagtttataatataaacaaattggaccacatttttaaagaaaaaaaaaactagacgtgtcaattgtttatatacgtttctcttttagaatttaagaacttttttattaatggaaaatttctaaatctactcatttaaatcttgaaatgattaaaaaaataataattcctgtatattttcaatgcaaaaaaaaaattataacagaaaagttatactgtcaattaataaaaaatcacgctcattataattttacaccacaagaatgaattatactggcattattataaattataaatatttgcaatgcaatatgttgtttgattaatggaaaaatagcgaaggagggaaatgagggagtttggtactgattagggcttttcccaatttccagcaatagtcacggccaggcagcggcagcctttcacgattcattcatgtgaaaaggagaagtgtggggcccacataatgcggggccccgaactttcatgatccatatatatgttccattacgtgtaaagtaaaatttacaccatcaaatgtgttatgtggttttgtatttttttacaaactatagtatttttttaaaataccaagtttttatactaattccgatttgttttttttaagaatgttagagatattcgcaagttagttagagataactagaaaaagaaaagcgaaatcctcaaagctttctacataatccttgttattctaacatggctgaaacaaagagaactttagaagatttaatgaataggaactaagacttagcatgcttataattataggactactcatagatgcaaataactttgagattaagtctta

SEQ ID NO: 4142 - DNA, 1833 bp, Glycine max
  Soy_ogl_3951 Gm11:37592068..37593900 Cluster 18
acacctttatcaattaccttattttttaaataaaaccacaataataagtttatgttgtcaacgactcactcgctttcttcttacactacaaccactttctcacaataacatcaacacacaccttctcactcaccacacctatattttctcacaccacactgactttcttacaattacatttacagtaacacactaacacacattctttcccactgaccacgtccattttcctacgtcactttcttctcacaccacattctgcacttactttctcacaattacaacaacacaccttttttttcactcacaataatagtgtcattttacttttttgtaaaaaaaatataaaaaatttcagttaatgaaaatttaacagaataaaaacttgttttggttgtattatatttttttgtacaatccacaataaaaacatttctgtcaaggatagttttgttacaaaaaattcaagaaaaatatggggtgtgagaatagaataacaaagccctgtctctttgtgtactgctgggccacctcttcggagactattgttttatttgggtctgtcggacccgttcttgtatgatattgggcctaaaagggaggcttatggaaatccaaaactcttacggctgtcacttcttcaatagtttttttttttggaccattctttttggttaatttattaatagttagccttttgttcttgaaaaagaaaatttgaactcaacgatcttttcttcctccctttcttcttgaatgatgaacccaatcttataactccacttatttaatagtatatatttttgaaaaaatataaaaaagtatattaataaaattggaaaatgtaaataacaattgccttatgtgacccaactaaactctcaactctccaactccaacccattccagatgttatacatcatcctttaccatcttgcctattagtatcatgagcggagttacatatcttcctcttcattttttcatgccatgctttatctctattatgtttaatttaattcttaacgttatcgaaccaaagaaaaaaaatattttggcctaaaagatatcacaattcttgttttgtttttataaagttctagtttacatatcgtaatttctcatatttttttagtcttcattagttttatcatttaagagttgtttgtatgtgtcttttctaaatatcatgttttcctattgtctctaaatattaatccctcatgttaattagcagtaatattatcgttcaacggataacaaaatggaagttaatacaagcattagttacatcagaatattttttaaaatttaatagtgtttttcataaaaagaaaaattaaataagaaaatgatgatattttgagtaaaaaagcacataatttagtccaaaatcaaaatacaagtgaacagatcatgcagacctaagaaaatctcatcattaagtctttaatgatatatttgataagaaaaaaaaatacagataataatattttttttctttcaattttttttctctccactctctttccttcattccaaacataagataagaataagttaacacacccagctgataatgtaggaataatgtgtactcctatatctcctaaaattaaacagcaacatttttattttcctaaaaacctgcacaatatgaacctcacaattcttgtccaaccaatgacggataaagatgaagagtacggatgtctggttaacaaacgattttaaaatcacactccaacaaagtacctgaaaatcagcaccccaacatagtaactatttttcctttagttaaaattttaaaaatttctgtatctcatcagtttt

SEQ ID NO: 4143 - DNA, 1400 bp, Glycine max
  Soy_ogl_4515 Gm13:37391201..37392600 Cluster 18
ccttttctttagtttaattagatctttgagaggaaaagactggccagagtgagagcatgatgttcttgtacgtattataaattataaacaaaaagaataatatatttttttttactgcagattaatattattttaacgatactttctcacaaaaacctttataatataaacaatatgatgatcaaaaaattatgcgcaaaatttattgttttttaaataagaataacaatatctagaaattgatccattaatatgtaatcgcctttcttgaacgacttctggtatatatgcactgtgttgtgcacttatgcgtgcagcacacaaagtatggattgcatggttgactcgaagtggaaaattgaactcaaaaggatatgtttggtaccgaaaatcgattgagatggagattcatccgttacttcttcactcagtcctgcatcacaccaacatgcacgtgtctacggttctctttgtattttcttaggacccagatcagatatggtctgcttctgaacagattcttggggaatccatattctgggcaaggcctaacacacacacacatatatatataattaaggtaatatataaaaaaggaatgggtgaaattttgaatagataataaagatatgatttttccaaacatgtaatcatgttattgatgcataataataataatttgtttttatcaaagattaattttaaaaaaatctaaatgatcataaaatattttatcttaatcacatttattctcatttacaatgctcaaattgatactttgcagaaagaaacaaaatctagttctattgaaaaaaatattagagtattgttgttatattaattaagaaaaaatgataagatatataaaaaggaaaaataagtttagtttaaattctgcttaactctagaatttaaagtgtaattttttatttttgttttcaaaataagaggaaaatttaagggacttgactatctctctatatatatcaagggaattgactcttgtaaagtgaatatgtaaactttatagaataaagtacattcagcatcattaattaaaaaatatgattaagaattgtaatatcgaataaattctaaaattaattataacctcacctgctaactttctaattagcagttattattatactatgtcctctaaaccacccaaatctatattgagaaatgcatgcatctctctagttattattattctcagtcatatattaattttttacaactttagggaaggaattcacgcattatatgtttcagcttcaacttttaactcgtcacaagtacgattattaattgagttacttaattatgatgttttaaaagacaagttttgttgtattttcatcttcttattaggcaacaattaattgctaaaaatactg

SEQ ID NO: 4144 - DNA, 1200 bp, Glycine max
  Soy_ogl_4821 Gm14:48474401..48475600 Cluster 18
gatttaactttggtttactttaataaattaaaataaataaatattgataagtgtgtaatatagttataattgcgttaaattaaaaagagtattaatatatcatttaataataaataactatttcttcggatgaataaaaaaatacggagaactgtaaataactagcatccatacccctgatatcgatttaagagtatatccaattaattaatcaaagtaacttaattcattaataatttaataattgttaaatgagccccatcatatatatgacatattaattcttcaatttttttataatttatacaactattcatcgtcttaaaggaatgattattttaatttttcttttttaaattatctcacaggttcatattagtatttacttttgttttaattttctgtaatccgtaggttattgaagcaacttaagctcaagaccccaacaacgttatgttccaataattgcttgagtagaaaagaaaagaaaagtaagaaactttcacccattaacacaaaattaagacgttttttatattaccaatttatatatatttttatgtcaaaaaaataatcccatgacaaacttatggtgaataattactcttatgtctgtgtcctaaaagaagactctaagtttcacttagtccgttcaatcaacatcctactatgaaatttgggattagaaataatagattaaacaagaaaaaaaaaattggccaagcaattttgaagaagaaatataaccatttgatttgatgttgttcatgttgaccatgattgacagaagagtggaccaaacgtataatgtgggccatgggacggacgtggaaaattatcctaagtcctaactccaataaatgcgtagaaaaaaatgcattgaaaaaaagataaagaatattttatcactgtcccatgaaagtcacgtaattaatttggtttttgtgtttatttttttcggccattttcttgtaaagtctttatgtagctatgcatgcgagtcccacatgttctattccattctttctataacagcacagtaagatgatgcaaataaaaagtacttattttaatataaaaagtacttatgataagtttttagatgttgggtaaactttttaaaataagtaaaaaattacttattttgagagctgtttctcaaaataagcagttgcagaagcggatccaaagaaacatgaa

SEQ ID NO: 4145 - DNA, 1401 bp, Glycine max
  Soy_ogl_4928 Gm15:8887536..8888936 Cluster 18
catgtttttcttatatatgggttcagatttaagataaataattttaaatcttctactaatacattcttttattaatctttttattttatttgtatgatagatattaaatatattatatatttttaagacattaaatagtatattttttatttaatgttttctttataaggtggtaaaaagatttataaaaggatatagttggagaacgtagtattactctattaagaaatatatcagaatttagtcacacgaaatatcagagttacacatatgcttcgggtttagagagaaatagagtgtaaaaaggtgctgtatagatagataaaaaataaaaaaggaaattggtaaaaaaatattaatattctattttcttgcattgttccatatgtatttatggatgtaatacaacaaaggtatctttgaattaactgaaatatcagagttccatatgtttttcaagagtgtatttttcatattaatttaatagatttataagaattatttatttatttcacacacacacatctacacatctataaggagcacatttcataatcactgtaaggtctacatcttcccacaagttctgaaattagaatggttaaatttttaccaattttataagtgtttggtaagttttgacgcatgtcctgagcggtccatctgatgaatcatagaatgtaatccaacaaaaaagaaatccctaggtttttaatattattcttaagcacaactccattttttctttttaaaaatttcatgtcattttctctgatagaaagtagtaggacatatgaaaaatgagttctacctgggagactggccttatgggtaaggtcctactagatggattctccgtgggaagaagattttctggccttatatcatcgcacacaaatgaagatgtaacttccattggcccatcaccctcaaaaataacatattcatttgaaggtgtgggaccaatcccacttactctctggcagtacgtactagtagatctacgatccccatcaagtggaagctccttcttttgttatctacaacaaggttccaatggagcataccccaaccctagtaatggacccctccttctaaataaaaagtggtcccccttgttctattaaaaaaaaaaaaccagatagataattgggatctaataaatatttgttgtaaatctgaagtaatcactctccaaaattttggggaatggtttttttttcttttactttttaagattgtgattctcttatagtaatattttttaaaattgtattactaaaaatgtgtcttactcacgtttggtgttttaatatgttttaatattttatctcttatcatcacttctcacaccacaaccatccactacttttaagtatatgtttaaattaatggtgataa

SEQ ID NO: 4146 - DNA, 1797 bp, Glycine max
  Soy_ogl_5525 Gm17:5406004..5407800 Cluster 18
cacttcctaatagcaccagatgcttttattatcactgaacgcgacttaaaattttatgatcacttactagaaagtcacatggagttaattgtgtttatatatatacatacgtacattatatattacataagtcgtaactggtctggagtacactaccggcggaatatgcctaatttcttatgcggtgtttagaaagaaaaagaaaaaagaaattatggattgataatgttaaataactttatattattattttattataaattatttataaagcattcaccaaaaaaaattatttatctactaaaatttatgaactttataataatcatcataaagattatactagcaatattcttttattaattgacaatctacattttctgcataatacataattattaaactcataaaaaatacttttgaagtgagattatcctaaagtaaaacttaaaatttaaaagagtttaataattattgtctgtcaattaaaaattactttgtaggataacttttataataattaaataataatataaaattatttaatatgttatatgtattgcaaacataaaccacaaattttctatgctaggattcatagtaaaaaatgtaaacatttttttctcaacagcaaaaggttcaactgtcttctccgatcgacttgtttatattctaaccagagcgcgtctccatttcatgttaatcatcatatctttgattaaatttatctctacttcttattatgaataaaacacgagtttattctcctaaaaaattattttgttattaatacataatctagttttttcaattaaaaccgcattgagggtcaactagctaattgaaacgttatttggaaatggtgattaatttgcaactaatgccgaaaggtgtgcatgccctttgggtgagggaagaggaagctagtcacaagaagacgaacgtagccttttggagtctcacgtttggggcattatcatccccgcaattatattgccgttagcccgcgtcattgccactaagttccttctgtctttgtcgttatctacgccattttctttttttcaccatgccaccgcccaggaaagtgacctaaagttatggtgtgcctccattattgtcttcaactttctttctttacactaatccttaccttaaaactgagtagattaagatagcatgtcaataaattaatttatctttttctggacccttcctatttactaactacatagtaatttgttaaagacttaaacgtgcccatgaggtcatccatcacgtattttccttgcttaaaataaatgagttgacttgcggtcttgctaataactgttttatgttactactatacatttatagtattaaaaaaacacgattttatccttaaacataaatttattttcgtaatctaattttacaatttttttatagaaaaaagcaaaacacagtttttaaaattaaaaaaacgattatgctcgcacgcataatcaattatattatttaagactcacaacaggaagaagctaaagctcgtttgctcacattgaacatttgttgagtaagtctataatagcaatacttgaagaaaagagaagtagttacacgctctgaacatatttgtgatctcttgctctaaaccttttatcccctggacgatagttcctacaagggtaaaatagttatatcatttgcttagtaaagataccttgtattttgtgttaaacttttatagtctcactttgtgagttaatttcctgtaatgtttcaaacagtctatttgtgaaagcctaaataagt

SEQ ID NO: 4147 - DNA, 2500 bp, Glycine max
  Soy_ogl_6734 Gm20:33944001..33946500 Cluster 18
ttagctacgattttggattttaagcatgattttaatagtagcaatagcattttttttacttatgctttaaggggtttagtgatattaaaaaattagtaatggggagtaaattaagaaattacgaaaatataaaagacatagtcatttattgaaagtttaaattgtaagagtgttcttcagagaactggggcacattgattctgctagatatcggcaatgttaggaagacatcaggcgaaatgtttattgcctgctgtatacttagttacctgtaaatacgctcaaattagtaatgattttagcatagtagtgaaaagaacatgccttagaaaagagcatgtatagggctttacagagagaaatgggattgcttagggtggaggatgactaagacatcatataagcttttgtggttacccgtatgcaaccttttgtgctcaatgggtgccgacttgaaagaagcatgaaccttcacacggttgggctaggatcttgggcttaagaagatacagaacaaaatatatacgtataatttgaatgtgttgacgatttgattaattaaaataaaataacgttattatattttggttcacttgtcccccagaataattaagtggaatatatggaccataaacatgaataaaaagttaatagaatattaggactttcaaaacatatcaagggaatgaacaatgattgaagtagaggtacctacccccttgactttacattctcaaggcattgaatttaagttagcttaaaaacaaaagtttgaatttattatcctatgtctgtgtgctttcgattaagcagaagtttccggtgtgcctcttaagcaaaaaacaagtgctgtgatcgagagtccatcaaatatccaactttgacgtattgtatggtggcgttcaaaacaagctctgcagtctacacatctgattggaagataattgaacaatgggatatcaataaaacttgagtaatctaagaggattcttttatatgtttaatgttttttactttttatataactgtttcgttataaaaagaaaaaaagaaaaaaaaactatttagtaataaaactgtgtttcttaaaaaaaaataaaccaaacaattttaaacaaggctgtgttttgttgagtgaagaggaggaaaatgaaggaaaaaataaaataatatggatttttatggggtcttacaccttttgtattttactttaatttaaatatttttatctttttatttttatcctctaaatcaaatacaacatttatactgttaaacatttttgttatataaaaaaaaacacttctgaacattttaaagatacttgttcacctgagtttgtctttttctttagtaacacagttagcttcttttatttatttatttaatagatagtaacagttagctatatgcggaaaataatggattcacatagcaagtgtcacaggtgatcgtgatgttagatatataactagcgaaaaatagtaatagtaatcacccttgtttaaaaatttccaaagatattattaaatgtttatagtttctttaaaaaaagaaatgaaacttattgattatttgaattttttttagtgaatagtttaattgatgaataatatagttttcaaaattgaacctgactgatgaattcgatcaagaaacagtctaaaatctaaataaccaattcaggcaattcttaaaatcgggtggatgttgaactcgtgaaccggtcaagaatttatgaaactgatgaaaactggtattccaatgattctgggcaatttttttatgatgttattaatgtttttagtctccactaaaaatttatcccaattgaggatctatttttaagcttaaaagaaaatagtgaacgtatacctttcttaaaaaaatcttgttatttttctttcttccaaaaataaaggataaaattagatttagactcaatgattgggtgtaggtgttatccgtaatagagagtaaacgatcaactttgtctttaaaattatgaggtgtggttaatttagtattttgaaaataatataaaaacaaaaaggttcctaaaagtataatttctcattaattttagtctctgacaataattagttaagtttaagaattttttaaaacaatagtataaggactttcaagaatttttttttatcatatcattacttttaaagactaaactaacgtgtgaagaataaaattcgtcacctatttcctaaaaattttactagtcaaatttgatttgggtgtgtgtatataatcactagggtcggtgaagaggaccatatgcatgcatggaacacacatataacacaattcattcactagtatatttatctatgctctgagatctgtacgttcgtttatatatattagagtactgttatttagtgtaataatgtagtgcattttaaaaaaagggtgatacacagagtaatagtgtgatttgacgtcaagggacagcgatcgatgtagatcattaatgaaatttatt

SEQ ID NO: 4148 - DNA, 1890 bp, Glycine max
  Soy_ogl_6847 Gm20:38527387..38529276 Cluster 18
aacttagtatatatattcatgttgtaatttgttaacatatttcaattaaaaaaaagtgagtgtacattgagaaagaaaatgcaatattatatttacagaaaaaatgagctatacattgattaatttgtacagtattattcaattataagttatcataatataaagattgttagtttttacaataattttcttaaaaattataccaacaatcatttgattgtttgatgatacaattttttttatattattaatatgtgaccattaaattcgaatttatatcataatttatagaacattttccctttatctttctattatatatgacgtattttatttcattattcttttcttatttgtatgaattactatataaattatatgatttctcaaataaaattataaaaaaatgctctttttatgcatgcaacaaacataatttcacacctgacataatagtaaattcggagaataggtgggcaaataaagtggaggtaaaaccgactattttgataacattatattaataatttctatatattattaatataaagaaacttacattggttagccaataaaataatcattgttggtatgattgtaaaaatgattattatgaaatcaacaaattagatttttgtgattataataatgtgttttttttatattgtcaatacatatactatttattctaataaaaataataaaatatacaaatttacatacaagtaatgatatataaacattccattattttaaatactcaaccaaatttttttatttttctttatttattttttcttatcacatcatgaactctactacacttatatttttttttctatttttaccctctcaatagttgttaagatagagtataaatgtactctaaaatcacatgcaaagtttaaattgtcttgacttgatttcttttaaattagaagttttttttttgttgttaaaaaaattcttcctatacttctttaggtcgcacaaccaaattgcaactcaagctttacgtttcatatcatatgtaagggattcattctttctttagggtgtatatttgatttgattctttaatacgatatattcagatgaatttaagttttcaaattatttaattaccttgccgcattgccatgcatgggatccgatatttagcttgcatgttgtaggtagtggtaattcatacaattccattcacattggacattggagtgtctacacagtttttttagcaaaaatgtaaatgtcaataaacttaataaagacacttgtgatagaaaattatcaacagtttagaaggacatgcgaaatcatccagattgataattgatttatttgttatactcaaactgaaatatcaagttcagctatagattaagctgaattgtgatttaggtgttgttggattctacgcggtgagtgacaaagcccagtgtctaagttagccaaactttatcttcaggtagtgaaacatgtcattttgttcttatcgaaatgaagtgaccgggtttcaagtaacatctgtggttgatttaagattaaaaaaaaaacgttttactacatcacaaatcataatccctctatagaacacaggttaaattttttttatcacatactctttttttaggggtaaaaataataatttgcatttcactgttcaggaatagtcaataggcgtgcatataaaaaaatgatttcatagctttgctataggggtcaatacggatcgaaatatgatatccacaattcaatgagaacctacccactgtgatcaagataaatacatgtattcctggctctttcaatttgagagaggtaagatctatctgctaaacttattaattattattgattgatatacaaatctaccagaacctgtgaaga

SEQ ID NO: 4149 - DNA, 1392 bp, Glycine max
  Soy_ogl_6878 Gm20:39729040..39730431 Cluster 18
ccataaaattattgttctctttttttcttatttttcgcacacagtcaacgagtgacatttttatttctgagataataattataaatattttttcctctctctgactgtccgagataataacctattataaacaacttttaccgcgcatggcattcgatttatgacgtttagtcttatcaccttatgtttgactttgaccattatttactcaattacaactatatctcacagatcagcaacaggcaaggaaattaattaaacgttagttgccagaaggatgacttgacacgttattaagatattggtcaatatataattatttaaaatttgtttagataatattatctagaaataattttaaaagaaaaaaaatgatatgagtttctatataagttaaaacgagttatttattaattaatttataaatttttttcatataatttttctaaaacatgaaaatatatttacaaattaactaaatgttagttagtggagagatcatattaatttatagagaaacttattttatttttttttgccattctacaaatacttttaaagaaacttatctaaagagatccttacataattttacaaagaattcatttgttttttttttaaaaaaaataaatggttgattcatgaaatattttaaaattcagaagtaaatgatttccactcataataccaaacaaaatagtaaatgaaggcaatatctattctctatttctataattaactttagaaaagttttatcaattaaactagctataactgttattattgttttgaccccctttttttaatagtgtagtttttgtgctgtcagcaaaatcaaagatatattaagcaaggtagcatagatatacaaagaaagaatacaagtgtaagtccctccctggttactctatatttatcacatataataaatataattaaccaggttttttttttgctggcatttaaattaaccaagatgccaaaaacaaaaggcatataacgtatccatccacctttttttttaaatattattgtaaattaagtcaaagtgataagccaattatcaaaattcagatcccatcaatcaaggattaaatagacattttctacctcacatcttataagaaactaattaatgtttttttttaaggaatcgcataagaaatgttaagataactaattcaggaataatataaatagaccctatatacagggtatgtggtattgtaatgaggtattttatttcctttctaacttatgtcttttatttgtatattttaaaaaaatcaacttaaatgtccaaatccttgtataccattagattttagcttgtgagaagctatgaagattccgtagttccaatattatatttcaacgaattgatattaaaca

SEQ ID NO: 4150 - DNA, 1357 bp, Glycine max
  Soy_ogl_1014 Gm03:41357744..41359100 Cluster 18
agataacatccaactttgtgctttcaagtggtataatatttgatttctttgagggaagattttgaatttcaactttgtatgaagaaaaaaaatatattaatagaactaatcacaccatgttataaatgtttctgattaatttaaacagaacataattgttaatgggaaattcttccgtctaatattttaaattttattagaacaatattatattaaaagggacaattataatacttgatatttctttcttcatttggtgacttaagtctttgtggaaattagttaagaacttgtgatgaagaaataaaaaagctaagctttatggaaagctgtagacggacaataatggctaatggatgggagaacaagactaaattaagaaagactttttctgtgtttggttgagcgtgagacacgtgcaatgtgtatgaactctaaagcttaaaatacatacttttgcgttaaattgaaaattttgccgtaaagatatagatagatgaacatggaccatggaagtggaaccaaacacatactataaaaagtatctaaaaatccatagaatactggattattttcaaatttgagtaaaaagtaaattaaaaatatctaagaaaaaatgagaattatcaaaatgcataactaatcgaaatatactttaaaaaataaaggaaaatataaaaaattaaagctatagttaaaaaatatatgcaattaattaaaaataattaaaaaattgtgttaaaaacatgtttgaccaatgcaggaataaattaatcacttattctttaaaatatctcccaagaaaattgataaaaataattatttaaaaagaataactaagcacatttattctttaaataagagtactttaattaaggataatatatttaaacaattaacaaataattttttttgtgaatgcattcataatagtatttttttttgttgttgtacgatagtacaacgtgatttaaacatagaatttcatacaaactatccaaatatcttagctttgggataggctgatatttaagcaatatatttttagatgatttatttatttatttaacgtactctaattaaaattaaatactacaaaatatcatgatattgttaaatattttatgtcgtaaccttttacgtacgtggatatttcacaacatgcattgagtgaagattataaattatatacggctgtaggagtaggagaacatgcaaggggtaggtggaaactaccttgtgtatctgtgttgcaagctaagtacagaacatgagagaacattgaaccctaccactaccaagttattgcacctgtttctttcctcacctaatataaatttggactttttctcattgg

SEQ ID NO: 4151 - DNA, 1636 bp, Glycine max
  Soy_ogl_1204 Gm04:3919401..3921036 Cluster 18
aatatttttttataattagagattaatttattttttatgcatagactttactaaaataagtttttatcaaatgtgacggactttaattattagtaaatgtcctgtgtttttaacccatagtaattaagtaaggaattccactaggacttataatatttaagtccgaagagttaccacaataagtcatggctgacactttttcttctcctaacgtttgattgtttatgtccaaatgaaactttaacgtacacaacgaattacatagagagtgaacgaagctattatggtgtcaattaaaataattcatcagacgaagaatatcgttgagtagtacttgactacttgtttttattgaccaatcatcatttaaaacataaaacaaagatggggtaaaaaaagatgcgatagaaaaaacgatgagattgaggggaaaaaacataagcttgtaggacttgcccaaggaatccgatggtttaggggaaaatagaagaaaactctaacatataatggtaaataaataattgaagtgtaatgacagaggtctgtgctgacgatttggattttggctgggccatataatcctcgaatttccatgcttgatttgacctgcaagtttgaaaaatcagtcatttcttgacaatctcattccttagtagtcactagtcagtagtacagctgaagccaactttctctggttccttagtaatcttttgaagacttaagactaaatagttaatttagtattgaatttatattttactgtaattttaatctttaaaactaaggaaaaaacttcaataaatctatgaaatattttttttttgagagagagaaaatctatgaaatcttctagaatttcacttctagtattcctaaaacacatatggttgctttctggttaaaagtaacgaggacaatcatgcatataagttagttaattaagaacggaattatgcttaaataaataaataataataaaaggattgattgggtcatattccatattgaaggagagaaccgaagctggcttaatttaattgtcataaagtgactgcggatttggaacctcgtgggaaactttttgtgggtggtgattggtgaaactgaaaatgaagggttcaagagtcggacaagttgactttttcataaagtgactagtacgctatctattctacgtgacggcttcgagttacttgcctttctttatgcataaccatagtgcatgcacttgacccagccaagttctatatattactatgatttatagacaatgatggatatcaaaattcggtgtaggatcaaaattccaaatatctcttggttagttttgttttttttttaaattatttacacctagaattaagaattaaatatgagaaacatacataattaaagttcaaaaaagaatatgattgacataattaaaagactcactatttactaattatatgaagttttatttgtaaaatttgcaatttatgtttcccggccgagagcgatcaatttattttaaatttctctttttaaaaaaattgtgtcaaacataatgttacaaaagatctaaaaagtaaaaatatctttattaattaaaaacataaaatagtaggtaagctaactttaaaagcctttctttttc

SEQ ID NO: 4152 - DNA, 1600 bp, Glycine max
  Soy_ogl_1263 Gm04:6819901..6821500 Cluster 18
actaacgtgtttccgaaaacaaaattaagagaccaacaatgatcatgctatgaaaaactggaaatagataagatgaaaagaagggaggggaaaaatatttatacccaaaatagagatataagattggttgatttcttaaaaaaacgtaaaaaatgtcataaattgaatctccatagctaaaaaaactaacaattaatcttgataaaaaaaaagaaaatatttatacccaatcgacaaagaatggatgagcttttgcggtttgcttgcccttttcccttttattattagctttagcttttggagggaaacataaaccaattcccccaattacccacacatctggaaatcgaaaacttcaatctggcgtttacagaaattaattacagatcataatagtctttcgtaagctcaaaaaatttggattattagcctggttagaggtgtaacgtaagaaccgccagacacaagttaacacgcggttatgatttatgaaccttctgcttcagaccattcggcatgcatgcaatcactgcaaagataggctctttttctttaattatctcctattaaacccccaccaccctatttgattttatttttatcagccaagatgaaaaagaatctaatcctttctttaattttcgtcctaataaggaattaaattcacgaagattagtttctagtcaggtttatagcctgccgtttgtctttttctttctttctgccgatcaagtgtgatattaatgttctactcaaaatatttgcctcaagttaattaagtgtgatatgttatacttttttttgctataaagggtggcaaagcctagtgatatgttatactaaaaagtatagaaatatctctcatttgaatcttaaagggaaaatgttataagtacagctgtacatatctttggctccataagatttatagtttatacattaataaagaagaatttgcaagtaaattatttaaaatggagtcacatacaaatttaggtcagataccagtaatgatataaaaaaaggtaagatgccaatacaaaattgtaggtagtactatccggttatatatgcgcgctagttaaatttaggtcacatacaaacacacaacaaataatactactttttttttactacacaaacactatacttaaatagcatgataacttatacaaattttgttagatataaaatttaataaataaatttaaagattatatgtgagtgggataacttataaataaacttatgcatgacataatatattgttagaaagagatgataaactttaaagtataattaagtcttgaattaaggattaatctcacaatgaattcaaataattaaaacttatagaatacctcgaagtcatagcggaagttaaaatctctaattacaataattacaagtaaataaataaatctaaaagattatcgtacagaaaaaggatcatagaatttttaaaaagcggtgacaaccttttgtccacgccatgtgattctctacaggtagaatcggaggccaattgttttataaaaaaaatggaatgaaatgcaaatattaagtaaaaataagtacgcttcggtgacgaaaaataagt

SEQ ID NO: 4153 - DNA, 2139 bp, Glycine max
  Soy_ogl_3459 Gm10:39699001..39701139 Cluster 18
actgagatagatcagctagcagcgccaaattattattccgcttgacatataaaatattactatctacagtataacagttttatttggcttgaataagattaattactttgatctgtaaaagatatatatgtgatcattactaaaaaaacggcacctaattatacgtgtgtgagatggtattcaaatgctttcaaaaggttctttctattctcccttcagataagacgtggctactggcttgaatgcttgatctcacacaacacaccaaccatcactcatttactttaacggagaaggaaagcaaatcaagaaaacttcagcagccaccaacaattggcctcatggcttccactggtacccatcgttaaagctatttaatttgggatagtaataattttattcagctcgtacacatgcaatgcatatactagtacttcattatttatttcctcgtcgcgtttttctgtaattaattaaataaccatgttttgtataaattaatgacaattaacgtgaactaaattgttggtggtgagaacaactccaatcagattcaacaagttgcagtgcagatagtagtaagagaacccaagcaaacatggttgtcccaatcatctatcaaactacgcccctattataattttccttctatattgcgagatagcatttgtgcccacttgcacacatttgtctaattcacttatcgtgacatctgaacagtatttatcatgacatattgtatatataaaatattaaactgttggtctcaaagacggaacaagttgacagctattaataattaacgcgagacaagtacgagtaaaggaaataacaagggaccaatttgcacgataactaaaatgatttttcagtcgtctgatctccaataaatttatagatcgatcaatcattttcccgaagataatagtcccaccactgtactcttctttaatactcaatatgatttgaaagtgaaaattcatttgaagtaaatcataatataatctgctcaaagttgtctatttgtcaaagataaagaaaaaccaacagaagtacataactatttaattgactactctatcaaaaaatatagcaaaagccttaaagttacaaaagtcacctggcaattcgttagccttaggtttgctacaagcccgagaatttctgtgggctttttttaggtccttgaggcctgcattgccaatacttcaagacaggtactctgtttagttcgaggttgatagtaagaacttcaaatcagtgccacatggctgtcgcagggaagacacttcgtgccactaatccttcgagtcaggaaagatatgaatatttaataaaaggataaaatcaaatttgatggcttatctataattctgtttaactaccaaaaaacaaatctatatttttgttttagttgagttttttaagttttgaaaaatatttttttttcaaagtgttttattagattaggttaattatttcgttatttattatattaataaatcgtcaacttaataacacgcagcaaaatacgagaaatgttacatcagattaatatttatgacatcaatcaaaattaacaatattaatgtaaaacattaaaggaatgaccaatttaatctaataaaaaaatattttaaaactaaagtaaaactttttttatttaaaaaatcaaactaagataaaagtatagataagaaaacaacattctattttagccttaataaaatattaaattaaacttgtactatattatttaaaaaaattaaatttaaaatacaaagatagttttagtcacataagaaataggacgtatgactctgagtgataccttgtactttttatttgttatataactgaatgtctcatccttaaaagttcctattaggtatttagtgtaaaattaattgatattaaatatttcaatttaataacatttttactcaatttagcaccattttaaaaaaaattaaaatgtaatttataactaaatattaaaaaaattaaattcttattaaaattaaattcaagccatcacaagacacccttttaagattggcaaacccaaaaacagaaattagttattttattaaaaacatatattttttttaaaaataaatttaaataaactcacccata

SEQ ID NO: 4154 - DNA, 1500 bp, Glycine max
  Soy_ogl_6492 Gm19:41646401..41647900 Cluster 18
gaaccattaacgtaaatctctcttatatgatgatcacaaattcgttattatcttgtccatgtttctgtgactagcgccgattagcttgtcttggcgtgagcctgcaatttcagtataactaagagagtcccgtacttcaatattccattattaatcaatgtccgtgtaccaaaaagtcttaactcgattggaaacaacataaatcaccgagcgacacattgctgaatcacaaggaaaagaaaatgccaaagagctaacttctaacaattatgttttgttcctatggaggatatgtcgttgtgtaatcaattgcacttttactcttgataaaaaacagagatgcaagagatagacgaactaaattttcttcgatctgaccatgtggttttctgataaacatgcatgaaggatagggtaaaaaactcaaattggggctcaaatagggtaaaacgtatttcccttttaatgctagtaaaataatgaaagctattttaatatcagaattaacttaaccaagaacaaatgtaacaaaaacatcagagttcactgtaataagaatttaaccaatgctataaaaacaaaaaaaaaaaatttaaccaaaacaaattaaaactccattaattagacaagttcaacatgtatttagttcaataaatatttaaatcttttttaaaatatgaaatataaaatactctccccaataaaaaatttcctttgtcaagtaagttggttgaacaaatgtgtgaattattatctattttctaatactacttttaattcttatgaataaaaaaataagttttcctttaaattgtttagtacataaatgcccttaattactcaatattttttctagtcaatcaacaacaaatataaagaaattacttgagctctctctcacatgcatatgagaaataaatagtgagaactttctctctcattaactttgtctctttgtatagaatgcaaaatatctttatttaagtaaaaacgcattaattaattagataaaaagagataaatagaataatcatctaataattttaagaaaggtaatagatttttttattctaataaaatagttgtatgatttttcattttattccttttctttctattttacaataaatacatatgtaaattaattaaagattaaaaaaataaaaatataattgataaaagaaaaattcatgtgatcttcaacaactttacaaataatataagaacaaaaattcgataattaaaaaagaagaaagtatctttggatcgaagacgatcttattcaactattgggtattaaatataaatattttccacaatagaaatccgaacattagttaacttacgtacgttgaggtagactatttcattccactaataaattcaaccccttcgtaaataagtagaaacttatattcattagaaataattattacgtgtgtctattggttcaatatttatttctcatcctaaccctcgtggtggtcttcttgttccaaa

SEQ ID NO: 4155 - DNA, 1400 bp, Glycine max
  Soy_ogl_6608 Gm19:47249501..47250900 Cluster 18
aggtatatatacataagaattcagacacactttagaatttcagtcaaaccgtcattcactgatatatatacttaagtaactagtttcttattcaaagaatataattaaacatggagctctccggcccaatgctttctaattgtaatttgtggtttactcaaactatcattttacttagtaaatgttattgaaagactaatttatcaacacctttaacactaaagaacaagtcctctaattgatacttttttcacactcatatattctacaatcaaacacaacacatgcatgagggacctaaatccttttttcaaactatggctattacagtacagattaattttttttattgttttccccacatacaaatatactggagtttaataaaaatgtaacagtattactagtattcataataaaattgtaactttaaaacatttttttatacctaaatatctgtttttttatccctctaaatatcataatcaatttcctgattttgatctcacttttttttgttaaaattgtaatttaccgtacctttagtatttctttttctttttttcaagtatatatagtccgtctattagtctttcatttgtttttctgtgttcttaactatatacggaatcaaatgaaaaattgttgatatttatttagagagactaaatagacaaattgaaatgttaacaaataaaatattcagaagactattaataaaaaattatataagaaagaaaatactaacaagtttcaattctaacattttaaaaatcagcgagtgattaaattaataagaaaattgtgatcggggaattgaccaaagaatgggaagtatcaagtatagttgactagtgtgacgataaatgactgcaaaacagcattattctacaattcagaagtctaattgattgtaaaaaggacactaaagcttgttggatgcaatctggctttcatgtatatagatagtatggctggatggaaaatcgatgcatcttttctgcaaagtcaaattaattcgatgagtttaaaatttgtggagttggctatggaaaagaatgaggatattcaaatactccttcttttgctagagtttaaaaattaaatcattgagttgagcttgcttatatgtcgcaaaattatggtaaggcataggctgaatcctctaaaagatagatgtaaaagtaaaacaaatggttagttggacgctttctatgatcaaggatgggcctagaaaaaaaaaaactgttttcttgagattgaaaaaactgggtttattataaagtggaagctaccatctacagaaagaataacccaacttggagagttattattctcaacctcgtttttggtaagttcatcccagttgttttcaaaatattttttttgacaaaaacacg

SEQ ID NO: 4156 - DNA, 1472 bp, Glycine max
  Soy_ogl_640 Gm02:44226729..44228200 Cluster 18
taagtcaagtattgggtttaataatcccatattgaataatttatagattttttaggttaaattttttgtttttttcttatcttttttcatttcctaattattttaataataaaccttacaacccacattgccaactaaaattattccaaaattaatcggattcaactattttgatcatattagataatttagatctaaaaattacttgtgcttgcctcaacctaatcaatgatccctttaataacacctcaatttaaagtctttgaatttaaagattacctaaaacttacattttctttgtattgaaggggggaatttgaatttagaattcgctagatgtggatttatcattctctactcaatcagcggcttaaaattagctaaattaatttaaaataggctaacatattagtttaataataaatatatcaagttctttgttttaattaattttaaatttacttatcttcttaaactttatccaattcataatattttttaaacatgttcaactagttgacaaaaaaaaaattaggtcaccgaatttttaatccaaccgaaagttggttaatcaattattaatcatgaaaacaagttgtatagcttggagataatgtgagcaaactctatacgtagcttaagaagttgaattttacttttgaaaaaaatacctaatacttaacgtcgagtaactagacacccaaataaaaattagcttcacgcttaagaaatgaagaaaaaaaaagctttatagcccgtaaagaaaaaggaaaaaatacatcataaaaatataaaattaaaaagtcaattctaatattttattggcgaactaaaaacattttacaatgatactgaaaattgattttttataataaaaaaaagtaaaattaagcaaatgattttttaaaaattatattttccatataaatcctaattttcaactctgcttttaagagattaacttttaaggaatggaaagatacttaatagcccgaaaaaagaaaaaagaaaaaggtgctttatacgaatatgaaataaaagcaaaaattaatcttttaattttttttcttgctgtactaagaacattttctagtgccactgacagattaatctataccaaaatgtaaaaaaaaaacaatgtgatttttttaaaggataaattgacgtggtttctatacacgtataaatcataattttcaaactatacatacagtcaacatcgtttttttctttttttgtcaaaagttgtagtttaacctttgagaagggtattagtgtagtactacgagctgaacattaacgcagggcacagtcaaccatgaacttgttctgattgaagctgaaaatcacgtttctgccccaaataaatgaatgagcggattcaatagtatttatgatgtttgactactttctaatcaaattactgttatgtttggtggatttttttttttaaaagatgctttcaaattaaa

SEQ ID NO: 4157 - DNA, 1600 bp, Glycine max
  Soy_ogl_1860 Gm06:8548101..8549700 Cluster 18
cttgtgaactcgatactccagtgaacctagtacctgaaagcccaaggatggcagaattcaatgccgaagaagttgcgaagccactggaggacataggtgtaggtccattcaatgtggagttctgctgctgaaagctagggttctgcaacaatggattgtgttggttcccttgatcttgctcccaaagggacctttcaaatttgaaaatcaacgatttactgagttaatatagaaaataacaaattattgtagaactcataagtaatgttcaacgtttgaaattagtgtactgcattttcccttgccaacatttgttaatttaagctaggaacttgccctcgtatggctctattagatacacttcccgttagaattactctatcgttaatggaaaaatataaagagccttacataaaggagagtgtccttaattaggtcagaaatagtttttgctaaaactaaaggaaactggttatccactaaaagcggccatatatattgttatcttgttcatatctagttatttatgaattggtcattgccttctataaatgaagagcttggagtagtgaagagcaagtaagagagaagtttcttctcaagagaaaaggacaacctcctaaagggagagagggacaagcctctcaaaaaatgagagagaaatacttgtaatactcaacttccaactttcttctcatgatatatttaagggggctttcaaactatgtcgaaaaacataggagaggccaaaagagaagagaaatatttgagagttgagataggagaggccaaaagagaagagaaatatttgagagttgagatcagtacaaatgaatttgattgagtgtgcaagaattctattacgtactaatcacacaatgtgatttgtataagattaaatccaactaattatcatccaattataattatgtgtaactaattaattccaaactaattaagtatatacagcatcttgatattatatcttcaacatattgtactctcttgaaatagttactatgtaatcattcaattgttctaggggtcaattatgtcctcggacaggagtttatggcctaatttatattacgagactatttttttatatcaaataaactaaattaagatttttttaaaaattctattttgattaaaaaaaattactttaaataaataatttaaaggtaacctaacatgtcgatctaaaataataaaaaatggttagtatcattattacattaatttttgtaatatattaaaatcatatatttatttacttttttcaatatagattaagtatcttcatctatataaagagtcaagtttatgaacttgttaaagcataaatttacaccctatttagagacttttaaatcagatatcttaacagtcgtattaaatcataaaaatatgtttatattgtataagcaagataatctttttttaaggcaataaacaagataatcttgatgcttataaagtttaatccaattattttcaccaacttcatgcctttaacagtaattattttaattttcaaaagatttaattatgattaactttagtctctcgaatcaaaagatatgtttattttaatatc

SEQ ID NO: 4158 - DNA, 2300 bp, Glycine max
  Soy_ogl_2214 Gm07:5406501..5408800 Cluster 18
tcacaaaaaagggcccctctttctttatgtggtggaggatgaataaacagaaattatctttgttaaaaagctgccaaagactgaaccaaaggattttatttctgagatttggatggaatgaatgccaagctttcttgaagagaaatggttggattagttctcaagttttttctgcaattaaaagtttaaaaccataatcctcgaaattaaaaaaatagaattcggattctactatcatacaactttaacaaaaccaatagaactagaccatcttctatcaactaagaagttaagaataacaatcatgcgattagaagaaactacgattaccaaaccaaatttcaagaattgatataattaaataacttttagggggttcttcacatgggcttatatgtgtgaacatcaaatataatgacagaaaactgcacaatatttgaaccaattcagttaaagaaagttgcaaactcattacaagctcaaaaacagtatatactagactagacacaattttaaaagaccaaggacaataatttaatctactattcaagcaaccaaattactagtcactacaagcactattacaactaacaagactgagaatgtccatagcaatatgcaaaagaaacattttcagctaaagatgaaagatgatgaggagttgtaaatctcaagaccgcttcatgtgcaaagttaggggttacaaacccacttatgctcccccatttcaaatcttagaggaacatggtttgataaaaataaaataaaaaaataggcacatgatctgattgttctgtttaccctaaatcatataatgaaagacatagatagttagatgttgcttttcacacgtattatgatgatcaaagatcaaaacatacagcaaggtcaaaagaaaaagttaacattaattgaccatagcttgacctatctttcaaattgtttatgaaaggagcatatcacaagttcaaacgcacttcatcccaaaagccacagtatagctacaaaagaaacatctagctagctagaaaataagacatgtcccattgattccaagttttaaacctattcagtcactatcaatgttgttcaccatttagccttcaacttcacaatccaaacattataacaaatcaaactttcaaaaggggaaggtttattcaaaccacagaaaacatgtgcagcataattaaagatccccgacaacacagcaaagctactcagcaaaggcctattgtttctctttagctcaatgtccaattataaatgtcacatatggcattaggtttggcctacaagtaacatgtgctgtgtttgaagaacaaaaccaactaaaattgaaggcaaaacggttaagagaatcatgcaacagagaatgaaagcaacctcttaacttgtcaaaattttaacaaggtcatttttacactggtttccaaaaggagagacctattgaaccttcgaaaattcacgagattctctattggcatattattaaaacacagaaaatgcaccaatcactccaaaataatgccataagtgggctttttgatcgtatgggggcagtttttttaaattttttttactaaatagggatagtttttgaataaatttccaataagggataagtctttatgataaacacgattctctagttgaagtcgtcttcatatctacgatttatgtattttttttattaataatttattcacaacttttcattacgaagtgtttgtacctacgacttattaattttctctttttgaaaacagaattgttattagaagtcagaatcaatggtacaacttaatttttttaaaaaaaaattaattcaattgctgcgttagctttttatttttcattataatcaaggagtcgtcaacatattcacggcttcatcctttgttttttttttcattgtttacttttagtttagaatttttaactttaatatattattgttatatttctatgcagaatttaagcattttatttacaccattttcttttaagaaaatgaaaacaaataatttaattcataatgttagaaaaaaaaatataaaaattaacacgtttgtaagaaacttaaaaatagcatatattttttttcaaaatataatatttatagaaaaaaatacaaaactagtttgcaaaaaaaaaaaaaaaaaattggaggaaaggtaaagtcaggtgtctagattcacgacttcactaaaatactttctaaagaaaactcctttaactaatacaatattattttttcacttttaaaaataaaacttaaaaacaaactcgtatttctt

SEQ ID NO: 4159 - DNA, 1156 bp, Glycine max
  Soy_ogl_4126 Gm12:37620045..37621200 Cluster 18
ttaaatgtgagatttatactattttttaattttttttctttaatagtaactttttcctcctcaaccaaatcagcccttagcaacttaaatattttgaagcatggtccagacaaaaagaaaatcgtaacaatgacacaattcttgttgtttgcttttggaattcagggaaacactatggttgaaccttgaacagaagtcccccctgttcatttaatgcccacacatggttttagggttttagctccttaatttattgacagaatctgacacaacaactatttgttatagagacatgggagagagggagggtattggactcattccaaactatcactattcacggggagcttatcaacatttttaacgtcagattttttgccttttctctcccaccaatcgaatccatacgtagaggtagagatcatgtttatcctacaattgacttcaactttataagcgcatgtttggaaacagataaaaaaaatatatatgtttattcctatttcttttttgtttgtgtcaaaataaaaatattctaaaaatattaataaaacaatctttttaaccctttcctaaaaaaatttatatcttagttttatttttttcaactaagaatatttctgtcatataatattttattacatataatacataatgaacaaataaaaaaataggaaattggataatttgattaaataaattgaattttttcaattaacttgtaaaaaaaattgcttttattttcattttacttctatatgttagattgcattagaacttatgttgcaataatgttaactataaatcagacaacactaattcctttaatgtatgagttcatttttatgccctaaattttttcatatggtaacgcaaatgtataattaaaatggtaaaattattattgttagagtcagcatattgttatatatgataatttctcatcaatttagtaaatatcataatcatccagcaaaccaagtgaaacaggttaattctacatataattttcaacaatttataattgtttcactgtgattgattggttagctggacttgatagtggtgtaaagttggcatgttttttcgtgaaaactatagaaaaagaaagttcacaagtgaggcctttctggtttctgttataggaaataagccc

SEQ ID NO: 4160 - DNA, 1991 bp, Glycine max
  Soy_ogl_6280 Gm18:59662990..59664980 Cluster 18
ttttaattaatgcccttaaaaatattggttaaatcaaaataaaataataagataaacagggttattaattaattattggacaagtgaatatcctcagagtcgttggtcatcctctaattgtgcatattttcataaaggtactattaaacatgtgaacgcagttggagttgtgtgcacatgcatgtgaatctcaaggatgatcgaggtatgtcttcacctataaaagttggttatgctttatgacgtgtgtcccactttgtcaagtggtttatagtggtggccacgaaagaactcaaaacaccacataaaggcactgcataaagtgataaatataagttagatgcagcaggaatcatatttgattttttacatatcacgaatgcatgcaaattagctcattaacaaaattttacattggacaaagaatgaccgggagataatatcttttgtcatccatccacagacacagttatgcttctactccattcaaactcctaaatagttgttgatgcttctcctcagtgattttacacgctgataccggtaccaattggttattcttgtatgttgtttttctatcttattttattgtgtgtttagccccttcgtcaaaaaaaggaagaaaaaaaaacattacaatttatttggatggagtaatatgcccaaagagacatgcaaagctagaggttaataaaaatgcagcgtttctgtgatgctaccgtcagagttgcgacgttgtcagaggtgaagcaagccaacattcactggtccactataaaccacttgacaaagtggggcacacgtcataaagcataaccaacttttacaggtgaagacatacctcgatcatccttgagattcacatgcatgtgcacataactccaactgtgttcacatgtttaatagtacctttatgaaaatatgcacaattagaggatgaccaacgactctgaggatattcacttgtccaataattaattaataaccctgtttatcttattattttattttgatttaatcaatatttttaagggcattaattaaaagtaaaaaaaataaaatataattgatatacccttctgtaatttctattacattcctaacatatttctttaatatgtagtctaagcctttcttgtaagagaaaaaaaatagttgggatttttgtttatgttgcattatttaaacataaaacaattaacatgattgaatatggtagatcggtattttatttaattacttttattttgttatttgtttgtatatataaatttctaaaatatatcttaaaactgaaagaggcaatttttttattgtcattaggatatacaagaaacttccattttattttattatttagatgatgaaagcaccgcattattttatgaagttaatagaaaaatgtagatcgaataccttatttttggaatgcattagaattataaataatgatgtccatcgtggttaaagcattctaagattcttatataattaaacgttgaaagcaacattccaagacgttctttacaaaactatcatcctcaaagttcattatattacaaaattatcccacatacatattttaagacgaatttttaaaatgtcgggtcgttttgctgtagtagaatataattttttttagtaatgagcttaggtaaagttatacaacgttgtagagctcattgatgttgatgccgttaatatttgttaagttgaagtagcaatacgaggagatcgaagtagtggaagatccggttgaagagtttcacagatgtgaaacagagcccgggtgagaacattgcttgaagatggtttggtcgaaggcaaactcacccaaaagtgacgccaacgaggtccattattctttcatctttctttaaagtgtaaaaagggtgttggaccagttgatgaagggctttgggaagcttttagggagtgtgtgtttgggaatcaattataaggcaattcaatgtggaggcaagaaaaataaa

SEQ ID NO: 4161 - DNA, 1337 bp, Glycine max
  Soy_ogl_6281 Gm18:59666091..59667427 Cluster 18
taagcaataagtatatttaacgatatttttcgtatttcaaagaatatttttcgtaattccacttttgattcagaagacatgttctgcaatacagtatccattttttcaatacgcttctccctgtaaaacttttctatgttgtagcatacttttctatacgagaataactatttaaaagattagaatatggaaagtattgacctgtgaagtgttggtagaataatctttttatacctgttacaagtctccagtcttgttttgaaatcttaataaggatgaaagcatgcaaatccttgatgccctgaccaaccatttgaacggggtaattttaagcaagatatagaataagttggcaaagcagatactgcaacttttaataaaacttattttttgtgtgtggacatcttaattgttagttaattattaattatatttgaaggaaatgttattaaaactcctttcgtaaatagttcatggaaccaatgttattaaaaaaatataattattaattatatttttcgtgtgtagacatgttacatatttattcattttatttttgctattttttcattgtgtttctaatgcgaaaaaattgactcaggaacaggagcttgatgaagagaatgttgattctgaagctgatgatgaggtaattgtagttccattttttcttacaaaaagtacaggtgattgacaaatatgattggagtattgatttttatgttttatggaacctgacaattgcttgatccatgctaaattcatccaaaattcagtcaatggatacgcaatttaatatgcaattattggaggcctagtttaatgttgagcatgtacaacccacttctgttaagtatactcaataaacttagtactcaataaatttcaattaaattatgataagtatatatcgatattaacatttaaggatgattaaatttttgtatagacaataggcaatatgagaatgtcccctagaagaaagaaaagaaaaataatattctcttaaataaaggatttagttccaatattagtctcaaaatattgaatattagaaaaaagggtttgattcatcaaaacagtatgatatataaaatatatttatcaattaagaacataatgatatataaaaatatatgataaaaaaattaacgatcattagttgagttaagaataaaaaaatctacacttgtcttttgtgaggtaaatttaattaacaagaaaatcattatataaacatgctaaaattctaaatatcgctaaatccaaatatatcaataactagaagcactagacaagttagttacagttagatctcatctcctttaaatctaaac

SEQ ID NO: 4162 - DNA, 2791 bp, Glycine max
  Soy_ogl_6731 Gm20:33813601..33816391 Cluster 18
gcattaaaagttaaacccccttaattagatttttttatacacaaaattctgaataattatatattccttacactaatttttactaattttaaattctgtccacttttagctttagggtttttagtaaaactacatattaaattgaattgctcttattgatccatggtaatgcaattgcaaaagtaaattgatcataggtatcctaatgccgaaactactgctgccaatattcgagtacttatatgtgggtgtgggatacttttgtatcctaataccacgtgacacagtagattttttgggggggtttgcacacacttcggtggatggacaattcacttgtaatattttttagcatttcttgtgcagttaatgaaatttcaattgcagataaaagaaaataaaacgaaactaccgctgcactactatacgtttgatcgacaatatagatattttgcaacaatgacaattagctgcattcatgtataacttagcatctattggattatatttttttcattcttttgcagaagaaggagaaaggttatttaaccttataatcatgccaaaacaaacatcacacagaagctaaaagttatatctattggggagatatgtaatttgtaaaaaataataggaagagcataaaattagtcaaaattttgtgtataaaaaaaacttaaaaagtaggtccatcttataatataattattctaatttattgggtcacatgagatgagattatttaatcctatttctacttggagttctttagactacccctattttcatacatcttatttctcttcctcttgcaccaaatagaacggtaaagattaatatattctgaccacggtactgattcaaaattactcattcacacgaatttacgtatagtccaacaactctatgtttgttattacatgtattacctaccgtgatgtgcacaattattttaacattaatgtcactctaaactgcacgtcccttccaacaagcttccttttttttcgctttcaattaattagacaaaataagctcacaggaattaagtagctagtagaaacctagtcacaattcaaaagatgcagcaaaataaaccttccccagaaaatgtatgttcaaatacatataatatacatagatatactcctctatcttcttcttctttttttctcactaattaatattattatgctattataatttgtcagcattgtgatggcatggcgcatgggtggatagcagaagtgacagtgaaaggaagagaaaaaatggcagaaccagcagcagatatgcccctttacctaacgtatagaattaaatgtgtcacagtgacaacccaatctcataactcattgattggatatacttgtcattttgtttcatatatcataagaaagagaagagagaacccaggcttgcaagtagaaaaaaaaacttgtgctgaaaaaaaataaattgtggtggtggggtaatgctactgattaaaagtactgcacaaatccagcattattggcactggattgagttgagtgttgagcccccctaaagtgcgccacgtgaacagaataagacatcccttttatttgatttgttcccttcccttctcctatgctggctcttcactctttggggtattggatagtcccaaatcaaacacttgctcataaaaacaagaaatgaaaaggaaaattgtaagtagatggatgttttttctttgtcctaaaacaagaattatgggtgttttttaaccaaactcactaaatcagaaattaattttatctatgatgtgtgattgtcgttgatttaattaaattttatataaatttttttattattaaatcattttttacatgtaaacgcaatagaattttggtctaacattatgtaattggaatatgcatatatgtatatataataataataagaataagaataagaatttttagttcaagtggattcgttttattggactattatattcatgagtacgttcgtcctcacgtgagaagagtctagcttggtgttacaactaccatttattatatcagatatgattaagcaagttggaactttgatttctcttcttcttatgatttatgaaatgagtgggtttgcaaaggtacgtgggccatttttcttttctcttccgactaataatttggcagctaatgtacaaaacaatcaattaattttttcttttctttttttctccctagggtttgtgtgtgtatacaatctggaaagtgataaacttgtacttcaattttataagcaagtagcaaaagatgcatgatgagctgaatatatcgagatgaacacgaaacatggaaagttcgtcgaggcctcgttacaccgacagaagaagaatgggaatggacaaattaatgtgtatcatgttctttcaactcaaatagaaatagtcatgtctcgactgaggaaccaatgtacctagtctaggttaagcttgctgcattcatgaaaatggtccacaacatacaaggactacgtcggtttttgttttagaatactaaacaagaataaattaaattagtctttttcttatcagagatatgagtatgatacgtaaattataataaagtttatactaagatttagagtatcaataaactatacagtacagattttaaaatatccttctaaaaatgtaattgataaccatacactcttaggttgggaaataagattccacgctctctatagagtataaataaataattatttaccatattatttcttttttttttcaaacttattatcccttccgtcc

SEQ ID NO: 4163 - DNA, 1400 bp, Glycine max
  Soy_ogl_273 Gm01:51848801..51850200 Cluster 18
attgctgcttagattagtttgttttcaatgaaatttaaagaaactttttaaaaaaatctctctcacacacacatatatatataaagaatacattaattgggaagaatattaataaacttttttttaatgaaaaatcttgatgataaccaattaaggactagatataatatcaaattgtgaggtaaaaacaatataaaatttctaatatgatatattatgttcttgttttatttgtgtgaattaacctaaaaaaattattctgtgaaaaaatattttgtaaacaattttttttaataaaattaagtttcttttccatcgttggatcatcattttttatgaatgatgatccgtcgtcttagttttttgaaaactttctttaatcttctgttgtttaaaaaacgttttacaataatttcaaaaatgaaattcaactttgtgcttttctgcttgtattttcattttattcatttactatttttattttaattataataccaatacactataagaaagtataataatatatctaaaaaaaatgtttgtggtgccttcatattttgacacgtattggtagtttgatacttttctttaatagatcaataaataaatgaacttgtaaccttcactgtatagatgataataaatgtagaataaataatatactagtatgacttattgtatatattcttgctaattaatttttaattgttcaatgatctttaaggttacttttgttgtccgttcatttatatatttcatatgtttcatgtttaatatatattttttaaaaatggaaataaatatagatagaattttttgcaattattagtaattcataaattttaaataatgaataccataaaatatagagagagaaatacatcatacaataatgcatatgagttgaatcatacataagaaatgcaagtttcaatttgatgaccacgtgttgtgatctgatgaagctcacacgaaaggtcatttcagaaaaaagttgagttgtatcatgtattgaagattagataacgctagataacaaaagatacgaaggagacgaggaatgggtgattggataaaaatgggaaattaaaaaggtgaggagggaagcacggtgcacaaatttcttggggaaccgttcgagccaggtatccgcaccctggtgtcggacacttagcatacaatctgctaagaaacacacataacaaaataattaacaagttcagagaaatgacagctcctctttcatctcactgcatgcttagtctcactgtactgcgaccttacacacatacatgatcaattgataactccttcaccaccaccaaattgatcccatctctgcctttgtctccttcctctgccaagcaccccccatcatgcaaagctgtacaccacctaag

SEQ ID NO: 4164 - DNA, 1634 bp, Glycine max
  Soy_ogl_1825 Gm06:7248867..7250500 Cluster 18
gaaggtggtctgtcctcgtctagctttgttgtggataatgattttgctaagtacatagctggctgcggacattaccattatcatgtgaaggtgagtgagggtggttcttggtacctgtcaccctgcttattctctttctaacaaaatgtttgagatgatggcttgagacttgtggtaacaaaacattggaaagtaaacaatacatgcatgctaataataacggatggggaaaaaagtgcaaaacattagttaagggaaaaaaacagtgttttcaatgtaaagtacttctcttaatcgttgtttaacatgttgaaaatcgtattacatagaaagaacatgtaatgctagaagaatgtctcaaatatcttaactatagtgattatatataaaaattatgtagatcacattaaatctatattaacaaacataatagaaccatgttaataatatttttaataaaaactattttttttttcaaaaaatattttaagagcgttgattaatatttattagtttgcattgcataaagtataatattaaaataaactcgtcatatatattctttttaaaagtaaaatgtgatgtaatcataacttacatgattatagtgaaaaacatttacaaaataaaaaatgtttttactcctgaaaccgcaaacacgtgagactttatggtaataaaagtgctagaaaaagtagtttctaggttgatcacgagtcatttcctacgcaacaaaacgagaaggagcagaaaactaccccaccagatatattcacccttaattatttcatcaaaagtcgtgcttgtgatatctctcctctttgcatatgataactttattcttcttaattttcctttgtttagtcttcgatcatttccgtaacattatttttttggtgaaccatttccctagcatttagtattttttatcggaattaagatatatattagataagcaccagaggtgcaaaaatattacagcaagtctcgtgatcatcaaaaggaaccgaagtccatcatccagcaaaacacgtaccatatacaccccggtcccaatgctatacaaagggacccaagtccatcaccgtaccatttagtataatatacttcctttgtttttaactttttattgataagcaaaaattaaaattaattttacatttattaaagaaattagtaactttattgtgttttttatacagagctttattaaattgtttttttctggatgtattaaattatgttaatccttgttaaaaaaataaacttgtctttaaaactacgtacatttcatcctaatcaaacattcataattaataagaggtttatatttgatataaagttttagtgtaaacttatttgacttgttccatttaatttgttggttatacaagttgggccgggatctatggttaatgcgctaactcacaaaccaattatatttctttaaatatagtttttttatttattttatagtttattattttaaatatgaattgtcgtttaataatatatttttgttaattagtcttagactatgtttttagtttttattaaattttgttcttgttaagtcttttaaccttttatttttaatattaaaataattctataactattttttttattattat

SEQ ID NO: 4165 - DNA, 1433 bp, Glycine max
  Soy_ogl_3936 Gm11:37064378..37065810 Cluster 18
taaaactaaacacatgaaaaataattaaacgcacattagttgaacatgcacttcatatgccatttaagatatttatgataaaaattaacaaaattttcatacattataatttattattagataatagtataaaaattatttatactgtgtgcatctactcattcaattacaactatagcaagattaattaaaacgacacaattaataacaagaaaaaaggtaacacagtttgatgtaacgctacttttgtcattaaatagtttgaattactaggtaggaaattaaacccagaatagaagaattaatatataatatagcatgggggtaaggttgagggcaagcaagttcatatcactataattgtttcatggagaggtcccaaaacttggagagggtgtttggtattttggagtgattaaaaaaaaagaaaagcaattgaaaacgttggcaaaagcgaactcacaagttaacaacaaaaatggacgtcaaatccatagctttttttttttttttgttacctttctctctctggttggggtggggtaagagagagaaagtgggaaagaaatgtaaaaaagcaacgtgatgctgataggggatgcttcttcaggccaccttgaaaagcagtggtttcatacataccctgccaatattgcggtgatgaatgatatatgtgcggtggtggttgtagccttctagggttctttccctcaaccctttccaatttgaagggacctttgaccctttctctttttttattcatcaagccttattttcatatctaaaaatacttatacattaatttaacgtcactgaaaaaatataaataaaataacacaaattatttgtttaataaaaatctattaatgattacatgaaaccacaggagctttattagattcaggttgggttgaaaaaaaaatataattgagtacataaattaattaacataaaattatttttctttaactagagtctctagttcaaattttaaatgtttctttaactttagtttagtagaatatttagaattatatctaaatctaataaaagatatttgtttctaccaaaataaatatatttttattttcaaatatttataccaaaaacaaattaaaacaaaatgatgatttcataaattaaaaataaaaacaaaataaacggccataataattattttctcttctcactcttactttactccccactctcaaaagttacacattgacttagacctctgaccggtgtgaacgctagctaacatttgactcgatgagtccattatggcattatgcaaaatttgggagattctcagacggattgctatgtgtttgtagtcaagtttgcataatttaaattttaacgtaaggtttcctaattaataagcgatacaaaatctcataataaatcattactaaaaattatcatttgac

SEQ ID NO: 4166 - DNA, 1240 bp, Glycine max
  Soy_ogl_3937 Gm11:37066861..37068100 Cluster 18
ggtttgaacatagttaaaccatggtagaacaaatgaatcatgaacaagtatttttaacagttcaattctcagtccattttaaaataaattaacaagtcttgcaatcaaatttacaaattaaaattaattcttagaagcaattttataattaattttatttaaatgatagttaaatttattttaaaagtataaatatagatcaaatttaattatattctatcaacaatgtaaaaaaaaattcaatcataaattaagaagtttcagtttttttatataacaattcttataattatttaacaatttaattattatacaccaaattatgtacacaaatagttattttgagatagtatatgatatgatatgcaaaatatatgtatatcacaatttttattttaaatttttttttaagtaagttgaacttaagaattagaaatttttcaaatgttttttatttataggaatctaaaataatttttgaatgtttataataaattacgttttatttaatcaatcgaaatatatatttttttgacaaattcgttaaattaatcaaaaaaataatgtatacgacgttattacttagaagtggtaaatattattttggaatttattttaaaaaaataacaggttccctttaagagattaaaaatgaatgaaattttacttggaataaaaaaaattccaaagttacagacacgagtacacgacgtaatgagataatgaggatgagtgtggtagttggcccacggaaagtaagtggacgcagcatctctctctttttattcacttagaaaaataaaaagcaagcataaacatgatgatgaagacgacgaaggatgacgcagacactttgatactcaactccaccctctcccaattccaaaaacaccaaaacaaagagatcattgaataaaaatctccctcaactatgtgccccaaataaaaatctcacctattctcctctgtctacagtccataccatgattttaaatagcgttttgcaactatgattatgattgtgaccccactattaagatattttacttcattttaatgcaataatcaccctaattgtgacagtattaatcacgtttttttacaattacttaccatatagtttttttttactcaccacaatacaactgtaaccgtaaccacaatcccaatttaaaaccattgtcaataatgactataccatacatcataattcatacatacagtgtacacccagaattga

SEQ ID NO: 4167 - DNA, 1500 bp, Glycine max
  Soy_ogl_4486 Gm13:36489601..36491100 Cluster 18
cccatatagaagctaacttaaagacaagatataaatgaaaatccgagaagatttagttcaggaatattatacattaaactttggctcatactcactttgctcacatcagaatctcgaaactgagactggtgatttattttataaaatatcctattcctgtcaaagaacaatttgttttgtttcaaaatgtaaatatcttaagcaacactattaaataaaataaaaagagtgaacataggagagactgatcgattgaagcaaagtataatataaattatgactatttctcagagtcacgcgcgagggcaaggcgcgtgtaataatcacccagtgtaaacgagtgcgagtttcagaaaccctgcaggattgtccacgtggctccatctctggaacgtgaaactggagcgcgtggtggggatgggtggtgaaaccccgcaattcgtgcgctacgttgttgttaatgagaaacgatgcaccgactcactgccatggcacgtgtgctgacagcttaatctcccactcacacttgcaccacacaaaataaaataatgcctgctttgctctttgcctcgtgttgcatctcaatgactttttggcccaaccctttctttgctttcggcttttgaccatgaccaatatgaaattactatattgctcttcaagttgtcttcaacaatactcattaatttcaagatatgattggtatactgttgtggttttcaagtatatatgtaaatggggatctaatgttttcgtttgtgtctcagaaagtatttacttgaagacattttgtatgtaattaggagttgaattcttttaaataacattttagattttgtatgtaagagttgaatactcttaaataggattttggatttaagttttttaaatataattgaagaaatttttctattaaaatggtcaactagattttttggcaaaaaaatacttatcaacaaaattaataaatatttaacatcagataaattaacttttttccctaggtcaaacaaagattataatatttcctaacttattttggttgtagattaatttcatttgatgattggcgttggtttaagaatttttttcattgaatataaatagatagtttctccaaatataaatacaacatgggtctacacacacaaaaaaaaacagttactcttaattaaagaataaaaaataaaaaatatattaaaattattaatatattttcacctgatttcaatttaattaaaattttaatatatgttttttcaatatttttaaagtatgttagcacgtctactcttttttatgaactggagattgaaaacactatgccgacattgtgggcagaaaaatagcatgtacgtttgatagaacataaagaaaagaaaaaaatgaaattaaaataatataaaaagatgtggaatttatgtcaaaattttaaaacttttcacatatttttatttctttcctcaacaaccaaacaagacctaaaatatagacaacgaa

SEQ ID NO: 4168 - DNA, 1694 bp, Glycine max
  Soy_ogl_4798 Gm14:46956407..46958100 Cluster 18
ataaagaacgtaaaagttgtagagtgtgttttctatacccctacaaaatcttgtaataccataaaaatagaaataattatttattgttttagatttatcataaaaacttaattgaattttcctcatcataaacttattccaaacacattagtaaatcaacaggacaagaaatgaagagaacaagaatagaaaaagaagtaaatatataaataataaacataattattgttctttttcattttgtgcgaagcagcatatcttttgcgtggaaaacactgcctattcacacttgactctgcatgccttcgtttctgagctacaataatagattttcccctccaggtcaaatcttagtgcttttctttggaatttgcatgatgcatggttcgatcagtatacataatagaattccaatatgatgagagtgttaacagcaaaaattagactttaggggtggtataactagcaatggacccgtagcgtggtagggatttttagactttaggctaaaacaatgggcgacaaatgagtggaatgctcgtaatggcttacgaatggaacagatccaataattgaatggttggaaaaagtgcccccttcattggggaaggtgttaattgttcaaacttcaaagggcatgtttattttatgtacttcaacttaatttccctcaccgaatgatgtatattttaccaatatatataaattgtaattaaaattaatttaaatatatcaggagtagtatatttcaactatatggaaagatataacattaactttatctattttcttaaataaccatatcataaataatttttcttagcctttataaaaatgtttcataattcattatagcaaacctatactttggattgtgagtgtgtgactatcttgaagtgatattcataacacgcctattacactttttgcacaagaatattttggagtttgattgacaagtgacaactttttgtcatgtgttatatgtatggtgtgtttagtagagaggagcaaaataatattaaaaaaacatcttttttagatttatgttttttatattttattttaattcaaaaaaaataatctattttttttttatttttatccatttaaacaaacacacccatatcgatcactaatactcatccagtgcatggttaatcgtatttggtgtcacgaaagaacattcctgccaaacaaataaatgcaaactcgaatgcattaatgttccaaaaaaaattaattaaatgtcttagaccttataaataattatatgccaaataatcaggattctcataatattggttaagaaatttaaagtaaaaatatttttattagaagataaaaaattacattatttatgatcttttttatactctcatataattcacataataaatattttttactttaattccttaactaatacccaaaaaatactaattaacaagacccttattatatttatatacctccttactgtctttcaaattctaaattatgtcattcagtgtcaaagttaataaatcatatgaaacattaacactagacagatcttgcaacttactcaaatcctgatagagattttaaattttcaaacactctatatgatgatgaaagcatcattacaaagaaaagtataaatatcaataaattttagcaagtactcaacagtgatacactttaggactcat

SEQ ID NO: 4169 - DNA, 1624 bp, Glycine max
  Soy_ogl_5250 Gm16:2264001..2265624 Cluster 18
aggccccttagccgaggctgtgtatagaaattgcgtaaacaggcctgaatataaggggcctggaattgagctgggctgaatataacgggtctttgttcagaagcgatcagaattctgggaacttttttggatttgataacattgacaatgccataacggtgtattcatctggagcttgtcgtttcctgcattctcattattgttataagaatttttcattttattttagaatggattttctagtatgcaaggaagagtgtagaaagtgcattcctcatctcgagcttcttcgttccattgcacgttcatgttgtattcatagcttccattaggcaattaattacaatttagaaacaatttgtaaagaaattaagaacttgatctgattgctatttgtcgtggaaaaaaggcttcttgtaagataaaagcacacggagtgtacgttgaattgacaccaacagaccaattattattgcaaggaaactaggagacgctacaattgagcatgttacaaattatttcttgcaagttcagagttagattttttgttgttgttgttgttggtaaagtaggcaaattaagaaagggaaaaggataaacaaaagattacaaaggaatgtgctggatggccatgtctgaagtgctgcatatggaggcacttcccaaagtctaaggacgtgaccatcattgatttgtctccgtgtgtgtatcatttcatattttgagtttaaaattaattttaaatatatttttatatctttgattttatgttaaagaaaaattcagaattaattgtgtcaaacaattttgaatagtttctgtattagatttaaaaatttatattgaattttatcttaacttaattttataataaaaacattccatcataaatcacaaaatcaattttgtaaaaaaaaaccaacttggggaagaaatcggcagcatggttgctttccttgagaatgcgatgaataagagttagactgtgcataaagttaatgctatcatttttttttatttagttataatgtgagtttaattttcatgtaatgtgaatgtaattttttatattatgaactatatataacaatttacaattgaaagataatatatttttttacactattaatatatattaattaaattcttacactctgtaaaaaatttaaatccatatacttttagcccctctattttagtttagactcaagttttattttattttatggaatcacatatactttaatatcagagttttataaatcgtttgatttaaaaaatgttttctatttttattacaaaattatcacctattttttcttttattttttgtaatcaaatatttatatagaaattcataaaaacttgtattattttcactgcttttatatgaacttttgaaaatggaaaattaagaaaaataaatttacattttcaattaaaaagtgaaaataaaaatgaatttttccaatttaattgacctcttaacttttatgtaaaataaaagtgacgaataataattaaaaaattaagagaaacaaattaacttaaaatttattgaaagattaaaatcacacaataattataacaaaagggattacaactttacaagtataattaaggc

SEQ ID NO: 4170 - DNA, 2106 bp, Glycine max
  Soy_ogl_3785 Gm11:7115301..7117406 Cluster 18
cctaggctgctatatgaataccttaagagggcatggtatttactattgctttggcatgtggtaccaaactccaactggccaattgaatcctgagggcataccaatccaattttttcttgttccaaagccattttcatgttcatgtcatcagctgatcatgtttgacaaaaaaaaaaaactttaggttggtcttacatgcatctttatcatgcttaaataccactacatgttatttaaggatttgcaaaattaattttttgttcaaattctgtttaaggtatacatctagctagctgttctttttctccaccccccacttttccccccaaaaaagaattaaagcctgatcacatgaaccgcttcaaaataccataacatcgtatataataatgcatatttggtagtatttaatagaatcctttatttaattgattcgttctcaataattattttaagattatccttttgacgcatattcctattatacttatttgggatgatcctcttcgttataagttgttgactgatgcatgtttggtagtaaaaaattggctgtaattcactgcttcaactaaatataaatgtatcctcatgtcatgtcatttcatttgcccaaatgacttattatatcttccttttgtttttcattacaaaaagttaatgtgcattagtaactaaatagattaatattgagatcacaaaaaatttagtgatgtttttttttttaattacatacaattttttcagacctaattttaatttttttcgattgtagtgatcttttagtaatgaaattaattattcaaatagaagaattaataatgagctaaacttatggtggccgttggagcaactttggcggcacgtagattcaaatcagaacagtgtgcaaccgaacctgcagccatgttacaccagaaatagtctcagcctttacaactgcagactcattaccccaacaccagagaactagacaaggggcatgatgagtattgcattgacataaatttatgctttatctttcagcttctgtttgttaggtaagaaatttggaagaaaagatttagataagaattaaatttaaaattggtaaaactcggactgtattatcttttatttatgtttaattctttattaatctcttttctgtttttatttaattaaatatttttaatttttactttatttctcacttatttttaataatttgtatccatcctatttctctcttctctactcgtgcgtattctcaattctcaaattgatcaacctagcttagggactgacccttgatgttttatctagccctatgtatacttcttttgcattcctcacatggtgtaaatttaagacgtgataatatcaaggcgtaactctcaaaacagaggaaacgagaactaaaaaattgaaacaagagtactgatgtgtgaaccgcatatcatacactctattaacaatattttttcatcttaatatctttctcttccattcatgaatcatgtcatattccgtattatacgtataattttttctctttctcacattctaacacccaaatgtctatgggtgatgatttttcttgaaacaaaatcttcatgttatatatatatatatatcacccctttgtatttctagagggccacaatatagtgctattaacgatcacaaattccatacgtgggtcgacagaacagtcttttacaaatgttgtgtaacatatatacatacatatccacatcacatgatcattaatataatgtagtacgtacgtctgcgaagaaaaccccactttcatccatcattacatgactttgaatatgtaaagaggtggagcgaggtctagcgtgaggtacaagtacaatggtaaatggtgcaaggtggagcacctttatttactatttttaaatgacttaataatcaatattaacagttagataatgttaaataattaaacagtctgcctgtctatgtaggcccagttttttatttttttatcacttaaatatgttttcgattattgtaatttttttttaattttggtcattgtaaatttattttgttcatttttagttgtagtgggtttgtatctttttaattttggtgtcg

SEQ ID NO: 4171 - DNA, 1200 bp, Glycine max
  Soy_ogl_6876 Gm20:39708501..39709700 Cluster 18
cacgctcgtgcgtgatggcctacactgtatattacccaagggattgctagctaggttggatgaacttattataaatagatgataggttatgttttatattttttaaaaattgaaataaatatataggttattggttacttacactaatctggataaaaaaaacacactacaatttttgttcaaactagattcttcatcttttgagttgtaaacgattttttttttctattatcgtgagtttcatatctaaagaggaataaaatataacttaacttcttcttgtgttattctataattttataaacgatgataatgaataagttgataattgttcataatgtccattaaggactatgtgcatgtgtagagatagtcgattggccggtgttcattatttgtgggtctgaacagtacagttttatttggactaggagtaaaataaaaatgatagaaatagagaaaaaaatagactaaaaaatatagttacatgaaatgacaataaaatagttatattttattctttcctcgattttttgaaatattttacacgtaagaattttattgactcgtttttttgatatattttagttaaaaatattatgcacatctaaatttataatctctttaattatttttttgaaaagataaataaaataataacacttcatgttctggacactaaaataaaacacttcagttttttgagtttgtttatttattttattatattttctgtttaataaaaaaatatgtcgattttttcatttttatttcttcaaataacagtttttgctctattttttttctatctcttatgattcctcgtccagaaaaagtgtaaagtaactttctttgtagcagctctgtactttcggtttgggctaatgacgcttgcaattgcaacattcgatagcggccttgcattttgagtaagcactcctccaaattcagatgacctctaattcctatcgtcaaagccgtacgaattaaaaataaaataaaatattccaaccataaagtaatctatattatcatgcgcaggaacttccaaaatttatgtcacgtcagttacgatttgtttttttttttcttaatttccagtttagttattaaatttaaaaacctcgtcactataccaaagaacaaataagaaatactctatattaaaataaaagtaatacttttccgaataatgcgaca

SEQ ID NO: 4172 - DNA, 1463 bp, Glycine max
  Soy_ogl_7002 Gm20:45118301..45119763 Cluster 18
atatatatgtgtgtgagatacgtaggtacagagatgaaaattacgggtgtgggtggtactccatcaatgatcaagatttctatacatgacttgcttttcatgtgtttccaaaaataagtttcagccaattaatttaaaaaaaaaattaaaaataagtttcaatccatcaatatgtgtgtgttttgccgcccattagtttttttggtatgggtttttccttttttattcctggccaaaaatttaaaaataaaaaagacatttttataatttctttttctttttcaaataaatcgatatcaaaacttgggttcaattaattttttctccagaaaccaaacaatctcaaatatttgtaaattataatgagatgtttgataataataataataattttcctctaatgtttgataggatagggtaaataatctcatccattggtgaaaaaattaatggttgatatatatataacaatatgttctaatattaataattgattttctttatcaactaaaattatttttcttttactcactttaagagagtaaaaatccttgatgtagattggcatgcctttacattttaaactttagacattttcatacatggggtcaatctatttacctattggggatatatttttaccactttattattaatttaagttttaaatatttatagtataattttcacattttattacaacatttgtgattataatatacaatattaacaccatgttataaaactcgtgaccatgctatttgaatgaaattgattttaattaatatataattcaaccaatattaattttatgaatactacttttggggataaaaatatatatcaaaaggtaaatccacttattacaaatttacttgttattaaaatcaaaattttaaaattgtgtagtaatgaaaacacaccagggaaatcaatcttgaagtcgcttaattagatcctcccctccatctatgaaagccaatcttctaccaaataaacaaagcgtaaaaagagatttgcgtctgaattgactggctgtttaattaaattagtataaaaatcaaaacattgggtgaagaggtgcataggatccgacttgtgtgtgcatgtgctgctgttgataatcaatgcaccctaacctccatacaacacacatgttcattttgcccttgagatcattcgtacacgtttaaaggcaagatccaaaaaaattatgatttcaatcgaagcttttttttttttttttgtatttgtgttgtaaataagaatgaaatctctcctccaaccaccctttcttatttctattcttttcagtaattttgttttattctttcaccaataatttattataatgtaatcccttaccaattttgaatgatataactctttaacaattagatttttcatcaacttagtcattcataaatcatgaaataaatttaagacaaattttagatacaaac

SEQ ID NO: 4173 - DNA, 1680 bp, Glycine max
  Soy_ogl_85 Gm01:3373621..3375300 Cluster 18
attagacaaagaaaaacataaataccgagaaatacaagagcacaggagatttatcctgatttactttcaaagtaccaagttatgtctagttcctgacacagattggggtttttgcactataacccgtttatagatacaatagatatctaagtattctctccacaaccttctctagactccatttcttgctatcttttctcacaaacctcttcgggatctttcccaaatattcgtttcttataagtcttgatcttcaagctctaaacacactaacaatgtttaagatactagtgattccttccattctagattatatgatatttaaggctttgacacatctatttaggaatgtaattaatttattgaattttgaagaaaatattagataattttttaatatatcttttatctctttaattaatgagtcatttactattcttatacactactctcattaaatattaattaaggataaccttgaaaaaaatatttaatgcaacattaattttctaaagcagcgaaacatttacaactataacagcaaggacaaacaaatgaatggagggagtatgtttaatgccatagcaaataattccttttttttccccataaacgtttccttttataatttttcagaaaaaataaatgttgtgaaagaagtctctaaggttatataaatattctacatcttcacataatgcatgggaatattttgccgtagttatcttattataatgtcataatagtctattttatttcattgttcaaaaggagtgtataaatacaatagtctaacaagatgtacttgttttttttttttgagataaaaatacttattttatttcattcaaaaggagtgtataaatacaatttaattcttcttagcactttttttttaatgcattagtatttttttttaattttgtgcaaggctagtacatttaatattctccttttattttgtcactttttcactgagttgtgtaaaagtcttaaaatttaattttgaacgacatgacacaggttctaaaaatatattttaaacgattttactcaagttgtaaatggtttctggacaatccttaaaaattttcattagagacttcatagagttcagattccagacaatcacatttatatcatctgaacatgtacacttaccaattcttttagatttcatcccatctttaaagatattataaaacttacgttcttaattctaagattggtgatatttgaacattttattattttatatatctaactatcattgttttttattatacatatcacctataatacacaattttttctttctttcatatgtctctctttcactaagttttgaataatattgtggttgtctattaattattattttttaattccaactacgtcttctcatgggaaacgccttctaaattctaattcatgcttaaccacctcgtttcttttctttgccccaccttagacccacctcaaaaattgcaaaaattgtcctccatcacactgaatcaatttgagagagacaaacatcattagccgatatctttcttggcacaatatatatctcttaataaataacaagtagactatgcagagttggtatatttctatatgagatccatcctaccaccaatactaaactaattttcttctttctttttatcccccttctta

SEQ ID NO: 4174 - DNA, 1600 bp, Glycine max
  Soy_ogl_210 Gm01:48796501..48798100 Cluster 18
aattatgtgcactatccctccagatgcattgttaaaaaaaataaaaataaaaaccctccacaaacagataaatacacgcttgagaattaaagataatgcatagacgtttttagaagttgaatatacattacgtaaatgagggtttgtatactttcccgaatttcaaccgtttagttttttttttttggtgtgtgatgcatgaattaatttatgtaccttttaaaatatataaattgcatacaaataaatattttaaaattgtagtattatttaattttgctaattattaattagtaatagaagacaactttatgtcgtttttaacgtgctaagagatcttttcagacaaagtcgaagcctaaaaagttggcaaccactccttgttctcccaagtcacaaggggggccatatacaaagcctttcttgttgcatggaatataaagtattagaatttaattaggttaggctatcattttagaaagaaaaaaaaaagtgttaaagccgtatgtttaataatatataaaaatgtgtgcaaacacggtcaatattagatatatttcattattaaaatgataattattcccacacttaaaagtaatgagactaatctttcaggaaaaaaaatatcaatcaaagagaaacttttctcttcacatgtggggttctattcacatggttagggataaaaacctctacatatagttaaagaggatccaaactacttgttccttgtgttacacacattgtggatagatataatttatccaaataaaattttttagatataatttacccgggagtcaaaatgcttactatattatattgcaggaaaaagaaaagcttcctatatcacttgatatgatcgattaagtaatcaacaggatgatatctcaattattacttctgcaacttcattgacaagcggcgcatgacaaggaattaaacatttgtatttaatacactattcaaaattgcaaactattgagatggaagcttacagaagatgtacaccttataagttttactgcacttatttaataaacgaattatccatttttctatctccctatgttttattagtatatactaataatttcacaattaggtgaattgattgctttttgtctatttaaaatttatcaactaagtattgttttgtatttcattatttatgccaaaatctattctatttattttcgtataaaacttaagagtagcaccttaaatgttttttctagtgtttttaaactaaaattagagtttcactaagtaactcgcacaataaagacaaaataaaaattgaacactttaccaaagtaaaactctaattttaattaaaaaaaattgttatataaatacttataataatacagttcagttttattcccccaaaaaaactaggtattgcacaagagactagtgtctcaccacaactatgcatggataagtaaaaaacttggataattagaaatagaggaagagggagttaaggtaacaatttttatttttgattgtttttttttttgttctcaaaatttactttaattgcgaaagctaaaaacttttcaaggaaaagacctccatggccatgggccacatg

SEQ ID NO: 4175 - DNA, 2243 bp, Glycine max
  Soy_ogl_737 Gm02:48486358..48488600 Cluster 18
ccctctctttttccccttataacaaatggagatttttttatgttattttaattttcacccattcaaattcaaataatatatttttatttttattttcttattcctttcttatctatttcatctctaattcagacaaaacattaatttgttagaccaacatgttgttttgcatgaaataaaaaatataattaaaaaaatcaactaaaatgatcggttgaattttaataaaaattaattattaataaaactaataaatatttcatattaatatgattgtaaaaataacattaatttgttagtggtgagttcatctctctcctaagttccatccttatcggtatgatatggtggagtttactcattatccttagccaacaatgcaatgccatgtagtccacagaatcgcgcagaatcaagggtgaacttatctgcgaaatttcataatgtcaacctcgaagaagaaatcggattctgtaattccaagacatggatcggatatccttatacgtttaatagtaaatgctttagaacttacttactgttactaacgtatgatttactattcacagacacgattgtaccctatgattgacaacttttatcaattaagttattttgaaaattaaaagatatccatacttttttttccccgataattgatgatatataagaatatatgtttttgtctacgtgagatgtctcttaattgtaccactataacaataacaatattcgagaatttagtgtcaaaataatgtatatgtcttaattaaaagataaataaataaaagaatgtcaaccgcggaagaaaattaaggagatctcgattccatttaaaggaagtgtcttttatctgaaggtttttctttctttatttcggtgttagaacgttttttcttgtattttagaatatgacaattagaaacgaggttaattatgctatgaggaaaaaataaaataaaaggcataaatttccttatcctgtacgtcattacctatatatatgcttaaaaactacacagtaatacgtactctttgtttcttatgattaacagtacgcattattgtgttttttagcaaaaggaaaacatccaaattgctcaattaatggagtatcagaatattaacttttttgttattccattcgatggcaaagatatgcttcaagacttactggaaatcatctttgagtagatgcaaacaaacaacgtagtaataaagaaagtaatcttgaaggtttctccgtacgtgattcagttggatatataatgacttcgaaatctatacatgctattataatctaattgctaattattgactttgatatttaagtttattaagaaattgaaatagcagattttttaagtcatatgaatttatctcaaacacgttcagctgatattttatcaattgtaaaaatttgtggattaatattttggtgcagttcatttataaatgaacaaccttagcttgttactgagtccctgagtgatttatgtctcacactcaagagtatgatcttgcaacattcacaaagtaggctaggattcataatttgggaagtcattctttttcctaaagttatcaaagtaagcatttaccaattaaaagataaaaaaagctataaaaccttaactaaacatattcacatcctatttaattccattcatgtagttatatttcagaccaattatcaactaatacatgacaaggttaaacatatggtttctttttcttttcttttattgttaaacatctgtgtctggcccttttggtttgatctgtttgccattttgcgtatcacttttcagaatcacacttttggttctcttggaccttggagttgtgatactccgtattggtatgaaagccacacgaatgaatttgcaaacatacattggaagagaagagggtacatatagctaaaaatataccagaaagtaaataaaagtcaatattacatcattttgtaatattcacatggataaaattcgtacaaaaatcttcaatttctttttcatattcactcaattgttcattatcttcgtctcattttggctgttactttgattattagcactctgtttggagggaaattgagagaaagaaaaaagggcaaaaataaaatatcttccactatttatttgagtagaattcaaggagaggaatgatttttcgtgggtttcatatgatttgacttccatccaaaaatttcgtgaaataggaataaaatttgctcacac

SEQ ID NO: 4176 - DNA, 1400 bp, Glycine max
  Soy_ogl_806 Gm03:2026301..2027700 Cluster 18
aattaaacacccaaccaaatttgcacaccggacatcgggccaatacttgcttaagtacagtagtaatttaattatatatatataaaagtaaggatacaaacataaatgtttttttttttaatttataagaatcaaagaagatatgtatcaataaacaattcattaaattaagtagtaatatatgtatcatgactattttttgcggcaatacattagatccattaaccattgtcatccttaaatacagtaatatatatacttgtttttatatttaactggttttcttctgtatattatacataatttaaaaattatttcaaccaaacgatttcataatctttaaataacatttggcctctctcctttaaaagcttctcttacgtgatgtccacttacctcgtgattttaaatcaaatcgtatcttctgttttattttgccttttccatgtaattaattctaaaattaaatacctaattacaacgtgtggaggtcttctatgtattataagtggccaggattgacatacatcaagtaaccattaagataacgagttcaggacatgtcaatcagccttttcttattaccttttaaggctcgtttgaggatgtttacaattcagaaagtaattgctttttaatagtatttttcataaacgtactgatacttttttttttacctttttcggtaaaaaaacagttaccctaaattaaagctaattatatataattttaaaatgaagcaatgcatgtttgatttagcctttgaaatattgacagcatattccaacgtaaatctaatgaataaaaataaaaatcataaattgttaaataaaattatttttatctcaaaatgtaattttacaactgattctcaatcatactcttatatacaaattttacatggttttgctaacaaagcatttttttttatatatattagacgactaattaataagcatacttaaaagattgagatatctattaactaagttgattttgttgtttcaaaaaatgtataatgccattttacgtacagtgggcaaaaaaaaaaaaaaaaactattacctccacgaaacaaattatgttgcatggtacattcttgtgatagaaaaaaaaataatgctaactttactgagacataaatcttgtcatgttcgacaactttttttcttgcattataatagagagaatgacagcttgagcctagaaattgggaccagtgcgatagctgtgtttctgaatcactttttccacgtaaagaatagccatgagttttctttatccaaagtttggctgcaaatgcatgcattgctaactttttctggtcgacatgtcatcatcgatcatatcatcatatctcagcttgaagggccggtccaattagaaataagatctaaaac

SEQ ID NO: 4177 - DNA, 1200 bp, Glycine max
  Soy_ogl_1384 Gm04:44199901..44201100 Cluster 18
aattagaaaagttaaaaaagcatttttttttccgtcaattatattttcacactccaattttatataaaataaaatatataaacgcgttgtttgtaaagggatataacgtgcacgttttgtaacattttagtatttgcaaattttataatattgtactgttagacacgctatttatagactttttagtcatacaaaaattaaggcatgcatgttcaaacaaggattggtattaatttagtgatttatttcgtgaccttcggggatatatttggtattgttttatgaaccctacttatttgatgttcgtcgcagcgaaagtgagagcgaagtttcaagtcagagtctactctgataccatgttagattttatcttaaaaattaattggcattaattaaagttgtccaataaatatataagttaccttccaaaaattaagacagtcgatgtgagactttagtatttcttaataagatcttcccttctcttgaacaaagcaaaagaccaataaaattaacccatgtgaagttgaacacttagttctttttcgcagttattttgcattgttatagaccaatttattcatataaaaatagtagtagttcgtatacaaggcagaatttgaaataagtcaaattattataaaaagaacaaagaaaatgatcgaaattaatagtgaaaaaaatcaacggtgcatcaaagggggagagaaaaaagaagataaggcgcaattaatcaacttatggaagacgtaacccagtttgacagcatgtgtttttttgttggagaaataacaaataaaaaagcaagggaagtagctctaaaaaagagtgctattaattagctctttgatcagcaaattaagtgcttaatagcgaaatctatgataatacttgtctacgacacggagtgtaatctacgtaaattacacgttgttgggatttggggcacttgttctatctgtctacatcatgaaactacgacatattcttatcaaaaaagaaaaaaatatatatatcttaaacaaaggtatttatttttattcaacatttattttataagatattagcaggattaatacgaatactttgtacgaaaatataatattttttattgttagtttccatttaaagtaactttatctaaccatacacaaaaaataaaatcaacattgacaaaactgaagctctaaaatgttatac

SEQ ID NO: 4178 - DNA, 1500 bp, Glycine max
  Soy_ogl_1830 Gm06:74171..7442000 Cluster 18
aatcaaatatgtccaaagtcagttcaccttacaaactctttaaatttgataaatcattataatgtcttgtattaatttaataactttgatttaaattcataacttttttttactaacattaagttaaattataatttagtcatgcaaaaaataaatcaaacagtaatctatatattaaattaaaacataatgataactgttattaactattattcccaaaaaaataattatatatatgttgtcattggctcacgaattcataagtcaagatcaagttggattcattataatttatagcaaacaaaatagtgtcctaaaattttcataaactagcgcccttccagcattgctcgcgcgctctacaaaattcttctaataatctcaatgaaacttgtaagtacacactagcattcaatcattggagtacactgatttgcttgcattcaaaattaaattgaaaactttcattaatcaaactattaatttagagatcccttcgccaaacatttataggtttaaatatattttgtttctataatttaataatttttatatttttcgcttttataattttttttaattcttctaaattatgcttattttatttttagtctttaagatacttcaaataacgctttaaataagggaaaaaatattatctaaagtgtgttaagaattaaaaataaaataaacataatttataaaaattaaaattaaaaaaataattttacaatgacaaaagcaaaaaaagttaaattgtaaggattaaaaatttatttgagctattatatttcaaatctttccgtttgtggtagaaaaacccaactcaagatattgttttgccagcagtcaagaaaaaaaaatattactttgcccacaaacaataatcaaagagcattatatgaaaatgaaaaactattcggaggggcaacagcattgcctagtcgaggcgcatccgagtgatgaatgatacaaaaccaaaaacacgttggattggaccaactttatcttcaaaatccgtttgatctgaatactcaaaactctacctttaatttgcaaatttcaaaaacacgttcaaacccccacccctctctctatcaaacaaaaagacacacacgtgatatcacattaccattaccatggaaaagatgcaatttttaattgtctaagagtgcattatccgtgtaagtttatattacaatggcaaaactgaaatttgcaccttcagcaactataaaatgtaaattgtcattaaccgtggaccaaggttaagcaaaattaattctaattagaaaagggattaaggtttacatatgattgtgtgttgctgaccaactaactattacttgtttgtcaagtcagtaattcacatcctttgctaattggtcacttggaggatgaggtcctacactccttcttaatactaacaacaatttcgtacttgcgaaccaatattgttagatcccaaaaggagacgaggctaaaagtaagaaaagagca

SEQ ID NO: 4179 - DNA, 1558 bp, Glycine max
  Soy_ogl_2263 Gm07:7897243..7898800 Cluster 18
atgatatttgttatgtagtcttcttttattcctaaaaataagatgataacattttttttatatttgttagaaggttattatgaacatatatctgaatcatattttatgagtattatccgatatatgtgtgttgatttaaataacaaatgtaaaacaaactgcacaagtcagatttttgtagaaaaactccttttgacatttattgatctctgtagcatgacatcgactctttttgacatttgcagacaattaccatctctagtacgagttcaatcaccaagggatagacgtaatcaatttcctagcattgatcactactccaacaagtattccactacaagagatcaacatatttcttgattgaactcaatataccaaacactagttgttacagttaccttcaggatatgccttttcaattaagtggttgtttacttaacttcattttagagaattatttgttttacatgcaggatcccatgtgctatgaacatggaccagtgtgagtgacattgaaacatctttcccttgtcttgaggtaatttcttcttgcctttatttttattgttttggccagaaataaactacattaaacattctaatttgttatgatggttccattagtttaacatcttagaaagtagactagaaactactccagagagtaacaaagcattaatagaaaaagaaaaagttattggggcattttattttcagtcctaattcaccattccatcatagaaaaagtctcttttgtatcactatcaatatatcacctaaagcaattgtgaagatcctatatataaagttatgcatgtaattgacacactgaaattgtagtccgtaaaatttgctacaagaaaaccataatagcttagtaacataaatatgtaatagcaaaccttgtctttgttagattgtcaagtagatatatgtgacattagttggcagcaacactagaattaacatgactcctcacattgtagaaataggaccaaacttgagccacctcattgtcacttgaaccaaacacttagagtggtattgacatactcaaataaatggtatcccatcattaacatagtttaagcaaaatgaacaagactttctaattttggatgagactatacattattttatacgtgtatcctttttcactatagataatgattatattgtcagagactattagactagagtaatggtaacgcctcaactaattgttgctgacattactacaaatatgtttttttacgacacgaattctacacagctatcaactgaatttgtgaattcatgttgttgatgtgagaggtaccaaattataacaagagcctcctatgaatattcattgtattatagaaaaattcaaaactgtaccaaagtgatatagaacttgatcacaagaaacaacagatgaaaatacatgttcatgaaatactaggaagttaaagagtacattttctctcccaaaagtccctgtctactttagtctgacctttttttggcaatttcccacgatatatgtccactgtccattatcccactctttcataac

SEQ ID NO: 4180 - DNA, 1800 bp, Glycine max
  Soy_ogl_3327 Gm10:2678201..2680000 Cluster 18
cctattctcttgttcgtttttgctaagaaggagtattagagaagataaacatttccatacctaaggcaaagtagttaaaagagaacaataccatcatctccttcctaatggccgccaattaactactttttcttcatggtgacccattataatgcatatatattctttttcacctcctatcacatatgtgtccatagttattcccgtatctctttttatttcttctccaatggcctgcaggttttccaaaaaaatattagatacccaaacctaatagataatattaaaaatgagaattatgaaattacacagcataaaaaaatctaaaatagtatgagtttgaattggttcggattttacatacttaaatccgatattcaaaccaatatcattggatttgtaattttaaaaataaatgaattggatattccatatattttcaagacattaaagaataaaatatgcattgttaaaggttaagttcaacataattcaaactttaacatgttaattagatcattttagaattagttactagcttagtcagtcaaattgttttttttgaaaaaatagatgaagtatataagtttatatacattaaaaatttagttgactattaatttaattgtttttaaattttactgttaaactattgcatctttgttatgtggtctctaaagtaagataaactacttaaataatttcagaagcatagaaatcatactcagtaattctttaagtattaaaaaataatctctaaatttcactaaaatatattaattcaaagacaaaaataacgaatatttgatattttgtgaattaattaaataattttattactttaaaaactacataagagagaaaatagtacttcaagtacgaaatttataatttattcttaaaaaatttaaccatccgaggaatacctttttaaaagttattgtactgagttagttacacgtatccgaaatcacaaaatgctagtctgcattttttgccgataaaatatgaagaaattctgaaattgcacagactttttcgaaactgtttatacgtgcaaggataagtgccctaacaaaaaggctgagccaggagcgtggctcctctgaagttttccaagtatgcgcttgttggttaatttagtgttagggaaactatgatcgcttcaccgcttttctttcttgaactttggaaaagagatttgcaagttacaacaacaattatatcaaagtaaaaaaacaaacaagaagcggtgcgatagatgagaatatgcgacccaacagaacaatcaacaatattgttgccataacatgatgttagattcaaaatagagcactatatattgtggtcattagttaatttatggcctacaaactgaacagccatggccatttcatgttggaaccgagtgaacccttgcctttgtctcactttcacctcaacatgcactcgctgcatttctttattcttctttccaattggcgttgccatttgtcatactctctctataacactaatttcaacaaattcttagtagccagttgtcccacttctacacttaaattgttattcgagtaaatggctcgaaattattttttatcatcatgatatggcttttttttttttttactttagggtgaaggaatgattcggatcatgtatctgtagtttaaaaataactcgttaattagtagcagatcattgtaaacaaatttgaagcgaggccaatgagccatgcaattattataaatggaaagcaaaaaacttgtaagagtcatacattgtaaatatttaagaatt

SEQ ID NO: 4181 - DNA, 1163 bp, Glycine max
  Soy_ogl_4141 Gm12:38098201..38099363 Cluster 18
aaaatttgcgaagagttgtcgataaaataaaaacaataaaattaaaatgatttcatgttttgctgtctatatcagagccccttaatggcaaaagatcggcccatcaaatcaaagttttgggttttgatgatggaccagaactaccaagctatgtaatgggctttaacagtcttggacattttttggctgagattattagttctatagtaaaaacacgaggattcatttgtacatttttttctctttgcgtccctgttccattttcttttattttttttcttacaaaaatatccttcataaaaattaatttttggaacatatatatttttcaatatatacacatctaaaattaagcttcaaattttttttattaaattttataaactaaattctggaggtgttaattttaactcttagaaattaatgtttcaaattaataaattttaatattcgtaatgaggaatgataaacatcatatttctaactcttccctaaaaaaaatacaatagttaaggaatctgaataaatttaactaaagtgttcagacataataaaacgcaagaaaaaggttctaatttaattaattttttaattaggattgctcaaaagtgaagatgcttttggtcaatccatgaccacaatataaattctgagagttgtgcgccaattggagagagagtaggcaaggcaactctgactcatctcatgcgtgaaaatcaaagttcagttctacacaagtaaatgatgccaaaagcttaatgcttcattaaatattgccatcggaatatgttaattagtctcctaatccaaagcacacgctcttttttaatcatatgaaatatttattggtcttattgaagagtaattttcgttaaaaattttaattggttatttttaataggatcttctctcataattatatctttttttatagttatttgaattatttgcaggtttccttaatttaccatgccgttaagcatccaatagtttgcagaatcaatcaacggcaaactcggaatgaaaagtaagtaaagtgtctttatcttcttttaatatccgagagataaagtagaagaacataaagaatatgaactgcaatgaatgtcatttgtaggcttcctcatgtcctacacctgattaaagataataaaaaagtatga

SEQ ID NO: 4182 - DNA, 1463 bp, Glycine max
  Soy_ogl_4404 Gm13:32063201..32064663 Cluster 18
cctaatttcagttccaaagctgatagtggcaaaataggttatacatcttacatatatgctttgtgtctgtactttcaaacgagtacggaaatagtaatctcaatcatcgtgaaacttagagtgttcataaagcatatgccatgaatgcacacatgccacatcgtgcgcgcgtgttctggtttagttagtgatttctcggatccaaatctaaatcatgagaacaatgttaagtgcacatggtttgtgatacctaaatggtatacaaaatatgcatttcgtaaagtttataggaagtttcaggtcataactacaactctatatacagataaactaagagactaatcaattacatctggcataaattgcataaatatttctttgagatacttatagtgcatatttctttccttaattcataatcatcgatcggtactcaagaggaattattaagtatttaactttatatactcgtaaaaaaaaaattaaactttatactccgcgttatttccaatccactctttaacttattctttaacaatagaattcatatcaaaatcagtttaaaaataaaacaactaaagcacaaatgttagacataccgataaaaatattttttcttttagttttataaagagaaaatacctcatttattagaaaataaatataatatatattgacaaaaagactcaaaatattgttttctcatttaaagtaaatattttttttaaaatttattttaggcctgaattaactaatatttataaataaaaaatgttgtccagcatttaacatagaattcttcaaaataatgtcgtatgagcaatttaaaaaaaaaagttccaatttagtttttaatgattgttgtttaccttttttttttggtttattgttgtttacctaatctttaatggatatttttattactttatgggtagcatatactgaaaacttcattgatatacgcactaaatttttataaggcatgtctctaatctaatctctcctagtgagtttgaaatttcgttaaaattaagagttccaaattacagtttaagggggaaaaaaaactttattttctatagtttttatccatatcttgactaatattattttttacgttgagtgcttaggcagtaacaattttaaagtagtgtttttttacagaaaattttaaagtatagtatttcatagtaaattgaaaacatttgatttctcaacgttccttaaaagctttcaacggataccatttgaaaagaataatattccatttgtgtcaaaactaaacatccttctatatcagaactttattttacgacagctggacaattcctttcatcctttcagtcatttcccactttttttatataacttgcattaattaattttgttatatatatatatatagtcaaaaaattaattcatagttaaaagttcaaaatttaatttcttaaaccgtaagtgtt

SEQ ID NO: 4183 - DNA, 1000 bp, Glycine max
  Soy_ogl_4666 Gm14:5103210..5104209 Cluster 18
gggcacaagacgggcagtcacgcacgcacgatcgatggtgaatgaaccgtctgttcacaatcacactgccccatgtggccctgattcttccttctcttcaaaggcacgtctcattaactgaatgggccgaaacagactactctatattatagtccttagcgacagcagctattatattttggtcgtgtttgatacataagaagattaaaaatatatcaattctattataaaaatatatatttctgttttatattccatatattttagaattaaaacaaatccaaaaacaaaatatcatcatataaaatcaggataaacaaaataaaacaatctatattgttctgatttgttcacacgagcattgtatctatgtatttactttttccaatacattttacaatattaaacagtctaatactatttttgttaagaaaaacatactaatagcacggttggtatgtgcagtaaaaaaaaaacacggtttgtaggtggttaaaattaattgatccaactatcgtaattgtgtttcacatgatttttatagctttttaaattagttttaagataaaattgattttaaaaaaagttgtttgttttaattgaaaataattaattttgggtatgaaacccacaaattaaattaatatttaagactttgtttctttaagattttttcctaaaaaaaatcacttttaaaatatgtacaaatgcttgggtaaaccttttttcttcttaaaaattacattctaaaaataaaccacattataaattatttaaagaaagatttacattctctataaatttgacaaattattttgcctattaaaacaattatttcaatcatctattttattaaaatacctatttctattctagccttgccattggatgaaatatgttaaatttcttttaaagcaaaaaaatatgttaaactataagagctaaaaatctcacctatccaatctcgagagcgttatcttgaaatttacttgaaaaaaaa

SEQ ID NO: 4184 - DNA, 2228 bp, Glycine max
  Soy_ogl_4812 Gm14:47902473..47904700 Cluster 18
caaaatcatcttataactacacaaacaaactttactccgtatatggcatcagtgaaaaactagttatatataatatgtgatcattagtatattcttgaaaaataactggagagaataattattgttataccttgtattattaaaatagttggtagtatatataaaagtgctactttatccgtataacttcataagatcgacaactttgggaaatgatttcatatcattgacatggatgtaaaatatgactcgaagataaacaaaatctaaaagatttgtattgtgttgcgtacctcaagatatgtgcagagttattgggatttgggaagaagaacgagagttcagaaacaaccttgttggaaattacaatttttaatgatgtgggagttgtaatgttaaagaatgaaaactttgatgagagataagacattaaaattactgataagcaagtgaagaggtataaaaatatgcatatggttaaaggaaagaataaaacttaaagtaagataaagttcttccttcctcagttaccaagtaaggtactgaattgataagttattccttaattttatgggggctcatgaataagaagcaattgtttttttatttttgttttgtttgtgctttgaaccctgcccaagttattatctgcacaacagatacaagaaatgaggacaaaaggtttgattcctattgatgaaaaataaaatacttaccgagtaatgctttcctgatcactatttaaagtaagtgaaagtcttcatataaatcagttgattattctcaagaataaatctaaataaccaagtctgatcgagccactgctgcaagaaattttttaaggttattttgatgcaactcattgcataatccagatatcagaattgtcaaggacttgtgtaccttgtatacattgtttttagctttatggttatgtcttcttaagaatgtttgggttaactttaatatttaccatggcaattaaaggataacacctggactttttctgggtggaaaggctatttatttaagcaattggttttgtagttttcatttataatagccctgagttttggcatctatatataagaccaacgttcatattcttatttattaagaagatggaataatgtgtacagaaatttttggtttgcgagatgcgtactaagtcatgttcatgcctatgtagaaagatgtaatctgagatgcaatcacttttttatgtaaaactcaaaaaaaagtttgctagatgcattttatgcatatgatagggtgctgtatgctgttgctgctttcaagcaagtaataataacgtagttgactctttgcacttgaagtaggttgaagagcttctatttgagcaaaatatgttatcctgttatgagatcattaataagttgcagcagaattctgcatcctgttctaggagtgtaaagactagaagaagcaggcttgctagtaattctttaattgaaaactcagaccggatattgggtttaacaaacagtattctcttaaaaaatagatattaacaatttagaaaagggcttaattgaataagaggatttatgaccctgaaactgattattaaagagcatcattttataaatctggttgcaattaaaatttacttgtgactaaaaggtatttgtatttaaattttgttttaaaaaataactttgtaatgtagaagttatgtttgagttgtttcttttttagaattagttttggcaacttttataaaacttagtttgagatttaaatccccttgcaaacttcaaggcagaacctagtacactaatcattggcgaacaagtttgactctaaacacattattggttatgttccttccatgtgcatttaactatttatagtgactgatttttaattaagatttaagacaaatattacacattggctgacattaacttggttagagtggctgaacaaatctcatatcactttctaaacataagaatggtacatttgcaccttctaagatgaatttggcttcttctcttatgaaatggagcagtgtatacaaaaacttacaatcaaattatagaataattgaactttgactttattgttctaagttatttttctgacataagttgctaacattttattcttttgcaaacaagttcatggacgagattgttgatgactcctgttgctgcaatggacgtgtgcaggctttccaagacaagaccagggctcaaccaaag

SEQ ID NO: 4185 - DNA, 1920 bp, Glycine max
  Soy_ogl_4963 Gm15:9867281..9869200 Cluster 18
ctacaagcattctatattctcaaaacattattttttgttaatgaattttttaagtaaaagaattaataaaaaataggactaggaaaaaaacaaaaggaaagattagcagaaagggtacgttagtagcttgtgtcagggttatgaaagttaagttggggtaatccgaaaaatgatgaaacaagactctgacatggcagaggggtggcaagaggacaaaaaactgtagggctaaggctggagctgaaggtacttgcaatttttaatatgtacactgtgcgttggggattgggttcttttggcttttaaaggacaccatcatcatgacaataataatctgctgcatctgttaccatgagttcatgttttgaaagtgtcgccagtggggttggtttctgtgtctccctcataaaaaaagctgttctcccaaatccaaataccaacagtgctgcattgtctccactcacacgcaccaccaatcctccagccccacccccttcctcttctttccctttcagtttcattcacattgtacaaatgtggttatcttcatcctcatcacaactatttccacccacaataaaattaaatacatttacttatcccactgtcattctttaaatgaaattgttgtttttaaatgattttgtacctgctgcacacaggtaaatatataggtgacttccttctacgtatctcctatgcctaatgtttccttttttcacaatcgatccttcggagagccgaggagtgaagtatctatgaaagctagtctaatgcccttgattaaaaataataaatgagagtattaaataattatgaataattttttacctcaaaattctcataattaattatatatatatatatcttagtagagtttggatgcatgaactcttgtgcttcattctaattatcattagggtgctaattcaactaagtaaccatcgttataaggtgatatgacctttttgtggtagtagttgggtatttggcctacttaaatcctggatacctaaggtgaacttttaccaaaggatttttttaaaagatatacatatattcgttattcgttctggttgaatatcttgagattttattttacttaggaggattaaagatactcaatctatttgaatacttagaagatcctttctttacataagaggaggatcacatgttacaagggtgtttaggtattctgctcaatcagtcaaaagcagtcacactagagtctttgaacatgaagtgtttggttgaaaacctatttgtcaatatagatttgttacaatgtgtgtttgagttgaaatctttttaaaaaataaatttgggatatcttactaggaagacaataatcaatcctttaagatattaaaatctatttaattaatttttcttaataaatatttttttatatgtaagaatcaaatattgaatatgtgacacccacattacatatttaaataataaaattatttgtcaactatacaatatcgaatgaggtaaaagttagaaaagtgaaacatatttaataaaacttctaaatttgtaaattatacaccaataggattttgttcaaatattgagaattataaaatgccattaacaacgagatgtgacaggagcacattttattgcttacacaagagaggaagcaaaaattttcattacgtaacttaatttcaatacatatatcagtaaaagatttatttatatacctctgtgattcttgtttataaattttgaagggaaaattttcagttattaatctaaaatagtataattcttatataagattatattatcaaatattttgataattctttcaatttcaaaatttcaatacatccaacctaattcggtgtatgctataaacgcataaataaaaaatcaaagagatatatccaaagcttgtaaaactat

SEQ ID NO: 4186 - DNA, 1458 bp, Glycine max
  Soy_ogl_5033 Gm15:13061443..13062900 Cluster 18
aacatattattttcaaattaaatttataatcagtgtacatcttataaagatgatacagatctagagtggtaactaatatttttcttgaaacagttggcccagcactgaagaaatcagcatcatggtcgatgtaaataaacccttggaccaaaaaattgaaaagttcatactgtaaccccagactcaaaaatagaagttttataatttggcaattctcgtcttggaccgttaccaacagtcaaatacccactttgagacgcaagataatcagaggagaggttggattgcgtccttgaagacaagtaaaaaaaaaaagctcttcgaataattaatatctacaaaataatgacataatcttttcttgcttttggaccttttggctaagaattttcatatcctatatagtcttcaagatacactgattatgacatttttacaaaagtggtataactttttcaattaataattatcgaaatgggtagatttttaaaaaaattacatttttgtaattttttgaaaaatgattttaatgtacttaaatcgtgttttatttcactttagctttttcatttattttcttaagattgtgaatgcttaaagtcatgcgcgacaaaataagaggtttatcttttttcttaatgaaacaatttgtgatgactaaagaaataatttgttacactttcagctgttacaattttttcaaaaaacaaatcctaaaaagaaaattcgtgttttaaacatgatttcaattcatatatataattgtctttcaaaagatgatatttttttttttaatttaaggggtctctttttctcactgatgatatcaatgaaagaaagaaggcaattgtgggtagagatcaaccctggggccttcatcaacgtgatgcctctggaggccctaaccgatcttggaatgaattatactcctacgagctggcttcaaaatctacccattttgataattaattaaaaaaattatactactttggtaaaaaaaaaaagaccatccattatcttttccttatagttacactttttttatgcaatataatataatacaatacgtgttgctccaggatcaaataaatttgaggaaacatcaaattgaaattttttaagttcatcaacaacttattaaaacaattattttttgtttgattatttttcttatatttaagaattaacaatatatcatttgttatatataaaattatattgacaccttgtaatggatggagttaaaaaagttacatttttttattagaaatatgtttttcatacatataatataagttcattttgattttactacctaaaattttatttattttagtacatgaaatttttaatgtttaattttaatacctaatctggttcatttgactccaaatttcgaactgaactacttgcattttaattagttcccctagttcttgtgtttttcattccaatgaa

SEQ ID NO: 4187 - DNA, 1300 bp, Glycine max
  Soy_ogl_5805 Gm17:39795201..39796500 Cluster 18
gccttactgctattactctgcttgcttgcattgcaatgaaaataaaattctagcttggtaatgattatgaacatttttctattattttcctgttgcattcaaaatagacaacgacccatcctctctctcttttattttttttataattttccttcatgtggtgaactacaaggaaagcaaagttgcagtagtaaaaacgaattctttttaatttccctgcacagtgcacacacttcacttgtcttggttcctcctttagttagaaggaagaacaaataactgtagagagaaagtgggtacatagatacgatcccaaaacctttttttcttcgaacctaactcttcattcattggatttttgtcactcgaacgttagttagctcagatgcaaacaacaaagcaaccacaaagtggggcccacgtatcaaactgcttatttcggattcttgaggcaacacatcattgttttatttgttgatatcgaataacatgcacttggagttaagtttagaagaaggacattaacttaactagtaacatcatgggatcgagtttaattaattataacaatagtggtttttgctaggtacgtgattgaaacatggccttcatccgacaaataatttttatcccacaacacactaacaggcttaccaaacagcaaacgaaatggcactcacactgtggctttgggggggaagtgagggagtttagttatgttatgtacgatctcttgatgggttaggttctaacaggtcattattaattatcacaaccttataattattattttctcacagtacttagccattttaataggggggtcatcattggtttggtttaatttaaagaatccaatcacttgaaccaaattcattaatttaagttggttcgttttttttttattattaagtttaacttggattaaaccaaataagactcaaccttcattggttttcgggattaggtttatcttttacaacatcaacatttaacttcatgatagtctattttctattacttttttaaaaaaaaaaaaattatcctccttcttcctcgttccaactccttttccttagaatgtaatatgataccttaaaacaaatacctttaaaaaataagattttttaaaatattttttaattttattataatattagacccaataaattggaaccaaaccaattaacttgctttttacgagtttgtttgtttcgaatttgatgaaattcttttaacaaaatggatcaaattaaactatacaatattacaatttcaattaatttgtattttaattttt

SEQ ID NO: 4188 - DNA, 1431 bp, Glycine max
  Soy_ogl_642 Gm02:44309770..44311200 Cluster 18
tttacatgcattaaatttaaataatacatagttttcagctatataatcatatggtatttgtttatattttccatatttaaaaaatagcattaatgatcaactttatgaataactttagtctgttaattacattaatatcaaatttctactgcataaaatttattagatgatataacaaataacaaaatataaagtacgaggtagagaaatgtagtttagattgacaaaaatatagaaaaaaaaattcggtggagacaaaatcaataaaataattgtattaatttcttattatttctaaaaaatataggaaaaatattatggaactcgcttgaacttgtctcgcatctcatgaaaataatacgagaaaaagagaagaaatcttatttaaattgaaaaaattacacacttattacattaattagataccaaaattacatattaaagaaaatacaagaattaaaattatatttaagcctatattattttaatttttcatgataaaaaatattattttaatttgttcattttgtatctttttcgtagataatcttaatattaattgtgagcattcaatcttaccaattgtatatgatatttatcagtcattcaaaccctcttactaaatagttacgtcaaacccgttgttaaattgtagtcaaagtctcttagattaaacaaatgacgacgtgtcaccattttgtcaggtaacttcaacaaaggttcaccttaagattaattaattaagaataaaattaagcctacttatcatcaattcaagggttttgattgtttatgaattaacaaataaaatactcccacattaccagatgatagtgcagcgttcttttgcagcctttgataatttttattttttgaaaattataaatatcatataggttaaattcatctgcacgatttcatttttttttatagaatttttaatcagctctttgaatttttttttagtttgatccatattttttccaattgtgtcctcaagtctaattgttgttatagaaaattaattacacatacctacatacagtaaactaatgctataaaatgaatacaagtttaggagcctaattaaaagaaaaaagtttcaggacttaattgaaaattttataaaagtagagagatcgcaaaataattaaacctattttacatttcaatgttaaatatatttaatttttatttaatatttttataaaataacaagtagataaatatgaaaatttataagagaatacagtattatttctggatgtttagccaaaattaaatggatagaaaaacctttttttttttttttatatagctcacctggttactgttaaggaaggtcattggttggttggcacaacggtggtaagagccaactaaaaaaagacacgtgtgacaatcagaaagggtgggacccaggtcctagag

SEQ ID NO: 4189 - DNA, 1500 bp, Glycine max
  Soy_ogl_799 Gm03:8401..1870900 Cluster 18
aattaaacttgtggtatctgctggaaaatcatgttaatttgggattaggatttaggaattcttttctcattagagaaaacaaacagagatgttttctttgtctctctagtggggagataagtctaacttcaattacttttaggcatagacagagaaacaaagagaattttatcccaattgtttttctaatttgaggtagttaataagtgacacatacaaaggtacgaataatatagttttcacattttatgaggtacacatattaatttggttttttctttcatcaacaatagagagaagaacctataatattccttattgccgcaaactaccatcatttcttaaaatctttgtgtaactcatctgtccttagcttatcgaactttaatttgagtttttttttttctacctttgtggttaggtctcaaggttaattaagggactatgtaccttattagtagtcattgataagtactttttctatctatctcttgatggtcgagtaccgaccactgaccttccactcataacacttgcgatctcaggaattataacagtcacctaagaattatgaaatatcaatcatgctttatacttctttttttctctgttttattgtgcaaatataatttctcaaagaaaaagaatagcgatttcttcaacaatttaattagctagaatagtatgatagtctaaaaaaaattatattgctattcaattacatgttattatgtattgtaatttttttcacttataataattactttaaaactcatataaaaatgattttttttagttgatgattatttttttttaacaataacaatatatgaaaattgaactctttcttaaaaagactaatattttgatatatttagtgtttatttggaataatttaattttgggtgaaatatgttttttttttttttgccattctaaaaattttcaaccactttaaaaatggagtattttcaaattttagggacaaaaataggataaatttgttttagatgactaaaactaaatatagaatattctgctggaacaaaaaatatatattatcctttaatttttctaaaaaaattgtatattttcttaaaatcttcttaagaaatgggggagaatcttttattattttaaaaataaactaaactaaacatatttaatttcagatgagcaagatctgaagatatacattctttgttgcctttaatttctatgaaaacaacaaattaacatatgagtattgaaattgtttttttcacaagtaaatggatcataatttcaattttttttaataggagaccccaaatattatctacatgcagaaaatagtatcaagtgcatgtgtaaagtaaaataactctgaacatttattttcctaaatatttaacgcagatataccatagtatcagctttagtgtcatttgtttatttcatcaatttgagtgggaaagacggcttgtgcactaagcaacagccaacaggcataaaaataac

SEQ ID NO: 4190 - DNA, 1212 bp, Glycine max
  Soy_ogl_6295 Gm18:60161893..60163104 Cluster 18
atactctaaaatatacttgtatgtttttttttaaaagaaatggaatccttcgttatttaatggaaacaaacaaacttgatacggaagttctttatactttaaaatgattaatcagtgagtattttaagtccttgcagttgcaaccacaagtttatgataaaataatttggaatcactgttttagcaaataatttagttaaagctaattaagggttatagcaattaaccaaaacaatgaatgttattggagggcgctataaggttagacatgtctgcgtgctgagtaagaattcaataattttacattcaagatattcttactagaaaatcattttgaactttgacgtcttagataaatttaggttataaaatatctttcacatgcacgtccgatctagcagaaccacaaataaagtcttgagtttgtaaaatttaattaggttaaattgacttcaattgaatacatcaattttttaatttattttcgttttagtttgtatttttggttttagtctatcatgtcaagtgaactcatataacaactctttagcattcaatgacttattatatcatttaagatgctaacaagacaatcatgcataattttttaataatatgtatttttaaattcttatgtttaaagtatttgataaagttaaattagtttatctaacaaatttaagtagtaacactaattaatgaaataatactaatatttggaactaatgacttgtgactttatttaaaagtttaacaaagtgctcatgtgtattttttttagcaaaaattgttttaaaatatttcattaattagtgtaatgttatcaactattttcaacatataaaagttttaaagcacaatttactaaaaagatttatacataattactcttttagatttattattgagtcattggactgttaatatggttgttatattattagttaatataattacttaataacaaagactagaacacacagtattaaagttgacaggaactaaagtcatttttttattgaataaaatcaaaataatcctatttttaaaaactaaaattaagtctttttttttacatgctagttaaagtaatacttaagtttataacttattataaccttttcatttttacttattgatgtaatctcttttttatatatcgctatttacttgaattatcattgtatttacactatttactttaatttccag

SEQ ID NO: 4191 - DNA, 2021 bp, Glycine max
  Soy_ogl_6909 Gm20:41139201..41141221 Cluster 18
agttaggcaaagatctaacctctcaaagattatttcaggatgcaatcaaactgttcttaatggaactatacaattagtttttgtgtgtttagaaaccttccaaaattaagatgattgtccatcaccttcacggaactttcagttacaaaaggtatgtttgtttcaaaaggtgaaatcgatattttttacaaaattatttctaaaatattaaatgtaatcttaatcataggagtctttatatacattaaaatatgtgtttttttattcaaaagtatgagaattgatttttcaacgtgaaaacaaaccgatcaaagtctgagtaaccttaaccacctataccagcttgtgtgactcaactttgctatttctataaaagttaggttatatgaataaattattagaagtgaatgccttttgatcactacaagcaatatataccatcctaaatatcaccttactggaatccatttaaacatgttatttagtcgttcatactgcagactgcagattttgtattctttgttaagaaaagttgtgttgaaatcttatatataatgcgaactacaattatgacaatgagaatcggacctaattaagttctcatacatctattttaattaactattaccattagactgactctattgagttaaactaacaaatgtatatgcatatcaaattcaagaacatgtgagaagttatacaaaattagatcagaaattaaagtatataaaaatattaataatgaccggcaacaagaatatagtgagtcagattaactttatggagattttgacatgtcaagaccatatatgtttctccaataaataaatatcagcacaggccaggatttgacaataacttatacgttttgttttttaagatatctctttgtgcagtttaccacgaatttcttaagctaaagtcaaacatattcgtccgaaattggtgtgtttctattttctagtgatatggttttatcattgagcatagatacagtgtcatcttggacacatgtataaagtaatcgacggctcatgactctcagagatctcgcaactttaaaaaattattaattttattttagtgaattttttaatatacaagaattttatgtattatttttttatggttgaatttataaatttgtgaaattttttattaatgaattatttatgaaatacgtttttattgtttaagaatcatttttttaatttttgttctacgccccaaaaatgtcaaagagtatagacattgactccattgtccattacttggtgtaaaagaaatcacctttcctcaacaaatgtccattgtcgtcgtccaagcaagttcaacccaacgcccaacggtattgtagataaacgtttcatcttatttatatattatccttttctttatcaactagatcgagactcataatcatattaacaaagctagatacagaatataatagacaataaattagatatttaaaacatgctaattagaatgtgattcttaatagtgtttgtgaaagaaaaaaaaaactaattaaaataaataaatttcacctggataatcttcataacttaaaaaaagtggttttgactgtcaactagaaatattctttagtgcacactaataataatcataacgctaccgttttgacgacgtgtttgatattttaatttgttcgtacacatttttttgttgaagctcatacacatattatgacacttaaatctcactttggcaattacgttagttaatgtaaaagtattttattgaaacactattctgaaaagtactaatggaaattggcaccaaaaaaccatccgttgagttaaccaatggatgatattaaaatttaatcttaaagaattaaattgataaatgaaatcatctgaaaaatattaaattaacaacaattgtatctttcatgtactccaataaattactactcatttaaactatggctcactcaaaatttaatataaatagtagtacacaaattcaaggcaagttgtcacccgtttatt

SEQ ID NO: 4192 - DNA, 1506 bp, Glycine max
  Soy_ogl_6996 Gm20:44718725..44720230 Cluster 18
aaatactgtggtatttaatttaacttcttttgtagctttactcctgtgaattcaaaattgtctcatttgtatcccatttctatcccacctatcacgtcactataattgacacatttattttacatcaatttgacttaaagtagtaagataaataaattattattacaattaagttttaaagtgtttatttataaataaaaatggaaaaatataaggatagatgatataatcaaagtcgatgatgtttatttgcaaaaagagaaaaaattaaagctcaattaagataaaactaatttaagttttcttgtgcaccattgagttacatttttaaacaattcttggattagagtattaagatatgtttaatacatactaccatacaagataaagagaatagttcataacataataaatacttgagttacaatatagtttattttatagtgtaattttgtgtatttcaaaaggttacgatttattattttttagcttggagtatttttccagtgtaatgacttgtttgttatacttttttttactgttttaagtaatcataattcttattttaaatttattttaatacctcatttaaacataataattactcattattttaattaattatctttatcacacactattattatatggccattttctaattataaatgagatgttctccctattgttttttatatcttagaaaaagcacaatcctcattattctcttggtttcttaattcttatcttatttgttagttttgatatctcgattattgttgaggcatttatagaataattccttaagtcagaagcttttggagagttgggagtggtgacttaaatgagagattttatattcatgtgttgagttaaaagcttttgggagaactaattttttgttgtaataacaattaataactcttgtccctagtatgtgactatctcttttaccacatgattttttttttctttagctttgtgagcatgctctttttcttttgatacctgaattgattttgtggagattgtctttttgctatatgtatttggaggtttaatatggattatattagatattggagatagtagaattgacaagattgaacggtgttaatgtgaaatggctatttatgtgatctttaatgctagaaattgtgcttgaaaataataatattttatattcttgttacacaaatataattatttataatataaagttgtttattatcataaataacaagcatcttattgagctttggctttcataatggtgggcaaaggtcaaaaggtaaaagacataggatattccaagaggtaacaacataggaaatcatattggtattaacatgatatatatatgttaattgtgactttatcaatgttatgcgacgaacaagaaaaacagtggtgatgtaataatttatttatttttagtagactagtgttcattgacattaaaattatgatattagaaaatgattgtatcttacttttttagtagga

SEQ ID NO: 4193 - DNA, 1330 bp, Glycine max
  Soy_ogl_6203 Gm18:56485401..56486730 Cluster 18
tgtccaaatccttgccatacacctcctaatatctttgatccatgcttcattttcgaacttggaattattttggtgagaacaaaacagacagcgtgtattttcaatttataagaatatatttggatacgtattcgattggttttaaatttgtagctcaaatttgtttttaattcttaaaatgtgtgaaactttaattgtaattcatattttaatctggtttatttttagctttaacatttaattgtattaatcagattaaatacatttttaggttgaaataaatttgataaaaaatgatcaaggttttatttttaatcagattaaataagaccaaattcatcaatctttctctctttgagaattaaataaataaagatgataaattattttttaaaattaattattatagttaaaatatctgttgatgaaattttaacaaaatacttgttatctaatgtttttaaaaaaacatttaagaaaattctaaaaaaattcaggatgaaaaatagacaattatgtttaattaaattattatttgttcagatatacaaaatatcattactcgttgaaagtttattcttattacatttagaatctgtttgattgagtagcagaaaaaataagaaaattattgaaaattgaattaaagagaaaagaaaatatcaaaagaaagcacacttttagaatactgaataccatttattattaaaaataaaaaccattaagagaataaggctagtaaagctgtacagatattataatttgatgtgccccaaaaaagatattaatttcattgaaagtaattaaaataataatatttcagaaataaagttgaagaaagtgatataaaatgagcaatttgattttgatgaaacaaacttaacaaaaaaagactaggcaacataagaaataatgtgaatggttgaaactttttcgtgaaagccaatgaaagaggtacacgtgtaggggtatagatgatagaggatgcagtggatagagtcagaaatttgatgaatcgtactgcagtcttatctgtacggttcatacggaaagaaaggacgggtttaggcggtggccggtaacgtttgtacttaacatacaactttgctccacgcgcatctcataactctacctacgaccacttgagcttggtttgaccaatacgtcataattctttaggggcaatattagtaggaactaaaatgaaaaatataaattttagaaacctaatttaaaaaataaacttacaaaaaccaaaataaaaaaaaccattaacttacaacaaaaaaaaccatatttaagcctaagataattagatactaccttggtt

SEQ ID NO: 4194 - DNA, 1540 bp, Glycine max
  Soy_ogl_6561 Gm19:44431161..44432700 Cluster 18
taagtatataataatattcttttttaattttacttttttttttcaagtagctagtaatatcttatacacatttgatgtatttcacttctgctagctagctagccagtcaatcgtgtactagtatatgcctttttaattattttatggagtgaatatcctttgtgatatatcatttggaataaaaaaaaaagagaccactactaagagcatgtttggttgcgaattgacacccctgaacgtggattatgagtggtcaaatgtgaaaaaattgtaagactgtgatgtttgatttaccatgctagatgtgattcatcaagtaaaaatcgattttggaaaaagctacttagagttgcttttgcatcatagagaatcaattgattatttgatctctcatttttgctctccaatcttttctagtgtcaatgaagctaatacatgggtcacttctctcttggttgttgccgctaccaccctgccattgatttccttccttatgttactcaggagagcagatggaacgaagttacttcttctgtgttatctccattcctaaccaattaaagaggtaaagaaaatgttaaacttcccttttgtaatatgcccacaatccaccccaatatttactacttacaccattagtttttacttattttttaagagctttccacttcttatttgatactactcatttattgctagtttgtattttaattaagtttgtaagtttttattaaggaggtgcatttgcggtcaaaaaaaaatttaaggaggtgcattttatttcacaagcttttttttttttttttacagaatttcacacaacagtaattttttttttacagaatttcacaagctactatattatgcattttagttattaattttattataaacaaatcatgttacaaattttgctatttattttaaaattaatagtctatatatcaatatcaatataataaatcaaaatgcaaaagacatctacaaacaactgattttcgtaattaattatacactcaaataaactttgaaagttactttccaaacatcattgaatatgaaaattaattttctaatatatgtatccaaacaaaaatcactaaaatcactattattcaaaatcagttttataaaatcttgttaattttgaaccaattttacgaatgttcatctaaacatacatacatatgtttaaaattaaattaaatatgcaattagttggctaagaaacgtggattctctcattttaaaattatagatcatgatatactatatcatgtactagtaatttgaaatagaaataacatacataaatatacgtggagacttagtattttctagtttcaaagttgcgtgctgtgaatttggatagacgaagaattgactaggggataatagacctattatttgaacaaagtcactcaaaataatttatgagtttgaatactctgtaaggaggagggttcctagagagtactgagtattctctagtagggttcctagatatcactgagttgtttcgcctataattaattattaa

SEQ ID NO: 4195 - DNA, 1563 bp, Glycine max
  Soy_ogl_729 Gm02:48140701..48142263 Cluster 18
aaaataaatctctaagatgtaaaataaaccctaaacttaattacatattattaccttagttcttaaatataggttaatattatcacctaaccacaagatttttaaaattttggagtaaaattattgagatgcactatgaggtacgttttttttatatatataattttattacttttgaagatctaatgtgataacactaaacttttagggactcgaatttaaattcctaacatatataatatttatctaccttaaatagtgtacgttagggatcaaacttagtggttttatattttaaatagattaaaatcaaggaatttgtattttaccacaataaaaattcactaattttacgtagactaaaaataaatatttcaaattttaggggaataaaaacaaagataattaataaaatcaaaataatatataattctttcaattatatgtaaaaggctgttgttaattaccaccgaatggatagatgatgtggtgtgggcaatcaaaacaaagaaaaacaattgggcttgcaaatacttatattggctttttttaggggacttatattggttcttaagagtatgaaacactgtcattttaatccaggaaaacaataacattaaaaaatccaaaaatacaatttgctatttattttagtttaaaatatttaagtagttaagtttaaggacaaaataatagcacatacacttattttgaatttttttactttcaaagactaatttgattattttttattttttttaggaattaaaatcgtggttcatccaaatataaaatcaattaaacttacgcacgttgcaatatattttcttcaaaggttgtttttccatattcttcattgtgattcctcttaaatattttatacagtacaacttcaaaattcattttagagctgctactttaataaagtcgtcatttacgtatacgactcaaactagttttttaacgcacaaaaaactaattatttaacacaaaatcatatatggtcttgaataatgaatattacaggtaaattatttttcattagaaatttctcaatcctaatcaacattaattagtaaataatttttattattttacatgaagtccagtacggaaaatacttgtctcagtgtgtgtgtatatatataagaacccaagttaaattttcatttttttaagacaaaattgtggctgagtcgtttgatagattctgatataaattcaaccgcgtcctatatttattcttggcaattacctcgctcttcctccaacagactcctctgacatgccacaatattgtcaactcgatagatttcatcaaccaacttgttaatttgtgtgtccccaggttcccgaagacctccactccacattccacttcctttcctttaacttaattgaagccatcccaacggccaaagtttttaaagatggaagcatgtctaggcttattgtctgtcttcaccctaaattggaacctacagtagaaaaatgtggaatgtggtgaaatttcatagtagaatacatatacctaagtcctaatataagaaacttcttcgattt

SEQ ID NO: 4196 - DNA, 1500 bp, Glycine max
  Soy_ogl_6854 Gm20:38922101..38923600 Cluster 18
attaataaaatttagtattagttattgtgcgcaattggattgataaataagcttggttttgcttataaaaaaatataatattaaatgtatttattggatatcattaatataaattagtttaaatttataatgtctccgtattaatataaattagtttaaatttataatgtctccgtattaatattaatttatgaatattaattatatttaatatcattagaatatattattaacttaatattaaaaattcacataattatgatacatggaacctaaaggatccattgaatcgaccaggtgagcagtttaaataaaccatcgaacccacatacataacaagtgctaaaaaaaattaaatttaaagtgtgaagcgcggataaattagtttctcaaagataaattcaaattttttgttcctaaatgtaaaaaaaatgataaattagttttaaagataatttaattgataaaatgatacttaaactttgtaattcaatattatattggtcctaaaaaaattatctcacaagtttaaacaacaacactaattgttcatactttacgaggtgaatttggctatttattccaaaaaaaaattaagtaaaattagttaaaaaaccgttttgcaactaattatttaaaaagaaatttgttattaaaaaagacttgtttgatttttaacaaaattcaagaacataaatataaattagtttaaatttataacgtctctgtattaatgttaatttataaatatatttatgaatattagctttaatattagaatatattattaacttgatatttaaaattcgcataattatgatacctgaaacctaaaggatccattaaatcgaccatttgaccggtttaagtaaaccattgaacccacagacaaaaagaagaaggtaaaattagtataaaaaaaaaaactgacaaatattaataccgcttgcaactggttattaaacaagaaaacatgtcttttggtgacgattgactaattgttgtgtgcaggtcattggtgtgatctccttagttctgatactggtatcagtaaatgtgaagatagccaatggggtgtactatgctataaattgccgaaagcatagtgcagttttgacagattttggaactcaccggacagatgtgtaattaccggtaactatttaattagcctgagtaatagaccattataaaaggttgttaagttcatttaaatgtggccaagtcatttttttcttttaatttgacccgtttgaatttgatcattaggtaacaatggtctaattgatgggcaaggagcttattggtggaacaagttccatcagggtcaattgactctcactaggccatacttgattgagaccatgtactctgatcaaatccagatatcatttctcactttggtcaactccccaacctggtttgtccacccagtttatagcaggtttgacaaggcttctttgttcaactttcttaacatcggtgcattctttatagcag

SEQ ID NO: 4197 - DNA, 1500 bp, Glycine max
  Soy_ogl_1147 Gm04:788101..789600 Cluster 18
cacttatgacatttccatcaatttacttaaaggacatgatgaaaatgatccaattgtttaaaataaaaaaaaaactaagaaacccaattacccagtcagaaaattaagggactagtctttttaacaatctaagagatcaaattgaatataaagtgttcattttttcaacacattttattgctgagtggtaatgttgttttgtgtatttttagtggttttttattactaaatggtatttagactcatactaaatttaaattagtataaaactcattaaaaagaaggtggaactcctgttatttagcaaatcccatatgaacttttcctaaaactaaacataaaaatactaatacttcaggtatttttaaattttaatgttcttcttcagtcaaaattaaagttttatattagcaatttgtgcaatgttcaacagtcaaagtcggcactgattattgagataaattttgactaattattattattctgtacattgtgcttctgaaatttgtttggggtctatatatagtgcaacgggattcaggatttgaaatataaagacaagaaaatccaactctttcaatgccctgcaaagcccaaacaaaaaaaagattacaaaataactattgggacggttgtgttcaacaaagcccatcagtgtctttttacccaattacctttttttggtgaaaccagctaaggtctaaggtagtagactagtagttattgacgtattggacttgatatattcatcaaattcaaagcaattatatcatcaactcctgatactgcttcctctatataaaaaaaactcctgatactgcttagtgatcaaggtaatatttttggatatttcttcttaaaatatggatagatatatcaatattttttaaaaaattaatatgttttgataacaattgtaatgatcgaattgatcatatggacaaaataagtgaggttatttatttattatcaattgcttaaaaaagttaatattaacaattactaatagagtattagttaattgtaacagtggccgcagctctccagtcatacataacgccaactagtaagttgtgtacctcttcacgtggccgaaggttaagatgttaatattcttgattttttatttcgttgtaccttttcactgtgaaaatattggtatcttgtcaagacagtgaaataatctttattcataaaaatatgccaaaaggagttcacaacatgttaaaaaagaaagatgaatgaatatattatatatatttatattgttttatcctaaacttgacagatttctcatttctttctattccgaaatttgggaaggcgaaattaaggttgaattcggaaatagaaggtagagagaagaatggtggaagcctggaagttatgaaagatgaaagagagggagaagatgacaatcagggagacccaaagaagaagtgtgtcttttattatttttttactttaatttaatattattttgttatatcatgatgaaat

SEQ ID NO: 4198 - DNA, 1677 bp, Glycine max
  Soy_ogl_2907 Gm09:451624..453300 Cluster 18
aaaaatagaaatcattacatatataataccacatatatataatttttttttaggtgttcaaatggtagaactctttttctttttcacccatcccgttatatatattcgatcttctgcagttactaattagtcaacgttcaacggacgttgtcaattcctttaatggggttatgttcaatgctttgaaggtgatgatttttttggggtacacaagaaggttttttgtttcaaagaagaacgtactcttcctagttaagggtaaagatatgtgattacaagatttttttcaaaatttttataagatattttttttttaatttttagatgtattaattttttatatatattcttacttaattattttatctccaaatattaataaaaaacaaacaaataaatataaagagaataaaatgatagttttaaaatgatgatagaaatgacaaatttaatatgataattactcgtcatgtcaagaaaaaaaactaaaaataattattgtaatctattattcaatgtaaagttttaaatttatttgttctttttaattatgatgtgtgattatggtaatatgtaggaaaaaatgtctgaattcgaaaaaagaaaatgtaagaccaaaatatatgtacataaacacgcaatgtttgaacatcggatataaatttcaacatagatatacagaaatacttttaataactttttttaagtgataaatttgatcaatttaattattagatgtgattttattttgagtgataactatatatatgattatatcaaattataaaaattgtccaaatattttttttccattgattcactcacttgcttgtcttggtgagtgttgatgtattgtattcatatatatcctttagtgttttttatatgagtagtagtttgtttgtcactttcatcagccgcaaggaagatatgttgtgaaataattatgtagttttgagtggcattggatgcatggcgctgctactgctgcaactagtatttccaccgtcaaactcaaacaaaaacatatactatgtcataataaattatggaccagtttttttacaatacaattttcttcctttttatttattaaaaaaacattgatgagttagggtaggaccgtcgtcttactgctaaaaaaaattcttacacaaatatttataaattgagaaaaaaaacatatataatttaaatacaaaactttgttatattatccatcaatcataaatatataataaatttattaacattaataaaattaattttaaaattaatttttaattgattaatagtgtaaaatctttttaattatgttaacaatttatccatccttacaaataattcacctcctttttgacaagatgtttgactgaaactcctagaaagaaacagtgggacgtgggggagaaggataagtgccgcacacgagttcaagactttttttttatatatataaaagtagtattaaaaaatctatttacacaaataaagtaattttaaaattatttatatgcgatgcgttattttttttaatactactttcgtaaaaaagtggatttcgacgctgtcgtatacaaagaattttaggttaaagcccattgatactggcccaggtccgaaaagggtgtgtctgacgtgctttttatttatttttattattttacaaatccctga

SEQ ID NO: 4199 - DNA, 1474 bp, Glycine max
  Soy_ogl_3248 Gm09:40770020..40771493 Cluster 18
aatgtatttatctttaaatctttgaatacttattgccattggagggtcctaaaggacattgactaaattaaattggttacaaactgaatcctaatgcaaaaaataacattttttcacttatgcactaaatatgttcctaataatgtttattgtattaaaaatataacaattatataacacttagtatattgtaagtaattaaaaatatttaagaacataataattatgcctttgttgtactgtaatggacagaaaagtagtttttaataaaatgcatatatagagtttctctgaagcttctgagtggttgtttcatcatttcctgaatacttttcaattagtggctactaatacgcgtccaaactactagatagtgtaggttacagcctccgtgatgattcaattattggctttttctttgtacctaaggaaaatggggaatgtctaattttctaaatattgctcaattcctccttgtaggttatggagagcaagtcatgcgggcaactctgcaagctcacacgcaaatcaaaaaagcattaatttgaatgtacataacgaaaccagttctctgacttggtaagaaacttctgacaaaggtttaaaaaaaatagtccgtgacaacgatttcaattacaaatacacatttttttttaagttatcgtgattataattgtaatcgcgtaaatcacatttatatgtaatatcctgtaatatttaggactacaatgaatatatgaaaccataactatgattgcatcttaaaacctagcttttgatttaaataaagagtttcagttgggtagatttcttgacgaatattagaagaagaaagtaaaaaataacaaaatgattttttcaaatcaatcttttaacattaatttaaaatcaatttatactagttttttgtttttttcttttcaaggcaagaagcaattagtccttagttcttgaataagttagatgagaagattttaaaaaaattaaagtgtacaaatagattaaaaatttaattaattttgcatttttattttctcttataaatatttattaaaagtttatctaaactagactataggttagttggtagttggtacaaattttagttacattgtttattatttgattgtcactaataattttaaggggcaatattctctataattgaaagccaatgatccgacaaggttagcatgtcactctatgataatttaggatttacttcatttaaaaatcaaaatgagaagatttaaaaagtaagcgaagatatattcataattaatttatattgtgcattttttaacttaaacgatttaaacgaatagtagatacattcttattttttgtactttatactttttctcattttctatgcattaaataagataatttgcgattcttttaaaaacatttccactgttttctatgcgcacgacaaagggcacacatgggcttcagagaagctagaggagac

SEQ ID NO: 4200 - DNA, 2042 bp, Glycine max
  Soy_ogl_3530 Gm10:44783059..44785100 Cluster 18
tagcactcattggatgggaacaatattaattcaggacatgggtaacaaatcatgagtaggtgaggggaaaaataaaataaaagtgaaaaaactgaatcacatgacacttaaaattcgtaaacccatttgtgttacaattttcaatatttttaccaagcttaattaaatttttgttcctaactcatgattttctccctttttatttatttcaaatgagtactccgtgaacctttttctatcacataatctgataggaatgggctagaaaatcccaaatagtctacaagatttaaatattatctttttatatagtttagttttattttatatttcctaaaaatactagataatactacttgtggggttgatattctttgtaaacctctattatagggtatgtactttgtaaggataatcaatgaaaaatattaattttatatttatctcttagtttttcttaaatgataggagtaatgataaactaaaatatcttgcgcttatcataattttgtaattttctttacagttgaaattgtataatatactggtcgatgccaattattattgcggaccacaattaattcatcgatccaagtgaagacaataagaacactcctccgaagtaggaatattttttcatgctgaaagcaaattaacatacaactaataattaacctggttttgcaatttgcattgactaaagttgggtgaatgcgtcctctcagtctcatctaaagttttttacagcaaagcctgcatcataataatgttgataccagaagcattcgttggcatttcagtttgcagtactttgatttttttaacttaaatccctcaaatacaatgactcatgccagttataacaatgattgatccacattccatcactcaattacctattctgatccaataatgatatgcaattatttctttttaggttaaattaagttagactttccccttttagtcccagtatgcagataaagacttcacatgacacaaaactgttcttcatatggagtggagtaaatatgctgcaaactgcaatcatatttttacagtagagtttttttttttttttttctttacactgttatgatcattacataaggggaaaagctatatataacattaacagtatgtgatcatacagaatatgcttgtgaggattgcaaagtaatttgtgcaagcatcttggtgtgatgaatctttcttaagaaacatgcatattcaataaaagagtaaaacataaaattagtagttaaaatagtatgcatagatcattttaatctttaaaattatgaaaaactgattaaaaaaacttatatgcactttgtttaagtactttcagtataattttttatatataggaattggagtttctcttcgataacttcttattttaattttcaatcactgaatcagattttcagctgttttttaaaagaaaaaaagttgtttaaaaatacatgctatataaagattaatgtggattatgataatgataatttcaagctacttaataattttttctattttttaaaaaggaagaaagaaaaagcatatattatagtcaattattacatacgaagggtcaaagaggactcgataatgcacttgttagtatttaaagcaaaacccttaattaagttagcagaatattgattgagtggttaaaaaaataaaagaaaaaaaaagtcactaatttaatcttttactaataaaaaactaacaaaattaacaattaaaatttatcgataaaaaaattatcatgaaagtataagaccgacccaaagataaaacaattaaaatctaaactttaggctgatcaacatatgttattaattttgttaaaagaaaaaaaaaaaagtcacacatattaactaaaatacctcacatgttactctattatttattggaaaaaaaatctctcaattattacttgcctcagtttctttggtccggcccatgtgagagtataagcctttatgtggagaaattagaatctaaaagttaggatggtgcattttggtggatgctta

SEQ ID NO: 4201 - DNA, 1500 bp, Glycine max
  Soy_ogl_3697 Gm11:2659401..2660900 Cluster 18
cattgtgagaagaataaattaaacgcatgccatgtgatgtgacagaaatttagtgttagcaagccggaaaaagccaataaaaacagaaccatgaaatgataaatattaagaaagcaactaaagtgactgacaaagctttatatatattctgaatgaaaatagaactataaatataaatcattaaattatatataaatagtttatttaaaaaaaaaaaacatgcacatagttttttaaataatactgactactaattttgttttaatttttaaccatatatatataattttttttcacagctaatatttgctttcttcttttttatgtataaactatgaagtgaaaataagagcatatcttttcaattaatacatatataaaaattcattaatattttattatgcatgtaaatcttgtgtattttttattaaaattaattatattcgactcgcgtataaaattaaactaaaataactttatgtcagttaatcaatcacacactcaattaataatagaagaaatgtaatctttaatttttaattaagaatttgtcggtgagaaagcaatttgaataccgtgaactattttttctttttaattgttcatagctagtatttggatgtattttttctaaaataaaaaataatgcacgaacatctcattagtttttttcttttttggtagtatgatatctcattagttggacaaatcgtgtcaaatgaaactcccattcgaataaaataaaatagttattatattgattctatgttgaattattaagtgtttgacaataattttatcgataatttaaataagttataaagaaaaaaagattactatcgctttttgcagtatgattttagtgggcgtgagtggttcttccacttcctataaaggaagcaatgtggtggggtataaatataattgaagacacacgatagctaccacgtgaaatggctgactcctctcatctgataattgccatcgcgaaaaattgttattgaaataaaagcctgttgctgctttataatattgtcatatttttcctgtcctaaggttttgttttagtgtgtgtcgtgattatcttcgttgttgcttatcttttgcatgcatgccttttgatctgttaaaatgatgtagcagtgttatatgctttgatttgcaaggatattttgtatttttgtttaattacgtgaataaatcatgtgctctgattgctttaggtacatcaatgctttcgttctagagtaggataataattatatcgtaagttgttgaaacacttaaactttcttctaataagtaaagtattaaaaataaaattatttaagtatattaatattttaaaaattgatgaactgtattcatttttttaaaaaattcaaataaaaatatatataagtataattaaaaaaatagaagaaattagtaatacttaataaataaaaaatttcgttaattttgttagttatactccttatttaataaaccttactcgta

SEQ ID NO: 4202 - DNA, 1466 bp, Glycine max
  Soy_ogl_6284 Gm18:59811696..59813161 Cluster 18
attgtaaaataaaataaattatatgataaatagatataaaaataaattgcaaaatattttttaaaacatagcttcactctataaaatattaaaataaacagtacatatatagctataatataaaatattgtagtatataatatacgtaactcgtgtgatttgtaattctcttgataaccctagttattagtccattaatcctttcaatttctcccacagactccccaataaacttattttttcttcctagtatcttagacaaaaattaatcataatatcttatctataaaaagtcccaccaaatattatgctttaaaacatttttatttttaaaacatgtctgtcataattttttttgaaaaaaaaaacgtatacaaatgaacacggtatttctctttgaaattcatctttacacttaaaatcataaaaattagaaacctcgaaaaatttgaagtaacgaatagataccgactgaccattagacactaaccgtacaaaagatggtggctaatcaaagtcatccgatcaagatgagattaataatgtcatgcgatcctattataaaaagtgtcactttcctcttagtatcatttttttatatgcttctccttagttttttttttcctgttgtacaattatcgcaatgataattaatcaaatctttatacatatatttcaacctcctaccactagactcacccaagtgatctacatacttcttattagcaatatttttttttctagatgagagacaatatttttcaactcattacttcagaaaataatcttatttgtagtacataattatagtttatcaaaaagaattttttcacattgtgaaatttaaatatggatttttttattaaataaattatttctacatatataaatataacaaaaccttatattaatgtatcaacctttaggtttctaagcttataatactatttgtaaaatatgttcagaattcttcaatatacaaaacaatttaatcgcaaataaaaaaaaatataaaacaaacatgacttgtttagtaaagcatcatactggatcgccggccaacgatatgtgaggagaaacacttaattctttttatccattctattttatttacttatttacgtgtttccttattgaggagaattatgattcacccatcaatattaattaaattaaatatacttacataccatgaaaaacttaggacagatcagcacaaattcttcacggaaaatatttaatatatgctcattttcttttgtctaaaagattattttagtccatatttttaattatttaatttaatttgatctctgtttattaaaattttcagtttagtttcttaattataaaaatcgagttaatgttgtcctttatgtttaattaacattaatggcattaatagaccgagagtgaaattgaaacttcgaggattaatgtggttagtgtcaattagaccaaaagtc

SEQ ID NO: 4203 - DNA, 1200 bp, Glycine max
  Soy_ogl_6927 Gm20:42162301..42163500 Cluster 18
gttgctggatttgtaaaataaaacataacttttttaaaaactcttttttaacattattattagtccatcctttttatacattatcataaaaataaataactatttttcttttccttaaaagaaagtgagaaaaagaaaagtttaaaaactgaaataacctaagtgtcaaattgaggcttttaaagacagacataagtttatccttaatgctctaaaagatgcaaagaaggggacatgaattaaatggaccttttctttacaaataaaaataaaaaatcagttaattaatccaaatatatgtgccttcctcaacttacaagaaacctacggcctcctttcgaaaagattgtttaacctatcttttcaatgtttcaaggtctcgcatcttctaagctgattctaaattatacaatgtaaactatcactaatatgtaagaactattaattttttttaccgttagttttcattaatttaatttattaattgaactatgtgtggagctagtaaacattaatatcaataacgataatgagtattaaataaaaagttttattttataagtatcactaaagatttatactgagagcataatttaatttgtactgaagtgggtcatgtgatatttgctttcatgcattcgagctgaatgcaaaacgcataattaattgttgaatgacatattgggatgatggtgagtccctctttgtcattttctctttagcataaaagtggtcaaggtatagcagctaatataatagaatatgtatgaacatggtttttaaataaaatgataatttcgacttttgaattttgaatattcgcacagtacaaatgctttcccttttcatagcatatacattatttattatatttacattttttcttctatttttctctctctttgagtcaattgaattattatatttttttttcactcaccaccgagaataatcagagattaatttctttcaagacaaaaaaatcacaaataaattttatctttcttaataaaattttctccatccgtatgattaaatccttaataatatatttaaggagtccattaacaatttactaattgtgttggaccatgttcttatccgatataataatgatgtatatttcttgtaaacttttatagttatgatttaaaaccagttagtctttacactgttgacatggtgacataattttggttg

SEQ ID NO: 4204 - DNA, 1612 bp, Glycine max
  Soy_ogl_6626 Gm19:49563514..49565125 Cluster 18
ttaactaccactactaatattctttaaacattcatgataagccttcttttttaaacgcaccaacatttattagtaggaatttcgctgtcagaaagtgtcatgactatgaattagtatgacatcagatcagacatttagacgtataggctcaccatataataataatagcaacaaataattattcaatacgaatagaatgaataaagccattaaaataagagttgcaagatatctgaacatagagcagcacaatcgttactcagaaaaacacatggacagtcctttcctttccctctcagaaagttgcttgatgtgatgatatccggagactaaattccaacatataggcttatagcacctttctcacgaaaagcaagcaacaggttgcagacactttgaaaccaaacccaccattttcttctgcaataatcataatataatatcctgaataaattgtaaccaaatcttgctttcagtgcgcaaaaactaaatcttatccacaaggacacatacaatacatttgataaaattatgactgttgtgtaatttattcggtttgtgtttggattaaccgtgggatgggataattgattttgaatgaaatttgattttataggattgattattgtaaaatttgattttgatagaagtagaaattactcatacttaattttaagtatatcataatttttttgttagattatttaatctactaatgactcatgtaattatgaaatgattttaatgaaaaaatatctaatgtgatagttcttatgactttaaattatattaaaattattgaagattatttttaagttattaaaataagttcatctcttctcacttcattaaaattaattatggcattaaagaaaaaaaaagatttgaaaaaccaggttatgaaagttataaaaaaagaaataaaagataacttctctttcttttatacattctcaaacatttgttttctcacgaaaggaaaagtggagaacaaggagaaggccaaagataagtttacaggatttctaaaccattagagagatcaagtaaaaaaagtcagataaaggagaaacattactaataattatgaacaatattatagattcaaataagttttgtaaactttcttataaaaattacatggtataatagatgtaagaattatgttatccagatcctttatgatgaagcctaagaaattacacacaagagtaaaattattctaacataatttaatcataagtgtgtattggtagaagtgatgaaagaaaagtcattttcattaagataagacatctgattttttttcttctcttgatagggaaaagaaaaactaaacaaatgcagctcattgaaaaaaaaaatagactttttaaagaataaaaacctaaatacagctctcgaaaagcttttttctttttttggtttggaaacatctggttttggcccatatgtactgtgagttaaatggaccaatctataaatgaaatgtgcatatactcatcttacttatttgaatgtcttatgattaaaataatattattagaatatgtcatttacggaagctgctttcaaggcgcagttattacatttgaaatcatcacaaaagcca

SEQ ID NO: 4205 - DNA, 1657 bp, Glycine max
  Soy_ogl_5554 Gm17:6878850..68802 Cluster 18
cacatacatctattgtggagtggaaaaaaatataataaaaaatcccaaactatattatattaggatacgaaaatttattgtattttttgtttgtttttctacttaacaacattaaaaacagataataaaaaaggggaggatagtataaataaaagacttttttatttatcttcttattttgtgactttaaatttattaagaggtattgacaaattatcataaattcacgatcaaactaatattaattagacaggtaaaaaaaactctattgcttgctgaataagcatattttgctctacgttaatacttgcaatgtattgcaatattgtattttttattgcctaaagtttttcaaagacaatcttattccaaacatagttgaataccagatgtaaatacttctttcaatagagatttgcaatgatataaagtgaattattcatagtaaaaattaatacaatagtcaaattttgcaatgagccttttgtttaccttacatatgcaattcttgaaaagtcaactcaataaaatacaaaaggggaaataacaagtacatgcttatttggataaaagtttgtaaacttaaatgttagttttttttataggaacttaaatatgagttaaacttaagtttgtttatttttttattggcttaaacttaagtttgtaaaaaacaactcaactcctatttttacaaaattgaatttttaagacaaacatacttttaaaaaagtaattaaacatgtcattgaactgagtttacttatcaaattgaatttgaaacactccaaacaaaaacccaaaaataactaaattgttgaaaatactcaagtcctcacatactattggccatataattgattagtattaatttagcaatgtagttaaaatatgatgaaacaattgattgtgactcttattcatattcaactaatttaactgtttaagctgattagtcgaatgaatgaagctatcatacgatattataaactctctgtttttaatttgttaagataataacaatgggttagttaattcaactgaaatttaattattataatcggtttaaagatgcctttcaattataattagacggtgtgctgtaagcaatgaaggatcgttaagttatacttattacaatccaattatccaatccgattcattcggagcaagacaacaccgatactcaagtagcaagaagtctaataaaagatcgtattaaattatatattgtatgtacttatataatcatacttacaataatgtgtttgacgtaaacatagtgtgaataaatgtgatgcatatgtctatagctcactaatttttaattataaggaagttatcatgtattttccatcacaatatggaatcgcgctttccaaaaaaaataataatatggaatcgcgaacccattgaccaatatactatattaataatttagtcactttctaaagatttgaaacatattgaagaatatgaacccatggaaaagaactactatttttcccatatatattgaactaaattttaacatttaggcgtgctctttaatttacatttcttgcaattttgaagataaataatatatatatatatatacttaaatattattaagaagaaactttcatatttgagagttatccaaatttacctgtat

SEQ ID NO: 4206 - DNA, 1313 bp, Glycine max
  Soy_ogl_6610 Gm19:47349688..47351000 Cluster 18
aaaaggaaaagatattatttacttgattgtgttccaaaggaaaagatataattttcataatctctaataaacattagtcattatttttataaaaattattctaggaattagacttgagagatattttcataaatacaatataggaattgaatatatgattacatgcttgagaaaaaaattattactaactatatcatatcatattagttatttttataataatattgattgattatttatcatttctacttttttggtattattcttaacttcacattccaaagttaggaattgattttttaaaatactgagatttatttacagaatcaatctctttctccctaaatatttttttatgcatatgaacttaagaaaatcaaatattttattacatatttaaaagatacaactatcctatcctatacgagattgattattgttctagtatgccatctaaatattgaagcttcttaaaacatcacagttaattgtaagagaaaattcatgttttgaaataaacgtttatttaaaatgatataatttatctaattattatggtatttcaacttttatttgcataaaaaaataaaaagaaaaaagaaaaatataaaaagtactactaaaataatgtttaatgcaactaaaacaaaatatagtcagtacttagaaatctcactagcactagctacttcctacctagacagaagagaaaatattacttttagaaagaaaaaaatcacatctcatcttttttaactagatagacatatatgaaaggatgtaagaaataaagacatgcaaaccttctgcccacaaacttgtttctttgtcttttattgttcacactatgtactggtttgatgatgtttcttagttaccatttggatgttctcattgccaaagaggtatctgactctatttctttggtcgaataaaagccactattttgattttaagaagaaaaaaagagagacaagtaaaccttaattcattatcgtttccttatttacttcctcattagtgcatgctattaccacttaggttctaattttttgggtccgtaatgttagccattaatcgcgagttgactttttcgttatgttgtattgactttcaaattttactaatcagagaaagatgagcttttaacacaaatcattgtcgttttcttgtgtgttcacgggacattatgcaactcaccaattttagacataagagcatcaatatttctagaataattatttgataatcattgttaagtctgtctttcttaatcaagatatgcaaaagctcacaacattgataaacataca

SEQ ID NO: 4207 - DNA, 1453 bp, Glycine max
  Soy_ogl_341 Gm02:3098848..3100300 Cluster 18
caaatatgactcccagcaaattataggcttaattccctcaaattagagggtcattttctcaattttcctaaataaaaaattatatattttttcttaaattaaaacttctaatttttttttatttcagaagagagtaaaaaagagtatttttaaattttgaaaaactaaaaaaagcagtcagtctaattagtgagactaaggggatgaattagattaagattttaaaaaaatagtataaaaaagattccataaattttaaaagattttgtgagactaataatttttaagatttttttaaaaaacctgtatgatttgaattttatactttagattttaatgaatataaatttataagatttgaaaggatttcatcattcaatttaatcttttaacacaataaatcatattaagtaagttttaaagccagttaaaatcggttgtcaacgtgtatcttaatgcccaagaaatcttctactggacagaaacatggtttaccaaaagcaaaattggttttactgcaactctcttcctctcacgtgatttttcaattagccttaatggagcaatgtgactcactaattagaatgagtggatgaaaattaaaaccaaccagaaaattcaattggtttaaaaatattggcttcatgaaaacaaaagaagtaagtacttaaatcaatcagatttaataacgattacgtgaaattgaaagaattaattatttaaaataataaaaaaaaccttttcattttatgttgttacagaaaaacaaagcaagagaaacgagaagtaacctttgcatgacagttataaattagcatgcgactattaaagattatgaggaaaattatgaaatattatacatgaatatctatatttttttaacaaaggtcaaaccattaatatatataagaaacgtaaaatgccaagccatttacactaaccattacatcaacaatcccataacacccagtggaggtattggacccaaagtctgcaaaaaccagaaccataaaacctgctatatatcagaacaagcacataaacaccgttctccttttcatagcctcatatacgccgaatgggacttgaatgtctacatagtctttaagaaaagaaaaagacaagaaattacgagtaataagagaaaaggaaaataaaagaattcagtaaactctcatagtgtttttagatggagaaattaaaaattcttgaaaaattttaaattctaaaaatttcaaatactttaattaaaattagaatattttcaaaagtgtttggataaaaaaattaaaattatggaaaaaatgaatgaaaaaagagaagatattgttggtgtgttagttatacgtgttcctccatgctcatatccgatcgatattttaggaagtgtgtttcttgaagaagacggtaggaaatttaaatttctcatcttttagaataaacttgaaattcc

SEQ ID NO: 4208 - DNA, 1800 bp, Glycine max
  Soy_ogl_695 Gm02:46285701..46287500 Cluster 18
tgttgtaaaaatatggaacttattctcctgctgaaaatgttcctactgtctatgtccagatcctggaccattgatttttttttatttttttttcgttttcgagttaagttcatcttaaccaccattataaattctcctagattgagatcgctttttgatgttcatatttacggagaaatgtgtacgttcaactttttccccctgttatgatactttccttttttattttatgagcatgcaatgcagggcaaatatctttttgactttttttataatttacaaataaattttattgaagataattttattcgagtagaatcgttatgaaggataaatttttttttccagtatttagcataaaatatctttttacctttaataaagggaatatatagcgacgatatatatcactatggtaaatgtattattgaagaaaaaagagaataggatcaaggatgcatggctctctatcctacctttattttatatgataaaattcgatgtttgttaagaattggttactccaatttacttacggaaactatgtgtcataatttcgttcggctacactaattggttatccaataaagtatttaaacgtgcattgatgaatactttacagaaaaagttttcatatctctagcagtgctcttctatagttttggcaccacctatttttttatataattaataatcaataatgagtgaatgaatattatttatgaagggtgactttttaatgaaatttaaatataaggtcaaaaaatttattgataatctaaatttaattgaattagttctttgatgtcaatatgaatattagttcatttgatgcaattatgaatattttctaaaattaaatcgattttttttctaaatcgattctgaccatttaatcagtgaatattaagtcaacatagttggatatgatacaactaaaatagaatacaatgaaaaaacagaaagatcatgtgctagtcttcctcttcctcttcctctcatatgtatataacccactttaattagtgcctatatatctgtgtggttctcaatgagttccacatgatgttctaacctttatttctctcgataactcataaaactttcacgtcactactcctatacacatacctcatgggtgcttgaaaatacgattctttgccttgcccataagaagatctcgtattcaacttcttaccccaaaacacatacttccataccctaaagtagttcctcaactattcacgagcgtaccatgcatcttcatgatcacacattctttgatcatactatcaaacaccgaatagtcattatcttatttgttatttaaaaaaaaaatgtacctgactgtcagagtcttagagaagaggtaaaacttctttcatttcctcactatgatcgaactacaaaaaaggtatttttctacacaaaaataaaatagtgggcatacaaaagggtgggtgcaaatagaagccccataatatttagactaacaacaaatgttagaagacatttcagcttccatggtccatgatttttcaggttgcaatacaatctcagcccaagcatatgtttgataagatattcaataaggaatataaacgagcccaaaatttaaaaaggtcgagtgagcaatgctattaggactacaaaagaaaataatatagcctgatgatgcatttaagatttgataatttaattttttatttgagaacttacttttgttttgtttttttcttgagttttgatttctttctaataatttgacattataattataattataatatattataataa

SEQ ID NO: 4209 - DNA, 1376 bp, Glycine max
  Soy_ogl_5222 Gm16:1078701..1080076 Cluster 18
atgaacattctcattattcggcggttagctattggcttgggtactagtacctaacttagatagcaacataaatttaatatattagtaattgtaactaaggatatagttggacaaatttacaaatttagcttgaatttataaaatatcaatagttttgaaacaaagctaaaatgctaaaatatttactctctccgttttaagattctattatctaatttattaagattaataaaaatagttaatttagttgataataataaatttatcttaaatttatatatattttttaaagcaatccttataattaataattttttatcttctaattatttgttaatatattttttctcttctttaaattaagagtatttcttgtctgaaattaattaatgcaagaatcattatgaaaaagaataaacatcattttaaatttgaatttgataaataaaaatgaaatgagtataatttaggaataaaaaaatgattaaagtcgggaaattaatgaagtggggggaaaaccaacttatcacctttctcaatttcccttttatttgcataataagagtcaaagcatttgacttagctatttatagctagcactaaaataatgacaaagcaaaatcatgaaaatctctaccaaaaaaagaaagaaaaagatcttatttgtaaacatttaggagtgtatttattactattatatggatgaatttggggtaccctacccaactgtctgtctgctacctttggttacctcacacgtgcggcaatcaagagagcttctcaaattaattttgttcatatactaaatttaaatgctaccaccaagcaatggatcatatatgctgaggatgttccagcttaattaacatgtatttgagtcttagatatgcaccttagttaaatactcacagtaatcttatccgatttgattatttttggtgaaagataattatgatttagaaaataaaatgctaaacaagaacatgctaatgatgctccgcagcacaaagcaatgtagatttttcaatccccagacaacatcgtatgtgtcacactctccgcagtccacctaaactgcgtaacacgggtgcacctaaatgttggagccgtgacactttccattaattctttacctaatctttggagtatacaaggtggcagatgaatttaattgggttttcaatgatcgtgtcacatgccccctgcacctcagtttctggctcccacatgatggtaacattgtacaaagctgcattttgtgatctccctagtaatggccaagaatgctttattatatgcaaccagtgattcatcttaccattacgttgtgatgggaaaaaaaaaatgagaccttctggtccttgtccaatataata

SEQ ID NO: 4210 - DNA, 1007 bp, Glycine max
  Soy_ogl_5806 Gm17:39855869..398265 Cluster 18
ttttacagtgaaaggatcattcattgctatcacctcaaataagtgtctttggactgtcatccattcacgtacaccttactcccaaaaacaaaatccctttcccttgcatttgtgtccactttccattacatgaaatgacaagtatttcatgcccttaattcctcttcttcactcactttctctttctcgagaaaaaaggaaaagggaaattgacactgtagtacataaagtcatgagttaagtgtatataaagatgtcccattcagatctattcgggaatatatttcaatccaaaaaatgatgctgccggcatttcactttatttggcattatacgttaaagcaaaaacagcagtgtgatatatatttgagcatatcgacaatcactttccatcaaattccaagctaaaaggtttccaaacaaaatgaacactaggagcttatagagatcaaaagctacttccccaacaaatactagtagccacaactttgcctcttgtcaatggttcttttttctattactaagctaaaccttagatactactcgagtcaccattttttgggtgcatatgttattatactttttaatacgagaccattaattaagtttggagtttggaccactatttgtcgtctattcatattcaatttcaaatttgtttcaataatctcgggtatgtcattaaatggtgaatgtttttatttattttaaaatgttgctatgtttattttgagtatgatatgtgcacattgtatagttataatctaatagtgggtattataaaatattcatccataaaagatatatatcaattaatgtaagagattttgatttgtatcggctttattaaattttaaacattaaattattttagtagattataagttgttaaattattaacgaacatacttcagtgtttgattttttacataactaatccagtttgaagcaacggtcaaagaaaacaaaattttatttatatgaactagaaacaaaaggaaaaatat

SEQ ID NO: 4211 - DNA, 1615 bp, Glycine max
  Soy_ogl_333 Gm02:2757086..2758700 Cluster 18
gacttgttcaatttctatatactaatagataatgtaaaatttatatttattgatcaatcacaaattataattaatataacttttaagttaattattatatgggtcaataaatttacaatttgtaattaacggacattataaaaaattttattcaatacatacattatttattcattatgctattatgtgattaataaactcttctcctagtcaatatcaagaagtacccaacaaaaaactttatgtgaaagcggcatgacatgtctgaaattcattagttagtttatatgatgaaaaagaaagaaaaaatggaaggtaggaatggtttggcgtggcatcaaaatatgaccaaattcggagtgtgggttttatgataatgatattatttaatatcaattttagggtgtggaaaaaagtggtgaattttggtggcgctcttgcatgtatagtgtaacgcaatgaaaacctaagaaaagatggaatagacaagagaaataggagaggctgtttagccgatagattgtaccggattgcataattgtgaaggaataaagatgaagtaaaagagaagagttgagaaagtacaacgaaaatgcatatagaaggtctaatttttatatggtgaatatatggaaaggtagatatggttcatcactcagttattcctatccttccttttggtcattaataatcatagtgcatgtttctatataccattcctttactttgttaaatgcgtaaagatgacgtgtaaaatgccttgtctatatttcctttaatttcttcctcacactatctttatgatcactacactgctcaagtgaatgaaatttagacagaatgatatgtcaccatgcatagtgcattctacactatttaccccacggagagcccatgcgttcccatcaaccaagagagagagagagttgcacatgtttggttgagtttatctcaattttaaaaaaagtaataattcttttctagggtttacgaaagagagtttaaaaggaaaaataattatttttttcataaataatgttgtagatgaatcaagatagggtaaattttgtaaagtccaggtctaatatgtgttttaaatcttaatccaatctatttatttaatataggtatttttaaggcatagtttaattttcttttttaaaattcaatctaacctgaaagcttatttaaaagtaccacagtttaaatctcaagtatgaaagaataccaagacttatattaatctgtataattttagagtggaacaattcgaggtgtactcaaagattaaaaaattaaatggcaccaagacgcttaataaaaagataaacttaataataaaaaaagaaagaataccaagacttctattttgtcatgtgtacgtagggaaagtgatcattatttaagctagagaatcaaataggaattcaatcccatgtatattttacgagttcatacttttaatacgtacatctttataatgtgggggtaaaaagagttgagtgatgtttgagtcccacgacattatagtagtagtttcgagttagaaccccaatgcgggattatgcaagatatctaattgatcacttgtgatgggttcaccaatccccactta

SEQ ID NO: 4212 - DNA, 1852 bp, Glycine max
  Soy_ogl_1509 Gm05:1248801..12252 Cluster 18
tattattgcggtatcacatgttcttaagaaactagaacgtatacatatttttttctcaagaaaagtcacatatatgaaggattgagtgagacataaatgaagacaagcagacaagcagagcatgcatggatacatatggggccaggggctagcccaagccaaatggatcgagttgacctgtcccggctagggttctgattaataaattttttatattcttttttctttctcttttcttctatgaaaaagaaaaacaagccagcactttttcttcgcagtgtcagccgtaatcaccccatcaaccaagacacaaaaatgaaagaagaaaaacattgatacgtatatgactccaattgtaagcatatttagatgatttattgatttattctaaaattatgcttaacagtaaaacctaacataaaattttatatatagcgtaaaacgttacctaaatatacgtacaacatctatttaaaattaggaaaacaataagattgtactatttaacacactcttttaaacatattttgttgaaatttatttgaaatcataaaattaagtggatctcacatcttatttaatgtttctctctcataattttatagtttttaatacattttaattaataaaaaatagtgtgttaatgatgctactcttaaaattatattaaatgtgggtttgtattagggttgacaaaattaatttagaattgaattaattttataaaattaattttggagtgatatgatttatgtataaatatttttattataaaattaaattaaaaataaaatttagtataaaattttagaaccaaaacaaaaatgtcactcaaagttacttcaatccatagttaattttgtatctaaaattaattttgaattcttctctaatgtaaaatcaaacttataaaatatatttaaagttaattttacactcaaaatcaattttagaaagacaaatcacatgtgaacttaatttcgttgtaaaatctattggtaataagcctttttcttgtagtgacacacattagttgatatttaactgtgatgtagatgataatccaatatgatttgaaaagggtgtatcttactcatgttgcccaaagtgtatgggacctggaccatgagtaaaataaatggtgtaatactggaagagacacaaagacaagtagactcgaaatcctccactattggtgcagccatcacaaacctgatgtctttgctgttcttttcccatcttttccgctacaggtctgcttaatttgtttgtaccttactccatcagtttcatcattaagctagccaagtctctaaatacaaaaatattgcttaataaattaaaccaatgcctacttaattagcttgggacatcaagaaataatcaaaagggtgccttcatagcttttcattttattttaatatttttttctcattatggccggatcactatatggttgttagcttatctatcctcagacatatcgatcagtctctgtctatgataaccgacaaatttctttcattcatttttttaaaatctggaatatatatgggaatttaatactttatttaagggataagattattgatgaatcaatgtaacactattttggtaacctttctttcgttcatatggactaattaatccgggcaattgatttcatgatttgctttccagcaccagcagctgctagaaaagatgatggtaatggacacctgattctagtgcacaatgtatccatatagtcactgacagatcattctgcacagattattttatgcggtttgttgccaacttgtcgaatttcaagtggaatcacttacttgtacttggaaaataacacaacctg

SEQ ID NO: 4213 - DNA, 1400 bp, Glycine max
  Soy_ogl_1542 Gm05:2087901..2089300 Cluster 18
caaatctatatatttttaatgatcaatagaatattgataattgtcttattatattttaaaatttatcattaatgttatgactattatatttaatacatcattttttaatttttttatagactcattttcacttggagtcaattagacatactttttttttatttggtctccttgattgcataagaatgaaatcacatttaagattcttttcaatatatataacaataaaatattgaaaccaattatgaaagttagagcttataaaaaaaagtttgaataatttttttgtatttgttactatatcacttttaacttttagtatctattaaaaaaattatgattccttaaatatccaaatcgtgttttgtggttcttaagattataagtcttgttacaaaaacactcgagtggctctatcttgtgtagctatgtaagcatttttgcaatgtgagattgtcgcgtacgtaacgacacctagcttacaaagtcgtttaagaatttttacaacggaagtatcaaaattaaaatatttgaatattataatgataaaaaaaatacagaaactaaaattcaaaaacaatatatttacagaggtaaagaaaaaaaggatttaatcttgaaaaaactatcaaaggatggataaattgaacaaaacaaaagtatatgaggtgacaggtgcactaattttttttacttacgagtggtatctcaatccaattaggtgtttacactaattctttgcctagaggttacatgagattgggatggaacctttaaatatccttatatatttcatacggtcagtttggattgctccacatatattctttattgaataaatatcttcaaaaattctgtttcttttcgaagacgtgttctctcacaagaattggataaaagagttatgcaagatttcactcttgggttcattttataggctttgaattggattaaaaaaaataagagctttaggtatgagacgtatgactttgaaggttccccttttataggctttgaattttagatctatttcacaccaaataagcataaaatattacagacttctaataattttcgtttggcataactggccattgatcagtgctcttgttctctattctctttactgtacactacgtagacttcttgtcatatgaaatgggatttgacatagcatatattaataaaaataacataaaatattataagggttggaatgagtcataactcataagatatagataggtggttgggagtcatacgaggtggaatatatataaggaagtcattcgtatattaccggctatgaccaatacatgggccttgattattttttcattaaatgatttggcctagcttgctcaacttgttatactttgttacccacgtcaagcttatca

SEQ ID NO: 4214 - DNA, 1570 bp, Glycine max
  Soy_ogl_2561 Gm08:8409601..8411170 Cluster 18
ttttttagttaattaaaattgattaaaaattataaaatcagtagaagaaaaaaaaatcaattatacaatctattcatattattcctacaggttatgatagtgatttttatatgatgaagtgtgagaaatatctcaattgattttttatttgttttcggttgtgtacgtctgcttaacgaattatgatgtcaaatactatgctttgtcattcaacaaaaaaaaataaaaatactatgctttgtggttttattagagtcctaaacaattttaccttggatgtatgggatttgtaacgtatattcactttagttttaaaaggaatatgttaccttggatgtattttaaaatatgacaacacgccaaaaaagaaatatgatgacaattttaaagtttgtttatttctatctttttaataaatttttaaaaataattaaaatatattagtaaatttaaatgtaccctttttagtctgtattaatattgggtgtggttttagttttttgttttatttttaacccattaatataacaaagtcaacatggagcttaaaagtatttttttcttcttttgcaccttagaattcagaatgcacatttatatcatatgtaattttaattattattattttgaatgtatgtacttttaattattgattcaaactttcagcaattggccattaagatataaatattatagtacatatggtacatgtattgaataatatgtagttttggtgacaagttgaaccgttgaattgaagtgttgaaccaatgctataaattctgttggcatcctctttaatgagttagcctctaaccactagacaactgacagcgcatctgcatgcatgcaccaccaaagcgttcattctgcaattaccataccatgtgaagtgaagactctcatatccttgttaataggcttgttctgcaaccttctcttcttttttttttatcaataaatgtagaaaataaattgacattataattattgaagtatcaaattaaacaaaatccaaaaaatttaaatttaaaaaaaataagtcatgtgtctcttactatgaatgacgcgccatgcatgaaaagaagaagaaaaaaagagtgtatggtaaatgatttgtgccagttttacaatttaatgaaaattaaaataggtaaaaggcaaatgatttttattgaagatactaagtggatgaaaaagactatgaaaaaatattttactttgataaataaaaattgaatttattatataagaatgggtgcagtatatattagaagtatttcaataataaatatcaatttttcattggagaaagcaaatgaaccaacgtggggagtcgggaccattcaggtttgagggttgatctccattactccataaatggcaacagaattgggataagcgtgtgatttcagataaatttcttcttacagtagaatacacagcttctttagattacacgaaaaaagtgatatatcaccattctaattatagggtacagagaaactcctagctagcaagcttgtttctgtcattgaacatgcacaacatttttttttattatcagaca

SEQ ID NO: 4215 - DNA, 1125 bp, Glycine max
  Soy_ogl_3767 Gm11:6240243..6241367 Cluster 18
cccaaccaaatttttaaaaaattaaaatagtacacaattgcatatgatattaaaaaatattaaatatattttagtcttcttaataggataatatttttttagtctttcaaaaatatataaatcattttttattcctcatttatgaaaatatgtcaaatgcgatttttgtttttcaagaaaattgcctctttttaattcctaatttataaaatggagaataacatgtgatatattttcataaatgagaaaaaataatttatttttaaacgactaaaaattattttcacataaattacaaatatattaaacccttatgaaaattaaaatgttagggaaagatgtccttgctattagtagcctccctcctcaaaggcaataaagaatggtatttaaaggagggagctaaataggaaagagtgcaaaccacgtgttcaataattcttgaaattttcaattacattgtgtttggtttaggtgaaataatgagaaataagaaaaaaaaacagtaaaaggatataaaaaaaaagttaatgtgtttatttggatgagataaagtggtgtgaaagtataaaaaaatatacgagccccacacgacgtgacacacttgttgcaaagatgggaaaaagaaggagaatgttattgacggggcaaaataaggggttgtagtttgatttttacaaaaccaaactttgtctcgtgatactcgtaagagtggtcatgtgtccctttatctcacattttactttgttgtttgtaataaggggtaaactgtatatttcctctgttcatttttataagatttttttaattgatttatattttttaaaaaaaaataattaatttaattaatcacgttaaattcattaataatttgtaatgtttttctctctctaaatcacccctttatttctttaaaattaatcatctctttctttttacctaattgtttatcacttaattgttatttatcttctcccagtaatttctataatttactatttcttggctgatttttttaattaattaagtgtactttaagaaaataaaattaatgcaacagaccattagaaatgtgtcttataagagacaaataattttttggatagagttgtatacaaataattt

SEQ ID NO: 4216 - DNA, 1187 bp, Glycine max
  Soy_ogl_5238 Gm16:1865056..1866242 Cluster 18
cttacctccacaaaattggatcaagatctcataaatagcgagaatccctcgatttccgaacatcaatcgttatgaaaaaaataggagtttcattctaattaaccaacacaacaattaagcacaaaccaaaatctaaatacataattatgaactcatgtgaattaggaaggaaactggtgctaagggaagaagagatggttgcggaaggaatcaggactaggtcttaacgagagggacaccacggaacaagactgctgtggagaatcttaggttaaaaaatgatatttttgtaaataaaaattcattaaagaggctttcatgtttaccaacttatttggataagttactccaaatatcttatccaaataagttatttttagcttttgcttttttaaaaaatttatacaaacatctaaaattttataataagcttttttttataaaataagtgttttttttttctaaaacaaacttgagcaaactcacccttctattcgaaaatcttaaaatagtcatgtcgtcttcgtttgtttcatctccttgttcgatggataatttcaatcaacaatgttgaagtacgataacttattgaattaattataagggacgaattgaagtaaaagaaacattgttaatgtcgtcaccgttttcgatttccaataaacttaatatattgataaactttatttaattatttaatgatatagtatttgtaaacgtgaaccacgagagtgaaaacttctgctgcattattagaaaaatgattatgtccactgaacatattttaaccgtagtgcttttggtttgcggcttgatcactccttaattagtaaatacatttgttatagtatcaatctctctttttaacgcatgtcgttactactttatttatatatcattatatacctttcaagtttcatctcgaagtttctttttaaacacgtatctttaagaggggataacttcctttaaaaaaaggggggataacttaagctaattgttaattcataatagagatgcaattcctatagttacacgactaattttattttatctttcggtttttatatttggctattgttttttataccacgtgtataattctattcaaataggttaggactaaattttttagaggaagtaggttaagaatattataaataataaagttatcttcttgaatttta

SEQ ID NO: 4217 - DNA, 1505 bp, Glycine max
  Soy_ogl_5559 Gm17:7163296..7164800 Cluster 18
gaagtgatagctcaagtgttgttctggaatcaaattagctttcctttttttttatcctttcaataaaataactcctccttaattatcattattcaattgaagtaattaccatttactttcataatatgataacaattacttaattagagtgaaaatcatataacactattgactaatagggtaataattctttgcattattttttttgacaaaaattatttacatggttagttgtgccttatttttttcttcttctaaaatttgagagaaaataatctatgtgtggaataatataaaagaattttacattgctaattacaaatctgaaaattttattttttataataattatcttaaaaatcataaataaatcatctcaactagaaaaagaaacttaagattctcaaatgtcaaaatctcaccattaattcttttaaacatctactttgtaatagaaatatattactatattaatagaacttattgaagggctaagatctcatccggttataattgtagaggattcatttccttaaaagtgatatccatcatgatttataactgactaataatttacaaagtcaatgcgtagaaattacactaaaagattaaactctttaaaaaaaattagagaatatatatttgattcggttattctccaatctcatcaagtatggaggtatgggattcaattctcctcttctgcctaaattccaagccataaaggttcctctatcaactatgatcttaaaaataccaaacgtatctaacaggactcgatctccatgtaatctctaattgaaatctatggtaatttgtactgtgattatgaacatcttgaaaaagtgactttttaaaacaatataagttaggtgatgatgagcacaattacctaatacactcatactcaaaatagttataataatttattcaagtattttaataattttatcattcttctcgtaccgtaaaaagaatataattaagaaaaagaatactatacgcatgcatgcacgaagaaaaattagtggattaatgtaagtatagttaacacattgagattatcaacggtgttttattttcctagtattaaaagtaaatttaacacaagttgttgctgttttaatatgaatttgaatttaaaaagtaaaaatatttattttgtaataaaaagttattcagtgctttctatataaatttaagcatgtcgctagatgtcagccaatgattatagatatgaatgctcaaattggatagtggggcttactggttccgcttccacacaaatagtgcagattaatggcgtgatgtcaattgggaattgttattactattgtttgcatattatatatattccgctttgactcaagtccgaagtttggagatcgagaagggttattttcatccaggtatgagctctgttggattctcacgttctggaatccattgaaagaatgacgatcttagaagcacaacactatatatgtatgccactggttttgaat

SEQ ID NO: 4218 - DNA, 1500 bp, Glycine max
  Soy_ogl_6627 Gm19:49632801..49634300 Cluster 18
ctgagtcataaaggaaggtcatggaccagccatgcataaatcttaagccaacagcgtaaaccaatgacaattcaaggcatgatccttgggagagaaaggaaaccattggctcaaacgtttactttatttattttctctcaatatatagaccaaatttgaagcctattagagcatttctaatagaaaatgaaactttatgattttaaattacttttttaagtctcataatgaattcaccttctaatatttagttacaatttattttaaaataattaaaattaattaatcatttttttagtttggtaaaaaaaaaacattaaaatattgttttttagtttcacgttcaaatctgatttgtttttatagaagaacaaatttctatggtaaagatcaattcccttactccaaaaacaggttttatatatgttacataaaagatggggatataaaaacaggtatcggtgatgctgctaagttttgctttccataatcttggtgttggaagaagttatcaagctttcaaaattgcagccccacatgccgatagtagtaaggaagcactcgttacagctctgattgtgtctctgtctaagtattctccattgtaaaaagttgcacaggatttctaatctaactactcaactaatttgaaagatgacaggatgattttacacagacaaccttaattcgatgttagagttgggaattcaaacttacgactaaaaataatcatgaatcagatttaaaaaattagaaaactgtttgtttttattaaaaaaaatacattttcttaacaaataagtttaaactttaaagaaacagaccaatttgctcatcatcggcttgaccttaatttaattacacctaaattgatagactagtatctagtatcttcaatgattcatttactatactattttttaaaaaatatataagaaagtgtaacataattgatatatattaagaattattatcaaggttcgattcctaattttttgcacgaaaaaagaatttagttaaaataggtagaactcactggactttaaaacagattagttttcggttattgattataaatactctcaaatctcactggactttcttaccatacttacggttaattaatttaattaactaatgattagttagataaattgtgttagttactaatgattaatagaataaattttggacaatgtattttttatatactacatgcattttttactatagacaacctgtggaaaaaaattcatattagaattttgagtttcttcttttgtacatccttttgtttcgtttgaattttgtttcatctccggggtgttttccatcgttttccaacagtttaagttgatgcaaggttacccattaattaatctaataacccgagttgaattgtcacatttctccatttttcaactccactaacccaatcctatcacttcaggatggtgctatctgcgtgtttgaattacattaattcagggtcaatttttc

SEQ ID NO: 4219 - DNA, 1261 bp, Glycine max
  Soy_ogl_6968 Gm20:44003840..44005100 Cluster 18
catcatactacttattacaattattacattttcttaattctcttttatctctggctcctttctaataattgtatgcacgctatacgtagtttcaatacatccttattcaagttgcacacttgcaataaacagtgaggggaatatttccacagtatctagctagttcgtgcattattagctggttgggttatatgcaatgcaagattccacctgaattctgaggcaaggttggaagaggacgagaaccatatattggcacttagccgagattcaatttgcaaggttcagttgggaagaatatcctcttcagttttgataaaaaccagatgaaatctcagcttttgttttattttaatatttaataattttaagagtaaattaaactaatactctctaaaattttgtgagattacaaaaaaaaattctatatttttcagccatcatatccatttgtgggggggcataactcaatataaattgatttttaatactacattttaaattatgggcggggacagatgtaagtacgtgggtgactatggggtaattgcctcctacaaagtaaatttcttacttgaatatattaaatgattattatttttacttgcacaaaaaaataagtgttgtctcataaaatattttttgcaaaaaaagaatgggaaagattataaaagataaaagaaaattaataaattggtactaatttatccttttaaatttgtgaaagcttaaatattttgatttttttattaggagattgtatattttataaaaaattataatacttttttgtctatgaaagtattataaagtatttctttgcctcgttaaaaaaacttctgaatctgcggccactaattatgggaataatttatagttacacatgtatattatattaactggctcatacgattttgtataatttattcatgtccgtctcctcttacacctaagttaatggctgatgctctcggggtgttttttcctaagacaaagctagttattttgtgtttccgttttccgtgttttaaatttcccactcaaaaaaaatttaactcatatgattgtttttgaaaaatattacaataacatccttttgcatataaaacattagacttaattacaccaaatttcatccactcaatttaaataatctaaagaataaaattaattcacttaaaaaatgctaattagtaagttacatgagatgtctttattatttctaattaaactaattgatgaaaatcaattggtgatagca

SEQ ID NO: 4220 - DNA, 1485 bp, Glycine max
  Soy_ogl_6987 Gm20:44499316..44500800 Cluster 18
gagtgactattattatgttgaaaaaaagaagtaaaattgtgattctgcattaatatcggtgaaggggattaagatttatacttttaaacttatgtttaattaaagttttataatttaaaatagttgtaattttaattttttaaaactaatcaaggagtaatttgaaaaaaacaatctttaattaatgagaagacatatgtcatgataattttattggttaaaaaaaaaaagtaacaaaatcctcacaatttttgacgtaccatagaaactctatattaaattaagttttttttattagtatattcaattaaattatagttcataaagtttgggtagattcaatgtagtggaagtcaagtgcgctgatagaatgcaactcctattagtattatgaatttataacaagagttttaagagttatgctctgccagttttggtatcaagctagatctggaacttgttttgtttgttgcgatatcatttgaaagttcaaactgaacccatgtgtcctatgtcgccatgcgcctcaagttaattgacttgaatcttgtgattgttgattactcacgcgtataaattatttatgtgattgctcattattcatgagctttaagtttttaaattttaatgattttagattaaaatgggatatcaaatttgattatatgcattactcacgggtgtaaattgtttattcccctcaattctccaacaagatgttccaagttactttcacggacaactcttggtgacttagaagaaacccatcatccgtttgctctgttctatcgctatttcttttcgttgtctgctctactctcttcgctatcaccttcttacagaaaaaagtataaaaatgccattgtgctgaactcttttgttctgttcttgtacattgcgatgccaatttttggtccactatatcctttaatgtctactgatatattggaattgcacactctgaatttaatttgcaaacacacaaacactctttccacttgtaaatagtaaagcttgttcaaaagaatcatttcctccccccataatagacaagttaatagataatttctatgggcatcatgtgctttcctttcagatgttatgttcaaatatttatcttatcagaactgctacgaaaaatgttggcacggattaatacgtgttttgttatctcttcctttttaaaattaaaaatacagtttagttcacttttatttatttactttcacccagtgaccgtgcacgtaggaggaacacgcgcaaaatcatgccaacaaacggctctatgtagaatggtgggtaaatagagaaaacctgccccagtaaatggctctacgtggaatgatggattttggtgaacagaaaataatgtgtggctttccatacatagaaggtcattgtaattttttttttaatttgtaccgagctctagtactagtatatatgaacacttttgaaaaaggtaacaactcagtcacatccaat

SEQ ID NO: 4221 - DNA, 2164 bp, Glycine max
  Soy_ogl_5540 Gm17:5818601..5820764 Cluster 18
aactatattgtccaatgttggttaaggatgttttttttcttaaatatatagtatactttttaaataattttaaaagtagttttaaactaaaaaaattatttttgattttaaagttggatttaaaattcatccaaaaaaaattcaaattgattttcctacaaaatatgaatctgaaatttaaattcaatccatttaattggatctggatttaaaattcaatccatgtaaatggatccgaattagatttttgaaaacatgcccacccctaagcacaagttgtgcttgcacaccaagttccaacatcatgataaaatctgaactaaaaaaaaaaaaacaaaatctaaccccacacgggatatcaaacccgcaagattacacatgccctgtacatgtaaacgacccaaaacatatcagaaaagttgcatcaacaatgcttacggtccataaacttaacagataacaatttccatgtgatctccaaatccaatttctgtcgaagcatatgccaacattatcacaattcacaccagttcttactcacaaaaacagttcaccagaatattcaaacagtaatatactcacaaaaaagttcaccattagacacgctatagccaaacaaatttcaaccatattagcatctacacaggatccaacgctgaaccttccagaaattcctcccctgctcattctgttcatacataacctgatacttttcctacgacattccacagggttctgcaaccagtccactaatgaataagagaaactttcttccgtgcctttagccatttccaagagtaaagcctttgcagtttcgaaaatttcattacattgcattggttgaactctgaatatcatcttatttctagccaaccaaattgctcttatttactactgcatgccacgcacccgtccaacccaccaagtcagcaccatgattatgatattaaatctttcattatttctctattttattccaagttaactaggtaacagaggttttttttttttttttttgtaatcacagatacattgatagtaattcactaccactatacacgtaagcgaaatgtcacattagctattgattaatgtgcaatatcacattagttattcatttgtggaacacttcaatcagtttaatgccatatttttattaaactaattattaagtaatgaaaacattaactagaaaaaccaatctgagttcaccattaacaaaagcccaaagaaagcagacagccctgacaagtgacaacgattagtaaagctcaaaaagaaaccttgtcagcacttcaaacctagtaagaagaagcccaatacaacgtgatctatctgagtaaaggtactactgctagcctgctacacaatgttggtgcctttcggctgattattattattattaatgttattctattaaaaattgaccaaaataaataaataaaggttctgcaaaattatctggaaaaagttcaactgaaattagcggacgataggataccactctcatctccgtaactctaactatgaatgacaacttttatggtatgtttggatggaagaagaaaaaatagaaaggaaaaaaatatgaattatgatgttttttttttttttgttggttgaagataaagaaaaaacaagatggagagaaaggttgattattagagataaagaacatattgttcacatttgaattaattttatttatataaataatttttagtccattttagtaccaacaaaaatggttagaactaagtttttaaaaaattaaaagagccattgaattggtgaaggaatcagttcttaatttatggatcaaatgctcgaattgagtaatttataagaattaaatatgtcctctgattaagccttggacccgtatttatttgggcacgggttcatttattagcttttgatttgacgtatgcgagattccactctaattaatatcataccattgatccgacaaagtagaaaacctcagtctcgctcgattcatgcatctgatgaaaaaaaatgtcaacttgtttcgggaagatgtagtgtaaaaaatatcgttattaatttctaactattttatttaagaaagatttttattaaaatacatataattatattaattatgacttttttttaaaaatttcttataatctttacaata

SEQ ID NO: 4222 - DNA, 1494 bp, Glycine max
  Soy_ogl_1160 Gm04:1257901..1259394 Cluster 18
gtcgttacatgagagctattgaggtcatcagcatcttcacatggctaacgtgagcacaagacccgtcatccattttttagttgaatcacaaataaacccatcaaccctgccatactaggactatcatatcatggctaaaacttcctgcacctacattcttgtttgctgcactctattacactcctaaaagttcaattcagaatgtaatttacattttagattgagctttccgtaatgcaacacgatccaggaagcaacagtctcatcatatgtctgatcagaaaatcttttaaagctgcgtctacaacttcacaaggtgtagtccaaatctggtgactgcaaatttttatttttaaaggtgatattttttaaaaaaaaaattactcggaatattaatttgacgaaaagaaatgaaagaaactaaagtaacctgaagaatgacaatggttatgtttgaattatctaaataagatcaaataaacttgatagagtttattgtagttttaaaaaaaaaaattgactcaactaggtctctaaaataaagaaaattactaaacaatcataaatagacatttttatttttcattcattttccttttagatctttagataattagtctttaaaaaaaggtaaatctataccatttcagtccttaaaagagttatttgtgacctaaattggtttctgaaaatattaactaagatagatgaagggttaaggtgcttacatttgtaatattaaagattattcagcgactttttttctttaaaattaaattatgtcagataatttattttgaggaatggataagtatatgcactaaagtaaattaaaatgaaacaaatgaaatttaaaatcaagttattttggtcaacttactacaatctgctctgaagattagcgttacggtgacaaagaacacgggtgctatattttctcctgcttggtgcgtagatattttagcatcaagaaagcatgcaacgacacggagaatctttgcctggcgtgtcttttgtttcttagcaatagcagcacaattctcttgactatactgggtttgattatttgaaaaatgaaaatagtataattattttacagttttcttagtctaaaattttactaaacttactaccaagtctcccagacttttcactgatagattagcaatttcatttaaattgccaatgtgaatcgaacttcttttttgagatgttaattgttagattttgttagggaaattggactcataattttttttaaaccatccaattaactttatagttccttggaaattaaattcaacaaaaaagaaaaaagatattgtgatccaattccaaatggacgagttagtgtcaaatactaatgtgactgcactgactattgaaagcggccgaccaacttagaagaaaagttatctccaaagtgagggacagattcaatgataacgcgtatttgcgttaagttccgtgtccttcacattttgttctgtttgt

SEQ ID NO: 4223 - DNA, 1439 bp, Glycine max
  Soy_ogl_1733 Gm05:38592101..38593539 Cluster 18
gtacccttgatcatacaagaacaatttgtaaaatagaccgaagcttcaacatgcatactgacagtgttaaagtttatataacatgtatcataacatttataaaagtagagagtaggatgtttgacaaagtattccttccattcaccacaaagtttgctcaatacaagaatacttgcatcaagggtatctatataaagcaaatcctgtttcccagtattaaatacatgtctgtgttagtaagtgggaaaggagtcactaggaaaaaatagataagagaaacaaggatatatgtgagatatgaacttctagagacttgcctaaaactgtcatactatcttatcaaaattattttagcaattatcaaatattcaaactcaagtagcactaaccaccattttactttttctccatttatcttgagagaatgacatgccctgttggaactaaatacccctaagtcataacaagtctgcattagataaatttaatagcttatgcagtataactgatgaggtataattttctccctaccactaattatcctcttgcttttgtaccttataatttatttgttaagtaattttcttaaattaaacatgtgtggaaataacaccaaaaggcatgtattagccacttgatttccatttccaactttgtgatagtgttgaccaactattgttacttagatattgtttttttttttatcaattgaagacacaaaaactttgaacatgtattgaaaaatcaagttattttaagatatatcttttaccaactagttgttgttatagacctaatggcatggatcaattagttgatttatatatagttggtgtggaataacaaagcttggttactatatattttggttgtaaaccccataccaagtgaaacacaatatactgaattattaggagaactagaaattaaaaacaaactatgtttgtaaataaagaattgtaattgagttctatatattttgtttttggaatggaattgttacatagttattcaagttttgttttttgagtcaagaaaattagaccttgtaaaattattttagtgagggggtagaatttctagtataaatggtaaaagcaatatggcgggttaaagtggtaatggataaacaggtacatttgaaagccattatcatttggttgttgtaaaatactgtcattagaaagcataattttgaacaacccttagttaattttaggtttgggttttctttaatggcacaaattaaggaattaaaagataacttttttcattagaaatcacatgggagtgtatttttatgcatcccaataaaatactctttttgttttactttctggtattagttaacacatgcattgtttaattgatttcttttgtattatagtttgttacaacgtaagtaattccaaagggcaaaggttatataaacggttaat

SEQ ID NO: 4224 - DNA, 1974 bp, Glycine max
  Soy_ogl_2133 Gm07:2431901..2433874 Cluster 18
tttctcgtgataatcaataaagataaattttccctcttaatttatctaagtcaaatctcatgaaatacctatgtcacggatttagtttgagattgatggtttagctttacgcaactgtggagagcgatgtgcagtgataatgtcgtgatgatggtgggagacctctaccatgtgcgattcagaggtcttagttgtggtggtgaaaggatataaaacgaaatagagcgaagcggtttaagaccaaaattctgatgaagatggagaaaatattcggtagagtagatacaccataatgatttgtaagtaatattattccaagaactaaaaaaaagtgtgcaccatacataaatttgcatacttgatcaaggtagcttgcaccagaaaacatagcttcaataaatttataacttctctagttgtcttggtatgtttgaacctacagttgagacagttgacatgattctagaacttaacccgaagcccataatcatattaaaaatattgaatttgatccaactcaagtcatgacattgactattctaataatgtttaatctaaaaaattaaaataatattgtttttatgtttgacgattatggtggacggggattgttgtttttttatccacagacagagtttattatgatattagtttaatagtttacactgacatacagaataccgtcattatgatatgagtttatatattagtttagttagtttgcctttaaaaaaaagtagtttattagtttttttttaaaaataatgaaatgagtttactagtttactgttctaattattcgtatcgtgtaggaattttaggcgttcacgttctaatttccgcagtataataatggcgtatcgtgtacgagttgccacaaacatcagttgcatgttgcatactttattccttgcaagttacgataacatcaacatgttgtccttgttcacgtaacacgtgtaaaaggtttggaatcaaaataatatggtaaggttcgtagttagatcatagatgtactaaaaaaccatatcaattataatcattaaatatcaaccacaaattaaaaatttgttatgtcagtgtcattttcaccaagttcataattatttcgactattatatcttctatgttaatcgaaatttaaggtttttttatggaagatttaaggcgtttataacattgcattctcaagtaaattgaaagtaatgctttaaaaaagtaataaaacgctcaaatgagttgcaaaattacgattgacaaaaagtctttgtttatttaaaaaaaagtaaacgtgatttgtttcataaaaagaataaaaaattagttttttaagaaaaaatagtttagataaacacatcaaaaagttaaaaaaactacttatatcattaaaaagtattttcttagtaagctaaaataaataggtccaatagcttttgtttacttacaataatttgaagcgggtcagattccctaacacgagatcaagaccactcagagacaatattggcttgctttaatatgatgatagagtaacattactttaagtcgaggtgtgattcgttattcatagttgcattatacgaaccatatggccaaataaaggtgttctcctttgtcaacgttagcaaatttgtgttggactacaaatggttggttacatttacatcacttgcatggatttaaccataataccactccaaaacagttatctccaactcgtcatgcttaagattggtgagtatgtcgaattccaagctaagttacgggctatgattaaacacgttgcatattataataattaagtaactttactttgtctctcgaaaaaaaagtaactttaatctggatcaaggtgtgattcattattcaccattgcattattgaaacattgaacctaagcgaagttgttggcatcagtgaacactacactttagactaaaataaatagttacacaattaggactaaagctcaat

SEQ ID NO: 4225 - DNA, 1600 bp, Glycine max
  Soy_ogl_2177 Gm07:4148501..4150100 Cluster 18
actttacactcttgataagatagaaaaagtgtggagggtagcacagtagattttggataacctggtattaaccacgtatatgtcaagtgagggaaatggcacagaccaatagtaggcctcaaaggatacacacattatcttggtgtcttgtgattgtgaaggcaatatcaagatcctgcccaaaatctccaactcagtttgcgtagagaggccaaataaagacaaagcatgtgcatggaaaatccaatgtatatcacgtttcttacttggattgctatcatgatgtcaagccaagccactcacgcggttcactgttccacaaggtagtattctgtttctgtcgtataaggcgattttcagtttcttgtatttccctctctttaggtaataccctcctagtcgtaggcattatcaggatgcataatttgtccagattttacaaattcaacatttcctcatatattctaatttcagtgtcactattacacacccaaaaaattttgacagtatctaaataaaattatttttagttttacattgcttataaatcgaaactaaggtaggtagtttataaacaactttttaatgaccttaaactatcgttaaagcggataatatatattagatgtagtgaccttaaatgatataatggacttgagataatataccatatgtattacgtgtttagtccatgtaaagtgagtaaattttgattttagtttttttttgttaaaaaagaaagttttttagttttcatctctaaaatatgtgaaattatttttttcttatgattacgtgacacttaattatttgcgtgttttaataaaaactcaaaatagtcatcctagatggtatactaatattttcagtatcatgtcaacatatgatacctctaaaaatatttctaaatcttagaataaatatttcttatctatcttaaaatgaacagggaaaaaatagtaattataaattttggagggacggaaatcaaagaaaaaagttttaagaagtcaaattttgttcattttaaacaagtgatttcaaattttgagaaatgaaaaaaaaatacttaggaactaaaatcaaaattcacttattagggactaaaatagccttatttattttcatttttttattttatttgattaaaatcaacatgtattataataattactttaaaattattctaattagttgatttttttttttaccgattccaattagatgatactatagaaatctttgtaaatagggtattttgattactttgatagaaggaaaaaaaattaagtagaacctccataattaaaatttgattctttggtgggatcttaagatattttgtgagaatcaaattttttattgacaaaggttagaattttgttgaaaaggacaatcaagctcatgacctttctctctctcatttcttttttttatcatcaaaataaccttataactcttaaggaaatcaaacttaagtcttctctcacaaacataacatatcttaccaattcatctatacccattgaatatcagtcttaatagaatcggcaaaatgaccgatctaagtcaaatcgattcatcggatcaagaatgaaag

SEQ ID NO: 4226 - DNA, 1900 bp, Glycine max
  Soy_ogl_3674 Gm11:1331201..1333100 Cluster 18
aatatgtgtaactattcttcaatgtgaaagcttacttatagtgttaagtttattaggagacataaattaaatgttgttgttcattctctaacaagagtgacaacttctggtagactcaagatttttcggcatatttctgcctgtatctttcaaattattttcaatgaaatatcatgattcaatttctgtaaagaaaaatgacatatatgcttcataaaaaattgttgagaatatcaccaagaaagaaaaagagattttcagggaaacttaccactaaatccggccacaagttaaatccaatgtcacaatcgaggtctttacatgtgttggaagttgggggcaaaattgtaccgtactaaatgcccctaaagaatacataaacttgcatttgttacccaatagtgtaaatataatcatattaaaaacatcaattactagtaattgacagtccatttaaacacttccaaatacagcaaaaaaataaaaaatacagtccatttaaacactcgaccttaagccattattgtgagatttgtccaattaaataagaaaaatactaaaaacacattccataagatactcttttgaatacatattctcttattagtggtaatataatttaaattacaaatttttgtaatgagtctctctttgattttataatttagaatgaattataaccagtgttataaatgaagtttggagttagtgtccaagtgtggtcttggggtaagagtaggggcacgtgatgcagaaaagagcagtggggcggcataaggtgtccattaggcaagttaataaatctctgagagaccatgtgctccatctgctactcgatcgtacgtaaccagccttattattagttggagctgcaaattgcgccatctgataataactactcgcctctgcatcgaattaaacataaaccatcatttctttctataatccaactcaaatttaaatccccttctacgcgctcagatctcttcttcgactgtttaacatgcacagcatcagtcgcggattgccaccagtactacttcaaataaatgccagagaaaatgtatcacgtgtttacgtgtgtttttttaactctcagatcatcaaatttctaactgttgattaacaaatcaaccgctaagattacaatataaatctcatgatcagttgtttattttttaacgattactaatgtctttataatcttgttaagtatactctccttgatttaaagaactaattctagtgtgcgcatatattttgataatcattttatttgtatgaaatatccattaaatatattaatgattaatctttctcaaaaaaaatttgattgatttttgtgatgatttttttctccttgagaccaacgtgttgctggtaatctcatatatgttgagtgtgattggtggataaattagaaaaaaatgcaacaacaactaaaaatataaaattgattttgctaagttcaaaattattttttaaatgaagcaaaaacagtttcttattatttcagctctaacttattttttcttaattgaaagtaattttattttggcaaccaaacattataatttttttagtgacactaagattgatcacaataaatatgcatggttaactatgattaatcccaccaccaaacagagatcagtgactcatatatagttagtgcaaaaaaaagttttttcccctaccaatattaatatatcatcttaactcgcatggtataaacaattatcaaaagtaaatagtagtaaaatattttatggattttaatttttttttgtctcattaattgatgtaaactcaatttattttcgctattcacaattataacgggcattattttggtttaatggaaagtggcaggccaattggcgaaccggatacccctgta

SEQ ID NO: 4227 - DNA, 1300 bp, Glycine max
  Soy_ogl_3952 Gm11:37746801..373100 Cluster 18
accactcaccaccgccaaccacgctcggacccactctttttccttttcccttgccctatgccataccaacaccatcatccttctcttttaattatatgatattataaataatatttgaaaaatgtttaacatgataagagttttaatgtgataaagaagaaaaataagaaatttttgttagatatttaataagagtcttgttaatcaccaaccttctttcatgcttaacataaagggcctatcgtttttcatcgcatcacagcggttttgaaacactaaaccagagagatatttacgccttcaataccagtccagtgatgcttgaatatggcgattaatttgaggaaggaaaactaaagaaaatgactcctactgtaaaacttcttgcttttacgtggtatgaagattggagagtaaccgcatctactgtcaaaaggttaattacaatataataatgtagccttaccttaacggatcgtaattatttacaattggctaatcccttgccatgaaaatccttctaaaagttaatcctctctttcgcccttggatgttaatttcatcctttttcccccgttctttaaatgactatgtcagcagtgtaacagataatttgggcatttattatcatgaaagatcaatgtatttttactttactattaattttctattcaaaaagaatcacacgttaattaatttgtgagtagtttatgctttaaaaacttaattattttttaaatgcaaagtatacattgaaatattcagtaaagattattttaattaattttttttactaagaataaaacttaattcaaatttaataatgtaaaaatttgaaaaatttaatttaaatagtacattaagaaagactgaaagagtttaattaatactggtcatctgcagtatcttattctgttaatttgaaaaattaagaaaaaatatttttgaatgaataattaattaaaaataatagttttaaatcattccactttaaaaactcaaatctaatccttccatttggcacacaaataaagcagagtgaaacagtaatctcattccatttgttttatattttacaagtttatactattatttgtatgatagattatactaaagggttttagcttcataaattaaactaatggaatatttttagagaaagatatatgccaatgtatatatataaacaagtgaaggtggcgtgtttggtgtggccatgtatactgtggtaagacataaaatccacaggcttaggcaagtggcctcaagttgaggtgaaaggccgtaaatcggccggggc

SEQ ID NO: 4228 - DNA, 1238 bp, Glycine max
  Soy_ogl_5892 Gm18:2244401..2245638 Cluster 18
agaaaatagagagacaaggaaaagatgtggctgccctagaaaggtagtgaacaacacctagacaaaatgtttgattattttgagccagtcctgaaagaacatatctccatgctgcaccacaatctgatttgtgcgttgcctgtcgtttcttctccgccatacgctccacagcatcatggcaatcctccgttgctgctctttatcaacagaattcatcaactggaaaaatagttgagtaaaatcctccatatgaaatatgagttcctcaattttctgacgaagggatcggataaaagatcccaacatgcaaagtgcatgttttttagttcatttctcattttcatttcttcaaactatatatacctgtgtaagtgtttaggccagattacttggactcgttcgtgaagataagcaagttgttgatatcttagcaaaatttggtttaaatcttcaaaacttaagacgtatactgttcaggatattatttcacatgccttaagggagaattttgcttgtactctagttttcctagagattactagttcaattttatatctatcattattaaaaaaaaaaaaaaaaagtcctgtttttcgagtttggatggtattttgactatggcaaataggcattggatggttaattaacttgtgtttttcactcacagtctgtctctagacttggttgggtctttatctttacattttggattcacctcctctgcttgagatgcaggactaacatatatgccttaaaaatgtatttagttagcaactatcattattcataataagtatcttggctatctatggaggatatcatatttggcaggcacgagtatatacaatgaccatttaataatgtgttagctcactgttggttatgtccataatgatacatggagtaggtgtttaccaagttttactttcgggtataagataatcatgaataaagttataactaacgaatttcaataacctaatcaattatttttattttttaaaaaaataacctaattatttttctatgcataaggataaaagtgttacgtcaaagtagaactaaaaacaaattaaaccaattaacttagaattaggcataaaaatgggatgccttggtgacgagtttaacacttcttgtttttatatatctttgtaaatggcgacgtgtttaaaattttaatacatattcttatccgcgttgagatttattggatatttgtgggtaaccatcatgtc

SEQ ID NO: 4229 - DNA, 1401 bp, Glycine max
  Soy_ogl_5602 Gm17:9217038..9218438 Cluster 18
ttttgataaaaaaggcgtttggttaagagcaatcttatggaagttaaatcacgtgtttgcgaaaatacaattaaaaacctccactcctccagcataaattggaccgatcttcagcccggacaaatggtagtaaacaacgtataagatacctaataaaattaggagtgaatgaaatatttgagttcaccacagtacaagattataggtgcattgtgcatatcacattacaagtatcttaccacataattttatggagggaggagtgcgttaaagtcttgaagagggggagtgcaacaacgcaggaagattaatttctaaaacccagggtattttgggaaaaagaatagaaaatgggagtgtattatcaataaagggaagtgtaaatagcagctcccttatttctatatctcaaaaatggacctggctcaacacgtctgcccaataattgaactccccatagtctcatgtgttgtcccatgaccttaaaacaaattagttattaaaataacgagcataagttattttacttttttaaaaaatataaaaatatcatttcaactcctaaaattatcaaacaacatttattattaaataatatatataaagactaaaatgattgatgtttgataattttaggagataaaataatatttttttataattttaagaaataaattaaacgatgttaatattttgtaaactaatttgatgaattactctaaaaaaatcattgagatgaattaaaaaacaataatttgtttattgttccttgatcaaatgtgcaattaattatttacatagtttttttaaagacagttatttttaaggactattacatagttattaaactataatttacgtgagaatgatactttactttcactttattacttgtataaccaatacttttgtcggagaaatgcatgtatatattttttatatatataccattaaacaaaattaaaaatagaattccattgttaagttgtttttttttttgctcttcatatgcatctgcttttgaaaacaactttatttgagatattgttagacattaaatatgaattagttttatgtgaaagtaagaaatttgcaagtatgataatttttttcagcaatttgtctattttttctattttctttccgatttagtaaattattacattacagtgacacacaaagttgacgtttaagtttcatgtacttcttgtatttctacttattgatcttaataaaaaattaaccctgataaataacatccctgtatctttccccaatgtaccaagttccagcacattaaggacatgtttgcaatcaacgttattcaagaatatgacacaaaaacaaattagctagattcacgtggaagggtaatggacgtgttatgttagagcacgaaga

SEQ ID NO: 4230 - DNA, 1500 bp, Glycine max
  Soy_ogl_2966 Gm09:3438301..3439800 Cluster 18
aaactaatcactagtcagtatcattttccttattaactagagcttaaaaaaaaaaaaagtctacaattgttatttaagagatactttcaccataacatttagctattaagtgaagagagatatgtaaactaactttagaagaattaaactacccgtgtgtaaaagatacattatgcccttaaaaaaatactcaatataataagttacataatttatgaagtgtttatattaagtaatttataattgagtcctagctattattatttagtttgaattgaagtttaattcttgtgtaactccatcaaattcttgtttgaatgagtttgtcaaggaaatttggcaaacaatcctagctagaaacttagacatttaggcaattgagaaacgaaataagatgggttgaaggtttgattattagccatgagtgtgcagtgtgagagtggaattataattcctttgtcatcgttggaaacaaggcgaatgtgtttaatgttgatatgcgaagatgatgctcaatacttgaataaaagaaaaagaaaagtttgtaagaaaacaactttttaccattatttatggaccaggttttagtaatgctcttggtaccacggaactgtgctttacatatattgtacagctacaaatcaaagtactttttttcatatagctacatgcatgcaatggaaagtgtgagcacctacctgacttttagtaagtatccggtgtcttaaaactccatctagagggaaaagagttatccataagaaaaaatctctatgaaaaatttagcattatcggatgtccaaaaaatattttttttcttataataatattggtatgaagtttcactgaatggaatgattaattttcttccatggaaggacatgagcatacacaaaataagtattttatttcttacatatttaaactagaatttgaaccatttgattaaatgatataaatcattatcatttgtatcatttgttgttaataaatataattttatgttttcttaaatgatgttttttatttttcaaacaaaaaataaacacaatactttttcattaaggaaggaaagcaaaacgaccactctaatctagatatccctatactctcaggacatctttcaaaacaaaatactactatatcaaattgaagtgtttagacagcaagcatattgttactcctccctaaactctttttcaatagtattttatatagataagtcataaataaatgtccttcgatactgtactaagtcacaatccccttgaaattgtcattaactactgttcttccgttggtggagatgggctgacccaaatgtctattaaaaagcccacacaggactacaaggataaaagggcctcttggaaatagttgatgcggcggcccaacatggtagtaagtgaaatctaattattcaaaatagaatatcgagcagtaagaatcacatccccttgcttaaaataaataaaaaataaaaaaaaatcacatccccca

SEQ ID NO: 4231 - DNA, 2200 bp, Glycine max
  Soy_ogl_4422 Gm13:33363701..33365900 Cluster 18
catccactcacccacacacacaggccctaaactttaattataagtataaaaaatgtccaattcataattcccattcatatacacacagttatcatgataaaatgatgaaaatacagttcacattccaaaatctccaaaggaaaaagaaacagagaaaaggtgaaggtgtttgtaacagatgatgcaagatttcactacacgaaattaaacaaaaaccaaaaaaaaaaagctgcatgtattttgcccaaaagagttgcaaaagaaaaagccttaatatattcactcctttatcaacaaaatacacaataatagtctaaattttttttttttccattctagctcgtggtccaggctatgtggactatctaaagcaccttcttgtcgtccatgacgacttaaaatctgctttatatattaaatttacaaatatataaaatagaaaagatagcaacaggtttttcatcttgttttctttgtcggatgcaaaagaatatagtggtccaacaaccgtccaacaaacagaaacccaactaaacattttcctgattccaagatgtcacacactcttgctactatcttctattagaaaaacaatcataagatattttaaagcaatactaccttttagaagagtacatagcagccagcatcactataaaaagatcaagagctatatatacggtggagccccaggagaaaatctgtggggcctaaaaagaaagcttttacaaactttgaggcaaggttatagccctgatccattatattaactattaagctagacaaagacacaaaaaggctagtatagtaagtaaattaaggtaatggtggatccaacttccaacccatttgagcctgttccagaccacattcattattgtcgtcttatattttaagtctactagcattacccccccatgccaccatttcccccacttttctctgtctaagtttgcagccactatggggaattctttttccccattttggtgtagctttctcttcttttggtacgaaatctcttgtttcctactactgtgcatgattagtgaattaaaggagatttggggaagatccctgtagatgtttattcctttgatctgaattgtttaacataacacaagtttaaagcacattctttttgagaggagcaagttgaaaattagtagattagctgtatatattccaagcatgtactcttgctatgttgttttaaaaaataaatcatggttcatgggaggaaaagcttgcatattctataaactaccactatgccatcaaagttgaactcacaccaacccttaattactttagttttgtttctttgtcatgattcatgattccttcacatatcaagcatcaatcaattaggaatctttttgactagtgtaaaataaagcaaacaatttcaattggtatagctagattggaatttgctacacgtttgaaagccttttgaattgactgagaggtgggggaagggaaggagtatatattattagtgatttaattaggcatctaacttaatgcacaaatttacgccccgcacacacacacacatatatttccatgttaaaccaaagatatttttcatttaaaacaatcatagaggtatcaagggctctctaaactggtgatgatgtggatgccattttgatgtcaaagagatagataggtcagggtcatgatttgtttcataacgggaactgcctacctagtatcaaattctagggtccaaataatgtattgtttgattgcaatattatgtatgttgtgcattgcttctaatcttctatcacgtggtattgtttagctgtttagggataatgggaaatgaaccgaaagaaattcctcttcatccactccaatgataatagcattggcatatataggataagatatgactgattgtgctttgtgacttagatatatcgggttggggctacctggttcacccgtttgcccgagttgggtatctatatgtgctagatatatactatctcctcaataaagtgaatgtgtggggggaaatagtagaagtgacagtcataatataattaggatctcaactaattaagttaaaatgcatgatagaatatagatccacttggcacttgtaaagtcagagtatgcatgatagaatatagatccaaattaccattcaagaaatgcgaagtcttaaattaaataaaaattttaa

SEQ ID NO: 4232 - DNA, 1405 bp, Glycine max
  Soy_ogl_3926 Gm11:36771096..36772500 Cluster 18
aacatctatagatactgttacaagtgaattcggcctactatgagaaattgagaagttaatttctttctactcagaagtcaaatgttataacattattttatatgatttattcattaattgcacattatacatgagatataactcacattcgatgtaaatttaattagaatatacaaatagtgcatataatgttattattctattgtcacagatcgacttttttacataaaaattaaaaatatatatatatatttattcaaataatgcaacccaaaaaatatatattcaataatacaacattatatcaactgaaaaattggttccctcaagtcgatttttcacttgttttttattttacatgaatcgatttcataacatgtgttttgtttttttttttttcaaaaaattatgttacgatttcataattttttttgttgggtgttttctgctacttatttggcttgttggttcacccagatgacacttgtgacaagctttttgccattgccgcaaatgatggagttcgaccatgggggccggagatacgcgtaaatgtgagaagacctggtggtggttacggcaaatcacgctggctacgtggtgagggtgaatcaaacagtaaatggatcaataatgatagtagagcacagtaccataaatctctttagttaagtgttattaagtttttaagaactcattaattatacttaatctatttttccttttggaatgtgttacaaaaaatcactaaaaaaagtgaaagacaggaagaaccattatactttttgtatcaccaacactgttagtgatacttctactccaaatgaggcagaagcttgggctttacactcagtcattctttggataaagagactaggtctttcaaatgttgttatagagaccgattacaaagcggattattttcaagttaacactaagggttcaactgattttcatgttatcttgaatagctggagagatcttcttttatcaatttcaaactctagagtgaattttataaagaggcgagttaatcatgttacttacaatcttgggagggcaacaaaattttatgctaactctcatgtctttgattatattctctcatgtattatttcacacattgttaatcaaataatataactttattttccctaaaaaaaatataccttttgtattcttgttttcaagatttatttttccacagggctgccttcaaaaccatcttctataatctcattttccacaactaattcatgacaaactcatactatctgcaaatccaagttttttttcaaaggatatgataatccaagttgaggaaccttggtaattgacatatgcaaagaaatggtaaaaaagaatatgaacatggtttttgtagcttcaaccttcaagatcaaga

SEQ ID NO: 4233 - DNA, 1094 bp, Glycine max
  Soy_ogl_707 Gm02:47081907..47083000 Cluster 18
aaggaatatcaaatttaaaattatctattaaattatttataacttgatttttttaaaaatttataacttaaatttaaatttaaactataataacttataattaattgttgtatcatatattagtttaacggtataatgctgttacaccgaagtagtatggtacctttatgttatcgacttattattgatcgagcgttgcatgtcagagaagtagtaacaaacaacaggatagggatattttctgagtttttgaccatgtcactgtgtctttggggcctctttggcagtgtgacagcagaaagcaataaaaggaatgctagtaataagcacaaataatgtatagttatgatgtcaaaaatgcaaatatataagtttttttaaaattagttctaaagatatttaagaaatccctatccctacttaacaacgtaccaaccgttgctattagtctatttttcttaacaaaaatagtattcgcctgtttaatattgtaaaatgtattggaaaaaagtaaatacatagatacaatactcgtgtgaacaaatcagaacaatatagattgttctgttttgtttatcctgattttattttatttttgtatttgttttaattctaaaatatatgaaatataaaacagaaatatatatttttattcttcttaattcttgtgatcttatcaaacaccatcaaaatataatagctgctttcgctaaggaccgtaatatagagtagtctcttttggcccattcagttaatgaatcgtgcctttgaagagaaggaagagtttcggtgtcaatctacttgggtttgtttgaaagctaaattcgttttttttttttttttgtcatatgtgatgtgacagtgtgggtgtgcttagctttaatgaaattttacatttgtagcttttttaatattattttatctttccttcatttacataacttcgaaagaaattaggaatagtttatgttaatgttaatgaaaaaaaatataagatattatattatagttgtagttagggttgcagtaagaagaaaaattagcagctaatttttttgacaaacctcacatcttctttacacatagttatagat

SEQ ID NO: 4234 - DNA, 1197 bp, Glycine max
  Soy_ogl_5017 Gm15:12651001..12652197 Cluster 18
aaaaataataatacatattatttgaaactgctttgttgtaatggtaaggttgctatcttacaatcaatagatttaatatctcaactaaacttttgccattaagcaagcagaagaaggttccttacaacgacaaaatgagtttttcacttggattgagctgtgttatcaaggttacatcattgacattgtctcgctaagaagaagaggagcaggtatttgatttatagatacactatattctatatcatcttgcaactacttttatttaagaattcaaatgtaaatgagaaaagaagttgttctgcatgaatctgcacaacgattaaaaaatgccatagcatgagataagcattcatctaactgttaagtcaatcccttagtccctgagctaatatgcatgttgtttgtcttctttagtctgttgaagccttttcttatgttggttctttctgttgatctggtttgttttggtgtgtttctgctattaagctcacatgtgagatacctacttctttattttgtttctgcgtaatttcattattattttatcctctgtaatctcattcgcaaacatactttaaagagtaaaaagtttattaaatcttgcagtgttattcaattgggagtttgtaaattgtaaccaacacacaatattagagattgttctagctcaggaaagaatattgtctatcaatgtaattcaaggattatagttcgattggaatcggaaaagatataaataaatgaagagaaaattaaaaaaaactttatacataatttagattgaaaaaatggtgaaaaaatttcaaactgataaaataaattcatgttaaatgatatttaaatttaaatttaattaaaatatatagatgatgtaaagatcatgtaaaatttaaatgtaatttttttaattacatattaacattacagtaaatttatatttttttataataagtatttaaaagtcatatatatttatctagcataatttttaatccaaaagatcggttgagtagaataagatagtctacattggtcggttggagccccacttgtttctttgaagtttgaaggtaaaaatgtaagttactcttcaaagtgctctttgaatccaaaggcttccctgccttggattcatttttgcaccatccactcctaaattcctccataaaaaaaagaagaataatttgattaatt

SEQ ID NO: 4235 - DNA, 1475 bp, Glycine max
  Soy_ogl_1934 Gm06:13939126..13940600 Cluster 18
gttgtttgataggagaaaaataaaaaaaaaaatatttaaattaaaataatttggtggaaaatacatttttacccaaaaaaaaaaaaaagcacacccaaaagcaatcggacgaaaaacaatagaaaaacacgggaccgaggggtatttacgtaacactgcaagcacaatacttatttcttggcgttctagagaagaaaatctgcagcatagaactcactgatattttgaatatttcgaggctatctcactgctgccaaacgacggaagaatgcgctcttccccgcactttgccttcctttctctttcaggttctatcaaacacagcctaatgttcacataataatttgtctgtcatctgctcaaacttgtgtaacattcttatccatcaattcctcgtcactttgtaatatgtatccaagaagcccaaattgtccaaaagcattcagagtttctttccaaattatgtatactttaataccttccacctttttattccatacactatctaatcatgaaacccatttattccaaaacttttttttgtcataacaataaaaatagatactaaaaaatttaagatcaactcattaattatcctactcaatcaatagttaaactccttaattattctaatatcgctgtacacaaattaaaatttaatttttcactaaactcgttaatttcagaccttatcattaaaaaaaaaaaaaaaacagagctaagctatgcttgagatgatatctgaaaaagcctcctcttctcaattaattaatctctttctttattcattgctcttgataaaattaggataaagttaatgaaagtggagtgcattttcaaatcagtcctttcagactttaggcatcatcaacacttattcaagttgcaattcccgttggtaactagcaagttgatgacttttgacttggatatactgcatcacttttccacctgatgatttcaaatgatttatcagcatgagatgtcttctgactatgctctttgcttgcttgataggtaagacaatattaattttatcttaaatatccttagcagttggtgatggttattcagatttttatcctaatatttcctccaaagaagccaacttatgaccattcaggtatcttttggattcttttcccattgattcacatttgattgtgaatacggtttttttatgtcaatgtgtgacagaatatttcatatttgacccagatgaaattctggaacacaattaggagatctctctacaaaacaaggtacattatcacgaggtcgtccatgaaattaaagatttcactcaccaccagtgaataggagcagccaccatgtgtcaaacaaaaacaaattaatttcccatatcaaattttatggcagttagagatcctaaatcaaatagaaactaacaaattactaaaacaataattaataactaattatgccagcaagcataattatttcaaaactccctt

SEQ ID NO: 4236 - DNA, 1300 bp, Glycine max
  Soy_ogl_3536 Gm10:44970101..44971400 Cluster 18
gtcaacaggagtggtcgtattcgtacacacaaattaatcctttcatattgcaaggattggaaattttaaaagtgtttaaaggaactctaacacaatagagtaagtcaacttgtagggtgattcaaactgaaaacaaaacaaaaaaaaacaacgatgagatggtggctttataattgacttttagttaaatttatatactattatttacgcagcttccatttgtgcaatatttatgtaatagaacactagtatctgaaaatatatatggataaacatgaatcatcatcatttcattttatttctaaaaaggaagatgtttgcaacttggtttctggtttcaacacaccgacgtaggggcaatacgcgaaaaaggcgtttttcacgagacacatttctgtgggagcgttttgtcaatggattggcccatcgtttgcttcgttcataaataattttgaccaaaaatttaacctttttttcattagaccaagaatttaattaagatatactgtacgtatactgataacggttattttatactttgaaataaaatatagctgtactcgcataaaaaaaattatagctgtacaattcatattaggtgtcaacttaataagataataatggaggcttttgtgggtttaagcagccgctttgagagttgagatttatttcatttatttattatttataaataaatattaattactaatatcattagttttttttttgctagtatagaatcagaattcatgacctttcctttatttatttttttcttcaccgctaaactaatcttatatttcctttaagtgttaatattaactaaacttatcaatgctatacggattttatcttatttataaattatatacaattttagaaagtgacctttggttttaataacgaacggccatcaacttaacctagcctgataaaataagagtttgcactaaggttataaattcaaaaccacagacaaagacatgctatttaaaacaatatatttcttcaatgaaataaaaataatggccatcttattgagattatcacagagacgagttaaagtaattttagtttttatatatgttacgatgtgaactttatgcattattgtgtgttaggatactaatcataagcgtgcctttagtttaaactttcaagaactaaaacatcgtctttgaagatttaaaccaccacaagtagaatgctatgcatactgtgtcaaaaaaaaaatgccatgcatacatcttctagagatgttagaatgggtcaaatcttatgggtctatttaaatgtctat

SEQ ID NO: 4237 - DNA, 1415 bp, Glycine max
  Soy_ogl_6617 Gm19:47691901..47693315 Cluster 18
ttttaatctgttgttaatatataaaattgtcccatatatagacagagtaaacataaatatggatcatatcatcctaatttttctaagtaaataattaaggatctatcttttgataaaacatttataatgttaccttttgataaaagttttaccacatgcataaatgtcacttctaacaaaaaaatattattgacaaagttattagatattttctaccaataacaaagattaaaaaattaactaaatcaactaatttggttcttttggtgaacgcaaggattggattttgtgatatcaaaagcaggaaaaaatggggtacgaccaatactaagcctagtaaataattgaaaagatgatggtgggaaaaatcagtatgttcaatgggcaaaacaacatggccaaagagtaaacaacgaggatgacttcttctcacaccccgtgttaagcaatactacaaaaatcacgtcaagttaagaatgacgaataagcaaaagctgccatttttctcacgtagtattgtattgacaatgtttaattataattattagactagaaataaagatttatattgtgctttaactataaattttatttaactttttaaattaaagatcacatgaaatttataattaaatatataatttaaattattaaccggtttaatgattataagtaaatgttgtcatttcttatatataattggttgatatgcataatttgtacctatattatattatatttaagtttaattagtaacctaattcggtgagtatttcgagtttttttatgaaataatcattttttacaacttcataaaaaaatacatttaaaatgtaacagatattcacttaaatatctgaacatgcataaatttatagtatattatttttaaaaaaataattatattctaaaaataattaaaccgtaacaaatttaagcattcaaatatctaggcataaatttatataaaataattattggagatcactgggtaaattggaaaactataactcaaagctttatagtgtatttaaataatacataagaatcaattttattacataaaatcatggtgatacaaggaaaaaaaatagaaccaactatttgttgctttgccttggttactttactgagtattatattgttcatgaaactcaagctaataaagtaaccatgaattaattagtatgatatatttttgtttagcaacttaacttttgtaaatttggttgtgatgaaaactatattaacaagagaaaaaaatattataattggattaatatataaagatgatccaaccatttttgtatggaagcttgtgaatgaacctagttctttagagcaatttggaaaacaaatttagatactttttcttcttacaaaataccttagttgcatgcatgcttctcaccggt

SEQ ID NO: 4238 - DNA, 1500 bp, Glycine max
  Soy_ogl_1201 Gm04:3812101..3813600 Cluster 18
agatgggtgttataggatagatcatgtggtgatactacagacttaggtcttttgggcccacatggtattaattcatagtctaagggttaattacacttaatgttcctcatgttttcccaataatgtgtatgtaaaaattgaacatccaataagtttaatgtgtgttgtcaatgtcaactgagtcactcacagtcatggagattgcttgagttttgagacatattaacaaacattctctcttcttaacactattctttgtatattttatttgtttttcaactctcaacttttttattttaggcattagttgtgagatttcgatgtgtatcaagccttgaacgtactggtttagatgtgttgttgttgtaaaagatatctggcttttaacgtaatctattttgattttgtagattttcagacaatattaatgacattttccttaaaaaatataattagtgttgataccaaattttgttataataattcattcaagtttttggtgacacgtgaaatcggtgattgacattggtcattttgttgctgttattgttgttttaaataggtatctagtttgtttcatgtgtaattatactttctattagccttttgttagattatttcatgtaatcaacgttttggaatgtgtaacattattattatgatatttgatgtttatatatttgttgaatgaattttgttttgtatggttgcctcctctgttatctatgttcggctttgtcatgctttatcgagaatgaaaaataaactaattaaaacctaaattgcatacttagtaatatagagtcgttcatctattttatttttctggtcccttacttcagagataattttatttaaaacactatcatacactacaaataatggagacctaatttgaatgaagatttaaactttagtttactacaataagataaattagttgtttccactaaatagaaaaacaaaaatttacatgtaattctattaacttgttaagtaagatgattaatttattaatctttataagtaatttatgtaataatgtagaagtgtattctaaataattagccattgtaacataagagttaattaaaatacattttccacgcaattttcgttcgggacccttgctcatcattcctggaatatttccaagcttaccagagacctactttccactttttgtctgaaggtaggtgttgactacacactctaagacaaacgggaaaataaagggtttccctattagtttagcgtttcagagcatatataagtatttgctgaaggcctgagaccaaacatttagttttaaagaatactgtccaaattcttataatcttatgacagaaattacaactattaaaaataaagctttatttgttcataacttatgttggagatgaaaagtaaattatataatgtagcattgcataacgaaggaaataattaaaacatgtatttgtttcaagtaaagttatgtcctttctagttttggatgga

SEQ ID NO: 4239 - DNA, 1845 bp, Glycine max
  Soy_ogl_2504 Gm08:4706456..4708300 Cluster 18
cgcataaaaaggatcctttaacaatataattctgcactgttaaaccaagaagagattgaatctgcgcagattttgtcaaaaggttattttgattcattattattgttaattatcacgagaggagtgttattaacataatttttagtacacttattctaacagacatttttatcggtggttaattttttttaactataaaattaagaaagagactcaataaatgaaaagagagacccataaattttgtaattttctgtaaatttttattaataataaaatttaaaagaatattaataacatttgttgtcatgaaatgttcattatttcttctactagtatagtatgcggcaactggtattaataatgatgtaatgttaatttgtttataaataacttttttttggtgaatttaatttgtttataaataactggtatatctttacttcaacaatccttttgcttacgtaaaactgttttggcatggtttaaagtattaattgacgtctatattgttgtcatagaaattgaaagctctaggtattaaaccctatttgtaagaaagatttacttgtgagaatatttagagctatctaatctaccagaccatcattagttgtaactcattattgtagaaaaatttcatgttaagctttttttaaaacttaagatagtagagttgagaactactattgcattaataaaattgacatgtcataaatatgcatattatattgcgtatggctaagaatacattcattttcatatcacttgagttattgtcatcaacttcctaggattgcgggctaaaatcaccaatcgttcgttaagaatagtttccgataagtcattcagatagaaccacaataggtccgtgagcaaggaattgggatgcatcgaccacaataatattacgcaaatgtttggtggaaccgcaaatatagttgaatcaggttgatttttttctctcaatgtacaatgattgcaatgagatcaaacttaagactttatacatctacggatctacgtaccccaagtcccatcccattactgctaggccattcttagttggtcagttgaatcaggttgaattgatattaggttttaaaatttatattcataccagttaataaaatttcataagatagcaatttcgtcaattcaaccattaactaatttgatattattcatgctaaatttcacataaattaaatattttattggtatgttatctaataataaacatttgcttatatttttgtacttttagattcctttaggctaaactttacgactgagcgtccaaacccatgattaattcctttggaccaagctttatagccaagcttgtggttgattcctttgaactgacttctttaggttgatctaggaccaagtaggactcatatatatgatatgtatactatagcagtcaagaaccaaggtataaaatcacgatccgtcgaaggaatgctccttcatgatacaagaaatgaatcttgtgatatgaggaaccaactcccagtatcgctcacttgcaaaaacttgcatatgctgagtaccattgtttatcatggaaaaaaacatttgcatcactcagttgcaaaaattgtatattttaagtaaaggtatcaagtataagcaaacaatattgctctcttaaaagaactcttgaagaatatttttgaacatgccgaacaagaatggcaacctccttataatatttgtattcaagtgaaggatttaaatcccatctttgccgaccacattgaaatattcttcggggtcttcaggctaatcttcatcttagtgataatcccatattttagcctcactcgtctgtggctt

SEQ ID NO: 4240 - DNA, 1500 bp, Glycine max
  Soy_ogl_2464 Gm08:2285711..2287210 Cluster 18
tatgttctcgttgcatatataatggacatatatttacgttgcatttttttttcacctctccttacacgattgaaacatgttttgttgcgtaaatatacaataaaaacatatttatttttaaggatatatttagaattagatttttattttacacgcatggagtgagaatagcatcttccttacaaattcataacaaaaatcacaaaagcccaacaaagtcccaatacaaaagttacataattcgctaatccattattaggctctagtaaatgactagtatagctttaagcctcatttttaaatctctatcaatcagatgctaccactattaagtattaaaggatgagagaggcgacaaatttggacaataatagacaattgatatccactttttctatgaagacttacattcacaaatgaaatcatatccacaaatcatcttttaagaaaaataaaataaaataaaaagtgatatgtctacctactaccgttattaatattgttaaccatccagagtagaaaaacttttgtaaatccttttgagaaagaaaagagaaattttataatcatactttcatagtatagatattttgttgaaataaatatttgatttcttcttactcacattaaaactatttttttatataaaaattctggtgtcatttttcttctttctacatttaacttcttttttttttgtctaaggaatgtttgttgtgttttaaaaaataaaacaaagtttagtctattaattaattcccaacctacgatttaaaacacttgatcaaaagttaaacaagagacaatttaaaattttattttggtggcaattactaataaacaactacaaatataaatagttatattgtaccaagaaacataaacaatcatacgcttttatcaatattaaataatttgacagagaaaaaaattcaattgttcttaaataaggtactataattaaaaactgtaaataaaaagaattaaatatcaggactcgggagaaagtaataaatgtcatctatccaaccttgactcccgttatcatactatcaaacttaagggcaaagcatggaaggttggatagtgttgtgataattttttttttattcataggaataaaaaatagtgggaaaaaaatttataataacccttataatttattcaattaattgaattagatagtttgactaataattatttggttaaggctaatattttagaatgaataaaataatgtagaccaaagaataattagggcagtgggcaactcccattcctttcttctaaaatgaaacgtaactacttgtataatgtatttgacttttaatttttaaccttttttttcttttatgctgataaaatttataatatttttgttttttgtaaatatattctttcattggatgagatagtgaattttaatttttaatatttttaccaaaataaaatatcttaaaagaaacttcaaaataaaaaaaaatccataaaaaaatcaat

SEQ ID NO: 4241 - DNA, 1196 bp, Glycine max
  Soy_ogl_662 Gm02:44950746..44951941 Cluster 18
atttattagaatatgtaagctattcatatgtaacatcttttcatttatcaagagttttaataattgatatatttctacaaataattaaaattcaatttattgatttgtatcctcaatatttggaaacttaaaaagtccttatgataagtccggagtaatgaatctacaaaatccttcaaattgtatgttattcaatcggtagtgtagatattccttcattttcatccggaagcattttcaatttcccggtaaattttatcaaaaaatattctaccaatttactgcaaatcacatgaatcaatttaacaatactgaaatttttgttttataccgaattacatgaaatttaactaattccatatatgaatacacagatgtggataaatatccagactcatccccctccaataaatgaataattatcatctttgtttagaaatacgtgtaggatctctggatccattttgtcattctgaatccaattcctatcatttgtaaatgtggataagctcagccattccgtattcgctaatggtccgagtctgacgtcaaataagaaaaagaaagcacttcaacttttcatgtagaccatacgatcataacagaatttttccaatctttagaattcaacataaagttataagttcgtgctttattattcatgtaatctgaatataattttcaagatttttaactaaatattttaagggaaaattgggttatagtaacaagtaaaaaagaaaagaaaaaatcgttaattttgatgaaattctccttaaccataagtacttatacaggagaaaaaataaaaaggtaaaatatattgaatttctccaaaattaaaatcaatttttacatgttcttttgattttggaaaaattaaactaaaagagcttttatgaatgtacataaattattttttatgatgacaagcatatttaatattggagaaaagtctctggtctcataatcaattattatgtataaaacatataatataatatggcttttcaaaagacaataatggtcgaagaagaatatcatggcagaaacttatctactagatttagtcatatatattctcctaatgacaaagcaactgcctccataataacagtctttcacgtttggtgaacaccatatagaatagaaaagaggaatgaacccaacaacaataatattatcgatcactttat

SEQ ID NO: 4242 - DNA, 1277 bp, Glycine max
  Soy_ogl_4792 Gm14:432224..46860500 Cluster 18
aaattaatattacatcaatttttaattttccaccaaataagtcactaacaacattgttagtagagatgaattggatataatctctcatactcacactttacaaaaattctcgtatacaaattcatattcacacaaatacaaatagtaattttaatacttaattttctgattggtacctaaatactcatactcatattcattacttatattttaattaatttataaaaaattgataaataaaatattgattgaaaatagaatagtacttaaattaaatattcattcaaatatcttcataaaacataataaatagaaaaaattgagaaaagaagcaaataaagaaggtaatatttttttaaaaaaaatttggattgtgacctatctatctttaagtaaataaatatcatgatctatctctgtaagaaatataaatctttttttaattaaataacgtgatttatctgttaataaataaagaacgtgttgtttttatttttatttttgatgaattaaaacttttgcaaataaataacgtccatgtaaatttgacaatctttagtttttacttccaacttgtaaaacttctattttttgttcttgcgttcaactttcatccctaataatatgccaagtttggagatggacgttttccacaataaggatgaaaaataggattttaaaaatcaagaataaaaacaaaaggattgtgaattttacatgaacaaaaaaccaccattaatcctaatttatttgaaacattttatcttaaaagttctcatttccaaaagaataaatttagttgaaagttaaagatttttaaaggttatttattgcactgaaaaaagtagagagaaagtgattcattgtctgaaaagtggacccaaaggaaagaaaaataagtcgaaacaaaaatgcaagtaatttgtcaagaaattgattgccctaattaagggcccattattaattgattttatgtaggatgtgggtcacatgtgccaacaactttagcatcctatcaaaccccactttcattcaatcaatgtgaccatctaatcagtgcattaccatgcattcactcattctcccttcttcagttctgtttaaatggatttgcatcaccttcttcttttcccctccctctcttatgtaatctttctaccaagggcctcatcactatctaatcaatcaacaacatgaggacttggaaaaatatacaaattattcctttttaatacagttgattgccttctacaccaaggaaaggcactcaaattgaa

SEQ ID NO: 4243 - DNA, 1200 bp, Glycine max
  Soy_ogl_1177 Gm04:2173101..2174300 Cluster 18
gtttgatggacacacattatgctataatatatcttgagataatagatattataaaattcatgttgtgataagaaaaaaaaaagagagaaaaaataatatgtgctagtatgatatttaaaataaatgagtatttgtgtatcattgattttctgaaaaccttgaactcgatcatatgtaattgtgctacaaactttattaccggatatactataaattatatagcttacggtgtatgaatatgagtctttgttatcgagtattttattgggaaaaaaaaatatctgaaacactcattcatagttattcatcatcgaggtttatttctattaaaataaaccaaagcgcaatatatatttttctataaaaaaagagagaatatatataatttgtgaaactaataaaattataatttaactatctctctcttagaaaaaagaataaaattaattttggagtgaactgagaatatcttttgataaaaactcaataattaatcctttaaattactaagatttattcaaaagtttaacttctcccatatcaaatatttttccataaaagtaaaacttttgatcatatgcataaaagatatgattatttatcaactgtatcctgctatgtttgtataatataattaatttataatgatgggagtgttaaaatctcaaaggaggaatcacctaggttgccattgaagattcttaagggtttaaaagaaaagaagcacgatcgataatgatgactacttaagcaaggtaaattaaattgttagggccagcccgaaccgactatcaagttggtctacaatccaatcatgatatggaatcggacagatgaaagagtatgcgaccgagaaagaaagggaaaaaaaaaagaaaaaaagaacaaggttacgtcttctcaatcctttagctctcctgtttccaacaatcatggcatcatgggcaataccttaagtacttagttcttaatcctccactcgattagccagcaatatatgagtcaggataaactttattatcaatgattcattcaatacttaatcaagtctaatcacttgagcttgggatctttaacataaacccgtttggttttgggatacatttcttaatttagtgttgtcggccctgttgaccagcttcagggttcattttaatgaaagggtccatcaaagattgagacctaagagaatcattttaa

SEQ ID NO: 4244 - DNA, 1052 bp, Glycine max
  Soy_ogl_3691 Gm11:2415001..2416052 Cluster 18
acgaaaaaagtaagtatttttaacctagtaaaaacgcagcaaaaagcaataatagtgaggaactggtgttatcttgaattctttgtggacagcatgattaattaatgaattaaatgtcataaaaattctgttagtataggcagcgcagtggtgtcagtggcatctgtcctaatagcatgcatttggtgattgacaacctgtcgtgcgcaacctctcaccatgagacatgtcagtttcatctcgaataataagatgtgtctcctttcagtaaatccactctttaaaatcataacacgataatactattatttcactcattaaaattattaaatggcgattagtttctctattacaaaatgtagttatttaatttcacatattagaaaatggtaggccaaaaattaaaagtaaattttttaaaaataatttcaggggttatattgactaataacatttgcttttttatttcttccatttataccttttcttatttttttgacttttcaattttttaatacattaggtttaattaatatttgaaaattcaaaaaattgaaatagtattttttataatttcaagagtaaagttgactaagtttatagcttgaaaggctaattttgatgtattgtttaattttttttttccatttattcctctcctcattgtcttttgccttctctttttaatattttttaagatatcaagatactacgttagatatttaactaatataaattgagtcaaattaaattattatttgtgacagatttgcctcagactttttatataattatattcctaataatttgacctctgcattgttcaacttttccatatattcatttccttattttcctttttcttctattttttttataaatatcaagatactaaaatagatatcatgaatatttgatcattttaaaaattaaaataacatattttttataatttcaatgactaattttttatatcattcaatttgttccattcattcctttgatcctttcctttatatttttccctttccttaatatattagatattagat

SEQ ID NO: 4245 - DNA, 1010 bp, Glycine max
  Soy_ogl_3751 Gm11:52147..5488556 Cluster 18
ctttgtacgtctctctcatcctttcatgtccaatggaggttcattacattgagacggtcagaatttagactgaacgtcaaatccagcagacctacgcctagcttctgtgtctgtatggctctgcgcatccacaaataaaataaaataaacaacattttgacgccacaaggaatgaaaaaagagaatgaacgaaaactggaatgcggttactcggttaccaaataacaaaaggagaatgataataagggtttcagtcttcagagtattattactcgaaaaattataagtagtttttttacattaaaattccaacatattttacatttattttaacggattttctatagtgtttaattagaaacatccttaaggataatgaataaaaaattaataaatagaaaattttattaaaaaataactatatttataacattagatattatatttttattatatttattttaaatttcttaatcaatatacataaaataatgagtagtaaagttatattaattcatctaaatattaattttcatactaggtcacatatttttttagagataattctattctaatcaaattggattattattggtgaaattttatcaatagagcatagtagattatttgtgctattacatacaattgaaattatttccactgataacggatttttaaaatttatatttatatcacaattaaacagaagaattttacgagttgtaatattcggtctattcctataataacaatttatataatttttttaccttgatctatattggttatataatttgtcacatttttaaaaaaaattctatattgttattttatctttttctcagttattgatgtaaaattggatgcttgatttgttctacaaataatatgttcgcttatgatagatagattgagacgatggcatgattgattgatgaatttgtatccttccccgaatcttcatgcagccaatgtcttacaagttacaacatcttaagcctttcattttt

SEQ ID NO: 4246 - DNA, 1502 bp, Glycine max
  Soy_ogl_6773 Gm20:35371399..35372900 Cluster 18
gatcataaaatgcaccaataatcaaactaattataaaatataagtataaaaaagagtaagaatctaagtatttttttaggattataaactctctaaaaaaaatttagaccataatttaaatttgtggagtataataaatttattaatttttatgaaaactacttcaaaaattatattaataataagattgaagaatgttttaaaattattttataatgtcatgtgattaaactcttagatatttgatgatttaattaagtttatggtggaattggttattctctaaatgacattttaatgatgtaatgctgaagtcaaaattgacacaatcaccctgccacatagactactaagtgggacacagcccatgtgtctcctgggtcccattctattgttgttttgtttatctatctagttggagtcaactttgatgaaatgaaatggccttcttatcccaatgaaagacacattcacgtgtaacatccgttcgataaagatcggaaggtgctgcgtcgttctatttctcacgataatgttgaactagaagaggacctttttgctttggacggagaatcataacaagactactaagacacaatgtaagtatttttaaagtttacatgcaagtattaaactcaacagattaccacaactataggatgcattttcgaagaattttagtaacaatttttttattcattgaaattaaaaaaatatttataataattcattactcacacacatcgtctcattaatttaactagacttcataataaaatgttaatcatatttatttattcatttaatatttttcagaattatattaaaggagtagcttttttttatgagtaaaaaagaatacaaaattacttttcttttattagatacatgaccactataccagtacaagacctatctaaattgattgtaaaattgaattggcaaataagttctgtactatccttacgggattagaccccaatctgacagcctttgccacaaaatacgcattgcatatcgaaagctcaatagatccacgtgcttggatcgttttgagaaagttaaaagcttttgcacaccttcttcacttagctagtgtatgatgtagtagattttatttagatttaattacttacttagtttttatatttatataattttcacattttaattcttatatttaaaaattatttatcttagtcttcacatatacacttgttaatgagttaatctgttctagttttatatcgtccaaaaattgtatgtattgtaagaactaaataaataatttttaaatataaagacaaaaaggtaaaaattgtactagtacaaagactaaataaataaataattttgtttatgtagccgctgcactctgtaaaatacctccttaccagcgtgaaaacggcaattttactgcaaataagaggtaccacgtgaagaaataattcaactgattaaattgtacgagtgacatgcgagattaaaacctattgagtggt

SEQ ID NO: 4247 - DNA, 1474 bp, Glycine max
  Soy_ogl_6313 Gm19:1071501..1072974 Cluster 18
atctttattgagactttctatcattaagcctaaaaaaataacaagctacttaattaacagttattcaatttttaggtactgttaaattgtgaagtgcaaaccctctaggagagtggttggggttgctagggttaggtatgagatatgtcatcttgttgtctaaaaagtgtaattcaagcactcataacttatatacacttaattttctctattttgctcaatgtgagacatgtatattctgtaacactcttccttaagtccaactgagttaatctgttttgtaggcataattgtgacttgcataccatcttaacctcagtctcaggttattattattttttattgcttggatttattcttcatgttgggcttattttgaagttacttcatagttcacacacaggtctgttgttcttctttctttctttttgtttgggcttttgtgtttcttcaattttagaagctcaattctttttatttttttattttttatagttaaattagtaccttgggttttcttttatttttgttgcctatatcttgcttatatgattttttcatcatcttaggtttatcacaattctttgtgaaaatttaaatattcttacagtggcatcacaacatgtctatatctgtatggctttatcttcaaattacattttttttccattctaatatgtccctaccaagttgcaacccaagcaactctttcaccaagtccaaagggaagtcacctattttaattcatgtatcaatatctcgtgcctaatctggtgttgccaacacaccaagcttttgaaactagctagttcttgtcacatccttcttcattttcacattaataaagctctttccagacttgatgcatctttacagaatctgagtaaacagtgtaagccaaatagtgagtttcctctagtactctttcattagtcctccatatggaccacatcatgactgatacatttcaaaatctccttagactgtattgagaattcagatattttttttgttacaaaagtagtgtggaaagattacttgtcttgtgatttgagaatttcaaaagaattcttttttttccccaacccttttagctaggttgggaggtatattgagtaaaagttaaattacaaaatccatatcagttcaacaaacaaaacttgaagctaaaattgtaggcaaaacctgtgaaaaaaatttatagaacacatagtgtagacatcagggatgaccgtttggtgagaagaaagagataaacaagaaataaggtgggtgacaatagaaaacatgaatgaaataggtgagaaataaaataaaaaaaatttagtgtaagaaaaaaataagtagatgaatgaaaataagtgagtctcacttttaaatttatctcctctccacctttttatttcatatatttttttctgtctctttatcatcttaggtgactatttctctttcaccaaacaaatttctagga

SEQ ID NO: 4248 - DNA, 1034 bp, Glycine max
  Soy_ogl_5221 Gm16:1063501..1064534 Cluster 18
aaccacaacgcttccggggccaaactattaatttatttggtgatttgacgaatataatttatattttaagtaattgtaattaactaaatatttgatgaatataagttacaacatttatattttaagtaaataaaatatttaatttgatattaataagtagcctacccacatgcacctatttcataaatagcaagtagcaactattttgaacaactccagattaccaacttgccatgatgacaccataagaaaaaaagaagagaagcttactacgatgacatgaaatggtagtgataaaatttcaccgtgattagtcatgcattttttttataaataaattcctttagatgccaatgttttctttaaaaaaaattattttttttctgataattatttagaacaaaaatgtttaataattatttagaaaaaaatgttgctgcttctgaaatctgttgggcgcaggtgagtgaatgtgcattcatatcatggtgttagtttctgccagtgatgataacaattgaatgtgtagacttgaactcaggttaatgtttgttaaggttgttcgagaactctaatgaaaattaacttctcaatgccaagttattttgaatgatcacccttcacgttgtaccattggttcccaattcttagctccttgttgtatgggcttgttcagttgcatgtacgtgttaactcgtgttgtgaatttttgaaattttaagtatagtgcgcgttgccagttgttctgtactttttaagtagacagagttctagatgttcttcctatgaggaagtttatttttacggcaagtgtttcaatgtttgttaaaataaaatttgcatatttgtagtattttaacagcacttaagagtatttccataattacattttaacaccaacattaatttatcaaaatatattagaggaccgtattaccaagtcagaactcttggagaagcatgtttgattaggtgaagtcatttatagtgtcactattgatatcttaattatcttttgagttatccactcttat

SEQ ID NO: 4249 - DNA, 1900 bp, Glycine max
  Soy_ogl_1007 Gm03:40817901..40819800 Cluster 18
caaaatgaattgttgttaacttccacttagcctttaaaaagtatttgcaattgcttatatattacgttcaaatcttcccttcaacctggtcttccctgagataggtcaaattttgagctgcttctcaatccaatttgttgcgctagaagctagtcgtcagaatctgttattttagtcattagtcatttttagcattgagccaagctaaaatttatttatattgagccccatagtcgatggtcatcaactgaattaatcggttaaatatatcattagccgataacaaacaactagcctcggtagcaaataccaaacattttttgtatcaacacttttgtatacaatcacaacaacaaggttagaatcttaagcaagttatctagcaactaggtccacaacacgggtttgtggtctgtcattcgttgaattagcctgtatgagaaagaagctcgatcatgttttccatagtttgcaaggaaaaagattaattcctctaaatgaaaaaaagactaattacactccacacattgggtggacgtacatatatatctgtatatgcattggagaagcagaatataaaggaaaatgtatataggagaacaagaaaaagtatgatatatggattacataattacataattactttgtatattatacacatcagataccagggcactataattatttatttctttagttggaaagtatagagcgacttttctcgcggtctattttctatgctactagtaaaatcgtttaggatgtggcttttactttattaaattcattatttatgacatgtatcatgtattgatgcaacttaattatcatgttttcaaagatgacattatccaagccagaaaagtgcgcaaataaaaaagaagactgggagtcaagtctacctaatatttattatgaataattataaatctttctctttatttatttctttgtttcttttatactgtaaatattaaatattttatgacattctttttattcattattaaaaaagaaacattctttggaaaatatatcattattcctttattattcaaatttcaaatcttcacattcactgtataccctacttgtataccgtgtgaatttctgaaatactttatctgtagtattgagttaattttagaatttttacatatattgtgaataggattaagttcatacccaaatagaaattactcttaattaaaaggaataaaaaattacgagaatctataaaacgtgttatatattcaagtgaatgtaataatcatatttactctttttttaatatttatgtattactaatttacatgtctatatatttaagtaatgaaaacttagttgttgtttttttggtaccgtaggaaaataacaaacaagaaccaagaaatagtaaacatatcgcgtcctaatcaagactttccataatgtgatccaagctccgaaggctctaccattggtgagacaacgagacattacctgcaccacacccggtcaaaatatctgcaaccatatttgcgtcacaattaagggggtggaattaattttgtatcatagtgtttattcttcatataattcaataattttaaaagaaataccaccaatcatttttatattaatttagaagtatacatttttttttagctcttaatcaagtgatttatgattcaaattttaattgagtcttagatattaaaagatcatagtaagaatcgaatataccttcagtacgttaaagataatttattactattttttcaggataattttgtatcaatatcattttgagaaaaaaaaaaaaacaggttttcagcggcttggatccctcaagcgggtatttgaccaaccaatatcttataaagatctaaaatgttatgtgtgtgtttggttcaattaa

SEQ ID NO: 4250 - DNA, 2525 bp, Glycine max
  Soy_ogl_1155 Gm04:1032930..1035454 Cluster 18
cctcttgcgataaaataaatcttggcttcaggctgctgcagactgcagtgttgtggactgggagttagtaaaagaaatcaaattacattaaaattaatacattgataatactcgtgtgggctcaataacttgttttcgataataagtaatcatcacaatgcaagatgcgctttgtcccaagattaaaactaagttgggataaaaatttagagagtacaattttttgtgaattttaatacacaaaataaagaaagattttttatccaaaaaatgtaaaaatatttttttattactttagaaataaaagtattaaattttctcaatatatatataatccaaacatgcactgatttatttccctatcgagtgatacttgatgctgtaattttttttttctattgaatatatgcatgcaaaaacaaaatattaaagcgaaacggtatttcagagttagaagaaaaaaaaaaactttcttgatatacttgatgcgtcatcatggactgtgttaatgaagaaacaagaaatattgaaatgattgaaattgataaacttctgtcgatggttttccatggcacacttagcaatctttgaatgcctttaaaactgccccgcatgacaatagtttttgtgaaggatatttaatttctcgctacctgcagcatcccatatgcacacaagtaagcaaaaagttttttgaacttcatgactatacctatatgtgacataaaatatattggtgcatccttttttttatttatttatttcaacaagtgttatcaaatatcaatattatatatatcatagatcatcatgctcgccacgattatttgaaacccaagctaacgaatttcccaaaactttggtagggactatggagatatattgcagtatggcgtcccatcatactattcgttgcggttataagaagctgacacttggactctgcaggcagagtgaccaaaaacccattacatacaacaacatacgtgtgaggatcaaagattttcactccaacttatcagtgttgtgacttctttggctctttcttggtacattagagcaagagaatctcgtttacgtttgtgtataacttctctttttgggcatgtggcaccaatagtggtggtggaaaagaaggcatttctggtgctgttatcatctggttgagtaatgggtggaccagttttggggctataacagccttaaacaaaaaatgtggtacgcaactccctttgataattgatgaagatcactttcaaatgaatttttgtggtattatgtgcgtacctctgccactgcctagatgtgtagcttatcagcctttttcaggaaaatgggagatgaaattcccaccgaatgaactagaatcatgcatataaaatatatctttggcggatatgattatgaagctatagaataacgtaaatcacttttgagaaaagtttgtatcagcatatgcgagtcactgttgcctgttggtgtgacttgatgtgtcaatattgtatttgatgaggtactgtagcaagtcgcacatcgatcaatttccgcgtggatctgcgcgaaactcaaattctgaccttggattctctgtatttggtattgcgttgccatatatgtttaggtggtgccaatcattttttctcttttccagttatttttttttacaagacttttttttggtagttagtaccacatacatgtgacatcaatttagcccaagaaaatgaaatatcattagctagctaggtacctaacactctcatttttcatgtactataataagaaattgattagatggaagaatttagtgaaaatatcagtacaattgaaagttttgagataacaatgagaattaaaagtcacagttggaattatatttatccgagttcaacctgggtggaatggcaaagtttcttttttaactataagctaacgaattaatgattgatattttaattcatattctgttatatatataacttaattttgaactaataattaaaattctatatttattttataatgacttcttactttataagaattaaaacttaaacatgcatgtaggtgctgccataaagttatgggtggtgatgatgaacaatatattattctccttccagcaatcaaagatgttctgttgcatgttgtccacattaaacgacctctcaccataggttgtcatggattacgctcgtcttaagtttttgaacatatatttttattattttcaaaaacgtgttaaatgagaaataacattaatatactttttatttaacctttttaaaaatgcatttaattattttcaaaaatcattgaaaatcataatttttgtgtgtttgctttcttatttaagaatcaaaattattattttatagttaaatttgaattaactattgggatctcagcctgcatggcaactatttttatatttggccatgcaaactgggttcaatttagctgattcaaacctcattggtatctaaaaaaaagttttgaatcaacataaacaactaatatgttat

SEQ ID NO: 4251 - DNA, 1600 bp, Glycine max
  Soy_ogl_1191 Gm04:2641801..2643400 Cluster 18
gggcagatatacgtaccaaaaagaaacacaacccatccgggtttatttttactagttcattcgcctcaattactgttaatattaatgaactataactgtttctaataaacttaacggctatatttcaacctatatataggtgtttttatgtagagctaagcttccgtaaatgcaaaatgctaataataaaagaaacacactaataagccttaaaaagaatgaaagtgcttgttttttgttaaaaaaattaggaggaagatcagtgacagtaccctaatccaaaacagaaaaaaaaaattctaagctcaaaaaacttcaaaaaaatgagtgggaacttgcaacatgtcatgttgaaatgaagagtacttgattcgttaccttttaaaattcattctcccttgtattttgtcaaatgcacacattgtttgtctgctgtttcttaaaaaaaaaaaaaggtattgctttgtgcaattcgtccaaccagtcttgtttataatatcattgttcttcgtaatttaatgctcgataaattaacattttttctgaaatatttttttattccagttttacaagttggcaaaatcagtgcattcaataaattatttttttttaaaatcctatataaaattatattctcactaatatcataaattaatcatattgtaagataataataatatttgctttttctcaaagtttacacagtttcatctcaaactttctctttgtaactaaaatctttggtgtcatattctcaaactgtaacaaaaaattatgaagagttactgttcgtttcctgtgaattgttccaaatgttctgaaccatccacaattgttttaagggtcaagataccagcagttttaaaaataactgcagaggatctaaatcccttctagaattttggtgaaacggcaaactgctatccagtatccaagataatttcttaaatggaaaatattgtgtttttaacaacaacaaaaacatttataaaaaagagacaatacaataatttgttggcctgaggttaaaaaaagtttgaaacatttaaaacataatgtcttcaaataaatttgtacaaacacgtgttatataatatgttaaagtaaaatgactaacattatcaatacatatatattttcttaattgaacagttaaaaatatgttattagtgaaatcaattaacgaaaaaaattgtaaatattttattagaagttaaaaaagtatgaccatttagctaatgtgtcgattggattcataaaactcgtaaattgtttgtacggtagtaatgtatacattataaaaaatgtgtaagattcacttctactcttctgttagagatgatcgaataattaaccttcattaagaataagtagtccttgaaaaatattactatagtaaagaacattataaacgttttataatagaaactgatgaaattttaaggtaaaatatgaaaatagaataaagtattatatgcttgaatctcttatgggaagaatatacatatatatataagaagaaaaacatgcaagggtgttaccgtaaaaaaaggtaaggcaggggcagagggaacaagaaagttgttgcaattttgtccac

SEQ ID NO: 4252 - DNA, 1468 bp, Glycine max
  Soy_ogl_2125 Gm07:2144501..2145968 Cluster 18
tacctatactcaacattatttgtggggccaaacaaaaattaataaaatgaaaataaaaaacatttatatgataaaaaaatagctgttgaaaaggaggagatataataggaatatggtttatttgtaagatttatatttaattaaaattttaaagttgctgagttagaaagaagagttatttaaatcattaaaaaaaaataaagatatataacgtgtaatgatgggaaccatttaaaatatgtaaaaattaaaaagacgaggtgctggattgaagatggaactaactaaaatccttttagccactgttaaaatatgtctcatattcttacttctattgttcatattttgtaagttgtatattttctgatttttcagttcatagcgttgtatctttacttttttggtccatacgtatatccaagtcctcgaataacccaacttagttggcccatatagtccgaaatcactactctggcccaaataataactgtgcagtatggacgctgcccaactattttgggaaccgagaaactcaatattaagggactctatttatactttccttttttctcatcgtacattctcttcgcgtttcttcttcttctgaaaacagtatctctcaaaaactagtttttagaatgtataattggaaagacctcctactaacgagtcttcaagtagacaattttggaaatatttgtgtcctgtgaaaacaaaaggtgaaattcaccgaagaaaaaactaccaataaagaaaatgcccataaaagagaaagttgtgacttgtgaggaaggaagaaggagatgagagaggaaaagaaaagttaatgttaaaatatgtttttaataagaagaatatcacttcaattcatatgattttcttttctttaatcttttttattaattttgattctagtaaatttatttacataaaaaaaaattctattaccattaataatgtaatatgcacttaaacacatcatatcacatgttcttttagaataattttcaatatgacataatttgaaacacattatgtcgtcattaaacagtgacaaaaattatctgaaaaattttaaaatttaaaattagtaaaaataatgcctttttaaaagatttaagaaaaacaagattatatttataagaaatgaaacgtatttaaattttaagctaaaaatgaaagtaggaaaaaaaaatcttggtctgaagtcagaactacaaatagcagttcatatggattacggtattggtaacatcttattcgtgccaactcttctttcatcttatgtatagccctgtctcgatcggcaacagcaacaatagtgctcgataattgtttactggttcaggttttccgttcttattgttttgttttggtaatacagaaaaaacatgtaagactgtctcttaagatgcgacgtacaatcatcctacagcttaagacatttttaggttataaattcttaaga

SEQ ID NO: 4253 - DNA, 1832 bp, Glycine max
  Soy_ogl_2488 Gm08:3282724..3284555 Cluster 18
atatatataaaaaaaaaaaattcttaatcagtcattagcctaaaacatggatacccgaacaactgagtttagtttgggctttgcagtggaattaggtgtagtagcatttaaaggtcttccttggcccacgatacataatgattgtatagcaacacgctggaaaaaaagcctataattgtttcggcagatcatcgacgcctgaactaggagttattaataagtatgatgaaattacgtttcgaaatgcaacatgctgacgaatgaaacaaactctcagttttgtaaaagtttggcatttactttactgtttaaatttctcatatatatatattaaagactaattacaaattttataatttttaataaattttaattcattagaaatatatatttaaagcaggcgtcatcagagaaagtgtgttcttcctcatgttattattcaaatctgaatacaattagttaaatgaagaataataagtgtaactaaaattaaaatatggcggacttctctcgcatcaaaccacttcatcttttttttaggcatccacatcatattttatagtatataaatagtttttcaaaacaattggtttccaaaaacagagagagagagagagagaagtgcaaattgtatacagtattgttttaatttgagctacgcgcagaaaacatgtgccaaattaatatagcttttctcttgttaaaaaacaaataaagacgtatattatataggcccgtttctttattgacatattaaaaaggcaattatagcaaggataattttttttctctcactaatttttaccacaattttgttatttacgagggaaaagtttgaggtcagacaaatgatgtaatgaagtgagatgaaaaaataaattataaaataatattgtaagaatttgttttaagtataacattacttctataattatttgccttaattacaataatgacctggtgatcattgagaaatgggtgttcccatccctgtgtaacaaagaggtgattaaacaaaatggaggtcgaagagaagtcattaatctaagtgaaattatatttatcccctttaacgtctcaaatttgagcttaatttttaggtagatgaaaaaaatcttttaacagatattaatcattagaaaaaataataaataattcaaattgatattataataaaaaaaatatgaatagaaaagaagaaatagagggaaaaaagagagaaaacggcaacaaactcaactgtagatgattgtgtgtgcttatagaatcttgtgtttgaaaaaaaaaataaaaatgcagatgtgatgtcaaggctcgattcacaaattcacatcgcaaaatttttggtaggattgaaatttgggatgctttgaagattaattgtccatgaaatattatggaaactgtcaaacggaaacgtttagcatagacgtggtcagtcttgggttggtaaccattttaacctctcatggtaatattagtcgacataaacacttaaaaatttaaagaattatatattaatagtacatgaaaatatgagagcgtttatttcacgaaattatttttgcatttatgtgagtcacatcctcaaaataatatagttataaatattatttcttagcttatataaaaatgtgttcggttaatttttaacatttttaggaatattttaaaagtttaaaaataataaataaaaataaaagtaaaaaatggaagttataggtaaattataaaataatttaccatgcatattctcatgagaatatgactttttcgtcccattagcatgaaaataaaaattagataagcatgaaaatatttgttttgggaat

SEQ ID NO: 4254 - DNA, 2300 bp, Glycine max
  Soy_ogl_22 Gm08:4721901..4724200 Cluster 18
agaaaataaaaagtacatatgtatggatggaagagaacgaaagaaaagggacacttcatagttccttatttcctttaattctttgagaggttttaaacctcaaaacttaaaaagaatattacttagtacatgtttaagtaaccgttgtaaacggacattagaatcaagcataggtttgcaaaagcatcttgattcttccttttgcattccatacttccatctgtgttgagtcattggatgtgatcttgggggaatttgtgcacaacaatttagactgcaatgcaaacatgcttttagccctcattatttgtcatttcatctttttttttaataacaaattcttgccttctatgtcatttcctttctaattcaaatattaatattaccaaaatggagggttctcacccctatcaccaagcatctaatgttgctacatcagcgttcttccgaagcccagaagaggtaatttggtgcgtaaagggcttggaagatcagattcaaagtaccaacaaagaaggaataaccttctttttctttggtgaaaagaaagaacccttttcaggtgggaagaaaaacttgtactagaagatagatatagattgtcattgattagccaaaacaagaaaaagagaaagttttgtatcaaagaaagatgagtgaggactcataatactcatactttaataataccacaatgatgcttcgagccttttcgtttcactgcttaatgaaattccttttatgtatatatcttctcttatatttagtaatcaaccataagtttatgaagaaactaagattatacgccagatcgagatcgagtatggtaattaagatgatcaatttaaaaggacataattaaacagaagtgaaaagatgggtgccaattagtgcatacctatcaattagatgttacgtacgtatatgaaggctaggaccgttttatttttttgtgtgtgtgtgcgtggataatagtatatattgggtgggttaaatagtggaaagatcacgtgtagcatgcaacactttgattaggtttgtttttttgctgttatgggtaagaggatagtttagcttttccacaaatctaatctggcttagttctgtaaagggttggttacccttgtaccggtacacataacagggtacccttaattatcttttttttttttttgtgcgtatatcatgccgtgtacccttaattatcatcttatctaatgagtttgcttttgttgataaaaaaaattacttaagtggtactttttcgagtttaattagtttctttttcgagtttaattagtttcatcttctagcctatttctgtttagttaattgatcatgagcccacaaattagtccattgcaattcttttaattaagagatatatatcaaatatttttgtatgagtgacaaaaaaaattctaagttaatgcatctctcttatgtatactaattaaattaaaacaatcatatttgatacatatgttcggtggtgtcactattatataacaagtcatacatgattgaataatactcgtagaaaaagtgttcacatgattgagtttaattattataatttttatagtacgtagttgattttatgttgattttaaataaattagattttatttttgtcttttagaagaacctaaaaaaatatcatagacactttaaagcaaaagaaaaacataaagacatatctgctcgtatatattaaatttaagtcttagattttattcttatggttctcgtattatgccacatgtcttgatatctcttattaaatgaaatcaaaatagtatttttttatcaattaataattcaattaattaatgatattctcattgttcttaatttttcaatgaatatttaaatttcttcaattaatatattaaatgtaacaagatatttgaaaatcataattaaatcactttttgagatgttttgtagaactctgagattgttataattaaaaatcgtgaatatatataattttttatttgcattaaaataatttatcttcagtaaaaaaataaattttcaccaattagtttaaattttaccctttgttcttacaaagaatcaaacaaactttggtattactaaacaaaatctaaaagttacaggtaaggttattaagatgggccagactggcccaagttagattaatttaattatgaattgaattttttttaatctactccgttttattggtagtagtaaaaaatttgttacacttactaacttttctttcatttttatttttgaaacaaaaaatgagatgattttatcataaaatg

SEQ ID NO: 4255 - DNA, 2129 bp, Glycine max
  Soy_ogl_3622 Gm10:48537801..48539929 Cluster 18
tctattatacactattcatcatgcattatgtttggttaatgtagactaagattttacttaatacatcctcccatacccaatactattttgatgcaaaaataatatgataagtggtccaataacaaatttaagatagtttctaatattgaatttagattttagagctaccttaaatccaaaaattaagacagaaaattaccttctatttataaaactattcagacagtatctctcaacagcgtgggatcgttcggtcttaatctaaaaggcaaagcgtgactcgattgtggctctctgagtaatacacttttgcacactgatgttaacgtttcttatcatttttagctattgttattaattgtcacccaccagttcaatgaatttgaacgatcgacccattgaaagagtcttccttacctaattttttaagaatcttccggactctccttgttccactaattgattgggcaaatggatttgcatcataatacttcctgaagcttcgtagcaagtattgcattatcatattcttctaaaccttaggttaagcgtatagttacatttattttttcatttaaaatattgaatatattgtccttgttacaatgccaactcactactcttgccagccaccttgaaagcaacaatttctcaatataatgtccttgtcattgttaattgctttctctgttgccatggtcttcaccccaaattctttctcgactcttctctgcattccattattctatgtacctttgaggcattctgtagatttatttttgcaacattcttaccttcctccatttggctgtgtctgctattatagagtagagtgtgattttgaattctttacttatctcttcaaagcactttttctgtagccaagggtcagtacatatcaaaagagcatgtcaaggtcaagcacaaaaaagtaatgaagagaacttgataggtatgccgttgtacctaaactagatttgcgatttcaaaattcatataagattagctcaatcaagatattttgggagccatggcgtaccatcatgcataacatagtgttaattatattatgacatatttaaaccaatacataaattagtttgttagaaatttatgttttaaatttgttttttttaattgtcataataatttttttttctgactaaattatcataatattaatgatatgtaaacacataaagtaattatatagagtagttattatgcgttaattaagaagttgatataaatgacatctatgcatgtacgacattaattatccgagtattttatagtatattttatggaaattgatattcttgtattgaatttttaggttaaattatcttttttgtcgtttatgcttgcttagtttccgtttaattttttattttatgtttttcttccttagtttgctctttttttttaattttaatttagtcatcagtcaaattattgattttaatgcagcagttttattgtcacgacattagctattcaaagagtagtttacagtagtacttacttaattttaatgcattataattgttatagtaccgtgtcatgcttattcaccccctttccagcatttaacttacctaaacaacaacagcaataataaaaaaaaaaacacattaaattcataacattaataatctaactaatgataaatttttttttggataaaactactaataaaataactcaaatatatataaaaaaacgcaccacactaagacatttagttaataactaaaaaatgaataaaagctaatttacaataataaaagacattcttaagccccagatatgactataatttctaacctatgttttgtggatatatgttgcattattaaatgatgcgaaaatgcgccatttttaaaataacttttatttttgttaatgttaggatttgaatactgatttccaagaaactaaaattgaaaatcttcaattgagaaaaaaaatgagttttcctaacaagcatcttaaggaattttacttgcaaaatcaataaatagtaagttttaacagaaaattatggtagaaataaatagaaaaccatttctcaaaaaatgttttaaatttattaatcaacattttaaagacactttatgtatgagcat

SEQ ID NO: 4256 - DNA, 1086 bp, Glycine max
  Soy_ogl_3639 Gm10:49043401..49044486 Cluster 18
atgggggcacgtgccctttaatattctctgttttatatattattagcatattaagttattatttgaattatattttttttgcaactttattcgcacaacttttttttttaattctataaaatattatgactccaaaatgactcaaatttttggatccattgcacccaaaatctcaagtgttaaaaagcaagatatgaggtacatagtacatcccaccttgttgaacattaccacgtttgatcattttttttttacagttgtaaggagttaaattatttgtgattcattctaagttgttgactcattcaatgtttgattatttaaacttgttttttaaagcaaacaaaattgattaaaatatatgtccaactatttcgacatatatatacttctcttgtcaaccaacatcaagatcacaattattgaactatatatgctggtccgtaggtcttctgatactatttcactttattttcctaacatgcatttgttaagtattgaattaatatacaaaaatttgtttaaatagaaattcaacaaataaaatataattaagtcatgtaattaactaaatgagttaaattcaattttgtagtatcttttttcagttttaccgggccaaaatgtaaattcaaatttaagtcttttgataaataaaccaaatttaaacaacctttttttcataaatcaatcctaattaaattctaagtactcatattcgtttatgttctaccactgaacttgtagatctattgacatgttttaatttaattaatattatgtttaagttgaagttttgaatatgtaattgtattacatatttaagtaaaaaaagttattgcccataacaattttattaccagtctcaaacataattacattatttaaagaatatgcatatattctgataaaaaaaaaaatcatttgcgtacatttctatcctgtatagcaattgttcttacagccatttactaccaccacgttcttcaatcttcatctttaatttctgatgtcactacttgccatcaacaacatgccactgaattcgtgccgcatcagccaatgttgctattgccattggatatt

SEQ ID NO: 4257 - DNA, 1700 bp, Glycine max
  Soy_ogl_5209 Gm16:589901..591600 Cluster 18
tttgtgattctttctctctttgaacaaagattttgtagtttgatcggtctttaatttttagttctttcttaatttgtagtacttcatccattaatgcaccacgtacgtacatgcaccagaagaatgtcggaaatgcatgcaatcattatattcatggcataacaatttgattttgagtgtagataattaaaaagaaaacagatgcgaattaagaaaaaaagacagagagaaattgtataaaaataagatagaaatgagataaatgaaaaaaaagtaaattattgtaaccatcaacatcttcatttctctttatttttcttcttaatgcatcagatcattaattatatcaattataatgatttttcttcttttctcatctttctctaggcctagatactcaaggcatatgcaacaaaaaaatgtagtatgattaaaaaaaatgtatataatggagtgtatgaatacactactgcctcaaatcctagctgcaatgctatattatttaatcaagaagaggatagcataatgaaggaaatgcatggaaagttcagtttactggaagtactgcagccatgagcagagaataataattcatcttactgtattacactcgtatactcagaattacaagcaccagatctactctgaataaaatgattatatatttaaagatatacatatactggatttcacaccacttaattttagttttaattttttattaaaaaattatttggtaattaatttcttattcaaaatttattaaattttgatttctttttttataaaaaaaagcgtttaagaaaaaccagaaacaactgaaagtttttttttaatcattttattattctattctatggccctaactcaaatctatgagtcgtttagaattatactgcaatatatgtggtgagacatgagttagtatgtgtgtttgtttaaaactatatacgtattatccatattgaatgtacatatgtagacatttttttggttccaactatatgtagacattgatctcacaatttgctttacccttaaatgtcatcatagaaagtttttgtttcagttgcatgttcacttttcagatttctgcatgcatggcttttgagaagtggctaatgtagtattgattatattttgtctcgtgacaaaaaccttttgaccatccaatactgaggcgcgtgttaattggagaccatgaaaattgaaatctacgtaagtataataatattaatgtaagcaaaggacggaataactgcaaaatggtgcagaaaaacccatgtgtttcgtgaagaactttgtcgtacatgcaatctatctatgcgcgcccggttctaaactctatgattgttgttctgtccttctctctttccttttcctctttttcattatattttctggttacctgaatcctgtaacgggttgattcctgatgacgatgatgaaacatccacttcataatatatatcacaatcatattattttattttagtaaaaataaaaatctaaagaaggagggattgagtttaaacatgaggaagtgaagcagaagaaggtgacaaaaaaaatgaagggattgagtggagcgaaaaatgagtaaccaaagaaaataatggaaatgcattgtagtcccttaatcaaagaaacagttaagagactgaaaataaataaataaaaattaaaaaagtgattatgat

SEQ ID NO: 4258 - DNA, 1900 bp, Glycine max
  Soy_ogl_5276 Gm16:3657301..3659200 Cluster 18
atgcaatgaattgggaggaagttgcttgcttctcccaacttgcttcctagaggccatgatgcatttggataattgttgaacacgttacgacgcagaaaaaagaaaaattagaaacctcatgatcctcatccaatagtacctaattaatagttttaaacttttagtccacgtcatcactcccacaaattgtaattttgatttgatgctcaattttgaatcctttaagatctttcaatttaagaagcaatacttctgataggctggcaacaatgaaaaaatattaaaaaaagaagaaattatcttgtaaaaatataatggattaatcctttttagagccattagttatttttttttagaaaaaaaatgcaccggtggattaaatttttagaagataatttctttttagaaaaatatagccacacataattattttctttgtttatcttttcaccgtatgttatggatataacatgattaacatctatatgaaatgtttttttaataaaattaaaatatgcaatatctttaaagttgtatatgttcatggtttctcacatatatcttctttcggagttaatcaattaatatatgcttgagacatggtctaacatagatgtaaaaatttattctaacgaaaatttgaccctttgtttgtcatcttacaggagtctagctccttttgttaaaaccaatcctcattagtataagtcatattttgctataggattccttgatgaccacaaataagtttgtgtgggtaagtaaaaaatttggcaagagacaaaaaaaatgtaaatgacattttagactcgggttgttctctctctctctctctctttttgtgaattctcactctcttgttaatatgttgtagatgtgaagtgttttgagtccaaaattttactgaaagaattcgagtatcagaccttaacgttgattccccctattgttttatgcaattggtttagtacatatattttttttttggtaaccccgttaggtttagtacatatatagaccattacataatgacctatatttactaaattaacaatttttaaatggtaggttttaatagaagaactcgtaaaaaaatatttcaaaagttttaatttttagtatttatattttttaactaccatagttagacttttgattgatcttctacaagattctgaaacatctctacatctttgattctttacaattttacattgagactaataatttattttcttttttaattacttttgtagtaaacttctcgatacaaaaccaagttttgttcgactatcttttttctatagtttcatatatagtctgatccataagttttataaacttctataattaacaaaattttgaatctctctttaatttgttcttaaatatagggactaaaatattactgttacttgtaccaaaaaaaaatctaacattttcttatatctcaaaatctcgttaaataacatagtaagtcaaatgatatcttattctactaaatttttctaaacttcaataaagataccatttggcctaacaactccatttttccctaaatgacaaccttaaatagttgtcccctaaataataatgatatagaattactatttaatatttattaaggtcaatattaatttgggacaagagcaagtctgtgtttttgtgttttgttctaatgttagaaaaaacagtgcattttttttccttaattaatgtttccacttggtctgcagtaaagttcatgcttgccttgagttttattctgttctatatatcagcctctattcaagaacagcaacactacttgcagcacacaggaaaaaaggctaaatatatatgtcggactttatttcggtatccaaattatttggtctatctttgatttttaagtaatgtg

SEQ ID NO: 4259 - DNA, 2000 bp, Glycine max
  Soy_ogl_5455 Gm17:1951501..1953500 Cluster 18
tcccctcctattatcattgtcaaaataaatattcacatcagtcacaggctatataagttttggtaacactggagaatagtggtgttcgtgcctaaaactattcaacacggtcacaccaaattaccaattgctaaaattattatcttataatataaagtgaggagtaaggtatttttctgaaaataatgtctaattagtttaaactgttttttttcttctggtagcatagtgtatctttgaatttaagttaaaaacattatttatacgttttaatgtgaattcaacgaattaaaaaaaaaaaaagcaaaaataagcatcaaaatgcacatagtcaacgctgtcatgtactttttttcttctcctggtggtatagccgttgccatgtacgtacccaagaacgacagtacataacggacgggattaggtgtgtatatattgatttatgtaatgtattgtgggtattgatttatgagaaaatgatctacttcaatataaatacacaaatatctataagaaaataatctttttggatctttaatgttgccttttttaagcttccaaagcatcttatattccgattttttttctccaaaatgtaaaattttgcattctaaaaagaccttttcagagtgtaatttaacattttggattaggtgcaggaagcaatatgggggaataagaagtaattgtccttgtaaaaggtgcaagtcatgtgggaagtttggggattaccccgttgagagatgcttgaaacacatggactgggcctataattttggggacataataagaccccaggccagtcgaatggtgaagagagtgaggaatgtgaccaacttaggttgcttcattctgctttcgaacctatcaagttgccaactcctgcagtacccatgattagcattcttatgcagtttgttataaataatcgtgatataaaatcatctggtaattattttttagacatttttaaaagttaatttttgtttgtttgcaattatagcaataactttttttaaaattttattttttatgataagttatttaaaatattttttattttaattagattttatcttttttttaaaattatttattagaaaactgtaacgagtgaacttattatttcccggaatcaagggaacgtttgtttcacatactattttgttatttccagacatataaaaccaaaaaaattagcccatttgttacgagattataaaaattaatcctgaatatatattttatttttgggaaagatataattccagtattttatcgatatatttagtcctgaccgagaagacaggaaaaaatattctcatgaaataagaatatcccttcatgagtaaaaatttatatatatatatcctcttagtaaccattatctaattactctcccatcgtttccttatcatatgcgcttaaaatttttttcaatcccgcaaattttgttcttgtccaattaatgttatcacagtttgatttagtgtcattttcatttctacattttactactataatttttactttccctcccatgctcctttttaattggtaatttttactcctctttccattattataattgtcaaacagatgggaaggagaggaagaatgtaatgagagttttgtaataagaacattttagtaataacaatatatactctcagaaaaaaataactcaattaaacacatgttttaatcattcatggaaatataaaaaataatcctaaacaattcaaacaattaactaaacatatttcttaataatattccggaataacattctcatgttatatttttatttttaggaaaaaatatttccgagactacaaaatttccaaagtctctaaagttacatttaaaaaaatatttttttaaaaattgtacgtgtgaattttgtaattatgttagttgttattcacctatttattatcgatcaatattctagtcttttatttgtttttgctattatcatcaattgatcatatgtgcca

SEQ ID NO: 4260 - DNA, 2037 bp, Glycine max
  Soy_ogl_6844 Gm20:38453164..384250 Cluster 18
catatgggcaagaattttagttcaagtgaaataaagttttttgagtaactgaattttatatatgcgtaattgacttacactttatggattcgaaactcactttgtagtggatgagaagaaacaaagaaaaaactgaaattggagaataactttaaaaagaaaaatttaaaattatgtttgttaaagttagtttttctttcttatttcttttcatttttacaaggagaaacttttaaattataattttttttcattttctacatccattatataagcttttatctgttttagaatttaatgactgtgaaagcgagaagtttggtgtcccaaacacggtaaggcaaaaggaaatggatttcgcctttctgttcgcaagtacccggcatagataagttaataggttgcttaaggtaaataatatacttatatctcaaaaggataaaaagacgtgagtttaattattatttaagaattttgttggtggataatctataaatatttctatgagcgttttttaaatattaaaatttatcgcaatactgataagttctgttaaaaatccaacacacctaaactttattatcaaccataagcatagataagttaatactaccatggttctaaaattaaagttttagtcttcttttattacaaaattattaatatgttacaaatttcaaatctaattaattactatttttcttttatacttctatttaaaataattaaatttaatctttacaagaattattgtagttacaacttttttaaataacatttcagcaaaaaatagatgacatttacattttatattaaatgaggttatttttaacggaatacttttaatctgactgcactaatcttaatctgatgacaccgggtgctctatcaaaaaaagaataaaggccttgccgattttaataaaacatatttaagataagggcctacgtttaatacttggattgtatttcaaacagaattatctgttattccaaaagaagaataaaagccagtataaaaaagaaaaagaaaaaagaataaaagcctggcaaagaatgttagtgaaaaaacaaaataaacatctccacactaggtgaaaaacatagaagaaccatgatagtggaataataataaatataatccaagttatcagttccttataatgcgtgtggatcaacaattttgaaaattttgactattgtcatgcccattcaataatcaaaagctgggccttacttttgcactatttatttttttctaattataccgtcctttttgatataaattttgtttttcttttcaccatgacagcacctattcaaataagtaataaccccatcctcctttatccttcatttactttttttcggaaatctccccctattgctccacctcattttctcacacaagtctgctgcaccctttcaccgtcacaagtcacgaccctccccttctcctttctcgcaattctctagttagtgtggcaactctattttttttccttctatttatcagaattcagaaactagtttctaaaattatacaaatgtattaaaaaaatctaatttccttaatactttgaaatgtgttttgaaaattactttccaaaaaaaaagtgcgggattgtagttattagcacgtagaaaaaatgcaaaagaaaactcggtacaaaattcctatgatacaattgagatttcagaagcctaatagtattattgagcccaattgagtaagatagtacaaatacgtcttaagttagttattttacatggtttgaagttagcctcgagtgatagtgatgaggatgttgggtattactgattctctggagtgaaatgaatccgtgttagaaatatgcaacaattattgcatccattaaacataattttcgtttcccttgttggccagtgtaacttggtcattctttgtgagaaggaaaccattgtgcgaattttatgtctaagcttggtccaaattctaggttggactttcattttgtgcatagagccccaaataatctttgtccttttctgctgg

SEQ ID NO: 4261 - DNA, 2051 bp, Glycine max
  Soy_ogl_5508 Gm17:4540150..4542200 Cluster 18
gtaaacaccaaacaaaatgagacgctaaataagagtatatttgtaggaaattcaatcagacaaggaaaatcatgggagagatttcacaaaaagccattcctttccttgctattaaaatttagcaatagcttcgatcagtcacttgtcacctttcaaagtgggagcattttactattattttagctaaaaaatatggtatttggcgtgcccaaaaaggtagataaagaatgggaaggagatgatttcttgatgtctgcaacgtagaaactgcgggatccttattgcccttttcatttatacacatcagacaaaaataagctgattacaaataagcactggtcaggatcttatcaatcgacaaagatgttgacttgctggctgatagtcaaatatgtaatagttaaatgttacctaagtttagatattggatttctcattcatgaatcataacttattcattttttttttatcagcacataacttattcagttactttacaattttcactactttactgaacaaataagattttttttaatatggattatggtcaatattttttatattaaaaattacaaaaaaaaaaatgaataggtaacattgagaaaattcacttttttcccattatatatatgtataaggtatttgtatttttgtaaataattaatttttatgaaaaaatttgaggctaccttttaataaaatatttttgataattatatttttatttatttataagactccaaattaaattcgtaacttaaaggattctagtccaattttatttaaaccagcaataaattggtaagcaaaatttactttgattgatcttcacgtctttccagttattggttatattccaataacattaaatattataatgtttaataacatttccttaatcattgcttagaatttttttatttgtatactcatttagtaatatttatagacaatattaatcactagcatttcaattatgtcttatttctagctacctaatttttaaattctttacatttttttttatcataaatgagaaagaaataaaaatagtatgttttcttctaaagtgttcaaatgaaaagaagtggatgcaatggaaaaataattggatttagttacatttttatctatttattatcgtcaaattttgattttaacgccttttttttcatgatttggtgacgacaacatggttctgttaaaatggtggtgcaataaagttagcctcgttatttttattaaatattgaatatccagttaacaaataaacaaaaaaatgcacaattagaatgaaagaaaattaaaattacatgcaaaaaaaaaatagaaggaacaaaaattaaattttgacgatatagtaaaagaccaaaagtataattattagttctaggtaacgagtgtttaagaatactatttgagaacttaattaataaatttattaaaaatcagaagaaaaatacattagaaatcatggagagatcgatgtgttggcaaaaccgttgatttttcctgttaattaaaaataactagcaacctaaagatatgtatattttcaaactgaattcgtaatggtgtccattatgatacaaactaaataattgatggtggcttatgactttcttagggtcatagttgtgacattatattttatggttggcagttagaactaattatgctttgtctactaggtaattatgaaaccttttcgtataaaaacatattcccaaatcgtttaaaaaaatatagttttgaaataaagcaaatgcaaatctatatatcgagtatggattaataaattaaaagtaaacaagtattaaaaagtattattaatgtacttactgtgatttttaaaacgtttctaacttgatttgtttattaaaagtttttttttattgattatttaatagggcagatagaataacccttaaaagaattctcattttaaaaatagtagattgctctttaaatgaaatttaagtttgtaatattaatattaattgatattgatgatagaaaacattaaaaagagcatatattgattaaaa

SEQ ID NO: 4262 - DNA, 1200 bp, Glycine max
  Soy_ogl_660 Gm02:44943101..44944300 Cluster 18
ccgcctaacattttacgctacttataaataattcgtgaaaaccctaaccaagtacacatcattggcacaccatttgcctaattttgaccatgggtgtcaaagtctttgcaggtacgtcttttcttgttccagcacttgaaaaaaaaactgcataaattaaattcagcgaaagaaactatggtagaatccatcatgatagcacccttacaagtccatataaatattaatatgtaggtcaatcataataataatactagtattgtactatttttttgtaatattttttaaattacataaaaaaattgagtttagactcataaatttttatttttattttttaaacagttagactcgttaaattatttaaacataagtttttttaattacctattgaatagattgtataacaaaataaacttttaaacaagcttttaaatgttaaaaaaaagacctatgtcaaataaataaactatattgaagtcatattagaaaagaagataggctcatttgttataaaacctagctcatttcctcctttacactccatttattttcggacaaaccttcagatttatgtgagatattgaaaaaaaaaattctagataattatctgtaagtatacattttcttttgtttcttcttcttattctctaattatcactagtactaaacagttacaaacaattagagtcgtacaaccgggaagaaatggaatcaaaagatgccttggtcccaacatatattcttataatcatatcacccacttgaagcaaggcattttcaaccaactaaaccactatatatatcctatcaaatttgagtcactcaaccaatgattttggttcaatttgtttctattatcctacgtctttgtttgttattcactttatcttaactcttaaacctcaattgaaataactagcaatagcaagccaatcacattgatcgagggtccatataatactgctcatagaaagaaaaaaagttgttcaaaatataatggtgcaagacatggtatgagattgagataacggtccaagacatggtgcaagcacacctacccacatattaatgcactaaatgccatgcaagcacacatatatgccatgtaaacttcttcaagagcaaatttcaatatattaaaacatggctatgctataagaaaaaaaaaaccaaaatgaaatggtcctcataggacaa

SEQ ID NO: 4263 - DNA, 2839 bp, Glycine max
  Soy_ogl_749 Gm02:49684610..49687448 Cluster 18
agtacaagaatatccatgtcctcctaatcctagaggcaccaaattccttctacttagccctaggagccagtcaacaacaaaagacttgtcaaggtttttccttcgaatagttttcttagccttctcaccaattgcatgtgtcttaagaagacacaaaatgccaacattatattttccttcagaacacctgtccttagactaaaaagctttatacctcatgtaccattacaattccaatgaaggaccttcattgagaaaaaaatggttactagagggttttaaacaataaaggaagactgaataatatagtactgttaagggcttaaggtcatgtgcctacccttgtgtctctggaataggaggttgcatgccttacgacaaatgagttctcttgggataagctggaagtaccctaatgaccattcttgagtttccttgctttaatgaaagcccttgtctttgcatggtaaacaccacgtgagtgataagattttggtccaatttcttgttcccacttttttggctttcgcggatccattttgttgcatgcaatacaccaatagcttgctcgttttcctttctcacacacatgcaagacatcaatagttttccaccgcgttttgttttgatttcaatgtggccccattttagtcgttacctttggatcataatttttttaacacccaactgttacctaagtaatcctttccacgcggcatttgggggatgctcctctatgactgtttcaaactttacccaccatatgtgaattaattgtggaattattctggctattatttgccatgaatacaaaattattatagctatcatttgcaaaaaaaaatattacatattgttttcgattcaattttgaatttggatctagttccccatttcgatatgtttttgtcaggaactttcacattaatggctttaaaaacttcaacattgatttttgtatggcccttggcgtcttagacacatttttaccctttttaactatcatccatggactgcataatctcaacttatctcgaacgaattgattagccacaatttacgactaattaatttgtttagggctaacatcagcatgactttccttttctccacctttcacagctttcatgttaactttctgttggtgattatgcgttggggcatttaatttgtttgctcaatccctaacgttgcttcacttcgttgtgattgtttatgagcgtacttgccataattaaaacatattgagtgaagcccttcgtatttcaatttgagaatctaacccaagacatggattcacgatactagctttcttcctaggtcaatttcaacactacagattctggcaaaacgcctccctctggagtgtattaaagttaattcaatggaaagacttggaatgtatatatataaacatctattttttgcacctcatttgccaacattgagaagaaattaaggtccccaactttggaccacacataacgatccattatcatccatggtccttcaaatagggcatgccactaatcctcctttaccaagaactgaacttggcagtagtcttgtgacatatcaattaataatgcgtaaagttcacattttagcccgttccttgtgtagcttgtgttcaatcataattaaaactaactttcttcccaacacatcaacaatatgagcattcttccaggggtcacaccattcttcaattttttccttcgagataggaattgttggacatagttctagctttgtagcatcattattattgtcatataaaccttgtaacatctatcctatgagtgttccatatcctcttctgacttctgagcagtggaagtttgccacagtctctttttcagcctctatcaaggtatcaaataggactttggaaccctacatattgtctttgtctccctcagtaataacctcatccatcataatcaaacctttcttagttttaaccttttcggtactacagttaaaagagtcttcctcttcctgcttagaactcttagcaagaaccttagcagagctcttcacctccctcagtcttatgccttatctttatggtctgtttgatttgagaaaaatagggtgggtgaaaaaagaaattaagtaaaaattatgtgagactcgtacctttcatactttactttaattcaaaaatctatattctattttcatcttcaccatttttatgttttctatcaaacgggacctaatatatatagtttgtattgatgttttcttggctttcttctcttttttagatgttttatataaccatattcatggcataattaagataaaaatcattctaaccatttgatcatatatattcctttttaatgtgatatggctattcctctaaaaaatgtgatgtggctattaaaattttttagcaacagtgcaacacatattaatcactgagaggaggcgacacaaaaggaagaaaattcattggttaagttaggggaaactgatgactaaacaaaagaagattggtgaccttggttttagatatgtttgagccttattctgaatggtttgtgaaccgaaaactgcagattcactatgctagttcagatgagccattcagcttgcagcagaattttgtttcaccaatgtgatttttgaatttcattgccttcagcttgtgaataacaggaatagttcaaatacaaatcacaaaagttattttgcaggaattgttgctgattgcaagtattttagtaatagtgtcttcgcacaaacaggattagtcatgggattttttttattttggaactagagttattcttaacatttagtttactatttacatattttcgtatcg

SEQ ID NO: 4264 - DNA, 1631 bp, Glycine max
  Soy_ogl_759 Gm02:50394401..50396031 Cluster 18
ttgagcaacaagcatgaaattgtgctatctaaagaatagtagtattagataagtacaaaaaacacagagttgttaggtagagggagggggacgaacttagagtgtcatggtctcctcaagctttcaattctctttggaattattcagttgttactacaaaataatcatataaaatttacatttagtctattttcttagttataaagtatagttatctgtatattatattctagataaagcacaactttaccaattactaaagcatataaaacaacacttaaaaaaagtaaatatataattagaaaagttgatattcataatcaaatcttacaagtttacaacccacaacaaaaactaaggaagaaaacttttcataccaaacagagtttggatctcatatttgcttttaactttactgatatttttattgaatattaatatattatattgtctctgctattaatagtaaagatcagtagtagtgtttcacaacaaagttattactgggtttaattttgtttttgtgatgatattcgataattgtttgaaattataacgaagctaagcgatgagtttgacttcagtaaagagaatgagtttaaccatttaagctactttataaccacgggtaacagctgaacaataatagttttttggcagatggcttgaatcatgtctaacaaatgaagtgtgctttattatgtttatatcacccttgttggtaacattcataaattgctaatataagtgatagataacctagctagtgtaagttgtctatatatatgggaaatgggagatggcatttcccacttacgattttctttacaccgacactagaactactgggtcaacttacttggttcattatatgatttttgtatcgaaagaaaaattattgaaaaaaaaaagttattacaaatataataattgaccatttttataccataaaacatccacaaacacgaataaggaaaaaaagagtatatagataattaagcttttctttgatatcatacattatgtcttttaatttaatgtcggtctttctcatatatatcatggctccgctcttggttatggacttaattatggtatatctctataagactataactacaataagtagaattgcaataactacagaagttatatttttttaaagaatatattaactattatttttttaataaatatttagaaatttgataaatattagcttttgataaatacttttttttaaaaaaaaaaatctacaagtatcctgtgcaagaggtcattttgtttgtgtgggtatgattattatggaaaaaagtttcctttgaatttaataaatgcttaataacttatcgtgaatgttatcaatattcaagaaaaaaatcagatttaaatgtgttgcttgtaaaaataatgattcttatatttttttatgatttataatgattcttatataagaattgtaatgttaattattccaatggtgaaactacatacaaatcaattcttaaatttaataacccataaacaactctcattttttttttgggtacataaaaaattctcattagacataatctaagtatatattattaccttaataaagaagaggaaaaagaataacatatcctttt

SEQ ID NO: 4265 - DNA, 1800 bp, Glycine max
  Soy_ogl_959 Gm03:39098501..39100300 Cluster 18
cacaaggtgcacacgaatattttctcataaattctatagcaagtcttcataaaaaggttaggtaatatatatgcatgacatggagaatgaaaattttctttacggctgggacagcgcgtatgtagtcaaacggttccgagattaagttatcttgtttgagataaaagcaaagttgcacatggggaatggttagaaaaggtataaaaaaaaaagcaaagcacagagcataattgtaatgagccttcaagtgtcactgtaaatttgaattatattaacgatatgtatacacacaaatggaaataaaatccactaaataaaagaaggttccaaatagtaaaagacaactttacgatgaactggcatacttatagttggtccacttcagtttgaaataatcgcacaggaaaatgatgtatcagacggctataatttcatgattcatgcaagatatcaaaatgaggacgtgtcgttattaattggtgccctcccagccccttccaaccacttctattttactgtacaaaacagagaactgagaaggcatgccgcttgcatacaaatttaaccacatacttacgtcatatatatcttaattatcattatatatcctaattaaagatcaatgtcatttttattttatatatcaaccataaatattctctatgttatttaaattaaataagattattatagatgataaaactttaatttcttttaaaatatgtaatataattatatatttaagactcaaacttaaaactataaattaagttaaaataatctagtacttgttgattcacgtgttaactggttatatatcatgaagatgttctgttgttgacgtgaaaaaatgatttgtcgatgatggtcacaaattcgttattatcttgtccatgttcctatgactagcatagtagcattgatgggcttgtcttggcgcgagcctgcgatttcagtataactaagagagacccctacttcaatatattccattattaatcaatgtccgtgtaccaaaaagtcttaacttgattggaaacaacataaaccaccgagggacacaatgctgaattcacacggaaaagaaaatgccaaagagctaacttctaacacttatgttttgttcttttggaggatacctcgttgtatgatcaattgtaaaacagagatgcagatagaccaacgaaattttcttcaatatgaccgtgcggttttctgataaacatccatacaagatagggtaaaaaaaaaaactcaaattgggattcatattcgttattataagattaataacaattatagtatacatacttagatttaatgacgcctatatactcatatttacatctttatttagtatatatgagttttacctaaataaaatatatttagcttttagtgctagtaaaataagaaatgctattttaatatatcagaactaaacgtgccaaaaaagaaagaaatgtaccaaaactagctatcagaattagctgtaagattttaaccaaaacaaattaaaaatccattattagaagttcaacatgtatttagtacaataaatatttaaagattttctctaaaatatgaattataaaacactccctctaaattgtcttgtacattattttttttacccaaatgcacttaattaatcgatattttttcgggtcaatcaacaatactcctgtgagttcatgcagtatatatatggttatcatggcttggcaagttcatgcagtagacatattagaacattgtatgctcctgtgtgttttttgcgttgaaaacgagtaaatccag

SEQ ID NO: 4266 - DNA, 2400 bp, Glycine max
  Soy_ogl_1053 Gm03:42836101..42838500 Cluster 18
aagattctccgttgtttttttttattagggtgaagtttctccctcgttaatagtaccgataccaagatttttttttcttgggtatttttcttcctattccgcttacgctcactagtcacacctttttagagtgcacaatcataattatcctaatcacgcgaattactactgatatagacatatatagattttttttgacatatataaatttctttaaaaaaaatcgttatatatctttttcaaagaaaaagccattcagctagcttttgaaactggagttttataagaaatggataacaaaaatgcgaaatccgattaagattcacttccgtgttcccctgtgctcaatgaaagagacgttgattcacgttcttttatcacatcactaattcttttatcacatcactaattagttttttattttattctttatattcttctctcttgaattagtataggtcttgataatattgagaggtccaatttttgctatgatttttatctctcgtttccttatatcctttagccattttggatcttccgtagttgagaaccttaggtccacatgatgagctcctgctcacaaaacacgaataaacggcgatcaaaacaagaaaaaagagaagatatgatattaactaatttggttaaaaacttaaaataaaccttcttttgctactatagcaactatagtttctgaaatattcttcaacaccctgcaaccacacacgacaaaaccttatagttagctgctgtcatatgagacctttcagtatattattagtcatagtaatgagaataattaattagcacattagaaccccgtaattaattagcatatttacatgtaataatctatatgtttcgaaaataaataaatagaaccctatcaaattaataactgggcttcagggaaaatagaaaaattaactaacataatatttcaaagttcatttagtttagggaattatcacttttggatattatcaccaatctcccgattggctagtgttatagtattgagtaaaatttcagccaaaatgatgaagagatgttatgagaccttaaagtcttgagtgaagatgttagtccaggtataaggtgaaaccaaatccagaaattggaggattggggctgaggatgacaaggctccaatggcaacatgcggatactttaatctgaaccatgcagccagcactgcaaaacatccattcagactaatcatcaaaattaggggtgaatgggatttaactcttgagtattaaaagaggtagacattgtcatatataaaaataaaaataaaaagacattgagttttgataaaatatagatagctgtatatggagtatatagtatacttcctccataggatcctccaataacaatgacaggggaatctgttgctgataaattcttcttcaaatcaatgatgagagtggcataatcagctaatgcctgtgtggagctcaagtatccaagtgtgctgctatttgcatttgcaacctcctcgtttcccccaaatggaaatgattttccatagtatctatgctgcatgaagttttattttgaaaaagggttatcacttatcatttatcaagcacaaagacatagtacccctcatcaaattaaagaagggtacgaaaatgaagaaggcatacctctataaaaactaaaagggccttgaaataaggtgctgtgtcaaacatgaagcctgtgatctgtgcaatccattctatgtccccttcatttcccatgtagacaaagattggagcattgttcttggcaccaccccaataggtatcattgatgagatatctttgttgaaaagtttgatagctctggggattataactgaagtgacccagtatttgggtgaagaactttgttgtgtaaagcccattttgggcagaactagagccaagatctagcgctggatggagcattgaagaagggaatcttggaatgacatgggcaaaagtgacggtgaaacgcaacagagaaaataaacaaaagcatatgataaactggaagctcgttgccattgtaaactgaaaaccatatgaatgaaatcaatatgggttatatctccatattcgccacacaaattttgtttgcaggggtcacatatgaagataagaaaatgtttaagacttaattacgtttttttgtccctaaaaagttaataactttagtaactaaattagtctatgaccattcattaatacactagactacttagagcccctaatcttgagcatcttccgttaacggacattacaatgttaccacttcttaggcttttcaaaccaaccagcacttctcgtaataggatgcaattacaaagagccggctgaagcttttttgtttttttcttttaaattctctatcgcaatttcaact

SEQ ID NO: 4267 - DNA, 1295 bp, Glycine max
  Soy_ogl_1133 Gm04:327953..329247 Cluster 18
gaggggagaaaagaagagagagaaaaagtcaaaacttctctttatttatttggctgagtagaaaaattggaaataaataaaatataatcactttaattaaatgaactttaaacttagatcttgtttacgtgcaacttaatcctcaacctttaaaacaatgtagcacgtttgttttatgaaatcctattggatttttataaatattagtcttaacaatattagatgggaatgatatttttgtgcatttcaaaaaaatgtgttgttaattattgagaattttttatattattgagaatgtttaaatatatgtttggttaatattttttttaggaatatatgttatgttaacaaaatattatttttattaaagacattattatattttatatcaactatcaattataccataatttgatgttacatgactcgcgcatcatttaaacatgcacatatgaaattaaattcaaacttaaaacacaattaaatatgctttgcttgttgtataattttcactggataggaaacaaaccaagaagaattatagaaaaaatgtaaaataaaattataatttacacattaacaaggaatatacacgataatgagaataataaaattgatagtaagtagaaaagtaattgatagtgaatattaatagtacttttacctaataaatacataaatctacattttctcctctttccatgccaatcaaatcaatataaaaatgtcgtctttctaaaataaaacatgatcaaatttttttattattatcttctaataaatttggaaaaacatatttttatttttatatttctagatatttaataagattccgttaaagaaactttctccctatcttatttcttactgttttaaaagttagcagaatgagttccctattaagtttttaattaaatattgatgaaatgcatagtctttttcatttaaataaaatcttagattggattggggcatttgatagattggatcatctttaggcaataaaaaaagggttgatgaatctacaccatatattgtaatgagtgattttgtttcatcgtttgttgagctttgagatgcccacgctcatcacggcggagcattcaattacggctcctgagaccttcaatgctgacgtcatctgtgctggaacaacaattcttataaatcatggacgcctttgacaatcattcatggcggggactaccttccaaattataaatgttttgggttttatctcttaaaagttacactttattgaatttctctaatttgataaatatattatttaaatt

SEQ ID NO: 4268 - DNA, 2473 bp, Glycine max
  Soy_ogl_1137 Gm04:508660..511132 Cluster 18
gttaatattttaaaaaatactaacattttaaaaactgttagaaattactaaaaaaacttgtttattaaataatcaaataagtttttaaactattaaaaaaagtaaaaaaatgaactaaaatatattaataaatataatcaaacaaacttttcagtttaaaaaaattcaaaaataatataaatgtcttgtcaaatatagttccaattacaaaatatgtttcaaatgtatttttcaaaagaagaagagagattatgttgaaaatctgatgagggagagaattataaaggtgagagtttccttcttaaaattaaatattctaatctataatataaaagttaattaaaataataaactgtaaattaactttggaatgtctaattcagattttaaacactaagtttatgcattcaaagtgtctcagcatcacatgtaattcgaaccacattccaattctatgttaatatgatgtgtgcttgatttggaaataaaacagatacattttaccaacatcacatccaatatggataaccaactgatagttacttcaagaagacaagagtcaagatcctaggacgcacatccaaacacagataggacagacgcaaattaaagctacagatgatcagagtagcatttatatattttaacgtgtttgtgtatttatgactattccaaagacacactaatcttgggtttgcaggtggtatacccctccttcacctccattgtgtcaaccacacatggggtaatgctattcaaaaaataatctgaagttattatagtatatataagttttttttgttggtataacaattgacaaatttatctaaatcaaacactactataaataacaaaattcatttttcaaatatttaacgtgattatatattcatgattttaaactcaaactacttattaaattaaaatgcaactatttgaaatgtgcttggataacataatttttcggttgggtatcattcgattcagaagttaaataagataacatacaagttaatgcaagagaaagtgcaatattgctatgtttcaaagttacaaataatttttaaaaagtaaatttatatgttgtctcacatattaatttacgtgcttttcagagagaaaacgagagtgagggggtttcaaactatgagggagaatggtagcgcactatacaaatcatcattcgcattaattaaaggcaaatcagcaagttgcatgaaaacaaactttgaaaggaactcgccttccttttgcagagaaggaccagctgaggaacaaaggctgcctctggttagatggtcctatcttcattattaatgcttctttctttttgtttcagccacaaagagattctgccattcacaactattctataactgtctcactaactcccttagccccaaaagaatatcttctgctctccaagatccaaatttgttaattttccttaattcagaaagaaaaaaaaaatcatccatgatttctccctcattccttttctttcttgcccatgattctctccaacatcttgtgctcgctctcaagaacacatgattaagcacgtatgacggtttggtttagaaaatcatgtttcatgatgtattttccctatgtagcagcagatgatcagtgcttttgtcaaagttaaaatctaaatacgtaaaatgtattgcgcttgaaacacaattcttttgctagggaaattgtacagtgatatgaaagtggatgccttcatgaataaagttatacctagcgtgcgttgcctccgtgaaggatatatacttgtgatctccgtaaacaaaaaaaaaaaaaaaaaaagtggcttcatggatactttgacaaaaactctttcataagaaaagaaaaaatcttcccaatttttgtaccaaaaaactgcccctcttctggaattatccacccatttctacctcctatatgagattctggactttccaaacaggaggaattttgaaagaaattctgatgagttataatatttctgtaactctttttccaatattttctcttattagttgaaaaatccatgtgagtcttactagtttggaaatgaaacatgtgtatttagtagaatttatataaatttcatccaataaaaagagtgtttcaaaaagaaagttttagcatttctccctttagtatttccaaattaatgtaaaaatactttcggatattattaattttcttggatctattgcgaaaaatatttgtgatctacatctacatcgaataggaatttctctattggaattttgtcccaaagtgccccacccatgttctcgcctatttcctggaaagagcgcatcttggtctattatatctgtaaccatccatactatcctttacgttgagaatcagactcttaatgctatttatgattctatatccatcgtgttgctgtcatacttgtacccggaacttgtaataacctaatgtagatttagtatgatttctg

SEQ ID NO: 4269 - DNA, 1900 bp, Glycine max
  Soy_ogl_1143 Gm04:654901..656800 Cluster 18
tcgaggtggaatttgtctatttaaacgacttgtagctaacagagttggatcaccttatgcccattttttatttatttaaaataataattaactacataacttgtattcaaatgtcaatatttttttatttgttaacagtacaatctcgtgataaattattgttgaaattattaatttgcttatctactaatctttccattaaatcgtaatgggtcatgtgttaggttatcccacaaagaaattcacatgtgatatttagaaatatatttaatcaagtttacttcttcactaccccttcccccttggaacaatgacattaagtaggaacttgtctttcaatttagactgtttgtaatcgcattacaagtgcttgttagaaaacgtttcgtaccatttctcatcaggcctaatacttatttgggggaatataatgtttccttaaagcaatcattttcttttcaaaatctttttcatccgatagataaaaataaatgattatttaaaataaaaaaatcaactaacaaacatgtatctagtaagtgtaaaggataaatgtaataagcttttgattgatagatgtgataagttataggaggaaagaaaataaagtaaaaaaagagatgaaaataaataaatgcatgtttataagtattgctaataaaaataagatttggaaaatatctacccagtctgtatgcctgtgatgagattttgttaatgtacgtaggtattagtaaggtcaggtttaaataaaggtaaaataaattaagttttattttacgaattaaaatcaacttttatatatttcagtttttggaaaagttatacaagtgcacaacgtagtaatcctccctgttttagtctgcaaagttgattgcagcagggctccaagttaatttgataatcttcaaaagcatcacgataccagataagtgagcctcaaccattgattatcgtggtgctttgaagtccctcttaactgagccattgaagttcgtgattctattttcaagttaagaggagacaagactcgcgtggagaagaatgccatttactgccagaaaacataattgcttatgaagtgtttgattttctataatgttttgtccaacgccaaaaaaaaaaaaaaaactttcacaattttctcttataatgcgtataatataattaatgacttccaactggtaaactaacgcaaccttaggtgttcattttctagattataggaattaggaaacccattacatatacgtccagaagaaatattaattaatattatagtattcctgagtccttgcgaacaaagggaatgtaacattgtcactctctattctccaacaatagccagatgcatttcagcctcgctttcaagaccatgtatgtcgtgcaacattaagttattttatgtctcctaccatcaacaatattttgttcttgctcaaattaatcaagaaattttatgcaaattgttatgttgagtttgtgactaacattagataatacttcttgggaacatgagttacaaacctcatgaccaaatgttcaggggatgggcacaattaaagtgttctttcggcgtggcccagcaaagggcatgctttggtctaactctaacaagctttgcttcaatccacagaaaggtcaagcttgcttaacttaacatccattgattgattcattgtaagtcctcacatcacatgcgctgacatcggaaaagggcaatctcattccctcgatctccgtgcctcccgtaaacttaaattttaaagaaaagaaaaatagaagacacttacaacctttttttctcacagaacgaaaatggacaaaaaatctttgccaaatttaaatggatgtaatgttgtctcgtactcgatcatcattcccaacttatattatttag

SEQ ID NO: 4270 - DNA, 2200 bp, Glycine max
  Soy_ogl_1523 Gm05:1613501..1615700 Cluster 18
caccctaaagtaatcaattctaaataggcattcttattgttttagggcatgcttggtttatggcagaatttcggtcaactacattgattttagttagattaagattgacttgaatttagggtgtttaattattgaaataaaattatttttagttgagaaaaatcaagttgaaatcaaagtaatagggtatgtgttgctgttactttatttaatttgggaacttttaactgttatattttctcttgatactacttatcaaaatatgctttgtttgtacactgcttgccaattgtctgcagttacattctatattattcattgaaatgatattcactgcttgagtaagacgataagaggttttattactcactgaaatttactgcaccacttggctaagagattgtcttattactcactaaataatatgcactgctgactaggagattgttttattactcaccaaaataacatgcaccgcttgtttatgaggctattttatgactcatcaaactggcacatatatagcgcctgattagaaggttgttttattattcaccacaatggcatgcaccgcatatctaaatgtttattttatcactcactcacatggcatgcaccgcttgactagaaggttactttatttctcaccaaaatgacttgcaccaccacttgactaggaaactgttgttttgttactaatcaagataacgtgtgtgttgtttgtcgatctagaaggttactttgttactcaccgaaataacgtgcatgctttctctaagagattgttttgttacttatccacatgacatcgcttgactagaaagttattttatttctcataaaaataactagcttgcaccacataattatgaagttgttttgttaatgaccgaaatagcatgcacctcttagctcttgaaaaggaaattactttgttatagtcaccaaatatatatgaaatatgacttagatacactttcatggatatatccaaccgtgtctaattaaactcagtaagctttgtcggaagttaagtaatttaactttattttacaaagaatgtcatctatacacttaggtctgagtccaccgataaagatatgtccaatccgaactagactcaataataaacactttcaataacctaaattaagaaaaaattagcaaaagaaaccatgtcatccactttaacttggtcttgcttgaaaatggttgcaaattccgagcaagtccattggcgttagtgaaaaacccaaccaaatttttggcggtggcgccaccgttgacggcggaggtacgcttaggcgccaccttgctggtcctcttaccatcgctgtgactctccgaggcagaagatctcgaatcttccagcgcttggacatggggcttgcctcttgcatggtggggtccacacgcagtaggttccctcagccacgccttctagctcgtggctgtcgtttgccgtctctcgcgcctcttcgaacatcagcgtcctcatggttaaacgtggacgacgagccgtttcgacgggaacggacgtaacggaagcgtgaacgacggggtaaatggtctgatctggccgttgtagaaaatgtcgccggcggacacaggggaggaggagtcgggcgaaggcatcgccaacgtcgacctcgtcgttttgttggtggatgactctggcggcgatataaggactcggaagagtggtagctgaaacttcttggagaagatggtgctgaatggagactgccaacaatttcagcttcagccagaagaaaaacacaagaaaatgtgtagagaagctctggtatggtatggcatatatagttttgtttggttatgtttgtttagaattaattttatgataattaatttgttttgatcaatacaacaaaaaatcagtttttacgaaacgaaatatgaaaacaactgttaaaaaacaattataagctattgttttattactcacccacatgacatgatatacatggcttgacttggaagttcttttatttctcattaaaatgacttgcaatgccttgatttattactcaccaaaataacttatgtctgtttgattaggatgttgttttattctcattgaaataacatgcattacttgcttagagattattttttattttttactcacttaactgccatgcacagcttaatttaaaggatatttattattcattgacat

SEQ ID NO: 4271 - DNA, 1200 bp, Glycine max
  Soy_ogl_1524 Gm05:1627401..1628600 Cluster 18
tctattccaacattaaactcaacgtgtaaaaatttatctaaaatcaatttaaaaagaagctccaccgttgatcattgacttgaagtgagttttgtaaaaaaaaaattatttaaaaatttcttttataaaaagactgtcgtcataaaagtatataaaacaaagtgactgggtacacttttagaaaaatgtctacagtttaataaatataccatctcaaaatattacaaacagaggctaattttttagggaatttgagtgacttttcttcacacaatgaactagctttgggcttcatttggaagagacgaaagaaattttgcaaaacaggaaacacgcttaatttacttttttgaagtaatggaacaatgaaaaaagaaaaaggggattgtagggtccgaacttatttctatattgaataaagtggaagaggagagaactttattgcaatgataaaaatatcaaatttttaattttattatattataagagtttaaatattattcaacacaatctttaattttttttttatacaacctaacaagcacttaatgcattaattgggagacacaaacgttatcttgatagagctgaacattgatgtattatttgaatggttataaaaaggcaaaggacaagtgtggtgtagaagtgaaaatgtagataaaattgaggaccaagatagtgttattgaatacatgggtgaaaactctcctgtctaatgcatgcaacatgaacttcaaaagaaactcttcccaccagtcaaggtcctataaatatacttcaaattctattttagaaatctcttttcctattaaacctttggacactattagaaattacctatgagttaaatatgacgtctagaaatattctttaacctttttatatttgtaactctgtaaatagccttagaaaataagtgcagaatccgagtactagtctagtaaagaagtttttatgtttaccttgctccctcaacaatcaaatatatatggatggctccttcttccatttcaaagcttgctttctaatttatacttgagacaatttttacttgtataggggtgaaacttccttttaatactttcaaagttgatttactcaactttataaacatttctcccagtcaattacacccaaacagttggagttttccataagcatattgcaagtgttatgtaagcatctaaattaaatatg

SEQ ID NO: 4272 - DNA, 1781 bp, Glycine max
  Soy_ogl_1680 Gm05:323720..325500 Cluster 18
taatatattaacgttacgttaaactcttaagtttattatgtaagataaatttattaatttttaaaataattattttaaaataatttaaataataatttataacgttaaactcctaaaagataaattgagtaacaagatgttatttagcacggaatagagaaacatgaaattcacggaatcaaaatataatgccaggggatagtctcaccattggagggaataattgaaaaaaaattctaatatcaacggaacatgcctatttgtacacttttttgcacacgtaaatttcacccgttacatcattattcatcatgtgtagtatttaatatttagtccgatttattttaggcttttcttaaaaaaaaaaagaaattgagttaaacaaaaaaaagcttttctagaaaatagctttatgagtttttacttctattcaagtttcaagatttaatgataatataatatgctaaagaaactttatgttaaaagtaacctttgagtttaagaaattatggagtaattaaataattataatttttatctttaatttaaatttaaaataagttttaagctctaaaaaggttagacctaacaatatttggtttcttttagttttactttctattcccacaccttcgaattccttctaagtacatttaattttgacaacaaaagaagaagaaaaaacaattttgtgatttttgataattatacgtttctttcttcagttgaagggatccaatcctcgaattatgtttcaaagtggtccaaaaagcacaaaaaataatggttgttatgataagttgtttctatcattcttaatgcaatgatcaaagccactcttgaccgcagtattccaagctgttttcatcaacctctcttgagaaaggaaaattgcaagtactacacgcaagttcatgcttcgttgcttggggcaattccattacatgaatattcttcatagtggaggcacacagagtgcacacattttaaaaaataattaattggaggttttgtgagacacttttgttttgagacatggtggtactcgagcttatcttgtttgatatgatgcgattgaattgctaacgatgacaataacactatatgattctcaatccatccaccatatattttcagcccaagaagtagcacaagttagtgtcttgagtcctcattgttttctccatttggttgttgtgtaagattttttatttttacagtgaattgtcactgatattgccccttattgacttgacgtattaagacttagacttaatggactgagtattgtgtcgttaggtttctagttaatagaccgtgacaagagagtttgttaagacttagaactaggtgcctgtatatataagttacggttttatttattcattgaaaaacgcaccacaactagaggaacataggacaaggcttaataaaagatttgtcaggtcattaaaacggtttttttttccctcatgtaataatgataaaaatgtcgtgttattttattgtaactcctattttcataaactaattttatgggtaaaaaattgagcctttatgattaatttgatggctaaattatactaatccctttgtatctttaatttttcaattttcctattcattaaacccttttgcattttttaaaataataataatttatcggcccttgaaatttcgacaatgtaattaatttacatacactaacagtccggttcaattcaaaaaacaagagagaaataaaattcccagccaatcaacaatttcaaacaatcaattga

SEQ ID NO: 4273 - DNA, 1584 bp, Glycine max
  Soy_ogl_1779 Gm06:3181917..3183500 Cluster 18
tctcatatgctaaaaaatgtaaaagacactcaccaacataatgattcgtttattagaaactttggttgaacttcttcacaataatgattattttggtctctactcaaattaagtacaaactgattaccgaataattcaatatactagtatataatcagattaccttcaaacatctcattttttttaaaaaaattatatcaaaataattgaatgtcaatttgggtacccaggaaatggcatttatatgagtttaattttgatatattattagtgtaaaatacttttatacatcatttaataaaaaaacacttttttattcacattatattaataagtaagttaacgtgattaattttaattaaatgcctgtatgaaaagttttatattaaccgtgtatataattaaatttttttctattaatggctttagtagtttcataaatcagaaagcaagctcaccatgtgtggaccttcaacttaaagcatagtctaggatcattaagagatcgataaccctgccagtgcccctccgtgcaacaactttgatctgtttttcaaactctctttaatgttccaccggttaccggctttttattacagtcaggagaatgaataactccgactttaacagaacgaggacaaatgttattcatatagacagatggatactacgatttgcgcactgagcttcttgttaatttaatttgtaacagaaaattcaatcgaatatgtggtctcagacggaggatggggatgacgtacgtggagtcattcaattaggaaaatgttttatgtatatccaaataaaataacaaaagagttgtttttttttttaatttatattttaagatatattttttagtcatgtacatataaaaatggtaaaaaggtataataattatacacatataactttagtttttatgtttaaataatgaatcttatttaattatattaagggcactgtctcatgaatgagcgacatgagaattcaagactgaagttcagaaattcattgacagagtagataacttggttgattttctattactgatccaaaacaacaaaacacgaaaagacggtgaaagtagactcgtgtttgttgagggagaatccacttacatcttccatgttttatcatatactcatatattgtgtaagtgtcaataaaaagtatacatcaatatatttttataggaccaagatatttttttatgacaataaaaatcaagtctaacattgatataatttggagaaaacaactgaatcataaatcagacagtcaacatcaactgaaatataaaatttaaacatcccgttttctatactgctagtgctacacatgggaaatccattattcctgaagataagccagacactcaacgtcaaaattttaaaatattaataataatcagaagagttatagcgtacgtacgttcctaaataatttctccgcctcataagtcataaaaattagctaatacagttgtccaatgaaaatgatatatttttccacttgtcaataccatgtgagtataaacaaaattttcaagaactgtgaataaaatgtacttaaaattattat

SEQ ID NO: 4274 - DNA, 1442 bp, Glycine max
  Soy_ogl_1864 Gm06:8714359..8715800 Cluster 18
atacactaaaattaacttgggcacatgtgaatcttctattcacttaattttaaaataagcatacctcaatctttgttgaagaaatagaaaagggtgtgttaaaaatctataatttaattcatttttttccacttaattcctatacatagaaaaatgagactcgatatttttaaggtaatttaaaatcattatcttttctattaactataagcaatatagtattttataaattatattcaaaagaaactgttttattgcactcatatagcaactccaatgatatctcttttctttggtttttaattgatttttggaggattttattatgtcacataagaacttattattattaaataatatgtattgttgttatttctataaggataatttagtgttggttttatatttcttttcatttttttttttgcactctcttctttttcttcttccactttgtttatatttgcattgttcagcaaattcaattcaagttacaactttcatcacctatagtgtagttcttgtagtttgtattccaccatacaacagtttttcgatttggaattgcaattgatttgaaattacttaaaaactcataataaaaaatcttagatattgtctcatttttatattttatgctaaaaaatgttttaatactattaaaaaataattttgtttaaaaatcattcttacatcattatttctaattggatctgaatccgttctcttcataccgataaaatctgttgttggaaattgtctagtgagagcattcctcttgcaagaaaattataataaggaacttgcattgtgcacataaaaatattaattgctaactccttgtaatggtcaacaaaacattgataacgtaacaataacataatacaattacagggtatattattaaagccaggtggtggcggtcactgttctattggccgtttgtctagtttggactttggttagtttgatgcatcccgcgaatgccaaactctaaaaaatttgtgcaaaccctttaggttttgtttggtaaaataaaagcaaaaagaaagaaaaaaaggaatatagtagaaaaaagtgaaagagctatcatttaccctttttcttattcctttttaatcatcccaaaaagggagggatgagaaattataagattcatatattatttatttttctcttttggctgaataaagaaaaatattatttatttttcaaaattttactctctccctttatatcaaacaaaagactaatttttcattctccttgctttccttatcactcaatttctataccaagcgcaatattgaattaaaggtctgtaatatatacggaactatggttagaaatacgtaaatgtaagagttgtgatattttgacacttcttgcattcatttcacacttttttttaatcatatgtcgtgtcatgactttgaaataga

SEQ ID NO: 4275 - DNA, 1304 bp, Glycine max
  Soy_ogl_1877 Gm06:9005201..9006504 Cluster 18
gggcgtggcagctaagagtacggtctttgacatgctatttatttcatattaatgatgcgcacatgctcttgccacgcacaatttgatttagaattttgtgctcaaatattctgagaagaggaggctctggttgttggatgtttgaaggaaacttcatttgcaaatgggttttatccattggattagctggaccttctcgaatttggtttacttattgctaccaaccaattatatgtgtgaacatgatcatgatatacgtcttaatttaccaatacttaaattccgaaatttggaacgtggagtaatagatagaaatgaacgtaagactccgaaagactgttcagaactatctattaaaatggtcaggttaaaaaaaataaagcttttgatttaattaaaagaaaagaaaataagccttgagttacctcaaaattttgtttggtcatgccagcatgtggatcagcctattcaaaaattctgttacgcatggtcaattagcttgtttaatacataatagttatttattattattattagtcataaaataattaataatatttatgttgataatatattttgtagtctttttatattgattagaagcttatgtgaacttataaaatgaagaataaattaaaccattaatttcatctctaaagcactattatttcccttaaatagtgcttaagagttgtctgaattgatgataaagaatagagtgaagtgaatcagaacataatgaagcataatggattaaaatgaaatagattaaaaatatttgtttgaatattttataatggaatgaaatagaaattcattatattgtatgaaaaaatgatagaacgaaataacttataactttatactttctatattagcaccactttaagatcatttttaaagggttgtgtttttttagaatgttaaaatatagatttttttattttaaaatttttacttcatccccgcacccccaaatcgatggacatttaataatttagagagactgcttatatattttattattttttggtaatgtggggatacatatattttatgactttgaaaaatttttaggagaaaagataatatttaagagtccaaattgatagtttatgctaaaaataactgattactgttataaagtctttaatttggttcaatgagcacaacttatcaagattaattctatttgaatacctcaatttttggtattatatataagaggccgagggaatggaatgttaggaaggagaaaaaaagaaggaaaagagaaagtaaaaggtataatgaattaatatttc

SEQ ID NO: 4276 - DNA, 2104 bp, Glycine max
  Soy_ogl_2129 Gm07:2356701..2358804 Cluster 18
atataaaagtatattaatggaatgtacataagaattatcaaccaattttctacctactaaaaaatgcaggacacagaacatccataagttaatttacaaaataaatggcaggaacattgataatttgggtcaaaagtggtagcctgaattatattgtttagttatcaaactgcaaaagcaaatagtttttttgaaggcaaacacatgaaacagaaaaaaatggtttgtggaattaaaatcaagagtgaaattgtcagatctgaagagtcctcccttgagatagaaaaaacaaaatcatgttacataatcacctttactatgagctgccatattgataacggaagttaaaataacaataatatgacacatacacaatccagatcagagtatggaaaaagcatagctattaatatatatgacaagtatgaagagtagaaacacattaatttagacaaacattaattttaataacatttaatatttaaaataattttatcaagaccaatcacacccaattttaaaataaacaagctactgtgccaaaaaatgataccaaaaaaaaaaaataagcaggctaatatctgataggtcagggtagttattgggctttggtccctttgtttgaaaacaaaatctaataaaacttcctaaaaaccaataatatatcagaggataagaaaaaatgtcattgcaaaacatgtacttttgaataattttcacttttgtgtaaattatatatctaatgacaactatatacatattttaaataacaagttttaaacttgaaatataaggagagcgcttaagaaaagaagttatcatgtatagtagattcatagacatacatattcattttctacaaaagaatcggttatttgtgttgtatgacaatgactgtcaaacagatgatataaattcctttgttgtaattattattatcgacgtaggcacgtaatacaactatgaggtattggccctgcagagacactttcttatgcaaaccaagagaaacagcatgtcacccacgtgcttgacgccactccatttcgtcttcttttatgacgcatgtgaggttcagaatttttctgtcttcatatttatagcttgtaattgccttcattctgttcagagaatggaaatggtagttagtggttgacatcatttgtgatttactcatgaaacttaattgtcttttcatgtatcatgtattgaatgttttataatctgtaccatttgtatttgtatgtttgggagagtagtttagaaagaaaaagtcttcacagtgagatgtttaagaaaagagattttaagatatttgttaattaatccaaaaatatactcagatccgtttgtttacaaagatagatagtaaaaaaagaaaaggattgaataataaaatgacgtgagactcatttttatattttactttaaatcaaaaattttatctttctatttttttttctctgccaaatcgaccctggaagtggagtgcaactaattttcactccgatcttcacctcataaatttcgtccactcctattgtgagtagaatgtgtttaatgtttaaagccaaaaacgatcatgtgtgagtagaatatgttgctgtattctttttttgattttttttttctatttttaacttttgaggttatttttgcaatactacaagaaaggtggccaatttctgaaatttgaatcctaatcttggtccaaccatataatatatatatatagatgatatttttattatttcctcactagcattgctttgcttctttgtgaaatttactctgaagtgctgctatataatttttggtaaaaggcagcattgtattttgttcattgtaactcttatattattcaaaggttgttttgctgcccttttcgttttgactcatgaatattttgtcttccaattccaaactatactgctacatatgtattattatttgcaatttatcaaaaggataaccaacttatcctttgattttttttgccttgtatgatggtcatgtttaccgtctttccttgagagggtcatagacttagcgttctttgttgaagagataggttcgtctcttggctaggtagttttgttgcgta

SEQ ID NO: 4277 - DNA, 1931 bp, Glycine max
  Soy_ogl_2132 Gm07:2402201..2404131 Cluster 18
tcctcctctatgaccaataaactgcagaataatttgttcgtaacatgccccaagaaaggtaagaaataaaaaattacaagtagaaaaggcaagaaccttagccgtatactacttcacatgtccaccgttatatatataattgaattcccgtttcaacagtcttattacttttgtataatttggaataaagaaagctacacatctagctaggttaatagaccaaccatatacgtacacacaaaataatgcaatcaaattaaagagaagatcaaagtggtgtgagaatctgcagaagcagaactgtaaagggagctattcaaattcctgttcatatatcactattaacaaatgaaatatttgtccacttgtcggcaagcgcgtatacagagtgaaccaccccatcgttaattattaattcaaggatcgatattcatatcatgcatgcatatatagtcatatatatcccattttgcctttgaccagcttaaacatgtgcgtagtataaaacgataaaaaaaatcatgtatcaatattaatgtatgcttatatatttattattcctatattcaactaattctatgtacatttaagaagaagtattataattaatcatttttcttataaatatatataacatttactattggttggtattactaaattaatacatttgtaatttttaatgtaatgatatcgtacggtagaattagagaaaagcaaaaacgtgcatcaaaatataacttcgacttttttatatgattataatagtattaattaaggatgtatatataaacttgaagattttttttttatattttcccttttagtatactgcttttgaccaacgttttacctaggaaattgacatgatatatttgaacaaatattagaaaaaaataaaattatgaaaatgtagttaattaaatttactattttattgtatgataatgcttcattaaagtaaattcagatgatatgtgtccctgctaatctaatcccgcactcagatgcaaaatacgcaagaagaaaaacgctgctaatcaacaacgatatttatcttcttttttttctattacaaggaagataaccacttttaggccagaggacggaaccatttgttaggaccatattaactcctcttttctgaaagttaagttttaaattcaagaaccatattcttacgaggaccatattttgctgtaggtttgtaataaagacacttatacatgctaaagcaaagatagaagacaaaaagtgcatgagatcattggatgcgaagtatatgaatacatattcatgcactaaatgttctgatgtacgacatagctcaaaaacttatgtcattctcagtgggttaaggtgtagttggttgtcaagtttacctcttatgatactataaggaattctcgatcggtgggttacatagatagtaagcagggttagctgagaattagtgtatatttgttttattgttacaaataaacttttaggataaaatgaagtttacaaaagtattcagattttttttttgttgtaaaattgagtttgtggaccattagatttttcttagaattcatacaccacatttttaacagaaatccaaatcttagttagaagagttaacttgattttgacagtttgcctactaattgagcaatatatctagtctattttttatatggtgtggcaattaattagtcgatgataatgcacaagctaattggaccgaacacgtacactccttattatttagttaaaagttgaaataatatatgtagcgtgtttatcatatcatctatatatttgaaataatatacatctcttaagaaaattattaattagataaattactataataaaataatttaatttgaaaaaattatccttattaaagatttaaaatgtttttaataactttctcatttattatt

SEQ ID NO: 4278 - DNA, 1300 bp, Glycine max
  Soy_ogl_2206 Gm07:5190001..5191300 Cluster 18
gagaggtacgagtttggcatgcacactaacaaatttgtgaacaagagggtggtcggcattcataaattaaccccaacctgtgtttaataaaatttatttgtactacgtgaataattgcctacattttttattttctcaaaagtaatacaaaaatttattaatattttagaataaactgaacgggccgtatacatatattgagctcgataaaatgtttctcgaataagcatgataaaatttaggtcaattttgaggaaaagtgaaaaaaaagacgtacttatttatgcctaaagtcacatttagttttgttagaatcatactaagtcagtttttctattaaaaaaattatccaatataccaataacgtatcggcgggagtggaatacgtttaacgaaataaaatagacatcaaaattgaatttaagttatcctagtgtttgtgtaagagattataaaagaaagagattttattttctatagaaaactcgtttatatgagtgcgaaattgggctccacaaatttgaccaaaagttgaaactgaaaacacacgatcatacgtacacacggatcatgaataattgaatattgaatgctcccccacttagcccacgagaaaggttaacattggtcacttgacatactccaaaagttgtcaagtacactttagcatcatctccaagtcagcttcgtagctacttcaactaaaaggctaagctgaatgatgcacattggcttgatgcttcatgcttaaaattatggatcttgttacgaaatgttattaattaattaggatattgattaagaagttaaaaaataaaatatttattgtgtaaattatgagggtaaaatagatcataaacaatataatttttttatctttcaataaaaatatttttattttaaatttcttaattaatgtccttagaacattaattagtatttaccaataaatattatgataaattatattaactatcatgaaattttctaaaattatttaatttttttactcctatattaactctcaggagtgattagtgtaatctattatagagattattggttgctaggcatatcacgtattacatttataatttttttatatatatttcttctttcgcccattcttatatgcaattttagaagtgtcatttcaagttagcatgattcgttcgggttaacttataacatgtcaacttatttcgattaactcaagttaagttgatttattacatgtttggttggtgcattaaactatcgctaaaaatgcttattcaattcctttgtcaattatatttga

SEQ ID NO: 4279 - DNA, 1700 bp, Glycine max
  Soy_ogl_2446 Gm08:1033001..1034700 Cluster 18
aatgataaaggagacattaatgggacaatggcaaccaaataaatgaagaaacctaacaaggaacaggaaaagtacgtagaggaatttctctttcttttggaagagaatatatttgaataaagaaatatgcatgtgggggccctaatgaaaagcatgcacatggggggattcttcatgccaggtgaaaggaagcctcaggtttgcttcctccaacatggatgtggatggaactttgacaaaagctaaaacaaaaaaaccatctcagattataaaagttctagcaatacatgacccaacaacctgtcttcatgctacatcttcaatacttgatagctaatcaactagctgacttcaaatacaatatttaaaaaatacatgtacagcattatatatatatatatatattcattttctcccttttttttaacaaattaattgttgtgtttgagaattgagtttattttatttggtcatgttcctgagcttaactgggttttgaaggtgccttattgtgtaatctggttcaagatcattaggttccttcttcctttagatatactccaacaacctttttaagaggttcttgctttgaagcactgttgacgagggccctttaacttaaacaatatctccatttgtcttttgttaccccttatcattataaagaatagacttcgatataccattaatacaaaaaagtcaaataaaaaaattcatgtatattaagtttggtatttaattatggacattccttttctatatttatatacctaagacgtaaaaaatagaaagactaactgcctatttgatttcacgtttgagtaaaatcgaataaaaatgattatggaaatagtgggagacaaattgtattgggaatatgcattttccagtgaaaaatatgatatttataatgataaaacaaacgggacttaaagtaagcagatatgatcataaacatgaagacattgaagaaaataataagataaattcacccgcaaatgcaggacaatatcatgcatgaatggcttattaattaataaaaaaaagaaatgtgggtaggagcgggagttgttatacatcaagaccaaaaagataattgacgcatgacattattagctttaataatggttttggatggagaacaactgtgaaatgtagaatttttgaagcattttctttcttcttctttttttcctgtcttaacctgttcatcagcaaaaagaaatagatcatatttatccggaatttgactgaaaagtaagtgaaaattgattaaaaattaaactcaaatagtaatattttctttctttttcgaaaagcaaatagtagcttaggtagtatatatcacctaactaaatattaaccatacaatttaaatcattaatttttagttagtaatagtattctttataaaaaaaatatttattcaaaataacttttcgcatgcaggacaattgttgttattacgttgacattgactaattaaggaaaaagagatagtttttgttaaagaaattgataatttttataacatttaacatggcttttttaagtattatttttgtaataatatgtggggaggggactataagtgatttaaaagttatcatctacttcttcctatattcaataacagccaatttttttttttaaaaaaaactattctttcttatttttttatagaaaatgacatatattat

SEQ ID NO: 4280 - DNA, 1680 bp, Glycine max
  Soy_ogl_2509 Gm08:4967801..4969480 Cluster 18
cctgagattattgttttaatttataatcatatttttcttttcattaatttgtaatagtatgatcagtataatattctatcggcaatagcaatgtccacgtagtcaaagagaagttcacttgctcttggttcaaatttcaagggaaacgaatcttgaccgaaaaaaggttcacttgctctttcttcaattgcttcaaagtcaaaggaacaactctctttctgtgctaatttatcaaaataaaattacctttcacttaattaaatggtctataacaatctgattttagtaacagttaaaaaataatctgtttttagtaacaatcacctaaatacttgttaaatcagataagcatattgcaagaaaaaggaatttgtgcctgtcacagctaagaacagtactccccatattcttattgcggttgatccaatgggaataactcttctgatgaatacgtgagtcctatgctagtgcagctataaattgcagaagggacatttaaaaaaagtaaaagacagttaaatttgtctctctttcattggattggatcactttgtgtgatacacaattgaaattgagcacttgtttgttcacgtgggagattactttttagcaagggaattacaagcatctacatatgacagccatggaaatagtttcacggtgggggagcatcctccacccatgttacatatatatccaaacgaagactagtttgttaaggccctctatttccttaattgacgaaaggcatgctcaattattggacataaggattcaagtgataaaaagttcatccgttcaaattctattccactaattttgtgaatctttaattttcaaaatatgagttgtttatcataattggacaaacatatattttcaaaattttaattaaactcatcatttccaaatctaacctaatcagattagagttacttatatcttaacagattataattaaaaatatgcattcacttctttttttattatgtattatagatcaaagctgaggtttccgtgcaatatcagtttcgcgcaatataagttcgtaaacaacttagaaagtatctagtaacttagctttcaaatacaaaatgatcctgatgatgaataaaaagccataccatgcttcctttttctaggaccatatatatatgtgtgtatagtccaccacatagaagcaaaaggaaggagaaaagaaaagaggatttcctagtcagagtttcattcttgttgcatgtgtttccttgattttggctctatgtatatctacttaaattttttacctctagaatttgtttcttccatatataaaaactaaagtagcaaaataacattgacaactatatatgcaaagagcgccatcgacgataagtggagtattattcttcatatattgaccatacaatttgcttttaagttttaacaatatttggtatccgtgtttaatttccacctaaagatcgcaatcaacgtttttctgtttttatttgctctagctattgcggtataatttgtcaattcaagatatttgatcaattcaagccattgaacatgcttggtcagtggatatagttatggtaggatgtcaactctctcagatcaccttgatggattggtttagtttgttggttcgtatatttgtttatatacctaaagtccaaaaatactcattttaat

SEQ ID NO: 4281 - DNA, 2481 bp, Glycine max
  Soy_ogl_2584 Gm08:9859076..9861556 Cluster 18
atttaagttttttaatatatatattaaataaaaccaaactaattattagtccacccgttaaacccctgcactattgacacactacttcaactagacgagtgactaaacctggtttcatacatacatcaccctcggcattttagattacaattaacctagcggctagcgacatgctaattgctaaacacagatccattgtcaatatgaatggaagcaactcctatcaccgatgacattgagatgaggatcaacgacacagccttcatggtagtgccgtatggtaccgattgtccagcgacagaaatctaacatccgagggtagtctgtttggtaaagtggcaagctacccccaattaattttctcattgttcagagaaatctaaggaagggggaggggggatggaccccaaccccaagaaaggaaaaataatgcagaactagatgatgatgcaaactcaaagatacatcaccctcgacattttagatgatagtaatcaagctttcaatttcatttcatatgataccaatgaaaaaaaaaaaaaacctgaaaaagtaaagcactgtctcattaccggctgtcagtacaatgtgatgatagtctcttaaaaatttgctaaatcaaataaatgggatcagaaccaaaccgaataacacagccacaagtttgttgcttttaatgccaatcctacctccgattttggtgacactccccacctaacggagccttctgctgccccattcgccctcaccatttgaaaagcctccacctccgttggcatttgaagaagcaagtctgaggaagccactggagagaggtccgacaatcatagaaatgctacaatgagtagacaattaatttgtcaaattgtatatatgtgtagtgaattgtgctttttttcttcttcttattttcagaagagaattagatgagacaagaggattatatgatgggaggaagagacgaggggagtgtcttttgtgggatagtttaggaataaaaatttgaaaggggagtggattagtaaaaagaggaagtggaaatagtacttgcttctaaagatagaaaacaacttccacattatcattattcaccaaaataaaataaaaaacttttcattatcatttattatattattaaattagttggtttaatatctgacttcaaaagtgtagcaccttttgaaggagattactgaagtactctaatgtaatgtaggaaatttttttttttaaaaccatatttttgttcctattgttagatttttttatatatatatatactgaaattctatagttagaatctccaggtttaaagatttaaaagataatttcggatggttttaaaatatttttaatgtaatttttcatattccaaatactgagaaattaatagttataactttcatttatcagattcttaagtcttaaccaaattttaaacaggccaactttctctccttgtaaatgcacctatgtatcaccccaaatctaaagtcaaattacttctcaaagtctcttctcactctttttctctttctttcatgggagaagaaacaaaatcattcaatatgccaatgctgcatacagcagagggagaagaaccaaaaaaggttgcaatcgcaaccgcggtggaagaagaatcgaacaaggttgtagccaccctgaaagaaaaaattgaagaagattgcgatcgcggagggagagaaattggagaatgatacaccctgagagggaggagaagaattgaagaagaataagcgctggttaaggtgaaaacgatggatgaaggtatcttagaagtggaaccttgtgttgtgaaagagatggaggcggtgcagtcctacattgaaaaaaaaaattgagagactagaaatgctgatgaaaattaattgaggactaaaatttgttaaagaaaacttttgaagaattaaaaattgagatttaaaaatgttgagagaataaaaatttaattaattttttttattttctaaataaatattattatattttccatgattgtgttgctctttggttttaatttctgattattatatagttaatgtatattattatttgtcatcattatttttaattttttatataagttaaaatttattagaaactatgaaaaatatattagtgaagttaattaaataaaaagttgtgatttctaaaagagtctgctaggtatcatatttgtctaactccaatacctttccaattccacatgagagttgctaagaaggatgaacattgctggaagcaatgcctgaattaactgcagcctcaaactcaatacaactcttggaagcaacaaaagaagcagcattttccactacacttcccatatattcttctaccactctcggcagtttcagcttttgacattctctcaagctcttcttcaaagtatctaaactcttccatgcatggcagaaatttgccgtagggccacgtggttcctaacccatgttggaccat

SEQ ID NO: 4282 - DNA, 2100 bp, Glycine max
  Soy_ogl_2901 Gm09:358701..360800 Cluster 18
gattggttcaagacacactaagagccactcgcatttgtttcaatgtcttcctttcactactacccatgtcactgcttccactttttttcaggccaggaatattcggtaccctttgttaacttattcacaatttgtagcctataaactagtataattttcatgtacataatagaacttcattattggcagttccaacttccaagtaacatatgtatatgatccttacttcttatttaactaatagcttgttgtaatgttttgtttcgttgctccttacattacagcaagtggacctaggccaaaccctcagggatcatcttaccagtatggatgaaaaccatcattttggaaaactctgcccctattatcaatagcaagcagagataagcaccagataccccgttgaaactagctgatttattcaacatctctggagttttctctgttggaagcattcctaccatgcattaccaacactaccaaaggcaaagcccacctccaaacttctgtcatgaatttgtagagattgtgttccaaaactgggaaaactctttgcagtcgtacgtggcatattaatggctgtcctttctttgttgtagggtaagctcattaccaattaccaatataactatttaaccatgtttcagcatttatgtgtaattcaaatatatgacatttcatgttatgagattattaggtttggtagcgggcaatggacacctacaagtagagcatactacaatctgagagacgttatccctagatgcaccactcaggttaaaaaaaggaataagagaagaaaagaaaaagaaaacacgtgtctaattattagttaaattccatgtaatgccacaacaatttataattaaagtttctaatgtgggaatgtggaatgtaaggtctgagaattgggcaagggaattctatcttagagtgtatacatcttccaagtggtatcattcataacttgagattgtgattgcaaggcaattaaattaattatgcataactttattctcatatataagtggtatcatgggttaatttggtcttaggaaatttgcagtagtcgtatttactttttaaattcgtcaactacttgacaaattaatttgtgaaattgatcaaatttggagactaatttatcacaaaatcaacatgtttagagaccaaacatccaaaccatttcgagtgaaattgatggacttgagaaataagattgtatgaattcttattcttaatgaaattgaaataatctttagattgattttaattgactagaattggttacttgaatgaaattaaatctcgtgaaattatattgaatatttaatgtattttttaattaacgtctatgatttgaaagttaaaaaaaattatatagatgtaaacaagaatcaaatcgacacatgttcaaagattacctgacatgcatatatttactcaagaaatagtaataactaatgaataaacaacttgtaaactatctgctctatcctcaatgattaagatgttaagtatagattaacttagtcaaacaaatgttttatgttgagttaaatataagacatgcacaaaatttagtgtgaatataaaataatgtggttaaattaatgctgaaatagggtgaaactttttgtccttggctattgcaactacggtctataggctattgatggagaagctgaacttgttttcatctgtggttcctaagatgaacaaaattcttctacccccacccatgacttgtcgttactatatgaagagagtcataattcattatcattcttttgcagctttagttattcaataaaactgtgattgtttgtaaaagtacttttatcccaaacagtatgcaaaagtgagaaacacgtcagttgttaataagaagtccataatgaaaattcccttgcacatgcatataagatattgatgaatcaagtgattcaaaatatctgatctctatagtggggccaaaatagatgagtattattcattttgggaatatttttgtataatataatgtgcatatttttttattatataaaattacaatattaaaattgatagcacatgttgtttctctttaactaataatcc

SEQ ID NO: 4283 - DNA, 1811 bp, Glycine max
  Soy_ogl_2927 Gm09:1202001..1203811 Cluster 18
tgcgttgttgtgaagcttcatcgcacctttgtttataatgaaaaaaagaagataaatatatgaaatcagtacttgtgtattgcacggaattaatattcttaaaaaaaaatgagatcttcatatataattaattatgttattgctttataataaccatgaaaatagagccattgaatatttaatatttgtttccaatgcttgaatcttccatggtacaaactagagagtccaaagaaccctaaaaggtctttgttttttttcgtgtttataggtgcttggacacacaaacttgcaacttttacataacaatgaactaggagcatgtattatggtactagcgtgcaaataacagaggctagaagatgcccataaatgtaatgcaggatttacaaattacgataaattcaaattggaccaatgaatgtagccagtaggccgaataagaagggcataaatgtggggtacaatattttggtcaggacctgtttaggaataattatttttaaaagaatttaattattttttttttgtgccccatcaaacattctactatgtactataaactacttgtctgctcaaatgggatgcaagaaccctaatttgcttggaagtagtgggcccattatgatgaagtagctgttgactacttccatgaccatctaaaagcttgggcaggtttccaaaccatacttattagttattagtattactatgtactgtattttagttggaggtttacacatatatgtaatgtcattgccattattaataatgactagaccaatcaattcatggttcatgcctgaccacatatatcttgagaaattatcaaagcaacccatgacatgattctagtaatcgtgagggcctactgtcttaaatgtcaagttttaaactgccacttcacgtaaatatagacataataatcaataattaattgatattataaggcattttaatcgtcaataaagcacgtctatacttgcatcattttagaaatcggcaatcattttgtatgtgaataataatcttagccatgtattttccccaccattattatacataaatacataatgcatatatttatactcatgaccactttttttaaatcaccccataataataataaccactagtatattttttttgggtaaataataaccactaatatatagttatgaaagttacttcctttccacactgtttaattataccttagagaagtcgcgtggattaaaaaaaaaaaactgaactgtcaattgaagatataaaattaagtaacttaataggaaaaaaaaaacaaaaagaaaaagaaattgagaagtagacataacatgaataggtatgtagtcgtctcccaaatttaaaacatatccctgttcttgttctcattcttaacgggtatgatttttggttcttcattatcataatcagctggtattagatatagtcatgccttatccgttcttataattaaaaaaaattaaaaaaagaatgaaataataacatttgattctctataaaaaagtatcaccgtatataaaaaaggctttataaataataacaaaaaattaattaagtaatatatgttacataaaatagaaataattaagttattatacatatcagatatgagtatgagatggatatatacatatttatccttgttccatactcgattttaaaaattaaatattattcatacccgtattcatcacctatcaaagtgagaattttctttcaaactcagaacgaagtagataagaggataccatgagtatgaatttgtttctcatgcctgacgagaagat

SEQ ID NO: 4284 - DNA, 1950 bp, Glycine max
  Soy_ogl_3230 Gm09:40437332..40439281 Cluster 18
atttgacagttttcacaatacaagaggaatgcactttttggtacccttcacattaagaacaagtttgggaccgattaattttggggatttcagctgttttatgagtaaaaaaaggctgttcgcaaagtgttaacccccagaaccttttgcctttttgactgccttgggtcaaatatattatgtctttttaaaaatttacttttgcaaaatactaaggtttgcacaagaatacctgtattcttgtaggggattgaacttcaaatgaggaagatgcactgaaagacaaagatgcaaaagggctagacaatgttgtggagtttataatagtggagctactagtatcaattgtttgcgtaatcttgtccaccttcaacaaaggcaatcttcccgctgctagaagaggcaacagttcagaagatgcagtgtacctgacatcagtttgacaagcaaagaaacagtaagaacttcaattaagaactactaatatgataattaagagcttatttcatcaatatcaacattacttttatttctgttagaggagaccaagatgaaaagaaacaaatacttttatcagtcacactatattgatttgactcggaatcatcttatcctttcagtgcaaagttctgacttaaagagaaccattattaagagttggaataatgtatgttgacatatactccaacagctgttatcattttttgctaactttcggttctgaatactccaatagtacaatgctcacattaaatcttctgttctggaagtaaaacagctgcgactgccaagcactctgcttggatgaccaagccaaccagttcacccttccctacattgaccaagtgctcggcccattttcaaggacaactgttgcctggtcattaatcagcatcaatcatgcaacctttgctgtcaatgaagcagcccctatgagcacagacaacatatccgtcacatcttacagcagaccccattgagagaagtgacaagctaattataaaagagccatcaaacccctcagcatttcaccgattaatacccccatggcaacctcaatcaagtatgcaaatgcatacaacttggcagttactctgcgaaattctaagtcatacaccttaactgttactttgtcaaattctgatacgagtgtcaatgtctctacaggtatgtccctctctgtcttcagcacgcgcaccggctgcactatattgatacactagaacaaagctccagagaaaatatcaaccacgaagcactgtgccagttccttcagaacaccttccaaacttatttaacctagttatgtggaagcaattaacttttgaaaatagtcccaaatcttcattgacttaaaacatgtttaaatcctataatcaatcgggtcagtcaaacttcatgacactaaacaatttattcaaaaaacaaaaaattgattagcaatttattcaaaaatacaataatacacaaatcgcaatatattttatatttataacacgatattacattgtttaaatgtagaatgaattacattgttaaattgtaagaagaaatctatttagaataaaaatttaagaagtaaatatgaaatatcacctttgaaaataacataaatgtcacattttacaaaatatgcatgttgtattctaaatatatttagaatgcaattttaacaattaaatttatgttgaatatataaagtaatgataaaacttaattaatattcttaatcaatgtaaaattggcatttgaatatttttgagtaagaaacaaaattaattacaaaaaaacaatattaaataaatttaaagtatttttgttctttcttttttatttctcccatccataaatttcctattgttatagtttattgtagttaatataaattttcaagcaattattttcaaatatatagttattttgttttttcagatatatatgtattgtgaa

SEQ ID NO: 4285 - DNA, 1667 bp, Glycine max
  Soy_ogl_3242 Gm09:40626841..40628507 Cluster 18
ctaaaagggacaataattgccaccaaaagccatttttatgtagtgccttctcagcataacgtgacgtgaggatcccaataaagatcatgactgaagtggaagatgtaaagagagataatgcatctgctatgataaacaagagtaaaagaactagctgtgtcttttgcccatttctcaccagctttcactatctcctcatggctttcactgaatatctcacggggcttcttaccagctgcatttttgtcttccttcaactttggatgcacaattttctcaacagcctgcagcaatttcataaattgacttctaggagtaaagtaacagtggtaactggtaaccaattattatgtcatacaaaattggtgtagacaggattatagtgcatgcttagttgcgcggtgggcaaataaaatccacgtaaatttgtggaaatccggaagcaatccttgaaactttactttcaacctgaaaaattaattaatcgtgtttcctttgaaggaataaaatgcttctctctggtcagaagtaagtctaatcaggagtgagtatgagcaactactctccgaaaatgcagctctcaaggtatgttaattaaaatcttatattactacttttggaagtttttaattaaaaggagggaaaggaaggggatggtggggtcgttatttcctcttgctcgaatgtctaactaaagaaaggaggataacagaaaattgtaagttttagacagtaaagtgtacaaaagttgttttcccttatgtaatttagaataaacacacttcattatttccaaaccagagaggaaaacaattttgggatttgagggttccccgtcccctcaccattcaaacattttgtatatttggtgtcttctacaaattgttaagcactcttgagtcttgacattaccatgttctgtatgacacctaacctagcaaaggataggttcagagagataaactacacatttaaaagttgatttggagaaaagcatagataatgacactaacaaaggcggtgcagggtggtcattattagcaccaaccaaccactgcatgcggtttttaagggagataatctaacttaatagcaagagagcaagattttgtttcggatagcttgttgttcaaattgcattaaagctgaccacttttagtcttaaacatctgtttaatgttatatgatccttcattcataaattgcccttctttctactcattcaaaacaacctggattgtatgtagtgtgtggattctgtgtcgtcataccttatctgcagcttcaaagttagtgttcccattaattaagtaagcaatatggttaatgaacctgggtgttgtccattatatgatttcctgtacaaataattcatctggaaaataaagaaaacataaattttctgaattctgcttcttgacaagctttctatatatctagttgaaacgtagccttgggacgagttaaaaacttatataaatatttaaggaggataaaaaaaaaccttctttcaagcccatagacccaaaattttttttttatataaaatataatgtataaatatttttaaatgatcgaaacataacaatagagttgtaaaatatatgaatccaataaataatatagtatttaagttaattgtattcatttaataagttagtaattta

SEQ ID NO: 4286 - DNA, 1834 bp, Glycine max
  Soy_ogl_3263 Gm09:43243829..43245662 Cluster 18
atcgtttaggataaattggatattatttctgattttgatcataaataatgtgtttttaaatatatatatatttttttatcttttaccattttcaaattcttttttcttaatttattttcacatttgagatcattcaaactttgaatatggatatatcacaccgatttaaagatagctttctgtttaacataaattaaattttaagattactatatcttaattaatcttacaaatttaattgtaatcttaatatgatatatccaaattaatcacacgtattgatagatgatgacaaagtgttaaaatcccgagcatgtcatactctttttccttttccaaacctaatgccatgcaaatgtaattcctatgctcaagcactatgtgtacagggagcaaatttctgcctagtttcaagcaccgtgacgttaggtatccagaggaggcttccaactccatttttaaggtttggcattaagtcttcaatgcaacagcattagaccttcctaccttattagccttagcaattagctcttcacctaaacaatcagttcacagcttggtaatctaactaatgctcaagatttgtatcaaaagaactatagagattgaaaaatgtaaagaaacaacatatacgcacattttagtaactatcaaaaattggataaaggaaaacaacaaagtctgaaatgtgaacttaatttgaacctaattactaatgaaattatcaaactttctaaatcagcaataatatatatatatatactagctaggttaagcaaggatatcgtaactaaacccatgcatataatataaaagggaaattttaactttttcttcttacaacataaaattataaaactaaacaactaagcctaccaaaaaaatagtactaaaaaattaatatacgtaagaggttaatttatatacactactaatgtaaattttttacagacatttaataaaatttgactattttgccaggtaattaatatggtttggcaataaagtagatatctgtgtagaaatgtttttcagtaagtcagagactatatatgtatatatattaaactcataatatatatacataataatgaggtaaaggtattttgaatgttactgagtggtatttattacataaggggcaaaaggtgttgtccttgtggatgtatcgaggtatatgtgaaggtgcagttgtagtttagaggttcttgttcagttgcaatttgaggttcttcaattgtagttgtagtatgaggttcttgtttagttgcaatttgaggttctttttcaaatgcaattgtggttggaagtttttgttcaggtgtaggttgcacatgtgtctttgtgtccttagatgttgtatttccaatgaaggttaattttatgatcttaatagcaatgagagccaaaagtgtagctgagggcacaaacacaacatcaggtatggcattcataagtgcaagttgaggcactacttgtcctgctttcttatccatcatggctgctggtggtgccactattgcagtggttaacatagattcatctgctttgttcagattcacgttctcattaatgaattcagtgaacatcttttggtcttccttattagtttctttccattgttcgaacaagtcctggaaaatgaaagtttgagtagagctgaaaatcttttatagtttaatgcaaaagtttgaatgaaaaacatgataaggtataaagtgttttccccaaggaagttagagatggaagatgaaaaacctatccataaacgtgtggtgttataactttgacacaaggatatatcaatgtcatctaattttttagagctaaatga

SEQ ID NO: 4287 - DNA, 1476 bp, Glycine max
  Soy_ogl_3291 Gm10:845075..846550 Cluster 18
tcaatcccatgacacaatatccattcaccgccaccactaagtacagccccactaaaatcaatcctatgtatttgcagcctcctactatcttatttataagtgacaacactgctaaaatcaagaaattaagactaaactatatatactataaggataaaaaaaattatgtattgtttgatctaaatagaggacataggatagtatttggatagcaacgataaatatttgctgtatttcactaactacttatgatattaaaatggaaaaaacttaaatatagctctatatatataggtcaataggtatcgcttataaaccagaattaaaaattcacttcggtaattcatgaagtaaaaatttaattaaaaattatataaattactgtgatgaaattctaattttaattaataactaatacaaacgacacatggaactgtacataagttttgtcttattaaatttttatatatcattatcatcatcttaatatgaacatacaaggtcaaggtcaaggtcatagacaaaagaactaggagtttacttcggtaggagtttacttcggcatttatgtcatgagatagttttagttagatttttaattaaattaaagacccaagtcaaggacataagaagactacattcagttcatatttagacctgttaaccacttgataagggtatgttgataatacttttttcataaaaaaatatctttaatatttcaatattagcattttcctaactaatattctttacctaattaatttcatcagaatcaatgagtcgttgaccttaatggttccatcagaattaagcccaagtccaagaaagagctggttggtagtaggcatatgaatacgattaaagatatatcccaatgtaatttttgtattcatattcacaaactaatgttttcgcgcacaaatcccagactgggtaaataaaaaattacagtaccattttggtagattaaaaggagggaaatataaaaatgaacgatggtaattgagttttaatgataaaataagcataatttcatttcacaatcgtgctaaagctttaaactagaaaatcttaacatgttctttagcaatcttaatgctacgtaccttttgcattgtctagtctatttcaacacatattccctcactagagatctcattctattattttgcaacagcccagatgaaatgatgagggaaagcaaggcccgaatgggtcaaaatatggactagggtacatgttctaagggtccactagagagacatctgatatgaatgtatctagggtttttcaaaagtgaattcaaaatatagtaaagggatgcttgcacactaggcactcaaaaatgtgtatgggtattaaaaaaaaactaatgcttcacatcctggggacaaaggaaatacatttggagttgggaaggtcatgaaagcacaagctagctggcttcatttttcatttctttattatgctacc

SEQ ID NO: 4288 - DNA, 1800 bp, Glycine max
  Soy_ogl_3299 Gm10:1247301..1249100 Cluster 18
tttcatttctacttttccacttctatctcttaaaaatgtttccaattattggggaaacctctatgctcttccctcatgttaagtaccaacccctggaagaggtaaggctgataacatatttttggtacttcctttgggtgttgaattaagtggtcctacttaaaaggattttaccttttgtacaactaattaaaagctaaaacacataagattgcgaaagatgactctacagagccccacatggctggttaaatttatgttgaacttattgggaagagtttgtttgctgaatcactgatgatgaagacgaggtctaagaattgtcaaatgtcaactgctcgaaaaatgagttgaatcggcccactcgcccggcctgccatcaaccatattgaattttgacttttgttcatgtggccctttcaacacaaaatctgatagcatccacaccatgtgaaaatttggatccatacaattgggaatgattccctccattcacacattcataaattagaatcgttagataaaagatcatacgtttcatatttttaatatggtatgtttggatttctgatggaagtgttccaaaaatatgttttagattaaaattttgctagctttagaaaacttagacttgagatagttttacaaacttagtttataaatttaagtttgtactacataaatttataaattttaatccaaacatcaactacatattttaaattaaatttatcaaaataaaatttgaatcgctgaatcttcatcccctgactcttcttagtggaatgtgtgaatgcgagaattcctaacggtggaatctgatcccatattgtatactcatttctgcacaagtatggtgttattttgtatttgtagtaatttccaattaatgttctggcgagtggttagctttaattttcagtgtggtttgagagcacctttcagatattagcttgccagcttctcattttttttttgttactttttttgaaacctttattacatctgtgccactttgattgatgattggaagggaaaccaatactataatcctcatgtgtcaaagaccttagcatgttatgatagaagaatccttctctaggggacacttgtcaatttttgtagcctgatcgatctaagtcttctaattcaaccgtttattatgattcatcatggttttgaaacaaatagttttatgtacatatatttactccttcataatggtttgcgacttaatagcctgatcaagtttaatataatgtttagctgacagattttttttttatatacaattagctgacagattcagagaattaatagacacacctacacacatctaatgcataatgcttatatttaaaaagactaaatgattagctagagatatataaatcatttacaaaaataaccaacataaagttaaataaaaaagagaaactggagcataatgtgtatctgaaattcaaatttgaattttgagagtaagatgcattattggcaaagtttttgagataaacagcagagtgagcaaatcacaccctcattaagctggccttgttggccataacataaaaatcaattgaaactacacatgcatagcaatatgtatatgttagtgtattattattactgttggctcgcaaagcgaaagctacacatgggtcagcatctccacgtgaaattccatcaacaagacacgtgcttcccacagaggttccctgagcttttgcagagaagcctttggaaagataaccacattggataactcatctggcgaatacaaggcaaatcaaatactaa

SEQ ID NO: 4289 - DNA, 1711 bp, Glycine max
  Soy_ogl_3342 Gm10:3161290..3163000 Cluster 18
gttaaaaacaacacaaaggattaatgaaacccaaaaaagtcactgaccagctgattaattctcataatttgaatcaacaacaggcaactcccccagatatgcaaccaaaaacaatgccaccacctctttatgatgatcaaattatattccatccatttccagaaatgcttgacaatagaattttcaccaattaaaaaggaatggaagaaatcagacataacttatatgtatcctacactgtttccgttgttcaccatcgttcctgaaatatttttcctgaaagcgaaaagaccaataaccacaacattaatttggcatatttttgagggaaaagtaaatggtgtcctggtttgtgggtgaaggcctcgatagggtttaaaaggaggcggaggaggaaaaaggagagggaaataaggtttcatgtccaaatcccacattgaacaaaaaggaaacaaaaaaacgagtgtctcagtctcacgaaatgacttaagagagttaaattatttattctatatttttttcatcatatttatatattctttggaaaaaaaattccctggcttaaattccactctgtttattataattcattatttagtagtgatttccgggtatacattataagtggatagaagtgacagatagaaagaaaaatatgatattagatgtatgataaaacaaaaaagagataacattaaatgagataaagagaaaagtgggtatattaaaataatcattgattattatttatattttattacaagtattcacggtgactttcttcacaatatagtctgcccaagaggtggggttccactgtcaagaaattgaggagtgcaggacaatgaaaggaaataaataaatagataataaaagaaggaaaattgatagtacataccgcttacttttttgtctgtacttactatttataaatataaagcacgggaaataaaaaaaacaatataaatgttcttggttaagaaattcggtaatgaaagttttctttctctcttatttcctactaaaaaagtgatttatttataaacaaattcataattttcttcaaaatatttccaacccctgttgggcttttacccaaccaaactaccatcacacacctaattaaacagaagctaaacaactgaagaaatctacactattaatcaaaacttgaacaaattttgcacctaactaagcaatcataacacctaataatcatagcttgatcagaatacgaattcggcacccagagcacaacttttcattaatataatagcagcctgtgcgagagctcatgacaccaaaataacctaccaaagctcctcccttaactaactagaaaactaatagtactagatgaacattcaccaactttttgagagcaagtttcagtgatagattatgtgtaatcccaccatatttttggagtagcaaaccaacggcttccttatcaactttggcttgtatatatggtgagtatctccctcctcaagttttcaactaccccttcaatcttggaaagtcaagataaatggaaaatggtttcttcaaattgaagataaaagagtaaagactagctcctctctcatacaattatttgaacttaattactaaaaaaattaaaactagtgccagaacaatctatatgtaatttttaagaattccatcattaaaatttagtgatcccagaattactgaggaaaaaacaatt

SEQ ID NO: 4290 - DNA, 1357 bp, Glycine max
  Soy_ogl_3575 Gm10:46343844..46345200 Cluster 18
gaataagttcaagagtcaagacagatatttacatcactaagtaaactaatccctaccgtttcatttacatgttgagaaaaacctaatcctaatcatgttcaaatctgatatttccaaagttaggtcagactgagacaaatatcggtaggtatgaattttgttttaaaccctgccagcagccagcaaacaaaaaatttggatctggcataaacactcttgccgcgcccaagaacaatgcaggataataatggatgagttaataatggtgtctatgaagtatttgctttttagttgaaaattctcaaaccacggttttgcacaaaagctgaaatgacaatttttttgtctcgtgaatatttgagatctttcaaatgaaaaaccaattatacacattatggggttacatacgaaattcgtgatagggtattgttcaatgatttgttacgttattgaaggttgaaaatttcaattttttattttataatcattttatttttattaaattatatagtcttactagttatcattatatgaacatttcttattttgaattgcaaggaattttgtataaaacttatatgtagcctctcataaaagtctcaaagtttatctaaatagattagtttatatttgattaattttttcttgaatttttttttatttttaaattataaataccgtcttatgctatttaggacttttgacgacgtaattataaaataagattttcgttttatcagaaggcattagaattctacgaaaagtacattctctattttaaatttgattcgttcaaaacgaaaggtgtacacttttagataatactgtaaagtactttgatcttaaacatggataataacgaatgtaagtataattccaaattatttaaattaatcgatctcagattattttttttaaaaaagaataaaacttataagaggtttcttgagtatttttggtattgttctttaattagagtttagttttactacagtaacctatgttgacttttaatgtaaacctttaaaatccaagttagaatcatgggttatgtgaaaatatagagatcaaagacgaagcatggaatccatgctattcatgaaacatctctccctcaaacttacgacaacatcgaagtgtgcacttaagagggacaagagcagagtaaagacaacaaaaaaccaggtattactcttggcttgtctaccacatttgtcactcatggtgatgcacaaactatctgtatgtttggatctgcatttcggaaaaatggttccacgtctggccagaaaccactatcagtgacttctgcgtctttttgacacttaacatgaaaattccaaaatacctgagttaa

SEQ ID NO: 4291 - DNA, 1100 bp, Glycine max
  Soy_ogl_3576 Gm10:46382801..46383900 Cluster 18
tttctaatgaaagaaagttaagccttacaatttttttacaaaaagaatgccaaaaggaattattccacaatgtaatttttatcaaaaaaatcccaagaagatgaatcatatctctttaaagcaaagacaactaataatttctaagataacgagtctccccaaaaaaatgttatgagcttcacattaattataatataagttgacattttctttaaaaaaaaatgatgataactttgtttgagaagtatttagtcaaaaataggtgttacttagcatgtgtcttaggctcttagccatgttagaaaggtgtctaagtaaaagaaaatatatttttttagttgcaacacagtagatgagtatttgacatgtgtccaagacatttgataagtgtggtgtctaagaattagataaaaaaagaatcaacaaaattctcttttttgaagtacgtttataattttttatgatgaatctataaaaacagtctcatttatatatatttaaattggatttaatccatgtgttccgtaataaatagcaatggttttaagtaaataaaaacataaaaaatattatattttatggacaaaaagattaagtgagataaatttgaacatgtgaaagtggggaagcacaataaaattgtggtgatttgtcagattgctgaagaatttgagccggtcccctacagatcaaatttgaactgcatctgcatgtggtacatttgtaatcagatggcatacatatttttagaagaagaaaaaaatccggtttttttttaatgtaaaatggagtatttaaaatggtctagatctttgcaattaaaaaatttaaccatggatcaagttgatccgagaaatttagtctttcagaccaaaaaaaaaaaaaacactaagaaacactggcgtgatatgcagttcattgcttaaagtatgaattaagatatgaatagattgagataccactactaatggcattgactgagtaattttgctccgaaggcactacagatgagcttttttttatccaaaaagttaaagttaaggacatgagtcgtgcatccacgtgggaaaaagggtggggggagtatgtaatttcactaa

SEQ ID NO: 4292 - DNA, 1800 bp, Glycine max
  Soy_ogl_3638 Gm10:49031901..49033700 Cluster 18
tctactcatgcatattttgtgtgtatttattgagtttaagtccaactagcattcctcgatttaaggtatgatgatccaaactattaactgatcatacgcactgaagcgacttaaatttgatgtatttattctgaattgtacacaattcagaaaatattggattaaattaataatcaaaatgaaaaaaaagaagtaattattacagttcaaagttaaaaacaaagttccgataaaaagaagagggaggttaaaaagtattaggacccctcaatactcagtttctaaatcagggcctgcatgcatggtagtatccatgaggatgagggaggagggaaagggagagaattcaactcaaccgcgtgatgtgtacactacaccgaaagaaagaagccacattgattttgctgaaatgaagggtcgttttcgtcttgaatttcgtttaaacgcggacatgtttccattggtcggtttagatctgcccctcttgttccattcttttttcttatgcatttgggtgcatgcaaatccaaacaaccttttgtttaatttctcttttagaccatgctttcttgtcccttgttttgagtacttcaaatcacatttaattacactgtgattaaaacattctcaatatgctcacaatcagattaattgcggtatgtatatactagtaatttgtttggatctttctatgttggccaaaatgttgaactgcagaatattgctatcatcaacattgaagaatcgcgagattcttgagtaaggataatcacaagtatgcatgccaacagtttgcatagcaaatcaaccagaaccgtgtcaaaaggaaaatttaccatttttattggttgcaaactagtgatatagttaacaccaacgaatcgtaggtccaaatcatactaaattctaggaagcccattattgctgctaggtgaagtgaaacgaaaagtttaattatcagtagccacaaaattaatgtgtgtgaaaacaattttcatgtagaaaatattgtaccattgggaattatgtagtacataacacataagattttacacttatttatattgtttttaaataaaattaaaaaaaaaataaattttaacacgcgcacgcaaatcatgcttaacaaaaaaatgacgtgcaagaaaccatgagctatcagacctaaacatttatgtcatccggccccaagctaatagaaccgtacgatgcccgtgcaatgtatgttgtcgtggagtagtactaattagattatgtaatatttttgggattgtgcaattagataagagtatgactatagttccattctgataattcaagctgactcgaagttagttttgaaaatatttatattttagaaattatgcataatgtattttaaaattgaatgtagactatcttttaagtccttaatcactctctctctctctcatatatatatgagaaagataattatatatatatatatacgtaatttcatctgtaatattaaataatttattttgaaataatagaatcatattattattttgtttagattataaattaatttgaggaaaaagaggaaagaataataaaataaagaaaaaaagaatgaaaacacatatgttgtttggatatataaaaataaaaagaaaagaagtgaagaattttactatgtgcacaaaaatatattttctccttatttttcctctcaaataaatagttcaaatttagcatttttattatatctccctcattcttatctcctatcactccatttatctcttttggtttagcttccatactttgttgcgttca

SEQ ID NO: 4293 - DNA, 1900 bp, Glycine max
  Soy_ogl_3700 Gm11:3000401..3002300 Cluster 18
tcacgcaagaattttcaattatatctgctatgaataatcaattctaaatacttagactaaactaatttttttattacattcctagcatcatcgacaagatcagtattgtgccaacagtgaaaggtttgatccgtgagattatttcctgacagaaacaagcaaaagggaaaccaaacatgagatataaaaatcccccggttggcaatgcacatgtggttctgaagcaaagtggaaaaagaagttgaaattaagagcccaataaaaagcagggtaatgatgtggcaataaaatcaaccaaataaatgagactctttaatttattcgaattatcaagtatcaaccatgagaggacaaggacacgtacgttcctaaattaggccccatttttttaattctgggtgtttgcatatgctcctagaacgctcttgggtctcaaaacagtgaaaatgattgagcctttgacaatgttgaacaatgacaatagggggtggaggagacaaagatctatgaatgatcgtgtatgtgggacttccactaccttgaagataaaaaataaaaaaagcaacagagagaagataattagataagcaaagccctttgtttttatccaccctttcaaaccgtgggcgatggttttgggttttttcatagagtaaaggttttttttttttcaattctattagactataaaggattactaatttattttgtgtgataatactcttcattatgagtgtatttataattaggattaaaactcagaattattaattaaattcaaataatcttacatcggtttaatgtttaatggtttgattggtgagtacttggatagataagtcgagatataaaattattttggtggtaaaaaaagataaattatacgttgaaattttctcattaataaaaactaataattaatattttttaataaaaaaaagttggatagatgaggaagtctgaatttgttgtacgtcattgtaataccggacaagtgacatgcctaaattggtatgagtgtttgtgacttagatgatgaacacgtagctaaggaggcaatccattgaatccaatcgcagtgggtggaagtggaattatagtcaagcgatttattgcaaatctttaaattctaactgtacggaaaaaccagtattttcatacaatacattggagtttccaccgtttgtttcacgatctaaaaaacgcaacttattaagaggaataaacttatcttattagtatgtacgtatggataagatttggtagcattatacatttgtacctacttacattcacaaaattatatagataattgccatagacctgtatgcatttaattggttagcttacctattaagatgatttttatatatggatactttttttttgacagatatatggatacctattagttattaagtttgagtctacttgccttgccatccatattaaagatagaggggaaaaaaagtaaataatgaagatagcataataattttttagcatgaaatgcttaatgtgaaagaataaattataaccaaattaaaaaaaaaaagatatccattttacttatagtatgtttggttatgtttagtgtgacgtggcaaaagaaaatcaattgttttttttttctaaattagaggaatcacaactctttattttagattttcacattaaaaaatgaattttgtagttattctaagatataatacaataaatttttaaggttttgtctaactaatttcaactaaaatgagattaaacaacttaagtataaaccaattgttaaataacatacagctactaacacaatttattcattaaattattaataagtaagttcattttcaatttaggtaatcccaaacttttagacttaattttttaaaacttttagatt

SEQ ID NO: 4294 - DNA, 1364 bp, Glycine max
  Soy_ogl_3722 Gm11:4258201..4259564 Cluster 18
cacacagattctgcattttcgtgatagtatatttgatgtattattttagctttgctgctccacgcaaattagatcttccatatccaatttaaatattgatatattttctttgtaatcttttttcctgagtttcttggattgagttatactggataatattgtaattagctatatatggtcactttgattttgctaaaacgaacttttttttttgtatccgtaggaacaatgagggtaccaaaaataatttataatgctcagacatcctatttaatcaactcagttaaatctctctagttgttaaaactagatttgaggttttttatttgcttcttaattatctttgattgcttttctccatgcccattgggtttcttcacaagtcttcccttctcaatctcccaagcatgcatggtgcagaattagaactataaattaacttaggaaacctaagctttgtttgttatgcaagaaaaaacagattgacggatgtgcgaaggatgacccaaatgcatgagtttcgatcaatccttctgtcgtgttgtttggtaccaatgtaagagggaagaattaaaaaatgaagaagaagaatgcgaggtccattgtctaagtaatccacccatttttggaagagaaaagagaggaaataatattttagcacaggaaaaaagattgaaacactttcctttgtatattttttcattaaaaatatgtatgtcattaaatattttttgtcatttgagattttttatctggtttaattcatcttagaccttataattgagtcaatttttcattttagttcttatatttaaaattttatcttttaattcccatctaacaatttttttttatttatattttagtctttacgtcttcattttgtaagttgttttacaccgtaaaaaaactaacaatagaatatagataccataatagatagaattatacatacaaggactaaaagttaaattttttaaataaaatgattaatcaatcatgttttgttatgcgattggagacacattaattaacgtgatttttcatgtctcaacagaagtttttacttgtagcttgtcccttttgacgtgataaattgcattggcaacatatttccaaacactcgtgaagacaatgccgtcatctacaaaatccaaccgttcgcgcaatattgttgagacttgagagtgaccctgctccgtcgtgaatttgtggacttccaaattccttaaaaaaatataccaaagttaatgtcatgtccactttttaatttttcttttattaaaatcaataatgtcattgtcaatttctaaattaaggaaaatagaagtagatcgataatattattgtcaagttttctaaat

SEQ ID NO: 4295 - DNA, 1799 bp, Glycine max
  Soy_ogl_3747 Gm11:5215799..5217597 Cluster 18
ataattatcatttattttgaaaatttgcattcaacttatttagagtttttgttattatattacaagctaaacaattttagttaattcttaatttaactataataattataataatgagcttttggatcaattatctaccgattaagcaaaaaaaatgattatggaaggggttatcagtttaacgtttacaatacatgttttataatccgggatagattttctctatacatttacaattacaattaattatcacttatcattcttacggaactaaataatgaagaaaagaaccttggtaggcagtattataaacgtaattataaaaaatgactgcaacaatcttaataatttataaacagtttttatgttaaaaaataataaatgataaaaaaaatgagagatgatcacctgttaacttaatcattccatgcatgcggagtaagtagtaaccatcgagattttcagccccttcttgaccttacgctgagatcatgagatcatgcatttatttttctctctcgaatctttaatgaatcaatgggatgaggtgatgtaaggagcaactcagatgttatccactccactgcattgcattgcattgcttttccacgatttggtaccgtaccatcaaacactgacactctgacacggcacttcagttacctctagaattggtttaatgaatgaatgaacggtgaaggttttctaggaggagacagagagatttaatttgaacattttccctaaaaataagactgaaggagatagaaaaagaattagataacaatcacagataaatggttataacctaggtatcctttggttaatgacttgacggaaaataaacgattattcattattaatggataaaagttgagaggaatgaatataattttctttttttccagagtaaagaaacatttgtttttataatctatgttcagatcgaaccgagccgaacccatctagtgtcccagtaacccaccactttcttacctctttatctccccacaacatcaataaaactaatgtttaaattattctgtaagtatttttatgttttaaaaatttaataacagttttattttttatttatttatttggatccttatacttagtttgccactggagcatgattgttatagtaataaagttgcattaaggcatctaagtaaaagcttttgaaatcataggctgttaatcaaaagttttaaaatatattaatttatttggctgtattgttgacttacgttttcatgcaataggttaaggtccttgtgataactgagaagattatcacaattaaattatttattctttaaaaaaatattgtaaaattaatttaaggactgcatgtcgtggagttgcaaaattaactgcagacaattcattgcaccctaacctaacacgatagtacatgaggaaaatgaatttttataattttcattttcaaaacaagaagtatttgtaaattgtcatgtttcaaaataatttggaagatcatcatctcaaagtttattaccgctggcataattaaattgggcaataggcattaaacatggaagcaaattatgacgtaatttttcgataaaaaatgacgcaatttcttttcccgccgagtgacatttctaatgctattcaattggaagtgtttttttttttacaccaattcatttggaagtgttggagcttcttacagggcatatcttattggctcattcatttgaaaacatttttatttggttttagcttttaatttcttgttcgtttgcatgtcattccaacagaaactctagttt

SEQ ID NO: 4296 - DNA, 1868 bp, Glycine max
  Soy_ogl_3749 Gm11:5325933..5327800 Cluster 18
tagcttgcaccttaagaactttgaacaaatatgtggttcttgccgaataactttgtctagaacgtactcccatacctaattcgactaaatcaacaagttacatatactctattggctcatgattcttgaaagtctaactcatgtcaaaatgtctagaaaggtattttggaccaaacacgatactgagtgaacttaaacagaaccagttaattatataactcatgtctttgttttattccaattatgagatcaagattcctaacctttttcacatggcttacaagttacaagaatcactttctccctattttgttggtcctttgaccatactatatatcatgacaaattataagaaaactcgtaataaaactttgtatttttctatataacggacgttaataaaataatcaatttgagttctctgatatgggttaataagtaatcaatttcattattaaagtatcagcgtaaatagtcactaaagtctaaagtaaacaaatgacataagtaaaaatttaatgattatgcattattaatgtcaatttttttatattatcaatcaattgaaaattaagtatggttttgacactgtcaataagaaaaatcattcaaattagtaccttgaatattgataaaatatataaaattagatattaaattgatgaatattcaatattttaagaattgtttatgtaatttcattacttgaaagactttttataataaaaaatatacttttagtaatgaactgaaatgaatgatttactatgttctttttaaaaagataaacaggttgactaaagtaaaagcagtgttttttcctgatgacaaactacgaaactgtaaggctgactagtggactagtgcatagtcggcaagttgtcagaatttcatgagtgagggtcaggggaaagtaaatagataaattattgtgatttagtcattatccgtgacaaagttgtcttcaggtacgtgaatcggataagcattatattgcttggtgatataaaaatagtgattcatgggttggcagaagaaacaagcagatctagaggatcataatggcaaggagttgtctcttttctatggcatttacaggtccactggactagcaatttgaggattcccttcggagccaaagttagcatttctctctgtgctcttcaattattccgtgccataaccggatggatttttatgtgttactttaaactcatagaacctttttataaactcactgagtacctagctagttagtctaactttcatgtgcaatctttgtaaacaaacagtacaatttcaaagggtaattaataataaagacattaatagacaattaagttggaccttattaatttaggtgttcttcgttagatccaaactaacataacactaattaagcatgtaccaggacacatatagtaggtagatgcatagtgaagtatcgcttttctttctcctgtatcttgaaatttcgcgaggagggattgaccgactatatatggatttatttaacgcgagtgatttcataaataaagtatcgtacataatataagcaccattcctttggtaggaacaagacaaacgataatgcattaagcaatctcggagtccctttgctgtcatgttcacgaggcatttgtgtttttgagtacccgacacgtcgtggaattatttcttaaaaattcgacaataggcagtagtcacagtatacaaggacaaggtcgcatgcttctcctagctacccctcccttttcttttatttttattaatcaaatcaaatcacttcacaggacgcttgctttctatcgtattataaaaatcagcatgagccaattttcagtttaacacgccgaaaattggtaagc

SEQ ID NO: 4297 - DNA, 1500 bp, Glycine max
  Soy_ogl_4551 Gm13:38555001..38556500 Cluster 18
gctagcatgaaacttagatgtccttgcaagtaaatggacaatttgattggtttgcctcctaattaaattcaccctagagtttggaagtgtgtctaaacaagttttgcatttttcatttatgtagtgaaattcatctactccttgtttcatagagtgtaaagtattagtaacttgtttacaatctgtttctaggataacactttggaaatgcagctcttgcatccattcaagtgcctagagtagagccaaaccttcagcttctcttggtctctgggttgccattcatgtgtactgttctagctaataggaaccttccttggtcatctctggctactaagccagcataccaaaagagttcaagtctgcaaaagttgctgcatctgaattgtaaagtatttgttgatctttgttttcctccttttctatgtgggttgatttctctttttatatctctctcgatcccttcttttctctgcgtctcaatgttaaagaaaacataacaaaatacataataaaaggatgtaatccaatttgctaaaatggtagaattaggcttgatttaacttcacttacaaatcctatattgggaataatacaatttgattctttgtttcatctgctcaattttctaatttgtttttattgtaatgtattagataaaaaaaaattattccctgttaaagttctaatactcctacacctattaaatataattcaatgataaaacacatgtctgaagttattctttttattaaagataattaatgcatgtttaatttcacttttctaatataatttcttttataattttaagaagctaataattataacttttacattttaaatgtgattttttctttctcaataagcttctaaacacactataaaagacttatgtgatcaacactcgttgagaagatttatgttttgtctttttttatagaattgttttcagcttcgttgtatttgaggatttaagggatgtgcatagtaaattaatgaattgcaaatcaactaataaaacgattatgatttaacggaataaaaaggacctaaacatcactttcaaagtttcaatactgacagaaattagaaaagaaagattttacttacagcggcatcattgtttatggccacgtttggcagttgccactttgcattttagctgcatcacatccaaattttaggacaattatttgattaaatatatgcgatagtgagatataaaaatagatggggcgtgtggcgaccataatatctattattcattttcactaaaacctctctaattataaatccaccaaactcattagtttttcataattcaatcaaactaattttgttgccaaataaatagctgggttgattgattcatgagtggcatcaaaattatagaacagatgctaacatcgagttagttcaaccagaaaaggtgttcaaacttaattttgttttttaaaatagaattaagtgattatattaacgtatacttagaagcca

SEQ ID NO: 4298 - DNA, 1588 bp, Glycine max
  Soy_ogl_4554 Gm13:38576801..38578388 Cluster 18
aattattgcgtatttaattgggtaagtatttctatatttgattttagatgattttggtgtggaaaaattaattttggctaaaactaaatttaaaataaattagtttatatttaaaaacttttatcttcaaagaaatacagtaatatctatagtagaagtatttatcccaaaagtaagttttatggcaaaatttttatacataattatcaactcaccataaaagttacatgacaattgcttatatatgttttgtatctaaacagactcttatcgatcgcatttagtcttgtctttcttagttagcatccacttttggctgacactgattcatgttttttttagtgaatgcatcaaatagtagcaaggttcttagtgaatgttgatgatcttctacttagaaacaagtaatgacacagccattctcaaaaaattcaggatatcgagtttaatggccacaactttctctcaaagatcttgccaccctcacagacaaaacattttcttggggctgataaactcatctccactacctaaggcttagctagcttcttgctatgcaattagatgttagttatttttcaaaaagcttagaaataaaggatctagtagaattagttaaggtaacatcttgagtttgggttaaggcccaagttccgtgatttggttactttttttcaagatggttccttaacccaacagttttttttcaagatggctccttagttaattgtaagggtttgaataatccttttactcacattagtattttatttctttttgcctgccaattaaagaaggactacgaactttctaacatgtaactttgaagcgatataatatatagtaaaagaagtagactaacggtattttatgtaccataatttaaatggtttttgaatcatcctcagaatcatagttattgtttgacttgcagtggttgcaagctcatgctccctgctccttctatttactggaatataaatgaccaaggtttgtggtaatttccctcctttcgttttcttacttttttgggtcaatactttatgagttgcgtaatgagagtttctcactcgaggttagatttaaaatcacaatacgttgctgtgggtgcttaagaatgcgaccatgggcagatcgaatcaaatgcaaggactataattacttaattaaataacacctgtcgcctcataagcagaaaatgatatacttgttactaatatttttccttttgacttgtctttccgttaacaaattaattttactttttataatttcttaaaaattgtgtttgacccaacttaagaaaaaaaaaatcatttaaacactacctcgatcatttaaaactctcaatctactatacgaataaatgttaacatcgtaagtttcttttttcggtgaagcaacatcgtaagattctattattgttaaacgtaaagttatttattgcttaatattacgtaattgatatacctaatttctcacaacaattcgatggcagtatgttgttgttcctgtttttttatccattttatagtaaatagcacattggaagttttcttaatacatataaattaacatttagtgtgtg

SEQ ID NO: 4299 - DNA, 2000 bp, Glycine max
  Soy_ogl_4564 Gm13:39162701..39164700 Cluster 18
catggctaggctaagacacgatccacatgttaattcatagaaacttccccactttgttgtcttcaattacctaccacggttacaaacattaattagaggggtgcactagatactaaagattaaaatattagagttggccaattgtgacatatacaaatgaagaaataatcaaacccaaaagtggacatgtggtccaaatcccgaagcttaagctcccctttcgccgtccagaaagatacgtgataagttagattggatattgttctcataataatattcctaaaaagttgttcagtttatgcagaggttgttagttgccggccattttcatatacaatcacagagaatttcagcaggaacaaatatacatggagtaacattccttgtcctccaaattatgaaagtagtaaagactattattttttttataaaaaaaaagggggagtgatgcaagtaacaagagaaaagggtaactttatttatccacatgaaatttagataagacagaacacattattttacatatttgttgaatcctgttgtgagttcatgacatggacaaatcgtaggcccgtttgtttagaattttataaaggctgttattttcaactttttataaagcattattttgaatttttttcataaaattatataattattgtaaatgtttaaatatatctttcaatggtagaatttcatttgaaaaagcgtttaaataaacgagtttataataatttaggaatacttaatttttattttttgatcagcctgactacttaatttatttattcaaatatttctttaaggtttaaaacatcaaactttgaaatatatattgttattttattttaaatgagagaattattcattgagtttttttaacatatatgattttttcttttacaaaatctaataacaaataatttttggttaataaacctaagacttgaactttaatgactttactcttaagtctgttttgatgtcacctattttttattcttccatccttttaattaagcaaccaaagaaaggaagagaacgtgattttacaattttgcctttcccccgtccttcttcgttgtttctctcctagcaaatatagtgcaaagttattttttatcacttgttttttctttcttctcatttgttaacacataagttgttggatcaagtgatagtggattttattttttaaataaaatctcatgtttgaatcttaaaaataatatatatatatatatataattgaaaggaaaaaattttataaaaatgattatcagatccttcgccaaaataagtaaatactttatactaattacatgattaaaaaaaataaaaaaaaataatattgcatgctatttgaacaaaaaataaacataattatcaaataagtaaatatacttatcatcaatggaaattagatgaccttttttacatctattataaaccgtgttcacaacaaaatccgtttattaaattttagtatgcatgaattatgcgcacatatatgatcctatacaatcaaaaaataatgttaccatgttggtaacctatataaacaaatcaactgaaaactgtcatatgaggctgataaatcaaattatgacatctgagtaccatttgtcatgtattagttcttccaaaatcgcattatagagaaagttcaacgtaagaagcatataaacttgtcagttgtaccaacttgcgtttcactctgtttcaattcacggggcctaaatcactatgactttattcttgtcgtggaggcacaggagaaacatgtttctacaaaaatcaatacagtacacatcaccaagcaatacaaaactacatttacacaagcgaatgtgactaggttaagtgtgtgtgagaggatagcacatgatgctaattattgtccagttaattggtggggggaccatagtttgaaaacgaatatgtttcttttttgggtagccaaatggttcattcacttgttggtttggctttctaagcac

SEQ ID NO: 4300 - DNA, 2000 bp, Glycine max
  Soy_ogl_4590 Gm14:548601..5200 Cluster 18
tgatcaggttaacaaacctttccaaataagtactttttaaagcctaactccactgatcaaagttctccaaaatccaaatgaataaataatacttgtaagcccatttacctattcatgggctgtacttctgcatattgaggcccatttacctttttttttttatgattcttaaagagtaaaatttatggagtaaaaaaataaactaaaaagagttaaatttgtaatacatccatttttatacgtaaatttagattagacttactatttaaagacataaatgtttctgaaaatataacagatttaggtaaacatttattctctaaaaaaaggtagcatttctcaattaacatgagaatgacactcactaagaaaagcaaagaattctttctattcacttcctcttggacagtttcataaatgctttgctcatgaattaaggttaatactgataaacaaattaaggttaatgattttaattattaatcaactaaaaaacaattttcaaatataaacaattttagattattataacaagttttattgtattagtctaaacaattcgtggacagtttcagtgtttctataattgcaaccttcatcagctacatgctattcctacatactatattgttactctgtcaaatatcgactcgagtgttagaatctctgtaagtacacttctgatgcacagaagatccctataaacgccaaccagagaagcttctgtagcagttagttcttaacatatttattgcagcctttccatagtaatggaatagaaaatataagaattagaacaaggacaggtaagcacctcttcacaagctatgttgttaactatgtctcttgccaagcaatgctgctcaacactgggagtcacattcacatctattgactcaaacattgctttgtaataatagtccagagtttcaggcaaacgtggaaagaattcgaaaatgtctgtgttagattcagcaatcacactttcatccggcatctgatgtagcatgaatgcaaaattcacagccagagccacccgagattgaactcgaaggttttgtagctgaacatcacaagcaaagatagctacaacatcaaattcaaagagcaccttaaaatcctcagcaagttttgataacttatttcccaccatctgcattgcatcagatgatgttgaatcaccaatagccgtaatccggatgtggagtggccccctagacctagctacaaaatcctgaatctaagtgagccactggcttccttcatcaatatggaagtcaattatatgaattatgtcttcgtctctcatagcttgtgcaatggctctgtttgcacacatgtatccaaatttgaagctgagactaatttgatgaagcatgtgcatgtaggagaggtcctcttcatttgctgcttcgtagtacttcaaagctttgtagattgtagtccctgtgctagccaatcgtgcaacaagtgcttccaacatgtatgctcccaatctttgcatcggttcaccggaaactgacaccatcccccttagttagtgcatgaaccaatttgacatcatcaaatcagtgtctccaattgccttggcacatgcaacaaggtcatgcttcagcactgtgtgcatatcagtatcattattgctagaatgaggcacaacaagagcactatcaggattggtttgtaatgaatttaatactacttggtttaggggtaaggcatgatctgtgatgattctaattgtaatgaggaacgaagaataatgagagaataactaaaaccaactccaacaatgcctaacaacaatttgatcttcatgagttgtaagataaaaccacctaggaagaatacaaatccacttcaaatcccacgtgaaatgagactataggcatcgggttttgtgttcacttttttgtcatagaaaaaagaatacacggatgtggctgctgtcaaaatgacaactgaccgatgagctttgcacatgagatttgttaagtgtg

SEQ ID NO: 4301 - DNA, 1400 bp, Glycine max
  Soy_ogl_4594 Gm14:842101..843500 Cluster 18
aatataaatttaataaacatataaaaacatacattaacgaaaacttatttatgttgtgtatttgattgggtacatgacaaacttttttttgttgtgcacctcatttaggtatataacgaaaacaagttccatcaaatctttaagacagaaaaaatgagcttgaaatgctctcttgtgaagtcaaaatcaatggaattttaaaacactttggttcaacaaaattagagtgtgatggagggaaagttcaatggggaagagagggattgggaaagggggtgtgacaccaaaaacaataaaggggtcaagaacgtagaagaaaaactaataagtgagggaaagggggtggggggtgttctaactaaggtgtgtcttaatagaggggtaggggaaggaataagggtatatgcatctttttaatgtattgtggtaaatagcaattaagagggtgccaatagttattccttgggagaataagcccacaggtcataattgaattaaacagtttcttgtgcttagggcgctaatttgaacattttatctaacaaatattacgccaggaattgttattggacctgaaacgtttataagcatcatgtatcaaatgctacaactcaagatggtcattctagaataacaaaaataaataattttatggacccaaaaacaaaacattaaatgtcttcatggatatttaaaaacaaaataaaaaacaaatatatagtaaaaagatattttcatctgacacagtactttaaacaagaatacttaaaaaacaatacctgccattaaacaaaatacaaacaatacttctttgaattttttcttgaaaaaatcgtggaatgtggacggacagacagacctggtgtctcaatggaaaatactttattcgttgtttaaagatttttgtaattatttttcttaatttaatttattttttaattactttagttgatcagcaaaatattttgctctttaataaaaaaatgaattcttatttttaaaaataataaataaatggcttaagctattgttttatttttatatgaataaaaaaattaacagaataatatgatttgttttatgtgactgaaaacaatgaactaagattagagggtgtgattccgagatcaccatggaagagttgttgctactcgaactaattttagaggcccatgtctaacagttgcagaaggagaagattaaaaagattagagaaattgataaaaaaaaatggtaaaaaaagataatttaaacatgacaataaaaggacggaactaaataattagagaagttaaacatgaatgataataaataataaaaacatgaaaataataaatttaaattaaattatacaataatacttgtacaaaaatctaatttatatgtaaatagatagataa

SEQ ID NO: 4302 - DNA, 2209 bp, Glycine max
  Soy_ogl_4895 Gm15:3752201..3754409 Cluster 18
gtattttaaatatatttttataataataattacactaataaataattttaatgatatgataatttaaaattgtttgagagataattcttctatccctcgaagaggtatcgaatactctcaaacaatctaaaaccatcctatcgttaaaattatacattattggagataattcttccaccccgtgaaaaggttcaactataccatggtgattactgctgtcttcaccgatataaacttgctcctctcatttagttttacaattaccatggcttttggtaaatcaacaagataattaccaacttaaaaactaataaaaatcttctgtctactaatttagagataagaacaaacccaatgaatgagatatcgtggtaatctggaatcttacaattagcaagtagaaagataagcaaaaaagtgtagcataactcacattccataaggatatggttggtaccttttctttcttaaattaaagtaacgacgactacattaattgagaaataaaaaaatttagcgaacaaactttttcgtccaataataaactttttcttgccaacagagtaaaccaatccagttttagaacaagaaactcatttactttatgcatacgaagaaacacacgtcaataaaacaaatgacaaaaatgttaaggggttaaatataacaagtgtgttttttatttttattttaaaatgaacaatgtagttgttacttgatctagtactagagtttataacaatttttaggttttgggcttttacccaacccattaaaaaaaaatgtgcataataatttaaacgtattacttagtctgttgacctaaaatttcttgatagtttgttactcaatctatttttttttaagtaaaaagaaagacatactaatgcatcataataagagttgtacatgtattatattaattttaaaagtcatcaaggaagctaactttgtattgtatatttatttgtttctaattttccatgtaaccatttgatgttgcttgaaccgcgagaactgaatcacattcaatccaaaggtttaactagattttttgaaaagatttttcaatagatataatcactgctaacagctcaacatagagggtgaatttaatgccaatattataagcaaaacaacccaaacaaactttgttactactcatgaataaacttccacaattagttaaactgtgactgtctttagtcgtcacattcatattgtacttaatcctattaggaagagccaaattttaaaaaacctgcctaataatatgagattttctcaaatgcccatatatgttaaaattttgtaggacacaacttaaaaaagaagtttggaaaataaaataagttaaaaaaatagaaaatataaatagaaatattagatgtcaataatatcattctagaatcatgttatccacacatgtattttaccatttgctacttaaatatctttcgttggtcaagcgagttggtcaagagagttgcatgtttaaatggccttgatgattgaaaagaaaccgattcaatactacatttaaaagaaactgttgatttttttttttgcgtctgaaatttttgaatttaatcaagactcaagaggtagtattttaaatttctttacacgcacaaaaacgaaccattttcagcgaaacctcattttaaaaaaggaattagttagacaaagtaagtaaaaaataaaggattttaagatgaaaaagaggcaacaacgtaacaaatattaggtacagaacaacggatataccgattggtcagttgtattgaataaaccatgaataatataatatttattttgataagaactacagagaattgagggccacagcgccatatgtcgatcagaaaaataagaaagaaaaagaggcatagctagatttatcataaaatccgaagaaagtctcgctaataaaaaagtgtttttattttgaggacttggttcaatgctttttttttttttttttaaaaaaaaggatatatttgacagaaagttaggaactactcactccaagtacataaatttattcaagagattaaatttttcaacaatatttttcataaatattctatgtgtttaaactgatgaaaaaagtgtttaaattgaggaaaaaatcaatcaaatttttatggactcttgatttaaatattcttgcattttgatcaaatattaaattatgcaaattatagat

SEQ ID NO: 4303 - DNA, 1500 bp, Glycine max
  Soy_ogl_5494 Gm17:3831501..3833000 Cluster 18
gtgcaataatataatatgtcttcataagaggtggaataccctagtacttgattagtgcatgcttggtacgaggaagcatgattgcgttatgttcccctcaaaccccaacgacgagtgcgtagccgaatgctttttcaggtgccatttgcagcacgcattggtggattcggcgtaagaaaaccaagtccatttcatttaatactttttctattatgtatttataacatgcactccactactaacccacacttaatactagagaacaaactttcttgggttgaactttaatttagtagcacaatctttgtcactactttttaatggaacacatgaaacccggtgtatacaaagttatgaaacccggttgaaagttaaaatgaaactctttttgaatttttttaatgctacatttatcatagtagggagagaatataatttaagcaaattcaaacttgctactaaaaaattatttttatgagaaatatcgaaaaatgtttacaaattattgaaattaacatggtccttataaattggcaatatgatatgtactgataaccaattattttttcccaccgaaaaattaagtgtcacttcgaccattttagtcggtagatacgtacgttgaaagcttttggccctacgaagccagcgattatagttgattgtgatcttttttttcttagtttgagttttgaccattgacttgttagctatgagaagttttgaaacaaaatcaattttaccaaccaacaaccaaatgcctataattttttaatcttttcactaaacaaaaaaaaatacctataagttttataaaaataaagtttgattataatcaaaaccaagtcttcttatttttacgatgaatccaaacacaaacacactatatatttgtctttatacgattatacatggacggaaatgggttcgattaatttaaactttataagctcatcaaccaaacactaaatatataattaatgtaattaaactaaatatttaagcacatcaaccaatatttaatagtaattaactaagaaaaaccagcttactcaatcactaacaaggaaatataaaggttctatgcattaaaaaagaaaaaaaaaaataggccaacttacatagcttgttaaaagtgaataattctcttaaattcattttgatatattattttcaaacacaaatagttttctaacattaattcttttaaaattaattctatcaaaatctaaatcaaacaaatctatataattttttttgcatatgtgattacagacgaatgttttctttgcctttaactttgatttggcatacaacaaccattattttataaatttatatggtgttgctgttcagcttaggactgcttctagagagtagagagtattatcattttgtatagtcaaatgtattcccaccatttttgtcttaagcaaataatttgaaaataaaatcgacataaaacgacgaccaatgagtagctatcaccatcactaccat

SEQ ID NO: 4304 - DNA, 2100 bp, Glycine max
  Soy_ogl_52 Gm17:4467001..4469100 Cluster 18
cgttaagaaaagggcttttattatggtacaccacattgtgagttgcgatcacgtggaatcattaagggtgttggcatcgctatgaccatccccatctctatcactatcaagtttgtggtcgcggcggtgggtgtggcggggcacaacatccaaaccttgatgctactactaattggtaataaccaataagcccctttcatgaatattggtcacggaattttgggttacttttatcctggaccataataacatttttgtaacccatttttcagttatcaaacctacgtgtcatccattgacccaaacaaactgatatgtctaaagaaagaaaaatctttcatgtggtgtatatttacaaggtattaagactaagacatcttaaatgtttgcgtttaccaagtagtaccaacatacatgtaccctgccgtgttgcttcttgctactattgcatttttacagactctgcccgagctattgttgttagtgttatgtttcagacatacttgaatttaggagggtactaatactcttgctgttattatctttttattataaatcaataaaaaaaaatactctattatctatgcgttaaaatcacattaattataaatgaattggaatttaattctaaaaacattttaatttttataattataaaatcgaggtttaattatttcaattttttcaaatttaatgttaaacataaaaaatatatatatactttaaaggtattcaagtgtacatagtattgtgctttatatatactttaaaaataaaaacataaaatttgaacatattgtgtacataaaatattaaacataaaaatatgctttaaatatactataaaatcacaaaagattctacactctattctgctttacaattgtttaaaacaggctgtacaattgtacacgtactctatggaaaaaaacattgtttgcttataattcatctctggttatttcaagttaatgtagttttaaaacttcacaagttgatttcctttgtaagtaacatttaataaaataaaaaaagagaaattgcatatatgtgtgtttggaagtgtgtcccaaacacatgcagacgtacgccaaaatatataaatgttaataaatataattttttagtccaacccttcataatgtagagtttgaacgtgatatcaaacatgcaactatacaagggcgatctagtttattcagttaactagatcaaagtgaatggtacgagttcgtatacacgtacgacaaacattggcatcacaagcgaatgtgacctaatccttcgacctcgttgatattgccgttgtagctagacaaatgaagctctacagcctctactatctatatatagcccaaattaaagtaatagtattacccttacaaaactttctgttaggaattattgaggaccacaacccacctaaagcttgtaaattaataattcaattcttaactttgaagtatatatcctctcaaaaggaatcaaatcaagtggactatgtaccttatgtgaaattctaaactattaacaaaatatatatttagttagccattcttcctatatttttttaagatggaatttaattttcgtcgacagtagaatactagaatcagaccaaaacctttattataccgaaatgattttttttttgtcttctatctaatttctcacgtactaatcatacttactaattccttttggtttcggcttgatcttctgtatctacgtacatgatcagtccccttgcttgaaatcattatcattacaatgacagcaatctaacaattccgtaaatacgagtggctcattaggttagtagcttcccataccatagtattatgaaatcttaaatttcatcatagccttacccgtgcccatgaaaattctgcaccccaccataacacgctcagatcaagggatagagagagaaagtgtgtgtgtatgtgagagagagagagagggggggccatgggcgttctggtattgagagaaaagaaagtatgtcatgttgctgaaacgcgatggcccccttgccaattttgaaaagtaccataattttggacttactctgtattacagacagcaaatacatgataa

SEQ ID NO: 4305 - DNA, 1398 bp, Glycine max
  Soy_ogl_5877 Gm18:1899901..1901298 Cluster 18
tacgataacctacgatagcattttcttagagaaactttaagtttattttaagaaaaacaacgaacaattataactaatagattttgagattgttaaaatttgtttccgtaattgctaaaaaatgattcgagaagtttgagtatggtcacacggaaggtcaagcctaattggttctcttgttagatcactctctaaataaaagaaaaaggtgataagtgatattatgactcatgagagaaggaaccgtgccagaaccggtagtggatattgtgggccttaccatgttttggtataatttttgtttttggttcactggtttagttgtttttcgagtcactgccatatgtgccactaatagcaacgtctctcccaaatcagttgcatgacccctttttattttctgtgtcgttatcatttttttgggcgataggtaagttagcctaaatttcattgaacttaggcttccaatgggcccttatccgtgttgtaaagttacactcagtcatagccaagcctaccttgacattctcataaaaactaaccaaaagaagaagaaaaagaaatagtccttgaaatttttcttttcttattgaccaaaaagaaaacaacgaaaataataataataattattattattaggaaataaaagaggaaaatcatacttaccttgtcctcgtccaactcaagcgtgaagcttcacgccacacccatgccaccaaaaaaccagacccacaccttaatcacgctttgatatttgtttcatatgtttgcatccacgcattagtactttgaaaatgattctgatttatataaccagacagaaacacaagacaataaattaatatgtcgttttgcagtggttattattcgtatgcaggttcagtataagtctccttttttgtttctttcccatgaaaggctaacaacaaaatggtcaggggatcgggtaaacagagagtgatcgagaaaatatagaaagcggtacaaaagattggaacaaaaaactatatatacaaaaacaattgtaatgcttaacaatcttttttttctattagtgcagaggataatgtgagttttaagcttggagaaaatatgtttaacattgtttattttattcattttttataggaacattttaggcttcttttttggttatagaaaaattagggtgaggtgatggcactacagtgtaaggtaggaaaagttttggggttcaaataacactctaaaagaattattaaaagagatgaagttaagaagatcaaataaaaaagagtaattcgatatgcttgagattatatatatatatataacatcagtgtttaaaatgtgcatccaaaaaataaataaataatgtcttattgagatagaaaagaacaaaaatttgactttagatgg

SEQ ID NO: 4306 - DNA, 1354 bp, Glycine max
  Soy_ogl_5903 Gm18:2551001..2552354 Cluster 18
atgggagagcaagagtattatgaatccttgtgtggaaaattctttttaatagtaagaattggtttaatgatgttggtgaatgacgatatagaaagaacgcagcagtgtggagactcacacttaaaagtggttagtggttacttccatattggcttaaaaaaggctcaataaaaagatatataagaagtgtaactcacctgctttatgtttgaagattttgaatagaaacgtggtgtctgattctcttagttgtcattcacgaagcttagttggtctgttatcggaacaggaaatacagcgtgccttgtctaacacagtaacaactgataataataccaatcttttcagttattgatatgccaataattcctccggaaaccatatggtccacgaaaggttggaaatcaaagcaactactgcatcttactgtttgaacagatcatgtttgcacccagtgtccgaaatgtacatgcacgttcacccttcatttattcgtatgccaagaggagaggcgagaatcacaagaataaataactgctttaattattcttataagtaagaagtgggtttccttctattttaattacatgaaagttataaagatatttttttaagatgtacaaagaaatgatactttggttgaaatgatattttcttaaaattaaatgtcatttgaaaattggtttcaaatattaatatttcatgattgatgattaataatggaatttcatatttatcatttcaaccaaagtaccatttaaaatcaatggaaagaaattttaaatactataccacgatttttcacccctcattttacttttttcttattgaattactttttataaaatcgttattaatattatattaaatgattagtaattatgctattatagtacaaaactattggaaacggatttcaaccactactacatctttgaacccatatttttactttttcattgcaaaaaatttctctatctaaatttttatttggttgaattttctgaatcctaatttcgaaagagacaaatcggcgttctgagcgtatacagtacatagtatttgataagtcgtaatgatgacacgcacaacgagaaaaaaaagatggataaggtcttaaggtggttgcattgtctccttggctttttatatacgacccgcagttgacctgttcgcttctcaattttattttatcctttttctaattcggtatattgtgagtattttactatgaattattttaaattaacttaatttttttctttctataatgagtattgaatggttctaataattctgacatattaactatatttgtttttcgtttaattttttctttagatagtattaagaa

SEQ ID NO: 4307 - DNA, 1500 bp, Glycine max
  Soy_ogl_6582 Gm19:44892501..44894000 Cluster 18
acttgagagttggaaagccacacccaacttcccctctctagaagaaacaagaaccagataaactccaaaggacttttactcgtctcaagcgtttggagcttttgagttttctgattactattgtgtgatcacattgttgtgcacacccatcaaatcaaaatccaaataatggatatatatgtatcatcatcagtgagcaaatatatctaactaccgacttagtaaaagttatgggaaaataatataaggatggtcctttagagtccccctcctcccgtacaaggttggtttcttcttcatagtcatagtcacaatcatactacattaatgaaatagcaataaagcaattatgaaatagacaccagtcttttctaggattttttcaaaccgtctcgcttccatgaaaaaatttggagaaaaaaaaaagggggaacacaatgtgtaatattttggattattgcttccttcgtttaaaaaaatgtcttttcttttcagtatttaacttgagttttctttttataagaaaaactacatatatcttttaaaagaaataatcttactcaaatcaaataagcttatttagttgcttaatttgatatattttgatgtgaaaatttgatcaaacctaaatcaagaatgttaattctagcatgcactaaattttactgtgacccatcaatattatatttttgaaatttgattttatttaatttctgaataagtacttcagtgcagtttgtttaaagtaatattgtaagataaataatagtataaaatagacatttttttacagcaaatagacaacatttgtgtaacgatctgtttttgttttcttggaagaaaattaacctgctgtgccagtgaagtgtgaaggagccttgctgtcctgagacatgtgtcaaaaagctgctcatttcaatattggagtgccgtttgcaatttggaagctcccatccaacttccattttccttcaaaaaaaaaaaaaatccaacttctattttgtatgaattttatttttaggttttataacatattttataaaataatttaaaaatcaattttcataaagtacgagtaaggaaaaaatatgggaattagaaaaaaaaatatgaataacagaaaactaaaactaaaattaaaacaactcaaaaatcttttgatttttttttacttttaagaaggaaaaaatattaattttcaaaaactactcttattaaattaggttttatattttgatttacaactttttcaaagaaacaaatatgtcatttattcatcccatcatttcttttctttcctccttcctttgaaatagactccgttctttctgcttcttgattgtttctgaattaactatttgacctctggcctgcacccaatatcaattatgggccaccttctggtgggaaatggacgaatgagcaaaaaagaaaactgatggaactatggaaggcagatggctatgtctagggtacaaaactcaatcctttaaatgacgg

SEQ ID NO: 4308 - DNA, 1900 bp, Glycine max
  Soy_ogl_6586 Gm19:45072301..45074200 Cluster 18
ccttcaagggatgtaagcatggtgtccattaatacggttgaaatgttaagctagcacacttattcagtgaaattctgcttctgatatcagtgtggatatcggtagttggttactctattgttgcctttgccaggttaggctggaaacagttggtgcagagatgcaggttttaacaaaagtgagaaatggatctcgcttcaggccgatggtcaggttgttctgactcctgacaggggacaagaagcatcttcacagatactgcctatcaattttgatggactggcaaaggtttattaaaagctttcagccttctcatgatattgtgtgactgacttgcttttcatgtacatattttctaggagtattaacctgagtggtttctttttaagtttactcttggttgcctctggtcttgctcgaattggaatcaatctcaacttgctaccattgcttagctaaaactagctgtaaatttcagctatctatgtgattttgatcttgcttatggtgttataaatagaagattacatttgcatgattccttagaggccctttgcttgaattgtaatttgttacttgctacatgattaatacaatctatatattatgactcaattttttttttcaatgcaatgtttgagtttgtttgaaccttaatcttgtatggattgtttacagtcaatcaagaagggagacaccaattttattggtcaatacttgctcacaggaagtgaaactacttctgtattgctagaggtaatatgagttgagcacagaagacaaaatttattccgataagcccctttccatttttttattgtcatgtccttcaggtttttttttttttttataaaaaaaatctatattaacaaaccatttgtttgagtgtagccttttgggagtgagaatagcaactcccagtaggagatttcgtattgaagactagtttggttgcgctggacaaagtgaaccgtgcaggatataaggaggcccaatttgttattggcatcttggatgtgtggaatacaagaggtcaattggagcagacatattacagcaacgactaccggattatgtattgtaggagataaaaatcatactctgatttgaaccgattctacacgatgttaggacataacataatggatgagtttcttcaaacttaaacaaataattttaaaataagtattttttatataaatattttttaagaagaagatatgatttctttcttaaaataaacaaaaaaaatatttttttaaacaggaatcgtttaaacaaacatactaaaaaaaatatatttattttattaaaataaacacttattttaacaaatatgtttaaataaactgactcaatataatattgagtccaatgcctttggttttcagtcttgttaatataataatgttagttttgatttttttggatttcattcatcttttttgatttaatagtctcaacaaagcgtataaaagtagcctattgaacgattgtatgtgtgaatgcaacgtgtttcaaccttagttgttgttgaagcttcttgtcttcccagtcaaaaccttcaccgtctaacctaacaaagaaaaattacagaagaaaaaaatgagaaacccaaaagtttgttttatgaagtgatggccgaaaattaaattagctacagcttgcaaacatgattcaacggcaagttaggatggaaagcgttgaatcttttgtcattgggtttgacattttggccatttaagagaggcttggtaagtgtataatcattctcctttgacatgtgatcaatggaaaatcaaaatggcaagccacccctccctgtcgtcaagtccacctagtattagtaacacggtcattctaccttaaagatcaacgccacgacacgaattgatggtaa

SEQ ID NO: 4309 - DNA, 1732 bp, Glycine max
  Soy_ogl_6812 Gm20:37505901..37507632 Cluster 18
tgcatgccatgcatatataataatactatatgataaaattgtatttataatttttttctctctatcacaaagagagatagagaaaaacatataagataattgacataataaagaaaaataaaaaatattattataaaaaaatgttataaaaagatgttgaatgaataatatttaatgaagataagaggtaaaaaaaatagtaaattcacaaaaacgagaggtcaaatagaagcctgcatggttggtcaatgaagcccactaaaattgtctggtcatgggacaggctcacaccattcaatcaaataggaaataatgcaggggtcgactcttggtggagtttgagtactatgtacaatgttctaatcttgctgtgccattgcaaaataaaaaaataaaaaattagggaatgactattccttctaggttcaaatataaaccaaaaaaaaaaaagttatgttgtatgacaacaatgaattaataacccttccttaaaactcataaataaataattttttaaaagcttaataaacaagaggataagacaatgattattcacacattaaattaaaggtaattgttgtagaataaacggaagatgttagattttttttaaggtagttgtaaaatgttcatgatactttcctttttgtgtaagtgactcctcattgcacatctaggttcgggacttctctttagaaaaattctatatgttttttcttaataaaatatagcggtgactctcattatttattcagtttgtgtttcgattcatcatgtcgtttgcatttcactccaattttgatcttccttcttcttttcaactatctagctagattcaacacgagcattacaaaaccaacaatttaagctaccaaattccttgaatacagagacatattagagaattttaaaaacacctaccacttaattgaaaaattatatctttgcatacatcaacgatcacagattttcttacttttttagaatttaatcaattctgaaagtgcggacttgctcttccagtaaatatcgtcccctcaccccctttttttggcttgtgaatttatactttatatcccttaagagctgactatttcccatgtataatgatataatatccacaacaacaaaaaatgatataatggcatccgtacattaaatataaattatacttatatacaatctgaacttgtaagttgtaatattcttctttaattaaaaaaatacaatagtctttataatatgcaataatgtatttctttataatttaatagtatttactttgtactattcagataaaattatttttaataaaattactttggaaataataatatcaaacataaaaaaaaaaaaatcaatccaaataaacttgtgagaaaaaaatatatttttaaaaaaaatgttcaagccaatcctggaacaagaattggtctgactcctctattgggaccacccatgtgtacgagtcctgtgtagggattcccccatgtatgaaagaacaatcatatactagttttacaatttgttttataattttatgttaatctaattcctatattaaaatgtgtattaaaaaattatctaaaatagcatcaggctgtgatttaacgctcatgatgaatgcactttaccttgatcgaagggacatgaggtttacgaagacattttgttgttggcactgaaatgaagttatgaattgctccctacccttaaaagactattggaaaac

SEQ ID NO: 4310 - DNA, 1800 bp, Glycine max
  Soy_ogl_6983 Gm20:44339401..44341200 Cluster 18
tagtagtatcaattccttagctaacaattagcaaaaaaaaatatcagtatttagctttaacagtttgtacaaggggaaatattggactaggttgatcggttttagtaactttggggcaaaaaaaaaatgttaaatttaagaatatgattaatttgttctcaaggtactatataaatggtgcatttataagtaatttgcagtgcatgcgtgtgcatgttttctgaagaattaatgaacaaaactgtgctacattaattaattttgcaggcactcataagaagaaggcatcagaggcatatggcattgcagccatgaaatcccgaggactgaaggcagatgctgaacagttgacctcatcatcatggatcctcaaaccccacacgtgggttctaacatcaatatctttggagcttctcattctcttgcattccataaaccccggctttatcttatggacagaagttttggcgcaagaaagaacaagattctggttttcgtcataactttcgatatattcatcaactccagaatgcccacagttttcttcagtcaaatgtcataagcaacgattctgcttcctttgatgataaataataacagttctggatctaactatgtcatttatggtggtggagatggttacgcgattcccatggctacttctacgttcaataatgcagatgaagttattgttgatcaaaataatagaagcaactgttttgggataatgatgtgaagatgcttggttatgaaaatgtgttcagttcaagtactgatccttatcatgcaaggaacttgctgtgttatctttggcggccagcatctggtgttgctgttattaagggtagtgcatatgatcatgcatgcaatacttgggtgccaattgcgattccaagtactcttgcaccaaggcatatatcccaatgatctttgccccggagcttcaccgttcacattgtggcatgagtagttggaaattagaaagaagggtcatcactcatcaagatgcatgaaattaattaggatgatgtatatacattatttattgacttccaaattttgagttttcatgatcttattccatctctaacgtgttatatccgtagaaatttcctattgttatagtcttattccatcggctcgctatcaattttatgtattaacttgagaatgtagacacatctttgggaacccccactcgaacagaagcaaaatattggagaaaagggattttctcccctcagtttccctctcccttcctaaaaattgagtcaaacatcgaaacttaataaaaatctccccccttttctaatttttttaaccaaacactatgttaaagaaagtattaaccaatctcattaaatcaatattgtaaaatgaaaaaagtaaaattaattgtcatatttattatatataactagttgttaaatgatgagagatcaagtttctttaaaaatagttattcgttattttcaccatttattttcttaaaaattaataaataattctctaatgagtaattgattttaacaattaaatttcaagaaaataaattataaagataaaaagtaactttttttaaagttattacgagagtaacttgatttttctcttaataaatttaatatatatttaataaatccatatgacttttcattcataaaaaaaaatatcaccagattaaaaaaccaccattataattgtaatgcctgaaaatatatattattcttttaattatattcatatttaaatttctaaatacataatagaattacatgctatattcattaaaataaattt

SEQ ID NO: 4311 - DNA, 2700 bp, Glycine max
  Soy_ogl_224 Gm01:49396901..49399600 Cluster 18
tttgtctccaaattaaagtagtccaggattttaaaaatttaaaataaaataaaattataatccacttgatcattggattcaagaaaaataaaagggaaagtaaaagttctttatatagatttgattgagataatactcgtaagcacctcgtagtgataaaaaaatttgaatgttgttgtctccgtaatgtagaatggtcaaagattggcaacttagatgaatcatttacgtagatatttgttcatgttaaggtgatacggttttcgatttgctattgtttgtacagtcaaattacctttgaaagaaaaagtttacttatcttgaagcttcaaagtaacaaataagacgcttcaaagtaacaaataaagcaaaactactagtgaagtgaagcgaagctaaacggggtcaaaaggtaggagctatccaattgggtcgataaaactagaatttaatccaagtggaagattgatgcatgcttttctctcttgtacgttacagcaatgggatatgcttaatttgttattgccttattgaaatgagtttatgtatatgtggacgtgacttggaattcttagctattacggaagcaaatattaatttacatttatttctttgttaaatttccttgttaatttcttaactaatatgatctcctgaatcctgaatccctgatcaatagcgtttctgccagggtgctgaacacttatacacaacatgatgggtaatactttaagaactttccatttatttatgcgagaattgcttttatttctaaggagcttgctcccataaattaatacaacctttagtagcgtatctataccataattaagcatagaaaaattgcttgcccaagaaacagctaatgcaatgtataaaaagtccatggtaaagcaaactgctaactaccacaagcctatgtcggttattctaagttctaaggggttgaatataaagttttcttttactacaaaaagaaatggaaagtagacaatcatagctaactgaattctagtgctagaatggtgtgctggagattctgctgttggcatttggtagttgagcagagtggttacacaaaccataatcaaaaagaagtttttcttatctcattatttagagaaattttagctttactttaaaacttaaaattgtaatctattacgtttaaggatgttagacgtatccttctttctaatgctagcccaactattaggcatgcagcaaacattttcttgaaaatggttggtcataacattagcatgtagcaaatattttgttcacattctatgccttttttaatgcatcctttctaaataactacttgccatttgcctttggcgtgaagaaacattagggaaaattttgaaattggaaagaaaacatccactgagaggaatggacataagtcatcttcatatatcttggggccaaaagtggatttgtttcttttctttgtgttactagtcatgtgggtttttatcccaaaggccaaaagattctatttggtgaaagaatcactagcactcacaacccctttgttcgtaaaacttgaaatggaatctcatatagcacagggcgtgccaatttggatcccccctagttttggcgtctctgtagactgtagctttatttcattttctgataacaagtggtgtctgaaatgtgcctacagagatcataaaaagaaaaagcatttttcaaccatctcatgtatatttcacctttacaatgcgataaaaaaaaaagttttggattttcttcgcttttagcatgagtatgtgcaattatttatgatatgaggagtaacgtcccattttactaccgtggaatgatggcagttgtgcacctaacagaaggccctttatacatgctcactgcttaataagtttagttcttgatatcataccgtaaagatatatagttcataacttcatatcgagtttaaattttgtgtatacggttacattaaatttttaaacgaaaaactttattatacatcgcggtcctatctggtttgaatagtaaaagatacctatggtcctttaaaatatctaaaactcaaaatttcaatttaaattggttcttaaaaccataaaccttattatattgatcctttaacaaaaatatataaaaaaaataccgatacaagtgtttttagttttatttttttctcattcagtcattctaacttataaacactatcttatgttaaattaaaggttatattttccttcttagatcaattggttgtctgacttattggaagtcaatctgaggaatgagtttcttagcatatttctttgacaactgcaagttttttacgtccagtaaatgaagagaaaatttgagtaaaagtctgtttacatataccatcaagacatcatatcctacatatcatttaatgtgacacctgagcatgtttattaatgttaagtaattggtgctaacatagggatcaaaatgactaatgcaatgcacttccaagaaaatttcatcaaatttctttagatttataaatttcttaagatttatatttttattctccaaacttttttgtattggttttactcctctaacttttttttactttaagtactatctattaacggggtaaaaataagaacgaaaaaaaaatagtaagaaaaaattcaaagactaaaattaaaatactacaaaattaaagaactaaaaagataa

SEQ ID NO: 4312 - DNA, 1758 bp, Glycine max
  Soy_ogl_2844 Gm08:41129995..41131752 Cluster 18
ctcgttatattgaatgttgattgaagaattggaagtattggttattaaaaaaaggtgaaaaaagtattatttaactgaatttatttcttacattttccaaaaatacatgtgtaatgtaaataaatgcctactagtagtttttaaaatagattttttcaaggacgtgtcaattttcaataagagaaaagaatattatttaaaatcagtttgaacaaagggatacgtgtgagtgggatgggtagtgtttctatgagcacaagtatatacaatgcagcgacatattgtcctcactgacaatgggcaacgtttcaagatgcaaagtgataatcacgtcactttctagcgattcatcatagataaggaagcaacaactcgtagaaagaaaacaaagaatgaaggaactgcagaaattaagatgattctatcagctatggatttttctccaacattaatataagggtatctcaagtctcatgtgagaacatgagaaaagataatcttaatagtttaattttatataaataagtcaaaactaattttatatcaagtaattcttaaccatttatgtaagattttttttaaaaaaagtaagattatatattgtcatcactcctacaatctcacccacatgataaagtcactttttttttatgttgtttaacaggtgtttactgaataaattatctcaaaagtcttgtccatataattaagagtatttcaaaagagttcaatggtaagtattataatataaagcagttttatattactattaaattacaaatcactttcgttataacttttaagataagttgttaaaagaacaaatttatgatattgtaacttatgattggatatttgatttctatatcctttcaagtgtttaggggaataaagatcaagtgaataagatacatgacaaattcatcgatattttcccatgtaaatccaaaaataaatttttggattttctatttttgtattaattatttttggagattaaatttaatgttgaatttgagctaatgctctctattgttaataaatttatcctaaatatttttggattctataatgttaataaattttatcctatatttcgtttgtcttaatgtaaaattaaaaataacctttttacaaaaaccataattttgtagactcatttttctcttcctcttcttttttaaattttgaattcatatctcatacaaagtatatatgaatttggttttaatcaaagacacataaatcgacaaagtcacctgaataaataatacataagcaacattgagctgcttcgtattgacgtgcattaattgttgagggacacaagaaaaatgcaaattagcaagaaatgatctcttgcaaattgtcgctaataagattagtgaagaaccagtatattgtaaaatccaagtcattaattagcgactgacaaattcccttgctattccttcacaaaatgtcccttgccaagctctcactatcttgcaaaaagtgttaccatgttaatcccttgctaattcctcacaacattctctcgttaattcttcactattctttcactaaaattcttcactattccctcgtaatacatgagtcatgttttccctctctaattctttactattcccttgcaatacatgacttatgtttccctctcaaatcctttgtagatcagtgaggaattagaagggaaattttcgttcgctaattcatgattttcttattgttgacatcaaactaaacatgttagtatgt

SEQ ID NO: 4313 - DNA, 2100 bp, Glycine max
  Soy_ogl_3148 Gm09:37174501..37176600 Cluster 18
tttggaaaaaattgtctagtgaggactacttacacagttacacaatatgacaccattcaagcaatacggtgtgtattgtatggtgaagtagaggaaaatttggatttttttttgtcacttctatgatcatataccaaaatttcactagaaatatatcatgggtcaagttaggagaaaaccctcccgtgcatgacttttaatttaaaggtaaatccttctgcaacctaatagctaaattgacataatttgcaacatttaatatggtaaaatatggtcttgatttatctatgtgaaagtttgattttagtttctctaatcttaatctcttcagacgtgaaaaagtttgattttaataactgtaaaaaaaaaattgattttaatttctcttaaatatatagcatgacaactataagactatatatggacgacagaaaataacacgccacagtgattgatgtgttaatccattgatcacatcagtatttaacctaacacagttagttcaacacatacacaaaaaaatctatttcttaagtgacgaaaaaattgtttttactttgaagataaaaagtaaacgttattctatttggagagactaaattaaaacatattaaactatatattgattaatcttcttttcctttaatttccatgatgaaaatacgcgtatatatcattctttcttcattccgttccatattctatcgacttcgaggtttaaattcttggtcctccctttgtttagctgatatacatcctccttgaaaaacatgtgtggtatatattccttaccatcgtggggttgaatgtaattttgaataatataaaaggctataataattagttgaactagaaatttgataaacccttttaaaattgatagagataaagctataatacaagaagtagaaatgcactagcttggaggatgcaatttcttttgccttttttaattacatggttctactctttcaatgtaattgtgatatatatttgagtcaagcatgcaaatgtgtgtgtataattatttcatatatttgtgtggcatgtaaaagtaactttattgttcatctattttctcttccccctccaaggggccccttcctttcttcatgtatgcatgtggattggtacgagtagagggctccaatgttgggggaattgagaggaatatatagacacaagacattgtcgtagctccatgaccactccatcatccttattaactgaagggctttttcccaacattaaaaatgaatctgcacatttcaattgatatcatatatatatatatatggtgcataactgcatatgcatgtgaagtgtaatcattccaccaagatctatggaaacttcattgttgtcatcctgattgtacacactacaattactagtaggtgtgtgtgcgcgtgttggtctttgtgttcttcaaaggatccatcacgtcggtcgtcggtgtatcaatcattcaattatctgtaccatttggagtcacaacaaactatatgcagagcagtgtgtgcacagtgcttgatttgattgatgcatgcatggccgtgaccataaattattgaataactctatttcttcttatagactttgttccatcttcttgttgattctccaactcaccaaataaagaaaggattacatgtattctttatatttttaatcaagatgttaaattaatatatcgtaagagaatattagattaattaatactctaaattaaattaaatatgtttcaactctctctctctatatatactcaatgtagtttagacatatatatatatatataatcataaaaaggataataatgaaagtcttactaaaaattaaaaataattttaatataaactgtttagttcttttctatatttttaaaaattaaaaaggataaacatattagttctatatttttttatttatgtcttgtcttttaaaataaaagtttagttcttttccctgtatttgcactgttttgtttgtgctatatatacctgaagtgaggtgatatgtacccacaatctgtgtatcaaacttgatttaagggactttgcttttttcccttaaactcacagcaatttaactgagaaa

SEQ ID NO: 4314 - DNA, 1400 bp, Glycine max
  Soy_ogl_3265 Gm09:43282301..43283700 Cluster 18
aataatgaaatactccgtgaacaagcatagataaattgggtccacaagaagaaaaattagttggtgtggaatttaaatagtcgcattcagaaagatggaccttggtggaggtggtgttgaaaaataaggggtcccgtgtgtgtggctttttagaagtaaacatatgcatcattttctctggattgctgtgctgccccaccaccatagtagccctttcatatcagttttccatgcactcctataattatggagaataatttattaatgcagctttaaagtaatttcttcgatacaatgatttgtttccagttaaaactattaattatttggctagagatgattttacaatttgagttcaaaggtagtttaactttaaaagtaatacttgtttttattttcttttatccatttgacgtaaaatattcacacggttaatgattcattttcgtaagaaaatttaattgttgtttagctttagaaatttattatttcaatcatattttttttattcataaaatttaaaatcaaaatattacttaaaaaaatcaaactcattatcacccataaaaaaaacttattaattgataatttttcttcatttatatacattattttaagtttatcattaggtaacgtgagatttttaacataattatattttctcacacacgtaaatatgtgaaatttataggacaaaatatttgtatatggtctcgtaataagctgataacatatgatataatatagtttcaacaacaactactaaaatagaccttcatgccaatctcaaaatatgtttgtgttttaaaagatataatatatgtacgaataaagcagctttgagaaattcatcaaaaaaaaaaagcagcttgagaatattcaaactcgaaatcacagtcttggattgaatgccgcttttgtggttgttaatagcattatctataattaatcagcataaatgtttaggtagtaattaaaagtggtaaggacaggaggtagtataaaattataaagtaccataaaaattaatctagtagtcaaaatatgtcctaattcaacgttgaatttaatgcacccgatcgactatgaaaactagaataacaaaatcaaaacctaactttgtttggtttggtgttgattgacttgatatacagttatgatcacctgaaatttaattattttttgttttataaaatatcacctagcttataatattaccaaaaaaatcaattaataatgttgttcacttttttattaatagatttaaagttcaattaaaaaatgtgttcgtcctatttcttaatttttattagcttttattttcaagaacttaattttactatcaagaaaaaaaagtattttagttcacagtaaattgaaatgggctgggatcatcttat

SEQ ID NO: 4315 - DNA, 1229 bp, Glycine max
  Soy_ogl_356 Gm02:3620072..3621300 Cluster 18
cctaaatattagttgcataaaagctttcttatgtgttgaatttaggtacgcggtgtaattttgtttttcaaacattgcctaaattaatcgtacaaacaataaatatatatatattttcgataaccacgtagtatatttctattatagacaatctttccgctgtgtacactgtatagtaattgaaacgcgttttatttaaaaataataataatataggtagagctacaaaagggaaattaaagggggtggatatcctggaatcaggaatgtaatgaatccactgtaagatgcaccaaaactcttaacggttcctcctactttgtgccgtgagctatggttttacacgcaacaaggcaacactctcaaaaacgtgtgcctacatcttttatgtataacagtataagatggacaaacaactcaatattaaatataaatgaatttagggtatgtttagtttggcatttcaacattcaaattcaggtttgattttcaatgaaagttccacctatttatttgataaataatattatttacttaaagctaaaattgagtccaaaattaatctcatattttcttcattcaacataaaaaacttcaaatatagattaaatggattaattaagttatattaaatctacttttaacaaaactttagatttataaaattaagttgaactaaattttatttttaaaattataatccaaacacacactttcaactaaaaccatttggatttgcaattgcgtgccacggcttctatatatatatatacaccaatagttatgataccattttgctgtctctatttctatctccatcagacaacttttcattaaaatccttctgctcctgatgcttaccaacgttgctgtgaaatctgcttttgcattttcccttctgaggctggggccagtagaatagtccagacatggaggacacgttttatcagacatggccccagcatatcccgttgcatatatcttttgccagatgaacaagatacgctcttttcattttccttggtgtctattttttatatgttaattcttcatttataatttacagtgaaaaaaaatgaaatgaacgattaaataagatagaatttacacttttatattttatttcatttcactccactaaacactttataaataatttttttctcaacattttacattctaaatgtaattcctccatctaaacgaatttccaaatatacaaatattca

SEQ ID NO: 4316 - DNA, 2000 bp, Glycine max
  Soy_ogl_2223 Gm07:5957101..5959100 Cluster 18
tttatatatactgttatcataatgtaaagcatttattatttttagttttattgataattaatctttatttaataagatttttactcccagctatcttttaccatctggatgatccaagtgtttgaactcaaaatttttcttaaaaaatctgaacttagttttcttcaaaccaatataatgttgatttcaagaatatatatttgatcaaaaagcctgaataacactaaaatgaattatatgaaaataaaataactcattattattcgaaggaattaaagtactctctgtctagctaattttcaagtactctctgtctcttggtctattggtggtgaaagcttggttgaatcttgtagtagactatatttgatatccctacaacaaaatgaatgtgtggctaatatggggaagtgggttgagactaaatgggtttgagattttcaggggagaaggaatagatttatgtcggaggaaatgttgattcaaagcttggagaatatttttgctcccatcaatgtgtctcaagtagtttcacacgaggatgtgaatggcggaggtatgggaaatgtgttataggtagatatgaaaattgtttttaaaacaattttaagtctataacttgagaaaaagaaagaaagagaagagagataagtaattaatttaattgatgatgtactctaataagaaaggaaagaaaaaagaaaattgatgattgaatgtttcaattttttttgtcaaaacgtaatcaatctccatggatatataaaaatattgatagcttatttcctggtacagtggaggcacattattggcaacgtgacatgtgctgggaatcgaaggagaaaaggcaggtattgaaatttgtgtgggtttctatcatttggtgcatgtgatggaaagttaggattaggaacaattgtatatttagaggaggtattgttgaggcgggtatgggaaaatgtttttttcttaatcaagactcttttaatatttcaagaaagagaagtgtgaaagatattttagtcataaaattattattttttatcaaaaagtaacaaaaaagttttttttatcatgtaaaggaggtgagtgcttataagagaaaagaatagtgtaatggaggagaatgtaaacaatattttaataataatttttttcctaataaaagttaacggagctttgccaaaaattttaaaagtggagtaagatgtggtatgtttttaggatttaattaatatacattgatacaataaaaataattacagcatcaactaatcattaaatgtcacattttaaaataaattcagtcttattatcacaattatcttacaggttacacattttatatattttaatggatcgatagtataaaaagttttatgatttataaaaagtgttacaataaacaatgtaaagcaattaaagtcatatttttatttgtcaaggcaaaaggaatgtgtatttttgatatagtgatagagtaaacttaacgaaacagggagtgaacataagaatcccttaatccgagcattgcaacaaaggaccaaatgaatgtaatctttacatgtagtctaattttcaagtactctatatatggcccatcgacccccaaaaaagtactatctgttttggtaatcgtctcaattttcaaagttgaacccaaaaggaaataaagttacaaatctgtcggtgtggaacgataaaatgatccatagtctctgaattttttttataagagcatttttgaattgcaaatttcctctctcataaactgtgatcaatttcttttttaatattatgtagttgccaatagaaacaacttcttctgttacgttagacactaatgatgtttaacaatgcttataaaaaaacaaattcaatagatataactttgaaactttatagggaatttgatctgggcgcaaacttaatgatagtagtttcagtaggggttaattgggtaatcacaagggatcaatgggacaactaggaaaaaaaat

SEQ ID NO: 4317 - DNA, 1530 bp, Glycine max
  Soy_ogl_4452 Gm13:34821171..34822700 Cluster 18
gcccataaaaatatattatccaaaataatacatttaatttatctaaaatgatatataacagttataaacctttttgttcttcacttttcattaaatttctttgtccctcaactcaatattatttttttatttaatttttcgtctctctttgttttatttttagaaaatgttgagaggaacggcttatttttgtggaaaaattatgtcattttttattttattttttctcctataagtgtcgatgcagaaatttatcctaacatgtcataaataggttatatttctttgtttacaagcatttgtttaaaattatagctggttaactagatttactcttgtatttttttaaaaaaatcaaaaaatatattaaagaataaatgatattttaccttattgttatttttaaacatatgaaattaaaatgaatttttccttgaagtttataattttggaaaaaagtttctacattcttttaccggttgtgtgtgaacatgctatttaatcatttaatgtagttgattcttttttctaattgagtggtgacagaatgtcattcaagatagttactgattctaccttagaattacgaatactacaagcattcccattaactgggattctaggaatgtcaccagagttggatgctattcttttggaccaaaaatttgtgtctaattaataaaatgccagcaaattaagtgtccaatgtatggaagaatcaaataacatagtagagagagaggtatgctatgcatgagcttaattgcttttcttttctgttgccatatggcttccaactccgaaacttaaatgcatcggcgcattgattgctagaaacaattttttttggtgaaaaaaaaaggaataaattcaaagcaaaaagaaaaaatagtcggggaataaaaagtcacagatctataaatattagaaatattagtaattagtttggataacaagttaataatttgcaaatcagttaaaccatatccaaactatgagcaaccacgtggatcgactctttgtgagcttggtataacttaatggagtacatgtttgtttagacaaaaaaaaaaaaaaagatctaaactgaattctgtatattatatatttgtaatattaatgtaagtctctagtagttaaaatatatgcttggttgaattgattttttttccggaaatttaaaagggtagttgatagtaagatgagtagggaataaatattgatttaatgggagattatgactttccaaaaataaaatatatctaggaataattattttatttattttattactttttttaaatagttattttgatatcatgtaataaatgtgggataaatttcttcagtcttatatttccaaaaataaatatatagcacttgaaataaaagtctcctaaatatctagtgacaatgtaaatactactacataattttcttatttatcaaaataaagattaaatagcagtaaaaaaataaagattaactcaaaattgcactgttcattattatcgtgtttgaagaaattaa

SEQ ID NO: 4318 - DNA, 1979 bp, Glycine max
  Soy_ogl_5467 Gm17:2750501..2752479 Cluster 18
aaaaacttcaatttatgtgatttaagccacctactcaaatcctagtctcgaatcttaattaacaaccaaaaaaaggttgcatttatcttagatataagaatgaaataaacgcaaaacatgtttttactttaagcggaaggacaaagcaaacatgaacttttttttttagtacagaaaagcattaacttttttagttacggattgaaaataacttctgtatattttgagcgcaaacaaggccaccgttaactctttgtaaacaagcaacttgtggctgtgaaggattgaactttttataataataataaaaataaaaaaaaaccttgcaatcatgtatttttccaccccgctttcatcacaatgcttcacgcaatgaatgatcaatgaaaaggatataccgtggacaaactatgttaatgaaatagaaaaatggtgatgttctcttctaactaaggtcgaaagacgtattattggacatcaatggcattgctttgttgatgcagtgagcgaaggtggtggtggtcaattgtagaagttccaacacccaagtaaaagaaaatatcagattaacaactagttataattaaagtagagaacgtatttggaaaagaaaaaaaaaaagtaatgcaagtatagaataggagtgtaagggatgatatgttaactgaccaactgacacatggttatttcaatttaattaggagtctcagatttaaattttgtatatacaattatgttaaatatatgtcaaaaaaatattatttataatgattttatttgagttaaacatgattgtttttttacagaagatacttgtggtatatatatatataaaaaaaaaaagagtcaccatctcgtgttagtagtacaagtataactatcataaagaggattgttacattacgtacacataggaattcacattaaatatttcgtacattcaatgttcttgcatgttgtcagagacagtgttctacaagaccaagagccacgaacatgcatgaccaagtccaaggcaatacgatcaggcaagagccatatctaaaatagccatactaaaatcacattagctcactgaaaaatttctattatttatacactttatttacttaggaaaaaaattaaagaataaagtgttgaaacatatcattttctaattctatcataaatatatgcatggtataagaataatgtattttgtttttaagtacaaacatccttattcgaataaattaatagcacgaccaacactacgtttttctatattttgatggatgctcccagcgtccattgagaaaaatcttttacatgttatatgttgtttgctatgaacatttaaaaaataaaatgatttattttaacagtaaaagtctaaaagaagagatatatttcaatttcaagctattacattatttagtcagtttagattttacataaatggaattaattaaatttatcaaataacgtattattaaaacaaaataatagtaagataaaaaatttcctgataatgtatgaaaatccaactccttcaaatattctgctcattaaggtcaagtccactttgaagagcagcttgaggttccaccttcttaattttcttggtctctcggggcccgaaacagaacataacaaagaagaacgatgtgtttcgggaacccattactattcaacaaaatcaaatgacattgaacggggtcagtggaagatcatatgaatgttcatactaataaataaaagtattcaggataacagattgatgttatatatctaggtaaagaggataacattaagttacttacttttttgagggatcaagaagtttaattttccctaaataaggtcttagttttagattttaccaataagaagaagcttcgaaaagaatttaattcttctaatatatgcatatttatatatacttgagttgaaagttgcagagttactttctagtcaaaatttgtttgcacaacgttatc

SEQ ID NO: 4319 - DNA, 1400 bp, Glycine max
  Soy_ogl_6571 Gm19:44761801..44763200 Cluster 18
taatttgtggtgaatttaaaaattgtgtgatatagctagggttatgtatatttacgggagtgagttgtcaaaggctaaaaaaaggcttaatgatgagaagtgagaaagttagaggatatagatttaagctgtggtaattaaagggagtagcttttcgggctgcgaaagtatctttgcttgaatcattgtatcattcccagccaaatgtccaaaggtgtttcatgcacatataggcatatagccgccgggtcaattttcgattctcattcctctatgttgaaatggtgcagccattggattgctacggttgtgattaaaataattcttaaactgtactatcacatgatttctatctacggaacataagtttttaatggtttatggaagaaataaaacgaaagtagtttctctcacacacaaattttatgttaagagttgtaaagttgatctaacattgaagagataaagaaaaaaaaacaataaatttaaatccttcgctatcaaaataaaacctaataactaatatttactaataaaacatatatattaaattcaatgtataattgcggatgaaaatttgaaattaagtaaaataatggtgttttatagacaataacgagtctagtaaagtgacatacactcaactgacggacatttaaaagaagctcgtgaggtaatattattcgtacaagttctgtgactcacattatttgactatcccatcaagtgggattaatttaagaaaatgagtcaacaacatttaattaaggagaaattctaccaaaagataatgaactagggaatggaattttagagtcactatcaacgcaagtgcttattgttggtgtcacggaacagcggaatattggaagctcaacaactcttctttttcagcaaagtatcaagcaaaactaatttgaacagtaataataacgaagataaaaaataacatgcatattttgatctcaattaatgttaaattataataaagtgaattcttaaataagcttataaggactgacggatattgccagtttcaaccaagctccgtcactgctcataagtcagatgataccttcatgtaagttaggttagatgtttataaaaaaaaccttttaacataaacatgtcaaactttgattatataaatttaaccaaggatagactcagacctaataaaatttaatatgattcgacctattttcatgactagttgctatcgcttattgtgagaattaattcattcctattgttatatggtaaaataagattttcatttttaggaataattttttaaagttctttaacatttttcaatttgttaatgtcaaaaataacttttgttcctctgaaccttaattgtttacattttaaaattaattaaattaccttttgaaatt

SEQ ID NO: 4320 - DNA, 2733 bp, Glycine max
  Soy_ogl_3 Gm02:49335501..49338233 Cluster 18
atgcaaggcagaattttaaacgagactttttttaattaatgttatgtgtttttttttccaagaactaaaatttgaaataattgtgcgcctactatatcagtcatcatatatatatctttgtcattcttagtttaatattttttttttttggttattacattatatactgttacaagctcaagtgtgttgatatggataggatagctgtatcttaggtactgtaacaaaaagtattgtttattttagtatttagtggcctataacaattttgtccttaaaaattatctttgataaattaaaaaatagtatttatgaattattacttttgatctttttctaagctcaaagttgactgacatttttttagagatatcacatgtaaaatattattagcttcaatgtttgatggtctgtgacagttttattcatacctcaataaatcaagagataagcgtctataaattatcttccaccttaggtgatataagatttttagtgtacctaaacatgtacattaaagatatagtttaccttttgatagaataaaatattatcattttcacgtgaagatgaattttgataattaaattttgggtaaaatgactacatgttcaagatattgtttttgcattcttaattatcaacgacgaggtacttctcatgctgtcaggtttttgttgtcaaatgtagcagttaccacttttcaacattcttagttaacaactctttactaaatgccatcgtcaaaacacatagttatatatgtacatatataattcgccgataaaaataatgtacatagttcaaaacaagtccttatccaagtcacaataatcgttggcacgtatatttatttatttataactactaagaatggtaaaacttgccatcgcatactgttttgccaaagttcttattaggtggtttttaactttttatatgatgcacttgatcaatagataattgttcagtcaaagaaagggaaattaatgaacaaattaaagataataaattttataagcatacttactatgaccacatacttatccgtttccacagtatatatatatctatgtatattggttctcctccatcatcagcaatgacaatgaaactatattgaaatatatcccctttgttcattgaaaagttgaaaaactcttaattttgatcgtatgaacatcattaccatcgttgtcaatttcatcattagtctcaacctctcagccgttataaacatcatgcagccgcagtttctctttctcttcatattcatgaaggaaaaaaaaagtgctttgtgggatgatactaaatataattaaacttttcacttgggcaaatttgaatttgtctgattgagcaatttgcaggagcattcttaactaggtccccattcaatttttcccatgtctaatacaagtcaattagaaacaatttagcatgtcatctttagacaaagcaatgatgatgttgctagattaatagactaaaatccctgtggccaaattgtggatcgttcttgctaccttcttgatggggataatggggattctcttatcacataaaccatttttccatggagttcaatggggtggcttgtgtttaagcattcgatttcatatatttttgggtttggttagcattatgctttgagttatcctaatatcggtttttttttatttaattagttatcctaatattgtttgatgtctaatgaacttataactattttgataattaataatacatatgttttttaatttacaataattcattatgcttaactaggtgaagtaaattcattgctagtataatatgtgaatatagttgttgatatatataattggtattagaatatatatggttcaacaatcaacatcctttagtttttaatataattatacttgtaatatttaaatttatatgtcatcaaactatggaatcgatgaacacattcttaatcattatcatgtatcaacagatgacccgatagggttaggatctacaaaaatgaccttataaaatattatattagcttcagcctctcatgtgaacccctacaacatatcaaaattataatcctaattggctgtagttgttacgacagtcacatatatatgcttagattttattttaagaattacgtacattgaatttataaaatataaacaatatactctttatattttaagcaatttataaactaaacattttcaggtacttccattttcagacacatattttttaagcaatacaaaattaaattaacattaaatatttacagacatatagcaatgcttatatcatccaacacaacagtaagcagattaagctgaatggatcatatatacccctcctatgtattctggtcataatccatttgtcgttgcttgtttattttttcggctgatacattattgtggttgcttctaatttgaaggcttttgaatacttcaattcatcatgatatcatcccactcaacaaactacaggtccatatacattccggatcatgattcgtgcgtgcacgaatctcaccattcaaacgggcataatgatgaaaagctgacattgatcattcctttttgctaatatgattattaataatataaagttgggtgtctgcgctagttaatttgttgtgtgaaatggaatatggtttggtattttgtttaaacttgaaggaaaaggtgaattgatccattctttaaaaggaagatttagtcattacaa

SEQ ID NO: 4321 - DNA, 2956 bp, Glycine max
  Soy_ogl_2854 Gm08:41672145..41675100 Cluster 18
gacaataattatttcaggacatagaaagtaatgtttataaacactatcaaaaacttggaaaaatgagtagttgttaataaaataattaaactaatctaaagagaagcatatacggacgtagtgttggtatgtatgagtagaactaaacttatattagatgttttaggtaatattttatgtttaagttttatgaataaaaaagtgataaaaatcaaagaaattctattaaaagttatcagtcatgttttttaatatagaccaattaatcattagtaaagttgatcaatatttcacaccaacaaaatgttaataaaaaaatctaaggaggagcattaataaaaaatatttattattattttttataaaaaaaagctatatgttatgttgataaaaagactaattagtaaatatctctcgtttaaagtaaagaattttcttacaaaagtaatttgttttaggtttcacactcaccattgtatccatcttgagcatatctaataaagtttttgcaaatactatatcatgtttattagataacaatgtaaaggtcttttttccccatcaactatacatagagtaaatttgcagatattccacatgcatttttattcattataacaaaagaaaaagcaagaaagagagaaagaaaacatgtgtggacctggtgtgttttctgatgaaaaattacaaggatgcatgtgatgctattcaagaattgaggcgggttgtttagttgattggaactttgtaagttaaagaagaaagaacattctcaatggcaataatagggaagcagatagaacctaaaaaaaattaaaagagatgccataagtcacgactcaagattacagtgctccttgatctgctactcaaatgcaagagaaggtgttgggatattgcatactttactgcatcacgatcactttgaccttgtgccatcaaaattgcggctatataatagcataatgatacgcaccaatcattcaacctttgaaggctaaccattcaaattttgtgtctcatttttcgtctctgataatgttattcttaaaattaatgttcataatacaataatgcgtaattaataataactttcttaaaagaaaaatactcggtctcttttagtgaattgtgaataatatgaattagatgaatatctaaagtaaaaaaaaatgatttcagctcaccattcaacattttcactaacaaagacaggtgaatacgtctccttgtctacatacatagatacacaaagaatgaggtatgcatccaaccaatagacatttaagaaaaagtgagcttatatatattaatcaatttgaaaataaaaaaacttgatgtttagctgcattgtcaatgtcatcgtttcgtgctgtttcatgtagtatttgctttcgtgtatattatgataaagtcaaattaaaaaatcactataagaaaatcaaagaattagtgacgaaaattactttttcatcattaatatcagtactgtcacataaatttggtggtaaaatttaaaaaaattgcaaataaattatatatttcattactattttttttttgccgtaaatgcttaaaattaaatttttgcctgtagatattgattcagatataataattgcctttcttaaaaaaattaattaattagttcggattcctgcaccctaagcaatctataaacaccaaaatcaaacccaaaaaaaacttattattttatatgttttttgtatcatggaaatgtggtatcatgttattcaatcaagatgacgtgtaatttttttttccaattctgtggcagatatttaatgaagcttatttaatattgaaaaatatgtcaacaccaaaaaatattgacaaaaatgttaaaattttttgtaggtgaattttttttatcagcaaaaaaagaaattgtatattaaaactatgggcacaaggtacttatccttttcaaaaaaacagtgttaagttacccacaaaaaaaaaatgccattctgcagaatgtagtaatctgcatatactgcatactgttaaaaatgtatcatattctaagaaaaaaaaaattaatgcatcatcatttgattgtagaacttataagaggaagaaaaaaaaatcaattttatattctgaaatgtcccaatcataacaactagaaatttcatgaaataagcattcatcatatttataaaaaaacacgtgattttcaaattttgagttgcaattcatggataaagaattgcctaactccatttcttaccccttttcttatttattctataaaaaaatgttatgcgtgattaaaaacatcatattctatatcttcttcttctcttgtttttgttgaagtaccatttctttattagaggaacaagaaaagagacacacaaaggggatataactggtttgaatccacaattgatatactacctaatagttccgtaattgctttgttatattattgagcaactgggaaacaaggaatgcgtaaaaagaaaacttgatgtgtataatattgaacgcaacacacaaaacggctactacaacaattgcggccacaaattacagcacatttcaatcacgtttttgttttgtcctacatacactatactttcactgatttacgagtctttcctatcctactacgtacttaatcgatattcttttcgtttactttttctagtatgtgaataattcccatgtttatttcgtctatgatggctttttttaatttatcttaattgtcattttttcatatttcatagcttatattaatttatcctcaatcaagtctaaaactagtggacaaacgaaaatcttagctcgtaaaattgctttcaataattatttattcacgagagtagtttgatgagtaagtagaaaagtggctacatgcatgttttgtcacggtgggggaccattaatttacggcatgtgaaaatagaagcaataaaaaaatgac

SEQ ID NO: 4322 - DNA, 1475 bp, Glycine max
  Soy_ogl_23 Gm01:1480301..1481775 Cluster 18
gatccatttggttctttattttttcttcggaggttcattaccattaatttgattattcatatatcttcctcaaacaacccttaaatcacttcactaggctcaaaaaacgtctctagaaatcagagacactgaaacagtggaacatttggaagattaatttcatttcaaattcagtctcacttctactttaaatagttcacttcaaatttgggatatatttatgttttaattcatgtactgattttatttttttgttttgttttgctgaggattgtttcggattcggcgcagtttcttgataatgtacaacttcgtgagttttggcttactattcttgaataaaaaatttgacataattgaatctatatggagtataccattaaaagggtattgtttcaaatatactactatctcacaacgaatgttttatgttaattttatactagagaattaattataatgttctgtaacactaatataatgtgaattaataatggctacctttgaatgataatggtggcgagtgtggtattcgttaaagttgaggggtaggtggtgacggaagttgtcaggggccagagtcagtatgactttatctttatcccaaagagtctgaactgtgaatcattcattcataattacttccttttaatgcttttggccttagcaggatgtgacgtttgctgaaacattttatctctgttgtgcgacaacaatcacaacaatgctttgccatgtaatatatagcaatccacttttcctctctttataattttttttatatatatatacacctacatcatgcatgtggaccacttattcttcttcttatattattattgttcttaagtaacagactgactaaagagaagagaaccctaagttcatgagagcaagatttcaaaaggaattcagacatgcatgccagtggctttgtggagtgtggaccattcaaaattgaaaagacaaaaaaaaaataaaaatgatccattttatcaatatcttttattaacttttacacagtacaatattttcttaatcttcttattgttatgtgtcacgcctacggtgacttgctggcttttgttttttaatgtacatggttatgcgtatttaatttttttcccatcttataacatctcctttggatccatcaatttttttgcagtctctgtttgttgtctattatgtgactaatataattcagtatggttgactcgcatgccaaaaacttaataaattttggtcagcattgcagtgacaccgtagacgtagaatgggtccagtgtgtcaataatgtaatgtgccattaattaaaaacagacgtatgtgtacgcgacaaccatttatttaaaacacatacaatttataattgacccattcattacctacatgcataatgggaaatatctctactgaagataatgtgttggcttgtctgcaaatatatactgtatatattacatgtgttaatc

SEQ ID NO: 4323 - DNA, 1400 bp, Glycine max
  Soy_ogl_62 Gm01:2679101..2680500 Cluster 18
tcgctttggttaccattcttgtcttatagataatatttttctaatcattttacaagaactaagaaatttaattatttaattaatgattttaaatttgttaacaaattgtatttttttattcttctaaaattactgttatggagctattttgggcttggtcacctagcccagggctgcgataactacatgaccactattcctgcgatttactgttacattgggcaccacacacattcgtgaattattttgacaatggagttaaactcgtgatgttccaacaatatatagtcattcgatacaaatacgtatcacccaatgatttccaattccgtgtatatcagattcagaagtactgtgagtatgagacagacaaggtagctcacaatcttccaacaacaattattggtaattaaatagacatacagatgtacctcagggacagattaatgaaacacaatatcttccaacaacacattgttattcattcaattccaatacgttgcactagctctcgcacccaataaattgaggtttcgtatatctgaattgagacatattgaattcttcatttaaagttcatatcttattttccttacaatatcttttaggctattgataaccagtatccttacaacataattaaaaaactaaaaaaatatttaatataaaaatcataaaagagcgtaaaaaagatcataaataatacaagtatatcttaataaaaaaaattcttttaatttcttaaccaataatctaagtgcactacttaacactaaccgagctaacaacctactaggaaacagatagggaactctatagtgtaaatgatagcagtaagcttacgtgcacacccgaagtttaacattcacccttatacagcataataaaattaaaacattgttaaagaagataataaggtaggttcttgttctatttttttttaataaaatttttaaatcaaatattttaaaatttttttctccgtggatttttttttttcaattctcgaataatgaacaccaaaaatatattttatttcaaattgttattttgtgttattttttcttcctctaaatctcagctacttacacggatgatacatcgaaaatgttttaaagtgatacaacttattatgccctaagttaaattcaaattcttaataagtctcgtttgccttatttatttgtgtttgacgtttggacttagggcataagtaaaaaaacttgaaaatttaagagtaggtgcatgagttgacccgtatggttagtaccagctaacaaaggttaaattggacataagaatttctatccctcagatatattgaataattatgcattccaatctaatctaaaatagtttgaacatgcaatgagctagttcgaatagatccggctaatcag

SEQ ID NO: 4324 - DNA, 1421 bp, Glycine max
  Soy_ogl_192 Gm01:48074080..48075500 Cluster 18
cacttctgcatacatcttttttgtaagtttattataaagaaaatctttaaataaagtaaataaaataaattatcttgaaatcactttttccttatcctatttaaacatacatttcatataatcaattacaaagttattgtatctataatgatattgaaatgatttattttataactaatccaacacacacggttataaaaaaaaataaaaaatccaacacacggttataaaaaaatccaacacacacggttatatataaaaaaaatccaacacacacggttatatataaaaaaaatccaacacacacggtatccacaaataataaatgaaaaaattaactatttaggaaagaagcagtgcagtttcaggaaaaaaaaaaaatagggacaattgcatgaggaaaaagtcacttttatgttattgtaatattttcattgcctgatgggttgatcaacttttgacaatttgggcagataaagatttgaatcctttttgtgtgaaaggcgtgctgggatattctctaatcaactaataatttatgtttctaaatgcttgaaaggcgcaaagggagagaattattatgtcttgcttttgctttctatatttgtagttgaaggggatgtaagaattcaatctggttcccgaggtagttcttttgtcctctcttttttcttttcttattgcaattgcaacttgcaaccattgtgatggagtctttctttcttcaatctaaatttttctattgtggcgtccaaaccaatagaaaactctaagctcagcccccaggtggagttggataaatgaacctaagtccatagactgtgtcgtataacttgctatttatgagttaagatcaaagaaaaaaaaaccctaatgtgagattgtttcattttaatcagatttttatttttaagtgtatatttatattaaatactcaaaaaaattatttaattcaagcaaaattgtctctaaatttcagtgtgatttagacaaaaaaataattaagaccatctaaatccaaatttttaaggatttattttggtcagttcaaacagtggatttatgagtaaatttacgagctaaaatgttttttaaatgatataatttgttatttttatagtttagtaatctaatttggatggattgtacttgaagacttcgctacgagacaaaaaatttcaatcgaaatcgaaagacacgcgatccaatatgtattagaggaagaaaatcactgactagtgcaattccaatccaatgggttttcgtcacccgactaaacactacatttgtttttaatctctaataagtcacaagcattttataaaacatggggtttgctaaaacatttcaactgaaatatgagtaaaactaaacatacgactctaatgtgtttaattgtaatacggtaatttttttgtcct

SEQ ID NO: 4325 - DNA, 1200 bp, Glycine max
  Soy_ogl_229 Gm01:49575101..49576300 Cluster 18
taatgagagagagaaaatataagtatgatagttgatataatgtgatagaaagagagaaataaaattgttaccttatgggtgtggagtttaaaatattggggtgtcaaaatatcatcgcttgtgattaatgtattgctcaatgctctcatatattggaatatttcctataatcctttaacaaggtgaaccccaagaaaaagaaaattcatatactcctttaatgttaactagttagttacccgctaggtagcatgaattgtgttggtttttatacatttcagatataaagaaattatatttcaaaagatgacttattcattttgataatttattgaaacaccattttgattaaaaaaagtttgtgtgttgctttctccttttttggtattttgttcgtgtgtattttaggtgactccgtcaaatgtcactttcaataatttattcaaatgttttttttaatactgacttatgatttgttgattgataccaaaatcctattacaaataacttttctgaataagattattgtaaatgggataattaaagacaatgcaatgatggattgcaaccaactgaccaagtatgtctcgggtgcaacaatggaaatttcacctcgatgaatgtctgaaaatctctgatacacgactagacttttcaatgttttcatcaatcggaaaaggaatctgcagaggatgttatgaaaaaaataaataagatcaaataaataaataaaactcaggtactggtagaaagcccacgcgcatggggttcatgttgtcaaattggtttgttttggacaaggaatgaagtgatgaaggttgtttttcagataaacttttgatgtaggttatgccgtgtttagttgtgagaagaaaaatgaagtgcataaaaattagaagacaaataattaaagaaaaagaaaactagaatgaaaataaagtagaatattatgttatttattttaaagagaaatatgtgagaaataatgtgaaaatagtattgtaaatttatacttatttgatttgattaaaattgaaggacaaaatctcaaaacgttataatattattatattcttaatataattaattaaaatgcctaaataatcaatcaaacatgtacacttaatcgactatataggactgtaaatcgactaaatttgtgtatataaaaagagtaatgtgttttgtgaatatgacgcg

SEQ ID NO: 4326 - DNA, 2000 bp, Glycine max
  Soy_ogl_310 Gm02:1220301..1222300 Cluster 18
accatgagaaatatcaaagttcttaaaaagttcgccgattcattaattttaggttaaattaccttgtttacttttagagttattgtagttttatacattctagcttagtctttttagttgtgatttttatccttttatcctcattatcaagtttcaaactaatgttgtttgaagaaaataaatcatgttagttgaaactcgacagcttttaattgtgtcgaagcttgtttttctgctatattcttaattcattcatatttgctatattcttagttgaaacttgatcatgaaaattaaaagagtaaaaaagttgaaattctaaggaccaagatagaatgttttaaattatataaatatttttttaaaaaattattatagctataagaactaaaattataactaaatcttaatttttaaaaacaaaatatactaattggattcagtagctgctggtggcaactgtggaagagaattatgaagtcgtgtacaagggaaaaagtggtcagtttttcttaatcagttctgcacacacatatacaacaaaagcaaggtgtgtaatcagcactcaatacaagaaaacaaaggattagagacgaaacgtcaattcaacatttacccttcacaagccttttaccttgttttccgtactatcaattttgtttgaatgttcaagacttttaagtttttatatattttaattgttatacacgtaataataatgctattgtaaaaatttatacagcactgtttacgtatggcaatttcaagagggtagttgtggggaatcaatgaaaaggcttcaacagttcaacctcctaagcctaataattgtcttttgtttgaggcgtgctttctgatacacgcaaaagcttgtgcatttcttcttctgtgtaagagatgcatcattacacagattccctcatctcacttaggaggaaggatccaactgttgcctgcagataaaagtttgaatatatccacatatatatgctgatttttttcttttttataaaagaaaggtacttaaaacgtgagagaatattattcaaagagacaaaaaagacccttcactcagcaaataacaacaaatgtgataactgatgacgaggtcaaactgtgtgccactatgaatttcccatatgaggggagaaaacaaggctttctcaaagtgttcattaagctacttttaaaattaagcaaaactgtgtgtcatggttggaaggtgtgagttgcttatggaaaaccatggttcagcttgtccacattactccaatacagtaaaatacaaccaagtatgagaaagaattcgaacaaaaattgcagcctcctggagaggaagacaatttgcaaaacaaaaagtaaatcacaaatgcaaaacagattgagtgcatggttggaaactcattgaaaatggaggaatcacatttgggactaattaagaagctataattaattattagcttctgaaaatcatgtttgaaacatgaaattgaacacgctatatttgaaccaagtgtcttaagcatcagttctactgtccatcgcatgcaatattattactattaatggtaaatagatgtctcaaatggccattgaataaatgctaaaaggatttcctttttgtttttaagaataaaaacacagatttgggatgatgaataacattggtggaacagaggaaaacttgtcccgcacatctcctatttctatcattcatatataaacaacaaaatactactagttctgcaaaagcatggattatattatatagtcgttaaactttagtaggtatttttgaactgcttctctgactgtattattttttcccgataactttttctatttgaattttaatattcgcatttaaagcatataacaatttaatatatattgtgccgaaagaaaaggtgcatctcacgagggtaccatttctttagttactctgtggtcagaacctttgggggcctctacataagaccttgctttgcttgtattgtgtt

SEQ ID NO: 4327 - DNA, 1500 bp, Glycine max
  Soy_ogl_376 Gm02:4480601..4482100 Cluster 18
taaaaagtacacacatatatattaaagtgtatattttatctttccaaaattaaaaaataattatacttaaacattcgttcagaaaaaaattgtaacttattttgtattaaaaatattagtaaaacattttatttattattagtgaaagatgatgtgaaccttactattttaaaaataagcactcaatataaccaataaagttcaacatagttaatagataattaaaatttttgaacatcttaataaagatttaattccttgatcttgcgtatgaagaatattgttagatgagacaaaactaccactcaatataaactgtgacacacatatttaatgagatttatataaattttaattaataataaagaatattttgagaaaacgtgttaagtactaatattttctcaaactcttatttttttattatttaaattttcttatccttacacaccatgagaaggttatgaaggagcataactgcgtgccatcataggcataatttttctatttttgaaagaaggcattattgttttggtcacttagccatgttcgtcatcctttttcctcttcaccctattctccaaaagcgagaacgtggacactcactgttggcctccatatatgagcatataatatccctttcaactgagatcgagccggcatgtgttcatgacaattactttttcattgtgctactgccaatcataacacagcatgtttcgtttcgtattttgggcaagttctccaaaggtgataaagtattaagttaatttcttatcacacccgatattatttcatttttaatattactgagacccttaaggaagggttgatataacattttttaagcctaaaaggaaggatcggcataccaaagccaaaaatcaaaagatttttttttaggaatcgaagatggaagatatcggatgtaataaggataaatctaagagaaattaataatgtatcacggaaattttttattgattgagcatgtaaattttttttacattagtaatgtatcatgtatgactatcaaagtcaaactcaaagaaactattattgataacaattttttccccccacgttgtggtttccttttcttcgttgatggagaggtgaggaagacaaattgatatggcttttatgtgcattggatatgagggggatcctacataaaccctggaaaatattttaccgtgatgagttttctgaaattttgtagcactgaattatgtgatcaaggtactagattcccctaaacttgttttttattttaatccattcatcgaattttatagatttgttttctttaattgatttgttggactctgaactcttacgtaaattggttatttttcgggttctttaattgatttttaatcccctaaactctgaactctcttttatttgtttattattttttttttcaacttaaaataacctgtcacttagaacggagaaaatatgtttttgaaaccatttcaagacaaaatatttatc

SEQ ID NO: 4328 - DNA, 1900 bp, Glycine max
  Soy_ogl_940 Gm03:37715001..37716900 Cluster 18
tgtatgtcaactaagttagttattaatgtagttctagcaatactctctctcacataatttttatcaattaaaatttattaacaattataaaatctaagagattcattatataaaggttaaacatataatttattttcaatttgatcctcatacataaaaacttatttaaatcggttctgcacgtacaaacattaccatttaatccttgtcatcatatatattcttaatttggtctatacacatgtcgcacatttttaatttgatttttatatgtaaattgtattcttatctcagtcactacatgtaagagaataaattaagaatgtgctatacttatatgaattaaattaagaatatattacatctaaattaaaaatgtacaaggggattaacgacatagaggccagacatacaatgtttatatgtatagggaccaaattgcatgtataaagactaaacatttaaaatttgtgacacatacgtactgagttgtatgtttaaccttaaataaaaaataaaagtagaatttccaaaatttatttttagacaataatataaagtgtgtttaaagagtggtagtatttctcatgtacataatcaaaagagtatgtttgcacattctactaaatatatcatggtttgagtttaacgcatgacattttttttgttctatttcagacactgcagaggatgcagccagagcttatgatatcatatcaataaagttgaatggatgggatgcgcttacaaacttccatttgaattgctatgatgttaggtgcattatggagagtgatttaactcagaccacggaaggaatagctacattaagaaaagtagacagcagtggcagtactgaaggataccctcaacaactgaacaactcatctttttctgagttttctcatggcttcaaaaaccctaatctgattccaagcaacccttatactcttggtggatttacagctggtgccggaagcagtagcgatggcaacttatttggaggagagtttccaaatatgagtgctatactgcagcaatcacttcagcctcagagccaagtgaattttaacaatgttttcaataatcagaaccttttcatcaacaccaccaacaacaacatcaaccagtttctgcctcagagttctaactttacagctggtgctggaagtagtagtactgccaatttcaatccaattggaggagagtttccaaatcagagtgctacattgcaacagccacttcagactccgagccaagagaatgttaatactgttttcaatcagagtattctgaacgacggcgacgaggataacaacaacaacagacagtttctggctctgatttctaactttcctttgcttgctcgtggcaccaaaaatcttgatttagaaagctgtctccgtttcaccaattggccagctgagtttggaaaaaagttgctaggtgggaacttggaattggatttggaaccttcttcaagcaatctgaacgtgccatctccaacacatgacatggtgaatgaaactgcagaagctgcaaatgctgttggttcacttgggcaacagatccaaccagtggaaccatctaatcaggaatttggagccacacagccacagttacctgcactgaaccaaagtcttgaacctgatcacaactataatgccaatattttgaaccagataccacctcaaaacttaaaccccagcttctctgatacttttcagattaatcctagttctgaaccaaacaacattattggttcccaaagtcagaccgatgtaagtcaatttgattttgacatgagagaatatatcaacatattagaagacgataatttcagctacgattttgacatgtttgcagcaaggaatgaggataggcaaggcccctaatactg

SEQ ID NO: 4329 - DNA, 1859 bp, Glycine max
  Soy_ogl_1017 Gm03:41512785..41514643 Cluster 18
tcaagaagaaactgtttatgtcatcagaaacttcaagaggacaggaatttggtgagtattatcttaaaaaattcaaatagagttaagacataaaggttttacagttgggtcaataaaaggagactatatgcatgccatataggacctagttttaaattgttgtcgcagttatagctttattacgatttttgttgtcgcaagaaattgcgggtatatatgattaatatggttgcaattgcgatcccaatcactccaaaaaccttgctttaagagggtagcaaaaccaaagtatcgaacccaagaatatagatatatagggagaagagattgtttcactaaaaaaatattagagagcaatacaggagaattgttttgagaaagtcgagtaattaagaagaaaaaaatagcttataaaagatgactagacacctataaagacatttcagtactgctcaagtcatcaataattttgatagagtaactgtaaccaataaatgcataccaatataaacatttgtagacatgttgtgtcaatatatgtgagttctcctgtataccaagatgcattatagtttttctttatcagcaccaagatgcattatagcagtcttgtacgtgagtattaatgtagtgttgacttcgataaccacttaacaatttaggttaattaatgacggttggttcaacttaatttgtttgaattattggactttaagcctactccagaacaatattaatttatatatatatataaggtaaatcccactctcttctcctttttttttatcaccaaatatatatataaatcaggtcaagggtacaaggatacccaattaccgtacccttccaagttacaacttaggctatatgaaattaccacccagttataattaattaaaatactatatatcctctcccccctggtgacatataaactgaaaaagctatgtatcctactgttgatgaacaagaaaaagattcctatgtttacacaatattgttttcccccaaaatatagacactatactactgttgatgttgtatatatatatatatccctcacagtatattgctacaccaaaaaaatcaaactagcattgtgtattgtctctgctaatattttcgagcaccgcacctcactctcttttaatttgatgttactggcaaatggcaatagtactttcttataatgatttactggtaatttaagtttaaaaatggttgaattaagttccttctattgaaattttagttgtttgtggaaaataagaaattcagaaaacatatttatgataataaacatactaagtatctacttcagttgctgagtaactgttataaattttatttttttgatattatgtttaattcctacgaaaccacaacagaaccactgaacgtgcgagcgtcacagagacaggtacatagaggttgaaggtgtcgtcgtacaacgaaaggaggagattcgttctcataatatgtatgctagtagtatctaatataacctgggatgagtattgcttgatgagtaattgaatttctgatattaacatcttttatcaattcttttaaaaatttaagccactatcagttgagctaccacaaagtccttatcgcctaaagtaggtttcaaccactcccattataagatcaaccgattagaaacgaactactttttttatttaattcgttaacacgcttgttttctgaataaatttttgttaattattaaaattacaagcatatactatgttacatcatcaatctcagaaaacaaaaaattgacctagtacatgtaaaaacacaattatgacaaagaacaaatttatgtactgtgcctccattttccaaagggtccc

SEQ ID NO: 4330 - DNA, 1618 bp, Glycine max
  Soy_ogl_1269 Gm04:7119701..7121318 Cluster 18
catagcttaattattaatttaatatgcttgagcatttgtttataaataagatttggttaaattaaataacccccctccccttttcttttttgctttattctctgcatattcttttgagactttttataatatattgactgagcaaggcacgcaagatacaatttcaagctaaagaaaaagaagaaaagagagaggattcatatttagctactcaaatgagtaatttaataacatgataatacgattaacttgggaatacgttatattatattcattaagtaatgatatagtagtataatataatagtcctctggatttgtgttgcctgagatcgtacatacacacccgcaataatattaaatatatgtatgcatgaaattccttttctctctccctttcttgattgcattacttacccaatcatctaattagttcaaaattaatattacatcgatgatggatcacatggggtggagaaatggctgagaagtttcccttttccttctcatgtcacatgcattgcaaacttggttgggaggaagcaagaacaaattatttcacgtgcatgaaaaatcaagctattatcctgaagaaacaaagaaagtttactcttacacatatactctcgtagcttttgagttttgaaatgaatcttcaaaaaataaataaaaaaaccataataataatataaaaaaataaattttatttcaacttttgaaagtcgttggattaaaaatttaatttcataataatcaccgatctaagtaattgtagatatattgaatgtgatataattttaatggaatgttttttttaacaggagcattaatggaagtttattaatttttaaaacttaatattttatatattttttataaaaataattatgattgaatgtcttttgatttactatttttattaaattaaagtaaagaaaactaataaaataaaagataatgtaaccatgattatcaaactctcgagttaactcgttaactcttacaagtttacgagtccacttgttctgcgagttgactcttgagtaaactctttttttagtagactctaggtaaactctataaactctaagtaaactcggtagactctcgagtttaccactgaattaacaagttaacaagttaaaaaaattagacaaaaatgtaagtcattttttattattttctatttgtttagcattcaacataccttttaacatgttattctcaaatacaaaattctcacctttaataatatcaaattcttgttctctaataaaatcaaatcctcgatgagaataatctaccactactataacctctacaaattattgtttagtggtgatgtattattactaggcttggttaattaaatattctgaactttatgatttactgttttactttattatattgttgaaatgtttaattagtatgttatttatagatattttgttattatttttatatgaagtagactcttacgagtctacgagttgagtctataaaactctcacgaatttgtgtaaactctcgagtttgataaccatgtaactactctaaaataatattcatttttacttcttcattggttttgttctatttctctcacttagttgacc

SEQ ID NO: 4331 - DNA, 1250 bp, Glycine max
  Soy_ogl_1377 Gm04:43897301..43898550 Cluster 18
ttttaataaagttaaggataatttttttaaaaaaaatactgtaactttaatgcttataagtaagttaacaaatttctttaataaatataaattaatcaattatgtcttataattaagaatatatgaattatattttattttaattttaagaaaggaatagtttttacattgtgactcgacttgatttacagagtttaaagttcatataattattcttagaactttaaaatcgaatatggaaattctaatagtatcaaactagtattttttattttataggcaggcttgataaaaaaccgggattcccagtcctggaaacatagtatataaatgacaacgaaagcagcatccctgtaactttaatgtacgactgggtcttaggccacggcctccgtaattacgattcacattattgttgatatattgcaatactgcaatctattattaatttttatataaaaaatacaaacaaataagaattaaaattcataaagtataaaccatttcccattttccatttccccttgcctacctacgtaccaatttaaaaggtaaaatttgacacctgggacaattgagagaaaacacatcttcctttcacctaccaatttaaaaggtgaatttgttgttgctgaggaattcaaaggtcgaccttatgagtattatgtaagaatcatgcctattcattcatgttggattgtttgtctaattgtaagtttcggtcattttaagtgattaagacaagtcttagaaccctgaagtattcattctctgtttgattagttcatactatcaacactcaacaaaaagtcacattaaggtggactcaaaagctgtggtttcgagtattatgggaaacaaggatagttgttctactggttagagcattatatcagcaatttgtaggttactcaatcttgatttgagagtgatcatcaagcattcgtatagagaggctaacaagtgtgctgatgccttagcaaatcatgtttgtcagatggaggaggattttttgatgtttgagcaggtgccttcttttttggcccaattgctcccttttgacactgttagagctgcgtctccgcgtttagtttcagtgtagttttttctgttcctttgggcttttaagccccgattttttctggaaaaaaaaaatcatattaaggtagtgaaagttgctaattgctatggttcctagatgggtatgatacctgatagcaacaacccagaggagaaaccttacctgaagc

SEQ ID NO: 4332 - DNA, 1100 bp, Glycine max
  Soy_ogl_1388 Gm04:44258401..44259500 Cluster 18
tagaaccccatagtaccctatctctctctgcttttactgttctgtttagattccaaacaaaccagcctgttttgttgcagttaccttcccccactcttccattaccaaatcaaacacatatttcgattttcaaccaaaaggaattgaaagccgaggatgtcatggtttcacttactaaggaaagaaaaggggtgtcaattagtacctttttcttgtttctttgccccacctaagctacctacgcacaaagtggtccaaacccaaacttgttcttcatcttttctcctctacccctgcaattcatcacaatcacaaaccaacccatttttcaccggaaagcccctaccatcttttagcaacctgacaacagcttcatttcaccgccctaaacggcacgtcgcaatccattttctaccatggaggatgcctttcatcatgtttctcaggaaaacgcatgtcgccaacattacctttacaataaaacattttttaaattatcataattataattagaatctttgttctaggttttacaagaatcttgaaatttcaacatatctgtttgcgaattaagaagttcccttgacatctcttcatcggtaaagaattgtcaatgtagaagcatagattaaaaaaactgatctttgaatagaaaaaaaaataaattcgcggagtctcaaatgaattaacttattcgaaaaaatctcctagctatttttttaaagtcattaaaatttagaatttagttacccttaaaactcttattactctttaataatatattattaaaggtcaagtttctttccttcaaatttagttgccgatggaacaatatcaacatgatatcatctacaacaaatttgttaattattacaagtggatttataattattaattaaagataactagtaaatttttaataaaatatttgtatatgtaataatttataaatattttgaaatcttaattatagtgtgatattttataactatattttgcagccacttacaaatcattcgctatccaaaactcaaatttagtttaagaagattcgctaccccgctaatgtaatcattatgtttcatggttggctacaagag

SEQ ID NO: 4333 - DNA, 1400 bp, Glycine max
  Soy_ogl_1651 Gm05:32034501..32035900 Cluster 18
gcaatgtaagtgagttgtatttgtatctcaagaaaaatacgtatttgatcaatgattataggtaattttaacgaaggaagagtcgaatcattttactctcgacttaaagagagtcagatcccttagtcaaaaaaagaaaaagagagagttcagatcccatgaaaatgttcatccatgttatgagttcatgattgcctaaatttcttgagagtgtagatagaaaattcaagcgaatatacacaatgccgctcaagtaaaaagcaagtttgagttttacttgttcaaacatagacattaagaatgcattacattgaaattattgtgaaaattacactaacttttttttatgaatattattagaaaacaataaaaaaaaaatattacattagtttcaaaacacgatgcgtgatatttttgggagaaaagcaagggaattctcattttatgggagtattgatcttagtcttgatttaccattctgtttggtagttcattccttcacatatgcactcgtaggaagcaaccctatctttcagtgtaatgttcatcgaaacctgttgcactgttcatggaaacatcaacaacattgaacaattacttgagcattaagatttgtgatagtattcttaattagatcttcaaacaatctccattcctttcgtttttcttcaaatatttataacatcttaaaataacaagatttcaacaaaataataatacgtaataataatggttaaatcagagttaaaattaaaaaataaatagcattaacctcaatttagtttaatctccgaaattaaagaaataattggtggtgaatgaaaagtttagcaaaatatattctaaccatatatatgttctgtttactgaaaaaacaaattccgacgcatgtacctctaatttaccaataaattggtagtatatgtcattgaactttagaaagaatttcaatttagctcgcattccaacccacagttgagattaatccctaagtccctaacattcaaacttccacctcaattttttttttcacttcataaaatataactagaattaaatacataatttacactgcatgcataaaaaaaaagaaaagaaagataggttatggccggtgaaagtatttcagttaatttttaatattttttataaattcaaaagtttgtttgattgtttggtaaataattttttttagtaatttttgtaacttctaaggtattttgaaatgttacttagactatattcagtaaaattaactaaaaaatattattaagcctaacatcatttaggatagaaaatcaagttcaatttgggtaaaaattatcattaatgtcattaagcctaactaaaaaatatcattaagcctaactaaaaaatatcattaagcctaacatcaattt

SEQ ID NO: 4334 - DNA, 1537 bp, Glycine max
  Soy_ogl_1766 Gm06:2655401..2656937 Cluster 18
ctttaaaaaaattgctcggagactaaaacttatagtttttcttagtcttaattataaattttaccacctatcttttattattttgtgaattttatcattaagttttttttccataaattttatcacttgacttttattattttataaattttacaatcaaagtttctttttcacaaattttaacatcaaacttttaatatttcacaaattttatcacctgggttttgtattttttgcattttatcattacattggtaataaattaatgccattttattttttctttaatttttttttgtgagcagcaaaggtaataaaaaaacaaatttagataataaaactcataaaataataaaaattgaatgataaaatttataatcaagtttttcttataaacactaaggaaggtaacaaaaacaatccgaaaagggtgcaggaagtaacagcttgaatattgcgaaccttcagcttcttttaatagaaatcttaaaccttccccacttgccagattggaagaccttagtgatccatacgtaccgcgaagcaaatatttgtgctaattgtgctagcaaactttaaccttggccacactagttccttcatttggaccattttctacaaagcatcccttcacattcgagaatatgcattaactcagaaaagctcttttataatgaagaaaaaccatgtgacaatcttgaaaaaataatctaccatatcaagacaaatataatatccaatttacacttttccaagaaacataacacacacatacacatgaaatttctctcacaatcttttttattttctcactctatcgaagtatgcgaaatgctttttttttgttgttgataaaaatgcttcttaattattggcgcctcaatgcctcataatattcagtattcacttctaccgagcaagctttaattgaatttcagctaacaactaataatgaggttatgaggtcaaaagtcaaaacatgttttgctttgtatggctttgtggtgaggtgagggaaagatgtcctttcactttttatcgaaatgcaagttacacgtgagaaaattttcggagagctgacagagatggacctacactaagtaacaagattatagatgtccttactcatttttttaatgttactatatagtagtattagattgttacttggattttattgttttaattatattgtcattttgtcaaattttgttatctgaattctgaagtaagaaatattttcttattcttatcatcaagaatttctaaatgctcaacggcatactttttcagtttaaaaaatattctcgaccaatagaaaataatcattttagttaaatattatagatgtcaacgaatttatcttactagataatttgtaattagatagtttaaactactttacaccggtaatatataacctattttttcaatttttaagcccctatttgtttgccgggaaaaataattaagaatgagtgaaataaaacttataataaaatgaagcctatacttttaaattttactataattcaaa

SEQ ID NO: 4335 - DNA, 2200 bp, Glycine max
  Soy_ogl_1780 Gm06:3226101..3228300 Cluster 18
gacaatcaaggtgtctttttgttgtaagaactgatggtggctggatcgatttctcctatcagaagtggcttcgggaatacattagagataagtaccctactcatgcggaaaggtttattagagaacattttaagcgtgggagtggttgacgtatatatagtggaatttgtttactttggtgtgctgactactttacagatctgctttaccccccttattgttcagtgccctacctcgattgtcaatggtagtggataatcattgactgggatatcgagcttattatgaaagcaacacagaaaattattgaagtgagcttcactttgttgacttgttaattggtggttaggtaaactggttggcaataaggaacagagttttgttgtttaaccacctctaatattataagatatttactagaattcaatgttgttttatggtcttcgcattttttatttttagtgttgcatagtctttgctgttcagcattgaatttttgaccctcttaatttttggaggattctttcacccggaatgtggattcattgtagtacccattctggattatggattttgattgaggtgtcctgtgtccagctatattagtcacgggcaatttaggagtagttgagatcggacatgtacgagtcaaaactcaagggtcatgctcggttaggttcggtaggactctgcgcaagtcaaaacggagagaaactatgtctggcctacttttggatttttatctgaatatgtttctaaatcccaagacagaatcatctttctttatattaatttttatgataagtcaaacacaaataaattcccgttgtagctgtatgtcgtcaagccccaagtgttaagcatgatctattgtttaaattctggtaaatttcattttaaatcattaaatataattcaaatattttttcaaatcttgtccacaaattttatattagaacttctgtcaaggtgagaggaatttattttagttaacctaacgagcaccgcatttaaacttcgaccattttttccatttgccattggaatcttgaagaacttggtcaacttactatctgggagaggggttggtttcctctggtgtatctgacgaacgaactcaaaataactgtatgcgaggggtgagaattccgttctccaattaaataacgtgaattagtaaaaaaaaaaaaatcatttagatttcaagaacaatgtgatgatttcaaaaggagaaaattaagttcacgacatataaatctttatcattttcccattaaagcatagaaccaaacaaaaacaatatgggaaacttcttattcgaatgagatcgccacagtgtcttagaatcaatggctataaactcgaaaagcaaattagattctaacccagagcaagaatttgaaactttagcatcaataataggaaataacatagcgttccatggcccctatgatctccgatcaaactactaacctctttgtctcatagcattctatactctacatagcaacgagaaaacaacttggtcgattaactacaaaggtcagagtggtgggctccagtgaagatgtgactgggtctttggcggatttcacaatacctagatttaaacatgcaaaactactaacacattaatcaaatagcaaaataacgagagtaaggggtagagaagagaaaattgaatattttcaagaaccaatccaaacatgaaaattatgtcgtttgtggtcgaaatgatcatgaaccatatacagagaaataaatgtaggaggttgagggcactgaacgttcaactatttgtgggaatgtctatgtgcaacttgtactgtcgagactagtgaggggaaccattaaagaaattcacaatccaaatccgaagtaaacatctttgccttcactctgtcatttgcagaatatatttaatttgtgtgtttggaaatgaatcaaatgattatgctgcggactacacccgttaccaagatgggttacctgtcatttataagaattgacttgcatgtttggattggtgttgggttgaactcaccgtgatttttttaagcaacaaatagttgcttttgtggtgaactcatcatgattttgcactcgtaataattttttatcatcaaaccaaacacactaggatttgttcgcattaaggatcgaattgccatgcaaaaaagtgtttttttttttaaaaaaa

SEQ ID NO: 4336 - DNA, 1500 bp, Glycine max
  Soy_ogl_1858 Gm06:8391401..8392900 Cluster 18
atagagtaatggggtctcaattgattagagtggcatgcattgttgagaagcatagggcatttctgcaaatggagtaaccaatccaatgtaaccgtcgttttcaagtcgcagccagagatatttcgataggatttggtgggggcgcaagttactccaatttcaactttttcacggcaccgcacatgcctaaggataatcatatcatgtccaataccttccaccattcttttatattccctctagtaagctctcaaaagccttaggaagaggagctcttattaaatggtttttaatatttatttatttatttaacttgttggaattatggattcacacataggtcactaagcccattgtgagtgtgggcataataaggagaaccaacattgaaggctaatggatattttaataatacataatgaattgagggccatggttggaatgtttctcgagagagagcaagttgcatgcgcctaaagtgatctctcttttgtgccattcacctcttttcaccacaacttttttctttgcctttcatttcgctgtttcacagagaaacgcaagcctttttggtctaatttatttgtgccaatcgggtacttcacatcaaagactccccttacgaaactgtgcccataatgagtggctgtggcatatgggataagtggttaattagttaatccagaattagctattgaggagcttctgaattattaaaggcaatttgagtatcacgtgaaagattagtttcacaatcaaaagacgtgagaaaaccttattttaattgtttgaaattaaaaaaaaaaaatgaaactttaccttttatcttacttccaaagttgcaacaacattttgattgttgatgaccaacttcaaaatttaacttgtatgcaaaccaaattccaatattattgctcgtcagacaaactgaatttttaaactgtaaaattatttattattacaaaaaaaactgtactatattatttattggttcattggtttaattgaatagcataaccctctaactcatgattaacacaattagattatctcatactcactgctacttgtccactttgtatagcaatacttaaatataataacagtgatcatattaactaataattcataattattgtgataaacgaaaagtacaaatttagattatacaatcatataagaatgatcaagaggatacatgtgtttccattcagaaaaaaaaagagatacatgtgttcttcataggctagattttttccccatgtgtcttttaaaacttaaattaatgaacttaaaaagatgccaagatatttgataaaattaaattatataaatgagtcaaattaaatgtttaatgaagtttacttactttatgaaataagagtattcgaatgaaaggaaatgtaaagaaggatagaaagaagagaatggagatctgaaaaaacaaatgaattatttagatagttttaggtatttatatatacagagggataagtgaac

SEQ ID NO: 4337 - DNA, 1853 bp, Glycine max
  Soy_ogl_2113 Gm07:1350548..1352400 Cluster 18
aattgattttgagtataaaacttacaaaatatatgactcaacaaggtgaaaaaattcacagttgaacttaccttgtctaaccaggtaacattgtctagttgcacgtgatgagttgatgacattttgtcttcgtctatatgacttccaacgatgagatagaaataaagtcattttcgttgcttacacttttctgacatatgaacaattcaaagaatataacatggcatgaaaaagctttctattttttagtttgtagcctgctagactgtaaataagcaagggtaactactaataattatagttcttaatgtactgcatgcttgaatactcgtttaagagtagtataggtgactcaagatagaagtatgtcatcctaattttttgcatctttttctgactttgacgtgaatttgagataaaaatgtgggtacttgacaccgatccaaacagagtaatgcaatattttactacgtgctgcacttaacttatattttttattttttcttcagtttttgctaaaaaatagttgagcatttattgtagtatcaaacaattccttagattagaggtgtaaaaactttttttgggctttagggtatgtgcaagcaccccattgcaccgttccattttttcttgttttttttctgtaatcattgcaccgttttgttgggacaattattcggacaataatgctttggattgcaaaagtcctaaaagtctacaagaaactaggctaaaagagaagcccaacaccaacaatgttcttgccacgttcaagtttctaggaaatatttgatattaaaactcaaacatcacttggcccattattcttattgcttatcacccatttgggcataaaggcacattcaatgtatatcgatccgcctacaacccaaaggacaattgtggttcaacatataatttggattttgttttcatggctcttttgtattctcaatgttaagttctaatgaacaagagtttttttatttttaaatgaaatcaacacaattaaatgataattttttttcttagttagcataaactattttttttcttatatttcaggttgcaaggagtacataaatgttgctcttcaaaataaaatgttcaaatatttgttaaactcataataagagaaacaaatgcaaactcaatgtagtccatcttatttcattaattggctatgtgaagggaggggggggggggggtgcaattaattgtgtacggtgcacgtggtagcacgtttgcaatagaacatgtgtgagccacacacgtgtgggaggaaggatgaaaatcatgaaatgaaaataaattaaaaatcataaaacttaagtatctccttggaaccaacccaagcttgattgagaagcctcatcctcatactcaacctcacaatcacatgatcgctgacacacacacacacacatcttgtcttcctttctgcgtgctccctgcatacctctctatttttctaattcaaaaccacaccaataaagagaagccactccaacaacaaattttccccccactttagagatgatactatttcccccccttattcttacttaaaatatacaacaagtgaacactaaataataatagttaaaaatgaatgttattattaaattttaaaaagatgtgaggtagtagtaattgtgtaagcaaaccttatccatgagttaccgagggggttgattagtaacctggggatcagagtccaggccatctgactcaatccttgtttgttttatctcaatgtatataaaatgcgaataataaggtaaaatgctctctcaaacaccagcagccacatgattttatatcaagatgtttttgaatttggagaagtc

SEQ ID NO: 4338 - DNA, 1800 bp, Glycine max
  Soy_ogl_2122 Gm07:2103501..2105300 Cluster 18
tctaaaacatgagttttatgaataaaaattacatgagtggaaataaaaaattcattaaatgtaattaatcaattttttttaataaaaattaatcgttgataaaattgataaatattccatggtgaaaaaaatattgatatttctaattgatttgcaccatttaaatagaatttgaatacctaattaaattttttatacaaaataatcagaatcgaaactgaagaaacattaaaatgaatataattgacttaagtagttgtatcaattaaagttaaatataattaagaatttattaagagtcttactatcagatgtttttaggttaaaaaattaaaacattttttattattaaaaatcatatgagaccacgttttaaaattatagaagaatatattttttacattcctatcaaaacattttcgctaaaaaatttcttggtcagtatccttactggttagtatttgtcatttattaattgtataggtcgattctaaaagggatatataggtggcctcgtcaacttcacgtgcgaagacttgaaaaccgagcttccagatggtaaacacaaatgcatgcaaaacaatgaattttcgcttgctcaaggataatttcttgaataatgaatacttacgtactcccgtataatcttgggtttgagtctacaatatacatagtgcaagcacttagtttatcagagcaaaaaatttccctcatcctcacttgcccttagttgaatcttgaatcagaaagtcaatctcttaaaaatgtgcctttctcaacattctatgcaaaagaatcaacataactcaactctctcggtctcacgcacgcacaaacacatagttttatacattttccaatgttgccattttgcgagtggcatactcatatagtacaactatgaatcaattaggttatgtacccatcattttttgtaccatgtaggatatttaatagtattggagagtaactaagtaggttatttaataagttgcaggagaacattaattttattatgttaaatattaatgatgcattctctaaaacattcgtttaagtttttacacttaatttataattagttgaaatctaacaaaaatcataatctttttatgtctttcatttcttatttagttagtccatcagattttatagttctcttaacaatttttagtcaataaaagggtgagttaaaaaatgtatttgaaagtatattacaagagtaataccattatgacattcttaccaaatataaaagatcaacaatataatgtgcaactattattttcttatatgtgaactttataatatactactatattaattaatttacgtaacattattctttgagtagtaaacattctctgtgtgaaatacaaagaatgtcggtaaatacaccataagctagcacactgaagcatgggcgtgtgtgcaaccgttattggggaaagagaaggtgggttttcaagagagtagagaactaaagggcgaagcacgccaagttttttgtgttctttattgtgctcattcttcggaccaagagatttggccttgcttgcattgcatggagtgacgagagtagcttgctaggccccctcctctttgccttcggattttgtaaaagaaattaagagagagaaagtggattagaaaatcccaagaataagagacaaacaaagtgtgtttcaatgatatctttatcattttcgtacttcagtgctatacatatttgtgtaagcttccatctctttgttgcaagtttcatgggaattgcgactctttgcctaaataatgcaacct

SEQ ID NO: 4339 - DNA, 2018 bp, Glycine max
  Soy_ogl_2195 Gm07:4826283..4828300 Cluster 18
ttctaaaaaattgtaaagctataataatcattgtcaaaattattagtgttcaacagcacgattcatgtaaggcccaataataatattataatgatatgattcttaatgcatgttatcacatattgaacatttgaacttgaatcaggaaagttttttgtatgaataataatctccaactttgtggctagagtttttaaaggtagtagatagttatttttttattttttttctccatggcaaacggttatttctagagatggcgcagtggattgttgattttgcttcgtcaagaaaagcaattttcctacgatttataattacaatttttaggtggtgttatagtttaggctttattaaagtatttttgggagattataggggcagaggcccaaaaaagaaaaagagaattagaaattggtcccgggaacaagtaaataattttcatgtaccgcaaaaactgataaaatgtgatcaatattaggtgacgaaaaaagcatgacatagaacatcatgtttcaagttttcagcttttcctgcccaaatacccttgtattttcctttggtgaaaatcctctattcatattgtaagatccatattgtattctatctagatgatcaagacacatagttttgatattccatacagataataataaaaaaaggttaaagaaacttgcccttaggtggtagtgaaagtccatcacaaggggacgagatgtggggactcgctcgtctgatgcaacacaagggtcaagaatgaataatgccatgtggtgtggtggtcaagcaaaactgtagatgtgacctttgtatctttttggggtgtgtgtgtggttgaagtgcatatccacaatatgtttaaatccaaaaattgcaaattctgagatccatgagcaaaatcaagcgccaatattccaaatcgatatgattgaaggaatggacacatgctattacccattaatgatgataattaaccttattcatacacatcaccttttaattgtgtctaattatttggtttaggcatttattattctaaaatttgacttgtattcagtcctaatagccactaattgatatgaatggcgtaagatgccttatatacctgacgaatttccaagaaatgtcattaattgttactgcgtacaaattacgggtcacgtggcatggtagttagggtgggtacatgcaaaatgtgtagctttggttccttggtagatgcatgtcggtctttaaggtcaaccaaagcttcgatttgatatcattcgagacttaggctaaatgtgtcaccagtatgaagtgtgagaatgtctatggccaacttgtaaggcagtggaatacgatatgttagaggccgatccagtcttactagagcagactacatgcattttaatttagaggtttttaaaaatatttgatttaacacacacattttggggctaaaatttaaaaatctacatgtgtgcttgcgtgtgcttattatattgttcccttaacatgaattttttagacccgtcatagattatgaccatttagtgtttttagttgatttaaattttctcagagccttaagaatctgatgtagtcactgcccatttatattcaagcaaaatataaagcgctaggaagctaaatttgttgctcatataaaaagagagttacacttattagattataaaaagggaaatttcactagtcaagcctgaaaagttagttgaacaatattgtatagcaattatcaacatttaattttgttggaggcattgatggtcttcagtcttcacgatggttttcatgatgctaccaaaaacgtttatttgcttaatatcaaagttaagcagaaaaaactttgataataatttgttttcgtttctctgcttaacttctattgggtatgtttcatggtttcttcgtggcaaatgaacatctgataaactctttatattaattctttgtctattttttgaccctcctaactttcaatccccaactttagttttctctgaatagagaagaag

SEQ ID NO: 4340 - DNA, 1879 bp, Glycine max
  Soy_ogl_2610 Gm08:11472701..11474579 Cluster 18
agcttaagaatatattcatttgtaacattatttgtcttgcatttggtagttggtaggcagttttagacgcaactcatcatgtttccattttaaatatggcaacatcaagtgacccataaatactattacatcaaaagaaaaacgtaccatcatttcaactgtttgcaattattccaatcaatagtggatttgagcgcatgctcagaataattttgttggatattgttcgacatccaaaatatgcttcacgaatcaatactcattttaaagatattttgttgcgttttaatcccgttgccatacttttaaaagaaaaggaaaaacaaattaattaaatcttcataataattttaaaagttttatctaatttgtgaattactgtctataattagggctgagcaaaaaaaacaaaactgactataatttggaaagaatttggaaattctcttttataaaaacaaatacaaaaaagggaaataagcgcgcgctacataaaaagaaattcatcaaagttattcaagaggatatattggaggtcattctagaaagtgaaatgtcacaagataacgataagctaaattcaccataatatctgcaactccatcaccttctatagaggaaaattctcactaaaacatgatgacaattgcgaaaaacaatacgcatcttatatttttaaacatacatgaatcccaaacaaaactttttttgtatattttaatacgggatatactatctacgccagtttatgtttatatatatcaaacattaattttaaaaaaattattaaaacttataatacaattcttaactcaattttaaaagatttgccttaacttttaatcactacgagtgtaattagaatgcattgatacgtgatagtgtactgatttttttacataatcacattgctgtaaattgccatctaaaataagattgttaactttttgtcgtgacaacttaaaaaattatgtacacataagataatttttaattagttaacaatgcacaaatatttacattaataatccacaaaaattaaactatagtataagttttttttataaaaaaaatactggatttcattttttgtgtaacaatagataaatactttaagtaaaattaggtttgtggtcaataattgtgagtttaaagagcctacatcaacattccctcaaaacatgccacaaggttttttttttcttctttctctcccactccccccataaaacatgccatatgctacatatactttgtattattgcttcggactggagctcaacacattgggttcaggtatcagtagattcactgtaaaagggccatgccaattaccactgccctcattgaaagaatagacattcaatttactctcctttcaaataatgcatgggatcagaatcagatatcaataataagatttccctaatattctccccggcactactcatcaagagagtttgccccccttcaatccacaataaaaaaattaaatgggagactgctcatgaactctacccactcatcactaaaccatgtctccaccaatataggagagaaagaatctccgataaaagaaatgttattgtatagtatgttgattaacttttttaaaattttttttatagaatacaaatattttctagtagaaacattcttgtttgagttggattaaatcaataagagcagtaaatttttcttccgggtatttaacacaattaaggtaatttgatcacgctcagccattcagtgatttagtattttctttattgatgtataaataataacataatttatttaaaaaatttaaatgttttaataaaatgcacataaattttatttattaatataaaatacaatatatgatttgagccctaat

SEQ ID NO: 4341 - DNA, 1500 bp, Glycine max
  Soy_ogl_2910 Gm09:594101..595600 Cluster 18
tcataaaatattataactgaacaacataaataagaagaaaaaataatttgaattgtcaattccaggcaacctgtcagtttgtcactaacactttagatgattattgctggtccttgtttaccaagagggttcagtacttaagtgccccaatcttaatttaattattttagatagattttatgtgcaattgtgtagaactgaagttctaatctctttcctttgtctccctccctccactcaattaggtacacattggggagttagagaacaggggaaaactttcaaaaattgatcacttaacaccatggatcttgcaagtgattaggataatcctaaactttttgagtgagttgtaaaggcatatatatttgtaatgacttaatgagccaattaggttaatctaaactttcggctctctagttgttgaaccaaaataatccaccactctcacggtgtgtttccaagaagtttcggtaatgtacgtaaaccctttttccttagatcgtgcccctcgtgtggcagttgccttctgaagcttttcggccttttctcttttatctacgttaatcatcttcatcaaataagaggaaattacaataacattctctaggtcttatgtaattacatataataatattttttttatatattttcctacgctaattctctctttaagtttaaaagttttatattaacacttcttgattgtttaaaattattacgctatcatccttcaaattaacatccctaaaactttacactagcaccacttgcgggagatgtgaaaataataactaaaaaaataaaaaatacttgtataattacataaaatcatctcagtggatgttgctataagttgttctaaaaccaatctaaccttgtggtctctttctgcaattatttgttcaatatatttttattagaaaaaaatctattttaatttaagcataatattactgctgagagtctgaatcaacatgtgcagagttgttagcatacttgtattttaacatttttttaaagtaccgtcatatttatttattttaacattatagtttaaaaaaaacgaattgtcaaacataacaataaccatgaacatcattcattcgctccattttgcactttgtgggtgacaaaggctaaagacatatgcaagggatgactgattcatccagcatttatgatgttaaagcttttgatttttgaagagaaaatgggagatccttcaagttatatatggaatcaagagtgagaagtaactgttgtgtgagattcagttctagtgttctacgtactttatcctttctccaagtagaatgcaatatgaagatctggtcttgttgagattcatcaaaatgaaaatattgatgttgctaaattgaaggaaagtaaaaagaatttgaagctacccttaagaggaaggataaagagacaaaattagaggtaaacaatttcttgggaaagattcataggaggaatgatgaccataaattcaacaat

SEQ ID NO: 4342 - DNA, 2090 bp, Glycine max
  Soy_ogl_3015 Gm09:5561811..5563900 Cluster 18
tttgaaatcactaagaatttggagacataggtagaaagcaacatgaatcagaaggtaaagttttggaaaacagtagaagatctataccaacaaccacaacatctccaacctaaaagagtgagcccaacaggtaactgcaagcactaatctcaatgaaagtacactattatggaaggaataagcaaaataggctattaataagtctagcaaaagtatagctgctacaagacagcatttaattaaaattctgggtagtgattgcacagaactataagaacttatcaatttcttatcaaagtaacacaacttaaaaaatacctaagagctctggtcactaagctttgaactcttcctagcattccaaataaaaacataaaataataataatgtatatattacagttagtttaaatatataggtaaaaagtgaaaatacaagcacgagagaaagaaagagatgagaagaaagggaacaacaacaccttaggacaggacacatgacacgttctctccaaagacccccaagatgtcattttcatctttctccattgcattaacacacttgtgtcatttctctccttccacatttaactgtaattagagcaattttgaattaaaacaaggaaaataaggaacctatacctttgaaggtaacaattccaaaaataaagataagtagcgtacttcacctgaagataaaggaaaaagtaatgaaaaatcattccccacgaactgtcaaattttacaatgtaacaccaatgatacataagcttcagaattacataaggcaaacataattacataagcaatctttcttttgcagcatacctggtaaatactaatgcataatgtacaatatcatagaagcatgcatgtcagcaatagattttaacaccagtcattttatcaaggaggactcaccacttctggaattagattatctccaatctcaaatacatggagataataatctaaagttccaaatgtagctcctacgtttcccttcctgtggttggaactaaaattttggcaatagaccaatgtctttaaaatttaaattatttattatttattcaaatataaagttgaataaaaccagactcaaattatagtcctaaactagaggaaagcttaagatgtataagatcaaaaaatgaaaaaaaaaaagaacttattcaatcatttacaattttaatggtgacttttggttctatatcccttgattatggaaatagaatatataacagtgagggctctataatatatagaagcaagaggttaacaaaagttgaggaggaaaaggtcacagacccctggattgcttttctttcatacaagaatgcatgattcaactaaaacttacatgaaaaaatagaaaactgcattgaatgtttagtaacaatttaaatgaataaattctaaattggtgaaagtgcgtgaaaagcaaagccaagccctattggacagcaggtaccctttaattaatacatagtgatctcttaatacttgtagctcccaatcaaatacagtatcatgttgggcaaaaacccaagcttgccacccctcaggtgcctcatgtgctgccatatcaacaaaaaaaaagtgagttaaaggaaacaaaatccaagtacgactttgtccaatgaaattggtgctatgctcttttcagaaacaagccttacaatggaaacattaacattgagcacctcaacaatttcatggtaagtggaatcctgcctcagtcttttgctcaatcaaaactgaattcacggaaaaataatgaagatccaatgcctaatcattatatgcaaaagcctaaatcctgttgtatatctaggaactttatatagacaaaaaagaacctcaactaactagcaatgcaagaaagactaaaaatacatcatgattcatgttgtagtaaaaggcatatgtgacagtccaagggattgattcttcatggcaaggcttttaagttgggagttgggacaaagaacagaaaattggagaatgtcctcaacacgacatacaatagaaataaataattggcaataaaatagaatcgaatattgccccaaacaaatttaagtgtct

SEQ ID NO: 4343 - DNA, 1325 bp, Glycine max
  Soy_ogl_3206 Gm09:39834301..39835625 Cluster 18
taaaacaaatcattaagagacactttcaagacatatttttcaccataattaaaagatttatttatgttgaagaggattaccataactacttaaaaagcatatctactatatgatttcttataagttgaccatgtaatttttttacacattgaaaatgcatagaaattaaactcataagttaaaataaaataaattatttaacacctttcaagagaagagaattaatgtgatttactcgtaaaagttaatttataacagaagatataactatagttaatgaatcaaatttatgtcttaaaccctctttctttgccaaataaatgtgaagcttatcatttttcttagagaaaatagtatatgtacgagtattataaaagaaatcatatactgcactatctttattggttgatcatatatcttaaaaaccatactttttttattagttgataatataatatgttttaattaaagtctttcttcttatgttgtttatttaaggtttagttttttttttttatttcatggataatcctacaccccacaccccacccctaaatacatgacctagttgatttttggccaaattattaatctggccgagttaccaaactattagtaaaaaatgatcaaattaactggtctaacatgctagttaaagtatttagcttacttcagtaaaatcaacagatccaaccaaagtttgaaactatagaatatagatgattaattataaatgtttaacttgtcggtgcaatgaatgagtccgatccccctatcatgtttagtttttccttgacacttcaaaatagagatcacagtacgtattttatatatatatatatatattatgcatagcattgccagcgagaagtgcatcatatatgatacacaagccatacatggcatcagcctaaaagaagcactcttgttccctcggataagttgtttgtatggatatatggggaatagtgagggggacaaaaattacgtaactactagaattagcacttcatagttcaaaggaaattttagagaaaattaaaatacattttaaggtaagtatagaaatgtcaagtgttgagcctaaagcttctcctgtaatcagctacatacatatatgtctctatcgcagtcaccttcctaaaaacgagaataatgctttcgtctccgtcaccatttttgttttcttctgcttttttttggccaccggttttgaattgagaggattcgaacccaacaccattcaccagccacccccatcatttcacttcttgtccttttctttgtatatttatccttcttttcattctcccaatttctcttct

SEQ ID NO: 4344 - DNA, 1800 bp, Glycine max
  Soy_ogl_3704 Gm11:3667401..3669200 Cluster 18
taccaagacgtttttcttcactaaactgtgaataaaaacagaagaaatggatgtctcacctcttaaagtacaattttaccctcccaacgtgtctctatatattgtcgtttcgcgttcatcttactagcaaaaacgacactattcactgaacgtcctagctagagtaattctgacggaccattgccagattattccacaccttagccacaatcacaatgttaaaaataactcaattggtatggagatttttaatttaattaatggtctcaagtgtaagttttgattatcacgcggttatgtgagtaagaactttactgtttagaataatcatatctaatttaagattacttttttttaaaccttgtgtagccgcattcaagtgctaccgtcgtgacattgtcttctgcatgttatttttctctgacctttcatccttcttcgtggtttttctttttccataaaagtccagtcatgataaaaaaagggtaaaaacatttctaaaaaaagtacttgcatataaatcgttcttgtagttttggtttaggacctgatgagaaggcaataatagagcacatagatcaattgtggagggtttgttttaacttaagtgttttaggttcaattcaacatatataattacgataaatatttgaaggacaaaatttagaagtagctatggaagaaatggtggaggcaatagataatatatatgatagcggtgaggagtggtgttaagaagagagaaaatatcatgatcatatcctattattttgggaccgttagtcttagaaatttaattatattctcaagaataatattgttggaattgttattactaaaaatattattctcattcctttagatggaaatatgaaagataaaaaaatatgtataatatgaattttgaaaataaataatgtctcagaatattttttaattactttctaataaatataaaaatatatgttctcatttctatatttccatattctgaagaatctaataagattttacgaactaaatgcttccgaagaataagtagtaagattaacaacaaaataagatgagtagtaaaattaacaaatcatattctattaatacattaaacaaccacatacagcacgattcaacatgataataatcatatcctaactataccaattagacggagtgcgagagatcgactttgaatatatttacaactagaattcatatcaggtactaatttaagagaactcaggtttagacgagcaactctcatgcaataatagttgatacattgtatagtagtattatccaatttcatcattgctggtgtcttggagagagtagtattcgcagctgaagttacgccaaacaaaacaacagctcccagcgacagtaagaaaccatatacttgttttcagacctaaattcttttattttatttttttaatattaatcagatactaaagcaaagacatcggcttagaagtaagattaattgtttaaatcaaagttataaaattcaaccccaaccaaaattggaagataattgtggttttcaagattcaactgtcctttccaaatttcaataattggtggtgaacagagaggcatatgccatattacttgcacataccctcgcaatgcatgctcgggagtagaataaagtgtataaatttaaaacgacatgatgagattcttgttcattgttaattaattaaaaattaaccatattcaaatcaaagcgagatcctaacagtccactacgatttttctgacctagttaattattcgtgtctaaaaaatttccaagct

SEQ ID NO: 4345 - DNA, 2300 bp, Glycine max
  Soy_ogl_3705 Gm11:3670101..3672400 Cluster 18
ttaattggttaaacttttgctaaccccactatggcgatcgacagtgaagcatgaaagggggttagggttaaacaaatggcaacaattaggcagcgtattcaccataatctcgtacattgtcttgcccagtgggaacgaaaaaggaggacagtagttaaggcatgattaaaagttgacggatagaaaattgggaaattaggcaaattgaccatgcatgattaggaaaacaaaaacaaaacgcgtgtggatggcgcggctcgaggagtgtttatgtgggaattgggatatctccatttgcttctaataatatagttttatattcttgattacttaaatcaatttcattattattgtaacaaagcatagttggccatgacatgggacactctgcctatacgtttatttgtcctcgctcattgttggagaactgaaactgaaacacaaattaaactaaacggtaagaaaagtatcatattttaatccagtaaagcctacatgttctccgggttggcgacacaagatagctacaccttgacctttttacagtgtacaacgttggaggggaacccataaataaatgcataaaataattaaggaattgcgttgcatttagaagaaaaatttgcactgtcccagtcaaataggatgcgatctacaaatacaaaattaattgaattgaagtggtgacatgcatataggtaaaaaaaaaaaaaaaagttccaaaagtaaaaacttaggtggtgtacagctttgcatgttggggggttgcttggcagaggaaggagacaaagacagagatggtgaaggagttatcaattcaattgatcatgtatgtgtgtaaggtcgcagtacagtgagactaattaagcatgcagtgagatgaaagaggagctgtcatttctctgaacttgttatatattttatttatgtgtgtttcttagcggattgtacgctaagtgtccgacactagggtgcggacctggctcggacggttgcccaagaaatttgtgcaccgtgcttcccccctcccctccctccctcccctcttttaatccattcctcgtctccttcgtatcttttcttatctaatcttcatttctgaaatgacctttcgtgtcagcttcatcagatcacaacacctgctcatcaaattgaaacttgcattttttatgtatgcttcaattcatatgcattgtatcgatgtattcctctacgtttttatgctattcattatttaaaatttattaattattaataattgcaaaaaaaatctatcgatatttatttcatttttttcaaaaaaatagtagtattaaacatgaaacatatgatatataaatgaacgtgcatcaaaagtaaccttaaagatcattgaacaattaaaaaataattaacaaggttgtaagcaatataagtcatgctactattatttattctatattcattatttatatagtgaaagttacaagtatgcgtatttattatttgttgatctattaaaaaaatgtaccaatacgtgtcaaaatatgaagtcacttgcagttgcaagaaaaaaaaaatattaaaatttatcgtacatttaattttttttacggcgtaccgatagaaactaaagagataaaataaagaagaagaaaaaaaaaagataagattttttttgctgaattaaaaaaatgataagatgtgatcacatatgatgtaatgacaatgacgaaacataaaaaaaaaaaaggatatgagtaattatatggaagggaaaatggatgcatgttaagtattttttttttccttatattgtgtgctgttattcttgaaatcacaaagtattccatcatttattttattaaaaaaattgagttatgtacataatttattaattagttaatatgataaattatttctttgttgccctaattaaattaagaattagtttagtttcacattatagaaccaaattgtcgtatgagttgatcaatgtgcttcattttttaaaatctcttgatattgaattccatttttatgaataaaaaattattgtatactccatacatacaacccgttgaatgtgttacacatacatattatttaataattcatttttaaggtatagtcaagtttaattatggtctaaactaggttttctttgccccagtgcattgttacttttgaatgaacctaaaatctaaaatccaatatatgagtgtgttttgtgtataatttaaaacaaaatccatatgtgataaaaaaaaaacgtattgagttagttgggtcagtctaaactcgcaaatgtaagacctgat

SEQ ID NO: 4346 - DNA, 1500 bp, Glycine max
  Soy_ogl_3919 Gm11:36041001..36042500 Cluster 18
ttaatatacaattatgtgtaactttatattctactttataaaatgtactccttcctttaataaagtttattgaactgtgtcccaatccctacacaaattaaagctatggtgaattggtgattgagtacatatataaataaggcgaggaaacgaaataaaatctgaaaaatatggcgcatgagagtagaggacaaaagaaaattattacgcaataggtgtggccttgatttgaatgcaaacgcaaacgtcaattttggatacaaaacacaaaatgataaaaaataaaatacagagaattttaataaagactaaaaggagctagtgatgtgtgaacgtcaattttggatgcaaaacacacaatgctcaaaaaaatagagaagattttaattatgagtaagacgagcaagtcatcttggtgtctgtgtgtgagataaagaaataaaaaagctattaaaaaataattatggtattaaaaatatgaatatcatgcagtgcttactttttaaaattgtattatttttttttgttattggtgcgaggaaatgagagaaaaaggcttaaaggcccagtccagtaaaagaagaaaccaatggacaaagagaacacaagctctagcagtctagctagaatctagcaaataaatatttaatgctttcgtaacatactacttatttcttcccaaaataatagttgttttatattattttatacagaagattcaaatgataattattttgaacaattttttttcttatataataactataatgaaatggagagaataaaatttatgaatgaaccagtttcactgtttaagtggtcttacactgtgagacaataatcatttttaaatttaatgctctaatagtttaataaaatcattgaaaatttggacattatgtgatggtaatctccaagatcaactaaacaaaaatattaaaattaattaatttataatatatattataaattaaaaaaatacaataatggcactcttcgtatttgtgcaagcagttatctctcaagtttagatattgttttggtccaataatacctataaatcgtttaggtggccattcaatctccttggttaaggaaacactagagaccatccttatatcatcatgtcttgaaagttatctattttcttataaatattttgttactaaagagacattaaagagacatgaggatacaattcttaaactaagttcttagtacagaatattcaagtttattttttggttatttagatgggtgaatttttgttaatacttcctcctagagaacctaggaatatagtataggcaactaagaaaataagtatagataaggtggttttattataaccttttaaaatacggattacagcactttaaatttaacttatatatcaataggtccttttatactatctgacatggttatttgtgattattttttcatggactgtttctacagatgtgattgtgcaacatccgattaagacaggctaacaga

SEQ ID NO: 4347 - DNA, 1879 bp, Glycine max
  Soy_ogl_4003 Gm12:4936201..4938079 Cluster 18
atatgtatgaatataagtcaacaggccccattttccttttttggtccgcagttaaaactatagataattggaaaaagtgtggtgaaagacttcatcagttggtgacttttcaacttggaatttctcgaatattcaaaggaaagagtgcatgttgaattgtcgtgaactcttttgttcacgtattattttgagagttagataaagaagctcgttaagaaatttttacattgtcctaagttttctattaattattataatatgaattgtttaatgtagaaatacatttgttaatatgcagaaataaatcgcttattaagatagcatcgtcaaaagcaagaattaaattataatcatacaatcaggagtaatttttaactaaatctcctttgaattttcaaggaagaaatactggaaaacactacgttggttgtataaatcctcatacatatatgcatcctcctcagttgatggatctaactaattctgataagccctggaagtttaggaggatttgaagcaatggcactagctatcttatttataatgcatgcattttcttccgtttttctactccttgcaaccatataaagagcagtggaagttacttgatgcaagatcctatgctagattttatgagcacacaattaaggccacaatgtgaatttcttattaattttttttaatttatgtaatggtttccatccctacacttatctaaatcctccttcaacatttcaatcgtcttaaccaataaccttctcatatattacttataagagcctcgtattttcttctgggtgcctcaaactagcaaacaatccctgcaatatgagcttcaatatggcctcttcaatcaacctaaagacactccaatctaaccttggctctttagaaatttcatgtttaattagtcgtttgggccatattcggatgctaagaaggtataaaacagcaagaatgaattgtgccatattcggccattaccatagatagtcctttcatccttattcttttgttaaaaagtcagtccttgcatcaggaatgacaaatataattagacagcctaagtttttaagcaaacttgtgagccaatgaactctcctttgaataccacaacaaataaaagcaaaaccatttgtgccattcgtgttaagaagttgaattgaaactgcttaatttgaattaaagcatgaattcaatatactacaacctgagcatgaatgcaattaatatatctaactgaaaaaagaaaaaaaaaaacaaagatatttatataacataaaagttcataaaaggatgtgatatatatgctcatgttcccattcaataattaatgtcatacaacataaacgcattcacttttttttttggacagcgataaacgcattcacttagccaaagttgtcgatcagccaagccatatcttgtatctccccttttgctatagaggttgaaagagttgatataaggtgcttcagcgccaaacccattgtttttttcttcaacaaatcaatatagaccattcattgaaaatgtctagcaacacttaacaaaacatacaaaatgctaagctaaacagagtgttacaacagtgtacaatatatcgacaatggcgatcagacacaaacacacacacactgaaaattaacaacacaagcacaaaaaacagaaaattcccattaataaatgaactgatccgtggacaaggtgttgggcacggtcaagaaaatgaagcccaagggtgtgtctatcttggagcaagaagtgaaccacaatggacaggtttttctgaacatagaggatgcataactgaaacttcttaaagcttgggtttttctaaggtgtttggatccagctttgggaacaagcatgggaaggc

SEQ ID NO: 4348 - DNA, 1621 bp, Glycine max
  Soy_ogl_4372 Gm13:30845501..30847121 Cluster 18
taagcacttaatcaaccttttctttcgtctcttaatttggttgtcttcttagcattgactattctcagtctcaatttagtatatagtagaatttattttagatgattaaccgttaaccaagcagagaatcccaacatacgtacactaaaaatactattactagttcctatttaaaattaaatctcgattgtgcattcatgatagctagccgtgtctcagatttcatcacagtgaagatcctatacactaattagagatacaagagcaaataattaatcagggagaattggatacaaaacggacaatatcttacaggatctccttattttaaataataaccatatacttaccttatcagtctcacgacattaattatttccttgtttaagacaagatttagtttccttgtgttaagattaactcttgtattaaaaaaagagatgaggaacttgatgactgaacaaacaagaacaatttggtagaagcagctctacatatttgagacagctcccgagccagttcgattttctcatccaaaaagctcagagctaccagaattgtaagctctcgttgccatgtttctcttacatactcctacaaccccccctcctacgtacccgattggattatcttctaattttaattaaatatgagacttaattgcctcttttagaagaacagacggatatccattgctcaatatataataataataataacatacagcatctttggtatttgaacaagaatcgttgaataaaactaatgtttatcattttgctaagcaatatggtaagtttcaggaatcagatttctccacaccaggcgaatttctgccatcaacttctcaaccacagcataattctttgttcgatcttatgcagtagcatgcatcggagcttcgtgactaatttctaaatagcgcatagtgcaattgaaatcggatccagaattaactctatggttcacctaaagcgttggtgtacccattattccatttatgcatgcaaacacatacaccggtgattacggaagatgataatgcataatgttaacaatggcattttagaaacctgattcattgatgaatcattttgggagggatgtatctaggagtgtattaaaaggagagtcaaaaaatttcttacacaattatttaaatatttaacttctaataaataaaaaattattattagatttacataaaactagagatatgatctattagaagaaaattaaataaatattaattcaaaaattattttttattaataattttaaattctaatttttctctctctcaaatatacataataggatccttagagagggactaccccttggatccgttcctgattttggcttcactttcctttttagataacaaaacaaggactatagttacacattctaatggacactctacatccttttacctttctttaccaaaaaaataaaatgtagtgtgatatggatattttgatgtgtaaattttaattacgacagtaaaatgccagaatcggtaagtaagaacatagtactaatagctagcaaattcagaggtatgattcttctattttagaacagtattaattgaggaccataacacacacctacaaat

SEQ ID NO: 4349 - DNA, 2300 bp, Glycine max
  Soy_ogl_4550 Gm13:38518601..38520900 Cluster 18
gcttctccttttcaggatggtgatttgctgcacttctaaattaacttatctatcgtttgaatcaatttcactttgtaagtagcaacaaggaagcgctagtgtttgatcgatccctattgaagtagaaacatgtaatcttagtaaaaaaaaaaacttgactattgtctattctattgctttttatggcaattcaaataattgccaaatttatctagagtatttttactgttaatcttttgcaaaagacaagtaaaattggtgaaaaagaatataaaccaaaatttcctaaaatgctatatatagtttgaatcttcctaactccactcttgcatcttaatgtagaatgaacaatctaaaatgcgatataaaccaaaggatatgtagattgaacaatccatgacgaaacactagataaggattgcagaaaggaagcaagtataagattggaatcgtcaaagagccatttggtcatttcatctaacaaccaaaatatatgcgtgtgttgatgatgtgtgtatttgagtcaaggcatttatttcctgcactcccattgttgcatcctgcatctctcattgtattttgaaaagtccattctgaaatataaatttacattccggaatgcaatataaggtgtgggatgcaatagtgggagtggttctacttggagtttcagcttgaacaatggtaagaggttcagcttgagcaactggtattggacttgtaggtagtgcataattctaggcccattttgattccaagggtcagacatatctatgtaacaatgcatagatgtctcaaagtgcctctacttggagtttaaggccacaagatcattttatcttttcatgagtgatagaagtgctatttctgttgttagtgaattatgtctgttattttgacagaatctattacaggttctgtggcgttctttgaagtgtcatgtatcgattgcaccttcacaatagcatgacttgtaggcttgaagcacctaagtgcaggcttctattcttaaactattgcattataatatgatgaagcatgcaatatatctatactagtattttttattgcttgataacggaaaccaattgaataacaaagctttcatatagagtgaactggcaaaagggaatttgtatggccatctgattgattaaaggatggtgataactcaatctgggattcggtcccagccaactaggattttgatttttgagtaatgtttttaaaattaacgagtgtttcatgttttaccccaaaaataagggcacattttaagaggtgtgggattctttaatagtattttctttcttccatctattactctttttgttagatccttttgctacaaaaagcaactaagtctccaactgattatgagcattttcaaaatttcacgttgctttgtctaaactgtgatatgatcaaccctttagaaatataaccgtctattagtgtatgaccagacattttctcggttctttagggaaaagagatcctatatcctctgttgtatacactattcatagacaagtgtgaccaagtttcctaattacaattttacaatttctatacctgcatggctgcatcatactgataccagtacttgagtttttctagaggcatagctgctgccacctatagcctatcctgattgcttattgtttctgcaagaattgtcttgtgaaaaagctgctgaagtcataggctcatagatatacatgcctctgttttttattggttgtggcactgattttttggtatgagtctatgagatcacatatatttttctcgaagtatttaacaaaatggcatatttaggcaccaactttgataccattagttaagccagaacaacaaagtgctagttgatccacaagtctatgcgcttggtggtggttgtggcactagtttaatcaaatctcaaatgtttttatatgaataaggaaatcgttttctgctttttgttttgtatggttctaggtttgtggtaacaaagaagaccatgtaagcttcatcagtcttggtagatatagatgtaattgctagtttgaattaaacaagacattgcttctaattacttgaagtttgggtatgatgtggataaggtattaatgcatgattgaaaccaataggtgatggatatagttcaaatagtaggaaagcaattatgattttggctatatgcttgttggcaaggcaacttggagaacaaaatcaaggagctttgaaacccacttgcctctgaacttgttgaaaaggttttcttagcttttactacctcacttttgaactgaacc

SEQ ID NO: 4350 - DNA, 1815 bp, Glycine max
  Soy_ogl_4608 Gm14:2199886..2201700 Cluster 18
gtgaagagctctgctagggctccagctaagagttctaaggaagaagaggaagactcttttaactgtaataccaaaaaggttaagactatggcaggttcgattacgatagatgaggttattactgaggccagagacaaagaaaatatgtagaaagataaggttccaaagtcctatttggataccttgttagaggctgaaaaagagattgtgacaaacttccagagctttgtagatgaaatggaacgtaacactcaggatagatgttacaaggtaattaggagtatgacaataataatgatgctacaaagctataactatgtccaataactcctatctcgaaggaatttgaataatggtgtgacccccggaagaactctcatattgttgctgatgtgttgggaagaaagatagttttaattatgattgaacacaagctacacaaggaacaatctataatgggaactatacgcattatcaatatgtcgcaagactattactacctagtttaattagttctcggtaaagaaggattaatggcatgccctatattttgaaggaccatggattttttttttgatcagcatgaaaaattacttttatataaccaaaaagggcataagagatacccatttacatattacatgacaaatgttccttaaaacaagtgacccctctaatggttatatcatatttagcatactacaagattgatgtttatatctacattctgggtctttccattgaattatatgagagaagttcttatggtaagcaggtccaaagctgggaaccattttaaaaatcgatatgctaactttatacactccagagggagattttgccagaatctatgttgaaattgacctaggaagaaagctagtatatatcgtgaatcaatgtcttgggttagattctaaaattgaaatacgaaggacttcactcaatatattttgattatggcaagtacgatcataaacaacccaatccattcttaagaaaatatattctattacctttattaaaagtaattaaaaatattgcttatatactattttttcaatttttcaaatggtaagaagattatagggattaaaagagagaaatatatattaaatgcatgtataatagtgttttgaaagagaattttctagaaaatgaatcagataaatatattattttcttttcgtctaaaatcttgttacaaatctaagttacatctattgaaaagaaaaaagatataatgaaaaaaaaaatattttttaacagtttgggggatggaagtggactcacaatgtagtgaagcaacattagggattgagcaaacaacaattaaatgtcccaacacataatcaccagcaggaagctaccatgaaagtaatgaaaggtggagaaaaggaaaatcatgctgatgtaagccctaaacaaattaatgagtcgtaaattgtggctaatcaatttgttcaagataaggcgggattaattatacggtccatggatggtagttaaaaagggtaaaaatgtgtctgaggggcacaaaaatcaatgttgaagttttgaaagccattaatgtgaaagctcctgaaaaaacagatcaaaaaggggaaaccagatcaagattcaaattgaatcagtaccaagatgtcacgtttattgcatatgatagctataataattttgcattcgttgcaaatgtgtagtacatagtttcttatgacattctattccaatccacatcctatttaaaggatatccttatggacaataagtctagtaaacaacaatctgttattatatattatcatgattaattaattt

SEQ ID NO: 4351 - DNA, 2184 bp, Glycine max
  Soy_ogl_4907 Gm15:8235101..8237284 Cluster 18
ccttgttaattgtgatagtctgagtatatttttcttgttcataatcaagcaattttgtcctttctcttagttagcaatgcagtaaatttctttgtttcaagttctttgtcctttctctcctctttgcaggggtcaagccttcgttgataaagacaatattgaaatggtaatttttatttagctttgggcttttgtctaagaagcactaactggcatgagatactacatatacatggacacaacacaacacacagcaaaatctgaagtgtcccactaggattccaagtgtcatgtctgactcaagtgtacgtgtctgacatgtgacactgactggcatgagacaacacatacaagaaggactaagaagtactaactcaagtgtttgaaatggtaattgttatttagctttgaacttttgtctaaaaagcactaacgtgcatgagacacagcatatacaagaaggacacaacacacggcaaaatctgaagtgtccgactaggatttgatcaagtgtatgtgtacatgaccttcctttaatgtgtctgtgcttcaaagattttggtgctggctatttataattaaaatccatacttaactttgttgctggcagctctctctggtttatttaacgcaatagtgttagaaaagtaaaaatattctctcataaacagttagcatctcaacaatgtatcagtgaaagtacataatttggtttattattgttcagggtaaactgtccgaggatgctgtccatgtaaagcatacaacctgcaaggaccacaaaaggattctcctgtctcagagatttaagccttgttttcaaaagttggtggggttactgacatggatacagctggaggaaataattttaggacatccaaatatacttcactgctggaattttcaaggttccactagcattattgatcggtgtttgagatcacagaaaattgcacatattgattagataaggttaatcgttcctaccctgtaaaaacttattcatagatggctaggctagtcaatacaaattgatgccatggttttgttttgtcactcacagggccatatttttggctattttattttgtcacattcttttaggctacagcggaatcaatcaagttgattatccgtttctcactgctttcattgcgataatgttgaaattcacttcaaatgaaaatatcttgatcttgatggatggttaatttaatttgtgctagaaaagtttgtacatgagtgtattatcacattcacataacaaggatatctccttgaaaactacttttgcagactattactagtgtgctgttaaagcaccatgtaaggagtggaataagttgtgcatgcatttgatcctacatagactaaaaatggtcctaaaggaacatttaaatttgtaccttgtaggcttgggagtcagctatatccatgtatggtatctgatacttgtatcatatatgtgcttcataaagcttcacaaaaaagtttccaaaccagtgtgtcatatgaaacttaccttgaactaatgaacttactaatcttgaacgtcagagttgatagccaattttcagttaaagcactaggtgatagttatatataattatcaaaataaaaacaatatagagaaattaatgagtgatatgagtaaagctaataatttcttgtggttaccacaagataatatatattagtagcaaaagctgaacagagaaatgagaagtctgatgaagaaagggcctatgtactgtactattggcaatgattcctgaattactagcaaatttcaaaccacataaaaaaagggcatgtgaaatgaagcattgttatcacaagaaagactattggacaggttaaaatcggtttctgaaactattgttaagtctacaactttaatctgcataagattcaccatctgctttatttgaattgatagaaaatgtgaaataaaatggaatttcaatcaatttcgctttccgatcgcttaatatataatggaatggaattaaaaaagatgaaataggttccatataattcatccacaaaacatctatttttcctccgttttaatttggaaagtatgggattgtattatatttttttcattatatttatcatattacttatctatccttctttagcctttagtctcacgattgaaggtcacccgatagctttcga

SEQ ID NO: 4352 - DNA, 2200 bp, Glycine max
  Soy_ogl_5263 Gm16:3020201..3022400 Cluster 18
tcaatggtgacaataaatcatcatgtcattggttcttataaaattgaattcaagatctcttatatgaaggttctatctaataaaagaaaatgcaattggaaaaaaaaccattaaaagtgattaactaagttctacaataaattgatcattaacaaaactactagatatatcatatcaataatataataataaaaaacatcaaaccaaatcaatttttcgcattacaattaattgcactaactgggaaagctaatcaattatagtaattatattattataaaataatattttatcacatatatcacgtgataacactatattaattattttctcaatgaaagatcactgattttttttttagtttataatagtacataataatttctgttttaaagatgattacaaatttacaatagtgtagtttaccggaacataaacaaaaatagattctttaaaattaattggaggaaaatgatatattttaattttacaaggataaaaaatgtattaaaaattttgtaaggacaaattctgaatatttttatatttatgaaaatgaaaaaaatattttagtcataaatttatttttatttatgtaataattatttttctttattcatgtttctaattaactcattaacccgttataacttgattaataaaatatttttaaaaaaaataatcatgtgattaaaaaaataattatctatacatagttgtataactggaatttacttctctttctcttgcataaataattttctaactagaaacatcttttttttcttctgaattagcatgcttttctatacacacgagtgttctttataattagatcacctaaagctgcgtgcgtataagatgacgaatttaactttattataacgaacatgcttcgcttatacctatggtttgccgttaagatgtcgctgcatatgatcaatgtatgtaattgtcctatgtctcataaaacctcatattatacaaggtgggcaatgatattatattacaccactaacaagtgtcacccttaatttttaggggcttttaatcctctatttttttttaaaaaaagaagtaaaatattacaccactaacaagtggaagaactaaacttgttttgcgccattagggtaaaatattatactctccctcttctacatgtggatgcacgcgcgtgacgtgagtgtatatgcatgctaacatgcaatgcaaaggacataaatcaactaaaatttaactaccaaggcaatgtggaaggctctgagcaaatgtataaacgatataaaatttttagtaagcagctggctcacgtgtgtaaaagaaacaagatacattaattcattcattaaaaaaatggaaggaaaatgggattggaatcaaatgaatatagactttgaaatttctaccatgagataataaattttctagctcaggagataattgcggtgcaaaattaaagggtgttgttatttttggtgcctgcgttgatctggtcctggagatgaaaaaccaagcagtgactaaactaaaatggcttataagccactttggtgaaaaactcatgttcctcatggcttctattttcaaaagagagatcatgactacgcgtgagaatcctgacgcccctagctgagctaagattaatgcatgctctcaaagtctcatagaagattgattctatgctacgagttacacgtgtcatttcaatgtgatccacgtccaaaaaatgtttcgacattttcccaagaaaactggaaccctaccccatattaattagtttcgtagttattgtttaccatacacatggaaaagctagccttacattctaagtaacaatttgaataagggcggtgtgggggccaaagcttgacacggtgttgctgcatgtcccagaagccctagctagggcaatttaatttggagtttggaccctttcaaaccttctattgattgtctaaccaaagcagctggcttcactcaactactttcacagtagagtccaaataccggccaaatattcctttttccaagtcagtgcctgtcttggtatatttgaaattaattaattacgtattacaaagaagaattttttcaacataattaaacacaatcaaaaccgtataaattaagaattaatgtgtctcaaattatatactccctccttccgcatcctcgatctcccataaaaaataattgg

SEQ ID NO: 4353 - DNA, 2100 bp, Glycine max
  Soy_ogl_5272 Gm16:3455301..3457400 Cluster 18
tttgaaatagcaaagaaattaaaaaaagtgatatgcttttacttttaatcactcgtcactatcaccaggtattaaaaacaggcgttcttgcaagaatgtacggactaaaaattttgagagagactagaattgagttaagaaatatattgaatgaacagagaaaaattaaccctagaataatgagtttaatgctattagttgatggtttgcttgttttaacatgctaatgaaagcttcgtgatttttgtaacatgctttggatgtcatgctgagttactagcttttttatccttttttgcgtgtgttatgaggtgatcaatgatgcactggttttgttgtcttagggggtttaagcagtttttcaaacgaagacaccataaaagttcctgagtctgatatcggggcacattttggactgctgttagagaatgaagagtatctgatgttactttctcagttggtgaagaaaggctccatgcacatatgcttgttttgggtgcttggtcaactgcatatgtttgaaactgaatttttcaatggaacggagaaggatgatcctggtgacatagttgttaatgacatggaacctaaggtttttaggtagcacattcattataaatccccctattttctttatccttttgcagttattttttgttccatgcaacataaatgctatttaattcattttcagagtggcatatcatatcatttgtatggttatctaatgtttctggtgtcctattgttgcgcaggctttgcttgactctacttaggatgggtcattgagactacttttttgcttgttctatgttgtaaagaattgaactttgtgtggaaattgatgtttataagtgctggacaaaaaagtgaattatctcatgtttaagcacttaaaaatggatcctttacatgtagaaatggtagctctaatatgtttatatgtttggtgtattttctagggtctttggtgacctaaaaatgaagtttttgatactctggcatttttttattgtatatgcaaaaattgtttaaatacagtagcaaagtgtggtttagaaaactcaaagatggctattttatgtcgaaaaatgttagctttcatatgtataatttgccatgctactcaggaccaaaaatttacaagaaattttttgttgagaaacgtcaaacataaaaaaggaaaactaacatctactataggagaaaaatttatataatgtcagcgataatattcaggatggaaaatctcatgcgcacaaaatcttcaaaattcattaagcttttctttaaatcattaatttttttcttgaaattattaaattttttcttcaactcattaattcctttctttcttttctttgttttccatttattatttatttcaagcaaagttgaatgaaaaccaaaagtgactagattcaaaccaattaacaacacaatacaacatccagcggagacccattctctttcagttttcgtgaaaaaaaattgtttatagagaaaatggcaatgtacagcccagtggccgcgagcagaagcgttctagcggctcaggcgagttcgaggttggtgacccaaatggtgaaaggatcacacaagttcgagatagagggttactctctgacaaagggaatgggcgttggaaaattcattgcaagcaagtactttcactgtgagagggtacaagtgggcaatatacttcttcctcgacggaatagacccccaagataactccttctttgtttccatcttcgtcacactccagtctgtaaccacacaagcttcatagccactttggtcgctacctcaacaatgggccttacactctcaaaaaaataggcagcatgtggttagtgtttacgttttcttcttctatttttcttttggtgcatcaatgttttctttgtttaattgtctatttttcctttaaaaaatagattacaatgtacttttagtctttaaatatctcaaaattatgtgttagtttttataaaaagttattatatatgtatgccaaacatttaccaaacttgttaggtttttgagataaaaaataaattaagaaagtgatgtggttttgcttttaatcacttgtca

SEQ ID NO: 4354 - DNA, 1898 bp, Glycine max
  Soy_ogl_5443 Gm17:1304901..1306798 Cluster 18
tgtccaataaaagaaactatacgttgatttgaccaaataagttgtagaagatagtttttcagacccatattagccatccctaccaagtaccaagttcagcaaccaattatcttcctcccaaggaaaaaaaaaaaaaaaaaaccttctccatttcatcaacccatttctgaataaagtcacagatttatctttagacagcgagggcaaccaggggtacagctcttttaaactagagttttaatttttgaccatataaaatctaaatactaaagatactttattgataccccttattttctctctctatcatcttatcatgttatatgtgtaatcatattaattacttatttttctttcctttttgtttttctttggataaatattttgaacaataatttttttatctaaaacactttaaagacaaaaaataaaataaacatttttttaaagactaaaacaaaaaaaaaaattataggaatttaagtttttttttaacgagcctttttcctttaaaacccaaattgcatatccacatatgccaaaacaacgtgcttgacccattcctttttttcttatatgttcctttagagaactgttgggaatgcatagaggaatcataatcattagagcacatattgctccacaaacaatatgaattcttaaccacctctctatgctagctcctaaatgaagacaagtcaccatatctataattcaaaacagagtaccacagccagatagtttctttatcatagggaaatctccatctccactatccatagaggtcagatgtttgtcaagcaattttcagttatagatttataatattgtattagagagttatttaaggtagtgtagtttgaaaaatatgttaaagatgttgtcttttaaatgaaatatctcaatattttgaaagattaactgaaatacccagagataaaaggaaagtatggagagaattattcgaagtataacagaatgaggaagatgaaattataagttacgttgctgatgctgctgagggtttacaactttatcctcagaagctgcattgacagaaggttaacaacttttttcatagtagtatatcagaaagacttgcaactttattcatgtcaaagttgaagtgagaatgtttaatttgcatcttttttctattaaaaagttatatgatatataatgtaggtcacagtgaaatcaatagcatttaatccaatgatgtgtaggtatgttcgattgaatcaagttaaatttgaatttatatgtgattgataatttgacatgtctcccgcaatcactattgacttatttgagcacacatgtgacaagggataatgtatgtattcatgaacaagaggtatagggagttttgcgattatacactctcgtgagtcctgagtgggatctctggtcaatatacagtctaccctagtgtaggtcgggtggcatatgtctcattatggtggcggtgcaatacaaatgtgttttttttttgtacagagtgcaaatgtatgttgaaagactttttgatataaaagtcaatatgttacttataagttataagggtaatataagcacgaagaattgatttgaagatttgtatgatcattctgattgtgatttgaaagatggtggagagtatgaattcgaagattttggagatttgaagaatgtttgtggttcatagaatgcaaatattcaaggtggaaataattgggtttgacccgaattctttatttgaatatcgttacccatacatatacttttctattttatttacgattagacatatgttgtactgcaccaaaaaaaatacatatgttgtaactaacactggcaaatatctcatacgttgcataaatatttgtaaatataagtggaaaaaaataaatcgatac

SEQ ID NO: 4355 - DNA, 2100 bp, Glycine max
  Soy_ogl_5470 Gm17:3169601..3171700 Cluster 18
tatattagtgtctacagtgtcatgctagcacgtgacatctcatttttttttctttataaatttctgaaatgaatactatttatctaaattaaaatgaaccgtaggagataaaaaaaaaataatgatttcaaatgttcttttcaggcttcatcatacaatatcatgctcattactacaaagcccatctagcggagagggcatgttcaaggcattcatcatctctcactgcgtgtgattattagtcatgcagtacttgtcatcgagatcgatcagtgataataggcttcttcatcacactgatcatattcttgacattgccatgaaaggaccatggttgactgatacacatttatagtgagatcttctcttttttaacaatatttatttatttatttttattttacttttatctataatatttgtactttaggtaagggatttgaactcaatttcactcaaaacaatttattggggtaggaatatggtaattcggatatacttccgagtaccaaaactaaggatgaaatagctatatatacgatatttatgaaaaaaagtattcaatcctggataaataatgcaagttcaaaaggcgagagacaccattcggatcttgacatggaaattagaattagaaatcttactaatggaggagcaatgtggtacagtgagtgctattatatgcattaaggaagcttctactcttgttcttataattattctggggttcactttggaagaccattggcatggttaaatggaatcgtcagtaaatgcacgtctcagaatgatgacaagataccagtttaccagtgtacttaggaatatcattccttcatcttttttcattaacccatatctgttattactttgaattgtaaggttctcttctcagtacccacttccaagtacgcaagttactttcaatgtcaggaatatatgttcacttcttaattctcacatcatctcaaaagactaatacgtagcattactcaattaaattcctaaaattatcataattaatttctttttgatctttaaaattacgagtattatttttttgctaactagcaaaaagaagggaagctggatccacgtggagcagagactgacatgttaactatgttaatatcctaattcctacaatcccagaatggcgtttgataattttaaaattacgagtataaagattaaaataactggtgttttttaataaaaaagaaataaagaaataactggtgtttgataattttaaaaactaattaaaagggcgtttctttttatgattttaggaactaaattcatcagtacctctgattataatttgagagactaatttaatttggtgtatcgaaaaaatatactactatatgattggtacagataactataaactcactcgagtttcatcactttttccccatgtggcatgaaattttacaactttcggtagaaatttcagagcagttctgtaatagcagccgagagattctaacttagcttgatcttgttggtctgaaactagaaaagtcgtgcccttattatatactacggtaaactgatggaatccgatttgaagttatctttgcagagattgacaatacaacaattatattagggtaataaatgcatggattaatttgtttatattctgtaatggaaaatataggcaaagagtatctttaatttgtttgctagttactccagtgaactgaggttatttcgaagagtaaaataaaatgacatctcggacattgggaacaattgaactgatgaaaagattgtaaaggccatgctcaaaagtttgcctctgtgtcccatgttattatgtcctcagtggcttcagcttaattatattacatattttctgatatgaaagcagaaagttttccgaactgtataaactagaagcaatagttagatattttagataaacaacttttttttcttccttttgtacttaattttgaatatagtccatttgtaaaggataataatattaattgaattgtgattaaacaggatggaaacggcataaaaaatctaatcttcagttatccattcagataataagtcttaccaaattgaatggcagaggaa

SEQ ID NO: 4356 - DNA, 1555 bp, Glycine max
  Soy_ogl_5498 Gm17:3967446..3969000 Cluster 18
atacttttgtcttcatcaaattatgaacaaacacatgaagacatggattaaacagctggaaacgcgtcacggaggagggtccacctatatcttcaccattctttgttcatgcaagagagtgttttagtggaaattaaatctctgcctattctttttgtactatgctcgttaagttcactgatacaccacatcttctcttgattcgaccatatatatgcaccacactttacggcaaggctgctaataacaatatatgctgcattcaactatttatctttagctaaacctcatttgtgtttgttgcccacgatagagtattactggtattacgttatatttcagatgttatgcaaaattatgttgttgaaaagaaatcaaagagtcattagatgtgtagaggatgaataaacgccttttaatttttcttttgtcctcaaatataatttgacgtccattccaaattaactagtaatatttaattgaaggttcccttgtttctatgcatatatataacttaacatatataatttttctttcttgttttcctatccactcacggacttcgcaatcaaaacaaagaagcaattacaaaacgaagcacaacaaaaagtacgtagcacaacgacgagaatatgacgtatgcgtgcatgctttattaattttctccaatgaatggtttccttgttagaccatggacatccatcccactcgtgctgaacagtgtatactagagctgggttcagtttgaatttttttttttccacaagtattcataagaaaagaaatgataaggagatgaaacaactcgattttttataagttcaaaattaagttatatactttaacttttggaaaagtgaggtgagaaaggttttcaagaagttataattcaattgtatacatttttattttattcatattttgagagattgttaatgaaaaaaacccacgattatacttatatttttaaagtagaaaaaatgaacaaggaaggaagaagatttgagagtgatcaacatagaagatcgagtcattatgtagacttcagtaatgtaattgagataatcttagtgtctatgaaaagttcaagaaaggaattacaattgtcataaagcgattaattagtgtttttctcattctctttctcatgtacgtgaacattaccttaattagtcaaatatttaaaatgatatctacgtatctattagggatggtaaggtggattgaatttgcctaacccgccaagaataatatataggagtaggttaagtgatttaacccaacaaaccgccctaacctactaatttaaattcatttgaggtgaactttctcgatacaacaagttatttgtggttaacatgtttgatacaacaaattattgcgtgaaataaatgtcgcagagttatttgggaaataagtgaaatccctcattcatgtagacaaaagaatacagagatattccatatttgcatctatacatactgctagtagaagcatatataaaaaataactttatattttagcatatcgactcaattcgtgtgtctattcataa

SEQ ID NO: 4357 - DNA, 1300 bp, Glycine max
  Soy_ogl_5891 Gm18:2242701..2244000 Cluster 18
atcagtcattatcaacacaatgatatagcatatggacatcaagtttctttcaagagttatttcttaggttatatatatctcccataaggagtcattgcagggtaccgatctcattttggataaaatgtacttgcctaataatcaccttatagtcatctctaccacgcatataaccaaatccatcaagaacaatgtgagggtcctcgttaggtggtacaaattcaactaggttggaggaatgaccttgaaatccccggtagttaggttccacaatacaattttgttaggcacttgaaaaagatcgacaaagaattccaataacactagtagaccccttaataagaaaagcagggtcatcctcttgaaatggatttggccagtctattttgataatgctattttaaacctttcaccggagagagaaaacaaggaggaattaaaacccgataggatagacgacatagtcggacgcctaaggagagacaatacgtcgcaataagaatgattattagatatgaaattgttgtggaacatgctcatgaaataaaggttttgaaatacgagggtccataatttgtgtacacatccaaatttcttcaaagatttcgaaggtagcttggacagaatgaagaatgtaagatcataaggtatgtgattcctaagtttttcgctcgttgcacccatagattttttttctccgtctccacttgcaatggtaacctagtgggaaacaagagatcatgagagcagaaggaagcacattcctcttctttggtagtctcaccatccgccattgcaattgcaataccaagcaacgagagaaaataaatcaattcaacaagagcgcgggtaacgagggtttactttgggagaaaagaaaacaggtcgtttcactgtttgtttgtttgtgagaaaatgagagttttatattctttacgtcaagaagtatacggctgatacgaagaggccacgtccaacattacgtttcagttttcacgcttgccctaattcctattcctatcccagcatttggacttatatggccgattcaaatgggaaatattttatttgacgtctgcaataggataaaaaagaatcaatttaatccttaaaattaatattattagtcaatttaatctttgaattttattttattctataaataaattaatttaacttcggaccactttaatatttgtttttcttaatttgatccttaaaattcacattactaattaatttatttggtttctaaatttcacaattatcatcattgtagtattggatttaacttaacaat

SEQ ID NO: 4358 - DNA, 1500 bp, Glycine max
  Soy_ogl_6534 Gm19:43537301..43538800 Cluster 18
aaagaaataatacttaacttttatcttatttaatattatgtcattcatttaataaaatgttattttctgtaacttatttattcctattctatgtgttgatagttaaatttatttatatataaaagtggcgaataagagttatgttgactgatatgggatctccaagaaataagaattaacaagaggtgaggatgagagtgtgggtgtggggggcaatgaatggcatgattcatgcagctagctgtatgtatgtatcatgagcagcatgaaaagcctgttggccacactgtactgtactttctatatgtgaatagtaaaaagttgattattctggcaggggccactctttgctctcaaaagtaggtgacctatcaaatccgtaccaagttactgaccctatctctctgtcacttttaaattgccctctctccaaacttgaaggttgccaatgaatgacctaatctaactctctaaatttggtttttccctttgtttgttgggctctattgcattgccaagttattcctatctacacacaccacttcacttgaacctggcctcatcaatttcttcattcacatccatctcaactgccgacatcattatccctgcccataattacaaatcttgttctatttccctgtgttttttttaacctaaacatatagaaacaactaaatttaccgcctctgcccacaatcaatcaccaccagatttgcagtctcatatatttggattaactctgattctttgtgttgctttggtcaattaaaacctttataaatttttcttataaactacaggaaaaatcattttcaattaattgagagtataaaaaagttaatactgaaattgtatgtctattaaactcaaaaaagttatgttttcaattcaactatctaaattataatttttaaaataattactattacaaaaatcaactatcttactatatatgttgttaatgtattttaattaaattcttattttattttatgtatacatgctttttttcattaaagggataaatgaagtggtacttttaatactattgaccaaaacatccatggtatgctaaagctgttaatagaaactcacgtaaaagattattccaccgacctgtaagcagttttatttaattatatatacttagatcttatatgctaaaatatcttgagaaaaattgcccaaaacaaacaaagttattagattttaatctaaatatatggaaaatgtaataattatacagataatgatattcatctccctcagtcagtcttttataactcatttttacctcattttttttcttaatttatatctatcttcttattttgtatcaaatcatatttcgtatttattctttttaatttgtctttttctctcttactttttcctctatccatccaaatccacccaaatttattgagatggacgagtaacatttcccttgtcacatacaggtgcttctaaaaaaatggacaattttattgtcttatt

SEQ ID NO: 4359 - DNA, 1706 bp, Glycine max
  Soy_ogl_6549 Gm19:44074160..44075865 Cluster 18
gacaatgctattaatattaatgaattagttatttatttcttatatagaatatcagaagagtatgtttttaatataatcagtacaaaagtcaacaaatactaatcaatataaaataaaaaatgaaataaaatattttgttgagaagaaaaccctaatgcactataaaatgacacttgtataattccacttatcatcaatcctcttagacatttgtctagtgtaaagaaataatgggcccaggttccacattctcaactcaacttgatgctgaagtagctgcactgaagggtatgctttataacgggcttctgatttattatcccttgttttttgggaaagtgaagggacggtgagggggtgtttcagaagctgaactgaaaggctttgttttgagggaagataagattttgtcaacatcatcaatttgctttattcataagacattattattagctatttacaaaatctctgttgaggctgttaatagatgtaccatgccctcatgcaatttgatgcaccatgtccacaagcaaccgaattttgttttatgttatgatgatgcacaacaaggaagatgcttttgtccttaaccctagcccccagcaactgctccagctgttgcatttgttttcactcggatatttggctggttcacgttaccaggtgtagtatcattttactttatggcatggccatgcaaaatttatgccagaaagcaagaaaaaaaaagataagaggattaatactcatccgttactgcattaaaaaaaaagacactcatccgttactagtgatcaaatttacaatgatttttccaattttgcatataaatactcttaaattgctagttagcttgtccaaccataacttcaaataatatttttactaccatatccccctacagccttcaatgttccttgaataaaaaaaaaagcttttaaaatgtttttatttgcatcagaatctggttttaacacccaacccccagccccagttggagccaaacgaacatgggctagaagtgtaattttggggtcatccagattcaggcatgaaaggccgtttaatcaaaacacatcacaaaattggtggctgccaaatcgcatagtccttttttcttttcacaccgtctgcactaaataagtttctgaagggtacttttgtaaataaaagttaaaaaatagctggctttgggaagagccaaaaggccgtacaaaaataatagcaactcgccacgattatttttttggttaaccctcacaattttttgaacaatacccaatggtgtgacaaggccagcgtctcaatagtcagtcatctagttgataacactggttagagatgtaaataagcttagttgttcatgaattattcaaatttcactagttaaatgttcaattatattcgtttgtttaattaaataatcaaatttaaatttgagattaagttcaattattagaatgagttaaacgtaaattttacaagttcaatattaataactcatgattttttttgtacaaataactcatttctttaaattgatgattagaattttcactagcttttatcatttatatatttattattaaaatatgtaaaattttgttgagaacgttcaaaattaattttgaagtttcttttttttaatattcaagaagttatgaattttaattttctggattataaaaatgtaattgtctagaata

SEQ ID NO: 4360 - DNA, 1574 bp, Glycine max
  Soy_ogl_30 Gm19:44784401..44785974 Cluster 18
aaataaactgaaaatattttaaagttacttgattcgaatgaaatgagaggagagaattattttgaattaagtgaggctcatttcatttggataagagagaaataattttgaatcaatcacctatatcaaacaattggtgctattttcgtctgcagtagactgtcatctcagccaaacaaagcgttaggatttattacaccacttgttctttttaaggaaaggacatttatttatctttgttgttttcaataaataatggtatagaaattgtatgtaaaaggaagttatgtttaaataaaaataagacttgaagtgtaataaaccatgggtcatgctaatcagccattagagttctatgtcaaggaagtaataaatattttattttattaaaaaatacaataagatactttaaaaattacgaaggaaataaatttgtggtactttataataataataataaaaaattatttttccttaaagaaagtcatttttaattcattaaccaatgtctatgtgtcataaataactcattttaatataatttaattatgtcttggataggataattttttttatgtaagattaaatttcaaactaaattagtttcaactgatttaaaggaatctaaacttgtggaatacctcataattcgaatccaaaactcttaagtatgatagttacaaaacattatgtttggtaagttagtgtaattactcttaatgtaatttgttcgtaactattcacattacgtccttgatctgcagtgccccaattctgtaactgttccccagaaaaacaaaacataggtctaagagcacaaattcgaaggttgcaaatgatagtgatcgatcaatggcagcagaaaagcataaacagagatgccacctggagtgattagaaaaggaaaaagaaagacccagaaatcaagatgcaaattttacaagtcgtttatccattaaataataaaagggccttggaaaagaaaagaacatgagattaaactgattagtcgttgtcaaattcctccttccaagagaaatatcaccaaattacaatatttgatccccttccgacaattgtaattcttttacacttactggcccccagttataatattcctgctggaatgcccgaggagtcaaggacagccattacaaacagtcaaacacattcaaatccttctaaacaaaagtgctatctgtatgtagagttttgctttacatatcttcattttgctcgtgaaaaataaaaaaagataaatatctaatttcatatttgaatttataagatgttgatacttagagttttaatagagtcttaaattttatttctgaatttttaaaaaatgtgccaaatttatttcactgtgtgttgtgtgtgactgttatgtgtgcaaacggataatcacataaatgaaatgatgaataaaatgaactgatttgtcaccaaatttttttcggacaaatttgatagtttatgtaaacccaaacccacactctctccggcacacctccgttgtagctacacttgatgcagttccagaaaaacatcaaagctctaaattgacaaaaaaa

SEQ ID NO: 4361 - DNA, 1645 bp, Glycine max
  Soy_ogl_6771 Gm20:35280701..35282345 Cluster 18
aaaaaaatattatccgtttaatctttgccatagaaaaaactgttaataatttgttaggccacatcaataaaatcttacattttcaatttcgttaaaaacttaatcagttaattttgattcgtaccaatttaattttttgagaatataagtaaaatcagtttttcaaaccttttttttccctagttgtaaaaatacatttaagggaggattttactttgggttaagaccttcggtagcagattacaggactaattctcatttcgtccttaattttattttcactacaaaattcttcaaaagatttatagcgtgtttgaacacgcgttaacagttacatttaacatgatttcaaaatccaaattgaaaggattcattatacctttgacatcacagctttcttacggttcaatcgcatttttaaacacgccactagtgagtttgaacactcacatcagaagtaaacactagctagttaattattttttaattacattattaatgacttacaagttgataattgaatgatgtaatgaaaaccaattactgtgagcaattattggcaactagaactaaatggatatacggtaaaccactaaaccatgatcggttatagagaaaaatgccacaagatatagacagctctcataataaacttgccttaaagtgtgtttgatagtgggggaactgagaaagaaaaaaatagagaataaataatgcgaagtctgatgtgaatctcatactttttatactttattttaatttaaaaatatatttttaattttcatcttctaaatcaaatacaatcttaaagccaaaaaaatcttagggcgaggctaatctagaacaagtggacggcagagaagaagggtcaccactaagcttccattttgtgacgaggaagctgtcatttcaaacttgttgaccgtttcctgcacattttagtctccattgaattggcccaattgctgctgattttggtattaggtgaaaccattcatattagtaggcatggaataatgtgtgagtgtgtgtaacatttttcttctgagggcgtttcagaagcgtgtaagccatttcaaagctccaccctctgctataattacatgactagattatttgacccgctgctattgcctattctttggattctttcgattgctgctctttctctctttacgtggattctttaaaaaaacgttgtacttcagtcacaaagtcttattagcatttttaccaaaagaaaaaaatatcttatttgcatagttttttttttttatatataaatagtatagtattgatatatatttctgggttcgactgacggtataatttgtgacgcgttattcttagaaatattatatatacagcattacattcaagtgtaagtatttgaaatgttaatattgtattagtatcatatttgaataatggagagacacgtaagttatatttcattgactaattaaaaaaaacacacacacaccgaaaccctttaaaattaaaagatactataacaatcgccaccaaacattttttactttgaaaaataagtgggtaaggcaactcatctaaataataaaaatacaaatatactgaaaaataagtggggtaatatatgtacgtatatactagtatattgatttaa

SEQ ID NO: 4362 - DNA, 2100 bp, Glycine max
  Soy_ogl_6846 Gm20:384291..38467300 Cluster 18
gagactagtgaagagtcaagacaattgaatttgaatgtacataagaaaaagtgatagtgaattcatattttgggtacatcaaaaaatacacatcaatcaactgtgaacaaaagaaaaaatagaataggaatctccctttctttcttactctcttggcaataaagcagaaatggaagcagtcagaatcagagacttaatttggcctcacttggctttggtcacgcaatgtcatatcacacaatctttctcaattttccatttttgggacaatttttttcttgcagttgaaaaatcctcagttatcaaactgaggaaatattttcaaagtctagagacactattagcgtacacgcttccatgaatcccatgactctctcaatccccataagatcataaatataacgcagcaccaaactcaatctaccacattttttagagaatgcctttattttggttatttattgctttaactacaaaatctgacgaatgcaaatgcaactcactgtgtatgcacaggacatagtcacattcacattaacattagcagtgaaaatgtgagttgtaagtggttgatgcttatgtgttttggcctttgggggggcttggctggtttgaactgcatgcatattctgcataactttctttcttgggagtgtgatgactctgattctttctattccctagaaaattacccactaatgtgaattcactttcggccatgcactaatggcaacgacttaagaacgggtgttctaaacaattaaacaccatagaaagtgctctcgtgaaatttcaaaaccttgtttttttgtttttttgtaaaagctaaacattgcattaacaaaaaggataaccacaagcaaatgaaatccgaagacagtatgtatacaaaaagaaacagaaccttgtctaaactaccaaagagaacaaactcctataaccagatcacgaaatctattgtctaagcttttaatatcaaaaccttgttttgttgattctgagtgcgggtctttgtatcatcatatgactcaattatgagttagtgtgggtaggtcacgggccagttgcttacgcacacatattataaccctctgtctatagttataaaaaaaacatgcagccaaattatgaaaaagtgactaaggtttagaccataatgaaaacaaagcttgcacaccaaagcaggggataaataagaacaagaagaaatccatttaaaattagcaaaaggaaacagaaaaattgactgtatgataatttcaattgagtttaagtagcttaattctcaaatcaagtccctgtagcaaatgttgagttttttttaatgaacttacgatttctattcgcggcttcttctttttcttaatggtaaagattcagggtcagatcaatgataattttttagtttaaaagttactttcaaataaaaaactgttgggcaatgtatccccgaatcttcaaatttgtaataaagagctagggaagggaaggacaaattcttaaaactagtttatctcagaactcttttatattttctttattgaaaatggctcaattcattttttagaacgctcatataatctttttaaagcagagaaacaccatcctaataagatgtgttgccttttataagtaaatattttttgagagctttaccctgttaagtgtagttcaaactacacataattatgttatataacataaccgattaagcttgtacgcatcatatgctacgtgttaaaataaagtggaaaaaaaaaacatgcatataacaaggagtaaaacgcagtaaaaaaaaataaggcgtaaaatgatatatttttattaatgtactatttttttatttatcaaataactttaatttgatttttttttcactccattttacttcaaccaaagaaccttactttgtcacctttaagtatatttatccttttttcttacactggctgcctgactataattattataatgtgaccacgaacaacttacttaatttcgtaccatgagttaggataaaaattgttgaaaactgttcagatcgtcgttttatccgctgcaacttcctttagtggaacgaacagctttgtaccaaataat

SEQ ID NO: 4363 - DNA, 1462 bp, Glycine max
  Soy_ogl_6943 Gm20:43048607..43050068 Cluster 18
tttaataatttctgtaaaaataaacaattttataattcataataatgtgtttgggttataatgtacaaaaaatttgtcttttttgatatataaaaagatatatttcaataaaataaaatattttgagttactgtgacgttaatatagaatatatattttgttgatggtgaatttttgccgaattttatctacaaaatttaaatgacagattttatttaaaggaatgaagtccttaaataaacatttctttatatgttgtaaaattaaaattagttaattttttgaagacaaaaaaggtatagtgattgacttatgtatgaaatatttaatcttacaaggtgaatcaggtgaaggagaacagatacatctttatctatggaggtgccaacaatacgtgggtccagaacttcacacacgagctgtcaaagataaaaatgaacgagaatatccaacgtgcagatatcataatagagaactatgaactggggaaggggaagggtgaactcaacaacagtgttccaagtttctggattggcgtatcgcaccaagaggcagtggactgtgagattcagaagattgtaaagtgcttattctgcctcaaaagggacccacaagggtgggccattctcagcaaagggcacaacattaagcatctctgtcatggccaggctgtttatcagatcgtggctgagtttcaaaactggaaagagagagtgttcgatagagaagggtttgacattgccttcaaagagtactatatatgatgccaaggagaaagagatatctcacgtgtggccgtgtcatggaggtgtcttctgttaagtataagtgttgtcatcgtgatgatgctttgaactgttgagtttgagtgtctgattgttcaagtggaaggaaggaggagtatctgccttagtttgcttttgttgagctttttgatttgtttactatgcatcgtgtgatatgatatataaaccacctggtttgccccttcaatgggtagacatagctagaagaagagtttatcttttgtatgtcactctttcgttgaatttcttgattgaataaagttatatagtttatgcttccgcaaaagttgaacaactctatttctatttagtttgttccttgttacttttgctgcattcacttctcacttctctttggtatttgattagattcaagtgaagtgtaactctattaggttctcattctttaactatttttttcttattagttaattaaaaaaattgttaaaaactataaaattaggtaaatgattaaatgagacatcagactcatatattaattggaagtcgaaaaagttaacttataattgaaaaattatcttattaaattataaatatttaataaaaataagttgttgagataacagaaaaatggataataaaaaaaataataaaatcataatttattttaaaaaaagataattaagaaaacaaat

SEQ ID NO: 4364 - DNA, 1200 bp, Glycine max
  Soy_ogl_6980 Gm20:44203901..44205100 Cluster 18
catatgcaatgcatcgcaattcgcaatatagtaattaaaaaagtcaacatttgtactcaacgaagaagtcgccaatgaagggacgaaacctcatagtagtatcttccttagcattggaaaggcaaaatcttaactaggtgaagggaaatgaaattgaaggaccatgatttctgtgcatgttgttaaattcttgtgctgacatgagtctaagttgttttgtttctttggaaggtctaccaaattcttcaaaaggagtcatcacatcaagtccattcggtagaataaaaaaatgtaaacgaattaaaataaaatataaaaatatgaatctcacttgattattttatattctttttctctacaaacaaaaaccagcaatagcatataagagtatattactaaattggagccacatttacatgccatgcacctcattaagcgagacacgtatggtttgtgctttcgtggagttcccacgcaagccttgtactgtaatcgatcatgtgggggtggtttgacttatgctctatcaaattaaaagatctgcaaaaacagtttgctggtatgctctcgttgacctttgcttctttaaaaccctcattcccctctcaattaatgctcccacgattcagatataaactccttggcctattccacacacatatatatgctcctcccagtcactttcctcaaaattaaacataaggttaattgcaattttttgtctccaaaattttacaatgtcatgaattttgtctcttaatttacaaaacattgcagatttttctgacataaaaaattgtcagagcatattaatgagaagttcgtcaaaaagttgtcttaattgtgataattttttttagtcaaggcaaaattctgtgatgttttgtaaatgggagcgcaaagttccctaaaaaaatttgggaacaaaatttgtgacatcatgaatgatgacggatttagaattttttttaatgaaaaaaataataatttagggtcaattatatttttggtcttaattttttttcaaatttaacttctaaacaattttttagtacttttgttatctatattttttttttgttaacaagaaatagttatatgaggacgtgacgtacaataattaacattgttactctgaaagtaaaactattaacataatagatttataaaaaccaaaaagttaaaaaaattatttaaaaa

SEQ ID NO: 4365 - DNA, 1700 bp, Glycine max
  Soy_ogl_7006 Gm20:45440401..45442100 Cluster 18
caaatgcaccctgcttcgttgaaccaatgatatttctttacccaactttgttctaagggaaaaggacatcaaataacattggcatgacagctaacactcatgaattggagagtacatattggcctgtgagcccagattttagatatattaaccgttttataagtgtggatgcttgcaaattaaaagagacaagatgcaaagtgcataccttcgcattattgatgacaagttgacaagagaagctcatcaaaggtggtctacaatgctagataaaaaaaaaaactaaagaatggacagctaatgggccaatgaatcttcttctccttcggcctataataaatgcttaatgataattaagttataaagtataatatctactaattaaagcaaaggaagcctttacaaatatatcatatttcaatatctacagaacaaaataatagaattgttaattctatactttagaaaaatgtttcaagctagacgaatttctctgcaattttctccatatgcatgcaaccaagtgtacgaagctctaagtactagagtttactttctataatttcatctgaataactttctttgtttcttacttcattcagaaaattattaaggaatattacaattgattttgcatagcacgtgtctattagaaacaatacacaaaagagataaagaaagatgaattagcatggaaaaccttgacgagacaagcagctactacaacactattatgttgtgcctgacccaaaagcataaaggtccatattagtgatgggctcggtcttgggcgtaatgggacaagaactcccctgctacaacatactctaaaatagtataaaaaatattccttcatcaaattgatctcactacgacctttttggtccatgccaaatatttaggttagtcaatgtgttaatgtaacttgattttttttttaaatctatagaacatcctttagcataagttttttaagtaaattttttaataagaggctaagtaaatcaaattgtgggaagtgatcccctacttcataaaacttggtgacattcattttgcaatattacagatgcaacataaccttttagggttagcctattggtgggagtttatataattatttcaaagtcttatgttcaaactttgttttcatcgtcgtagacaaaaaaaaaaaaaaatagtaaatgcaataatttagcatatatttctaactagcatttgaaggcagagtgttgaatgaactggaactggaagcactttccaagatttctgttgaaatatttcctgacctttaactatcgattccattttgatgaaacatcactagcttatttaaatgtgacgttaatggtttaagaactaaattgtattaatccaaaagacctagttaaaaaggaactaatgagacagaagttataaagagacaaagcagtgcagctacaaagtgttcaaaaccacctcggtgggaacacgggacccacgatccatttgaattatgagaaggtgggtacatatttttgttcttggaattttctgttcccccaaaaacatcaacacaagtcgtccctacggtcgaaaatcacttctgttgtctaatgatttttttaataagcaaaattttatgaataaggcttaaattcatgagaacaagatgtacccaactcaagatcaaaacattctgttgtctaatgattcatcaa

SEQ ID NO: 4366 - DNA, 1000 bp, Glycine max
  Soy_ogl_227 Gm01:49462601..49463600 Cluster 18
ttgttttcaccaacccaacaactaggaaaaaataggaaccttaaatacgtttggaaaagtttggttaacgactagtgtttaattcccatttcctgtttgagaaaaaaaaaaaatatgcacgacttactttgtaagagtactctagttaaagtattgctaatcactatcttaactaagatattggttaaaaaatcaatcaataatttctttattataagtaatactagaagaatattagaaattatgaaaaaagtacattaacaatattttcaataaaaaatgaatttgtttcttaaggacacatgactagttgagataaacaattatcctttcacttttcgatacacaaaatcacattcttcttttgccttgagaaacgctctcctttttgtttgttaacttgtaaaatacatttaagagcatatttatggggtattttttatattcttaaacaattatagttaaatgcaatcaatcattagaagataaggaaattattcaaatgacacatagagagagatttatttatataaataaaaaatatgttgacttgtgtgtatatggattgcaagtgaaggagagttatgtgttcaaaaattaaaagatgttcacttgtaaaaaaaagttaatatagcttaaaaaaaacaatatcaacttaaagataattggttagaggttatatcaagatttaccattaaactcgcattactccttaaagtaaatctttattgttagaaacgccttaaaagtcacccggtattataacatcaaagggtaagataagaaaactatttaaatgacactaacgacgactttgatgatgttaatgagaacctcgatgatcactgttggaagtaggatataaggtcaatatgtttgattttgattttgacattgaacctattgttgccactaatgatggcattgctatggatgttaatgaagaacctgtatggtttgctatgagtccactattaatgcttcattgtacctttcttag

SEQ ID NO: 4367 - DNA, 1880 bp, Glycine max
  Soy_ogl_4345 Gm13:29498901..29500780 Cluster 18
aagcgcaactccgtgttcttgtttgttgagttgtaattgcttccatacggcaaacatggtgataacagccatggacggaactgcaaacgcatagcagcgcatgtaaggatgacgatagagaacttgttgaaatcacaaaggtggtgcgatttccagcgacccctcattgcaccaacaaatgagtaatctgctacaaagacattagctggaaacaaacacatatagggacgctacgcttggctcagcaacttcaacatcgaccatgaatttgccgttggaccttcctccatgtgtctgaattcagagcagggcccggaattctaaatagaagatgaagggatttctaagcttaccaaagtttgggactgattttaggtttagagattttttaggttaattagaaatctcatgttttttttttgttaaataattcttgcggtttaaaaccgccagaaaacacatctttaaattttaattaatattatgaaagatcatgtttagcacctgcaaatcacattcgaaaaaatgactaaaaaatatattttttaaatatgaggaaaaaaaacagttttgaaaactaaacaaaatatgatccaaattgaagagaataaaaacatatgtaaatccttaaatttttaaaactaaaaaacagaaacagattttagtagttttcctttttaatttgtcttttctcttttgaaaacacgcggagaagtggttgttttcattaatggcattcctataattttgataatcttttttctaatttcgtaaagtctctcacagactcagtgacactcgtcccttcttctcactcgtcttttaaagggtttagctggttccttcttctcacgcattttcttatgctgaattcgaatttcttcttccgcttttaagggattttggttttcttgttcttcatttgacgcgttcaatttatccacattcctctgatttctcataaagtcaccgtgtttgacgtctagtcttcataaaatgaggcttttagttataaaaattgttaattgccctgtgcgtgcattttctaatctttcatattcgatagtgccctgctgttaatgacctgcacttgtttcttcaaatgataaaaagttactgagttttttaaattgtgccttgcggtgtttaatggtctgcacttgtttttctttattaaattttctaaaaatattaaaatcctttaaatctaataaattcatgaaatcctcttaccatataatatgttaaaatccaaattaattataactttttttaaaaaaattgataaatcataatattttcacataaggtatttctcccaggctggtagtaaaaacaacaaatgtggtagtgtcagctccccacgcaacatttatttttgggacaaaggcaacgatatttaacattgtttagttgcgggggatgaaaaaatatactaaataccgttcaatggcaagcacgttgaatttgtggggaataaaggttccattcttgtacaatatactcgtaggaaagaatgaaaagttatgactaaattttggatggagaattagtttcatgcagatcccatagatctaatagactaatgtttgtgagaatatttcagaatttctctcagaaccaaatgccctaatagaatagaataggtatattttttaaaaaaaatttaaataagtaaaaaataagagagaatgcagaagagatgatttttttggacttgcattattattttttttgcttaaaattaaacaatttttaagttccactttttaaaaatattataaaaaaataaatttcgttgaattgagtttaatttaattttaacagataagagaagatttccccaacttctttttctgatttttattcatagaaacata

SEQ ID NO: 4368 - DNA, 1485 bp, Glycine max
  Soy_ogl_5899 Gm18:2420416..2421900 Cluster 18
ttaagagagagaaataagattcttaaatgaaataaaatatattctattaaatttagtttaattttattatatactaaacagttcaaataatagcaattaattttatttcatgctattcaggcatactcttaagtttttaaaaaatgaaacattataagtatatacttgttatggttgaagaatacttacatgtatgtaatgtacataatctaaagttcacgcaggttttagagattaacgaaaatgtgaaattattgaggggacaactaacagaactagcctcaaaccaactaaacgtgtttacaattagacaaaacattaagtatgagtttgtttagtttaacttttagtagggcttttttcttctcgtttatgtctcttaatcattcttttttacatatactatctcttaataattcttagtaatgacaattatagatgtcgcattaaaaaaatgttcatattttttcataacttttctcccatttttttctcctgcgtgttattcagtctcatccagacagacgtcatgggcagaaagtttattgcaatggtgtcatttgtggaagttctgtaacagaaaaaatagagaatactaaaagtgccaaaaaaggaagaaacgacgaggaaacgtaaaaacatcattatgtggatgattcccatgtgatactgtaagtcggtcaccactcaccatgctgcgtacgtcaagtcataaatctaaagtttaatttcaatggaaaaaaaaatactactaacaaagatggataaagtgttagtatagtagcatttttgcacccccaactattttttttattggtgaagggaaatagggtcagaaaaatgaaattaaatatgaagagtgtgtaataggacaaaagggtataagtatgaagtgagcaattagaatcctatgattaacagcaccgataaagaatcatatgattaataattagtcggaatgaatttagatagtgcacggttgctgccgctaatcggcgaaattagcgcttgagtctcatgtggacaaattcatcaagttaaacacatggcactgcatgcactctatatgttaccaaggttcccacattgatgcagtttatctctacataaacttaaattttgtattaacatgattatgttaacaattgcatcattaaatgtttgcataaaaccttttaattttaatattattcttaaaatatttatggaatgttttaattatctttaatgatttcttctgagctggctttgtttatacttttgagtaatgtcaaacgtatacattttcacgcgaatcactttatgatcccatctagttattttgaacatttagctagtctctgattttgtccctatatacgtaaatataagacgacgcgattataagagatatgtacgaagcattatttaaaaatttgttgacatgttcataagtgagattcaattcatttattcttccacagcaagattggaggcgccttcgct

SEQ ID NO: 4369 - DNA, 1168 bp, Glycine max
  Soy_ogl_3695 Gm11:2583701..2584868 Cluster 18
ggcagaaaactttgttagttccattcattaatatgcgtcagactattatttttttttttacagaaaagtttactataagattgataataaattcaaaagtatagcacttgaatttattcatatgcttgaaagtttacctatttaaattaaaaaaatactaagaatacaatatcaatttcagatatataatttaatactataagattggtaataagttcaaaagtatagcacttgaatctattgatatttttaatacctatttaaattaaaaaaatactaagaatacactattaatttcagatatataatttgattaaatctaattagaatgtaaaaaaactacttgaaatagatgatattaatattgttgagttatgagcaaagttaaaataaaatattgatgagtaatcaatctagttaagtctttattcaatatgtttctatcgtataaaattttctgagatttactaaaaaaaaatatatttcctaaaataatttttataagttaaaaaaaattgtataacatttctaaacgtcatccatgttttgtttacattattttgaaattatgtcctactcgttttattagtactttgatccctttttttatgatttgacaaggttacctttaaaatctttttttacacaagctaaatttaagttaattttgaatgcactctcacattaaatgttaggcgttctaaaaagtttttttttctactataaattaattctcaaaactattttttagagaacaagaatgagaaaagaagatgtgaaagtacaataacacgagtaagaaaaatttaaaagtaggaaaacaaaaaatataaaacaactgttttagacagagtagttatattttctcatcaaaatttattaatgatagaccaaaaaccaaaggccttattatatttaattgtttaattaaatattgaaacaaagctaactgtttgcatggttgcaaaggcaatgttctccatgtacttctcactcgagttgtgagtaacccacatggatcctacttgtctcgcaaatttccatgtccaactggtgcccatggacagcgaagcacacgtgtacttttagttataattattcttataatttattatgataaaacatcttttcacaatttttctataaaaaaaacttagaatataaccac

SEQ ID NO: 4370 - DNA, 1828 bp, Glycine max
  Soy_ogl_4879 Gm15:2786873..2788700 Cluster 18
caaggggacctgttaggtataactatttttttaatgacttaaatatgattctgttaactaaataatgtttcataaaagtctggatttttttggctaaaaaagcttggtttaatggtcatagagcttattttccactaattgttatgagaaataggaggatatgtaattgaatcactactatttaattatcagatacgactatggccaagtcggtgacaccaatatctttttcttgaacccaattatgtattcgtggttagagacgtgtaaactgtaaggtaatacgtgcaacgaaaatgggaagaagcattattaatctagtctaggtacaatgatgattctatatatgtcttagcttcagcaacaggcgtgtgtttttatccttgttttgtcgatcttttgtctttttcttcttcttttttattggtccattccttttcatctatcttgctgtattctacctctggattttatgggctttgaaactaagaacttccggtccagaaaataaataatatttatgcttgatctcaagcatcacaccaaaaaagacaacaaaaaaatctgaatatctagcatagcatttttaaatttatcaattaacaacttcattgggataccccggaataatgtagggtttcatgtcttctatctaagcttcgtcggtaaacatgcttggggacttggggttaatttaattgttttttatttatcaatttcaaattgaattaataaccgttgcgctgccatacacttcttgaacttgctatgctttacggaatagatgcaaatatatataaaatgcaggtttacatgtcaatcggccaacataatttataaatttattcttaatttgtatttatcaaaattctattttatagtcatatcaaaattattacgtgacaacaactttgcatgtaatttaaggataaattcttaaataaatcaagtgataagagtctcataaggattcttggtagatgcgtgcaaggcaatataaaaacatggggtactgtttctttttacggtgaattgtagtttagattagtatccttttctttttttagtttgtttcaatatgtcaaaaaagtctcacaatgctgaagaattgagatcaagtataattcataatcactttttatttatatcttatttatttcttaagcaaagttatttatataatttgacatacacatttttttatttcacttttatataattaaaaagaggaaaattttgtttttttctctttttttctttctattaaacagtctataaacatattttactttctattaattctctcctttttagtttgttttctttattacttttcaattttttttctatagcagacaaatcttaagacctagaatcagaattatctcttctttttttatgttaaacttttggtataaaaagaaaatatctgaatacgatattacaaaatagaaagatcttatattagaaacaaatcaataattgggctaaaattgaaatgtgataataatcacaagactaaggctgattgaaaagatggagtcttgaggcagtgcattgcatatttgcattggagcacataactaagctaatagtaactgtagacataccaggagtttgactaaataaatggaccgcctcaaaaggctaaggaatcggacacatcatactcagcgttatacgcatccgtttcctaggtaagcaatctacggacatgagacccacctcgctacactccactacgttgtagtactactacttgtacacatacaacaatgcaagaagtaaaggatctattaccattttatttatcactccatatagtagt

SEQ ID NO: 4371 - DNA, 1326 bp, Glycine max
  Soy_ogl_5503 Gm17:4171601..4172926 Cluster 18
tttccagtgaaaaaactaacaaaatattataatataaagaaactaactaaaactaatagctagccattaatttattgccatctatcgataaatagatataaaaaaaattgaaattaaatataaacaatagaaggataaccagagcatttatgatcatccacaataagacgcacgtgacaactaacttgagtcctttaaatatatgtcaggattcgattttgatttctaactatatgaatagagtaaatatgtggagaaagaagaattttccccaaactaatgttctatttaaagaaattagtctcatgattgttgattattggatcccttacagtcaaaaaaataaattatgatcttatatctcatgtaattttttttaatgacttcctttggtcatatatataattccataagtcagaaactctatagtttgttcacccacatactacaacttattgtgtttgatgccaataatatgaaaaatatttttttaaggacccgaaactaatttttcatcttccttaatatcatcgacatattcattattgtatgacaattattcttataaatatgtttagttgtttactgattattcttatattcttataaccggtatgacttgtttgacaccatgtactgcaactatttattggttctcgtaggaacaaaataaattatctttgttgttggaaaccattggtactgtgataaacaaaatgtgtaagaatttggtctcaagtctaatttaataatttataccttccaaatacatcttgttcgccttcattctagctagaaacattggattttacttatccattcatgtgcacgacatgaataatcctttcatcctttttttaacatatttgattactgattaagaacttgaaacatcaatctttgaactagagactatttgtgatgtaaataaaaaatgattttcctccacgtcaaattacataataataaatacttggaatcacaatactattcgacctcatctacaacagacatctttttactaatttctaattgtaaagtcattttaaccgttattgaatatgtttcttatcaacatatttaaacaagtacttcataaaatttaatttattacaaaactctatattgatataagtttgatattttatcctcaactttgaattgcaaggattgataaaactattattcaactcgattcatttttcttgttgtcattattcgtgtgtctagccttcttccataatttggatattcttctttatcaaatgattttttttttagcaaagactcatcaatttggttgacattaatacagataatggtaat

SEQ ID NO: 4372 - DNA, 1312 bp, Glycine max
  Soy_ogl_5885 Gm18:2101489..2102800 Cluster 18
taatctctattactctaattgtttttggtttgtcaaatactatttatttactgaaattctctagtttgtgtgttcatatgagtttcctattttggcatctatttctagagactttgtgcttttttggtgtgtaatactagtgtttgtgttggactcgggaatgttctttgaaagctctactaggaggatattagacagataacatatgcgaattgttcatcatcttaaggaataattgaggaaggtaatgtgaaaagcaatttgtaggtttgaaattcgttgccatgcatgttgttcctagaatgtggtgggcttgttttgctttgttgagtgatgtgtggccgactcttatttcttttagatgacgtgaccagcaagttagcttggtccataccatgattcatgccttgcaagatgaccaaccatgttactcatacaaccctccgttcggtagggaggggagggaaaaaatacctttttagtgtgggtatgatgtgagtttcatacttttttatttatcaccaatcttatacttctaaccgtttatcttaatttaaataaaaaggaaaaaatacatacaataagtgttgtataaacaaaagacagaaaaagttttatgaaaattttgaaaataaataaaatttattgtttgaggcttgaaactatctaacaagtaaacaattcttacttgttagatagattcttatatttgaatttataatttatttttcgatgattttacatgtttgatatgcatttttaaagtgatatgttttttttaataatgtcgtaaaaattcacctattttttacattttctttggaaaatgtactagatatatcatgtttttttacaaccattataataatattcactcatatattaggaattcattagttttttttatatataaatattgtaacttattttaactatctaatgtaaaacttgttatctacttattaccaccaaaaaaacaacatgtcatactagttaaaacgaataattagtttgcaccggtaattataagtgggttgtatcataaaggattcaaatttcaaagttcaaaataaaagcatcattactcgtcccatgtttttccctttcaatttttttaacaaatacataatatttggtggaagtgccgaagactcggttccatgacggagatgggtccagtcttgaggtccaacgatgaagcacttgcatgtactttgaggcttaagttagtatttgagatagaagagtgaatgagaatgagatttcataccaattaaggtgcctatttatacacctaaatttgtgaaaaaca

SEQ ID NO: 4373 - DNA, 1300 bp, Glycine max
  Soy_ogl_2547 Gm08:7767601..7768900 Cluster 18
atttactcccaaaaccatcttctgctcatttaatatggaatttttaatttaattttattcttacttaatttgtccatttgcctcttccttggtagccccggaaaataataatacaatcccacaaaacaacacatgtgagatcacgggagattgaggtgcaatttttttttctatggatagaagcactttctttcactctattaaatatccaatcatactaattttaacagtagttttacagaatgacacttttaatcactttagagtttcgttaaatattattaactcaattgttttgttttaaaaaggtcacattaatcacccggtctttataaaattgtttagaaatttttaaataagtttctaaattaaaagaaaattatagtcggatccttgatcttgcatattttttataattggatcctcgaaataagtttataacaacttgaaaccactaaaaaaatgtcaatctctgatgattttaaaattaaacatatttttatccttattgatttttctacactaatcttgttctttttaagtttgaaaacattacaaaaaactcttacaaagaaagtgaacttaatagttaaaaaaacatctaatgcttatgtaattacacaaaaattaaaggaatactgtaatttgtcaattatataaactaatttgggactaacatttatatattttttttgtgtgtcttgtagtcaacaaaatgcgtcaataaccacattaatcatttatgtatggcaatatatttttttttaactttttaaaatctcaaaacatatcaagtaagtaagattcttttaattgaatctctctttagcacaacaattcttttttacccaaaaatatcacacaaacattaacaatcctatacaaataaataaaactaactaattaataaattaaaataaaaaacagtaaatcacaaaaaaagaataaataattaatttggtggaatttatgttaaatacacggaccagcattaacttatgtattaaatttgtattcatttatataattttgtttctttcactcttaatccactttattaattttgtagtattaaaaaattaatcacacgattgatcataaaagattatataattagagatgaaatttgaaatttgacatggcatctcactgagtctgactattatcgatcaatttgtataggaaactggtgggagtttgcataatgaattcgaaaattgaaaccaaccaaaccacacagttggatcgagacagacaaagaatcaactccaatactacaacctcatagtgcacccaatgt

SEQ ID NO: 4374 - DNA, 1200 bp, Glycine max
  Soy_ogl_6797 Gm20:36882601..36883800 Cluster 18
gccagaaaaaaagcaaacactttttgtctagctaggtctaatttaacttatcaaagatcatattatgaagtgagatttggagttgattaatgattcttttttatgaagtggggaaattttgagattaagaccaaaatcgagatcaagatggtcggttatatttgaaaatgtcaaaataactatattggtcttggaagagattaattcaagataagtgtttgaaatagagaaattatttccaattatcaactttatatatagagagagatgtacaaatttagttgcatatgtttatctaagtttgcatggaagttttagaatgtaaggagaaaatctataagtaattagatccaagcattttatatgttgttgttaaaatacttggcccaaataccctataaatgccttatccttacttgacctaacttaggcttaccttttttattccatcaaactcaaattaatctttacagtgtcaacaaagtttaacataatcaacaaatatttgagtctcttgatgcatattcattgtttagtttaaaaaatatatattgatcgtgtttcaaatcttagtcatgtgcatgaaaaatactgttatgaaaagtaaaattcactacaacaatatttgtgtctcaaaaaaataacttttaattatcaactaagaagtatcttcgatacaaataaagaaaaactattaatttaggaaattgaaaaaaaagtctatataattgctcttacaaacctatatgaaaattattgaaattttatattttgttataaacaatcattagggtattttttaacatttttgttagaattttatttcattaatttttttatttgataaaatcaattcatttcagttttctttaagtaaataactgtcaaattttgattttgattttaaaatcttcatatagtaatttaattaaactgtatgaaattgtattttattcaaagtttatcaattaaaaacgtatcatttcaccttatttgtactgaaaaatatttggcctaaccaaatcagaatttggcagctaacggaaattttagttgaacaaatagggttaactgactgacagctgaacaactattggtgggccaactcaaagttcaagctgactagttaagaataaatttataaattttaagtactgaggaattcttaaaggatgattaagattttgatactattttttt

SEQ ID NO: 4375 - DNA, 1760 bp, Glycine max
  Soy_ogl_332 Gm02:2744701..2746460 Cluster 18
cattctgagaggtagcctaaaatattcaaatttaatttcagttagaccaatcactcgatgacaaaaaatattgttaaaaatttaaatgttaattttgacttggattcctctaaagtgcaccttgtagtttaggaagtaaataaagttggcatgtcataattattcattacaataaactgttcaaattgtttcaactattttttttttatgtgcctaattttactctatttcccattttacccttttagatctactgggctgcaacttctccttgtaccggaaatccaccgggctgcgactaggacgctctcttttgctccctccaccactttgaaattctaaattgtgttagtttgttatatttatttatttataaaagaaacatacatattctaagattgtctatcttggaaggatagattttaaaacaatttttgtaaaataatttaaaataattatatttatttacaaaaatatcattatatttgttcaagacgattttttttatcatcgacttaaaattagcatcgtcccaaaccccaaatccctcgagatcatgtcgctgagtcattgaaacaaaaaatgagttttggagtaattgtgaggacaataaagacataagaggaagggagggagagagaattggggtggttgcggtattgtcgccgccgtcattcaaagccgacgacaacgagaggtgtgataaagaagagagcaactagacacaaatcgaggaagtgaaaaaagaaaaaaaaaagaattaaaaaaattcacaaccattcattttaaaattgatatatcccacggatgaaaattctcttccacaatgggagacttatttatgtttcccacattagcacccctcatcaagcacatgctaaaacactgtagagccagccacaccgaaacatttcaggctataattggaaatttcacctttccttccacgaaagcaaaattccttactccccctaccaggcatgttaatgggtccggggaattacaagattttttttttaataccctgtttcgatttatattaaccattactttacatggacagtggataactttcacatacttgtaaatatttatgaagtttaaaattataaaaaaaaataatatctgtactatttattatgtaacaccacattatattaaaatcatatagttatattatatgtttatttattaaaaattactatgaaatttttttaaaaaccttatcctgaaataataggaaatcaaaatatgcataatatttaataaaaataaataaatattataatattcaagtatttgcatgtatatatggtacaataatatctgtactcacctattaggtaatagatatctaccttccatctcatctagagtagtccgtgcaagtacttaacgtgtggatattttttttcatcatttttatttctcgtacatttgaaaataaaattaaaaatgaataaatttctgatatactaacattatgtgttttatcctctaaaaaaaatattatgtgtgttttggtactgcgcggttgaataaaaatcgagatttcattttgttaatccctgcaaaacaagatatctacactaaaattaaagttcgagtaaaatgtagtatcaaaattttgcttggaaaaaagtttatattaagtttattatgtttttattatcaaagcagaagaatatcttaagaaaattagttaaaaaaataacaaattatttttatttgaaattataatgatgtattcataatactaa

SEQ ID NO: 4376 - DNA, 1505 bp, Glycine max
  Soy_ogl_348 Gm02:3415901..3417405 Cluster 18
gataatccaatttaaagtatttttttttattcagaagagatgtttacaagggtcctagggagagaaatggaaaaatggattttctgaattcctttagatcattgttataaaccaagtgaattcccttcttccatatctgatttcctgaaatttagtgaatctttgtatgtcacagaaagttaaggaaaatattatacctaataaattttcttggttgagaaaaaatagtagaatttattttcattcgttcgtatgtattctaaaccaagcctttttctatctctaacgtttctgaacacctttctgcaaagagctagttctacatctatgcttgcacaggtgcaggatgaataaagcaaagattaatcataattatttcttctccacataacaatcaatttaaagaccttttcctatttaaattatgtatatcgttggagcaacatcatcatgatgtagatgatgatgtatcacagtattagacaggttggccaagacatgatgctagcatgcaaatgatcacatgccacaagtttagaaaaagaaaataaaattggccgagaaacattcattccaaactattccactctcccaaattatggtttatggaagctctattttatgcctatgatcgagatgtttgacaacgttttcaatctctatgtttttttttgcacactttcaggttttgcatgtgtttacattttgaacttggaaagctggtcatgccctttaagctcctcagacaaaatcattgcttaacagcactattccatgcttggaagccttaatatatttctattgaccccctttcatgaaacttttggcttttaaatattatacgcgtacttatatatagaggatagttgtcgaattaatctaattttagagggagattcatcatttaaatctaagcaccttcgtttctaatgatactattctcttctttttatagaatcacttgactaatatcccactttttcagtagagaaaactcttagtttttttttgacagacaaaactctaaagttagatgccttcaatttgtggttacttatatgtattttaattaggtacaatatgctttgtggcttccttgttagcttagaatatggaggtaaatgcctaaatttttttacctatcatcgaaccactttgatttaaaaagttaaggagctgattaaagtaataatcttgatggccacgtaaaagactgaagaaaatctttcattgaaatctacgtaccttattttaaaatatttaactctcaaactacattatattaagacatttttatttttggtgggatcatatataattagagcatagaagttcttttagagtaggaattaaagcgccacaagctagccagagtatgcggctcattaagacatttttcttcaatctctttttgatacattttttcttcgtaaatagcgcttggtttacttttatttatttatataacatataatttgtagagattaattaaaacaacaatatta

SEQ ID NO: 4377 - DNA, 1300 bp, Glycine max
  Soy_ogl_1394 Gm04:44349201..44350500 Cluster 18
cacattactgattctttattagattttataaatattattcaaattaataacttaatttatgatttatttaaattatatgaacaaataaattttaataatatgtgagatgaatttttcacaagtttctttaagcttgataaaacccaatagtaaatgagactgcgtcatttttgctccctctttttataaatctgaacctaagttcataatcagaaatagagtacttttttttttttactttcttttctagcaagcaatttaagaaatgatctttttatacatttttttctttctttcacttctctatccattcaatgtttttttttctcttgatctaaacataccctgaaaacatgttcaccaatctatttcgttttccctttcatctcttgtgttgcaagagaaagtcaataagcttttatctatgtcattgactttggaactctttaggtctgtagcccatcacctcgtcgtcttcgattccattcgggcatcattcgtattgtccgttgttttctcaaatgtcaaactttacggtatttaatgcaatttcctcaatgtcactttcaacctggttatcattacttacacttgccttgtaacttgtaagcaaagaaaattcagtttctccttatttttcgtaaaaaaattgctaattaaattaacttaattaattttttttaatctaaaaccaccataaatccttcagcgaagtgttaactaaatagtaaagtttataaccgttaaaaacaagaagaaaaaaaatgatatcctaaatctaaatccaattttcactatgacccacctcgttcctgatatgaatctagaaagatttagaatccttaagttcaccaacacttgcatcaattcttcccaagataacagtcaggttcacgtgtttacttgaatcattgagtacaaaaaacaaaaatcctacttattggagacgtaaaaaaaagatcaagtcttgataagtcaaaaaagttttaaaactgttaacctaggtaattagacattaaattcctatttaacaacacattaactgggcaatcgaaaattttcaattaaacccatatgaatcatcttgtttaatatgtgacaacttaatacatttattatctccaaactaatcaaaatactcttattaaacaaaagtaaatgaaaagacattaaaattcggtcaaatacatcaacttgccataagaatactttttccgcccaaattaacataattaagcataaatacaaccaactcaaactccttaatttgaacagttttggctcaaatcttcatctttag

SEQ ID NO: 4378 - DNA, 1400 bp, Glycine max
  Soy_ogl_1503 Gm04:48892601..48894000 Cluster 18
gttgcatccattgttcttatatccatttttatgtgattatatataaaacatgcaaaaatattcacaatagatatcaattagtccgataaaacatctaaatacttgaaacactaaatacatccaccaatgaatttaaaagtccaacactaaaaacattaatactttagttcattaatacaaatgaatctatagttataaataagtcttggtgggttgtaataaatactaattttttaatgaaaatgcatgtcaaaggaataatggatccaattactaaaaattaatagcaatgttttttaataagcataggtagtcaaatagactaaagtgattcgataagatcccgtaacatgaactaatacaagataattgtggaaaagaccaaatttttttaatatctttttgagaaatagctaaagtagcttctaatactactattattatacctataaaagctattttatttgttattatgtttagaacaatgaaaagaggaagaaatcgagctacaagaaaaattctcacatctaccataataatgtgtaacatgtataagggtgaaaatataagaaaacccttccatagcatatggtagctataaaagagggaattggacgaatttagcaacaaaaacataaaataaaaaataaagtaacaaaaaaaaaactcatttttataaataacttattgattatttgaaacaaatatggaagatcacttaattcgcccttaacttgtttaaaaatggattgcactaagttgaacccattttaaactcaacccatataatgaataaagtagaccaatatccaatagattaactaaatcaattttatcatttgtactaatatccaatagattaactcaacccctggcctccttgaattcccttttcctcctatcacacgttgtacagagtttttgttgtaaacctgagcattcaatttgcttgtgtaaggctcatagcgcgcactaggtcaaccaatttcagacacaaaacaaaaatgaggttcgacaagccaaaaagcagcatgataagcatcaagcatggcatcaaacaaattgtagtacttgtaacccccatcatcagtgaccacaggacttgttgacttaaacagtgcatagtctagagaaacgtgttggggatcagaggaatatgcaaggtaagggtacgagttaatcatcacgggtgaaccatgttgcaacaaaattgttgcaatctgtttgataatgtttgttgtttcattgatgaatgttccagctgaaggtggataagaagatgctaagacaatacctttaagaactgcagatacctatatgtctttgtgtatgccggcattggtaagtgcattgatcatgttttgaataccctttgcaacgtagggtgctacaggccccgg

SEQ ID NO: 4379 - DNA, 1223 bp, Glycine max
  Soy_ogl_1815 Gm06:6996401..6997623 Cluster 18
acgattttaataaaggttgggatgagagagtggttttggtgcacaaaacacaaatgaatcaccatcattgaattccagaaaaagagatggagatgtcgtgttcatacataaaaggaaagttgaattcaaggttcggatgtactaatactcctagttaatcaacgggtttctgcataaaaaaaaatcaacgggtttcctgaaacaaatccttgagtctgaatttcggataaaaaaagttttctatatataatgaatgatacttatggttcagaaaaaaatgaagaaaaatgatgcatgaaaacatgtagtatagtattactattaggcacctagatacaaaatgctatatgcgtatcttttatcctatacgaaatctgccaagaaaatcttgccgtgagcttttacagtgtgtaacgagttaatcttgctcttatttttctttaggtgcttatgattttcctattaaagtttattttttgctttgggaacctacggattaaagattaagattaaaaatttaattaaagtaaaactcagttttaataagaaaacaacaccacaagtatccaagaaataatacctagattttatttaaacgaagatatatgttatctaaaatgagtctcatgcaaccctgatctggtcatgagtttttcttggttttgtaaaagggtcaaacctttccctcccccgactggtcgctgtattagcaaagggactaaaatgaaaattccaatatatgtaagattgaaagattttttggtacagctgtaagcttgaaagataaaaacccaatagcagcaggatttataaatccaaacggcaatttcttcaaaattaagcggtaaataaagtaatgactgttttataaattagtaaaacttattatagcataatgcatcctaaaagttgagaaaaaaaatattgaatctataattttttttcttaattatcctattaatcttatattttatggtcttattttatgtttggaatgaggaaaaaaagatggagaggaaagaaaaaatttaaaatttgaattaaaagaaaagtgaaaggatttttttttataaattcatttttttcattttcttttatcctatgtttggttggagagaaaatatgaataaaaaaatacggataactaagtgtattatttttgtttggttaaagagaaaatgaaagaaaaaaaagaagaaaaattctaaaaacaaaatttgaaa

SEQ ID NO: 4380 - DNA, 1528 bp, Glycine max
  Soy_ogl_2871 Gm08:43416449..43417976 Cluster 18
tgattgacaattaattggtctcttaatttcatttaataagtagagagagagagaggggaagagccgaagaggttggggacttggaatattggcagtttaacttatttatttattcttctttttaataattttagattttgatcgcttaaaatgattttgtttttattttattttattacttatagtcatgtaaataccgttttaaggataaattgtgactaaaattgaaagtcatataaaaataaattataaaagtatctaaaaactgttaaactactgattcaaaataaactgtcaaatatcatcagtttggtttattatgtccaaatctaattaaattaaactatatcttatttttatttaatttaaaatatttctattcaaaaatcaaatcaaattgcaccaaaaaatacaaaataaaaaaccatttccctgtctttatgggataaacttaaaatgatcgataattgaactttgaaatagttgttggctaatgcattctcaatatcttaagccatgaagttgattccttcagaaaataccaaaaagtgtaaaaagacaatgagacctaactgatgcaagctgatcatattaactcaagtcaatgtccccatattgtatgaattgacttgtttttatttttatagtagacaaactcaaagtctacgaaactatcaaatcaatgtaacctatgctaatcaaatatatgtattttcatttattgaatagccataaagcacgacagatgaatattaaggtaatcgttattacctaaatcaaatattaaggctcatgtttaattcccactacagtgcaaccctatgtaatataattaaaattaaaatatcaagaaggctgatatttgataattgattccaaataactattaaaaaaataattttataattattatcatttaagtatgtgtcttgttatatatcattatcaaaagaatgtgacttttcaaacggttgttaaaattatttattagttgctatcaaaaaagaaaagggggagaatgggaggtgcagaagacaagagtgtgattatgaatgtgattagcaataataataaaaagaaacaaaaaaaaaaatgcacgtttactcattgactccaattttgcattcgaggtcttcgatctcttgtaatcttcttgtcttctgggctactattctagtagcaattgataatgtttggtaaataataaagtgaggtaataaaaattgttattttaattttgagggatattttaaaacatgtgtataaaaaaaagtaagaataactacatatatttatcgttattacttttataggacctaaaaaaatacttttcattcaaattgacatgaaatatagaaaaataatctctttttattttaatttcttaaaaaatgaaatatttttatctaattgcttttcattaagagaggaatgactattctgatgggcatactagagattagtaaacacttcttcaatcacgttttctcgtgctttctagtttgtagggggaatttcccatttcatc

SEQ ID NO: 4381 - DNA, 1543 bp, Glycine max
  Soy_ogl_3203 Gm09:39767226..39768768 Cluster 18
agaatcacttgatttcagacaaggtgaaggttttgtgtcatcctaactacagataaagactaggatattaattacacaacttgctttacataattttactgcatccgtgcaacacattatattcatgattgcagtttctcaacttaataatcatttcaagaaaaaaaaaaaaggaagctggatcaggttaattagtgcaaagaatccaattcaaatgtaattaattttccattatattatatagttagtgtaaagaatttaattagaatgtagttcattgtttgtattaagttttaatcatttttttttgtggttacatgagtattttctaatttaatggatcaaagattgatcttattcatgatataaatttctttaggaggatgaggatcgaatataaatttatattgaactttttttttagtccactataaagtagattggcatgcccttaagtgcctgcgaattagttttgttcgtcaaaataagtgtctgaaaggatatcgttaagaaagaaaccgtccaaattaagatctctttcttgtttctagctcatcgttccgcggtgacaagtttgttttaaactatttaaaagtttacagcaattttgtctttgtcttgttggaactatggccccgatccttgaattgcacccacaaatcccgcgccaaataacaaaggaaagttcaataccaaaaccagcattgaaatagattaaggagtttcactaactttcctgtgtaacgagacatcatatccacttctgtgttatgtcacgttcaatattatccctaaaacacaaagtaagtattaagatattagatatcttccctcctctatcacactcaacaaagagcttagggcagcattctttgttaagttggtgaactaaacccgttaatgtgtttttttatactgataattcacaaaggctttaatctaaaaattgaaattatatccatacaataaatatatacaacaattaatacaataaaagaaaacaaagagaaaaaaggctatgaaaaagtgagaacaaaattataatagatgaatgatatagaaaaataaagaaaaaaaatataattttgttatatgaatattattatttgtccaatctaattaaaagtccacaaccaccaacttcaccaagttaggcatgtcacttcagttagggaagtgggcttaactgaattccattggcgtcttaaagtgcatgagtcgataagaagcataacccttaatattataaaatgttaaacaaaagtgcatcttcaaactgaaccaacgaaaatattcgatgcttaattccctccaattagattatatatgcacactgagtagttttgaccggttttgttaatcaaaattccaaggtggggcaccaactaaaagggatataaggacacagatacaactctgatagtgagagaatatactacagggatgatacctatgtgggttggttatgtaaacttcttctctaaaggattgcaatggattcgtttggagatctagtgagtttggcatccacatatatattata

SEQ ID NO: 4382 - DNA, 1266 bp, Glycine max
  Soy_ogl_3239 Gm09:40600901..40602166 Cluster 18
tgattttcttcatttcatattttttttttgaaaaataaagttattcctttattatattgtcgatgatgctccgagttggagaataattttcatgtttataaattagaagtaaataaaaatattttttatatagaagtaaataaaaatctatatataagagaactgtgtccaaagtgtaagacatttttgaacattttttatacgaacccatcattcatattagaaggagaattaagaagtcacttattttacactcttgaactgcaacaaataataattgaaagaccgaaaaaaagaggaagcaagacaagacttatgtcctattaaacccaaactaagaacaaacccaaaccgaatatttttggtacagaggatatttttggtacagacccaaactgaagattaaaaacaaataaacgagaaactagtaacaaattaacaattataaatgaggagtgtcagaaaataaatctcacggtaacctgttaaaagcaaataaagagtatataaacaagtcccaaattactaaattagaaacacaaaaaagattatatcagcaaaagggtcatgagttcaaagtacaataattaagagttcccttagtcacatatttggataaggacacaaattccaagacttctctctttggtgaccacaaatcaaaatgatgtagcagcgcctctgcatgcaacagaattctctgtctctcttttatctactagtacatcaaatcaaataacatcaatgtacccctcatcagcatcaatggcgttgaggttaatcagggagggaaaatggatagtgattaactgattattaggggtatcaaagaaacgcgaaatatgtttgtgtataaaaacagttctcatgtaatttttccagtctcataacattgtatgagcttaaaactgaagaaaactcactggaggtctgaacccgagttttggaatttatcagtcagtagtgaaaataagttatgtgcaagtaaatgaacaaacattcaacatagatgcattataaaaccaactaatttattacttttaaaaaatatgatatttggtttagttgaactgagttttggagtttataccagctagtagttgcagcgaaaatgtgtgatgtggaagcaaatgaacaaacattttatacacagatgcccaatgaaacatgaaaaataggtttatacggactccttgagtgtcaaaattgacattgctgcacaaaggattctgatggtacttattttcagctaactgggcatctttt

SEQ ID NO: 4383 - DNA, 1500 bp, Glycine max
  Soy_ogl_3971 Gm12:1661001..7500 Cluster 18
aaccacgaaatcaataggacaactctttactatcccaaattcgtgatcaagaaatatttttgtaactgaaactgacaaggcgtggcattaaatacattgtcacgaaattaaatggaaaatataaacacatttcacgttttatccgaatcaaacttacattaactataaagctctgaaatcaccaaaaaaataatctaaaaggctttgataaccaaaaaaaactactccataatgctttgtataccgtgctctgtacaaaaatatttttaagaaacctgaaaatactagattttggattttcttcatgtaaacctatggattgaattattggttacatttgtcagaagaagaaaaaaagaatcattggttacatttagtttatgtcacatagaaagaaaatatgacgttgtataacaatgaattatataaagacaaattagataagtaaaaaaaaaaaagagatttttggtgagacacatgcatttggtacattactagttaactacataaaaagaaaacgcgcaagcacccgagtcttttttcagctacgagacaaaaaagttccaatcataacatgcaggtggccgcaactaatggaggtgattttgtcataataaaaataaactaaaaagaaaactaaaacctcgactaatataggttaattttgtttcacaagtaattaatagtgttatgatatttttaaaatgtctaacagaagttaactttatttcacaagtcactaataatgttacgagattattgaaatgtttaataatggctgcctcagaaatagttaatattaatcacatcaataattatatgtaagaaatgttagtaatactttttgttatttgctaaaattaattgaaaattatcaatttttatgactttcatatcttatatatttaataactctctcctaatttaaatgtaagacattataaattatgatttttaataaattttaatgaataataaagagtatttgaaaaagaactttagtaacattcctcgtatatataattacgctgctttactcttaatcacttataaactaaaacaaccgtacatattaatgtagttaatcagataactatgtggatgctaaataaatatttttgattgtacaatataatcactcaaaggtaaagtagtaggtaatttataaaataattaaaggacaaaatagtctaataaaaagtagagactaaaagaggtaacttttactatagttattgataataaaaaataataataatggtacctcgttattttgtctgtgaagtcaaattgtttatattgccgaagtctttttgagtaataacatcagcacaaagaatacaaagtacttgtatattttattttatttttttccaaattcaaaagcatatacgcgtttgcaacattatgttcatgtattctattttactaattttcgtttgaaatcagaaatcacacacacttaaaagtttataaaataaacgaaaataggggatgaat

SEQ ID NO: 4384 - DNA, 1800 bp, Glycine max
  Soy_ogl_3995 Gm12:4516401..4518200 Cluster 18
aggatatccttgaccaccaagttattgactaaagtatatattaaaattaaattaaatacctccatccaacgtgaatgccttccattgtgataagtgacaagatattcctgtcccttgattcgatatcatgcccaaataattgacttggcatcaacatctcatctcaaatctcaactactgtgaatatattatttatggcatcaaacatatcataaaaggaaaggacaatatgatccaagggaactttttcctttttctaaaataatttttcaataaaattagttacaatttattgaatggtttcgcattagaaaattctcccactcaaaacttcatcaactttctttcaagttttaataaagtgtgtttggtattagatttatccagatacactcccccggcccagtccatttttttttcttttcttttgtttattccccaaattatgattctttttgtgactgaacctgtcatgttttcaaaaataggattcaacggtcaattaaataaaaaaaggtgaagtaaacaagaaatgaatcagataacagatctgcgctgttgttgatttgctacttggtgaacactaaatcaattggagcagttctatgcaaagatcagaagcccgatttctataaaaacaaaatggagaacagggaattaaaaaattaaaatatatattgattttgcatggggcttggtcttcatgaaagtctcgctcccacctaacgtagcacatcaacctgtagtaataaatattgttaattttaatttcattttaaaaagcagaaaaagaaatccacatactagtactagtagaaattactgctggactaagaatagtatcttcagactccagtatggcaccattcaccattttatgttaacgagagtttagtttagcaaatgtagctagattacagctgctccggattaagtttgaaaataataagtctgtaaatttctttacaagtctgccacaatctatttgaaaaaagttaatctaaaaaattttgatcttaggaggttctttgaactctacatcacgtacttgtcactttggagatccgacaggaaaatctgaatcatttaagaaatatagttttttttataggataaggaaaaatagttaaaacaagatacgtacattgatagtttcaaaaaataaagaatcacgacaatcttgcggctagagaaactaaggagctcatgtgaagttccacccagcatatataaatctccctctctttctcaatcaattcgtcttttgcagaatgtggtattttggttaaattaaatatcaaactttattacaacatagattaaaaaacttcaccaataaatggttagtttaaataagattttggacttgaatattgtattataaatgaaaaaaatatgattagaaaataaatatttattataagtaattagttaatttcttaacaaaaattaatcaccaccgaattaatagatatttctttacaataacattttaagaatttttttttaataagatgcacgttactgtgaaccaatcactttaataatttattgcactagcagatacaccgtttcaataattcttttatctatgatgtgtaaacagagttaattaattctaaaataaggtgtaatgtatttttatttgttaggaaaagagagtgtattttatttaataaaaaaaaagaagggtgttgaaactggaaatattgtagtaaaaggaaagtgttatagtgcaccttgatttcaatccatgctcgtagacaaagacaaagcataaaatcaagctcatttagataa

SEQ ID NO: 4385 - DNA, 1670 bp, Glycine max
  Soy_ogl_4536 Gm13:38073357..38075026 Cluster 18
tagtctttctgctagcatgtgtaccgtgatgcttaggtagcattgccgtgtggatgcttaagaggcatttaatagactctacataagcacttaatgtgctacataaggctccattaaatggagttttgatggagggtaacgtagagactatcgcggtgacattttcaatagtcaaaataacaacacaactttgatagatgaaagtaatgccacagcccacatgaatatgtgaaattcctttgcattttgcatttgtgtagcccccaattgtgtataaggcaggcagcagaatgacttgataatgtaaattagtttttccacaattacatatcaaccaatctaaagttggcgttggtatgactttacggtgtaaaactgtttatatttcaagagctttgaaatcaaactatgtaaaatttaattacagaaatgttaaaacggtagaaaagagaaataaattggaaagtaggggtttcagactttaaatagccatgcattacttctgctctagtaatgttggttccatatcatacgtatcccaaaaaagtcagggattgactcagagccttatgatttaaatgctgatcctacctagctagaatcttaattatgctaacaaaaggggcgtgaatttgtaatataggattataggacggcagaggagaaacaacttgctggctcatttgtctaaattttgcactccactgacgttgatacgtagaaaatgtgttattgctattctatgttctggtggcgtcacataattgcctacgaaattaacacaaattttccctttcccttaaaactctcccaattaaatgcctgaaagggctaactgaaaacagtagcagatggagaagcagtaggtgtaaggcattaattttgattcctcccaagcttcatatatttactttatcaaaattgatattggatctttatatcatttaggaggaccggtattagcagacctacttatattaatgtgtcattgactgctgaacagaatattgtgttcatggtaatgggcctcttgttaatgttgtgtgatatcctattttgtgtcgattaattggttctttcccattgcagctctgtgactgctattgatatttatgtgccctgctcatatgtccatgaaggatgattgaagttaaacataacataagggtagctaaggacggtttgggtcaggagaaatttaatccaaatccaacaaggtgagtggtgagaacggtttttttacattttttttaacttaataggatcgttgattgattgtgtaaagatgcgtgaattattttaaattttcactatcttgcatttctatgcataaaaaaaaacacatcttcgtagaatagattggtttgaatgagtcacaaatatactattaatattttttcatttaaaaagtaaacagatttttttttaaaaggggaaagttgaggttaaattggggtgaatgaaatttatcaaaccaaaacctaattcgcaataatcaagtgacaacaatttctatccaaacaatcctaattttttataatttttagtttggttgaatttatatttactaaatactatttagacccctatccaatcttaattatttataggggtccaaatgacaacctttttatatggataattaggaatataaacaagttgatttagtt

SEQ ID NO: 4386 - DNA, 1247 bp, Glycine max
  Soy_ogl_4537 Gm13:38092354..38093600 Cluster 18
tattataattaattaaaatattgttatatgaataatataattctttgatttatgttgtatattgagcctatatttttagaatttatatttgaatttaactgaagtaaaagttgtctctcccttatctaatatctccaacacttaataactaaataaaaaaatctatcagttagttagttaattaagaacatctccgatgaaggtacttaaatgaattatttaactttaagtaacaatttttttcaccaggcaatatatgatgtgtagttgtttatgtaagcttaattgtttaataacattatatcataaataacatatttataggatccataaaattaatttaagtacttattttaacaattttaggattggagtgaatttgaaatggaatggtaagattcacaaaattaatataaacaactatgcattggatatgctctaagaaattagatagggatggttaatacaatcaactctataaataagagctttcacggtatgattttcatctttttcaatcaattcaatatgtactctcacgaggatcaatatgcactttacctctcttatgagtttgatcttcatccattaaatccaggggttcataacagtcattgttcattcattatttgaatgacggtggaaacataattaaattacaaaaatggtgacactgtgtgtcaatctacaacccagagaatgaatagagagaagtggagacaagtgatatgatgtgttaattgggtatatacactcttcgggtgtacatgtatcatcattcatttaattaacattatcgcttatctaaaaaaaaaaaaaaattaacattatcatccttttgctgtggatgatggtgctggggcacatgccatgtaaccggtaagagataaataatactaatttcagaacaggcataggtatggcagctacagaaagaaaaagccaatgctacatctgacttttcatcatcgattttaagcatgttgtagaatttattgtgtgtcattttcttgctactgttaaagaaacacgggatctcgctgggaaccaccattcttcaaagtcgtggaacatgtaaaagcaattctgcttttctgaattttcttacatatatgaattggcagaaagagaagggaacaatggttgataatcaattgtcgtattcaaaaaacaaattaatttgatctattgctagcagataacttaagatataggaaatacaagcagagctaaagccttttgtgtcc

SEQ ID NO: 4387 - DNA, 1100 bp, Glycine max
  Soy_ogl_5879 Gm18:1977101..1978200 Cluster 18
gaggagcataaatttggtataactttttttttaaaaaaaaaaattacatcctattgcaaattttctcattctgttgttttgcggtatctgtgaatcacttattgtctcaaacaatgtagaaggagttgaacactgaacccatgcatgtaaaacgtaaatatgtcacaagcataaaatattcgttaagacaagaggaataggtgcgctgtgcacatgtcccaaatctaaaagcttaaggataaacatcatattctaaaccaaatttaaacacaaaatcaaatcattcaccaccattaaaataaaataatcatttgtctctgatgctcttctgtggcctgatgcagcagctaaggtatgtagctggcccaattgttcctcaccacatgcatgtcttaattgggctctgtccttggagctaaattcaaattaatgattatacatttaggatcggttcaatacaatagaccaaaagtaaattaagatgaaattttttaattaaaataaaatataaaaatatgaattccatctccttttattatttatttcatttttttctttctcactgcaaacgaacgaaacctgatacaattggatgacatgctttgctagcataggacttttgatggaatgttaatgttatataattgctcgtctatggggaactaaaaactgggaccatttttgaaaacaacaaacctttactatacaatgggcttaaaagtagttacatatattcctgacgtaatgattcatcaaaaataaaaatttaaacaatggaaatggttagatatctctaaatagaatattgtccatacaaaatttcaaaagaattataattaaatttcatgcatattctgtgcagttaaccgtttattgttagaaaaaaaacttatttattagtctagttaaattagattttaataatctcatgcatattgtcctagctagctggtgccttgtttcaattttactttcattttttttactgaaaaaaaaatgaaaagtagctggtgtcttgtttcaattttacttttcatgagtgacacgagactcctatagatgctgcggaaatcctggttcaggattctttatctatcaga

SEQ ID NO: 4388 - DNA, 1100 bp, Glycine max
  Soy_ogl_5881 Gm18:2005201..2006300 Cluster 18
gtccaacccccgatactgaaagacttaatcctttttgcattgaaagacttattcctaaagttaggacagtgactgggctagggaaaataggaccaagcgtgttcatagatattgattgttaaggtttcctttggattatctcagatagttgaggttacctcttttcgttttggtctatctatttaagctttttatagttatagtttgtggtttaagtgtgtcctcatatgggcctatgattgggcccaagcgtaatcactgttccactttgagaaacataaagggcgaaataaataattgagatacttgagttgagtttcacatcgttaaggcccaaaattgtttcagaaccaaaagcacaaaaacaatgaaacaaaatgcaaaagaagtttatttgggagtccaagtccaataatgaataatcaagagttaacttgccgcaaaaattgaaaccatcttctattactgtacgttaacattcacatttgtttttttaaatacattttataagtttgaattttatcattctcgataattttgttatttgataatggtatgaatgggggaatttacaaagacattctgatctaaattatcagtgatttgaggtgtgaaaaacgagaagagtaagaatgccatgttgtagttagagattacttatatgtagtaatctattttgtgtaataaaaagagtaggaagaaaataatatatatatatgaataaaggtctcttaagttctttccatattacaatttacaacatgtttgagttgttttaagtttgatttcattagattttcatgataagtatgacaccctaaaaatatatcttagattaaaaacttaagtaaattacctagtgtagttttatagagtttttgtgaatgcatggtttgatttttgtgaacttgttatgtttaatcaataattttaaacttgagtcttgaatatgtaattaggttaaatatttgattatttttttgtgcatagtgatcttattaaactggaacaatataatagattcgtcttcaatgtttactcctctttattttgaaggatagaggctaactcaaacatttgtttatttttctttgttgttt

SEQ ID NO: 4389 - DNA, 1600 bp, Glycine max
  Soy_ogl_6277 Gm18:59545001..59546600 Cluster 18
aaaactagaatcttattcccatttaaaggcgtgcccaaaagggtccctagatggtgtatcattaaaaaaatggacacaccatattgttagagataggcatattgaatccttgattctatcttatcttatatcatatcacatgagaggacagcctttcaaatctaccatgtggaagatatatgcgtggttgacattgaattagaactcataattaatacttatttctcttacacgttcattagacaattccaataattgaatcttactagttccttttcccaacattttaaggggaataggatgaagatcgaagagaatgagcttgagtacttgacaagtggcaaaataaatagcaaaattatcataggtgcatggaggattctggacctggccgggtaatttgatcacttgcagacgtaaaacttctgattttttttttttgacaaattctttgtttatgcaaaaagagaaaagatcgagagcatgaagttgatctcaataataggtgtcacatggactaagcattatttatattgcgtttaaacaaatgtttctatttaacgcaatttttaataagaaattagaaataaataaaactatacatttcataataatatatgtttgtagtaaaaagttaaaaataaatcatactacccaatcgacaggtcatcagaatcaaaagtgctcagcttcacatgcccaatcgcaatatttttggctcaaaataagaagattccattctgtttctggtcttgtcgtttcgaatttcaattgttcccatgggtagcaatttaattcatttctgtaccaactattcaatatattttgtgtaaatttaattaattcattcaattataaaataaaattaattaattaagtagagatgaaaaaaaagataaattgaagagatatataattaagaagataaagttcacatttttttttcttctgagttcacatctaaagataaaaggagtgtgatgtgaaataattgaaaaaaaacttgttagctagttattagcaaaatctaatattaatcatgccttcaactacttatgctaatattaatcatgctgaaaaatgtaactgttgtaaaaaaaaaaaaaaaaaagttactgtgatagtattaatcatgtcttcaactagttctgcaaagtttatgttgcaaattgcaataattatgtcaaaatggatcgactctctagactggcttctttttgcactacatcatcatccatactcaactcccatgcaaatgtgtccactggtatatggcatgatatcagcttaataatattgtcaatttatggcatgaaagttaataactacctacctcctaatagtagtggtttttcttttatccaaatttgagataataatgtagaattttgttttaaaaataataacgatacaggaaaataacagccaaaaattgtatgtatcttaaaagtagccaaagaattggtctaaaactaatgtatatatacttgatgccagcctgaacatgattatgtgattatatatgtatatgtaaacgacaaatatgataactttcgtcaagtctgtatagaagtcaggtttgtttgattttaaagggtac

SEQ ID NO: 4390 - DNA, 1200 bp, Glycine max
  Soy_ogl_1519 Gm05:1535001..1536200 Cluster 18
aagtttgagatctctcatattttgtatttgcataactgattacatagagtgatttttatctcctaatagacttgatgttctttaggttactttgttagtttgatagagatttttggcttaactgatttttggtgacacagtcattttgaggaggccaatcaactaagaaagagatattagaacttttgttaatcatcatttcgtactgtcaatttttttatagcatcatatcatattataattctggtcattgtgtttaatttcatagacattatggtgttgcttattgctgttgaatgcgtcaaacctcattttttttttcatttggttaatgagtgtagtgttggaactaaactgaaacttatgttactatgcacgttttgtgatatctgtctatttttgtttcatttcttccttgccaaagtaaatggagaacaaccttctcatcctggagcagaaaaaaaaaaaacaatcttcctcacggttcatgttgtagaccaggtaaacaactatttttaaaacaatttttttataaatcgttaaataattatttaacatttgtgggtttttttaaatattgttttcttatggctgatgagattgtacacccaaacggagcatcgtgtgaaagcaacaaatgccaaggatctaatatttttctgtctcctttttctatgtttttttgttgaattctaatggattttgaaaatgtgatttgtctcatcgaagggccctcaacaaagaggaggggagaaatttgcaaaggaaagtggacttttgctcttggaagcttttgctaggacaactctcattattttgtttggtttgttatgctaaacatcttatttgataatggtaggattgatgaagaatttatgattgattaaaactggtattatattttctgcatgttatatattctttaatagaaatttgtataacagttttcttaagaaaccttattcttaaaatgtaggaaatgctttgatataaatttgtgtcagatgaaatgtaaatattaatttttagcttgattggttttatatataaatgtgtgggaggtataccaatggagttataccattgttgttgagaatgagttaaataaattaaagaagggtccaaatgggaggtataccaatgtgtggtaggttatgagtgacttggatattctaattggagcatatgaaaatgttgttt

SEQ ID NO: 4391 - DNA, 1545 bp, Glycine max
  Soy_ogl_6852 Gm20:38863201..38864745 Cluster 18
ggcgggaaagctgctataattaaatataaaataagacttgtaaattatttattgaaaaattaataagaaattattgaattacactcaggtatcaggacaatacaccaaaagatatctccctaagaattctttatatttaattacatattatagcttttaatttgaattatgtggaacttttgccctttaaatttttttaatcaatgaattacatccttctgtgtttaaaaaccaagtatatatatgtaatatccatgaattttgctaccatctaaatctatcggtttctttttattatagttataaatttcaatttttatattcttatagatacaacaacttgaccgtcttgtgtatgtattcaactagtcaatttaattaatcaaacttatacaattatgaatttgctatctaggttatttgctttaatttattaataataaattttttatgtgtacatgaattgtcctggcattccaaataggttgggaccatttgtagttataatttcaattgcaaatagtagtcaaatttgcagatattctgctcagctagtgaacaaagcctcctgtggggagtttatgagaggaaattaactcaattaaaattttgataattatatagaatggaactcccaaattaaagccgcaaccaaaagatcgaatgccagggaagaagatgctgcatacgtacatttagggcaatggcttggacgtgaagctagatgatgcatgtatggacaaaaaattgcggattttccccataccacctatatatattgcttacattgtaaatttggagagagagagagagaaatgatttcattctctaaatcaatatacaatagaggagaagttattctcaagaaacaaactaccaatcatatgcaaaaagagtcatggtccaaagtaaagaaattgacatattctatataaaaaaaaatgaacaaatatatatactaagttttcttgtactatgtttttcattttatattcctttttttctttttctcaatcagaaattattctcttcaacttgattaaatgacaatagtaaattaaagtgatcaatttctcccccacacaatgacttaatattaagatctaatgtgtctaatttatatctaaacacaattattgcaaatttttctaaatgaaatcattggagaattttgtttcacccttgcaacttcttttaatgttgaaagaagattatcatggcatatatttctcaaatgggttatgaaatttcgacacatcaatattttaaacatttaattaaaatttcctattttttttcttatcaggtcatatcacctattatacctctatttttatctgtcactagatgtaaaatagaatttaggtgtctaactatatttatccattaaaaatacatttgtgaattcatacaaatgtcccactatcggggaattgtagtattactaaagctttgatatggtttttgttcttaattttgaatcacttttttaaaaatttatttttttagtctatcaacaaaaaaagactttttttaaggtccttt

SEQ ID NO: 4392 - DNA, 1284 bp, Glycine max
  Soy_ogl_1090 Gm03:44804941..44806224 Cluster 18
ctatcagaatctataaatcatgaggttatatttttttctcttcaaaacctagcaactcataattttacatgaatttttaagttcattttatatattaaattaaagtgcactatttaaagaacaaattaatcccttagcatgtcatttttaaaataaatgtacattattttttattttaaaaaattaaaataggtcatgtgtatgacgtatataattttaaatattaagaagtagtttctaaattacagtgtttggtatttaatctaaattataaaatatagtgttattttagtttcaacaaaactttctagtcgattttgtcacttgaaaaatatgccaagcaaaaagtttacatggttgcagactttttttaagactttgttttcaccttgcatgtgagacacaaagaaatagaaaaataagactatgattacattttcttttcaaaggtcttcggattgattggttcatgtccgtaattcgggaactattctcttatgctgtcaaagattgaaaaataccactcatattcaattatacttacgacacctcaaatcatacacggaagatcattagttaaatataatgtgaatggaaaaatatttacatttctttgatacagcactaaaattactcaatgaatcgccaataaaaaagattaaatgataatataaaaattcgaatgatttattgaaattaaaaatttacaataaagtaccttatatttattggttgataatatttaatataatatatcaaacatttataatttttcataaacaaataaactatttttttatactttcaattcatttttttatcattcagaaaatactttcaattcatttacctgtacttttgagttttgaaacattaattaacaaatttattaaaattaagctcggtaatataattacatgcaagaaacattatatttaagttgtcttataaagtaagcttacgtttttaaattatcataaaccgccgctaactttgaagtgagaaaatatcaaaattgtttttatttgactcttttactgaagatttaaagtcattaaaaataattttaaagaatataaaaaaatataaccgatgctaaaaacttccgagggtatgtcctacccatccaatttcattaatgagagtgatgatggggcatagctaagttattgacttcaacagcaccaaaaaccagcaatcatatattatatagggaaacattatgttatatcatcaaagaagaaaacgaccaaacccagtatacaacgccccaccctgaactct

SEQ ID NO: 4393 - DNA, 1731 bp, Glycine max
  Soy_ogl_1482 Gm04:47966870..47968600 Cluster 18
caacttgactggcattaatatttattcaagaaacatattcactacttgtttcaaatttgtataatgcataaataatttttctttttcttttggtgatcacataaataatttttctttcatctactacaaccgaatgaattttgcatgcatgttccagttaagaattggattgcgattataccaatttgtttcaaagttcaaaaacttactcatcttgaaattataagactaacatgatggttaattaaagcaagaagaaaaaaggaagagattgtgtgttgaatttttctcattaataaaaactcacgcctaatatttgtcaataaaaaaagtatttactcatcttaatgttcattggtctgattaattgactgttctaaaatgaatattatttgagatatacatagcgcattgaataaatttagtaaaggcatcagttgtacataagtttctttcgaatgctaaattacactagtacatgacatgagaaaagcaacatgttttgaaaattcataacgtatcttatcaaatcctatggctctcctataatctcgctacgttgttatgtgcttgctcctcattcccgggaacactttccatccattggcttagctagtaatttcatgcatggtcgggcccagacattaatacctgagtagataaagcgtagggaagcatattattattattatgcagatttgagttccagagctgaccaatgttgtgaaaaggctctcaataaaaccttagagacatatttacaagttactatcaattaacaaggtcttcatagtgacactgggacttggactcactactaatataagtctggatgttaccaattagactaatcattttttgtttagcaatagttatgcaatcattttctatcttaatttttagtatgaactatttaggctcacctttgatatatcttgtttatatatcattagattaaggattcaagatgggcacaattatttctaatctttgattcctttgtaaattctaacactaagactgaaacaagctagagagagcgtgttcaattaagagtagaattgtcaatcaaaaatctagatttctaattaactcaacttaatatatactggtgtgttaacttgtgctattgttaattaatattaattagtataagtaataattaacttgtgtcctttaataaagtaatctaagatttaaaattttatcttaaatatgaaataaatcatataaaaaaataattaacttctaatatatgttcatagtcctcgaatacaattaattaggactttgacaaaattcttggtgatgaaatattttatgaagctaaatcaaataaatatttgggatttattttttctctgagcaagatggttgttcatgcatgaggtgggttatgaagaagcgacacttctaatggctcacggcatgaggcagaagtgcgtcgccatctagagaatctcccaccgagtaagacaaaaccgcaatgattccttttctatttatgcgcaacttgtgctcagtaatgttcggtctattttcgaaggatactgttcattagaatgcacatgcaatttggaagaatacactaagccaaaagaaaaataaaaaattgaccattagaccatcatagctgcttactccacttttaggattgggcatcaataattgaccatgtccgattgtacacaattacaatgactgttattgtaattacaatttattattatt

SEQ ID NO: 4394 - DNA, 1357 bp, Glycine max
  Soy_ogl_1785 Gm06:3419401..3420757 Cluster 18
agaacttagagcgaggaagagagttggggagaatgttagaggaagaccaagagcgcatcaataaataactgacgaatgttaccaaacttttttttttcttatcctgtaaacttatttccattgggcggtaatattttaaatttattaagattcctacaattaacaaataatataatcaaatcttattagaagattattaaatatatctttaatttactgaatatacactcttttgagagacaagaaaaggaaaaatgataaatactttatataaaaaaaatttaatgataataataaaaacaaggttaagatgtgagaagataataataaatactaatagaaggttaagatgtgttttatgtttcttaattttttttggttaaaattagttttatttactatttttttaaaaatataattttgatcattgtcataaaaaaatatcaattataaaaaaaatgtgaaccaaaatcatttttttaaatatagagattaaaactgattatattttgtattttggacagaaatttgttccataagttctttagtgataaaaagttaagtttttgttatactcatatctatttaatttgtgttgtcacataatcatttttcatattaagtgtataacaaatatgtttattctatttactatcatatttttttaataaatcaaaacgtgtcatttattttaaaaaaatttgggagaaaaattaattaacattactaaatttattattgaactctaacttaagattttagtgatgttttaatataaaaaaattaaaatgtgctacgatgcatgctaaaaatgattatctaaataatccactaggattagtctaataataataaattaggctattttgcacaaagtactaagttaaaatgttgctactactattgtaaaaaaagtatattattaattaaattaattagactaaatattggtaactagttttaattaatttaaggcttaaaatggaaaggttagtatttgtcttgtcttttgttgttgttttttttttctctctctcttactcctgttgaactagctcatgtaagtttgcaataaaattttggatgtttttttctgcactttccatttcccatattggaagtgcaggaagcaattgcctaccatttcccttcctttcttgtaccagccatttcggctttttaaaattctatttctccagcccaattgtggtggacgttcagctagtctttgggctagtatgtaccctttggcccatatcctattgcaaggacaaagtaattgttgggctatatctccatctctcctccctaaaacaaagtctaatggaatgggccgtggcatttttttttgggttaa

SEQ ID NO: 4395 - DNA, 1500 bp, Glycine max
  Soy_ogl_3612 Gm10:47822601..47824100 Cluster 18
aagtgtacaacgaagacatttttatgttgtgaatctcacaaagatacgctacataatcacatttatgttattaaattatgggagtgaaaaaagtacaaaacaaaaacacattatgtaatattaatgatgggtgaaaaaaatatgagaatgaaacacattgaaatagaaatatgattattccattaaaagtgtattttcaaaaataaaaatatttcagcacgtggggtgaaatagcaattgatgagtgatagtagcaattccctagggaagtttgcaatcccatctggaaggatatggaagagtagacatggaaactttttttttccttgtcaagagatcatggaagtttccaactcactatttttgcttgttgtgcgagacaattgtagaaatcgaatataaattcttctgttactttgttaattgatgcacacgtaaatttaattcttgtaaaataataaatatattttaaagagataacgagtaaattataaatttaaaataaaatattaaattattaacaaaatctatatatgtatattaaattatagaattatttaaaatttaacggttaatttttactaagtggtataatttagtattttatacttatattttcttcagataaaggtgttaaaacttgtgtatttaatattcatgtgtgcttgatatctatttaacatagcaattatctgatattacttaagttttttttttcgagcatatgatattacataagtacagattagggtattttaaaaaaaatattgttataatttatttttcgcctattaaaatcaaaaggttatggtttatcattaagtgcaaggatcaatgaacataagagtgttttagtttaattaaagattttatattcgagtttagaatacggactaatttattttattgagtaaaaatatatttaagtttaaatatgaaaactatatatatatatatttctaaaattgattgtgataatacaagtgtttggtttggtgttatgttaggcatggtattgtcaattcttcttcattccacttgcacctgttttcagtgctcagttcatatccgtggggtttaggagagcttgacagtgaacgatgcctagtgtaaaagaacagtattgatgcaacacacatgcaatgctacaaaaacaaataagtatgcaagtagtcactattcatccatccactcgtatctcagaatgcattcgatctcatctttaaataatattatatcctaaattataataacacccccaataacaactacaacattagtattaatattagctcacacgttgaaatacattattattatacaaccaaagtgtttagtattcggtgattatgattagtatgaatgatatgatatgatgatgtttgtcggttatctagaacacgtggaagcaagctattgagagtttaaggtgcaacgtgtcaccaattaaaagaactcatatgagttgcgtgtcaatatacccaacgctttttttatttt

SEQ ID NO: 4396 - DNA, 1473 bp, Glycine max
  Soy_ogl_5384 Gm16:30952228..30953700 Cluster 18
aggcattactcataaacaccaccacattttacaagttgaccgagacatgcaacgcatgcatgcatgtgtttactgtatactcgtagaggcaacaaaacgtcgtcgttgggactttgctacccactaatggtacaccatacctatctactttccacctttcaatagaacaaattattggctctcaatcaataatatccgagagcgaaataacaaaaatgcaagcattatttatttaaataagtcaaaataattaactccacagctttgctcaattgttaatggttcaatagttttcatatattattccggtaaacactgatcgagctacaagtatgacattggttttaaagtttgatattgtttagtttaaagcagtgttttatcttttttgtattacgagtgagcttattagaggaaaactttaattcaataagttatatacgttagggctcaattgaaaaaaataaatagtctcttatttgattattttacatcaattatacgtgaaatcaatataaaaagtaaaaaacaactcacacttaaaacgactcttcctaccgcaagataaatgagcatcagaatacaactcgttgtcctgaaaattgttcatatactacatcttttgggtaaaaaaaaattgttttcacgaactttagtatcatgcaaatatagtaaaaaaaaaatatgtttatttgtattagtccaacgttaattttaaacaattaaaagtgaaaaaaatatgtattgcatgcatatgataagatatgcagaaatataatatatgtaactttttaaaaataaatatatttttaattacttaaaagaaactcttaacatttcagtaaaaataaataaagtctctcctcttaacacagtcagagggaacttcccatgtgtacaggtaatggtgcaaggacggctgagttcaccgaccacctgaccgcaggagagcatcggtagcatcaatattcgatactaccccattatacaaaaacaataataataaaaaagtagagtaaatagtataagaattaattttggtataaaatcctttattagttaaaataaacactagatcagtagatcgtaggaatttttaagttggatttagataagtataaaatgattttaaggttagctactattttattaaaatgtctgtttttgttaatagtttatcttccaaacttttttggtatacaacatccttttttaaattattatgatagataaatgaagatagttttacctttaggttttaacttaattacatgtacaaaattagattctgaattaccaaaagaagttaaaaatataaaataggaaacaactaaaaaaagtcaatttaacacattcacataaacttaacatgtacaaaacaaataaaagactgagaccaaccttataactcaattaataagtctatcaccttgttgactctcttttttcttctttaggaaaagttgaagagaa

SEQ ID NO: 4397 - DNA, 1258 bp, Glycine max
  Soy_ogl_5441 Gm17:1253201..1254458 Cluster 18
taagtactttgagcttaagtttattgtgattaatttagatgcatctataaaagccattatgtgcaagtgaggaaaattccgtatgacattaccatgtgaaaaatttgtactaccttttttacatataaatacttgtaaattttgattaaattgtacttatttaatattgggtttatgatgtaatagtctcgttatgatgtagtaattatcaattatgagatggtggattacattaatggttattacgaggcaaatgttaataagtactttgtagtagtgttctaattaaggaattttttttaaaaaaaatcagtattttttaaaatatcacgaatatatttttttattaaaaaaactttcaatgttaattccttaatcattattttaaaatcgattggaaatataaaaataaataaattttgaattgaagaaagaaaaagaattttcttaaaaaattatcttaaaagttaattttactttttcttaattgttttttataaataaaaaatacatcgccacccatatattttccctcactcagtgtttccaacattcacttgatttactcgctggtcaacaagtaattaaaaagagttcaatagcagcaaccagctcatggaagtgaagattcctcgtcaattttaatgactcgtgaagctgtactcctttgcaagaaagagacggtcagaatgacagtacacttacgaataataatattctttctatggtttatacacatatatagaaaggattaatgatattttttgtttttttttttgaacttaatagtttttcgtattttttaaaaatattacttaaactttagtcctaaatttaatatattttttctttatgcatgatgaaaatttaggtatttaaaaaaatataagggctaaactactgttttaaaagttaaggacaaaaggcaattaatttggaagctaaaaacactactaacctattatttcaaaatttaaaacaatactaaattctcctgtgaaaataagtcctctagctatgaaatttttttaaatataaaatgtgtactgaaccagattaagggattttttaaaaaaaaaaatcacaaatgctactatttctacggctaatatgaatctcgtcgtctcctctaactccgatgaggatttggagtattatttataagaacttcgacgtttaagtacatatgcgagtgagtcaggaggtgagaaaattggaggttgattattttataattttgttccctgctccttttaca

SEQ ID NO: 4398 - DNA, 1800 bp, Glycine max
  Soy_ogl_5850 Gm17:41668701..41670500 Cluster 18
ttatattttcttgtctatatggtagcctaggaccttctaatttaaatgttaattaattaacatgaaatgcataggcgttatcgtcggtattactttctatatatagagcgagttctgtgagaagtctgcatggcgacagtcacagtaataataaagcctatacatgcatttcatctgacaaggctacaatctagcaaaaagaaagactgataaacaaaaccctccaaaacttcagtaaacccaaaaattaataaagaaattaaaaactgtatagaatgagcatgacatgtagattgtggctacttcccatacgatgaatgctcatttatatgtatctaggaccattgcagggtctcagtctgtcactttataaattgttttggatggacttcatgtacgtctttgacaacttgtatagacagtggtccaggaagtttacgattctagcattgcaatgtcactactgcatcatgctatctaggtttgtttcaaaaaaattaaactgaactagcgtcgaactatgctaaaaaaatggaactgttttgaataaaaaactgagctgaattgtttcatacctcagttttaaaaaattgaactgctccaaaaccaaactgcatgaaccaaactgacttgtatcttatgagattaaaaaatgtaaaaaaaaaatccttcaaaataagatgtttattgagaataattcaaacaatttggagtactttggtagcagtttggagtaattcaggacaattcagagtagtccaatttagtttgttcggactgttttttaccgttcaaatcagttcagctcatctattttgtccaccccatttctatcacattttctgttgtacaaaaagaaatgtttactgctatttgtttgcttgataacaaactaagttctggagtaattaaagctctagtactataacagccaacctaattgattaatttatttttataacaagattgaattcattaaaaatgataggaccctggattttagcatgagaaaggcagaagatcagacttgaaagtctgatacacatgtcctcaaaaccaattaatcagaaaaactaataaggcggcctaaagcaaaacgaaatgtttataatatatagaagcagataaacaaaaacaccaacttaacaaagactatcctagacatgtgtggctcttgacatcatctccaaacaccaatatcgagccattttgaggttccactgattcttatggaaccacaattaaaaagcaccagctagccaataaatactctatcataattcagaaaaacaaactatgcatatcacccaattcagccataacaccctatcgattaattgtagatttgtaataactgatcttccatcaatcttctattatagttacttgccatacacgaagaaatactccgatatactaatatattgattaacagtccacatctgaaataaaacttcaatcccataaatgggtataacatgactagatgagtaagaataataaattaagagaaaaggtgaaaaatataatagatgatgtaaatgtgattaaaaaacagagagatagaaaaaaaatatatatatatattttaacttaattgtatttgtagtctcatgaatcttgaatcagatatctctatctagatgtagaagccaattaatgttataaagagtgagccacaactctgcaaaacaactaaatattaattgggatttgggagactcttgatgagataaagttcccaatttaattttttttccttaaaattactttattttactccgtctgtcaacttctgag

SEQ ID NO: 4399 - DNA, 1274 bp, Glycine max
  Soy_ogl_6296 Gm18:60179001..60180274 Cluster 18
ttacttttcatgtctttatgatatctgacaaaaattaattatgacttctgaggggaatacttcatattatatatcatgagaagaaaaaaaagtgataaaatgatggagtaaccttgtcaatagctacccttggaagaatataagcagctatactagcttgcaatagattgttttaaagctagataagtttgattctgataaaatgaattttaaataattaaaatgggtatataaattaattttaatttttatattttaacgtgtagtacggtatggatgtgaacacttgattttgaaagttggtcaagtggttattatgcattcagtcccttcaaatttcacaactttttggattgatactttactcctttattttccattctttttatacaagtttttcataatttttttctttatcaaatgattttccgtagtatttttttttctatttgttctctccaaatattgtaagtttatttcatctttttaaatatcatgactttgttttatttaatttctgaatgaggggaaaaaagacaaagagaagctactatttgataataaaaaaatgaaaatttattttaaaacattaaaatgaaataaataagaaaattgagaattttctagaaataaaaaaaaacaaaatcaactaagccttataaataacccactagaattgatttaacaatggatgatttgaataatatgcatgaaataataaattttaatcttggtgcaatcattgtaaaaaaaaaattgaacttcattaataaaaaatgatgataatagtttgggaagacgtacggtctacccaaatgaaaaataaaattacaaaagtaacatcattttataaatatagaatcatattaatttccatgcgtcatgtaatattttatgctgagtttattgcgtgaattttgccacattatatttgccatacaatccaataatattccatttttaaaacatctacggctaaaatcacaataaagcccacccttatgcttttctgcaatgagaatcttttgtatctgagtgctagtgcctagcctaatatagacataaggaaaggttgtcatggtaaagaagaacagggcatttcctttccaatattaagttgtcaatccacaaattttggaccaaagcttcttgatctgtccacttatccaatgtttctttcacagaacagttaaaagtttagcacaaaccaattcatgatggagtactttattacatatgtgctagacatacaatcttctttcattacccaacaa

SEQ ID NO: 4400 - DNA, 1523 bp, Glycine max
  Soy_ogl_6907 Gm20:41080768..41082290 Cluster 18
gacatctcgagcattagacactagatctaccaacctacttagacgaagtgctaaggaaatattttaaaatcaagattggcttaatatagcaaaactaattaatgattctttgtatagtttactcttggtccatatatttcatcgtgctgtgcagacacaagttcttaaaagcttgaatcgcggtgtccgctagatgggtcaaattaaggctacgcatctagcagcaaaaaaataaaaaataaaaaattaaggctgcgcatcttaaaaccttgaatagtgtccttacatctatctaatgtagacaaataatttgctaatttgtaagtcatgttcgtaaaagattaagtcacccataaattattaatattatatcacatcaaataattctctatcaattttttttttacaacatcaaattttactatttaaaaggttactcaattgtatattttaatttgattatattactgaggtaaataatatgataagtggaaaaccttaaagtagtatcaaagtctattttaattcattaaggttacccacttgttatacttcacctcactacttttttgacattatgcataaataatatgataagtggttgattaatgaatctaaaatagaatttaatattatctttgaatataaatttaagtttaacttaattttataaaatctatttgtaaggttaatattacctcccatttatatagtttaatttagttatacatttcatacaatgagttagttagtgcaaacatcttatataattttagcagaataaaaaaatccccagttctccgcaaaattaggggggaggggattggtggctgggaatggacatcttgaattcaatgctcaaatcaatacaggattaaaaaaaaatagagataagaaaaatgaataacaaaatcagtgcaaataaatcacacttaaaagaaaaggcaaaatccctaaaatcaattgaggcagacaacttctttatttttgtttgacctagtcatagtgctcctagagtgatgatgacaattttcatttataccatgttaatttttttataaagttaaaatatacaggtttaccctagccttaattgtgtaaaaattttcaaagcttccaaaactcaagctaatttgttacttgtgaaacaaaacctcaacccctgttactggtttgttaaacaagcctttttttttaagaaaaaaaaatcaacgtttgtagaaattaataaaatattcctccataataaatagaagacatttttttcctgcacttccaatattatattttatacctcccattatattttagaatgaattttctaaaatgcaatagtgagtgtgcaggatgcaatagcctaaatacagaaacccacattcaacgctcgcaaaatattcttatacaagtaataaaaaatacagatctctccatatctagttttgaatggtccaactccaaatactccttgcaagatccctcctaagtcctaattcctaacgccgtgtgtcttcccacatatcttt

SEQ ID NO: 4401 - DNA, 1200 bp, Glycine max
  Soy_ogl_66 Gm01:2852701..2853900 Cluster 18
tgctttcaagcttataaaaaaaattatgttgctttcaatagttgaaaaaaataaaaaagggaaagttatcacgtagcaaatgcttataatagttgtatccaagattttaaattgcggttgttatatattgtagttttatctcaatacttatgttgtggacaattatagacaaatgtaacttatgtgatcacaattgtgattacaacaattccaaaaaccttaaccttatgaccaaaatcttgattgtggaccaatttctaaaactttgtagttatacatacaaatgatgagtaataataaaataaaataaggtaaactagttaaaagctaataaattataaactaagaattaaaaaagttagaagctgatttaattgtgaattgtgaaagcaatatgtaatgcatatataaaaaatcgaaacctacctgtagcctttaaaagggggagaaacatgtggaggataacgccactggctcatctgccaaactctaaagaaaaagcaagggtggaattccaagcatccatgaatgaactgtgacccccatcactttccaagtacgtttggtagcatggctgaattagtatgtgtttggaaatgtttgtagattgtagtttggtcttatagagccttgaattgtaagatcagggaggattcaatctcctgaagcaaatggacctgcacttccctaagaggcaatcaacaagaccccttatgcaatctttttccatgacatgttgaagtgatctaaaccaaaattaatgtagtagtttttcagctgggaaatgtcaaaccagtcataaattatgacaccaatgcggcaaagttgtagcaaggaaaaaggtttcattgttctcccatcctctggcctgaaacaatgctcaaattgtagtgatcaacttagtactaacagtttactttatatggatatcttattgttggtaatgaacataatattgacgaaataagcaatgaaaaagtaatgacaaaatataatctcctaaacaagtagcatagccagattcatttaaaacgttccattgttccatccttttatattgttttttcttttccttttcttcttaatttcaattttttaaaagaaactatttacatcattggcatatacgctccccaaaacacccctttccaagccaataaaataaaataaaattaaaaagatttaagagagacagtttct

SEQ ID NO: 4402 - DNA, 1300 bp, Glycine max
  Soy_ogl_313 Gm02:1459001..1460300 Cluster 18
gcaataataattttatgtattatttaactagtaattaaaaccattcaagtaaaactataaaagtattgtcgtagtaattataacattttttaattcaaaatcaagcttaagattttattacattcaattcaaccgcctatataacaaatcatcacatgtatgatgattccaaattcaattcgtgcaaggcaatcaattcatgaaactaaaagaaagaataagaatgaaggatgtatgaagttgtaaaggcgagaaaattagctgggagaagtgaactttttttctttttccgttttgccctctatcgtttgttgttgttatgttaaaaataaaatcaattaggtaaccctttggtcagaaagcgattgcacggatttgacataatgacacatcgccatgtgcttctgttgtcctcccacatgcaacagtacgcatttcatgcctattttcttcgtatcccctctgcagcaaaaaattatagacacatgtaagttgtatttgatcagggctcaataaaaagactgacacacttttctctcattggtgtagaactgggaagatagaaccacccaatagtccaatttcgtgacctggatatggaatattgtggatagcatagtatgaatactgatgtatgttgactgtgagcctctaatttctcctatttatatttggctatagctaggttcgttgttttagaactatagaaaaaacccatgcacggttttaaccatgcaacgctagaatgattattagcattgcaaatggaaatttgtacactaagaatattgtttaggagtaaattggtttcatattctataatccctcttttcagaattggagggtgccactatcattttaatttttgagatcttatataatggttgatatgattaaatcaaagtatataaataagtaggagataatctcattttataagtatatttttaagattgagttagatttatagttaaattttaaaatgatattaaaatttattcttataattattgttgggttcaaactttatgatcaagatgttcaatcttctaaatgaggagaatgtattaattattaaagatctcattaataatataaataaattactgtatataagtaaaagataactttacttaaaagttggatttatagtattaaagttaattctaaactcaaattttaagttagcgaacactagagagatgcttctaattttagcatacttgataaacttctcctcaaagtttcacaatgacacaaattttgtctttcaatttctttttcacaaatttgcctccaa

SEQ ID NO: 4403 - DNA, 1410 bp, Glycine max
  Soy_ogl_728 Gm02:47925444..47926853 Cluster 18
ggacattgtcacatgttcaatacttacatgggtgtgaggaaatatgtcagtgcatgcgaggaagaaaatccccttcataaaggttatatatcatggtatggtgttgattttgttttcctcttctatggaacccaaatcagcttatcatatagttatgatacttagaccgatcaatgaatagaacgtttacttcatcttctccggtcaaatggacaactttgaataaggtggtattagatcccccatattaagaaaactctaacaaagaaagatatatatcagcaaccatgatataacaatttttttctgatcacatgccaaatggaagagattcgtctcgtgagccgttatcgttacaaactaatattaaaaattgaatatgcatcggtcacaaattgatgtgttggattaagttaattaatcgcaattgaatgtagaagctagctaagcagcatctgcggcctcattgtaaagcttcagaccctttctaatcttctgtttctttttttaaccactgacatgcatggcatattttttcatcccaaaaagagattttttttttttttctcttttgcaaatgatagaatgcaaactgtagtcactccattttgactatttcattctttacttaagcaccatatttagaatttcgctctcattaattaaccttcctagctatttatatgtgtatcaatatacggtgaataactcttgcttatcttttctacaagagccataggatatacagattggtatgtactaataatatacgtaatttcatcaccaagataccttgcccatctcattgcttgctgtgtgtctgtggcatttgtattatataactataggtcagtttgtttggatatcaattaatcaattctaagaaaccaaaaattattaatattttatgacctaacccaaatgacagaaatgtgaatgccatggtatatactatagcaataatgtttgttgaaaagcaaagaaaacacagaacccaccaccaagctattaatgagattcctgacattcaattaagttgtagggattattataaatgaaactcgttttcatggagattactattgaaacttgtacgagttgtagctagtgtggtagaaaccctaagctttccttgcattaattgcctcacatgattcaaagcttccttgtcatataaaacagctcttctttcatggcaagtcggtctcctatacgtctttgttttcaaaattaatgtgtaagactacctttgaattgattggaacaagtgaatgaaattttattaaattttggatacttgattaaagaatattaacttgtcctcctaacataataattatcttagattattggataaatagttatttttgtttttgaatgtataattgactaaaaaatacattgagaaac

SEQ ID NO: 4404 - DNA, 1200 bp, Glycine max
  Soy_ogl_758 Gm02:50331601..50332800 Cluster 18
aacagtcaaaacattgtcactggagagagggatatcagttatgtttgtttcaaggcatagtagtcagtatatgaacaataagaatgaaatatacaatggagagacactgaaaatattattgaattgagatactaccccgttgatcttcaaatattatgcatcgtattttttttaacaactagtatatatgtgtcttctccattcatcataaggtgtttttcaatacaagtgaaatattaagaaatatatatgaaaataatattattttagtttaataaattaattaaatataaatgataaagatatttaaaacttataatttaataaaaaattaattgtaaagaaactattttattgatgatctgtagacatcacattgtgtcttatgttaattaaacagatccgtattgattatttttttttcttttaatgaataactgattgaaaaggtgtaaatagtttaatttaatatggaaaaacagaagacgtaaatcacaaattgaaaaaaaaaactatgacatgactacatgagagaaaaagtacgtagatatattatataactcttagaaattttgtgtaaaaaaaaaactcttagaaaattaataactcaaatttattatataagaaatagtaatagtttatactcaaagcacttctttacatctttattaacctaaagttgtaaattaatcttttcaacgcaattaaattacgtaaatgacctttgtgagggagcaatagcaagcaaagaggagagacttctggggattcaactgcttcaattacaaatgcagagaggatcactttctatttcaaaaaaaaaaatctaaaaaatactgccaacatgtatttttttttccagcaacatgttatctatttaaaactcatggaatggcgtgactctcatttaatcattttttttcttcagaatttcgtaaattccaagaaactttaagcaaggtaaaaatgtgtgtattgtcagcaatattctgagacaaacaaaccaaatctgtcaaaaaaaaaagaactttgccactaatatatcaaactttgccttgttgatcatttctcttcccgaggttaattagttgtttcatgtcgatacttttaaatttcataacaataatgttatcctttattgtctcttgttcatgcaggcaagaaagcttattcagctattctatttgaacattatatatg

SEQ ID NO: 4405 - DNA, 1700 bp, Glycine max
  Soy_ogl_778 Gm03:777001..778700 Cluster 18
tttcataatacaaataaagttaaaaattattggttggccaacttttattatttattataaagtaaaaatgttgtcattcacaaaaggtgtatgatatatgcaaatcgaagaggcaaactaaatctaaatctatatacgtttatatgatttaatagtcgtttgtcgtattttttttttatgagtcgtcgtttgtcgtattctaattacaagaataagagagttaaagaagttgtgaaatatagttacaaatttgagtaaactacaagaaaatttgctattataacaggttaaaaggcatgtttcaaggtaatggaaaaaaaaaacatcataagttgtcattatcgatggattatcaatgactttgcattttcaagtttataaataagacacgtttttttagtagatgcattgtactattaacaatataagttacagaaatttaaccttttgcgtgttgcatgaatgacttttaatagatttaactattttgatgtcgtaaataaaattgaagtcaaaataatatcttagaaataaatttgttacgcggaacattaatacgtaagcatttgcatttaattccgtttgataaatcaatgttttgatgcttttattttttttaattccatataatatgaattatatgcaatgtgggtatggttttatgtaaataaaaaaaataaagttttaagggattagatgttgaaaataattatccaaggtgtttagttatttaacttagtcatattagtaaattaaataaggctcttgctaaatacacctccgtgtttgttaaattgaacccctttttttctcattaaatttgttattatcgattctatccgttttaccttgtttctacaccccatgattgttttccttgttttctctccacaaaccacctccactgtgaacctccgcaaaaatctggtaacaccaccttgaattccttatcatttgtcgtgtttactccctcttgaaacctcaattagacctggttaggtgattggtttcaaagaagcaaaggtagagggtgttgagaggaagaagaatggttgttgctgttgcaccgtcagcaacgaaaaaccccacattgcaacaaataaaaactggttttaggctgtgtttcacttttatcaataatattgattaattttttgttacaagcaccgagagagatgaaaagaaacgtaggttaacttgggtgtttataagtggcatggggaaaataggtgtggtggagagagaaagacatatagggcagtttcttctgccttggaattatagttgcttaaagttttgaacattgagtatcatcagaattagaagcatagatatatacatataaaatagggaatttaaatagcagacagagccagtaatgtcccatgccacgtaaactaaggaatttaaatagcaagaagaaaaataaatattgcaattgaaacttaaaggaaatgattttgatagatgcatgggtgccattgttcagcgtacaatcgctttatccactgagtattcatttaaaacgaagagagagaaaccatattcaaatttggatctgctttcgttttgttcctttagcatgtgattcttgaccatcttcagaatgcaagggtgggtgcgaatagtaggagaccctccttccatctccagctgcatagtgatagacgccaattttgtgcttgaatgaagccaatttt

SEQ ID NO: 4406 - DNA, 1400 bp, Glycine max
  Soy_ogl_1060 Gm03:43015901..43017300 Cluster 18
gcaaaccatcaggtatcatcacaaacatccacaggagcgttcatgttggccattattcagtaacaattgctttctgcacttctcatatgaccccgggataattaccaaattttcatattctcagcctagttgctctaactaacaaaaactggaggtcttcttagtcgccctttccaacatcgcctatgctagagaagtggcctgagttacctagtccaagtttatcatgtttagtccaattttaactaattatgagcatttcgtaactgttgcatattgtgatttgttataggtgtatatgacatttttgttctattaaaaaaaaatgtcttctgtaaagcttgagtaattaggtggttaatttttttttttatcaatgtttttggcctcttgaatttgtggcatagttaggtggctgattttttttttttatcgcatggatattgagtttaatttttgttaattcttatttgtaagtccaagaccatttattaggtattttgtgtctaacaaaagaaatgttttaatagatatattttaaaaatttataatatttaagttttaaaaatgttaaatattaaataaatttgaatgagataaaaaccgtacttgctggaagaagaagaaaaaaagtatcataaaatcatttttttatttaagcaattggacctaaccaactgatttgtggcatttacattgtacacttttattattacatcgaatatctctcgttctatttgaaaaaattcattctaaaatataaatttatattctaaaatgaattgttggaaatgtaatgagaggtagaagctataataataggattgttggatacaacaggcctgatttgtctgctttctcttataaaagttggcccaatccagtaagtccagcccataattagttaaaattgacagatcagaagtgaagcgacaatactttcttttaacacttcctttatcatattactgaataactatgatttatcaaataaaaaatggatttacgaattaaaaattaaagcatacataattttacagagactctacagaaattttgcattatcataaaaaaaacattgtaaatatttttaaaatattaagttattcaataaatttctgaaatatttgtaaatttttaaataggtccttaaactgacacaatgataattagtggcgattttaaaaactttagggatttaactaaaaaaaatcacatgatcatagatctaattaaacaaaaatagtttggagacctatttaaaaatttactaacagttcaggaccaaccgagtaataatacctttccaaaattacacataatgttatatactatttctaaatttttggataaaagccggtgggttaaataaggcctcagatttaataaatttgtgaaca

SEQ ID NO: 4407 - DNA, 1300 bp, Glycine max
  Soy_ogl_1093 Gm03:452171..45241800 Cluster 18
ttaatatattgttatttgacatctaaagaaataagagaaaaaatatataaacatgataaaatttatgatgtgataataacaaaaaaatacttaaatgaatgtttaaaataataatatatttatgtatcgttactttttatttatttatataagaaaaacatcggggaagccatgaagctggactcaaccccttcatacggtgtagccagattacattcacattgcccgaatctgtctttgccgtccggagaagattgttcatttgttctgtgcataaatcatgcattattggttcacactatgtttcggcgacgacttcgttcaattactcattcaactttgagaaaattatactgattactgaattattatttattattagcttaaaaaaaatgaaagaagctgactcagaaatgggaaatcagaaacgaatctatccaaatgacatgcaagataactttgcctccttgaaagagacatactttactgtctattctcttcactccacgagtcaataaatttggtcttctttttttgttggacaataaacttggtctcgtacaatgattttcgccattaacaaagaaataaataaccacagtatgctttcatcatcataataagagaactgtgtgagaatgagatcgactgagatccctttctcgaaaatctcactgcttaagaactctagtgcataatttaatgttgcatccatgttacaggattacttacatggttaaagtgagggactcacgtgtatagatataaatctaaagcaaaaaaaaaatgtaattcttttttagttatagttatgaagatacccttaaaaaataaaataccagggtcctattaaggagctcgtggtcaagaaacaaaatcagatatgctttcaaacaccatattgactgctttctgtcccagagtaactcttgcatttgaatatttatcttaaattggatacaaatcttttaaaatatattccgagtttgattttatattggaggattgattgaatccagaattaattttggaccaattttgacatgtttagttccatgttaaaaaaaaagtttactcttagtttcaaataattttttacggtggattcaaaattttatattaaattttactcctaatttaatcttgtaataaaaatatttaaacataaattatattactttaaaaataattttaaacaaaaattgattttacaaagtcaattttgttaatgttcattcaaaaacaccctttatgtttcaactaaggctgctaaacgtaccttttgtgtttattacccact

SEQ ID NO: 4408 - DNA, 1034 bp, Glycine max
  Soy_ogl_1158 Gm04:1151709..1152742 Cluster 18
tccgtgttaggtgtcacatatttacatgtcggttagagaccgattgatatgatattatatcagtttttcataaaataaactctgacttgctgaaaatccccatttgagtgtgactgttacgtttctacataatgttggaatatgtctggatgaatttgttgttgtacggagatatctgatagccaacaaagaatgtttaattgacaagtaagaatgtagatttgatttttttattgttaatatgaaaatcttattaatgaataagttttccataaatactactttgaagcttattttgacttcaattaatctttaatatataactcaactaaattattgtaaatcaaataagaatgaacgcatatgactttattttatttttacagaaaatatatgatagttaagaagtcatattctttagagttaataatttatatatatatatataagaatatatgattggatgatagactaaacaaattttacattagtgtatttaaattaaaatttattttaaaaaaagtaaagaaggaaggatgcatttattattagttcaatttaatgataagtttaatttaataataaatactcttttatttattaacttaaaaaaaatactcgcattcaaatctatttattttattagtgaaatactttgatgactagctttatataatcactctattaatctaccagaggcaataattaattatttaatcagccgtcctcacttagaacataatgatttggaatcttccaactaatcatctttttgttcaaaccgttccttccgatgtcactttcatatgatagtgacaaaagcaataccgtgagttgctgaaacttgttagcaacgtttaataatatgccgataacatatatgcagaacggaaagagaaaagaatgaaaagcataccgatttgacttaccaaccgcaattagattatttaatgcttttgcaaattactttttttttaaaaaaaaattactttgctcttaaaaaagtgtaaaataaaaaagttaaattgaagtac

SEQ ID NO: 4409 - DNA, 1600 bp, Glycine max
  Soy_ogl_1240 Gm04:5598401..5600000 Cluster 18
gtataacttatttttattaagttacgtattaatcataaaatatttgattaatccaatgcctgatgttgacataatttgtgaactttagagtcaagataaacaaaagagggaaagctcaatttcttatttaggttggcggcctaagttcggcttagcctgactcgccagcgttttcagcagttgtttactagaattaaatgtttagtattcatgattcaacaagaaaaaaaaaaagtactaacgatttttgctaaacagagaaatagctttagctatctgactctcaagtatatatattttggataaattttgcaacaaacatctataaaaaaaaactacgttcttcaactttttataaaactctcatgtaacttctgtataaatacttattagttctcgaacaggattgaggggatgatcgtacttccatcaaatacacatttaatgctccattttttttctcaaaaatgattcatgaatacccacgtataaatctacactgagagatagagaagcatatttatgataggtgatttaatatataataagaagagagataggaagaaataaaatgttgtcaattgggtgtatccatgtatccttacttcaaaaatttatcattagaaatcgtgtacatatataatcgcgtgtttggtttccaacctgtgcattcatagcttttacgcttttgaagtgaaattaaaggtagacgtgcgtaagaaaatgcacaagcaaacacacactaattaaagagtccctgaaatcctttacatcctttcatatccatcttcaatatgtaatgttggtgtcacgaaccatataatcacgagacattttgaccgccatcaccatatctggaaagaaagggcactcttctcaactgcaaccaaaggaggtcagaattttgggagagtaagaaaagtgtggtaacaaatattccttctctgggttctgtaacttctgtttctcttctttgctgtataattatattctactttgcttttactaactgctatggacctactcgtggattttgactttatcagctattcctactcgtgaactaaaataaactctccttgtctttctcctagctctcatatctttacatttgaaacatgtgctattgtactcttcgatctcgttcacacactttgacccgtgaatattgtcttgttcttttactcaagtagcttcaattagtttgtaactttcctttgtctgaaacttccgaacaaaacattttgatcacccaattcacccctatgatgtatacaaatcggaacagttattgctctaattcgatgatgatgaaagcccatcagtgtcttgcaccacgtagccgtaacatcgagtttttgttcttcttgggtccaattcgtttgcattattgctcgtcttttctctacctcctgctacaatttctgtcgccatttcttgccagctatattcaatttcagactttatgatacggacgaattccattgcattaaaaattcaaaatggtccatctttcttttactcgagaaaaaataatgcctctatcgtcatgcatttttaattagtttgtccccttttgcatcatagtgaagactaacct

SEQ ID NO: 4410 - DNA, 1878 bp, Glycine max
  Soy_ogl_1486 Gm04:48293356..48295233 Cluster 18
cgaacacaatattttttataatttgatgaatgatttactgaattcaagttgtgggtttggtgctatagggtttcttggacttgaggatgaaaagatggattagaaactgtgactaggtgcattgccgaagcacctagtcttattgtctcaatcattggtggttctgcaggagctggtcagcttatcatcatcgcatctgtttgtatattgtagaacttttctttcttttctttgttttcttaagtcctactaataaatgttctaagagcattggttaaagaattagtgaatagaattgtttaattgaaaatcaaaataaattgcattctaaattgttttgcagatgatactttcttttgagcttccatttgctttaattccactccttaacttcagcagcagcagtaccaagatggaacctcacaagaattccatgattgtgagttgtctttttccctcgcctatagaagcatactgttttagttgtggttaaaagaaggattgatttttatcccagtatataatagtggccactagccattagcaagaatagagatattcttaactaaagattgaaaaacaatgtgacataattttggtgcaggtcattgtcatcccatggatactaagcttgaggatgattggtatcaatgtgtactacctctgtactgccttcgtgggttggttaattcataacaatctaccaaaggtggcaaatgtgttcattgggatcatagtgtttcctctaatggcagtttatgctgtcgcaataatttacctagccttcagaaaagacactgttcagacgcatattgagacaaagaacgaaccagcaatgcaaacccacacggaaagggggtttacggctaatggtcaattagagttgagtcaagttacctacagagaagatttggctgatatccctccacctcaataggaggatatggtctacaatatgcatccttatgagcatgaatcgtcacattcctttcaagtcattctaatagagttaggagattttgctttatttaaaatttgacattttgaataagttctagatggtgtttttgttattgttacaaattttatcttttatgttatgcttctattagttaattagttaatgtaattccgaataattttggtgacaaatgagattgtttaggaatttcacattaagtttaagctcgtaaataagcattaaaatattaaaacttgcggagaattctcctcgagttgtcacccatgtgcttgctgtgcgtactaggtacaaaactattatgtatatgttatggcgaattttataagaaaaccagttcagtgtaaccccacgatcgattcaactgctcttgaaaattttccataatcaaaccccaatagtaagtagctttatcattttctacataataacggaagtcatgagtgaaggtaagatcgtacggtttgtactcattacatccattttccgagtaagtgaattgtgttccactctttctgttctttctcccccgcctcgagtttcatgtttttaggcaaactttgggcatccatgacaaactgcaggctatagacatgacgagaccaattatcatagactagattgtacaacagcaaaggtattggagaagtgtgaggcaagtaattgtgacctggttatctaactaaaaagggctttctgaagacaataaatcttcgtggtttctaagtccacaggaaagaaactagaattgtggaacatcaaatcccacttgtttcagtcaactgcaaccaattacaggctctataataacttatatggcgcattcagctaatttcctcttcgtttctgaggtctatggccatataaaattgcaaccattgaagtcaaaacttacatct

SEQ ID NO: 4411 - DNA, 1581 bp, Glycine max
  Soy_ogl_1559 Gm05:2724520..2726100 Cluster 18
attatttattttttaaaattaaatttctgaatttgtattttttattttgaataaaaaatgtaaacatatccaatttttggtgtattcaagtgagaaaaaagagagagaaaaagtaatgatggatatactctatcaatacctttcatatatttttctctcttttttaattagtgaatattaattattaattattgttaaaataattagtggagaatttaaatctacaacctcactctattctcccttcaaccttcatttctactatcaaaccaatcttataattttttctactatcaaaccaatcttataattttttattatcaaatagtcatatcaaatatataaattagttatctcccctttctttctatctcaaacactcaataagtgtccaacaatcattattcatcataattgggttaaaatgatggcaaagaaattaactatatgttaaaaaaagtcgattttgaattcctgaagctctttagggcatcaacaatatcacctaaatcatttccagtcccttatgttcttcaaatataaactattctccatcattctctactcctccatcttactcgaattcctcttctcctaccctctatttaccggccgccacacatacttattattattagtatcattttcgcttggttatccaaccctccactaccatcaacagcaggaaggaacgccctattatcctccatcatcatcctcatatgtatgttccacaaagactcatcttaacttcaatgccttcatcactttctccctcctcaccctgtttccggttcatctcaatatctcatgcagtcatgctacaagaagaacagaacgttgcagtgttggaccatttttgttgttgtttgttgttttctcatgcagtcatgctactgaattcaaagattcaaacattggctccttaagaaagataataaaaatgataatttgcaaaatgcaaatatgaggtgaccaaacaaaattataccgtggttagctcttagttgagttacttaactgattttgaactttaactaagaaatggacattaatcgatgattagccagcaacattttattgacattagattcctaacaaattttctcttatctacaacggaaagagtatgacagagaagcaataatctcttaacattttgtcatggtgatatagcacagtgatggcggtggttgacaacggcacaataaaatgttgagatatagcgcaacaatagctgcagcattgtaacaacggtgggggaaagctgcaggtctgttcttggagagatatagcgaaacaataacgaatgggactcttcgcatgtgatagagcgatgcaatgggctaggcgacaacagtggcgaacaatagcaggtctgtttgtgtgagacactggaaagatggaatagcacttgataactaaaatgttaaggctcttaaccactagagtcacatgcatacatttaaatggttaatctcagctattaatcttaaaataaaacaaatgattcaaattaagagtaattctttaaagttgttcttggagtaattggattctctctcatatttaaattgaatt

SEQ ID NO: 4412 - DNA, 1460 bp, Glycine max
  Soy_ogl_1570 Gm05:3237801..3239260 Cluster 18
tgtttatgatttgacaacacccagagaacctaaccaaagtagtttcacaatcgtacaacatagtaactaacactagttctaaactgacaattacatcaacttggttcgttaagtacatggaaaatggtaatacaaaaaatttggaatgaaagccacttcacagtttacattagagttgcatataccaaaaccacaggcaaaacaataaaataaaataattataacacattctcattctaagctataactagggttgaaaatatcttttacgtggtctttgaaaatttgttttacttgatcttttattaattttttatgctccaattccaacctttccacacactaaaccaagtagacttagagtgcgatgaggtaaaagagaattttagagaatgtaatgctagaacatgacgatcttttgagtattgttttaatcataatttatttagtatttaaagaattgcaactttaaacaaccctacccctagtcccctgcccaaattgcttgtattcacaatcttatctttctttgacatgtcctaaggttataacaggtgctacccaaacaaaacggaagttgatctccagcattaaattgacagaaactaaatcaattaattgaaaatattattatgcatggatacctttaaatcatctcacaattcattcagcttggaatttgaaataaattaactgatatatggtgataaataacaaatggagcatagattgcaagcaagcacaagaaatctctaaccaatgtccaagtatccaactctggtgtagcattaattagactgtacaaatggagcagagattgctagcaaggacaagaaataattcccttgctcctctatggatttgaaggactgacattagttgttaaagcataaccatgaccaaggaaaacaaagtgagaatccactttaatttgttggatggtttaaggatgtttagatagaaatagtttgcaataaccaaaagttaatgagtaaaagatgcagctagatcactatcacacctgcttttgccaactcaaacattgaaatcattgtgatggtggaaaatgaaaaaataataagccaattgaaaaaatggaaaaaatcttcaaaaagcacttcaatgggtgaacagccacatcccgagtactatttcaatctaaaacatgatttatcaaatgcagaacatagacaaatcataaagcagaatccaaagccatgggaaggaaggagactgtttttggccatagtataaaatcaacaaaagctgctgattatttattttaaatgaactttaaagttttaagagttgagtatgcacacaaacaaatgcacgtgtgcaaacacatcaagaacaacaggcatcaagcaaacattctagagtaaacaaaaacttgtttccagtcttaccttggtcttttcaactggtcaaatgtagaatcatcctttatgtcaactgtt

SEQ ID NO: 4413 - DNA, 1490 bp, Glycine max
  Soy_ogl_2175 Gm07:4138001..4139490 Cluster 18
tttggtaaattcaattttaaagtttagatataaattagcatatgcctacaattctcaaggacgactccaaatttagatgcatcatcctttagtcgaagaattctatgtactatcattttacaatctatctcaaagctcacattctacattcctattcctatgatccataaaaaaagtaaatatatttattgttttagaaacatcaaaaaattaatttttactatacaaagtaagattattaaaataaaaatattaaaagaagatttatttaaaattaattgtcaatgttgactttcccttcatgtcaagcaagatcacacacaaagaaatgattgggaagtacctcaattttattcatcaaacccgtgacttggtggcaaattccatcattagcatgtttgcttaacgtttggggagctctcatctatagtgaatttaaatcactagctagtaattagatgtaacaaaatatcccaattatgattctgaaaatgcaccagctaagaaattttttgtctttgtatgtacgtggcatgactttgtgaactctaacatgcaatctgagataaggagtgctggattatgaaaaaatagaagcaaagttagtaatgatgagtgatgaatcaagagagtagggaaagttagtggcctgagaaggcatgatggggctctaaattaattgggacagagagaaggttgtaggccttggagacacaaaggaaaaagaaaaaatagaaggaagagaaaaaagctaagcaggaaggcatcaacaatgggaaaagaggtacaccacactaggcatcagcaactcgagggccaaaaatgaataggactaaggctggggctgggcctgaaaaggagaggctggttttgtccttctgacacatttgcacatggggatggctgctacttttgttcctctctctgtaattgtgagaaagacaaatgcattcattatacaattttatttttctgggagagaaatttttttactataattttatactttaattgatttaatcgataaagatccacctcataatattcacaaattttaattttttttaggtgaagcctttcttagcgataacatgtaaatgattatgaatattttttttttcttattgactgagacaattctgttataaatataatttgactgaataaaaaattgaactttcatttatgacgtcctaagaaattaacccctattcactcttgaagtgacaattttttaatccactccaatgtttaatttttaaaaaatgttcgaggagagacaaacatattatacagcttttacttttgggagagacaaatatttgatataactttactattgggagagacaaatatattgtattataatgataattttattatccctcaggcagggtggtggtgctgtgtggggctatgggattgagactgccccttcatcattatgttgacttcccccgttagccttgatacagcttctcgtcaaacac

SEQ ID NO: 4414 - DNA, 1605 bp, Glycine max
  Soy_ogl_2485 Gm08:3239801..3241405 Cluster 18
ctccactccgacgtcaacaagctccaagtctgttagttcatctacaacttcaacgttactgccgagaatcccttcgagctcgtccccagcgataagcttcaagttactatcgccgccgcgacgttaaagaagaagagagggtcgtgcgagaatgggttaaagatgaggaggttgaacttggattctgccagaagggtttgagatcatagtccggttggtaaagggagaagtggttttgccaattcaagctctagtaaacttaaggcgaaaaatctaaccccacttcgcctaagtgtgatgctgttcccttctgccatttttgtcattttttaatgataaacttaaatgtacgggatgcttggagggaggtaatgaaaatggagtagaaagattattttcttagttaggaagaaagaagatacgaaattttatttctgaaaaaataaatttaatacaaattaataaaagggaacaatataattcatagcctgttctgcttctctcaacaacattgttggatagtctgaactatgtaaataccaattatccttagttttggaatgtgtttcaattttgttttattttttgttgttggtgtagttgttaagtagtagatgattaatttgagttgaattttttgtaaataccaattatctttagtttcataagaaattgatgagcttgcatgcaacttgattccttatattaagttcctgaagtcccaatgttatcatcaacgagagatataggaaaacatttgaagttcaatagtcaaaaactgtctagatctgagtaagattgttgaagtgttgctaatgcatggagtatagaaagcttcaacagaattttttttctcttatccttatttggatctattttttttcacaacagccagtttttttatttttaaacccattgttataaggaggaagaagggggtattttaggggaaaaatagttaaaagtcatgtgctgatttgtttctgtcaaacattcaaccggtgctagtatgggagggggggcaagtgcaaccattggtgaaaatttaagggatgttttgtagggataaaaaataaaggagtgttagatgtaataagtgcatatcttaagaatttactcaattttttatcatattatttacagttttttattttattttattttttatatatgtcatattttacaacacagaacaattagtagatgatatatcacataataaacttttagcgtagtctctctagctcactggtgtagaattaaaagaaactaaattaaaatccatatttacaatttttttaggtgttgaacaaaattaatatatacagattgaggaagttgcttaggtacaccaaaatctactattggtttctgtatcttcattggtcaatcttgaattagctagtatcttaatagaagaagaaaaaaatcgttgtatcatacttttcagctgaaattgagttatttttttataggcattcagctaaaattgagtatagaggtttagccacagttcctagtgaggtcacttggatctccaactttgaaaaaggcttacatttcacccctccataagctattgttctatgcagaaatcaagtttga

SEQ ID NO: 4415 - DNA, 1300 bp, Glycine max
  Soy_ogl_2958 Gm09:13201..2971500 Cluster 18
tacatgtaaagctattaatttctttttgaaaataagaagaattaagaaaagtgataataagaaaaaacaagagggaaagggagaccctaaccttcatggctcctaccaagtgggggttggagacgataggtgtagctaatatatattcttaggctttgttttgatgattagtgggaatgggacgaattggagtatatatatctgtattttattattattatttttttattgtacaatgtttgaatgtaagatttacacaaattatccaaactttttatactaggctaaccctaatgaattcatattttatgttctattacttgaattaataaaatttcattagatagaagttcaagaaagaatggaatttaataaataaaaaaaggaattttacacactagtaattaacaaacactttttttttgcacactaggctgaccctcaccatccaaacatagccttgattaatgtcatacaagttttctgttatcaaattattttactaataatattatattacttatattttcatttttcattctttttactctagatgtctacactccttaggtgtcaaccaattgtttccccaaatttaagaaatgtgagatacaattaagagaagaatttcttttttaacactattatgtgattaactaaaattcattaaaaattattaaatttgatagatatgtcaattcaagattaggagagagaatttttgtttttttaaatacaaatacgtgtctatattgattcaaagtcagtagttattcttcaaaatttaggtttaaactcaacattgatggcagctccattggtaaccctggaaatgctgggtttgggggtattattcgtgactcctttggcgattggcatgctggtttctatggctcttgtggtacggctacgtcactgcaggctgaactactagctattcttcatggtttgaatttatcttgggataaaggctttaggaatattcaatgtgagtcagactccaaattggctttacaattgatttcagagggaaggaattcacttcatccttatgcttcaatcatacagaagattcaagactttaagctcctccattgggaccttcacttcaatcatacctttcgtgaaggaaacatgtgtgcggatgaacttgctaaaacaggttcctccttgcaatgtaatctccaagtgtttaatggctgtccccccttcataactcagctggttcttgctgacagaaaaggggcgcagtacattaggcattagctcttctttcctttgttttttttttttccatgta

SEQ ID NO: 4416 - DNA, 1100 bp, Glycine max
  Soy_ogl_3200 Gm09:39744701..39745800 Cluster 18
gatttcataattaatcttagaagagaaaaaaaaaattattagaagtatcaaaatttatttaccctacgatcatctaattaattatatgttacctcatatattcattaattgatttatattctttcaaagatttaactatcttaatttctttttgttttattaatttgttaataatataattaacaacatgtaataaaataattaattaggcaccaaaacaaacattgcataaataaatgagcaacttctaaagagaccaaaagtgcaatgaatccagcgtggaactcacttcatcaatgtactaaaataaatattggaagggtagtattttcctaattgcattcattatgagtgtgtttcaatatttactgaaagccatgagcatatttcaatattttttttacatgtagaatatttatgcatgctacatatgtaaatatgcaagtacatgtcatatgcatgctacatatatactgaaaggcatgagcatatttcaatattttttttacattaactatgaatgatagacttttagggtaaaataagatttacaaaaacatctaatccttcattttgtaaaatgaaatctatgaatcatcagattcattttaaacgaacatgcaaacgtatttttaatcttttaagaaaattaggtttgtcttgtactagaatcaaacatgcagagagtaattaagggtggtataggaagaaagagaaagtgtaaagtgtaaataataacattggatgctaattggaagggtgcgtaggtgctgccggtctagatgtggtagaacgcagaggatgatgcgtattcgtcggcactcatgtttcccgggctgagtcgatgatgatttttatcttaaattaaaagtgacacattacatatatagtgtattagtgtattcaacttggtcttatatgcaacagctagagggtgatgaatgatgcaatttactgttcatgcttcccgttttctcggccactggtctagtggggtggcgcagtgtgccttccactctgctttctaattcgtccacagaaacttgatgttgccatttctttggaaccagcaggcaaaaaggacgaaagttgttttattt

SEQ ID NO: 4417 - DNA, 1165 bp, Glycine max
  Soy_ogl_3343 Gm10:3163201..3164365 Cluster 18
aaaggggtatcctaaacccaactacaacaagatatgttcatgaaagtgaagaggacaaacaagaggtccactactcatatgatgacatggaagacatttttagcctagcctgaagccacagccaactcctgaccttagtcatgtcaatcacctcagctaaatccaactatgctaaattgtatacatatttgatttctatatatgttgataaatgaaccatatggtgcaaaacaccaaatatgcttccggcactccatgaatttgtttccatgtggcaatcgtagatctaccaaaactggtctattctatttagtagtagaaccgtatttacccaactataatagaaaaatctttgccaaatgctataagacacattacaagaaaatcactcacccctaaaattatatatgatcacggaaacaacttttttctctagataaattttatttttaaggtattctatcaataattaccaatcaaaatatttggatgcatgtatatcatatttttaagggtcatcaggtctgtttagataagcttatatatcaatacttttaggaaagaaaataagaagataaaaataaaataaattttttcataagttaaaattagtttatgtataggttaaaaataatcatttaaatagattagataaaataatttttacaaattagatcatacataagttaattttaacttattgagaaactcttttttttttctttttattttattctcttacaagtatttttagaaaaatttatccagataagtcttcaataatatcacattttgaaggtatttttatcaagagaaacatttacaatcactattctcaataactaattaaaagggccaagccaattcttgataacatcgatcttaaacaaatatctctacaggcaatgaaaggttaacctacacatttgtggaaagtgaactcaaagaagcaacatgtaacagtagtaaaatcttgggtttagacggttacagtttcaaattctttcaagaagttttgagagctagtcaaaagtgctatctgcaacatgatggctgaatttcactctaatggaaaactagagaggtgatgcaagtttcaactcttccttcatttgcataaataccagattaaaataggagaatacaattcaaatagaggaatttt

SEQ ID NO: 4418 - DNA, 1167 bp, Glycine max
  Soy_ogl_3569 Gm10:46219501..200667 Cluster 18
actcagaaatattgttttgtacatagtattctattctatatagaatgaatacagtactgtaaagtgaaaattaaactacgggtgaaaccagaaatgctaagttgttagggacaagggatattcatattccacatgggcatgggactatccatgcataatgtgtggaccagggaggcaaaactcagaaaccaattacagaagttgaaaatgatcgcaaaatgtacagtgcagattttttatgatttcaccgcactcccaaaagaaaagagagaaaaaaattatattcccaaagatatttcgcttttgcgaacaacggtataataattatatgattgagtaccctttaaataatttagtatgaatcgacttgtttaggattccttaatggtcttttctttgtctgtccgtttatacttatgtagttttttctttgtctatccgtttatggttaatatgtgagttcatttttacgattaaattaaaaacgagcttgttgactatgagatatagggatgatcacttttcattcgatgctccgtaaatggtttttaaattttcatttatttaaaataagagatttatatattagaaaaatataaaggtgtaattattaattaaaaaagtgacgtggacagatggattttcaatctgcctataagttcaacgaaagctcaacacacataattcaagtgtacaaatcttcctaaaactaatacaaatacaaataaaaattaattaggcctactgcacatggcttacaaactctaaataagaactttcttttgtgcactcttcatccttaagtaagtttttctatgtgcgctatttgtccccaatgtttcgaggacggggagtatgatcatcactagaagatgccatttacttgcaacacaaaaaataaaatacaatgctcactaaaaaattattttctctcaatgatttcctcatacaacaatcgcatgtatagaagtttatgcctaaaagattagtgctacctagaagttggatcatgcccagaacatcatgcttaaaagcttagtggcactttattagacaatacttgacaattcacaaagaactcagagtacaattcacatagaactcaaagcacatttgattatatactaacaatgttatagatgttaaggtaattcaattttgtgttag

SEQ ID NO: 4419 - DNA, 1151 bp, Glycine max
  Soy_ogl_3572 Gm10:46257501..46258651 Cluster 18
ctggcgtgacacaagtggatattgccagatgagatacaattgtcaattcgattaattggatcaatgcatgggtgactcccagcaaagaatgattccaagcctcattcagcaattagtagaaaagaattctcttccatgtcgtttatcgtatggtacattagctagctacatgccgtgtgaattgttttagtctctggtttatatatgcttcaactatatctgaactcattcattgcatggagagaatgtaagcaaaaatgctacttctaaacgaataatttcttatggttaaaaatataagtttagctgtttagggggtttagataacacatttcttacatatatcattttctataacttttaaaatagggtttgggaatttatctgaatccatattgtgcaatctctaatagtgtttttcttgttgtttctgaaagaatttttcttctcttgctccattttgaatgtgtctatattacatagaacactttctaatttgaatatcattatttctttctggcaaaactctaaagcagaaagaatttttggaggggagtgagaaaagttgtgagttaccttttaaatgaaaactaactgagggaaattaattaaataacttaacctccctttcaaattaaccttttatttccttttctcttgttgatagagaagacaggctagatgtgctcattttcttgctagtatgtactggggctcatcaaacccagtctatgttagtttgggatgttatccttccctcacctagagtcctttcttcttaggaattatctaggtcgagcctcttttgtaatcttttcagtaaacaaataaattaagaatttattttcaattgcaaaaatatctcttttatggagtgagaagagaggaaattaataatcttaataaatctaaataaccctaaaaaaaatctaaataacctcaataacttgaatacaattttaactataacaatcatcacattagctaggcattcttaatttattttaaagtaatttcataattacatgcttgaatcattatcagattaaaataatttaatatttttccacttagctcatctgatgacatgaatattcaaactataaatgtgcatcatacattgaaattatcaagtcagcatccttaattat

SEQ ID NO: 4420 - DNA, 1000 bp, Glycine max
  Soy_ogl_3587 Gm10:46693101..46694100 Cluster 18
cccatttgatgcattggatctcctcggggcgagggaaggttttcagatgtactgctggtttcactgtgctgtgttcaatgacaagtcgtaatcttccttcctgagtcttatgaagttatgacttccttatcatcttttatttttttggcaaacatattcttgcagattcttggtgtaagattcgtgtttggtttactttattgaattttttttttatttctattaacttattcataaaattaaaaaatatatacatatagtcgtttttttcctccttcaaaaataatgtatttccacatttctgtgaattggattagataagagtgtttgggtgtttacttcagtgtcatgttgatcttatccatgccctttaaaagcatgccgaacgaatgtggtctaaatatgtcgttttattcatgctattggttttgacttttgagagagaaaattatataatccaattatttatgtttagatcaaattgatttttgttttttatatataaaaaaaaagtctagccgtataaaaaaattaaatataaaattaatcaatataaaaaatcgtaactcgatcgtaacattttttttgccagttatcgtgaggagtatccatcgttttgcatagcttgtaaactatatggatgcagcatgtaaacgaataggaataggatgtggcgtgcacctggcaaacagctcaactgcgtgggtttgcatagcttctggtcactgcacaaggaagattcttctattttgggccaactatttcattatttctcacgccatggaaagtgatgtaccgttaatagttaatattatttctgctggtaatatttcacaataataataatataaagttgatgtaatcggtaaggataagactcgtatctcaaaagatataagagtttagagatttcttgaaatatttcttaaatgaaaaaagttaaaatgaaaaaaaaaaatatgtaaaagtgtgagttttttaaagtttcttattattgaaa

SEQ ID NO: 4421 - DNA, 1516 bp, Glycine max
  Soy_ogl_3734 Gm11:4889185..4890700 Cluster 18
tgattgttgatcaattttcttattggggttgcttgctttatttatactcactttagattatatagattaaaaaaaaagttgtcgtaactataaaaaaaccaaaagagtaattaaaattttttatttaatatatttacaaaatgtattttatagtaaaaaaggtttctaaaaatatttcgtgagaaactaattttaaatatatcatatgttttgggaggaaaatgatatgaaagtaaagataaaatttgtgccgcacataaagagtatatataacattttttctttttgttattataatattagtgtgaaatatttattcatttttttaataattaatttttattgaaaaatatgattggatcacttttagagaaatctattgttacaactacattttttttcacccacaaatattcttgtctaaggagacgatggaatccattccaacaacctatttataacggtatatacattgcatccattttctattttatttttaagtgcgggatgcgttgtgcaattcgtgtgccaaagtctcctaccacacagcaaatctgtttatagagactaaataagaaaaccactgttacgtagtacgtaccattaagctacgtacagatcattgtgattaaacaacatgtgaacaattaacccgcgcatgcatatatgaacttccttcacattttttattctacctccattgtcaacccacaacgttgatagttatgaaccatgcgattgcacttgcaccccaccagccatcattatggataaccctcgtggaattaccaccttcaattcatacacccccaacttgtacacatgctcttccttcattcctttactagagacctatttaaagctgcggtacctccattcctgcatttgttgcatgcggtcgttgctacatttataacaaatgcacatgccaccacccccttgtcagctccccaaagcttcttaatgttttcacagatatatatgttaaaggaattactacgttaacattatattggggctacatttgtaatttacttccaccgttggatctatatttttgcaaaatccatagttaaaatgcatccatatgcacccaaactatgaagaagttagcataatacaatcagtggggattgatttttatcgtcgccaaaattatttgatggtttttttttttgtgtgtgtggggattgatttacataatttagaaacattgtatttgggccctaattacttgcttattttcggtacgactatatcataacgctgtgaccttatcctacgttgtctgatcccctatatattagttattaccctatccgtttcaaagtctcaccttcacgtatttccttaaaaagtctgcatatatagaatatatgtccacatgcatgtgttccacgcattgcactaaacagaggaaaagtcttacatgacttgctctgttaccgtggcgtacataggttcttagtttccttctttttgtgtgtgtgtgtgtggggggtggtttctagtcaaa

SEQ ID NO: 4422 - DNA, 1958 bp, Glycine max
  Soy_ogl_4483 Gm13:36344355..36346312 Cluster 18
gcattaatacaacttatcttactttcatattttatctgcatagcttcaatcactaacaaatatatataaatattaacaatttctttgcaaacaccacccccaccccaccccatgcaaaacatttgaaaatttgtggctgattcattcatcattttgatggtgctaatcacatgtcttccattctcataggcaatttggtaagagtcactgttcaaatttcagtgagaaattgaaaaattaaaaagcaataggagaattcaattcgatatgtgtttcttttttttcttatctcgtcagtgtcaatgccatgttagtttagggagagtcgcgatcagaaaaatgaggattatattatgatataaatttgaaatatttaattagattagattaatctcccatcagttagtgtgcagaatggtaaaattaggagatatacattaacacgaaaaaattatatttttttattcgtaaaaattagaaacattcacgtaagtattttgctcaatcaaatcaaagtatatctcattggtataacatgaaagaattgtagatttatattttgtagtagtaaaatagcatagtaaggcgcgtgtggtgaaaggaaagtaaatgttgagtatgattgggtagcaaccacgatgattggaggcatgaaattgcgaagctttgagagtgtagtcacgtgcgctgcaccttcttctttgttcttttcacctcgtccctatcctattcctctcttcccccttcccatgtgatgtctttcacaaccacccttcttttccctttttatttcctaactgccactcccaaccatcatttttttttttaatttcaaaactatttttagcatgttctgttcttggatccccttaataacttactcttttttttttatttacctttcacattgtaaaacatcataattaacaacaaagttaataatatctgaaatataataccgtttcatatacattttaccattttgagacgattgtggattggtttcaaatatagttctatgtactaatattcatcaaatattagataaggatccaaagtaatttttttatagtggaaatttgattatccatgacactaccaagagcatatgcatgtttgaattgtgatagcacaaaatcctgatgcacccctaccgcagaaataaccaaggattacatcttttttagaacagagtttgaagttgctaaagcaacaatccaaacatgcataagatcttgtttagtaactcttcttgaagaagaaatactttcacgtcaaaggaacaattgagtaatggtaacaagataaaactatttgcaattttgatttacataagaatcttttgaatatgttataaacattcagtttgataatgtaagggtatttttttcccctatcatctcattaaaagaaaaaggttttatgtaaaactattcattagatatatttcatcagccaagaaaagaacaaagaatgataatagagtgtggtgagaagtactgtgaaaactgagagcagagaggtgggtggggaaagccgaaaaagcaagcatttgttacagacagtcactgtagtacacatacacagtacgtacaccgttggttattattattatattttacacttaaaaagttacaaatggtaatactgcacttctcatttcacaccacacggatggacacatgaattctgtggaagtggcatgatgagcatttgatattcccaggaccatataactttgtccctcattttcccttattctagctatgatctggccacgttcctgcacacacactatataatatatattttactgcctgctacctattagaatacatcttttttcagatttttacatctcaaattggatcacatatgcatattatacgtgtctatgtatatgttcatcttggtgttgtccttgattccaaccatttcccatgaggccacctgcgaca

SEQ ID NO: 4423 - DNA, 1370 bp, Glycine max
  Soy_ogl_4533 Gm13:38046331..38047700 Cluster 18
aggaccaaaaattcataacctcataatttgaggactaaaaacttaattaacctatatatataattcataagttatttctctagccaaaatatacagcaactgcttggcttgacatgatcttgactttcatttatttttgcaaatctaaatatgtaacttattctttaaactgtgttgaatctaatatcttggtaatttcggtctaacctacctgctctagtagtgtctgtgcatttgtttgggagtgtttctttgtaattctttcttatttgataagcaaaagtgaatatcatggagataatgtaaccaaagtcaacacaaggtgtatcaaactctggtcacgtaagaaagtaaatacagattgtatttgatatctaaattgacagtagcgaatagcataacttccaagcaagatatatacaaacgtgtacatacattagagaaagatccctgcagcttatcgatcacttaattaggaagatcccaacattaacactttcaagatatatatacccaaaaactgactcactgacccaaggggatcgacccttgttatgtacgtccaactctaaatgtcccgtacgtccagatttatctcgaatcaagaaataacaccatcaacttccatgaggtaaatgctgactatacacttagctataagcacttaagagacatggcttaattaaggttaaggaccttgtagatcagtctgaaagcatgacatcagtattgtctcttcctcaccttaaggatcaacaatagtcattgtcaatattattaatattttgcaagaccaatctagctttctggacttattgttttatatatatgatcagtgtacggattctcccaaaattgattataccatacagttgtggttcagaataaggcttatctaaactaattaatcctggagaagtggtcccaaaagatttcaaaaatgttagatacttatcccatttacttcttagataatattttttttaaaagtttattagtacgtaggttaaaacaggatatctttggttagactataaaagtggataagcaaaagggtgagaggggaattaaattttttttaaaaaaaaacatagacactgatttcttttaatacagtagtagtttaacaatttaaatctgtaaccgcatacaaacaactcaataccattcgtaccgcccaaaccatgctacaactcttaaacagcaataactacgtcataactcttgaacatctccctaaaaaaaaaagtcttacatcaatagatcatctttaccaccacgcaattttattaagaccctttcacaaaatttacggggaacacgttctacaaaaatgaacatactatatattttgtgcacgttgctttatt

SEQ ID NO: 4424 - DNA, 1032 bp, Glycine max
  Soy_ogl_5513 Gm17:4761569..4762600 Cluster 18
aaacaacattaatagaagtatattgcttttaaaaaaaaagtccatttatcggaggttgaaccaggaatgggaagaagagatgcaatgataatatattgcgatttaaattaattagtaaagggtgtggtgtgtgtatgcataaaaaaaatgttataattggggaagctctggatatctgaacatgcatgtttttattgctataattttgtatatagatattaattatattttgcactaattaaggaaatataattgactgaccacttctaggaggcaagctttctttgaggggaataaataacactgtaaataatgggtatgttagaatcgtgtcccactgatgagcagtaggcacatgtttccttagccctttattttcatacgcataaaaaaaataccactctaaataaaataggaatgggctcaggatttaacgactgcgatctaaatatgaaaattataattcatcttaaaaatatattaactagcattaaaatttatactacgtattcataattatgtgttttttaaaattcatctaagaaaatatatttacatataaataaattaaacatttttaaaagatccaaaattataaataacaatggccaatttcaagtatcaccaacaaccctaatgaatttatagtaaaaattgcaatcgttgttaagcttttttttttttttaacgaaaaatcttattatgtttgacaaatctactaaattagaataaattatgtggttcactaaattattttttacaaaaaatagtagccaccaatattggagaataatttagtttcatatgattgaatagaagaagaacaatattatgtcatgacaaaagttacaactttatgatagatccttgattcaacttatatgtggattcttccactcgagtaggaaaagcatgtgggaacctctcaaacatcaataagaagaataaaaacagatacaaaaaaaaaaaaaacaaatagaatattttttagaattgaacttatcaattccaatccttatatagtattagtaa

SEQ ID NO: 4425 - DNA, 1440 bp, Glycine max
  Soy_ogl_6985 Gm20:44426566..44428005 Cluster 18
gattagattagatcagttccatttttaaatgacgccacatgttgaatttggtttttcaagaaatattttcttaaaaaaaatataaaaacaaaagctaatgaaaacgcacatttaataaggaaataatacaataagttaatttttatctcaaaaaaagctaaatcaaaagaacaatttatacagagataactctgtattattcccggtctctccccccagtctaacaaaaccatgcatctaggtttggcacctataagtacaagtatttgacggatcagacatgtttaggcctaacttctatcccttcaagaatgaaaccgtgcttccacatattactagttgcttcagtgactctcatctggacttcatcttcttccaagcctgagtgaagaactctcccatctcaatcatcttctaagttggaagcacaagaaaatctgcgtagtgagtatttggggacaagacgcggctctttatcctcccagtgatgtgaaaccagcacacatcataaagcctcgcaactttttggataacctacttgtaatagagtaggacaacacaaaaatagcatatttgatgattatttctctcacaaaattaagacatgcaaaacatttgaaaaaatcaatcgataaaacgaaagggaaagtgaaataaaagctgaccttgactctggcaggcttgtccactcgcaatattgagaagcctcacctgcggtggagcttgaagaaaaaaattaaaaggatgaaaattaataaattagaattaaatataataattttaagaatatttttttatgagcaatttttttgttgtgtgaattatgtatcctttggctgaaagtcgaatacttatccctttgttgacattttttaataaatgttttttcatagagttcaacttatgattatatgtttaacaaataaagttatttatatactatgtttaacaaataaagttatttatatactctgtcattgtttttatgagtgattttaagtattgaatattgttatttaaatattaatgattttctttattaattatacccaagtttgtttttccacagcttttgttcttttgccaatgaatgaacaaaattatctgcaaattttatgtgtgaaaagatctacaatatatacaattaatactgttaaaatttttatacaaaataaaaattgtatgagaatatgtaaaaagtattaaaagtttggataaatttctcaccccatacaataccaatatctcttagcggaaagcatgtagcacttctttcccagttcggttgtccaattgaaagctctgatgagtgacacaaacacaacacatctcatttattttaggtattccataaaattaagagtggatttgtttgaatttttaaaaaataattttaaaataaattaatactttcatataagtactttttaagaaatagat

SEQ ID NO: 4426 - DNA, 1182 bp, Glycine max
  Soy_ogl_1764 Gm06:2595019..2596200 Cluster 18
gtgttagttcattttttctaataataataaaaagagcaacaaaaattcgagataaacagaacaattcactatccattttccagaattctgaagtactagtattttataatattcatattatgtttataacaaaaatacataatgattaatgatgagtcacaggagatgacaatgaaaaataaatatctttgttttgtacaatgagtcaataacgatactaaagtttgaatttaggacggtaaaatactaaagtctcataaaatcaatctaaatcatctattattatgcaaattctaactctaatggatatgaaaaataaataacttagcaataatatggtcaatactttacttatattattgatttaacatgaaatcaataaccgataaatgtaccttcagttggtaacttacataccggaacctgtttctcgagcaacaaacaatagaaaatggtaaggaatcgatcaagagggactttaagtaacgtggggcacatgtcccaactttttttttttttttaatgttgtcatattagcttgtcattttaagtcttctattttttttaattttttctttatcatattaaatttagaaaggaagggatttacttattccacatgtgaatagttattttttatccttattatttatttttttagatccaatggctaaaattaatttaaattcatttttcagaattatttattacaatcaataaattttaagaaaatgaatgataaaaataaaaaaaataacttaaaaagtgttagtcttaaagtaagtaaatctcacctctcaaatttatcatatttttttacatgatattagagaaaccattacttgttcaaagacaaactttaataatttgttatcttactttttttactaaaataattctaaacaaaagaaatattaataatgaatatattcttttaacatttttctaataatttttttattaacgagtgaaaactacatcagcgacaacacacaaaattctccttgcgactaccatcgcagcttagcgttgtggatctttaaaactcgtcctaatgggtggcgttccgatttcactaatgacttttgtggtgattgaatcatgttttttattgttctggtgtgattgtgatggtactaattaaagcatggtgttatgaatgacattttttttttgacagct

SEQ ID NO: 4427 - DNA, 1441 bp, Glycine max
  Soy_ogl_4450 Gm13:34533801..34535241 Cluster 18
atatgaaatttttggaaggtggaagaaacttctataaggtactatgaaaattaattgtaatgatttttatcttgcatcgacaattcttgctacttgtgctgctttgctctgaaatgataaagaaaattttctgaaagtactttcaagaagacttaaacattgtattattgtgaaggcttttggaccatttttatttggtatgaatatggcttgcaatttgagttatagagcaattattgttgaaactcaatgaactaaagttgttaagcttgtggaggatctcagctatcatgaaaaccaatttgtagatcttgtctctaagattgtgaagatcaaggggaaattatttcctatttcattgtgaatgtactatattagaaaaataatatgagaaaatattttaccaaaaataatatataattctgttttgggacttgtccaagcaattcagaaaacaaaaaaaaccgcacagataaccaatcttaatttttcaggaaaaaataataataatcttacttttttttaagaataagtaatcttaattaaaatatagccaaatagtaaatgtgaatatctcccatgcacagtgagaattgaaaccataataatcttttttataggaactaattcgctgtactatcctgtcttaaaaaaaaatcgttatactatagtactagtacagtagttcttgtaaacttccatggatagtttaattagacgtagtaagcaaatcaattacgacccaaagtattctgcaaacgaggaaagatgacgtcatgcttatgacctggtttacagttaaggcggcaagagtgaacaacggacccaccaagcatgcgcgcgtgcaataggaagtgggacctcttcttaccaccaacccaccatgagtcaaaggctaaaggtatgactctcaagtcttcacacttattacccagttacccattcatttttctttcatttgcattctatttttttatttactaattttccagtaatttagaataattatttttcaggaaaaattatttatcatcaataaaaatctcattttaatttatgcataaatcaatactacacataatattttattaaaaaaactccttttctactactttttttaataaggaaaacaaattttgaatctaagtttgtgggttgtgttcatgcatgcataaaagtaaatgagaaagtatgttcttataatttttttttatttctataatttttataaaaaaaaagtttaattttctctattcctatatataagacttaattacctaatttattaaaattaagaaaaataattaatttaattaaaaataaaatttttttcttaaatttataattttttctaaaattatccttatcattaatatttgtttctcttctaatagttcatcaatacattttctttttttctttagtgagagtatttcaagtc

SEQ ID NO: 4428 - DNA, 1300 bp, Glycine max
  Soy_ogl_5444 Gm17:1309701..1311000 Cluster 18
cgttgacagcgacatgtatattaaataaacacatcgaacaccggaagattcgtttaaattattagtcatagtcaagcaagattatatacatatatagcattgcaatatgtatacattaatatatagcagcataaaaccggacaactaggcaatagactccggaatctgctcattctggcacccggaaatggttttcaagcacaaatatcctcttcttgctgagttctgtgatgttttataaggttaaaccaggttctgccactatgttgaagtagctaatataatatatatattaattagtaatttatatagaacataaacagacacgcatatggcagctgctaattaaaatggaactctagctaggacgaatgcactgaacaatttgtggggtcgttaggaatcaaaactcgaaagaaagtggcttaaatatcaagaaacaaccttcaataatatatacattaatgtgttgatgcccccttaaaagtctttcattattatatcatatttaattgtttataatgggtttttgcacgggttgacactttgtggttatcatatcgactaaaatttaaccagatttatgaaatcccatataattgactttatgattgcccatgattgcctttcaacactactttgcttttgcccggaggatatagtgatccccagaccctagcatatatatatatatacacacggaaagaaactaaacatcaaaagttcgcaagtaccatcaaacgtatgcatcaaataaataacgtcagattattctaattcaataaattgttttacattttaaccaatgggactgtaaagcaggtactaacatgaaggattcatacattttcgttaaaagtgtcaagtatataattatgttaataatttaaaaaaatcgtctataataattatattctattataatgtaattattttcagtaaaaaaaatacatatcatctatacaaattaaaaaaaaattcccagtccaaatgaacataatgctttttgattggacagatgtgaattaatgaaaatactagacatcgcgtaatgcaatttacaagattaatcattgcaaacacaattgcatataactatatttggcatgaccggatcactttttttcttcttttagttcaaatgaattatttgtataaacaaaaattattaacaccacaccagaataaaatgatagttttataattttttttagaagcgatagttttattaattacaagcagtaaaacattgtatctgtattctgatataatcagttagttagttaagtttgtattttag

SEQ ID NO: 4429 - DNA, 1062 bp, Glycine max
  Soy_ogl_6190 Gm18:55838439..55839500 Cluster 18
aataataaaagtcaatacataaaaatcaattttgtaacctaatcttaattagcaaccattctaaaatacttaaacacatggttcaattttaactttaaaataatggatgatataataaaatataagttaattaataagtataaataataataattataaaaaactgaattacgtaaacaattatcaaaacttctaacactatcattaattaatgtgaaaaacaagcttctgatcttccccaactgcgagaacttgtttagtattaatgtgctagcttctttttttttttttttttattggattaattgaattctttgctagaagaataacctaccaaattgatttgattgataactgattccacatttcccccctcatgttgtgtttcgaaaattcccaaattttcctatttaattcttaaaaactaatgtaatgttaaaaaatatgaaattgcaattaggtatttttaagaaaaatatgaaaaagttttgataacaataaaagtttaaagattgtaataaagaaaaaggtgctgatctttacaaataatgaagttaaaaatatatataattaattaatgatgtttaaagatagcaaatctaacattgaaacgtgcagaagaaatttattgaataagtgtgcaaaatttaaaaaactaatatcaagtgtaattcatgtttttttaaaggtaaatggatattattaatgggaatcaatataagatatatatcaaatgaaatgatttggtacaacggtcaaagactccccaatctaacaattatctgaataagtaaaagacaaaaacaactaaataatgagcaattttattgccccttctcttaggtaatagtaacaaactatccacataagacttggcatcaacctgcaacaatcctccaccagaccatgaaactaactatatatccacataaggctcctgcatatgctaacttggtgccaacaaaacatcaacatatttcgtagctgaagctaggacatttccttgagcatcatagagaattaaatccaatccagtatcctttctaattgcagcatcaaatt

SEQ ID NO: 4430 - DNA, 1264 bp, Glycine max
  Soy_ogl_33 Gm01:1718001..1719264 Cluster 18
aaaacaaatggataatccatatgattaaaaaaacaggaattcaattaaaataagagatcgaggttttgcgggtccaatttacatcataaccctaactatttaaattagatagccgtcgaaatagggaagcacaaatttacagccaaatacataaaaatcagaaaagaggagaaaatccttttctctcgctctctaattcacccttgttgctgctgcttcgcacaaaaagatttcattttccacaaacaaaagatgccccaaccgttgcttacacgaagagacaatcatgattgttatatttataacaatcttttttacttaggacgcaaagagacaatcatggtcgtgcatgcttcaacgtgcacgtaccactgtgttgcaaatactgagcagaactttttgaaactatgctcctttgtacaaggttgtgccaaattaatagcatgaatgtgctctcagttcaaagtggaaacctcaaagacaagcatttagcacaaccgtgctctagggcacaatggtgtgctcaacttagcatgggcatgcttaattaattagtcctcaatgattttggccttgcaagatcaagcacgattgtgctaatttcaacatgatcgtgcttagttctcaattttcctgtgcatgcatataatgttatttgtgtcaaactgggaagaaaatgtgtatcattccgaataacaataacataaaaataaagcaaattgattcccaaaactccccaagaaccatgttaaagtgattgtttatcatgcatcatcacttaaagaaacgatgatacttgattccaaagggccacaaattattaacgggagaaaaaatatactaaaagtgaattttccagaacatttaagaaccatatacatatttaactctttttaatttttaactcatttttaaacacgtgtcaactacatatggtattgttttgacgggttgaaacgtgtcaatctaattttgccatcactgctttagagagtgacctttccattggactaaaggcccagaattgctgtccacaatgcaatacgtggaaatgttttgattgtgcttagttcaagtttaaaccatgttaatctcagttttattacatgcgttaaacaaactcggcctccacaagtaccactagaacctagatgcgatttcgtgtactttgaaaggtagcgagtgggacatgcttacaactcgcaagtaacaagatctattaaatcttgcaaatgtaaagtattaaaccgtttaccgcaagcgt

SEQ ID NO: 4431 - DNA, 1486 bp, Glycine max
  Soy_ogl_276 Gm01:51897101..51898586 Cluster 18
tcttattttcttttaggaaatcactgaatatatctttatagtttgttaaatacacccttttctattctttttctcacaactacccctctctggcatctaatttccagaagcataattgaaaaacactactatgttcttcccacagagaaggctcttcaccagaaaacgtggcttacttttggaggaaggcttgcattttccttgcatgtattcattcaaacgtcccctcttttgtattttgatattttacatcaatgacaattagccgtttccaagaaagaaaaagaaaaaaattcacacgtcccctcctgcttggattcaaatcgtacttctggcagatgcagctgccacttttcctcgttattatttctagtatgcttttttaatgaagatggttggtggaaactttttttctctgtttgatttgctggtgctgaaattttagtgctctgttacgaagatttctattttatttttttaatttttggcaaccatgaagctttctacatgaatttgaaatggaatgtctatgtgcattagtaatctgttgttggattggtgataaatggcatttcatggctaagaaattctgattccggagagtatgagggaatttgtgcggtttcaattttccatgggatcaaccggttttgcaacgtgcaatttggagaaggcgtagttcatgttcacgtgttctatggaggagtgcaaaaacaaaaacgttacttaagctacaattttggccacgacgagttctagtgtgcgtaggcgaaaccaagttttagtgtaaaagtaactaacaccgtccgattgaattttccataatctaacggtcattttttattgtctgtcttgtaccgtttgatcgagttatccgtaatccaacgacctgttttcgatcttcctgaaagttgttgccaaagatacaaggaatgagaccacgcatccgccacgacaatcctcaataattagcacaaacaaactaattcatattttgatccaatttcttgttcctttgccttggctttggaggcatgcatgctctgttgcctttgctccctgaaagatttttttgagtggctatcaataataccaaaattggaggtgtataccaaaattggctatcaatttttcgtcaagaataatcatcataaaagtttcttcgtgatttggtttttaaattttaatgtgtagtgttgttgaatgaaattttttgcaaggatcctaagcttacttatgctttcatggattgggacctagagacacaaagaaatattaggacacttcgccgatggcacgatattggtcatggtggacgctgtggaatcagcagacaaaatcgatgtcggattatagataatacgggcaacgaaataactcaatcggacgctgtggaacacatatttttggggcagcacggccagcaaaaatagaccattggattacgaataactcaatcggacgatgcaggacgggcaaccaaaaa

SEQ ID NO: 4432 - DNA, 1362 bp, Glycine max
  Soy_ogl_437 Gm02:7235005..7236366 Cluster 18
ggaaagcttaccgtacataacaattaaaattttctttacactattttttttttacatctctacattgtttccccaattatttatgtctaaattccaatatactatagttcacatttcctaatatactccaaatataagacgtgttccatgttggtcacaagtaacgggctggttctagtagtcgtttttaattattttttctacttcttttgatcctatttataatatttcttattaattattttttagagtataaatatctctcattaaaagaagaaaaaaatatgttaccagattattagaaaaaagaaaaatatctataacaaagataattttaaaaaagttataaatttaaaataaatttattattatcaactttaatctaaatgaattaggtaattttctcctatatataagacatatataacaagtatttattttttgagggagagagcggacatgcatagtaatttgcaaagagttgaaaaacggttgaaattaattggctcctgaaaatgatataactttgttgggtggttaagctgtcttatgtcatgtcttgatttcaaacccatctttgaacccatgtgaccatctgagaccattactaatggtcattttcaaagacaaaacaccgactcaatggtggttaattaatacttaaacatttggtgatttgagggaggcaaatttcatgtctcacgtggctttggttaaacatatatatagtagtccctaatgctcagattccactgttatttgaacctttcattgaaatttaggggttatgcaactgtttaattgggtggacatgtagcattactattgattgccgtggccaagaagatttatgtgtccatatgtgaaatgggacatgttaatttataaagttttttactcgatatgattcattcgattttgttttttggtagagacatatgattcttattttttataatgatttagttcttcaattttatagttacaggaaaagttatcaagagcgatgctgaatttgacagactgtgcttgcttgttttccatttagtgagctcaggatgaaattcaagttcatctaaaataaaagtggaaaattatcttcaaaactatgcacaaaggtataccaggttggaagggtcattcagacttaagttgttttttatggttgaaattaagagataaagattataccgatcacctacctcttaattcgtgaagtcatacctacgtagttaatactgtagctagttacaaataaggcagtaaaaaaaaggtcaataaaaaaaatggatgttagtaaaataaaaaacaaaaacaaaaaacttacagacatggaaaataatctgataataattgcaaaat

SEQ ID NO: 4433 - DNA, 1254 bp, Glycine max
  Soy_ogl_896 Gm03:36255647..36256900 Cluster 18
gtttttgattgattgattctctaaatttattttattataacaatatatgagaattaaactcttataattatggactattaatttgaagcatatataaactccactttccagaattttatttgtgttttaattagtaattaatcaagataaattatactagtatatatttatacccaagcttaatttcttgacggatataatgaaaacccttaagtttgatataattaaacgcttaataattataattgaacagagttgtagaaattaaacgagaattatggtggtatgagtgtacagcttgctttccaacctccttatccatttatggaaaagttagcaccaactatgacttctattacgaattacagtggtaagatgaggaagccagtcacttcagataatgagacaacataggttgagaaagaccctttcagtttcctctgatgatgatgatcatagattacatgaacattcggccaaatatatatggaaaaagttaaccctttttatatttaggtatatagttgaagtcttgaagatattttttaatgggtttctgctgtcgttagttttcgaatggtgtatataattaaatgaggtgtgatcattgatatctgcatagtttgttgtttctcacacgtattaattaagccaacacgaggatcatgagtacaaataaactgtatagtactatatagctaattaatgaaaatgactgcggtatttgttcccttaatcatcttgtttctacgtacagattagttgttaatttcctcatgtgtgcacttttcaaaagagagtgtattaattctcatttttttgaagtgattaattttacgatatactttttcttctatactatatattagcttgctagatatattgtaattttcataaaggagttgaatgagtgtgtggtgtaataatttttattaattatttgaatcgttaaatgagagataatatatgatgcgcgcgtctcatcagaaagatttggaagtaattatacgagaggaagttatataagtgactgatgcaaacagaaccaaattgaaggacaaaatttctgttatttcttacaacttgcatctgctctaatgattatatctcgtaatggtggggtgaaccttttcttcgatctctcaagtctcaacttgcaaagggtcttcgatcattttatcagtttatgtatgtcttggtcatgtgaaaagactttttaaagtgtcactttctggggtgcttcttttccatttt

SEQ ID NO: 4434 - DNA, 1300 bp, Glycine max
  Soy_ogl_1375 Gm04:43873001..43874300 Cluster 18
tattgtgtaatagagcaaaaccataatatttactacattgttttgtaactaggaacaccttaggcacttctgcacttgtaatgatgagttcaaagcaattaatgaatatttatctctcattagcatttattcattactctggtaagtttaaaagccgctaatatgaatcaaattcttattaacgaacgggacaaacctttatttgccacatgtaatctatatgcttgtcaacttctaatcatgttgttttcttgttgtaggtgtgttggaagctgactttgttgaaccttgctcatgcagaccaaagctttgagtacttcagttttatcaagactggagatgtagttgatgcgattgcagaggaattattggtaattgatgattctaggtggattgttcttcgttattgcttacatgctattaattattgttttactaatttgttagtttctatttgatttaggatctctaactggcataaacttggttatgtttccaattgaaataaaaacaaggtaatgaattcgtggagagaaattctgatataagaccttgatttgtttttgtttgacacatggtggctgctcctattcactggtggtgagtgaaatgcttttccagaatcttcatctgggtcaaatatgaaatattctgtcacatattggcatgaaaaaaaaaatgtattcacaatcaaatctgaatcaatgggaaaagaatccaaacgatatagctgaatggtcataagttttgacttctcctggaagaaagattaggattaaattctgaatagccatcaccatctgctaagtgccaaggatgtttgagataaaattaattactattgtcttacctatcaagcaagcaaagagcagtagtcagaagacatctcatgctgaaaagcatttgaaatcatcaggtggaaaagtgatgtagtatacaagaggatccaagtcaaaagtcatgaacatgatcttctccctgtgtttgctctctctccccgttgcctttttttatttagacaacttgctagttacctatggggaattgcaacttgaatacgtgttcatgatgtctaaggtttgaaaggattgatttgaaaatgcactccactttcattaactttatcctaattttatcaagagcaatcaataaagaaagagcttaattaattgagaaaaggaggctttttcagacatccatgcaagcatagcttagctctgtttatactattttctaagagttaactttcagtccgtaccattttattttttacggtatcaaacgtagttggcacatacct

SEQ ID NO: 4435 - DNA, 1600 bp, Glycine max
  Soy_ogl_1561 Gm05:2926601..2928200 Cluster 18
ataagcataatttagaagattttagaagggaaataaggcttctcaagaagctgcataggattggcacaggacagtatcctaatgggaaactgttgggtttgtgaacatataacataacattacacaagacttggaaacattgcgtagaaagtaattttcacacgaacaatcagtttgaagcggtgtcatctcatggtgtcttctcatgttagtgtgtctaggttagccatcaaactcaaaactcaaactcaagcctttgcaatgtaatgtcaccctattctccaagtctacgatattaataatttaatatagggatttcatcgcttctggtggagagggttttgccgctccagttcagtaatgtgtaagctaatgcaaattaatctaagcttttgttttgaagaataattttattattattttggaataagatttattggaatgataatcttaaaaacttatcatacctatgttgtataggcattgaaaacttactcttaggattgcatagacaaaaatgattcaaacagcaaacatttttttcccttcactcccagtactggtcgctatccaaaactacccacgactcatttagtaagatttgagttgttttcatgggaataaaatatactcacacctcgggaataataataaaaaaatcccaagaataagttttagttgtaaaccttgaaacagacatggaaataaagtgttgccaagtataaataagtcttatccttatagatggaaaaaactttttcttaaagaatttaacacaattacatgaaatcgagatcactaattaaattaaaataatttgtcattaacaaatttataagtaatacatattgataaaaaataattaacattataagtggatcatgttaacagtgtggattcgtaacatcatgtaagatttatcagtttacattgaactcgatcatagttcttagcttgtccttaaattttcctcccaacacccatatagatatagtttagccatacttgagctacaaaattccttgtggtctgaaatgctttgtgttggaattgcacttgtcgtctgaccaccaattaggccgttgaaattttgagtctgactaccaattacgctgtcagaaatctaatcgaaatgaaagaaaaaaaaatgtcaagcgtgcacaggacacagtactgacaaggttgcaccaacgcactagcactaaacaactagtggtttgataacttttagttagtcacatcagttttccatgagtcatgacaatcagtccatgtgattagcaattagcaaatactactattgttattgtgtagcgtttctcttggtgacgaatgcattactcactaattgatgtattaattactttcagatatagtaagccctaatataatactaatatgagaattctttgataagatggtaacattaatcattattctctcattacccgaatgatacgcgagaattaatgaccatacaatgtgcttagtaggttgtgagccactaccgagcactattaattcttggaatgctccttgtttataggaatttttgtagatttccaaataacacaaaaagctgctgacactggtaattgct

SEQ ID NO: 4436 - DNA, 1600 bp, Glycine max
  Soy_ogl_2106 Gm07:864701..866300 Cluster 18
ttttataagtttgataactaacactagaagtacgtgggtcctctttgattattgacttagagtggctaatttggtacaggatgctgaaaatcgggtcctaacaacaagatttcgttgtataaacttcttttcatgcaggcattgattgaacaattatttttagctttgttgtacaccgttgaccataaggtttaaatatcaaattaggagggaacatgcgttaggtaaacttgcagggtgtgctaagtaccacatgataaaactcactaattaagttcattctaatttatttgcccactaagctgagtagtgtgccctacttgcacaaacagtacatgttttctttccttttgtgatgcgattgatgctggccctctcaagtagtgttgggaggacatgaccatattgtatgattaatctaaactatgtgttggcttctttccataggaatctggtttgcaatttaaatcttgttggtcatccctgtgataaaagtggttgggctgttaaaagcaaaaatgaaaaattgatggagtgtcatttgggaaaagacgagctctaacatgaattaactaacaattttattcatcataaagggtagtggtcattcagatcggaaacaaaaacaatcgcttgtgccagtgtgcagttagatgatacttgagtagaacttcaattaaattttttaccgttaacatattcgtgattttttttatgacaacattatgtcatcataatttttttttggtttagattacaaatattttttactcaaaacaatctcttcaattatttaacataatttgaattcgagatgtttagttaaattcaaactttaagagtgtgttagtaataatttaatgttgaacactgaatccaaaagataatactgttgatataaatatcaatgataaattttccatatctcaatttttataccaccatcatattcttttttatttcttcttttgcattgcatcataattgttacattattacaagcctaatttgttcgtgttagtgattttcatcatgtgatttggtaaataataaatactttgaaagggacatgaaaaggaaggtggagaatggagggatggaccattcattaccttatttattcttcacactccctaataggaaactttgatacagctgaaatagactaaacagctcaagaatttgccaaccattatcaccttccattcacaaaatccattacaaggaatataaaattaaaatatcataagagaaagaaaaaaaaaaagtccccaccaaagtgcatgtatcacacactcaatagtgcaagccctcatgggtgggccacttatgccacatgaaatttctcccacgtagggtggacatgttacatccccatatgttcccaccctgtgtccatgaaatgatgagataactgggtctccccttcccccacagaaggacttttattgctacttacacttcacataactactttatgtctgtctcaatttcgaacatggttttaaacaatggtcggggatccagattttgactgcaatgtcaaggtttttgaagtgtttgtgaccctaatatcaaaaaacgtgatgaaactgtgatt

SEQ ID NO: 4437 - DNA, 1226 bp, Glycine max
  Soy_ogl_2126 Gm07:2162070..2163295 Cluster 18
cttatgagaaatattaataatatttttaagagattatttatattaattagcattaattaaaatttattgaaaaaatcacaaatttgtgaatttcacttcatattcaatgagttaaaaaatatgttgttaacactcatttaataagagaataagataagaagataaaataaattgtttgttttttctcataaattaaatcttaattatattggttaaaaatatatgtacgagattgtatttttttttccatggaaacaaataatatgtattataaattatgtctgaaactgagtcacaagaagtgcaagcagttccagtcttgcagacatgagtagaaaatagagcagattttatacatccataaaattaattattaggacctttttctatgtacatagttccaaaaagctacccaccctgaagatcgtttccctggtccttccataatctacactttaaaccgtccctttatataccatttaccagttttatttacagtagccctccctgttatttgattgtagactaacttcacctccttcctgttatatatatcagtcatctcccacaaaacagaatattccttcgaaagatgtatgagattgcacttatatataatataatagaatagatgtataatagatgtattggttcagttttattcaattttgtatactaaaaatgactttagaggataggatagtgatataattattacaatgaagtgtgaactaccggccactgtctcccaataaatcatcttaatttatttggtcagctagttttctcctattttctaaccgaaggtggcatctgtttactttctaccatgcttttaaattctctgtttatcccatattttcaatgttcgccagagttagaagaaaaaaattgcaagtggccagctgccaatcattttttagacaaagaaataacctaagaaagtggaggaatggaaggctaagcccatatagtattttttctgaagttaatttgttgttattgcatttgatattcttctatttttttacattattttgagccttcaaagggaagatcggaacaacatcttttatggcagaggagagatcaatgtaatgatttactcctacatgagaagagttcaagccaaaaaattaagaatttttttttataggattcaaaaatagaaaaatattaaatgttataagggcaaactttaagagatttatgtgatgtactcaatc

SEQ ID NO: 4438 - DNA, 1400 bp, Glycine max
  Soy_ogl_2211 Gm07:5371401..5372800 Cluster 18
caatccttgggtatccaaaaccttctttgagattttctaacatattaattaatttggttcattcatcttaatgatccagattgcgtcgaacccatttccaagtctatataaacatggtttcacatgcctgatattgcaatcaactcttctctcttccttatacatcaaagcattgtttaaggtattgggtataatcccaatttggagttctcatcacacaattctgaaaggatatgatggcaaacctctgctgctagttcatggatacctctggtttcgtaacaacatacgttcgaagtcaaaggtttgcatgaattgggagatgagtttaccttgatctttttgtattgcagtgaagggagctccagagggggtcttttcaagcccttaagtacatgctcaaacaacccactctctctatttcaatttatatatcctatatatatatatatgtgtgtgtgtgtctaatttctcaatgtatttttatatagaaccaaatatctagtcttcacatttgtgtcttaaaaatgtcgttgttgactgttgatttttcttctgtcagttagcaatctggaggaacccatctccatcctgtgtaatatgttgatgctaaattaatccccatataactcagaaaaaccttaccctttttctttttgttattgtcattgaaacaagtttccttttcttttttggttgaacctttgaaagaagttattatgatagacataacctatatatttgtttattacaaaataattcctttgaataggtgtatattatagtattatgttcattgtttgcggtactcttttttgtatagcaatgcaattttttttcctcataagagcagcgactcttatttagcaattgtagtatatccaacaagtgttttgcggaagcaattaaagcgacaagaatacaaaataattttggcaaaatattgtataaaaaacatgaaagctaatatttaatatttacttaattaaaagtattcaatatgttaaatcctctttatatatatacgaacccttgtataatttaattaggttgttctcaaccttccttatccaacaggtcaagtgatgattctgattactgtttctatagagaaaaacatactcaacttgtctaaccgtggagcaacaagaagaggagctttgcaactccattgaaggctgctactgatgatggaaactatcatatatgctgtttatctagtttggatcagaagagttcactgcactcgatctatagttatgattgatgtacatttaattcgcttccaagtgctattattattgcatgaaaaatgagtttttcatgtctgttatgaaccttgaaagcgacaaaaaggaatgaaaaagattatatatgtcaatcgttatataagtatatga

SEQ ID NO: 4439 - DNA, 1200 bp, Glycine max
  Soy_ogl_3329 Gm10:2723301..2724500 Cluster 18
ggcgtcgccgcgattgttacaaaatttcttcctctgaaggttggtggtggattcggttggtggcggtttggttgggtttgggtcgctgttggttggttgtggtgcgttgaggttggtgactgtggtaatggggttgtgacgtcggcggcggcgatcgagtggcctcccgatggtttgttgcggttcaggaagcggcgttggtgtttggtggaacggtggttatggaggtgaggtatatatagctttgggtggtttacggtgaaagagaaaggagatgggcgtgctttaggaggagagaaagtttttttttttctctttactatctatctgcaccccaacatgactatcagcacccgacttctgttttttttttttttaagaagcacaccccgtttaagaagggttattttgacctttcaataaaagtttaacaatgttagttaacagaaacacttagggtgcaaaagaaatacaagaagggagcgtaataagtactaaattcaggaaaaataagtgtatcaattgaaatcagcactattttcccccctaaatttagggtacaaatttaaactattgcaattattcataaaacgaaacaagataagttatttatttatttatatatacataagaagtttgaaaattaattatacacatgtcaaaagaataaaactcgatcgttaatattaaaaatttataaataagaaacttgatagtcatttttctcttgattaaaatactattactcaactcttgaaaacaccgatcacacttccaaaaacatacattatgaatttcaaggtgatgatgtatatgtatttgtcacattctcaatgtgaaatctatttatgcttaatttacttttattgtacttttctctaaattattaatgtcttttcattttctatttcttctcaatttttttttcaataatctaaaagaaatatttatatcactataataaatattagcattattatcgaaataataatcaatattttcgttaatatacgagtaattgtgttaagttgaaactaatagttgcttgtttatcacataattactaagtatctgttagtgctattatcgtattaaattaatagtatttgtttgttcttgttgagaacaacgaggcttagggtataaaacaacttggggtatgaaacgttataactttgccgtttcaaggctgaaggtata

SEQ ID NO: 4440 - DNA, 1200 bp, Glycine max
  Soy_ogl_3545 Gm10:45231801..45233000 Cluster 18
aaaaaaatatttttaaattttagtgactaaagaaacacacccctaaattccagggactataacataacagtaattaaacaaactttaaatacatcctatattaaaaccatttaattgaattcttgattttctgcattatttttaattaaatctttgactatattttgcttagaattccgttaaacacaaagtcttagttaatctttttttaaatagtttaataacttactaaataattatatcagttcgcctttgaattatatgattttttttttacaattaagttcatgtgctataatccaaccttaatacaaatgtaataaaaaattaattaaaaatattttgtaaatttagagtagttacaactttttaaattataaattttttaaagattttaaaatatctcaacaactcataaatgaattacggcagtgtttgtaattaacatctttttttccctatttcctttattaaaaaataaattgattagtactttatttttgtttactactattttaataatcatgttgtctttatgtttcaactaaattgaaataatcaaaagaaactatattaactaattttggaaaaatattattaatctaaatataataaaaatattatggatctatattaatttttgaagccgccgagtctgttaaccatgtttttcaggagtggccgtgtgtggagtggtcacggtggtggtgggtttctctacaatactccattatgtggggcgtgatctttttcaatactttaatggcctatcatggagcacaagcattcacaatgaaaggtggcaactgattcggtagtggagtatgggcatttgtctaggggagaacatggttggagtatgtggtggtgactaatgtgggttaagaattgtgtatgaagggtttaggaagaggtgagaggtggggataaaatgggaaacataggaattgaaacttaaaagggggtgaagttagaaaaagtagggtgtgaataacaaagttcctgggctcgtcttggattggttgacataatcaatgataccttttttatgggacattaattttagtctctgttcttcaagctgaattctgggacattcttttaagttttaagtcttgggcttttatggagtctacgtgtggacatggagatcattatagagacggattgtttggatgcggcttatgtaaggaaaaaaaa

SEQ ID NO: 4441 - DNA, 1246 bp, Glycine max
  Soy_ogl_3642 Gm10:49096901..49098146 Cluster 18
tgcagactgcagacaatgaaagtcaagacattgtgcttcgtctaatcacattctcaatcagaagtgacacatcctatttcgcctgcaccttgcgcttctctatcacttcaatcaagtgaccaaatttggctacacgtaacctataactgtagtttaactttccatgttttttcataatattttatttttaaatatttacaatttttcaagtcttcattgagcttgttttgaattagaacaagcaagttaagaactatggtgataatggtgtctcctccatccacttcatgtagaagggtaataccaccaattaatgtagtaaatcgattattggtaagagaacatggtaaacggatttgatttctgatgcctgaggacgctgttgaggtaataacttgtgggtctcttttggcagtgtacaattggccttgaatattttgcttagcaaaggtctttaaatcatattttaaataatataaacattcataaaatatataatataataacagataactacatatattttaaataatatattgtctactaaaatataattatacactgaaatattaattatttcaaaattggataaagtttagtaaattcaatttgctttataaaaattagaaatttaatgattgaacaaataaaacttctttatttttgtagactttaatttccatacactaaataatttttacattagcaatcaataaaaaaccatattaaaaatgacttttaatataattattatagaattatcatagatgttattttttattaatggttgatgcgtattattccagaagctacttggttttgttctacatcttttgctaaattttggcgtgatttagatcgtaaacacgcatgcgtgaagggatttcaaaaacacacatactatttcccaattttacaagtcattaaacatataatgattttataatgtgagatgattttaatatggtggcattgaagcaattgggaagttcgcatgacagggattagaatggtgttccgttcacaagattgcatcaaaattgatacctaagatggtacggtcggtaatggaaaacgcgataacttgtaacgtacgttaaacctcgacacaaacaaaacactgtggcgcgattcgcggtccagcttcctcgcctctctaccccgttttccttctgcccatctcctttgtgttataacttacaagtacctttttctttgtcttatgccagtgatctcaagtctcttc

SEQ ID NO: 4442 - DNA, 1639 bp, Glycine max
  Soy_ogl_5020 Gm15:12678862..12680500 Cluster 18
ggtcaatggattaattaaaaaattctcacctctttaaatctcaaattaaaaaaaatcttaaactcaagaataataagacatatttttaaaaattagatccacaaaccataaactaattaatttaacaacatatttttaatgataaaatataaaacttaacttacttaacatctcatattatttataaaacataacattgttttacaactcaaacataacattgaagaaggcaatgccaacgtcgatcttgactcccaaatgatgggaaaatggtgctaaagacatttacttgactggtgacaaagcttagattcttttacagaaattttatgtctccatatttcagtttctattgttcatgttccattaagattacttcttatttttaataatgcttttgcatttagattaaatgtaatattggttcattcattttctacgttcccggtgggctactaagcgtgcctgtaaaatttataaattttacatgctatcgtttagctagctagatggtctaatacaatttacttgatatgataatataaatcaaaaatttatttgcacttcatgaatcttattttaatattcacattctagataatgtgtagtccatcgcatccataaggaaatatgcatccacaaaataaggagggaaaacttaacttacttaacatctcatattatttataaaacataacattgttttacaactcaaactatttttttaagaggaaatgtagttatttcatttcattaatcatgtatggaaatacaatcataatcctcagagccaccatgaaatcttgatgtcctagttagtttatcagccacaagattagcttgcctgttaactaagctcacctccgagttggttacaatggaaagagaatgttttgaatgagctaaaatggaattaaaatctgaaaaatcctatttcaccaaaatccaaagtaatcctttatctgtttggaaaatgacacggcttagatgcagtgcttgaacccgtttgatgcctttttgaagtgcaattgcttcagctactgcaggaaaatagccggatccagcttgcatttatgtagccattcggaggaggagaccaatttgtgggtgactagagagcttgaaaggtgttgttgtgattcattgttctcaccaagagccactcagaaaagaaagtcatggccaaattgattgcaatgggtggttccgggttggtgttctcccaaatcatgttgttcctgattttctaaatagcccataaaataatggatattttgttcattgtatgatctggttgagtgtccaaaagattgaaaatcagctcccaaaaaccttctgctgaattcgctaatggctctattatatttaacaaatctgcacattgccaaaaaaaatgagctgtatcacatgcaatgaaaatatgccattcattctccatgtaattcaggcaaaagcaacagtcatggggaaattggactcctttcaaaattaatttttgtcttgagtggctcaccgaactctttaacgaaattatgaggtcaaaacgcatgccggaggaatggaggagaagcacgttaatgccaatctataagaacaagggggatatacaaaattgtgtaaattataggggaatcaagct

SEQ ID NO: 4443 - DNA, 2163 bp, Glycine max
  Soy_ogl_5242 Gm16:1969101..1971263 Cluster 18
agaaagtgatgttaaaaatggatctgaaagggaaaatgaaatgaatctatggacagggattggtaaaggacgagaagaggaagaagaaccgttgatgcaggtgaagacaaatgaaaggtgagtcccaataaaatttgaaaccccacttcacacgccagtcccatgtgttgtggtctgtatgtgaaaagacagttctgacctagaatggaagtggagtgtaagagaacttagataagagaggaacattgggtgacgtagagtaaaaaaagagagtttagtgcattgcagagtgtatgagtgagctagggagcaaagcgtggcaggctcgtacatgtaaacgttgcccacaatgtactagtgtactctttgctacagtcttccacagtatgcaaaatcaccattcttcttctatttttataatacaacattgtcacatacataggacctgctaagtgttcacatacgtcctttaaaataaatgtaaagcgttaataaacctttaaatagctatccaaacatggtattgtctcaattactactatttatccagcaatacctattaatatgagaataaccaatagtttgttttttcttttttggttgaatagataaccaatagattgttattgtttttttgaaagagtagtttgttattgttatttactagtaaaattgaagttaattaaaatcatgcgatgacaaaagaaataattgaaagaaaaggtttggtatttctgaggatggagttgatgttaagatttaggaagatcttttaaccagcaggttactatagaggtgaattttgttcataggtgataggcgtggcatggtatttattacgtagtttggaagaagaattaaaaaaataaaaatgaaaatgtgtttgggagagaggccatactgagatgctgatactcatacagtgtgtactgagtgcccaaaagcaatgtatgagagccataagtggatgggcctcatgtggcctttcacactctcagtcgcatcaccagacagtgtcgtgccacacgaccccccacgtgtcagacatcctaatctgattttttactgctccacgtttattttgtcgtcccaggatgtcttttttccccacgcgcttttcccaaccccacgcgacaagggagcacccccaatctcaatccgatcgatatctatcaaaaattcacattttcagtccacttcaacttgtgatgtatccatctattttttgtttttatttcattccaatttttgttccgaccatttacattatgaagctacaactattaggagcaatggggttcaattcttaacatgtttctcatgtcctctcctatctctcgcggctaaacaaataaaaccgcaatttaaaatttccccaaaaatagattcccaatactagagacatatctaactcatcctctagacagaccaagttatggccaaggcaagcctaacaacatatcgggtagtaaacatgtttgtcccttgagggtcaatattaggagaatacatctaaagagttattgaaaaatgtctcgtataaataaaggtatgttccacatctcatttcggattcatgattagggtagcgaacttaggaaaacaaaacggaaacgtttagttttggaagattgtcctccctcctgtgtcttcttgagatgaatattaactaacaaaattatcatatcatctttcttctcattaagtaaaaaaacttgtttttttcttcgaattaatccttaattaataattgttttaacttaaaactataactattttaattttaaaatatgattattgtttagcacatttttatcaatctaaagtctgaaccctagctaatctcctccacctagtagcaagaactaagaacgtgacctttgtatgttcaaaatttctccatccattttgttcaatttcattcttacactaggatcgagagatgtgttgacatagaaagcgtgagttacaagataggagagaccatggaaaacgtaaggggagatgattacaatctaggtttgtaacttttgttgtttcttaatttcctttttgtccatgttagggaaactctttggtgtcgattgtataaaacttggttatctaactaattagcgcgagcgattctttattcctttcgtccattgacacactacgtcgctc

SEQ ID NO: 4444 - DNA, 1212 bp, Glycine max
  Soy_ogl_5321 Gm16:25201..5521412 Cluster 18
tagcatatcttcttcaatttggctctttttaacacaagaatttccaaggatcgcaatatgtccatcatcagcatgctacgtagatgttagaaaacagaaatgaaacacaaattcaagattcgcttaacaagacagaagaatcacttgtcttgagaagagtgacgtgaactaaggttgagttttttgtttggcacaataaaaaaaattgaaaatttattacgggagagaaaaggttaagtaaaacttggaagagaataaggagtcctctacaacagaaattctatatataaatatgagaaaaaaagagaatgcaacggatttgtctaatccatagtcaccaaccagaaatgcaatataagtaccagtaccactagtgattatattacaagacttatagaaaattatgaacattttttgacttacaaaaaattgacaagtaaacggggaatccagtacacaattcacaagaatgtggcaaatcctactgtaattagcacactttctctaattgattaaatatattagagagtatgtccctaaaatttctctagaattaatgctagggagacgaaaagataagaaaaggcttccaaaaaagaaaaaaaaatctccacccagaaatttaatagaattaaggagtatatagagtagcaatgatcattggtattgacaaggttgtgttagtaaaaggggttagtcctttgtaacgtcgaagaaaaatatgtgaggaaccaaaagcaatgatcattggtttgacatgtagagtccagaccatacataatcaaaattactagctaacacggagaattagtctttaaagaaagtgacataatctccaacagattagatgcttaaaaaaataaaacattatcccctttgaaaaggttgggtaatcaatctcaaaggccagaaatacactggttatggaaaaaaggtccacacacttagtctatttgatgcagtttagaacctgtttacaggaattctatcaagttggtttgtaagtgaatccaaattattaaacactaaattctaattaggaaagaaaataaaccatcctataccctttgttttccaattaaggctggaattttatgctcttggatcaactaactccaaactcgggctgcatgtatcttgtattcaaaacgttttttcgttaatgtttatatattttaattgaaaaggtgtctaataatacaaaaaactaaa

SEQ ID NO: 4445 - DNA, 1200 bp, Glycine max
  Soy_ogl_5466 Gm17:2725701..2726900 Cluster 18
caattatggtttttacattatgattcttcaaagatggcatggctcggggcaatggttttcttgggtttcaatgggtggtggcttgggaacgaagacggagctggaaaggttgaatttaattataatgtatttttatttatttttttgaaagggtaattagaatgtattgataatatagaatgtgtctgttttaaagtatagtagtaaaagatttataagaaacttagcttaattaggaagatctcgcgtttgatgcaagttctggaaaaatactcataggaattgttgattcttagaaataaaaaacttccacatttcatcacttgcttctcgtttccatgttaaaaggtggataatttatatttctataggaatactagttactagtattccatacattaactatctcttcccttcattattggtactatttcatatctcctttttccatgttttctttttcatatctccttttgccatgttaaaaggtgggtatcttacatttgtatgagaatacaagttattagtacttcagacattaattaccttttcccttcttcgtcatttcatacttctttttccacattttttttcaattttttaatcaaataaaattttaacttttctgaagttacaatgtcaattaaaatattcatgggaatactattccttcacactatactcctaggaatgcgattctccttaatataatatgatcattaaaacaaatgtctccgtaaatattttttatataattatttaattataatttattatgataaatttatggaattttacattaactattataaaagctatacttgagataattttttaatgtacatgaaaattaaacttaaaaaatatataaggctaagatttaacctaaatcaatggttaagattatgtcatatccttagtcatttaatattttaggttaacaaaataattttttataaagatttttattataaaaattaataaatgatcttagtaagttggatagttgattctaattgaacacatcctatagaaagagtgtactatcgcttttggtggtcaataatttgtgtgatatgatacaaagtgtactatcgcttttgatgggcaattatctgtgtgatagaataattccgtctcgtgtattaataattgatgggcaaagaggactctgtctggacccctgtttaccaaaccata

SEQ ID NO: 4446 - DNA, 1132 bp, Glycine max
  Soy_ogl_5516 Gm17:4961401..4962532 Cluster 18
tatataaataacacttaactattgggccattatggtaccgagaggcgggtccttgtctgccttgtatttgtcccccatccctatatgcatgcataaatttaatttaatgtctcaagtctacagaaaaacatggttaaaagaattacattaattaactaatctagctaaaggtgcacattatcccaagataataatctttaataggatctcaatctcgagcatattttcattctcaggatggctgcattaggtgggccccatagtttaaaaaaccaagcttaaatataattggtcacttcaaattagttacttgagtttcaacaaatgactgcacattaagtgccgtacgtcatgatccatagattcataagaatgtcacattcacacacatagcttgtgataaggtatggccagaaagtgttgtgtgatatatggggcccaacaggtacggtggtgacacttgtaagtcacccaaccatgcaaattggttcttagtactcttatcatgttgtttctaagttccatcgattggagagaatctaatggttactttgtgatttaatctgttttgggatcagttgttgattagttattgttccagggggggcttcactaataggcctttagtttgctgatttaggaagcaattgactctagattgaactttttccttcaagtatgttaggttaaagcctgatttccttttcattaattgattaaggccaaaggagctcattgcttcatattgatgaatccgataagcatcatgactactttattaatcatttaatctcatataatagtggttaaataaagacatgcgacatttattgctacaagacttgagtttgatcccttttattgctacaatccttattgttttactactactaattaaaaaaaaaaaaagatattgtccatctataccaaaaattaataaaataaagtgacgtgcatctttaaattatttatttatgatttaattattaagatttgttatgcttttatgacttttttttattcttactccgtcaaaagtaagacacttgggataggatttataagagatgacgttaaaattaaactcaatctgcttgttgttcatacaaactcaaggagaacttgtctcacc

SEQ ID NO: 4447 - DNA, 1960 bp, Glycine max
  Soy_ogl_5576 Gm17:8041801..8043760 Cluster 18
ttttgtgtcatcaggcttgttgggtgtctcaaactaaatatggtatgacccgccatatgtcaatcaacttaacttaaccttttttttatataaataaattgggttacatatattaacctatcaacccacataaattagtgccttaagttgaggcaagattaggaagttgatttctctagccatttttctattcttttcataattatgtatacaaaagttcaaatacaaacttaatttctattattgtttaatttatactctcattaacacttccacctatcttcttattcactttttaagttggttattttactcatgctttaattacatggattatttatacataatatgcattattaattacgatataatttcttatgctaggattttggagggtgaccattccaacaaaagtacaaagaaggttaaatttcaagatgaacacgaaggagaggaagagatatggataaagacaaacaatgtattaccgtacaaggacaagttgttgaatcatcatgaagcaatgatgtcataatgggatggagttaccagctagcttcaatgatgaggaggaactttcagagaatagatgatataatcaaccatttgattaggaggctcggaagcaagaagaagaatacagagcaaacgaagcatgttctaaagtaaaccaaccccttggattgctacgaaaaatatcatctcatttcaaagtagtacaatctaattcaaaaattgcacctgtatgggacaaagaactaactgcatgaagttcaaaatggaaaaatgctctaaccgaaaaatgtctcagacaatggaggatatatggagttttggatgtgtcaataactaagaaagcgagcgatttttttggtgagtgaaagggaagaaaatttactctcacaaaaaatcaatcaaagtgctagtgttttttgcccatgatttctagtttagaaaatattttagaagagaaatcgggtgctaaacctaaaggaaaataaaacgggtaataataatcctcaaattattaatgctccaaaatctaaggagctgatgggaacgcaatttaatgtgttgaatcacaaaaatggggagcaatgtgaggctgaaatggatgtgggcaaagagagatgatatacatatagttatttatggattaacgttgctaactaatggcctcgtgatctaaggtttatctgtttttagtttctgaatttttttcaagtttttacttttcagtccttaaataaaattttgattagtcttgatgcttgaaattttttctatcaactttttactgccgtcaactaccaccgatatacgatgacttggtgctggttttattaatattttattatgatttgttgcagttaattttctatggggttctaactgtcttaaattgctttgtaaaatgtttaaaatgaattgaaccatttttgtggtggccaaaagcttccagaaattactttttccttctttctatttctttcttccaaactagtaacaatggcatgtcccgaaaataaaaaacacaaatcactctttaaccccacagctgcaaccatctcaaccactccaatcacaacatcaaagaagcgtacccaaaccctttgaaaaacgctccctataggtctttgtgatatcgttcaacttcaacgacagcagactttaaaattgaaacctaaagtcaagcaaattcagagactcgcaatcaacattcaaatttccgtcaaccaaagtttcatatcaaaatctcagaaaagaagaaacccagtagatctaactgtggtgaaagagtggaaagggaacatttttcataggaaaagcgagatcaaacgtgaaaaagttcagaataatgaaagggagtaacaaggagcgtttttagctccgagcccggccaccaccatgctccgccgtaatgactgttacaagctcacgccacggggacattgaaatc

SEQ ID NO: 4448 - DNA, 1081 bp, Glycine max
  Soy_ogl_6444 Gm19:39029771..39030851 Cluster 18
ttaaaattattaaaatatgaattttatctttgcagattttttatctattttttattctcataaaattaaaaaatgttattttttcatttgaaattaggtttaattgatgtccatatttacgggtcactgtcttacatacgtgtcaatttttcattgggctaatttttaattactattcttataatttcccggggattaatcacaaatgttgaaaaaaaaaattatcacaaattttcaaaccccagtttttctaattatcttaaaatattcaaccaccataacaacgaacacttgttgtgatactcaaactgaacagagcagcttcaagtgagagagagagagagggagaacgataatgacgaagctctccctattgacagtgtttgttgtagcacctccttcttcacaccctcccctggtccggcgagtctcgacccctcatcaaccacagcaaggagattggatgagcactattgttctctctctgtgttcattccgctggtcgaattttttaagaagatgaagaagattatcaaatgtggggtttgaaaattaatttgtgacagtttttttctttttttttcttttcaatttgtgagattttttaaccccaaagatgaagaatagtagccaattagaccaatgagggagtatcacataaaccacagagagacatgtaagtatggacatcaataaaaaaaaatattttaatttaacaagaatgaaaacatataatttttttttataaaaacaaaatttatacttttatatttttataagagataaaaaatatattttagttcaaattataaatttcaagtgtatccttcatacttagaaacataaggaatctttttctgcattggattttttaccgaagagctgctgtttttcttttataacgcacgtgggattttaaccaaaaggggttagtttcatttggattttaccaaatgagagtattttttgaattaatccctaaatgagaataagttttaaaatttgtactcaatgtaaaatcataaaaaagttcatgacttggattttttttttatacagtgaagctgtaaaaaatctaatg

SEQ ID NO: 4449 - DNA, 1600 bp, Glycine max
  Soy_ogl_6508 Gm19:42385101..42386700 Cluster 18
aattatcaagtcaatcttataattttaatagatgttcatttaattacgagttgaatccaaaaaaaaaaaattatttgtgtgtgcacacgttaagagaaagagtttctacatttatcataatcctataaattcaaaaagttatctatcataaaaaaatgtattaaaaaattacaatgatatgaaatcttttatataaagtatattatttatagttcttccaagagtatggacgttggaagaatgatataacaaaacaacaaaaagataaagctgctgccctgtaaattgttataatgaaagaagtgattattacagctatgggtaagatataggaaacaaaaatgaactttatgattattacagctatgtgtaagctatgacaaaaaataaaactcgcaaataacaaaagaaaaatccaagcagtaaccaacgagtctaataagttgacatatgactttaattaaaatcataaatatttactatgtgcttagtgaacaaagaaattgtgaagttgaccactaccgatccttaaatacattgtttggactttggataaaagcagcagatatgatacaagtagttgatatccaagaagtgctgcttttcaaatctttcttttggtatagagtgataatgatgtatcgaaaaaggaagaaataaataagaagaaaataaggtgaaatgaaatagaagaaaaacaagagtgtatatgattacaataaccctttagtccaagtcttagataaagaatctaaattgcatgcagccactttattagctgtggttatgtaaatatcaaactctattagcagttttttccacgactttcacggtcttcacaattattcgttgtactcaatgtttcataaccacaataatgcatcatggttgacacttcatcgattaataaataagtacagcaagcggtacttaaaaaaggaataatgaatgatagaaaccttgacttggagttggagctggctaagcactgtctaagaatttaatgttctctaacggaattgatgaatcaaacatgcaacacaaggttctcacaagtcacactgtgagggtctcattttgccttaattcaaagcatactctgattaaataaataggaacggaacatagtcaagaaagtggtttacgtgggcctgtcaatctgattcatctaattaaaagaaaaaataattggcaaatcttgaaaatggtcaattgaaggttactgacagtactacaatgacacctcattcacacccccattagtgatttgtggagaaaaaatgcatgtcatggaatggtgttggtgttggctcacatgcttaccacaaatgtcactcacaggcacagctcaatgtttaaatgtgctcacggatggagggtcagatctctattgctattagcttggatccaaaggacgatttggttattggtacgtacaattcaatatagccagcaaagattgccccaatgcaagtccccaactaagcaagctagcattgccactcggctcaatggtactattgatgttccctaactgcactatatagaatttgaaaattgcatcaaatggaaaagtgtagaccgggtagtagcatagtcc

SEQ ID NO: 4450 - DNA, 1100 bp, Glycine max
  Soy_ogl_6842 Gm20:38428001..38429100 Cluster 18
aaggggcagcaagtttccatatgcagcaaaatggtcttgagtggttgatgattgcccctagtttaaaagtcttgtgttgtgtcatgtcttttatgtggaccatagaatgagcaacaagttgaacgttcgcattcaaaggatggaaacatagctttatttgctgctggggcgttgtgatattatgatccttaaatgcactaattagttgtcatctaaaacccagctaccccgtgtggtttgtgttgtgaattgattgcgagattttgacgcttgatcatctttcattggctacgctcaatatgaagcaacattccattgtgcctaaagattacatgtaatcttattgcacgtaattaaaattatgcaccctggaaattgatgcccccaggaaattgtacggaagagatgttagagcaaatttaaattttgatacctccatttttctgactggggcctgctctagtgcctactactacttactgtgtatcaccttttttttatatatacaatccttttttttccagccgattgacccatttgtttaagtttatttttaataaaataagtagttttttaatttttttatgtgtttattcaaactatttttccttaaaaaaccaaaaaaaatgttttttaagaaataaatcccacctgcttcttcaaaaatattatttttaaaaatacctttttaaaatttaaacaaactagcccattatgatgctatatattgtttgaattttattttgatagtgtcaattaaattttatggtaattttttaaagtcaaatatttgtgactttaaataagaatatgtgaaatgtactgcagaattcaacctgctttaaactcaaattaaccgcatgaaccttgtttagagttgtacttaaaatagttcagaccataaggttgaactgtggactaggattttcttcagtttaaaatttaccgtattcacgcagtcaattaatcgtagttaggggatgaagaacgaatgaatcatattttatcttcaacacccatttgccttgacgcccgaggggcgataaaggtaaggtaagggacagaaccaatgctgtgtggatagcactttgcaacagttg

SEQ ID NO: 4451 - DNA, 1480 bp, Glycine max
  Soy_ogl_6922 Gm20:42017335..42018814 Cluster 18
catataattgtagtaatatattgtctttacccccttctactgcattgcatctgcatttgattaccacagcaacaattaagtgcagctatagtaccaccaagcttggcactacagcagttaactgaacaaatgaagtgtccacagtcattggatggttgcctggtagaggtacatgttataaactaataagatttcctacgtgttaggtataattattaagaagaggcactatatatatagacttttatatataaagcttattagagttttaacacactctccactgttggtcctcaatttattgagaattataaaatcagaataatgactcatcatatgagtagttggacctgtaaaatttgtgatttttaagaaatttgagccaacaaaaaagagtgttcaagagaatgtgttagagacagtgttgctaccatttctctgtttaggaatggtgtttgtagttattagtgaaaatagaaatagaaaatactttccttatgtcaaacaggcttctgcattactatttttagtttttacaacattatgatagatcattatatattttttctttctctaaaacaaatgatttgtttattgtcttggggtggtgtatataaaaactgatcaacacattttacttttctttttttgcctgttcattccaatgtacaaatgattggcttatgatgcaacaaaatctaaatcaggaactaagtagctcttttaatataaaacatgttttctttatcttttacttttctacaacattcatgtccctttcccttgatgtctaggctgatgtgcttgttgatatattgaagatctattgaagattgttgatataatgctctctcatcaggtatgaaattttataacatgttctgttgggtgttttgcttcctggattttgtgattttcagtgaatttcatgtaaaaataagctgatcttgcaactgatggataacttggtataacccaaattacactttatgtttattttagtttatttcctaatataattatactttctgcgtgaatggtataacccagttttgtaagcagggcaactaaaacaacgacggtcgttagtcgacccgtctttatagccttataaaacaacgacggtcgttagtcgactcgtctttatagcgttctccaacaacgacggtcgttccaagacccgtctttataccttccttcaacaatgacgggtgtgcgtaagcccgatgttgaaatttttaaaagcaacaacgggtgcatcttccacccgtctttatagatttctgaaacaacgtcgggcccaaatgacacccgacgttgaaatcgatccgaacaacaacggtgctcctgaaaatccgtcgttgacttatgttatataacgactattgttaattgcgcactgacgtcgtcttctgacattacaaagacggtggttaggctgaccgatgtcgttgttgtcgacttacaacgacatctgtaa

SEQ ID NO: 4452 - DNA, 1605 bp, Glycine max
  Soy_ogl_1895 Gm06:10576401..10578005 Cluster 18
aaaaaaatggagaatttaattgttaaaaataaattaaagagaaactaaaattacaatttatttaaaataactagacaaaaaatataattaaattaaaaagagagtagaaaatcgtactgtattgaatatatatcttaattgcatatgtgtggaatgggtaattttcctaatctattgacctattgcaaacaacaggcaaaataatcacaccctgaaaaggaaaacaaaagaatgaagagaacacatataaacacagtgcacacactggttctttgacacacatgacaatgcaggcatggtttcaagctctcgagtctcgaggaaaattcaagtctaagatcacatatacttttgccctgaaatttccctggtccagtagtcatcgaaatctggatccttacccagatcaccgccggcggcaaaaaccatatacacttggctatccatcaacttcagttatccaattaaattttggagggttaaccaggtacctatctttgtcaaaattttaagaaaaataaaatgtttgcattgtgcataaacaatttttggaatacaatattcaaaatggttatattgtttatacttcatataaagaattatatattatatgcatttaaaaatgataaaaaaaatagagttatctagaaaagatttcttcatctcatctttaatataaaaaattcgtgtagtacaatttgcttgtgtactctacattcaagagttaataagagaaattataaacgtcgcacacacacatactaaaaatgatcattcgtacacttcctcatttacttctcttggatttgtatgtttcaaaattttcgtattaaaatgattgcaagttcctccatgcataaaaataattctaaaagataactattactatacattaaaattcaatcattaattaatatttaaaaataattcattagtcaccggtttccatctcttttcttttcccctttcagtgtacagatcgaatgtattaaatctagtgatttgataactccaattcgtttcatgatgtccagctgtatagaaaaaaaattctccaaggggatatgttgttataatacaattgagtacatgttaattagctgggcataggctacgattctgtgagttaggtagcaaaacaagtatatatttaatctgcatgtggagattattaaatggtttttaaagtctgaattgacttcaaactatatatttatattattgtgttgtgagaaaaacacacgagtatactgtattttattattattctttttttaatattggtttcgttttggggttcactttggcagcttgataagatctagtgattcacaacacaactataccttttcaattcaaaacaaaccagttgtccattccatctctttcataaaatgtcatttccttttaattatttatgcacactgaaagataggcaagattatattaaattgcacgaagaacatctcataacaagacaaatatcatactttcatatatatactagctaggtaagaataaaagttctggcgctttcatcattatacaccatgagttcataatttgttttgcgcaaaatgtttcagccttctttattttaatttg

SEQ ID NO: 4453 - DNA, 1200 bp, Glycine max
  Soy_ogl_6810 Gm20:37463801..37465000 Cluster 18
cgaattttacctgtaatgctaaaggtttaaattgtgaagttgtcatgaaacaagcttttatctaaccagctagtagaacaaccgttaaatacctgttaagaaaaatacattttgtccatattaaagaatgagtactagcccaacttaatgtcctttaagagagttgacgggttagattctttttgttttcacttttgcattttgcaggaaggattaaattcacattattgttgtaatattatagtataggacaacaaacttaacagcagcgcaaacaaacaaaaagcataacataaaaatatgcatggattttcgaaaggaataatgctatttggtggataaatgcggctcaagcacagccgcagaaagttaaaatgaaacgacaaacgacgaagttgaatggataataagttttttttcttacaaatattataaatgtaaagtatttactggttatttaatagtgtgaattattgtaaattatttaatatttgttttgatttttacataaaaagaaaatatttattatttttatggattaactatttttaatagagttttttgtttagtcatattttttatctacaaaattaaaatatgagattttactttaaaaaaaatccaagttttaggttcactttgatctaagtaatattgattgataataagtgtttaaactttaaataatataacaataaatctaatgtactaataatgtaattttttatactattgtctattggtaaacgaaagcagtatactacttaacatgaaattattttaacaaatccaatgattttatactattatctaattgatagcatgattttcttttttcatattgctaattagaatcgaagttaaatttaaagagcaattagtcaatatgatggagcaatttaacatcatttgcaaccttcccagaagcccgttcattgttaaggtaacgtggcatagacctcttctttcttggggtgaagtgtaactcggatgggagctctcatggaaatcctggtcaagctgcaggtgatggaattttcagagattacaacggtattgttcttgatagttttgctacctactttgctggtcaaacattcctttatagtgaactttttggtgcaattatgtccatagaaatagccatatctaaggcatgcaagaagttttgagtggagtgtgacttcctcttaaccgcta

SEQ ID NO: 4454 - DNA, 1366 bp, Glycine max
  Soy_ogl_760 Gm02:50421301..50422666 Cluster 18
ttgctagcttaagatcttttcaaaggaatatattttggttttgcaagttaagcttggttgctgtggtactttctaatatcttagtaaatttagctacaaatatatattattttagttcaaaaccactacggttaattaatcacctagaaccacaacttgataaaaaattataaacaaaatcttctagctttcttttgtcctctatgaatttcatctttttttgtctactataccatacgaaagttaaaaggagagaacttttgaggtccaaatccaataagtgataatataatatataaatgtttatttatacatattactatttctgttcagctcttttatatatatatatatcagatcatataacctattatatttatacttgtactttcctctctatttctctttagatgtcatttaagactttggttactataaatattttttcaaatccaataatagcttgtgtacttttctctcagaaaagaaaagaaaaaagcttgtgtgcttttcttgcgtactagtagctctgagaatttatcatataaatacattaaatcggtcctttaaaatatgtatacgtggcatattaatttaatatatagtttttttagaggaattaatatatagtttattcttttaatatcacatagttatgatcaatttctttttaagtggttataatttgtgtacgtggagtattctcttttttctttattacatcccacgacttttttttagttgtagaacaattgcttttcttataggaatcgataaaagaaaatactaataacaacgcatttttagtagtagatcaattgtttttctttttagtcaaaactatatggaaaaattattttcatatttttctcttgataaaatttaaataggtggaacccaattaaaattcatgaatatttattgtcagatatatgataatattatatgaaatttaaatttaacacgagaatcaatctattaactccccagccacacacattttatgctgttctgtttataatagcaaatggaatcccatgaagagatctttcttgggccttgtgaatcaaacctcagaacaaagaacatggcccaacacccccttatttgatcttcgcatccccaccttttttcatcattgttttatcataattttcaccattgttttatcatggagactgtcatctcgattatcaaggttaaagaacatccaatcttattcaaaatgaacaatttatgacttcatatgatcaatgttaaaaccatccaatcctatccaaaatggacaatttatgacatcagtcttttagtagtcataccgccaagtgagccaaacgaccatcagggtagttttttttttttttct

SEQ ID NO: 4455 - DNA, 1200 bp, Glycine max
  Soy_ogl_1069 Gm03:43286601..43287800 Cluster 18
tattgatttagtaataattttagggatgatataagtacattaattaatttagtatgagaaaatttagaatacattcgtgattgattttagtaatttcataattaactagttaaagcatctacaagaccacaacgcagttgcttgtgtaagtcacctaaaaaaataagtttgacgtaatatttttgtacaaacatgtttgcttaacttttttttttttgatcgatttttcaagtcaacaattagcaaaaaaacatgagagttaactattcactttagtaatcttaatgtttggactggatttttatgtggggttttttaatctatttttatgtggtctaaacaatctatttagattaagttgtttatcttatattaattgacctttataatattacatcataattaaataattcatatatattttactaatagtatgattttaagttactgttgaattactccccttaaatggtaagaaaatattattttcacccataaataatcgttacttatataaacatccgaaatttaatattgaataatttaatatgatacgcaaatcatcttcaatagtaaaaaaaaaataaacaaagatgtctaaaattaaaaaactcgttaaacaatgagcgttaaaatgctctaattcattcaagtaatcccactgacattctaaaataaactcattcaggataatagaatcaagattgcagcagaacaatcgaagtgaaccgaacagtaaaaaaaaacttctttacacaaattccacccagtaccgttgactaaaaaaaacatgtagtgactgtcagggtgcttcaagggataaaaagacccacaaagtgaacaaaaggatgctgacaaaagctgggttcgtgcgtgtggttttgaagacgaagaaggttcaccactgtggggctaataatagtactatagtacttagttgcttggagtattgatggagatcacaattaatgcttctgttgcgtggagctttgctgtcttgaaatgttggtcagcggtaatgaaactaagtggatattgacaaaaaaataacaattgtctaatatatattttatgtagtagatgatgtatttttttttcttgaactagagatcatttttatttattagagattacagtattttctagctcattaggactaatttcgttgacagtgtgtaattgttattcatcaattgtttt

SEQ ID NO: 4456 - DNA, 1200 bp, Glycine max
  Soy_ogl_1490 Gm04:48514401..48515600 Cluster 18
taaatttagtttattactagtatatttttgttttgggtccaaaatcctattatattgtttgaccttgatatggaaaaagttctagtattaccatgtgcagaaaaagtcttactgcaataaaattttgctaaactaagataaattatatattagttaaataattaaaaaaatacttcttaatattattaatatatttgcacaataattctaatgtattggcatcgtaatttttaatagaattctatattattaatttattaattagtacccttaaaataccgggacattgattagcatactcgatcttgaactactactgattaggtctgtaaacttttattcacttatcaaccaatgacataacataattagtgagccttccaaaagaaaaaaaaaataacaacataactatagtgaagttaacaagatatatgacatggcaaattggcaactaagccaacatctacagtgactgaaaaagaggaaactatttataaaaatggcaattcttaaagtctgaaaagttaccgcgaacacccaaatttgccttcagcaaaggtgggaagtggaaagggcagagatgaaagcattcggttttggattttcatgactaattaaagaaatgatagataagttaatactacttgaactatttatttaattaattcttaaaataagtgacatcgctcatagtcacatatatatagcccagaataaaagattgtttgcgcaaaaaactcttcatccaatataacgtgtctgcgtgcaaacatgtaatatacactagttaaggaaatactagtatgatcgaatattgttcttcgttatctctctccttttatgaagcatgtgacagacagaagacacaaggagatgaccagtagatgcacttgcttcctctatcatcaaataatttttatctgataatattttgcaggttactttttaattacactactttttttactaaataaataacacataaacattcaaacgtacttttttaaaataagaaaaaacttctcaaattaaaacactaagaaataatgcaacattgtatatttgtaagtgataaaagacattcagacataaccctttatctatactttaggaaaagaaataaaggggaggggaaagtatacttaaattgaagaaaaaaaagggaaagcagcattggatggagaatttgtggagtatcca

SEQ ID NO: 4457 - DNA, 1430 bp, Glycine max
  Soy_ogl_2121 Gm07:1828571..1830000 Cluster 18
aaatttttaagttctaactttgttgtgttattgtaaaaaaaaaaaattataagtataacataatttataaataaaaacctctccaatacatttaacataagtctctgtattggattaaacgaatcgtcgtaaataagacgagtaatcttaaataagattactgccatgcatgaaacatcgcattcgcatacagaatctgacaataattgaaccctaaatttcattattatgtacgtatatctggcaatataattatttttgtgacaacataaacttaaacaaaaagacacaaatctttgaattaaataataaattaatatgataattaagtagtctttgaactaccgtttggaattctttcgcttgcagcgttattccccattttcataacttggtttccatcaattacaaaatacacctatagatcatcgaaaaataatgcactatctacacattgcaccttctcttcatttatgtgatttttattttcacatgcgtcaattctctttagtctcttcaaaagtatgcgaaatgtcaggatctaaaacttataagcatttttaataatatgaaaacatttaattatacttttagtccttctgatttagactgttaaagaatgcagtccttcaagttttttcagactaattaaatcaagtccttccatttttaaaatcaagcaaatttcgtttccattattttctttttaaaaatctcaaattattattattatccgaatatttaaaatttatgatgggattgagatatatgtaattacgagtctgatttagactgttaaagtggggagagagaacttgttggagaggatcctaactagaaatattttagaattttagtttgcacatatttttgtgatggaagactttttagcaaagtaataattataattataatacagaagtgatgtaatgtgcaaccatcacaatttaaagacttgccatattttctccattttgtagactggtcaagcgaaatctgcctataatgtcatgcaatgtgggggcttggatctaccatcaccatggatcagtgatatttgtcattgtttgtatacaacaagaaaagggaggtgggaacggaatcatagtcttttgttaagtgggaaaggcgaaatatgctgcatgggttggtgtatgaacgaaattcgaggtcttagtattagagtaattgagtaaatatggcccaaaatcaacaaccccaacccaatgaaaggaattctttccgtccaatgtccaacattcaccttacatttacattgaatgtcgaatgcaatagtgtataaacagtatgggaaagtttgttttcaaaaggtttggtgagtagtatttttctgccttttgactttaaagttaaaaactatgtcaacaacatcaaactaaagctctgctgtgctgattcaagcatgaagt

SEQ ID NO: 4458 - DNA, 1372 bp, Glycine max
  Soy_ogl_3623 Gm10:48542629..48544000 Cluster 18
attctactcaaattgacaatatatacaatatgattggattaattcttttaataatgcttttctcatataagtaccagtttcttattagttgtaatgatttagtttaataataataatacacgtgatttgaatttgaaatctagccagaactaattaacgatgtacaactagaactaattacgtagcacatattaaagaaatggaaattatttttattaaccatggcaacattatttccacagttaatattttctgagatatatatcgaaatttaatatttgttaatgtatagattatataaaaatttatcgtataatttgaggttttataataattgtttttagtattatattggaatctttggaataattaaattttaatattatattggagtcattgtgatctatcgcttgattgtttacaagcaaccacagtttgcattaaaaaaaaaaaaaaagctgcacattatctgatattgtttgactaaaatactttattctcgaaataatatcacaatcgcttggattgattttaaaggaattgaaacatttaatttttcgaatataaattaattatagataggagattgaaaagataaaattaattatatggtttaaaggtgtttcgatttttattgaactaaaattattttagatgaatgaatcatcggcttcaaactaatttctcgatgcaccgacatagtgcttgatgatttaatttgcgcatatccaccaactgtgaatgaatgataaataaaaaggggtccgaggaggaggggaagattccgagtatctgcatatgtctatttcttagtgtttattttttgtcaaagtctatttcttgtgtaagtgtacgtgggtggccttatgatcccgatatgtttcagtagagtgcatgtaaatccaatagataatccttccaaattatgttagagatttgtacttgaaatcatcatccttagctaataactaaaacaaacttagacccaaaaatgtggaatgaactcacaacctatatgcagtgcctttgtggcaaatggattcctttttgtaccaagaatcttgttaaagaagaaaaacaaaatggtcgtagctacttcatacactctttgtgcacgtatccgttgaatttgtaatgtgttttcaaccatacaattttgtatttagaaacattaaataatatgtagtctaattgttacgtaatcaattgaatattaaaatacagtactctttagcggtgggactcctttcaaaggccaaggccgcaccgttttccttttttcttttttttttaaagagaagaatacaaaacaaaagggaaaacacaaataaaggagcataaggttccatttttgtgaacattttatatcaat

SEQ ID NO: 4459 - DNA, 1900 bp, Glycine max
  Soy_ogl_3667 Gm11:487601..489500 Cluster 18
ttacttactataatcaacttctcttttgtaatagcttctggaattggtttagagaattgtgaggacgagcctgactgattatgactgtaaaggaaaaaaagtgacaagggtttactattttgtctgttcctattttgttttttagaatttctatttataatctatgaaactttttttgcaagtcaatgccccttttcttttttttctattcttacctttagtcttttttaagagactaaagtcagtaaaaaaaattgaaaaagtttaataactaaaaaagtaataaactcaaataaaaaaattgtaaaaaatagcaagaggtagagttggcaatgtgagtctagctttatgggtcggtccaaagaatttgtaattaaaactagagtgagctcaattaaaaaatgtagctctgaaaaaattcatgcccaaattgatgggcttattgatccagtaaaattttggcccaaaaacaactgagcctatttggtgcaaaatgatgcagcattaatggtgacattttatttatttcaaaagttattcatataactaatatatatacacaaacacacaaagctgcatgcgtagatcagatcatgcagagaactaaagtggcgccgcgtcatttttccactcccagtctcgatcgatcagctatcctaagagtgaaggcaggacaattaattaatatcaaacattgccttatttacaatcttaacgtagaaaattacaaaatatatatatatgtccagaaacttaattagcaccttctcatcgatctttaaattttcaaatagtgaaaatgaaagatggaagcacgtaaattaatcaatattagtcatgtgatgaataataataaaagaagaaattaattaagaaactggtgtagcatatgatcgccttcctcctcccattctcatcatcatctgcatgcatgcataggttaattatcatgtacgtaaaaatgggaaaggtacctctgcccctgaaacccatttcttttcttcttgtagaatatatcaaaacaaagacacaaatgatgctattgtacgtcataatctcctccatggaatctatttatatatagagagagtaggtgtttgactttgaatccttcaagctcgatgatttgattgccatttgccaatccaagaaccaaccatccatgatccatatacgtcgagaaactttcttgctataaatggaaaatgaacaataacaagttacattttttattgtgtgaacaacaagttacaattcattagtgtgtaatttaatttcctatctttgtaactcgactttattgaaatatttttttaataaagaaatcattttaattaattctttaagtggaatagaatattgattaacattttcattaagaaaaaaagatacgtaaaggatccagctttaagaaagaagattaaaaacgtaaaaaaaaaaaactgttcaataaacaaatgtttctattatactaagaacttccgtggtaacctctatttagtaaacaaaagtaaatgttaatactagagtacagaggaaaatgtcagaattcaggaaaaaaaaaagaatatcacaattaatatatatggttacatccatagtacaatgagacagctctcctgtatatattatgaatgaactttgaagcatgaaacctaaatgaatagtcgtttctttttcttcatgtcacattgtcacgttgctataatgaactttctcagatagcctgattccttttcttattcattgtagaatccaatagttttctctttgacagtaaaaagtacaagtatttaatttgtcccttctttgtttacaaaacgttgcactttgagctatgtaaaggaacattcaattgtatttttattaagagtaatacgacagtatatgggatgctgtg

SEQ ID NO: 4460 - DNA, 1600 bp, Glycine max
  Soy_ogl_4858 Gm15:1585601..1587200 Cluster 18
atcttcgtcttctttaacgcaattcgtgtcgtactaaccactgccattcatcactacttgtgtccatgccaccatctttaagaaacgtatccatcataagttatctaagatgcaagaaatgaaagagcataaccattatcgaaataatgggatgttaaacagaagccacgataaacaaaagatgtggggaataaaaacagaggaaaaaaataattaaagaccaagtggtagttttcactttcaacgatagtggaccactttaagcaaaaaccacctcacaatctctgcaattgccttgaggaggatacatcagaagtggttaattcctaatggcacctgaagcccaaaatgggacatctagtatacctcaagaaaaagcactgagaggttaagttggtatatcagatattttttttgtcctatgaaatggcatggtgttgctctctagcaattaacattcatatcaacactggtcaatatttttaattataagcacttggaagaagttttaattgaaatgtttgcgttaatgattacaaaaacaacattctattattaagattttataaaaatataatcgccatggaatctaaaattagtcatttttgtccacaaaatcataaaaaagaaagaattaaataaaaataacgaggtaatctagtatgtattaattaaaacagattaattgaaaataaaaaatcaaacaaactctagtttgttaatcaaggcaatggatgacataatgtgatatgtttaattaatagataaagaggtcttttaaatatgtattcagagttcaatctttgagtccatgtgtagaggtgacaaaataggtcatcctgccaaccaatatgttagtctaacttgttctagctggtccatttttctattgtctaaatttacataaattttgtttataaggaaaaaattatggactaaataggcttgatagatttcgggcctacatgtcatcagtttgacctagtctgaagcccatcgaccaagtcaatttaacttgattcttttgagtctaaaatttaagactctaacctaaccttatctgtgagttatttgggttggaccaaatatattgctttctccacatgtatacgaagaatatctactaagaaagatcaaactctaaaatgaattttagtatctccaatgactaggtaatgctcgggtaaaagatacctgactttgtaaaaaaaaattcaacaaggataacgcattttattttcagggaaagaaaataattatagtattatttatgataaacaaaacagacacaatagaaattaggtagtgttacatggttgctttggggtctcacaataccaccttttttcggttgtggagcagagtcacagcagaaccggcaagtggaagcaaacaaacacaaaaatccatgaggaaacttgcggatatagcaagttttggattagattacccagatgagattctaaccaattctccaaatcccaatcaagaaactcactagtctcagatacatgtcatatgtcgtaaagtccagctaataagaaattaaagagcacagtaaacttgaaagaattggtcaagtaaaagtgtaaaacaaggt

SEQ ID NO: 4461 - DNA, 1293 bp, Glycine max
  Soy_ogl_6629 Gm19:49747108..493400 Cluster 18
tccttcaaggtatccaactaatcaacagcagagctttaaattaatgttcattatttgttcccttttgcatttctggcaaccattatttgctgtaaggtatggggcgtatggcattcgggtcatagttttcagagcaatgacaataaactttttttttccaaaatcttctgacatgggtggatatgaactttagaagtaaaaaaatttcacactgtaaaagctttaattggttactttaacttgtagccacaatagtttatgcatgattcatgaataaaaattgtgtgaaatggcgtaactcgaattaatatcccgttaatctaatgagttgcaaattattttcataggaagactaatttctttcgcagatttttttaagcacaagatttaaattccaaaccttatttatagaaaagcaaatatatacgacttgaatcaattattcattaattatgatacctgtggctgaatatagtgcaatcttattgaaattgacataatacttgctattcgattaaaaaaaatcttttagtatattttaaagaaaacacatttttaagaatttgttaaaaacgcttttgaaaaaaaataagtaattagtttcttaaatcaatacttacccaaacatccttaaaatgtatatagcatgcatatttagttttaaaaaattaaactgcaaaattatctttatgtattcaaatttttatgtaatgcgtaattatttttgtcattttgcggtcaaaatatttaatagaataccggaagaagtacgtaagctaaaaaaatatattaaaagaatacaaattacactttcaatctaatttttattgtttcaacaaatgatatatttaatctgttttttttagtttgatttttattcattttgattttttatgttttaaaaatgactaaaatggtcattctatttgttttgaatcaacatagttaataattttaaaaaattaacgattaataaccgtcacaaaatatatctcttttttccctttcattttccttctcttcttctgttcatcatctcgattcttcactagacaacacactgccaacaaaagttccataagcttctgtgcatcggatctgagcatatcgacctcgccaacaatcctttctttgtggcggtgctccagcccatcatcctaaactttgtcccgttgatctagatctgatttatatataaaatttgggagtttatcctcatgatctgtattgtctggtgaagaaccggaaggagaaaggagaaggaaaaagaagagttgggagattaagggggaa

SEQ ID NO: 4462 - DNA, 1300 bp, Glycine max
  Soy_ogl_405 Gm02:5601101..5602400 Cluster 18
ttaaaatgtaaaatttgttgaattgtctaataaaaatttattttcccaaaatagtaacataattgcatcttaagtcacctaaaaaatatttttctacgtaatatttacttaatctataattctatactaaatcaaaatattattatacatcattcatcaaccatttaatcatataaaaaatacttaaattttaagtttttttttacttagtttatattcattatttgttggtgttataaatttttatattaaatataaaaagtccttgagcccaggaataaaactcatttaacctatgcattaagaagattggactaaaaaaactcacaatttaaacatctcaaaatatctaagggttatatatcatgcaaggtaggatttcacgggctgtccgtgagcccaccgtttctaagcaagacaacccattatatcaaaaggaattagatgttcttaaattgcatagttaacataacatctacgactatgcactaggttgtgagtagatttgtatcagctaactggggtatttttgggtcttattttttatttattttgtggggtggtggcttaatttgttaattttgttgatcgttttccatgtaaatatgtaataaatatttgaattactaaagaagaaaaacaaacaaaaattcgatgttgtcacttgtcggcaggcccatccaatcgctacactttcaaacttgtgcagtttattcttctgctattgttcttctgttaccaccaattactttttttcctcattgatgcagtaatacttctacattttttccacattaaatattctacttgtcggtcttactgccagagctcttctgtctttctagattgttatatttttcaattttcatgcagaatagtatcatatagtacagattgtctatttttataatgcagaagaactgttttggatcggtcattgaattgaagcaaccatttacacaacaagtataattttaactagctagttagtagacctacactaaagataaaaactgattgttagtttagacaaaatattattattattgtgataataataatttcttttgaattacttatcatattcaatttttttttcatatttcatgaataggcttaaaatatttttccttggtccaataattaagatacagacagatgccagttgtctacgatgacaaatatattcaggggtatttttttatattatcaaatatttagaaattacataaggtacaaatcaattatttgaggataatacttaattaatagtatttgacaatttgttaaagggagtaag

SEQ ID NO: 4463 - DNA, 1058 bp, Glycine max
  Soy_ogl_4522 Gm13:37627543..37628600 Cluster 18
tcttttgcactagtagtctattataataataaaaaattgagatgatgcaacttcttgagatctcatataaatttcttgattttttttatttaaccactttaacaaattttacacatgtttattttatctgagagatgtctatatttaatttctcgctatacttcaaagttcgaacaacattgtctcaaaaaggaggatatatacatgtaaaagaaaaatagtactagcatatactgatccccacgtatatacttataaataggttgcaagaaatgaacaattattgaaaattgggtcaatggtccatcactaccagaccccagtatagttaaggattggggtccaacgaaattccgtgctttgaattccatcacaatctcctcttatgtgatgtttaattcaccctcatcaattttttcttttcaaactaaacattgtttaagaatatcaggatgtgatcaaataatcccagtgttagttagataaactcttaattccaaaatcaaatttgtaattaaaattaatgctttctacatgtagctagatttttagtgagcattgtgaataaaagtctttgtattttagaagaaaatataacttatcagagttagtctctagtaacgaaaagttgaagtaatttacataagattctcagtttaaatctcattcttacaataattttttttaaaatctcatgcattctcgttattatacacgccaagaaaaatgataaaagtatataatctcaccccaaaacgacaattgtccatgttatgggtttaaaattgaagagaggcatgagttggtagggatcacccacgtgataattaaatgccacaacgtgaatcaaatgtaatcttaatctaggataggaccgtcacattggatggccatgggattgtttcagatcaatttcttcgtgacaaacaaagacaagacgaaaaaggtagggaacgagctatggtagctagacagcaactgccacccaaactttctatggtttttgtttttcagttcggcagttcccattactaagccattttaattttttaaaattt

SEQ ID NO: 4464 - DNA, 1300 bp, Glycine max
  Soy_ogl_4556 Gm13:38767301..38768600 Cluster 18
acacaaaaggataagtcaataaacagattaactctctcacagtattatgaatgatgtgtcccttcttttctagaaaattaatccacacaagggataactgattttgcttcaaagcgataataatagtttcatgcatgacacgatttttgcgtccgcttttgtggaagatgctttccgtgtttgaaatctctccaacagaaaatttagaggaaattaattagtacttgtaaagctttttaatttcaaccctgtaaagatggagtttctgtatagtgcgtaaggaacaaatccacctttatgtctcatcaaaatatgaaagtaataactcaatttgtatgagaagtagaagataccgtatacaatgtaatatgggttgtaaatacggagttatgggcacaaatgtgccgtaacaaatgtctatcatatctaaaaggagttgaattaatgcgggcaaggtagagttcgtttcccacggaagcaaattttttgtggatctcttttacagatgtgggcacgtaaggacaaagacactttttttatcgccgaagaacgtcaaaaagatcgacattcaaatgatatctccacagtgttttggcatggtgaatggtgataaacttggctagttatagcgattccattgttcaaacactttgtggaagaaagaatagaagtgataagccgaaagatgatcaatagtggtcccgtgaatagattgattaaaacacgatggaattcatgtgtgctttagttagtttgtccaattatagtaactaacatgctttttaattcaaaaagtattttaaaaataaacaaaatggaaatagaataattttggacaaaatatatgaactaaaatatatatcttgtttaaagactgagttttggaacaagggaaatagtttgtttgaatgtttattatgttgaatactactatgtttaaagactacgttttttgtttggtaatctttattttttttttaatttttcaataggtgcctttgacatttattagcaatacccttttgattgataagaggtcaatagatatttatttttggggaagttctttaaattaattgtctcaagagtagataagtgaaggtgtatttattgttgatctaaccttttttttaaaaggcaaaagtattgtattattgtattatgtatattaagtagatctttacaaggtgtacgaccacattaatacattcacaaaaagagttagcctatccactatacataggaattgcttaagggtctcaaaacaagtctcctatcagattttaactttctgaattaa

SEQ ID NO: 4465 - DNA, 1186 bp, Glycine max
  Soy_ogl_5548 Gm17:6445919..6447104 Cluster 18
gttaagggaaaaattgtctttctacttaatttccctgtaacatttaattaaagtaagcattactttatacaagttgagatacatattttgatcaatgtgcacccatgttcccccagtcatacatagatataggtttggaaaaggaggttttcagatgtacagaagtagtagtaatcttgaaagtttgcatgaaagtgtagacaatatacacctattggaggtaattaaagtaaaaggaaaaacatatttggcgcaaactctttcttcagttgagctgattatttaaatataaatatttatggataaaaaaatatataaactcttgaagagtttctccttagtcaatgagggactttgttcccatatagaagcttcaaaaacacctactaattaaattcaccaaaaataaaacccctgctaaatgctaaatcctttaaataaggaggcttttgaaaaatacgttaagaataatatccgtttaattaagaacttaaaaaattaatttttcaaactcaaaagtatatttttctctcttacatcgaaactctagctagccagtataaatttcgaagaagcaattttcatctaattactataggctctcatgtgtatttataaaaatgtgattcaccaacgtctgtgattgatatatctaagtaataaagagcttgattctgtttaattagataaagtcttagagtttaattcttgcgtgaatagttaaaatatgtgctggaagttctactcctttgaataggctcattagctagtttcaattcagattaatttgttgaactcttgtgaataacaagggatgacatgatctatatttttttttccataaaaattaaatataatatcagagaatacatttatatattttgtttaatcaattaagttagacctaactaatactttattagctatataaaagttgaggagttattattctaggtaatgtctgtttttttaaaaataattattaaatgttaatcacttggttgtttattacttttgtacaaaacaatggatatcttctttttttgagaaaaaacaacaacaatgaatatctaagtaactaaataaaatttaaagaaatagctttttaatgtttattaagtaacaagatatagttttcgcaattccatttcaatgcagattaattaattctttgttttccatttgt

SEQ ID NO: 4466 - DNA, 1100 bp, Glycine max
  Soy_ogl_675 Gm02:45336801..45337900 Cluster 18
attttactaacttttttttagtgattttgtttttcttataaaaaaattgatcatctaagtaatatctgatgctaatggtttgtttggaattggtgaaaaaacagaagaaaaaaaagcatggatgacagtacatcctttggttgaagtagaaagaaaaataaaattaactagcttctataaaaaaaaaattaaactttcgtttacttttctttcaatttagattttaaacttttctctagttcctcatttcctttcccctggaccaaatataggattaaggattaaggatcaattaagtatttacttactcttacacggagctgcaaagagtacaatgaatgcatgatataaataatgcaaggtgcgatctttcaatcattattacgtgttgcaattagtttcccaaatgcttccttcttgtttaagaatattcctcagaagaaagtacgttattctcgaggatagaatcagaaggtggcaagctctggaatcattgtcctcccataatttaaaaattccatagtcatatataaatatttataaatttaattaggatgtagttacaatatagagatttttaagatttagtacacatatttagtttaacttttcatttttttttcttctaaaaatgaaactgttgaaaacgtgcttgctttaaccacactttgaataaaaaagttcatacaaaataattaaataaattaatataaaatgatacattctatatatgcttattattaacataataaagacaaatatcatagtgccaaaaattaacataataaagacaaatataaattagatattaaacataattatcattgtgccattttagagtttgatgacggtatcgatcctttgatataagctacatgtttttgttgctttcagaataggataacctaggagtgtcaggccacaataatcttcaaaatcatctaggtttccttcagcttattatgaagtggcaatctcaataaataaggtttggataacttacgaatgctagccacaatattgattcaaatctagtgaggtcgtcttcaacacattggcaagtagagctagcaataaataaattgaaatatctcaaaatt

SEQ ID NO: 4467 - DNA, 1200 bp, Glycine max
  Soy_ogl_263 Gm01:51255901..51257100 Cluster 18
tgctatcatgtgcatgcatccaatgctacaaagagacgtcaagaaaaataacaaaaggaaaatatcaagtgccggctttttcttagcattggcggtggcaaaaataaataataatcccttttctattttgaaagcaatttctaggattcgcctatctttttgggtactacttggacaaatctaccagttacgcggtcaattctttgtaagcatgatagtgtactactactaaagtccatagattaagccctgataataatttaagcatttttttatactgtttcttaattaaaattaaaattttactttattgtaaagataattgaaacaaactatattttttaattaaaagtaatttaaaaatgcctaatttagtttatgtaagttttgtatttattagcttgtggaaacttttgagataaaaaaaaaaataggcccacgtgactgcaccaaccccgtcctctagagtatgcgactttgtgatagttatggttgaggtagagtcgttgaggttactatactccctaacctccaaatccaaatacattgtcaccttttaggatgaaccatcacattaataacgagggtgcgtgatggtaacttctcaccgatgcttttaaatcggtgatgttctgggaaacagttccagaggcagctagcatgtgaacttaactaagcctttgtttctttttttttttagttataatttgggtaatttagttataaatgctttatttcttttacggtagtaagttatattgaggaaattacatttttctctcttaaaatatatgtaaattatattttattttattttaaatatatacttttatttttttaaacatcgatatgtgttatatttaaatctagtttaatgttttttagcacaatatgaaaagtaaggcaaaagcaaaaactaaggaacataatgtgtcacacacaagattttcaaaacactatcgagtgatacaaacaaccttgtgatatcatgtggttacgagagctctacgtatccagctgccaagataccagcaaccctattagttttgtgtgcggtatgaatgaaagactgaaagttacgttgtgtttagtacagcagaaataaaaggaggaaaactgaagaagagatcagaaatttcaaattgtttggtactatagaaatagagagtgagatgaaaaaagtgcagtctcatcttattt

SEQ ID NO: 4468 - DNA, 1411 bp, Glycine max
  Soy_ogl_1767 Gm06:2657101..2658511 Cluster 18
ctaatgagataatttgttatgagtggacatctcactatctcaattctcagcggacagacccatttttttctgtttgtgtagcacatgtttatgttttgtttgtctgaataatgctaattaagagaagccatcatcttttggtcgtggacctcttatacaatgtattgcacattcacttgcgttaagggtgagaatgccacagggcacagggtacatgacaagagtgtctaccaaaaaaaaaactaaggcgtgacagtattaaagatttaaagtcttcatctaaggccaggagggcgtattcacaaaaataaaatataattacaaatattgattaaaaataatagttaatataataaattacaagtttgatatataatttggaatgaatcacactgaagaaagtacaactcgttcattaaaaagcttgtttatattaaaaataggttaaagtaaagctaatcgtttactactccaaactgcttactttgtttgccttcgctgtttcattttccttctgttaaaattaatttggactctttctcgttagaatgattactatcttgggttttaagttggttgctcataagacataaagattaagataaataaaatcttcacgaaaagttataccatttattctaaattttaacaaaatgttcaatatttttttataattcaattttattaacgagtattttaaagatacttattaaataatatatggttaaatatttttaattattcaacttttattttcttatatactagttttaaaagacatatttaaaagtacttatattgatgtttcttttttcgtgttatgtatttttttttctcttaataaaattactactcatatattttctttgcataacaggttaggaagtacatataaaaaaaaaaaactcaagcatccgaacacgcccgaactattccatgtgcaaaatgtgataacatttcatgaatatctttttttttttttttacggaaatgaatattatgttaaaataagatgagacgcacattaaaatgaaaatgattattgacgaataagttgggcatttgtaggtctgacattttgtaagcggtttttcaagtggagccgttaacagtggcctctcaacaaaaagccttaattcaatcattctttagtgaatttatcataattacttaattaatacttaatcctttatgatttatgaaaatgaatgcctaaggaagattcggttgctgggatatagttatcgggtgagctagggtgtgatagttcaacatataccgtgtcgtaagaagaaaacaaaaatggcttgaccacgaaccatgaacaacattcaatgtgtgttgcttagataaatacaaagaaagccgtaagaacaacgtttgctgcgatgaagaaacacagcgaatacga

SEQ ID NO: 4469 - DNA, 1100 bp, Glycine max
  Soy_ogl_4160 Gm12:38745801..38746900 Cluster 18
ttaattttgaacagtagctcttgccaaattgcgaatgagagtggaagacatgtgattagcaccatcaaaggatgaatgaatcagccacaaaatttcaaatgttttgcaccgaagcagttgagaattcctttaccgatgaatgtagaacatgtttgatttactatttaacttgttcacagatttcgaaactaaattcaacgatttaacagaaattgaatggaaaaggaaggtgtagatgtttttgcaaaaattcttttgctactaacatgcggttgcaacagtaaattaaaaatgaacgtatatatgttaatttcaagggaagaaaattgagttgtttaaatccttcgacgaagatatggtagatgatagtggttgtaaagttatttacattgatatctgatagtgattgaagctatttagaaattagaataaatatgaaagtatgcataagatgaaattgtactaatgtggaattataaagggttaattttttatatatattttaaatatagaattatatactatcaactgattaaattatattatatgtgactctttaaaataattaattcaaaatttaataaattttatcatacattataataattttattagatgagaatacaaaaaaatatatcattttaattaaattctaattataaaggagtaccacataaaaatgtagtcagtctataaggacttacaaattgatgcaaccagtcttgtaaaataattaatattttccatttcataaacaagaatactaaaaatagattattcttttcaaaatattcatcgaacaagataatttgaacatcaccatgttttgattgtaataaagaaatatggacctaagaatttaaaggtatagttggccaagaaaaaaaaaagaagatataaacgcatgagaagtgtgcaggcgcacgcgcatgaaaaggagagtatatgtaagattctgaaacaagcatagggacccatttgcgaaggactgtgccgtatactatgtttcccgcggatatcatagaaacctgcggacatgtgacgcgtggcagagaaaacgattgattgaatttgccaaaatattaccactatcaaaacta

SEQ ID NO: 4470 - DNA, 1000 bp, Glycine max
  Soy_ogl_278 Gm01:52089501..52090500 Cluster 18
tgtaataaggctgtaagaaagagttgcttatgtgttcaaaattgtagggggggactttttgtttcttaattctataaggttttaaatattacatatttgttataaacaaaagttacatatctaaatgagttagtttccggattatttttcaacgtggatacagatgggtctagtgcgatcgagacaatttttttccagcccagtgtacaaggacgacagaaaaataaaaaaatataagagcccatcttccgagcaaagacaaaacaaactcagcttgcttgcaggaccaattccaatgaaaaaaaaagcatatatacgcataatctcagctaacacaaggcaattattatttatacctccctcatttcataatatacctccctcttttcataaaaaatatgattaaaatagataccaaatataattataaattgaggttggttgcatgtgaaatcaatgagtgacaattttgtaacctttaggcctttttttttaaaaaaaaaattatctttattgtaagcatattctctattatatgttctttgatcgttttgaaaaatacattattttgaatatttctataaaaaaaaaattgatgcttattaatatttattgaatgagttgaaatgtttatttacaagaacactcaccagtgtccctttgccattagagaccaataaattaaaagtctcactgttccgaagaaatacaagccttgttactcttgatccttatccaaattattaggtgatgacacgcgatgattttatgccttacagataattcatcatgtccatccacgtgaatgtgacggacttgcggggtctaatcgatttcaagaaaaacctcgtgcttcatgctattcctcaaacatcataggaccggggctaccgagccaaaagcaaaagaggttgctaaagtaatcccttgaaaatctatctcttttttgctataagtttcatctttgttaatttttcacttttttattttattttgcatc

SEQ ID NO: 4471 - DNA, 1127 bp, Glycine max
  Soy_ogl_1412 Gm04:45147301..45148427 Cluster 18
cttagagattgaacaacttattctcaatcttgaagtgatccaacttgttttgtctccctcttcctctttcaagctcctttgtcaatgggaagaatacctaaaaatagactctcatgttaaaaataatttatgccttttgtgaatatagtgagtatgaaatgttacttacctgcatcctcgttggtcagaatctatgttgttctttctaagacctcagcaaacatcatttattacttttaggaataataaatgtttctacaaactaacacgaaacttttcaacatattttgttttcactcacattttataggaaacttttcaaaagattgtttatctaataactacaccaagtcaaacatgctttatgaaattcttaagtgataaactatcgaaaaataaatgtattatgttagtataaatagtatcaatcaattctcttaattcatcctcaattatacaattttatacttataacctcaagatccctttcaattcgatgtgatttgttggggtgttacaataaccgttccatgattctttgagaccacaacttgataagagaggtcaatcaacgattatgctaatagtgatcatgtgtcaccaatatctcatccatattgtgatctatgccgtacacaactcatagtaaattttgaagccaacacttgatccatcaaacgaaatagaactaattatattcacgatgagtaccaatgacaacaccaacaaaaaaaacatttgaagctcttgatagatcactcaaagatatattgcttatatatgtccaaacaaaacaactcaaccatttggaggaaaaataattcttttgggaggagatttttgtcaaatatatattgcctataataccaaaaggtcaaagacaagatattcatgggatcattgcaaaatcttcatgctgttctaaagcatcaaagttggtgaaagccaacgttcaagtaaactaaactctttggcatgccaacttaataaacggttcctccaaatggatgatgaaaaaatatatacatgttacttgcacctgaaagtaggaatgtctattatgtaatcgaggaaatgtctattatgtaattgaggaacattaagaatggggtgtacagtgaagtata

SEQ ID NO: 4472 - DNA, 1000 bp, Glycine max
  Soy_ogl_5521 Gm17:5192301..5193300 Cluster 18
attaatttttttaggcatatagtacccttttggtaaatatacgtctctctgagcccctttatgattcaaagtaattaagctcactagtttttctccctttaatatatatccgttgaaattcagtcttatcaaactgcgtatagctacttagctaggttaagaaagtgaaatgatgataccgtaagaagaatctatacagcatgccaactaaatatatattatttgaccctacatacgaacttatataggatggaaggcttatcgtaaaaatttggattgatggcgtgttcaatttctatccacgaccatgcacgtatagatgagactagaaattggaacatccatctatgtaaaaaaaatagagataattgatggtgatgtttttttaatccataaatattagttaattaattttactaaaaatatcagttaaaaaatttaaatctataacttttttccgacttttttcttttttcatatttctctaactaccgtactaaaacaaggattctatttactagtgttatttgatttgatccctcgtattacatccacgcgcggtccgtaccatctttttacgtccattatgaaccaaagtgtctcagcattaacccactatcatctcttaaatttattcataatcatatgcgacaaagatgaaaaattgaaaactactctgaaaggaaatttgctggctacagctttacaatgatttgttggcgtccctctccacttttttctaagtttcaatcaaaagtgaaatgagtaaatattagcagtaactgttgaaaggatagggcaactagtccacacactaacaacgccgccaccaatctatatatagggaaacaatgaatgctctaatgtctcaatcttaacctactaaacctaattatttaagcttttctgagttttttcggttacgagattccaacatttatatgattattgtcggattggacgtgactaacgaattgcattgcaaatgggttttcatttt

SEQ ID NO: 4473 - DNA, 1900 bp, Glycine max
  Soy_ogl_284 Gm01:52159401..52161300 Cluster 18
tatatatgctattttaggggtttaaaatgaattattcgttgaaactattggatcaaaagaaaacaaagatataaagatatatggaaagttatatgtttaaagttactttttgttgatatctcttttttaaatacagtatattattagtgatcagattaataacaaaaggaaatattttctacttactatcaccatctcttataattcttcggcctgccaccgtcaaaatggacaaaaagaaaatattagttttattctgggagaaacaaatagtatagtcagacagacaaatcagggcaaaatatttgtactttttttaaaaaatataataaatacaaaattgctaactttaacgattaaatgaatattagaataaacaagtatatattatgtttatatagtgtcatggtagtgagtgtcaacatcatgaataaacaaagcgtgagaggcatacctatttttgtaatgctactgcctgttgcatgaaaagtatataaatgctcgcaagaaggtcgtcagggggcatttgtcgtggcctgggcagacttaaggcttcaattaaggctcgtctggtgtttatttaaatatttaatcaatcccttattatcgtcatggcattgacagaatgtgccatctaaatttaaaaacatatcttaatttcaatcaaagcctttgttggtatgctccgaaatggttgctctcgtcaagggattatgccctgagttccaacttccaagccactttatgaacattactattaaatattcacaaaagcgattgtattgagtaagttggtggatgatgcttggtgtgtagaccattattgttcagtccacattactttttttttccccttctcatattgatggcactgcctacccaacccgcttccatctctgaattataggtacaaacttgtgactaccgtcggccagaatgttgttaattatgtgattattccgtcaatacatatcgtaaactttacggtaacattttgctgttttttaatgaaaatttacagaaatcaaatctaaaatatttgttttatcgattgtttttcaatcccgccatttgagcccgtacctattccttatttgtcaaatttaattatatagtcatgtttatattttgacatattatatattcatgttatgcctagcttgcgtgtggataggacgcatagaacaaattaattttggccgttgttcgagtcattcaatatttcatttttattctttaacagaaattaaatatacatgatagccatctcatttctttattcatttgtcttcttgctgttggttaggaatgttcaaaatatgaatttgtttaaggactgaaacacaccacaaaaaatatatattcctgtactcgtacaactaagagtcggggtatagtctatatgaatcgtggcgaaaggataactaatcatatatgtaagaattttctgtttggagtgaccacctacatttccaaacatgagtaatatatttttagttggacttaattaataatcagaggtttaactttcagtttttttagaaaaattcctttcctaattttgtgtatatacaataaataaataaccatatttatacataaagttacaattatttgatatatatattgtcattacatttttaaaaattccattattttttagggttaaatgtaattttggttattttattttgtaattttaatcttttaattttaaaattaagacatttgatccttttatttaaaaaaattcacgattttagttattttattttagaaaatttataattttgatcaaaattttaattttgtttgtgttttatttatttttttatttttgatctaattgaattttaaatttaacaaattcatttaagatatcatcaagaaatgatttaat

SEQ ID NO: 4474 - DNA, 2100 bp, Glycine max
  Soy_ogl_5485 Gm17:3560001..3562100 Cluster 18
cgcttttaattaattaacattgcagtcacagatgtcttctgtgggaactatgtctatggtgaatggacacccccatgtgcatatacacctaacataacatgcgtatggatcattccattggcgtgtcgagtggctgaggcaacggaaataaaagagggtggaatcgttccctttctaaatcctgaaactgaaaggcttgatcaagggtttaacttacatggctaagcattacattttcagctataagcacaatatgcatatgccatcaagtatcttgttctctgtcacaaattacaaacatcattgatcgtagcatgtgtgcgggatgattttagtaatagtggactctcttcttttttatttggtttgatgctaatgcttctaagcggaagtttgtaaggaaatgtcttgaactattaggaaatgtttgtttatcttaactatttgaggtgatgtttgatttaacaattttttcacttttttctctttgaaacttagtaatctaaaactatcaaacaacttttactttattgtaaaaaacaaaattaactttaaacttaaagaaaaaagtcggacgaaactagtcaaatttaaatgataatttacactcgtaatctaaatatgaatttaaaaatgtcaatacaattaagtaatgcaattaactagttaattacctgaagctgtttcgtggataatgtctttttggggaatacttattttccatccttcattaatttgtcccgtctctttgaactttgaaggaaacccggccatcccatctatatatattaactagttaaatttaaatcccatctatatattaatgtcatattaatctatcggctaacgtgaggaaatgtgtggctacacgattttcaattatgtaaatgacctaacgtcgtagatcgatgttgtcttaaatatatatgcatgatttatcgttctctgcctaaattggattaagtttctttggctttgtgttaggttgattcttttaaatcttttgtactaattacgtcatttttctaaattaagaatatatttcgtacactgtgataaaaaaaaaatgagaactttcaacgtggttctattaaaaaattaaaaataaagtatactgaattgacggtaagaaaccacgttaaagataaaatcatggtgattgatgaaagtaacacaaaaacaattattttttgttttaaaaaatcaggatgggatcaactcaccatattagtaaagatgcacaaagacaagataattaaataaaacaaggtatctatgttcccagaaataaaaggtgaagaggtattaattggatatattatgcagcaagtacatattccccaattgaaaagaataagtataatgtaagttcatgaatttggaagagtctatgcacatgaaaattttataagataacaagatttgccctccttttccccagaacctttctttttctcttcctgtctttcatttttggtattgatacaatcttcttattatcttgtatgtggatagactagattcttactttttgtcattctgaattcggccccaaacgagataatgttggatctattatttaaactggaatcagattctttgcttgtcattcataatcagatttgatatgaaatttgacttcagaaatttaaatgtttaaatatattggactaaaatgaaattaatcaatccatatacttattagtaattggaaagtatatattatgcacattagatgaatatgtattttttaatttaagaaaagtttaaagaataaaaataattaaaactaaaagtgaaactagtataataaaattagacaaataagtagaaattgtaatacataaaagtattaattagtaagactttttattcagttaagttaactatataataaacgattttttccccttatcatcagatatagttgatattttttttttcttataataagattttattttatctctgttttacattaattatttttttattaaaatattttaaattatctctttctctttcttcatgatattggagaagatgaataaatccttaatataattaaagataaatttaatattaataattaaattaatt

SEQ ID NO: 4475 - DNA, 1518 bp, Glycine max
  Soy_ogl_6789 Gm20:36530483..36532000 Cluster 18
aattatataatataattaattattctttctattgtgttttacaaagtgtaaagtcatttctacctctcatcaaaagtataacatcttggagttatagaaatccactgaatgtgtgtttgcttaagagtatattgatacataaaagtagaactaaaaatgagttgaactcgattcgataaaaaattattaaacttgcaacttaatttaagtttgatatgaatttttatttttgattcaaactcaactcgattcaaatttgttagtaattgaacttagctcgttaactcggttagatttaaaattataattattttacatatattactaatttattcatttattttgtacaataaaattaatatataattaaataaaaatggattttgccaatttaataatataaaatatcatatacacatgaatatatcagagttgtacataactctaattcaacttgtttatttgaagagctcaacttgaactcatttggtttataaatcaaatatgaaattatatttcaattgatttggttatttgttagctttacacaaaagctacaaatggtagcttgtgttgagacttaaaaaatcacattaatcttgtgagatgaatatatacaaatatatattattagtactcttttttgtataaaaaaatatgtagaatttaattaatttttatagtataaattttacaattaaatgtatatacccgttgagaaattaattattggtacaaacctatatatgagaggctattattttattcgactgaaactcagttggcacttggcagtatgatggtcgaccaaattcgaaattataaagtgaaaaaaaggtgaaaataatgatgaaatgaatctgtactgaaatggacaaaaaatattaaataatttacaaggaaattgttaattttatatcgtatatttggtcaaatttaattagaattcattggcattcagtgatatataatgaaattattaaatttggaaataattcttttcaaagttatatttagaacagtttttaattagctgaatatataaaattattgacttttgaaataataatttttaaagttatatatagaataatgttttgatgagtgacattttatcatgacttaattatttgtgcttttataatgacctattttttaattataactttctaaaataaattcaaagaaaaacattttttagaatatatagtcaattgccaaacatgtcagtggcgggaaaaagtaaatgtttaaatttgttactatatttttacatccaatgaaacctctattaagggagtgaatttcgtttatttggaacaagatcgattaagtcgaatataatgggtcagattacagggtagtctttgacatcactctgccgatggacttgcattcatgttgacataaacaccagtgatccactaaacacttctaacactatcaaaattcgaatattgcgttagacatcggccaattaagttacgtcaattaacaccactagtttcaccattaaaa

SEQ ID NO: 4476 - DNA, 1900 bp, Glycine max
  Soy_ogl_35 Gm01:1762801..1764700 Cluster 18
ggtcaatgataggaacagtttttataacattgctttaaacattatgattttgaaagggaggaggcatattgtctacgcatgtttctaactcactcagtcttacgcgggcaggtgtgcttggtcggagttttctgtttatgttaagtggtcttctgaactttttcatccgcgcattgtgaacatattgcagtgtagactgtagaaccgttaacacctttcacgtggttgacaagttgtctgctttctagtaattttctctcttcaattcaacctcatccttgtactacatagtatttcgtggatcgtctaatctttgattctttccctcttggccaaatgttgttactaactcaaacgtatgggggacatatatgtcaaacagtttctatataacccaccgtccattttcaaactatatactatatttcaattaaaaatcgtacagtacttctcttcatatatagttttagtctgcgtttataaaagaaaaagtaaatcaaagcataaagtttttaacatctgttcacataattttatgctagctaaccttaacccttaaccatgttatcgtaacaacagatattgctaagcccctaagccaatgtgaagactaaaacatcaaacctggagctagaggacaaattaaacctgaagacagaagaccattcacaagtggatattttacataattggtgcaacatcacatctttgaataacttcaaagaaattcagcaaaacattacaaatgatcccatgtgcaatggtgtctggtgatgacagaatcacagcaggagttgtgttatatattaaacacagtaagacaagataacctttaattagaacctttatgcttatttagcttcttactgctgctattctttatgtttcctcgcgttaggtaagaccaattagctagactatgggtcaagaatcaacaccatataaaaataataatatacatgaacgagatttaatatattccgatactacatcgagttctagttatagctgctctttatctacaattttactaaaatgtaaataaaacaatacaattttgtctaaaattatgttgatgttcagatggattaaaaagttttaaaaaaattgctataaagtctaaagtcacaattccatacatctatttattatactttttcagaaaaaagttttgtctaaggacaacaattatttaaaaaataataatattattaattgttccaattgcaaccttggtcaagggagagggctagattcccttcacgaatgacataaaaaataaaacattgttagttgtatttgaaatattgtccatggtggttcttaattatgtatttttacgattttgcacttcaaaaagcatcttcatgagttaatggaagatgtttataagctattattgtcttcgatacattagttacgtgagactttttgataatatgaaacatcaatatgtttttattgcaatttctaataaaaatatcccttcttaacaatggtatttaatacaatgatcgattgagaaagctgttttaaaatagaagttgaataaaagaaagtccccaaagcatgtgaaatgagaatatggattaatttttttattttctagactatattatttttaattagagataattttgttaaagacaaataagattattatgaataataaaattttagcttaaaataattatatatttataatttaaatttgagattttgaatcaaaccaaaaacaatcaaaggtgagttgatgtatgcgtgcttcgtggtatatggattaattttctctcctgctaaaatcaatactgccataaactacatttttcttttcctctatggttataaagcaataataatcatttcaaaggcagtgattatttggctggcaacaaaacaa

SEQ ID NO: 4477 - DNA, 2000 bp, Glycine max
  Soy_ogl_37 Gm01:1798401..1800400 Cluster 18
aaaatggcaatcatgtcaatgtatgaatcaaatggtttcctctcatcagtcacaaatggataattggatatacctgccaaaaggggtggtctcacacgtcggacaatacaatcagttttaacatctacataactttcccaggaaaataactgttcaagtgctcatcctctactatttcaaaagttgcttttcaattgcagtagccccacaaagacaaaattttattttcctcacccaacttgcatttatttatttagtacatattactccctgctgttgtttcaatgccaaatttctgaaaaccactagtgaagagagagatgtgtcccacttgcttcatatttttgaatggaataacattattaggtagttcagtatattaatggtcttaatcaagttttacatcttatatattcatgtttttcattttataaaaataaaataataatactttattttattttgtcatatcaaaataaatagaaattgtgataatttctaactatatctaataatttctcactattaacaaatattcttcttttcttctaaatttagaagaaatattgtttcactaaatattattcaactgatgtgatcgagccatatggaatgggacaagaacaaacgtgcaagcaatataaaatgagaattgccaacactttttttataatttttttttaccattgaattatgttcttcactcactcaataattcaaaaataattttataacgaatataaaatgtgatttaatgataaataatattaataagaaaacatattgataattaatatttttgccctggagcaataaagcatgtttttgttacaaataattgagtaattgactaagtaagttggcaacgaaagacgtttaattaattgaatttgtgcacttccacgcaagctgttcatctacagatatacataaatcaaattaaaagtttccaagcgattaaagactaatactcatagagacacagataaatttgttaaaatcttcctttctaaagagcattccccaaaactgtgaaataacaaggaatctacaaagtttattcctttgtgagtacgtatttcgcacagcgtattatacactcaagcaaatatagcagcgtcctcatcttgcttaccatttcattatcacaattcattgtaattttggtatatagtagtttttttaaaaaatataacgatagtgacatatttaaatctgcgagattgcgaccttatataaactaccataacccatcagcatactatcatagtatgctgtctgcatgcatgatggaaattggaaacccttttatatatgtaatgtataatcaagaccatatattattaaacagagattctgaattcttttaattaggcgtaaattaaagcaaagaaaaaaagtgatactaaaataacaagaggaggttgtaaaagtgagacgaatttatcgagtatgatagcttttctcctccattggtggtgttcgattgattgttttggacagtgctcgagcaaaactcaaacatataaatatgatatatatagttaaggaaaactcgacttagattgtttcacttcacatatttattcattattttttgtgaaatgttagtaagatattattctcttttttttcatacactattttttgttataacatttattaaaaattataagcaaaactcattcagttttatagttcttaaaataaagtcaattaagaataaagaatatatccaaaaaagaatgtgtttaaagatatgttaccagcactactctttcgaattatgttttctatgttgacatgtgtaatccacagtccattgggtagagtatgaaaaaagtaaaatatttttttttaaaattaaaataaaatataaaagtaagagtttcatctcattttattgttatttttataattattttggttcttttttaactccgaggaacagaggggatatgggagatgattaagaggaaaccaaagcaatgcaagtggtt

SEQ ID NO: 4478 - DNA, 1193 bp, Glycine max
  Soy_ogl_3223 Gm09:40241008..40242200 Cluster 18
taaatgtggtggcactattgcaagttagaattctcaaataaattatttcattaaatgtgactgttaaagttttcaaaataaataaataaattttgaatcttataatcaaccattcaatttcaaaggtttgacgatggattaaaaggtccgagtattgacattttgttcttcattggagtgaaatccgattggtatcatcacaccaatgaacaattccaaagatatgtaagaatattatacttagcagttgaactttcatgaaaaatttattatataatttcaaatttaattcatcaacatacttgattcgatcgttgcatgttatattataaataatcaataaaatctatgtcagttagttacacatataatgcattaatattataaattatttaatatatatctttaattcatacggataaaaaatattatattataaataaaccgtccattttataagacaagttcgatccgaaccatgcacagcctaaatatccgatgcttcgagtcagttctgagtgcattatgcatgtttgggtaatccattcattcaacgtttgtacactaaaataggcaattggtatacacaatgttgattttgcagtttacttcaccacccaactactcacttataatgctaagatgactatccgaagctttgttcatcatttgaaaatacgtgcataggtaccctacatgtcattgattgtttttcatctgcttctgacaaacaattcaagaatttccatactttcattattactaagattagatattgcacgtgatcagactaaaacaacccaaaacatatttattgtaagcaaaagtttatgtacaacatcaaggactttttggtgtcttcttttaaaccaaaataggctttcacttggaatcttattattattttttgtacaaccacggcaatgaggtttacttgcaatcttgttttcatccagcaaatttagtaacaatctaatttacagtttagtggaattattttttatggaattgatttgaagtattgaatataattgggatgcatggtgtctaatattaacctgaaccatgtatatctacattgaaatacatgttttttcataaaacagtgcataatttgattttataactttaaaacaagcaaaatattagtcgtttatgtttttattagttattttcttccagccacaattttt

SEQ ID NO: 4479 - DNA, 2122 bp, Glycine max
  Soy_ogl_4549 Gm13:38489638..38491759 Cluster 18
tttaatgattttttatttttatgttaaattgatttgaatttaaaaactcctgtgctatgaaaaacccaaatatcccaatacaacggcttgcatattctattgaaagtgtatcaggaagttggacgagcatatatgaataaaaaatgttttgatggattaacgcgttacaagcttttcatcccatcttcttcatctttttttaacaacattttcttcatcctttgtgtggataaaaaatgaagattagggcatattcttggagcatccacacaaaactttatcaattatatttataaatttgtttctctctcccttgagctccagttttaattgaatttgtttttcattgataaaattctcgctctctctctgtctaattcgaagacttctgatgctgagaataatttattttggtcaccaaactacgtgggaggagaaaagtgatttgttttttaaatgtgtaaatgacgccttaaattacataagtatctttacatgccaaaaaatctcaacatactaacattattccttgttttcaatgttcaaaagacaaagaaagaactttagtgcatatatgtagtgtttcaagttttctgtacaatttagagatacatgcaagaacagaaagaaaggaagcaaaatgctgttttcacatcccattgagctgggtacacttctgttttttttatgcagattgagtgactgacatcgttattacttattagaatgctgcactacagaaaaaaaatgttacacattaacgtcttgatgatgaaattagcctttaataattagtataacttttcttcagtagaagttaaactattacgaattcacaccattagtgtatgcaaattgctagcgcgattttattgacattaaaaattattatatactatcgttacataaaagttaagtaggttcacaatatttgtattaaaagtttaatttctaataaacaaagactacactaactaaaacaatcttaaagccttaacatttttttccttaaaaaaaaattaaaaaacacttttttaccgtttgtgtactttgtaaacaacattctttttttgtggtgccaagataacccaataacacgcatgcatcatatgcataaagctagtatgcatcatttgtactgtattgtacaaaaatccataaccttgcatcagttgcatacatgttacaatgttagtatttaattaaaatttaagtctagcttgaataattttcccaataaacactcacaagaaaaaaaagtaaaataataaaatcaaagatcttacataagttaaaattaaattatatatatacctatatattttcaacttttccagaaataattttatttaagtttttcccataagttataattactgtagaacttacttttaatttataagaaaatgaattattttatttctttattttaccttcttcttttttaatcataacaatgatgaagtatttgtccacttgttgatgactaacaccaccggaaacatcactaaaagtgaagtcttccttttctattattaaatactttcttccttacaaataaatactctccttatttcaaaattattggtcttttatttcattttgcaaaatttatttcatgaatttccatatcaaattattagaacttatttgttttctatttctaagaaaataaatttattttgaaaaaaatatcaaactaatttcaatatatttgtttaagcttaaataaaatagaattagaaactacttttctgattatttaaaaaattatgtcgagcaccttttgaaataaaaaacttctattttcataaaatctctgaaaagtaaattaatttttaataccttcttaaaaaaaattaaatttaaacaaattgatccttaatatttctttttaatttaattatctatgatcaattaaaggagaattactttctttatttttttttattctttactggaggagagaagcactccgtatctctttacaaaaagatttagaagtaaaaaaaaaaattatataagaatagtgaataattattaagtgagagtaataagagtttaggaactgataaataataaaattatctaaaatttgggaacaccagaaaaagatatatat

SEQ ID NO: 4480 - DNA, 2284 bp, Glycine max
  Soy_ogl_5244 Gm16:2008317..2010600 Cluster 18
gatggtatttttgctcgagttgggatttgatgcatgaatatatatatttcgtgtaaactccaaaataaattccatattaacttaattaaaatattaattttctaattatcttctataaaaataaattgattattttaaagagtttttcaactaatgtgtttagcccaataaactaaaaaaaattgagccgattacactcaaggaggtgttacttaatgaatatctcagtttatattgcaaataattcttaattcttcatatgcttgcattatagtaatttctatataggagttttaactaaagtttttttttttttttataatcaacaggtgtattactcctcacacagggttgatttatttttgggataaagtgatactttcaggttaaaattttctataaaaaaaagttaaaggtaactatatatcaattatatatgcctattatattaactaggggaagagcctctcaaaatttttcaaataataagttaaatacagttaatagaataatggtagaatgaaaaaattaacaatatagaaataaaaggaagttaatgtaggttagacgaaaaatttgaaaatttaagaaatagtataaagataaaattttccaataaaatgtgaatatcaaaagaaaatatttcctttattattagtatagataatacataatcgtgcatatgaataacatatttcattgagtattattgttggatagaaaaaacaagcataagaattttataaaagaaaattgctttttagttgaaattagtcgtatataaaaacgataaataatttacacccatgattaaaaaaaaaacagtgacaattttgagagagaaaagagtttttttgagaatgaaggtaattttttgacacatagttgcacgagtacgtgataccatttatatactactgatacagtgagcaattcagttactaattgaactaattaactcactgatctgttctcatctcgttacattaattaatcttccgcaaacttaaagtcggaagatattgaactaagtttgtattttgcactgttgaaaaatataatgactagcttggtgagaataacagcagtttaattgttttgatgaaggattaattgaaggtatacgatggacctccaactggggttgttgaatcttttccttaacaaagtgtttagttagaaagtagggtggtggttctgaacattcaatgcaaaacctcgttcatcggtggagagaggtagagagcaaagaaagtaagtggcaatggattagtggaggagcaacatcaaaaacatgaaaggatttgttagcatcaaatcaaatacaagggtaatagagaatgaggtaaagttaattggacaagaagatacgagttagacgataagaaatggggattagacttaaagagaaagtgcaattcattacattaacatgtctagctagaaatgtatactactttaactatttcgtgcctaggcataggcaaccattgtgagaagcattatatgatggaatttcctttcttttctatcatattttgctgatttatcgggatatttgtttcttcttttctttgaattagatttaagcaatacaatgtttttacgcgagaatctcgcattaatctctggctctggtcacgttttttcagctttatgatgttcatagttctatatattgaatgtgtctatctgtcgcgtataatcttctcttaaaaaaataaaatattatcaagtttctctgaagcatgggtactcttaaattctaaaagctgtatcgtatacgtataggtcggatttgcctttgctatgttgatctgaattactgaatatgttgcttaatgcttattaatatgttgcatgcatatttagattatatcaaaatctagattaatatttagtatcagaattttgtatatctctactttgcttactctgttctgtttttggaatttgctaaatttattggattttcggtatgatacttcagtacattttttttaatatatattttagttaaaaatatactttaaaatcttataattattagtctttagtagtatattttaacgtaagagaggaggaatagtgtattctacaattttaacataacaagggaaatgtgtggtataaaacttccatctatcaaaaggagctagagaagtgtaatttattttaatgacgttacatgtgttaaattgactagatcgtatgttttaatataagaggcaaaaataacataattatacatgacaatgggtgagtcggaacgaatttgattctt

SEQ ID NO: 4481 - DNA, 2100 bp, Glycine max
  Soy_ogl_4105 Gm12:35916401..35918500 Cluster 18
ggaaaaacctatatcttatgtcaaaacacttgtttttatattttatcgtatttttactattaaacgacctctaaaggtagatgatcacctatatttttctggttcttgttctttttattttatttttttataagcgggtcacttatagatggtttgaagttctcattctttgttgcttgcactatatggctaaggagttatttattcattcttctcttttgtttcttcttctcttgcactataacgtttcttaattttgaggaaacgatatttttcttttggtatattacttcataggaagaaatattttttctgaagacgtacatatgctttcaacaatctcttaaatcaattcattctaattatttatggaggcatagaatcgtattgaattattgatggattgaacatgtctgtcctttccctaccctttcccccaattaaattataactttgtttcttaactatatttttaaaattaattttaaattttcctacaatattttcctactttttatatatgttaagcattaaatacttttttatgtaatactatttttttaaaaatagtaatatttttttaaaaaaatactatataacattaatttttgttaaccctctgttgtcgacgttttatgtgtgtgtgtgtgttattttctaattgcatgtgggacaggaaaattaaggagacacgtgatttggtttccatattacttctaattagtaatggccgacctataccatctccgagaagttttattctagttttgcgtactggtcaatgatcattaattagttcatattgatcatatacgcttttctggtgaaggaatcgggtatactttaaaacctatgaccaagagtacaagagctatcagtagttaagaaactaaattgaaataaggagcaggaaatcaaactcccgaatgtctgggatcagataaaagtcatactataaaggccatattacattttagctaataacattcatacaaaatattcattgatttgtttaatgattaatatctactaaaaacttaagcagttatttttagttggatctctactagtagtgagtccaaaaaaattatttaatggaaacaaaaaatacttcataatattttcataaaaagaatattataaatttttacaaaatatataatcttatatgatactttttttaaaaatgtctaagtttctataaattagagctgccttttacatatatcaatatattttctctttgatttcttataattttttacttttattttaaaaaaacaattatcttatgggacaacatctgatttttaatggggatggttttttttatttattaaagatgtctaagtaaaaaaaattgctagtggggacaattgtcccacagaattgaatgtacatttgcgagtgatctcttccaatatttttttctattcgtaaagattaaacttgacacatcgcttagaaagatcgtatcgaattcaattccattaaccaacaacatattggtaaaggactaaaggccatgctatatactagaataattgattttatttccaagccattaataagactatatataaaatacaggttgcatatactgatttcacaattcggtaacctcaaatttagagctttccacaacgataaccctgcctcactttaatagctgctaatgttaaaagttaaaacacacatatatggtacgtctttttcgatatgattataaatttactgtgatgctaattaaggtaaaccaaggataaggctcagaaagcatgaagatgaatcaccataaaaaaggaaatgaataaacggattgataacttcatgatttgattcattttgttcatgacaactacctataccctatattttattttctacccatcttttcatgtaacaagcatatttaattatatggctaacacgtgggaccttcgcccttaaccaacagtcgtatgatagaaatacactcgaagtgtcacgtaatctctttgaaacaagctaaggatgattaagtggaggagacataattaactttgatccttatgcctccctcaactttctaagaggtagaagaaacacaaacaaggaagg

SEQ ID NO: 4482 - DNA, 2800 bp, Glycine max
  Soy_ogl_102 Gm01:4129101..4131900 Cluster 18
ttgttatagtatattaatatttcacttgtattggcacaaaattcaaaaaagtcaaaattatatgatgcaaggtagtaaatttcagttcgagaattatctgaaacatccatgtttcttaattaagcagcatttcactgctattagtacggttctgttctttttctttgtttttgttgtgattgccataatgtgttatttgttagatttcataatagtcgtggtactgatttgttttcagctaacagttatctggaaattagtggagaagcttcttgttccgacttcaaagtaattgaaatctttgactgtggagagtcaatctgcttcacaaggactgaaatggtctatttgctgctggtacaaatttgttatctcagcttgggataaagattgagagacaatctaaacaaaagctcattgagtttgctcgggaactgaggtcatttcctagtattgatatgtcaggtatgctggctggattgataatttgataaatgaaaaagatgtgtataattatctaatacactttaaattcaataatgaagattcttcattgataatttttcaaaataacttcttttaccatttctggactgaatctaatccactttttcatgtattcgataatttttaaaggctaatctagttgatgttgatcttaccttgatatataacatccttctaattgattgattgtgcctcttcgatttgttttcttccttttcaacttatttttccattcaaattattaggaattcatttgctttgtaaatggaactcttcatttggaaatttatgaaatgaaatatgatttgattttgaaatctttttttattttatttgtgtcaatcaatctagaaatccactcattttttgactggatttggtttcaccttagacttaattatttgattgaccatcttgctcttatcagtttaaccactttatcacattcataataactaataaggataataaatgaatttctttttgccaactgtcataggcaatttgggaaggaggactgctatggtggggacgtaggccgcaatggtgtgtttatatgacagaatttgggccttaggccatattctaccgtctgccattgaaaacactgatggttgaacacttgaatctttacaagaatgacattggtgatgaggtattgtatctctgttgccccctatttcacataatgagataataaaaaatcttgtcaaaattgcgtcacatagtgtgaggtcaaggaataggatccttaagatgtttaagtagtatattgatacatgctatttgagattcataaaattgtttttccatgactgttcagtataaattgcattctatactatcaaaatttcaagtgtataatgtataaactaattttgtgtatcagcaacaagttgaatagtaaactgatgagtatactcagaaataaccatgcgtggcctctttcggtgtctcctttaagtgtacaaataggttgggaaagattgatggctggtagttgtaggtgcatattgccatacctgacaaaagttgtgttttccttttccctttgtatttatagtaacaactactacaacaaaattaatagttctgcaaagatagattcttaagaggaccatatgaaactagacaattgtcaaatcctccaaaagttgcttaatagtttaatacgattcaaagctctccaacaactatctttgaagagctgtgtaagcctttcaagcttgcctcctcaaataagaaagttgacctccctaaggaatttatccacttactatgttggcaaggaaagagggtttcttttggaagaattaggaccactgaaattaaaagaaagtcttcacattatgcattggagaaattaaaaagtgtaacatatgccaaagaggccaatatgccaagcaagtaattgaacaagttgtcattgttttggcacaaaaatgaagggtctgaattacaagaaaacgttgaggagattcttgaagtacttaaacctgatacccaacaacttcaaagtttgattgggttcggatataaaggtgcccaattcccttaatggatgtcttctagtccttctctcaagaaactatcaattgttaggtgtcataagttcaatgtgtcaacaggttttcaatgtctcgagtttttgtggattgccgcttgcacagagatggaaggtttgctagaggctttacatcatatgactgccctaaaggagttaagatcagagaatcttccgaagttacaatccttacctgactgccttgagaaccttctcttgttacagtctttgaaattactgcatctgccacagctagaatctttgccagactgcttccaaaaccttcccttgcttcgtatatgggtagaaagtagaatgtaatggaatttaacttcgtatagataactttccaccatttagacatggaaatgtttttgtttctttcaatagacactccatcatgactctttttaatgatcctgaggattatatatctcttttccaatagttattccatgtcatatgcataatcatgccaatgtcaatataaaagcttaggcacaattaattatctatctgttgtttgtgatacacaccaaggttcgtttggaaggagtgaaagtaaaaggtaagaaaattgagagaaaaaaacacgcataacaatattttttcttttgtttgattgaaaagaaaacaaaagaaaaattgacttaaacaaacaaaaatttaaatttttctttcctcactttttctccaatttaaatttcaaattttctttcctcccttttc

SEQ ID NO: 4483 - DNA, 1378 bp, Glycine max
  Soy_ogl_1463 Gm04:47307223..47308600 Cluster 18
ccaaatatagtctatattaaaaaactcagatattcttgttgagacatgaactaaattatcaactaataacagttttacaatcagtctcaaaaactatattactgtattgtcttttgatgtatagttttacttgaatttttatatgactttatgttaacgactcattggttaatatattagtacaatatataatacatgtttaattaacactgatttaaataaagttcaatcataactaaactaataaaactgtaaaattaatactttaactagtttaatgattcatacgtacagtttttttaagtactaccgtatttattaaatagaggtagatattttaaaaaaaatgattgaattggtttctttatttacattatcatatcattttttttactttttacagttaattataagatgatttgctctttggtttcagtccaagtacttaaccagttaattaccacccctgtcaggcaggcaaaatgaaatggggtttacagattaaagtatcagactactaagtgttaagtgtatgtttgatttactattacaaacggatgttaataacaaaataacttttataaaagcatctagctatactctttttttcgcgttcaatttctattgaaccgttggattttatttcacaattcgtacatgatatgtaagatgataaaccaaatatgttatatatccatacaacagtagattttcatttacatttgattcattgattttcatttactagtactatatgattttgcaattaagcaaaagtggacatttaatgtcgatccgcaaacaaagatctagcatttaaaatattactactaacactaacatgaaaaattgtatattttgcatgtgctgctaattattcgctctacgtatacaaattattggagcaaatgtacttaagaaaatcagtgcacaatgtagttttaaacaaaaatatgattagactgataatggataagataatcaactttggcacagaatgacatctggatttattggttggttggctacttgacgttaacaaccatttttgccacctcactaattaatttagaatgctctttttgctcttcaattgttcgttgagaggcttttcagatgttccttcataggtcagtttacacttactaattaacgtaataattccgtaattgaatcttcttttcccttcttatctctcacttttcttcaggggccccagctagctattgtctcagtcaaaactgggtggcgtcttccctttccctcgaaaattattgcactttcccccttgaaatcatttcaacattcataatttgaaactaacttaacaaaaaatttaagagcatttattctgttttgtttttctatcactcattaa

SEQ ID NO: 4484 - DNA, 2017 bp, Glycine max
  Soy_ogl_4627 Gm14:3828584..3830600 Cluster 18
caaaccaggcagatagaaaggaattgaaacacgtcacatgcatatactcctatattaagggaagcattctcaccatttttaggtttgcttcatttcttgtgctaagtatatctaattatgtgggaaagcaacctttccggcatttaaaaagaagcagacaaaaatatataaatgttgataaccatgctaattagaacataatttttaacacattttttttatatattttatatttatttcttttaaaagttgatagaatttttccataaataaattacgcattaaaaaaattaaattaattttcattcttgactttgctacttcattctttttctaaattctctcttcattttatattacattattcattagtttatcttttctttttagtttaacaggcatatgctatcattgtcaaaaaaaaaaaaaaaatacaatcaatcaatggaaaattatctttcaaataacttttaagataattttttataaaaatgaaacaattactattgagtataattaagttcagtgcctatattatttattatagatattataagtgatatgataaaaaaaaataaagagataaaaaatactatgaaaaagagataaaagagaaaataagtttttgttcataacttttcttttggaatatagcacatagattaatataacatttatttatctctttgacaaagcttaactgttaaacttttatgggtaatctattttgatgcttgaaaatatgagacggtatttaaatttattctccaaatatataaaaagtacgatgggttaattctcagaagtcacaaccttaatttattctattctcctccttatctttatggttggggaaacattattcataattcataaagcagcctttctaaaaggctgatgaattatgaaacattattcataattcagaaagcacactttgacctctccaaaacttgagattggacccaccatcaataatgtgtacttttttgggccatgtagcctacctcgcattacagggtaaagattgttagatccaccactgatcctttttcaccacttcctctagtgtctatatatgaatcacttgctgcttggtacagttataataattagggatgccaattattactcaggacccgaatctttttaattaatattttttaatgataaatattactaatattctaagaaaatgttttaagttaataaaaatactaaattaatatttatttaagtcaatgagtattttactcatggtgcatattcaatttttaaacattatatgcaaaaggaaaatatcacagagaagtattgatcattcctttataaatgactattttttggacgaataataactaattagtggtataatagaaaattttcaaaatagtattaaaaccaaaaataaatatttacttattctttcatatctaaattatattgtctttcccattcaaataaattcatacaacatacagatgttatatgtaatatactaatacgcgcgcaagaatagacactcaaataatcgataccaacacgtgaaaggtgttttttttctttcttaaacacaaatatgggaatgaatagtatatatatccgatatcatactcatataccttaccaattttgatccttctgagtgctccctactgatagactcaactaaaatattaaaagtctgaaattgcatggccactaccatatgagtattttcactcatcaatgatttcaaatacttcaacccgtgttcctctggtacaaagaagttatgactacagaagaaaagatgttgaaagggccatgcttcccaaacgataagaaaaccagctctgtgacaactatgcatagctactcaaatattccaccacaagattattttatataagaaaattagcctataaatagttgaaaattgagactaatcaatggtccaagtcttcagctatctttcctagatgcaaatcccacctttaaattcagtgctttgagatgaatttggaaaagaagacgc

SEQ ID NO: 4485 - DNA, 2000 bp, Glycine max
  Soy_ogl_4679 Gm14:5434301..5436300 Cluster 18
gcacttaacttgagtctaaaattgttcaaacatgaattttctaattgagcatattgtttggcaactcgcatagtgttagaaacttaatttcaagctttagacttaattaaaataacttttgcatctatatcttgagtcatattatttgttttatgcgtacatttaatcatattgtttgttcatgtaaattaaacccgtagataaattcaagttattttagtaattatgcacttaaaatcaatttgattgtaaaatttcaaacaaaagtattttttttaatattttttatttaaacaaaaatcatcttactacaaactcgtctttacttataattaaattttataaaatcatgttgcatcaattctataaacttattttttaaagacactacacctgtttctacatctttcaatgaaaagacgtgatttgcatttctatctgttttcaaacacatggtcaattgttaatggttatcatctatacttaattaatgatatgatcttaattgggagttgggactttgttgatcaagtgtacgcatagcttctagtcagattagtaatggaaatgcgccaatccagactccgagatacctacaattttatgggataaaatgtggcaaatatgattaaaaagactaattaatcctctttattttgagatttcagccaatggtgaaacacacgggagttctatgcggagatgctggttgtgtgcattcatcttattgggcttgtatacaatgagggcctattgaagtttttttttgctctctctgtttttgtgttggaaatcaaagtgagagacgtggacatgtactgggcaatttcttcctgcaccccattctgaaatgtgaaaaattgcattccaaattacattatggaatgtaaaacacattccgaattaggctttccataagattaaaaaggtgcaggaagtaagtatggaggtgtaggaagcaattgcccatgtacttggggtggcaaatgagttaaataactggagatataatgttgacttcgttgctaaaaggaaaagagaggctatgtgtaaagattagttttaatctgttaattaaatttttctgttattagctgtatgattagtggtttttgttattacttactattaattgacaggtttatttttcagttctgttgtgatcgtaacatcttgtaaaaaaaataaaaattaatcctttaacactaagattaatgtgaagctcatcattgtaatttgtcttatagcatattcatgaatatctcattggcttttggaatgcaccatttgaagtatgttcaatactagcgcaagttatttgaacaattgaatggttagtatgcaaagtgcctgtatctgaataaatgttaagtgggatgagtgcactatcctattttggatccatcttatctatgaaattgtttccagactaattcaaagccacagacagattgcagatacaatgatacattatgagtcacatgcaaatttttagtgctttattctaagcctttcttttgttctctctctctcttcaaacgttaaagcatcaatgtccaagttgcatatggatattgaagctttagcaaaagattgcaatgctagggaccggttctatgtatggtcgatttctggggtacttgaaaaccagaggcagcaaggatatgggccctagttagataaaaatattgtattggcactccttgcacgaccacaattgttatccaacatcttaacttttatcatgacattccaacatattaggaaggaccactggccaaaccaaaaacgttctctgaaagggaaaatgaatgacaagtccttttatgtaaattttcctaatggctacacatttgcatggccactaacttccttttcttatcattaacatttaagaatactggttttgttttgtaaccatcatttagataacgttgggttggagcaatctcctgactcttttcggcctgacccaagattgagtttagtaaatgcattta

SEQ ID NO: 4486 - DNA, 1861 bp, Glycine max
  Soy_ogl_6312 Gm19:1001501..1003361 Cluster 18
taacatccactactaattaatgggatcttgggctagtatatttttttaattactagtggttagaaggatgcggtggaggttttctacttttcttaatggttttgtaactatgatggcagtaggttcaatgacgtgcttagttaaatacacaacaaaaattgtattctaattcaacgtaagacctataaagagtattccgtgggaccctagtggtcaaatatctatattatatataccaatttattgaggtatggtagctcacaaatgattttagggtttggacaaaagcaaggccactactacaagggcttgtagttgtgtggttccatcacactcacacgtagctttcttcacaaattgcttgtgggattttgggtgagggttaaacttctcgaggcttcttactcctcaatgtgaaaaagattcgtgccatgtgttatgcgttttaacttttaagaccacaatttaattactactactactagtttgttctacgtgcttcttggtttggttcggtggttgttaaaatctcgttcaacgaaactccgaaagctgccgtcacaacgtgtatcttgagatattgattacgtaatgtttcatatattttattaaatactctaaaatattatataaaaaaatgaatatcaaattacttcttatatattttaatataataattcaggtgtattagttaacgtttgctagtttcaaattctattacacatgagattttacttctaatgtatatatgtaatcggtttaagtgataaaaaaaaagagtggtgagaaagctttaaatattttcttaaacaaactcactagttgatttcacttagaatttacattttttttataattttaatttatatgatgtaaaataataagtctaaagtatgtcaaatcatcaatgtacgtaaagaatattcatgttaagtatactattttagtcttttcaccttttgaccttggatctatttttatgaggcttttcttgacaactcaataatttgaaccgagtatttgaaaaagaaggttatatatatcttcagtctattttcaagttggattttagttctttatattcaaaatattttacttttagttgggtttttttaactgagttcattaatttgagtggatagaaataattgtcactcaccatcatatgtgatagtggtgttacgtggatcttgatatgagttaatggttctacgtcatatttttaagaggggctaaaattaatttttttacacatttaataggattaaaattgaaagaccaaaaacatatattcatattaatttgttgtaatttcgagaaggatatttgaaagtctgtggcacgatccatttccatcaagtatcatattcttgttgaaatcttccttgagtcctaactttgtgaaatgaaaaataccccgatacaaatcttcagggttgatccaaaatcttagtttttctatttgagtctctacaagtttgaattgaaacacgttaaaagcgataaaaaaatctttatgtatatcacttgaaatttttgctcgattgaggaataaggtataggtacgttcatcttatctttatacaatttatgatgcgattcgatagagatatagaggaataaggtgaaatctaactttatatttatattgtaaaaataattaacaaggtctgagacaagcagttcatagacaattaaatcgcttaaaacaagttagctaacgtcggattgtgtggaaaaacaaacttaaaagagacaaaattcactttaataatttaaaatagtataagattaaatattctattgtggacaaatagataatataaaataactttatacaagtatctaattataaacatat

SEQ ID NO: 4487 - DNA, 1933 bp, Glycine max
  Soy_ogl_1700 Gm05:37297201..37299133 Cluster 18
agagaaattctaagaatatattttatatatactattttgaatatattttttattagttaaaattgattaaaaatcataaaatttgattagtcttgtgtaatattgaataatttttcaataaattttaacgaataaaaagtatgtgaataaaaaagtataacaataaaggcttaagatgtttaatcagcaaaagaaaaatataataaatttatatttcatctcttacgcgtggctccaacaactcatttcagaaatcacgtacgtatacatatgtttgtgtttctttttcccctaaccacactggaaaagtaataaaaaataaataaaaaaaactagtagtcgtttaaataatgtagagataagaacgaattgtgaggtaagtagatttgatggtgtttggataaagatcaatgatctaccatatctaagaaccatgcgacttactttcgatagtgaaaatcaaattaccctatataccaccatgaagaagattaattctctatttcggatgttttagaaaagattatttatttaataatacacgtagcataaataaaattgtaatgcactccatttatttcaaattatgattagtccttttcattttttttttacttcattgaaggtatttatctttcaaaaaatcaagaaaacattattcctttttttcagtcagacccttataaaacggttaacaaaccataagattcacaattataactaactcttttgacaagaacatattttttttttcagtgacaagaacatattatttaataaaaaaattattttattaattacaacaatggtcgtaacaaataatcttcataaatatttattcaaatattttagatgtttcaaatctattttaactttaactttagtaacaactatttgagttagaaatatattaatggttgacttttaattcctattatgataaactagttattgaagctgatgaagtatttgagagaccgtagccgttaaattaattttgggattgatttaattagaatgagagcgaaaaaattcttaaatattttttgtattgacatcacttaattgaggtatgagttattagataaaaaaaattaaaacaagaattgattgtattgtttagtttgtttcaattatttggctaaaagaacttaccataatccatgaataaaattttatggagactgatattttcaagtgtattttccctgttataccatacaaagccattttaaaaagtaattttctctattataaaacatcaacctataatgcttttatagtaaaaatatattataaataacaatatatatatttttagttttacttatatattatttacaaatgataattaaaataaaattttatgttttttactctcttttttttaatgaaagaaacttatattaaatcaatgagaataatagggtgaatacaagaaggacattgatcaaagaaatggtgacaagcaaagggatttagatgttattgctaagaaatgagcaactaaattgatttaacgacttacaaattgaacacaacagttttcaaaagaaggtaacttcagagcacatttaggaagaatgtctccagcttcattgttcattgttctggaatttcttggccttgatagactccaaaaagatgctattgaaattagcattctcgatccaatataagaatcctgcttccaaaggcgctggaatgccattaaaccaagctttgtagctgtgacgacaaaagaggccattgctatccctgatacatgctgctacatcgaacttctgatcttcctggaaaatggcagcatccgtgttgcatttaaccacttcatactttttaggaaatgttttaattatttatattttaatagtctaataaacacttatttattaaaccaccaatggacatgtcaatgcaagtggcaaccgaa

SEQ ID NO: 4488 - DNA, 2231 bp, Glycine max
  Soy_ogl_3933 Gm11:37026270..37028500 Cluster 18
gttatgtgcattctgcagtctctctttctagttcatgaattcacagtttgtaaataatattatggtctattggtagctcagtctcaagtgtgaaatatgtctgcttactcaaaatggtttattctttatgaatttcatgatttcatattttaagtgaaattttgattgatctttgttagtttgactgttatacagttactttggctaatcccttttagtttataccgttgctacaataaaaatgtatgtgttcttccaagtggttctgattgcaaactcacttcctgccttaaatgatgtcactgcaatggagcttcctgatattgtagctgaggctgccaaggtttgtgtatttttgtactatgaactctaatttggtttgttatattttatgttttagaatcccttataaatttcttctggatgtcctcaccatcattcatatgcctcttatttgtttttatcgcctttgagggaacatactatactcactaaagtcctaggccagttaccatatatgactctccggtgatatttgattttcacagccttatcacacgaatcttatctaatttctttcttcttttgagaaaattggattctttagacgttttcctctgcatctttttgccctagaagcaaaatgtatctttgttgatatggaactttgaggccaaaaatataagtgttcaaaacagggtcattcatgctaaatgccattttccccaagctggaaaatctcgtgagagtttcgagcatcctcctcatttttcattatcagctttaggttcctccaaacactttctaatattccccaaatcaataaagaaaggaagccatgcacctcacatgattttatgtttggaataatttcgtatctacaatttttgttttatttcaaccacatgcatgacatgagtttcatattgtgatttttttatgtacttgaaggttttggcaccactttcaattggctttgttgtgttcatggttcacttggaaaccatcccgataacaggaactggcattaaccctgttaggagtctaggagctattgtcatgtacaaccaacataagggctatattagggaagtcagagacaattgaactaactacaaggaaaaaatgtgtcatggttatagggatcataacagctcttagtagcaggaagcgcagggtaattagtttgatgtaatctcaagaaacacaaagcacctaagtaggagaagataatattgaaaattggagcaaatatacttttctactttctataattcctttttgtatgtaacattgtccttggtcctctctttattgcaaatccttatgagatgttcaagcttttgtacatgatatttttctgaattttatttgttttatttttaaattgaaaagtacagttacacacatagtgattaattgagaccataaatacacactaatttgttttatatatgtacagatttgtcaatttgaacttgtctaagaatgagtattatgataaaaggtatgctgaataatttttaactaaaaataacattttaatataattttttcagaaaattatctttaaactgttaattttttttaacattttaaaaataaaaataacccattttaagatggtttcttagaaaactaatgtagaaaataagattctaagacagtttaaaaattgttccgaaaagtgttgactttttacaataacaaatttaaagacgattcataatgttgtggaaaacatataataactttctttgaatattttttttgtaatagtataaacacgaagaggtttgaagtagtgaaggcaattgacatacaaccaacccaagagtaaggattaggctttttttatacgttaattacttaaatatttatttaataaataataacttttataaaattatttattagttttacaagtaaaactaaaattgatttttattaatataattagctcaaacggcgtttttatattagatttctagctcttgcattataacaaatgagtagacctgtaattgatccaatttgacttctaagatatgaaatcgttcttcacaaggccattgttcggtgcaaatgccaaaacattgaaaaaggagcgggtttgtcaagatgttcaagcagcatatcatttttctggttgacatcaatttgggattgaactcattcctggaaattctgattgtaagagtaaagtgcaaattgttgagtcagaactattg

SEQ ID NO: 4489 - DNA, 1387 bp, Glycine max
  Soy_ogl_5887 Gm18:2197001..2198387 Cluster 18
gccggtttgaagagatgcataaaattagaaaacgagcatttattacgattaatttaaattattttaatcatatatcactttaaatcaataatagataaattaatgattttcacttaaaaatataggatatataaagacagatttatttgaaactggtcagctatatatatcctatactttttcacatacacaagctaaatccaaaaatacttttaaaagatcaatttaagaatcagcgttgctttatcatatgaacacaaaactcacgcagagtatgaatagctaattttgaacgatatggtatagtttttttaaaaacaaatattaattaaaaaattggaaatatatataaaacaaagtttgacagaaatcagcattcgtgtattttatagaaaaaccatttcctaaaaaatactagcatttatctttaatttctcaaacattacatagatacaagtgactgaacttagattattgaagaaaagtttcgagttcaaatattcaaaatgaaaaaaaaaataccattgaaaaggagaattctattaaagatagcaaggcatgttttttgaagattaattgtatataattagatataacagatagatagttgatatttataaaattgtcaaaaaacattcaaccgaaataaaaaaggagtagagatacacttacactagtatctgaacttgcgtaacttacagaattaccatctgtttaaaggaaacgtaaattttagttaaagacggttaaggatgttagtttgtcagttagggatatatttacttatacttcaatttgtattaacaaactatactcatgtcgattttacgttagtatttctgcttattatacttgctttgcttaaattataattttggtttgcttagatatcagaatataatcgttgatatgttatagttgaatactcaataaaagatttatatatgttttaacgttttctacgatccaattaaatatatttcaaagcagttatgcttaattatatagtattacctagctctataaaagtagtgttagttatataatatggcactctaattaaaatatgaataatagaatatacaaatatagacaatagtaaaaattattttaaaaaaaaagaagtgcgtgtttaatttttcatgcacaaaggtttatcgggtgtcaagagtaaaactactaacgctaggctagcttccacatttttcattaatttgatgtgattttagcttcaaatgtacgtattttataaatggatccattttttttatcagccaaagaattatgatataaagattaaatgaaggcaccagggtaccatacacaccaagttgaaaacgtaaatcactacaaatatatatatatttttacagaaacttcaaatact

SEQ ID NO: 4490 - DNA, 1815 bp, Glycine max
  Soy_ogl_2603 Gm08:11036001..11037815 Cluster 18
attagatttgaattgtgtgtgtatatgtttgcgaaaaaataatccaagaatataatgtagattttgtaaaagtgtgtatgcgcctgtccggtacgactctatgtaatgttatcaaaagttaaattaatagaaaatattacaacatatatattagatatctggcatacgtaccgttgcagtgttgcattactcaaaaccttgatgcaaatattaaaacaattaccttgaagaacttcctttaactttataaacatattctttcataagtttgtagttcgaagtttgatcattcctacattaaagaaaaaagaaaaaaatatcaaatttaacactaatgaatgatcatattataataggacaagatttatatattcaatttatagacattttttgaattgtttttcaataaaacacaaacatgtgtgtatacatattgttgtaattttgtttaaattgaaaacagcacaaaaaatagctacaaaacaatacttaaattttcttaataaaaatatcatattatgtatgaacgaggaaattaaaattacattattattgaatatgggtatttggatttggttactagaagagctaatgttaaacataaaaaagtaaaaaagaaataaaagttgaactcactagaattggtttagtggtgggaagatttgggttgcttgtatatggaatctttgattcaaactctagtaccatcattgtaaaaaagagtaattttttaaatctattaagaaataaagataatattataaaaaataaataaagataataaattatgttttattttgaatgtaatactttctctcttaattaaaactttttaattttaaagcaatttaatgatactttttaagtaagtaaacatattaaataccccattgattaatttccctttctacctgcctaatacataaatcatatgaaatataatataaaatcttcatctattcatttatgttaagaatgattttaacttcctattttttggtatttaatataaattttaaattcctaatatatcatctactattgttattttctatttaacataaaataaaaaaaaataattaatattgtcttaaaatttttaaatagacacgtgattataaataaatatttctcactacagcaaatgaatttaaaaggtaaattatttcattggtctctttatttttttaatttgctcaagtttgtccttctattactaaagtatttaatgtgatcctttacttgttaaaatatgcaatgtgacaatttttctttctattttttcattaacttggtcaatttctatgtggtagtgacatgttcatttttcattatactaggctaacatcgttaatgagaaaatagctagaaatgatgatcacattgcatataactttgcaactaaaagaccaatcacgatgcacgatacacgacatatgatttggtaattagaagaccacagtaaagactttaatactaaagatatcaaattaaaaataataataaaccaaaagaataatttaaccattataaacaaagaaaatatatcttaataattgctcttaggacaatcattaataggaccttataacttgaagcattcaagagattgtattaacttttatttaattaagatatcttaataaaaccataataaatttcataatagggactcacttgtgcgtactctaccccaatgaatgaactgtcatgtatatttttctttaaaaggttaacaaacattttaatgtattatatcaatagtttaaaattttaatgaaatattaaaaataacttaaataaaaatatacaaga

SEQ ID NO: 4491 - DNA, 1200 bp, Glycine max
  Soy_ogl_3727 Gm11:4423601..4424800 Cluster 18
tgcccatataatagttcaaaatgctactagtgagatttgtttgttcacaggtgaggaaatcaaatgtattttataaaataaagtgcaattaaaagttaatgactgagttggcagaaacttaaatttcccatgtagtaatatatattcttaactcaaatagtttatatccaattaaagacattcatgtagtcttgtagactcggaaaaatgccataagattattttccattatttcacacactatttataacatattgtttaataaagagtatatttggtctctaaaaaaatactactgtttattatcaagtaagatttatatgagtttgtttgaatggataacttaaagctcacttttatttgaaataatatacaatattgtttaacaatattctcccataactaatattttattattttataaagaaaatattaaattataaaaacgtacatttgataacttaaaaacatgataatcatttaatacttttgttttacacttagtaagtttgcgagcataaataacattgatatgagtgattttgcattcagttattttaagaaaaaatttaaatttgaatcttacatgtaaacaaatataattgaaaaaaatagttcactaaagatagtatgataaattgtcaattgaagaataattatcagtaaaattaactgacaaacaaaataatatacacttgccactagtcttttaatgaacacacctacggacaagtgttttaagagtatttaattatgaaagttacaaataaaaagttcaacaagtgcttattagtgtcttaatgaaattagttaaaaatcatttttaataaataatattattaatgtatgtctttttttttcaatgaatctataaactaattttaataataacttttagtattgatttttaactaacgtccttgaaaatttggtgagtaaaaactaaagtttttataggtaccccaacattaatgtattaatgacattatatactgcacataatttccaatattttgtaattttatttttaagtaatataatttagttgtgtttttttggtatagataattattacgtatcattcatgagaaacaattcatttcgaaaggtaaaaatattatgaacgataaaactttcattttaagtgtttaatgtaaatatataattaagattcaaacctaatacttttattaagttgaa

SEQ ID NO: 4492 - DNA, 1495 bp, Glycine max
  Soy_ogl_818 Gm03:3222601..3224095 Cluster 18
tgtaaaatctaaattaggattaaaaactcactaaatgtactttaatttacatttgtagcaactcatattgatcatttaagtcattattatctcacaagaaatgctagtaacacgtttaacacattattatgaatacattttgtactattagtttaaatttgtttgaaaatcataaaattaagtaggtttcacctcatatttgattattttttctctttttttaatggcaaaaaaatttattaataagggtcatgagagtacaagatgtaccagactcatccatcaaatacaattcatgtatcattactcataagaaagtgtcacctagatgataattgtcaaaaaagtacttaattgtgaatttagataattatcttattttttctttcatttaggattttatttgtgtctttttaattataaattttatgaatatgtaattttttttctttagtttatcattttaataggttacttgtgcttattaatggattttttttttaagaatttgaagtgggttgaaaggcatcttagagaaaagattgagaaagcttaaaaggtaaagctatagcaattttggtttgagttggaaaagatttagtttaagccgatcttcattgaaaagctagattttttgggattatataaaaaggggccaaatctccattttaagggaagactccattgcaagacaaaaacaatatttggtgaaggaaaagcttttccattgttcttttctttcattttttcctttcatcattgttttttgtgctacccatcagaaaaggtagttagatctcttcattgttgagattagattgtaactaaagcttattatcatatgttttttaattactcgtttttattctccattgtcgaggctatatttctcgattgtaagagttagattttaataattaacaaagaatatgttaataaatataaaaaaaattagtaacacacttttaactcatgctttctgatacacattgtattatgtttaaaaaattattaaaaaaataattaagagatagaatcattaattaaaagtgagactcagaaaatttataatttttaatttaaacttgaataaaccataaatgtgtactagaaaaagtatattagaaattatatttttatcatttctcaaaatataaatatctgctttggggttacgtaccttgtcaagtgaaaggcacactttctgtgcgaaaacgctgcgggctggtttatgtaacatctgaaaattgttttttcttccatcgtggattaaaaggaaaaatatgtgccaaattcgtccctagtgcttaatttgagagttgagacaatgaaatctacctgaattgtgaacctattctttcgtgtcaagtgactttatttcttttcttttttcttaataaaaggttaataatagataagaaactgaatccactaaatgggagttagattttatacaagaaaaaacattttatttttaagcaaagagatctaatcc

SEQ ID NO: 4493 - DNA, 2220 bp, Glycine max
  Soy_ogl_1481 Gm04:47943981..47946200 Cluster 18
tattgcgaacaaaattagagacttttcatttttattgctttcctaaaaatttagcttatatattgataattattacatatcatgattattattatattaatatttattatggaggacttctgattacatctcgaaaactatcaaaaaagaacatggtgtttgcgtaagaaaataaattattaataatgattgatattttaaaatatcatggaaaaaatattttcattttttttattgtattttaaattttgaaagaaaaaaaaaagaaatcttcttttgtaatagtgtgatacgtgtgttgatagatcgtcaacaacttttattttatattttatatacaatacatgatatgattcaagcttcgagaatgtacaagtggagtgtcaggtattatttttgagtatgagtgagttgatgcagctttcgggaaatttgtctcaagtgcctagctttagttaatccatgcatttttaacttatcttcatttaaacatgcctttgaagccttgaggattgagcaaaggaaaaccatgaattcccaggaatgtctacatacgcactgaatcttgcatgggttttcgtctgagtgcattccatcatgtcatggtataaaaaaaggaaagaaattagggtaaagaccctagctatctcaagtacaaactttcaaaattcaggaagataatcattgtgcagcatggggattgattcaatcattgaaggactcgtattttcttataaaaatttcatttttaattctttgttttaaatatttatataaaatcattttttttatttaatgtgcaaaactgaaaaagtatacagaattgcatttttataattattaataaaaatatttctttaatttggaaaatgtttgttgagttgatcaatattacctgactacttcttgactaacaagatggtttgattttattaatttaaaattatttaatagttaaaataaaattatttaataacattattaatatatcataaaacaatgcatagtcaattaattatttttatatttatattaaattcattgaatatatacataacctacatattgagctaagtataatcaattttattcttgaagagaatgtatatatatgtagatagagaacgtttctttcttccgcccaaccgtattcttaaataataaggagatattaaatatttaactttttttttttgctgagcttaagaaaatctcttaatcaaaagttaaaatttatttttttatgatattgagattcatttaaaaaattaacatcttttaataataaatatttttcttactcaaacagaaactaagcatttggaattgcccatatgtttctgtcattagaaaattgagaaaggaaacttgtaagacacttgcatcacatcataaatgaataaagaacccataaactatcattaatacagttttttctaatacttgtttcctctgataaataatttaattttgtaatccccttcggcatcggaacatttttttttcaattacttgacgtgctatatcttatcttaatctggacaagcaacaactttgaccacttatcattacccgtctttgcttgcgtttcaactttcaaaccagaattgggacgtagccgcgtaggtagcttacagcaaccaaaatccattttctatgtgtttctttatgtactagtatgtttttaattaagatccaattcaatttaataaaaaaattacatagtaaacttaagttggatctagttgccgagtcaactcatattttacttaggatactttatcaccatcaatgataaactacaaatcgattattcaggaattataatttatgattatgtatagttacaaacaaaataatcctaaacgtgtaacattatctttaaaaacttgtccgcataatatgtaagtccctcaagatataacaagtttttttcaagattaatttgagacaatagaaataacaattttttttaataagaaaacccaagaactcagagtaagaataaagagtctcatcttcattctctaaaatttttcaatataaatattcataataattaatcagaaataattgttaatcaatataattagaatgaaattcacattaaaatatgtaattgaattgattaaatgatatgttatccttttgaaatatctaaccaaaatatacaccaagtaatatttcaatgagtaaaatcgtggcatgtcatcacgaaaa

SEQ ID NO: 4494 - DNA, 1546 bp, Glycine max
  Soy_ogl_3932 Gm11:36913101..36914646 Cluster 18
tgtcttataattaatctttaggtggaaaaacacaaaacacaaaacacaaaacgcaaaactttagctaaaaagaaaaaaaaggaacctatgacgtttgttaaggcctaaggggatgagattgaattgaaacattacgataaaatgcaatccctcattgtctgtacggaggccttctgtattgcatatttgcattccatgaaaaaccctttcggaaagtgataagaaagagacattcaattttcattcgtgtagaagaactaagaaggataaaattactcctcaaaaggataaaaattcaatcctttaaaaatattagaaaatgcagcaaaaatatatatattaaaaatacatatttttttattgtaatttttaaattttgtagtatttatttaattttgtataaaaatattcagttatgtgtatttttatcagtgaaatttacacgtacaaacaaaaagtggttaaaatacattttaaaatattcctagtgtctgaactgaacactaatgaattacaattagattaagtaatccatgttacacaaaaattttggattaattttttttagaaaattgatgaagcaattcagaatttaaaatttccaaattatattacatgtgtgtgtgcgctcaaattctataacaatatcaaattgaggaccaatttggttttatttatttatttttaaaaactattctataaaatggttttgaagaactatttttcaaaaataaataaatctgagaggcataagtttgtgtttaaatagatcagtattttaactagttgtaacctgcttacttggttaaacgaatggtctgtgagcctctcattttttaaggtaagtggtctgtgagcctaagtccatatacttagtcttatttaaaattaaattgacttaattaaaatttaatctttaattatttaaatgctttgctataaactaaagtttaaattaaacttaaactaagaattttaaaaaggacagaatgagaagttttttttaaataaataaattagatttaagtatcgatttttaaaaaaaaaacaagttaagttcatttaagaaatacctaacttgacctaatcatctaaggtaaagtttaattcagtgcgatttcactcttaattagggtatatcgatttttttatttttacaaaagtgttttttaaatggaatacaaaaaaaacttgtgtaaccacgtttatgatatggttggctaggagggaaaaaaaacatatataacaatgtattttctttgtttaattaagaactctttttttaatcaacaatgtaaatctcaattttttctctccatcattattttattcccactctactaactacatatatagagttagtcatgaaaacaacagcttagaaaattactataacgctttttcattcaaattatttaaagttttagacaaattttctaagagtatatttgagagttgaaattccaaggaaattaaaaggagggttttttatttttatttttgataagtattatttgaatgtatcttttttaaataagagaataat

SEQ ID NO: 4495 - DNA, 1986 bp, Glycine max
  Soy_ogl_5860 Gm18:1289586..1291571 Cluster 18
atttattagaaacaagtactattgagaatgcattgcaaatttctgttagacatattaagacagtatttttttttattacctagtaccttgaaaatattcattaaagaaacgaaagtatttttttaatgaaaattattaataaaattttaattttaataaaaagttatatcatcaattcctcaactagtatattttaaagattatttttaataataaaaaaacatttttgattttaaaccagtgccctaaaagtatttattaaaatttgtttgtataatactacctgtgattcattttataagaaataaattataatttgtttcttattatattgtataacttataaatattttaaagaaataattgtctattaatttgtttatttttactttgttttcaagtgaataaatagagagaaatccttgttaattttgtcaccagccttttacatttaaattatttctctcttattatttagttttcgtatttctttaattctttcttatatcagagcgtggattgaatggatggccttgccatcgttgaagttcctatccagaaagtctttttcaatcgtgatgttactacccagggctacgtacatgttgacgcctaaaataaaaggtccaaactacacacgcatatactatgtagtatacactgtatatagatttcttaattaacttattccttgaaatgtactacaaattaatgcaaacacgtggccctagcattaatctgaccaaaactgttgagctaattatgtattgtttaagttacttgaacatgtaaaactactttaatttgtattaactggatgtggtcaccgtcccctccacctacaaagataagtggtaaatcaaagaaagattgggaaatgatgatgggacctctaatctaatgcccattattgtataattgatgcttggaatcttggacatacccaatattgttctccactgatcatgctggccgttcgattttttatggacggtccgatcgacaataatcaatttcattgctgatcctctgaatgagagaatactatatagaatagaatgaaatttttatttttggattggggggtctcatgctcctacaatttgtcccttaattcttgtacataatttacatgtggggttgtaaaatgccgcatctttttcacttatttctgtttacattacaaattccacatatacacggagcaatgaaacaaattaaggatcaaatgctttgattttccatttattgtacgcgctgtataatgtatatatacttgataaaaaaatgtttttttttttatactttcttcttctttcacctaaatgcatccctgcctaaagcattatcagaatccatattttacttaaattcatattgttaatcaattaatttgtaagggataatgatatgctaatgttaacataaaaaaatggtgtactaatgttcctagatctaattttaaaattttcagatgatgccgaagatcatggagacaaataatattatacattactattttttggtacagaatatatataaatcatatatatttatataataaaattgtgcttagttttcttttataaatgagggatagaaaaaagaggggagaaaaaggtaaataatgtgttgagaataaataaaaatattatataaatacgatatctctttctattttataagtataaaataaatgtaattaatgaaggacgtacacttataagttaaaagaggtaatgtgcatgttacgtaggtggcggatgcaaataagataatgctgtacctttttgtttgagaaagggttagaagctttctcatgcatacacgaaccgctgtatccgaaatgccactaaagtgataaacaaacagcttctgattcatacagcaataatacacaattcaatatataatttgttgtattgatcaaataataaaaaggctaaaggagtcttgttagattgagaagatttttagtagctgata

SEQ ID NO: 4496 - DNA, 2300 bp, Glycine max
  Soy_ogl_598 Gm02:41665601..41667900 Cluster 19
gaaataaagactcaatcctaagatgaggagtggacataaataagaaattagagttataattatattaattagaaaattaacagatagataacaatttaattatttgtcatacatatatatgcacattttgtcacaaagttcagctatcaattttcatgcaataccgagttttcaacaaaaaagggttagttttcttaacctataactcaagtatatattatagtgcgttcgagagaaattcttcaatgtgtgtgacttataattgttgcaaatttaaataatataacctgtcacatgttagatgattaattggaggttcttaatatattttatcgattacttatctcaattttttggtcggttactttcttgtatggacttgtgtatacaagttatgtggacttttatttttacctcctcttatgagactctaactatttaaaaattactttcccaataattattatgagattaaataaatgaactcgtttgtaaagattgttaatatctcttttcttcagtttttttatcgggctcttttcttcattttcacaatacttaaatccgacataactatttaaaggaaccgaattcttttttacctatagacccacaaagtttattactaatgaaaactaattgacaatatacatatcattatcttaaataattacatgcacccttaggtcatataattactttacattttaagtgataatgtgtttgtaattgatttaattagtttaatcaattcatgtggtcaatgttgttatcttttataatatgagaatatttattttttagagtaaaaaaatagtagaataactagtttttatttttaaaattaatcgtggctgaattttgttatctgcactaattacttttagaatgacgttcacttgggctaactatatttatcaacgtgatatcaaattaattatcaactatcaattgtaaggtttaaactacccaattataattagatttcatcagaaaaagaaaacgaaaactaagaaaattcagggtttgcttcagaaaatggttttaattagtttaattttattttttttataatttttaaaacaaaaataaagtgaaataaattgacatttttataacttttccaaaatagaaaatattttctcaaaaccaaataaatctttatatacacaatgctatatttatatttgtaaagaataaaataatcttagatcttttaatataaaaaaaagaagaagtaggaatatgataaaaataaacaaattaaagttttttgaataagaaaaaatttatgttaaaggagaataaattgtgaaccaggactatttgcgtttctcatcactgagaaaaggcactgcatgtgccctgagtcgcccaaaatcaacacgtacgtttgtatgcacttccatatgttgtttcgaatacaatatgataacaaagcaaataagttcgaaaacgcaaatcgtaagactgaggtaacatttcaaatgaccaacatatatgtttgtgaggcaagttatgacaaagcatatggtgttatttttccatatatattaatgcaagttagtccttcatctacatttgtgagtggtccatgacttcaaaaaaacattgggaacatgggggctatggaactaattaaagacaagaaggttacaaccacttgagagaggaatagggtgaaataggccactcttatttctatttaaacattgcattttggaattttggtcactcccatcctagtgttattgggatttataattacttttttttaaggagagattcataattactgtgaagttggtttctatattagcacaaaaatgcacaaagataggaaaaggtgttacatgcactaagtgcatgcaatatgaaaagataacaaagggcaaagaagagaaattattatttattatatagtctcaaatgactatgtttttaactatttttttacgtggcatatagtctaatttatttattttttaaaattaactacgtatcatgtaaaaattaattgaaatcatgaatatgtgatagtccaaaattacatgataatttctacctaaccatacctctcgtcaattaaaaaaggtagccccaaaaccccttactttttcaattttttcaagcacctgactagataggtgcaaaagagtccaattactatatcagtgtcactatcttcattttcccaacaaagtctgggatgccactacaacctatttcatgaaaaatacatattgtccccagatactcaaatctacaccgcactaaaacacaactacacaagttagctt

SEQ ID NO: 4497 - DNA, 1147 bp, Glycine max
  Soy_ogl_382 Gm02:4712262..4713408 Cluster 19
ctttgactaatacattttgattgtagaaaatcttgaatttactactgctacttttttaatgaatgtagctcatcttatccaagcatgtagctgtgtgtttttgtccaacaatgaatgaggagagaagggaatgataagtgcgagtcccaatactcgttttactctgtttcattctcgagccctgtgtttgttcccgcaattgactacctatcctctgcaactttatgcgcataatataccatgtactaatatactatacccatcgtatgtattttatactcacaagtcactgtcagaactcaaacaaaaaagacacacacagatttgatagttacctctccaaacttgttttttttattaataaataaaaataaaacaaattagattaattataataagaaaaaatatttgattgagacccattatgctatgaaaacttagggtgaggaaaatataaatattataaaatttatgataggatagcaaaatgatagacaaaaaatgaaaagctttgataggatatttaaaataaataattatttgtatattattgttcttataataaaattattttacttttttatgattattttctaagtgaacggtttatttacgtatttgttttataattagcacatttttctagcgtatatttacatgttttgaaaaaaataataatatatatacttacaatgtaaataacttgtatactgttaaacaatagaaattactatcatatatagtaatttggttaacttttatcatcactgttgggtttactttttattcttccacgtgatagtagtaatataaaaactctttataccttaagtatatagactattttcattattattttaaaagttatttctcatttaatttctaattgattttatactattaatatataaaaattaaactatttttaaatagaataatgtcatgtcttcttattttatcctcctactaaaagtgttcgtacgtgggacgagttaaaatagattaacctattttttcattgacctaaaaacttgttagagtcaatttaatgaacccaaacctgataaaaaaaaaactctataattgaaataagatcgagtcaaccaatttattggaacaacatattaatcttaacattatgtataac

SEQ ID NO: 4498 - DNA, 1513 bp, Glycine max
  Soy_ogl_5566 Gm17:7512701..7514213 Cluster 19
ttaggcttcattttagaccttagaacttaaccaacaatattatttcgacttctttaatttttatcaaattggttttgttttctaattgaagtttaacgaaaagaagcctggaaacttacgtgttacaagttctctaaacgagaccttagaactagaaactaaaatttaattttaatttttaaaattttaaaacattttaaaaactatcaccccagaaccttacttaaattaaaataatctctcaaatacttataatttacgcattggttataattaatttacataaacttttaaatatgtgacaaagtaaataaatttcccttctttataactatatattaacattgaaactaaacaaatatttatcaaatattattttttaggttatttaatagctaaaattatcagtaaaactgcataacattatatattgtatatattaaaagttcgagtaaagtaacttttatctaacagctgttattgtgtgacgttcaaggaatatttttgtttattattctctcttctaatccaattttatcaatccttatcttttgataactcaacgcgatcgcgtcatcctgttataataattacgtgcaaagatctgtttatctggttatagttgattaataagacttaatgtcgttttctgaagcgagatattgtggatgaaagaacgaagatagtgcacataataagtaccgtttgtctcattatgtattgtagtgtaaggtactgatcaacttttttttatcagttttcatcttctgggaatcttcctcggtacatcagtgtttccccttaatgcctattttactcaatatccctattaagcatgccaaccccaaaaagagtacccgctttgtcttcattcaactgaaagggacaacaaatgaacaaaggccttggacacgaacttgtgtttttcacgttgaaaataattgatagaaatggttaaaaatgaaacaatttctcaaagctaaaacataatatatttactatgaatttagtttaaaatatatgatcacttattcaaatttaagcaaaactatattttttatcctttaagttaattaaaattttccttaaaaacaaagctaattaaaatttcagtttgatttttttatttaacttagttctgtgagttatttttcatactaatgtttttttttctctaactatactttgtttttccaattttgacaaaagttttataattgataaggtttgaatttatgatctcttctcctcttacccttcgcagtacttaagtccctaatcaaaatttataatctgtcatcaaaagcctcctgaccatttccaaccacctcattttgtcttgctatccattttaaaatacctgataactatgataaaatcattataaatatttactaaatcttagatctttatttctgtcatcattaaccatcttcaccttcattatgattttatatccatcaataaaagttcgaaaagaaagtttacaaaccaaaaaaaccacttaaaagtc

SEQ ID NO: 4499 - DNA, 2100 bp, Glycine max
  Soy_ogl_6148 Gm18:53124701..53126800 Cluster 19
ttgcatgattgtgtatttgtgtgtgtatgcatcaagggtagaaattctttgatgatagtctaactcaagcactctggaatgtaaaattaaagttcaaaatatgtttgaaaattgaaagttctaatatgcaggggaaaaataatggattaagaataattaatataattaattatcttgtgtcatgtgacttaggatttatagaggtgcacatataatcaattaaccaggtaagataatcaattatttaacccctgacaaaattctttctcacacagattatctcataaaattataatcaatttacgactcaattccatttgttaatttgtttgtgctaaagttttggatgaaagttatatatgtaatctataactttaatgcaagttatgtacgaacaattaaaaaaagttttaattaatttatgttttacttgttaaatgctactttttcatgttatgcaaaactgataattttttttaatcataatataagtttccttcattttattaatagttttctatcatatattatttaattatcactagtatcttctatgctgtatagattacatatacaacaacaaagttatataggttatatataactttaatgcaagttatgtacgaacaattaaaaaaatgttttagttttttatttggtacttgttaaatattactttttcatgttattcaaaacccatataatttttcttttttattataatataatttttcttcattttattaatagttttctatcatatattatttaattatcaccatacagtatcttctatgtttattgaaatttggtaaataatacacaaattacgaagagaaccagatactccatttctcctcaagaccaaattagatgaaggcagtacataatttaatttaaaaatcaacaaagggagaacaatagtcttggtttactagtgtataatgacattattgagaatttgacatatatttttagtgacgcgacattactacatacataaattctttccagaattatatgggtagagtccctcttgctaggtccacattcaaagctcctcctttcacccaccaaagttaggaaatatgtgtcagcttcacttcacacttttcatacaaaagtataaattaatataaattaaatcgcattatttggaagtattgttgactcatgccactatacaaccaataagcttaattaccaaaatatatgtaaaaaaatatttaatttgcctatctgaatagttgtcaagttataagtatcataggaccactcaaataatgtctttggtcgtcgagaaaaaaaaaagatgattgcaacttaacgtataaatagttgacatttgattcaattttggtatagaaccaaacttatgctagaatcatgagatggtttaaaaatcattagtgtagtaccagtagtaataatttttacatactgcataaattatttttatacaaactcaaattagtagtaataaacaaaaaattgttattgacccatacgaattacaaatccgtaacgattttatgaattcataatatatattgattcatcaaaggaaaatttttgaattattccaaatggtttgggtgtgcatgtatattggtgggtgcaagaagcaaaagtgggattgctgaaactttgttcatttttaaaaccgcaaacacagttatactttgcatttccaaaccttgttgtgccttcttcattgaccagtcgaaaaagcatcaattttctaccaaaaatgaagaaagagcctggattggaagatgaagttgatccatctcacgtgcaacaacagtgtcctcctccatcagcgcgtcgctgcttaccactatcaaccggacacctaacacgcatcgaagcactatgcttggtaatattgttcgtaccaatacactgtatttagggtttattttattgtctctcacggagccaacatcatcttacccttacgattctttgcatttcctttgttttgttaataaagtatattaatttttggataatcataaagagacctgaccatttagttttaattaatcaatgtgcattacgagtggaaaaaaaaggaaatgatagtgttatgcatgt

SEQ ID NO: 4500 - DNA, 1813 bp, Glycine max
  Soy_ogl_6609 Gm19:47304701..47306513 Cluster 19
agataattaccacgaggatcacaatacttgagtttggagggtttttacatgtattaccttcgcgcccatggagaagtttgttggaggactagaaggatgacgtggcagaccagcagcttgttaagactcagcagacaaatacccagattttggcaagtataataatgttataaaagtattataaattatatgatataaatatttaacgtatataattaataattcaaatacatggagatggaggtgtgcatgtgaataggtatattctattccattggatggaaatgatggctatggcataagtagttgtacaatctcatcacagtccggaattactcattgaagagggtcccatgtgtggaaagaaggatcattggcccccaagcaaatgcaagcatatatagagatttcttatgtgcattgggtcctgcatgcatgagctaagctatgtcccattcctcttcatccatctctaaagaccaataattgaatcgaaaggtttgttgcatgtatgtctcagctgagtgttgccgctctctgcaacttccttttttgaaaattgaagatatcatatattgcacatgtgtgtactcatccttaggccccaccttcaactatgttcagaggtgtacttatactgggtccataaatttgaggggcccagatttttattttgctgtaatattttttaaaaaacattttaatataattgatcattcacacactaatcaatctggccaatatatatatatatatagttcacgcaccacttatcgtttcaattttttctccatttctcaattcagcgcattcaatggcagttccaaaatttaaatctcaaatttaaaggctacaaccaattgaacattgaatttccaccaaattattcaataacctacaccaatttctagctttatggaaatggtaatattttttttatgataaaaggtatagaaagcaagaaactgagagagaaccaaaaaatggagtaatacactaattattaaaaaataagagatcctttatttattattttacactggacccataaaatgtcaggactcatcctgcttaattaggctgaagatcgtgacattgccttgtttattgcctgtcttggcttctttccttgtgtacccgcccgcagttgaactttcgagtatactaattaatgaattttaataaagtttcacattcttgcattctttttttccttccggagattaattctcgatccatatgtgtatataagtgttgtgtgtgtcagctatatctctttttaaatcagtaatacaaagatacactttttttaagagtaattatcacttttaatataaaatattatttttatgtaataaattcctaggacgctagctagtataaaattatttaaaatatttttaggataaaaatcatttgtattcaaaatagaaaaaaaaaatcaagaatcaaatttatagcatttatagaaaggtaattttactatgttattattaaaaattattcagaagttattttctaattttaaaaaatatcgaatagctttaaattgattcgcttttttaacatacacaaatttttttaattaaaaatattctttaaaaaatacaaacaaatagccttggaactattttgaataaatttctccaaaaagaatcaaacatttctcatcaactaaattcaagttatgcactttaacatcaacataaaataattaatgaaaaaaactttttagaaagaaaggtgcataattttttttatttatttacttgtttttttttattgtgattgtcaagaagtttatccaaatgct

SEQ ID NO: 4501 - DNA, 1140 bp, Glycine max
  Soy_ogl_1311 Gm04:38616763..38617902 Cluster 19
aaagtgatacatattccgatactttaaaaattgaaacatattggtgtcgtacctatgtcagacactaatatatgcctttgatacatctcgatacctattcaagaagtgtccaattttattttttttgaagaaagtgtatggatgcgactaggatacggctccgataggcttaggatggctagacacggctccgataaggctcacactgtttttgatatggctttgatacgacttgagccacttttgattttttattttatttttttgttttaactttaggatttttaaaataaaaaaggtccagacatacacaaaacacaactcattttctcttcccatgacataaacaaaaacacaacatacgccttgcctcttctcaaggcttggcaactccttttcggtaggtctggatgttcttcatatgagcgggtttattttttgagcaagggtttgtaatatttgctaaaacataatttgtatatttgcagtgttttaactgtactcaagagcttttgcataattatattttaacactagctctattgcattttattttacatccatatataattttttattaacgtatttaggaggtgtcatatccttaatctatctatctatgtgtaaataaaaagcttgaaactttgttgttagatcgaaattctaatttgataataattgttgatttgatttaataaatatctagcatacttgagcatttgttagtcattggatcaaaattataatttgacgacaaccattgatttgattcaataaatgtctagcatatttaagaaattctaggtcattagatcgagattctaatttcaaaacaaccattgatttgatttaatgcaaattttacttttataaaaataatgcttgaacatggtagaaccattagatttattttgttaattttccaacaactattgtttaaaatgtttgaacagtttagaagcattagattttttttattcatttgcaacaataattgatttgattttgcattttattcaatattttcaagtcgttagatcgacacataacttcaccgtagtctttatatgatttaatatgtgatgtagcattaatggagaattattaacttttaacacaataatttaagagatagtacag

SEQ ID NO: 4502 - DNA, 1600 bp, Glycine max
  Soy_ogl_2814 Gm08:36416101..36417700 Cluster 19
tttaactaacttttcaactaattttgttatactttttcaaataccttaattagcatttattcttatttatttatttttttctattttcattatttctcgtacacacatactatataactagactttaataataatgtactgtttttttttcattttcaatcaataaaaaattgaaagtataaaattactttacattattttctttatatatatatatatttattctttctcttactatgtcttactaacacataggatagtaatatttatcaatatttttgttttatatatagcagtctatgttgaagggagggccggtgaggtgcagtcgttgaccactaccaaatcgccaaaggaatatgaaacagttattgatttgcatgggagttgaatttgatgtctaaatatagaatgatatctcggttcactattcaagttgcttttgctgaacgttcaccgttcaagtttgaatatgtaacctttaattttattttttcgttaacagtttgaatctaattaaactttgtatcatatacaatatgcaacaaatccattgaaatatatagtactcaacattaacaaattccaagtcaaataagaagactggtgaaattggttcgtacatctaaatttcttgtcctatcttaaatttaataaataacgatttgtgcacaagatagtcctgggttagtaaaaaaagaacaaaataaaagagaagaaaagtcatggaatgatctggtgtatgattcttaccaatctctacatgatgatcaaattaatatccaaaatcctaattattctctacatgacacataatcaagtgttattaattttttttcttcaattaaaaaacttaaatatgtatcacttagtcaccattaaaaataaatagtaatttagggctatctaataatttcttcttgcagagttatggacgaaggtgggacaacatatttatagaacaccaacatcaaattagagaactttttggtgttagtcatacacacaattttaggcttttcttcttcttttcgactaaagactttgtgatgcaatccaaagccaagatttattaatatagaataaaagtatactaaaataatcaatcaagccaaatacgaaataaacctagaaaacacgtgttatgcattttaaattaaggtttttcattttaatatgtatatattttttataattaataattttatattagagattagattttataagtagaaataaataaataatttagaaaggtcttttaagctatttaaaaaattaaattaaacttttttattatactcatttaacataattttttttatgttttataattttacaaaaggtaaaacaaaaaaaaaaatcaaatgccacaaacattttccctcactttaggggaaaatttttgtgattataagtaaaaacatttatttatttctcaaataaacagtaaaaatttgatcttttttattatatcaactcatctctattcaatttttttatttacattaaattttgtttcgattagtaaaatagtcaaagaggaatgaataacaagaaaaaataagatgatataaataaaataaaaggagagtaaaag

SEQ ID NO: 4503 - DNA, 1195 bp, Glycine max
  Soy_ogl_120 Gm01:38611236..38612430 Cluster 19
tctaaaataaaaatatttgatcttctatttttgtaaatatgtaattttggtctaatcttcaattttgttaatgtttcatttttattttgatccaattaaacatattcattttagatgaaatgatttaattaattagaaaggaaaaatgggaaattaaactaaatcatattatctattttaaaataatggacaacaattatgaatttgatcaaataagagacgaaaattgtattaagtttttttcttttttttttcttttggtatgtatagactatgatccaaaaactgtgatgactccagaccaatactttagagttgttgtattgacaggttggctaacgacttgaaggagagcaagtcaattcaatttacaaagtctcacacggatttcaaaatcacatgcacatgtgaagtggcgcagttcacaagcattgctttttgggttcaaattatttatcaaaaaaatttcataatatccataatgctatttaacatttagaaagaaaaaaacataaatataatacaatttatgatataataaaaaaataaaaatatatcaaaataatatttaaaataataatatatttatgtattattactcttactttaattttttagcttgcaaccaagtctatgagagacgaaggccatggtatgaacgcgatttgaacttaattgaatttattaagtctctactcgcgaagttggaaactagtctatattattactggtgtatagtacagtttatgggaaaaaaagcatatagtacaaagaaattttctaacatttttctctcgtgtttaccaaataaattcttgttgtttcattcaaagaactgacatattttaattatatcgatctttaatatttcacaatatctcaacatcgatatttatcatatttattactttttatctcttttctaaatatttcataaaaatttatctttattttcacatattatccaatacatttattgttcatctctcttcttttatctctctcaaaatacagtatgtaaacttaaaaaatattttttaaaaataggaatacatttagttttaaataataatcactgatagtaactatattgtttattttcgtaacaataaaaattcatatttaaatgaatttaagaatttaattcataacatgttttccttacattaaaaaatgagtatttttcacgcgaatc

SEQ ID NO: 4504 - DNA, 1870 bp, Glycine max
  Soy_ogl_132 Gm01:40136331..40138200 Cluster 19
ggaaaaggctggtttattcatagagtagttgttaaaaatttatctgactaagcatacccgctgaagtttactagcagatttttggtacatttcattcaactctggcaagtaattttgtttcatggacttaatctgcaaaataaaatcaaccaaatcaaatagggatcggttaattagaaaccttgtcgtctcttgtgcaagaaaatttgtaccattgttccactaaggaaggatgataaaaaatttctcattttgtaatgcattataaatttcatgcttaattgtgcacacatcatgcatgtaagataagcacctaaacacttggagaaccatgtcacttaatactccatcaagcgtaccatactactagatgtggaacttaagcacaccaaccatgactttgaatattaaattgaaaacttcaaaaatctcactaaagaaataccattcatatcaacacaaagacatgttaacaattaccagatattctcaatacaaataaccaatagagaataaaacgacagcactaaaagaaattaactctagaaaaaaaaacaaaaaaaatccttattgggtaaagcacaagtaatttctactgctacattacacattttttcaaatattatgtgaaggttcatcaatatatataaacattgagtagtatggatttaagaagagttctcattatttttcctacaagactactgaagagtttcattttcttcttgataatttctcacaataaaagccatcattcttcatcattttgggttttgttcatttgacaaatatctgctgttcaatccaattcacttagaaataaaatgataacaaaaaactacattaccttaccttttgatacacttcttattgccaatcaatatgaggtaggggaagttgccttgactgcattggaggcatagctttcttatgtctttttctatttatgaagtttataatatggttctcatatgaacctagtttctctatttatgaagtttataatatggttctcatatgaacctagtttctccatgaaattgggtgagatgttgctcttagaaacctgaaggaatgctataatacgttccagcattttaaatacattcatcttttcaagttgatctaactttggttgtgttggaagggaattgtgctgataaaggaaagatacagggttaaacatagtaaaaataatttacgaggaaaaaacaacaataaaggactccctttgaggaaaggtgatgacctgatatagggcttagaacatgctacaatctctagagtttgcaagaataacaataatggaaaaagattatttatcaatagcagttattaaaaattgtctgacaaatcatacctgttaaagttgggtagcaatcttttggtacatttcattcaactctggcaagtaactttctttcatagatttaatctgccagaaacaaataatcaatgcattagaaaccttgcaatctcctaccagtgcaggaattttgagcaattttctccactatttattcgcaatattatactggatttgacattgatagctatgtttaccgttgttacaactgagtccgaggataaaaagataataattaaaaaaaatgattcttatggaaaaccaaaaaataaaaatttgttttggttaaagcacttcctgccgcacacatttaatttaataaggaaaaaaattataagaaaataacatattacatgttgatacacttgttcttgccaatcacccccacttgactgtccggtctgtgcagttgaatccagaggagaagctacaaaagatatttcatagacacatgagaattcggccaaaataaataagatgataatcaaaacaatgccacaaaca

SEQ ID NO: 4505 - DNA, 1356 bp, Glycine max
  Soy_ogl_591 Gm02:40862301..40863656 Cluster 19
gaaacttaaaaaattaaagattaattacagtgtaaagattgattcaaattgatctaatttttgaacttttcaagttttccctttaacttttgcattttcacctattttactatcatgtatttctgtagaaatgtccctgagatccttgtttgattggtcatttgctttcaaaaatttaatcaagtacgtacttttactatgaaaagtgaaaaatactggatatatatatatatgtgtgtgtgtgtgtgtcggcagatcagaaagactgaagtagatgaaatgcaaattcgacattcctatttgtgttccttcactgttgtagcatacaacaaaagcaaaaggtgatatagagaagaaaagaatatgtaaaatctaaaacatgtatatgtattcaatgaaaaacaccggaagtcttaaattttttttttttttactaattattgtttatgataaaaagatgaaaagaaaaaacaaaaattaggcctaaggaaactcaaatcacacactttttgttgtctaaaaaagtataaaccaaacaggaggaaacttccgcacatatgacaccacaaaaaataaccatttactaatgaataaaaattaaaagggtgctaattaagattgttttttattgatataatttttttaaagtcaagtttaattaacggaatatattatacaaacatttggtatattaataatattctaataaattatttgttaaaataaatatatcatactattaatataagcttatagtcatattaattaatagttttttccttagcgaaatatcatttcaatagaagttaatttaatgaaaaaatatctattggatagatcaatccattaaatgaatcttaatatttttggaggattagtacttaaatttcgattgaaagatacctgattaaaaaaaaagaagttaatttaatggttaaccgttagtaaataatcactattcttttgtagtgcatgtgtgtatttgaatgaacgcctcttcatgtgtccagttttacaataaattcttcacatattagattatttttttaattaaaaagtcttcataattataatccgaaatatatttgttattttttttatcagaactctcaatttgtatacgttctttctagactttattgtgatagttattaagttttgatattccataatctacataatgtatttcgtttacccccattacaaatattccaatatataacttttgattatgctggttatattcttacaagctgagataggaacaattgaaaaccactacataaacaactaaatgatcccaaaatgcgtttcatgtttgcctcttagtggcaagactgaattagaaaattaggc

SEQ ID NO: 4506 - DNA, 1263 bp, Glycine max
  Soy_ogl_1320 Gm04:39339538..39340800 Cluster 19
catcttaactattactccctctgtttcctatataatagtcgttcagaggattttcacggtaacaaacaaatgcaattactccactctttcctaatcctaataaaactgtagacacttttcctattaagtctcttctctcactccacgtttttcttaatgtccataactactatatactcctatttctctctctgtgtccataactaacgcatattcctaatttcctataggttgacatttcattaattatctctaacgtgttttcctgaaacaaagtaatttcgggaatgtaagctaatgtttcttctcccagccaaccttttggcatctgttgaagcatttctctccctttgttcaattaatactttttaaacaaaattaaacttccctctataattttattcttaaaatgcttaccaccaaaagttttgattcgaagagacattaagatctttcctatttatgttactttgtacttgcatcttaccctctttctttttaaatttagattcaaagcatgcattatcattaattcgatctcttttgttgggaataagtcatttatggagaagtggaagagctggggaacgtgtatgtactccattgcatttaatttttctttgaagttttcaattatttattatttaattttataaaaaaatatgtaaatgattaaatgaaatacgagtataattgaaaacaaaaattaatcttatcttcaattttgaaaacgacaaataaataagaagatttttttttaaaaatccgacaattaaaaagggatgaagggaatattattttactaaaaaatataagcatgcaccttaggatagggtgtaaatggtccaggtttaatcaagtaatttagtctatatatttcaactcaacctaattaaatttaattggattgagttgatagtgtatgtgatgagattgagccaggattttgataactcgttgattcgtaagaattcaaaatgttgaaataagtgttgaattgatagttgattcctaagaatgataagagattgaaaaattgagaaaaactttcaaattttcattcaataataaaaatttccccctttgagtacatatgttttctctatataaggaaaaattaataaaactccctagaatctaaataaaagacaataagcaaagattatatatttctaatatcactaattaatatgttcctaaaatagcattgcatatatgataaagatataatatctttattaaaaagaaaacataatatattaa

SEQ ID NO: 4507 - DNA, 2041 bp, Glycine max
  Soy_ogl_2349 Gm07:16876960..16879000 Cluster 19
cttttaattagagacatgaaaaaaatataattattagatgaataaaaaattatatgtattttatctttcgactattttgtatttttgacaaaaagtcatcaaattatttatcaagtaaataacaaaattatgttttgtattaatctaaattgatttttttttttttcaaatcaaatagatcctttaagcattataatattttacatatttatatgtagtaataggtgacacacaatgttgttattattattttttaaaggaaggggcggccccaaacccaagatcaattaaaatgtacaagacaataggtttagtctataaacacatatattttcataagaaacaatcatatataaattagataaaattattataaattaataaaataaatctttaagtataaaacacaactgcatgttcaaaatttaaaattattaattaaaccggaacaatcccacaccaaagttaattcaagtgtttggtgataaactacagtagaattgcatacacgtatcgtcacccctaagaggaacaaaaataaaagacgggatcctggtcaaaactacttaacttgttatatagcctttgcaaaaatatgcttgatactgaactggggcaacgatccactcaaacgcgcgacttcatccgctaaaataaattatatacaattgtcattggtcaatgacgtgataaaaaaaatccatatatatctagtatcttcacaatgatatgcctcgtaattatatgataactacaacttgcactttttaatatgggggaattaggtattagcttacttgggaagccgtccactctctaatattttgtatttatgagtggaattttttgtttatttatttataaacctataacttttacccttctaagattttttttttttaatttcgtgaagctttttttggcctttgaaaaaaaaaacatgtgattcaatgatgcctttattgttaaatggtgaatgaatatgaccaggaaagttttatataccatataatgttctacaatgatatgcttcgtaagtaaatgataatagaagagaatttaaaactcctttgtcaatagccactaagaaaaaacaacaactaccatatgataactacagctagcaggcctgcagtatatcattgactttcgctcattaaaaaattgaatgatttaatttttttatagcaatatgaattttatatatcactttgtcaaatttatatatggaaattactttgggtgtatacgtgaagcttattttgtctttttggaaaaagaaaaaaaaaacttgggattcaagtgacccttttattacaaaattgtgtatcaattaccctacagggcgcagtgcaagacgaccaggaaattttgatctatacattttcgtcaggttctagatgatgtgtgaaaaacagatatattctttacacacacagtgacctaaaattagttatagcatcaattctcatgcccatgcattcacttcttttagaaatcgttctttaaataaagattaatctaaactaagttttcctttttgtcgatctgaaagattatccttcgcttcatagtttaaaaccaatcaaaactgtttcaaatctctaggcctggatatactttttcttctgtttttacattttggtttttcattaatcaaataaaagtttccaaactatgttcttaaaactaaataattaaaatcaattaaaataaaatggatgaaagtgatcgttgagtttgcatacgtatcttgtggatttaatttggaaatagttaatgatgcttacagctaggtataactattttttttttacagaacagctaggtataactagttgcatcaataaaggggaacaaatttaataaatttcatgacaaagtaagcagtgtagcttgtacttacatggctggaaagagtgatgtgggcagtaaattaaggtgtctcagcgcgccagtgactcagtactcgacactgattctgttttagaaggggcatatcttttttcttggggatgtatagttgttattgacctggtta

SEQ ID NO: 4508 - DNA, 1900 bp, Glycine max
  Soy_ogl_2828 Gm08:39589801..39591700 Cluster 19
acacgacaaactgaaagtaattattgtgcgggtggttcaaattgattttggtttagcactatacgagattaaatacaagtttgtttatagtaattggatttttaaaactgtgttatgtagtgcaagcacaaatttttagtgcttaacaaatttgatcgggagattttgtttataataaattgctatataatagtagttataaaactattcttgtatatttttagaataacttttcacgtgcaggttatgataaataaataggaaatttttaattattattaaaaaataataaattatagataaaaactttgactattactttttaataatattttttctctctaattcaatacttttaataatgattgtcaattgggctttgaaaattgtcatctgctatatatttcaggcacgactttacaacgattgaaaggaaaattgttcgcattttaaaaaatattttctattttatatttcatggataattttacaattgtagacaagaaaattattagcagataaaaacttttatttatactatatgttttaggaataaatttcaattactgttaacaattaaacaaattgtttcctattttatattttaggcacgattttataaccattgataataaaagtattcacactaacaaaatcgttttctattgttttttttttggaattattatttaactgttgacaagaaaagtgttgtttaaagtaaaaaagaaatgttgtagtgtcacatattacgtttttattaaataataactttttgtaaaaattgtactaaacttgaccgtgtaattattcacttttatattggtgcttattgagactttaattaataatccataaaaaacccctaaattttttttttatgaagttcgttatccacaaaacccacaccacatccaaataaagttcgtcctacaccagtgcatgtgcgtaggtagtgccatgccttaaccatacatgtgaactatacaattatatagattacgtattcatacgtgtattacagatattatggatataaaaatatcagctggcggatttatctaatcttaatatcaaataatttacgatttttgcttgaattcgtttcaaattattttagaaaaactcacactcaaatttatgaatagattctaacttaataaataaaattaataaattgtttatttaaacacacccttagtaaatacattcattggcaactaaacattttacagtactgtatttggacagtgatattattgctgaagaagacaaaaattcgaaccgtctaacttgagagagaaaatcaaatgttcattgttttgaatactttgtcttttagagtataagaagagaaattatgttggtgaatctacgcttttatcttctttaccattttgagcgcagacaagagattttaagtgagtaagtgagtgtgtgtctgcatgtgtttgcattgtaatctaaagcttgtcaaacaaaaaaacgttattttcagcacaaaaaattgagaagcaatcttattttatctcattgagataaacaaagttatgtgatgcatgtatctgctataccaaaacacaccttaattaattaactgatttggcatgttttgaccattgttattactctttcatcactacaacatttttagctttagaacacgcttttatttctatggttcaaaaactgtggttagaagattaaaaatgtcacaattttttactgtggctaggaagcgtgggctatttatattatgtcatgattttataagtgtgatctaaaatagtccacacttttttattggagtacattaagtcacaattagataaccgtgatttataaaatccgtggtttattcaaaatcattgatatataagcccacggctaaattaatgta

SEQ ID NO: 4509 - DNA, 2171 bp, Glycine max
  Soy_ogl_3109 Gm09:35134001..35136171 Cluster 19
ttatgataaaccaaacatgacagtgcggtatatagtagccttgtaacattgattcaagactgcatggtgaaaacgaattctagctatttttttttaagaattggggaacgatataataaagtttttttttcttccccattaattgtaccaaacaaattcactatttttattaacattttccagattcggaattttttatagcatcgtcttgggaaaatttatagcacgagtcttaagttctactcaactaattaataataagtgacgaaaaggtcatctctaactgaaggaaaaaataaaacgaaaacgcatccaattattttggttgcttctctgagtacacatagctgagcataatttgcaaagtatcagctattatatgacataaaatactgtccatatatgtttacaaaaaaaaatctctccccccaaccccccttcccttttttctcttttaaaaggtgaataagacataacacctgataatacatgtaaagtctatgcttaacaaccacatgctttaggtgaaattatttcatcaccctctcctcaccaaaaccaagtataatgtattagctttgacatttcgtcccaatcttatattgctgtttgttctccctccctctaccaccaatcccctccccaaaaaaaaaaaaaaagatatgatatatgtcagaagacacgttgatcgaagattagtaattagtaataaaaataacaggataaattcaaaattgcttgttcatttaatttaagtaaataaaaagaaaacatattagttggatgtttaattaatgatcaatggcaggaaggcgatagctatccttgtttctcatattgcatctataatgatacaatatattgcagtaatgataagaagaggctgctggtagttgtgacacatgcctatatatgtttttattattattaaataattaatcttgaagactatattagttaataaacatgtgttacagatttattgaaaattcgtaacgaaagttcgtttgtttatttttcagtcacgagtaaggagggtaatcttactagttatatatagacggagccatggaggtaaaaaaacaaaatcatataaaccttgtatgattttatacctgacaagattagaaaataaatactagcataatttatacatgacaagattttataaaaccttgtataattcatgtagttgatctcattatatgaaaacaaatatgaataaactaataagcatataatcacaagcagccaccatatatgataaatttcattaacttatttcagaataaatattccttaaaagttatattaaaaattatttttaattagtgtaaaatgttttccactgataatgaatacctattaaactaaaaaaatagtgtaatgaagattattttaacttgattagaatgtgtaataatctaattaatcttacatgtgcggcaatgtgaaaataacagtacgtatttcgattaacagtgattaataagataaatatcacgcaggccaaaaaaaatgtaatctcaccattaactcgatattaatttcttttagcattatctttaattaacaccaaaaactatatacgagtatagaaaagaaaaaaacaatcttaaaaagatgatacgcttgtatttgggaaaataagttatatcttacatgttttcatcttcctgaatatacaatttataaactgtatgcttgtatctaactaatgcatattttgaatgtaaaattaactttgctaaaattgattaccttaatgacatctggagtcaaaggtaacgagagagattatctccggcaatgcttaattaattttcaattcaaaagttgatttttttcctctcttttcttttaccagtttctttttttttaaatgattcttatttaatttgaggtacggtacttaaaaaaatagaaaaaaaatcttgaataaaataaaaactatatttcaaagagatagataatagttcggttgagaatatgttcatattcaaccatgtggaattcataatataggtgatgctttgcaaatcacaggtaaaatatttttttaagttttaaaattatattttaaaaaatttttagttattaataaatgagtactcatcgaataaagtagtttaaaaatattttttaattatactttttcatattttcttata

SEQ ID NO: 4510 - DNA, 3064 bp, Glycine max
  Soy_ogl_4053 Gm12:15868801..15871864 Cluster 19
caaaggtttgattaatttccagatgccttcttttgtagccttctcaccaacttgaaacctactccctctgattgtgtcatttcctcaccaacttgcttcctctgtttgctttctttcttcttcattttgcttcctccatttgctttctttcttcttcatttttgtggtctgtctcttccatcttcacttccattttatgcttttgttttctactgagttttccaatttctgtttgaataaagggtttacttttgctgttgtgtattttttttagggccaagattttacttttcttttctattatgcatgtttacttggtgattcattgttctttgtttcgtgtttctattttttttcttctgattttccactttatttttggttccttttttatcttctcgcttaccaggctatcgacgaagaagcatcttgtaggcaagtttttttcctttttgctgttgtgcatgtttgttgttatgcatgttttcttcttaataatagttattttttcttactgattttttaactctgtttttggttcctttttattgtcccggactatcgacaaagaagcattcaacaaataagttttttccccttttgttgttatgcatgtttgtttcattaatatttgtttctattagctggcaagttttttttttcccttttgttgttgtgcatgtttgttgttatgcatgttttcttcttaataatagttattttttcttactgatttttcaactctgtttttggtttctttttatttttccgggctatcgacgaagaagcatctagcaggcaagttttttttccccttttgctgttatgcatgtttgtttcattactatttgtttttatttgtaaagttctaattttgtttgttgttatgcacgttttttcttaactaatggttatttttcccggttgtgacattgatcttggctgcctgatatggtatttaacaatggaactatgcatgctttattttcgagaagagggttagatgaagagagatacaaggggattgtaaggatgcttctcccacacctcacagatctgtgaacttggagtttcattaattgaaaaaaaaacaaacggtaaatgaaataaaattcagaacctgcaaatatcaactcattaaaacacattattacattttctgatcaattcattataatgctagagtcagcaacaaaacaagcgtaaacatgcataaaaaaacacaaagaaagaaacttggctgttggatgttttttcgtggaccacattgcaagcgggaaaatcagaaagaaaacaaaaacaaagcgggaaaaattagtaaggaaggaaaaacactgagaaacgaaaagcaaacatgcatcagaagaaaagcaaaaattcatgagaacatcaaaaacaccaaacaaacaaccatgacttaccaggaaaacatcaataacagcaagcaaaagtcaaaactccttcactcaaaaaaaaaatggacaataacaaagggaccaaaacaacgaaaaacaaaaagttaacatgtatgagaacgaaaagaaaatatgcatgagaacagcagggaaagaaaagcaaaacctgatttgccgtcaaaaaaatgcacaacaagaaaagcaaagtggagcacgatcagaactatcctgaagaacgaacaaaggtgaagatggaagagatgaacgatgatacaaaacatcaatgggagtaggtgcagaaacaatgccgatcattaagcgaaattaaatgggaaattgaaatctgccaatcaggaagcgccatgtggcaatgacaacaaaaaaacggtggcaatggcagcatttcaggtatgggatttttctccaaccttattcttttaaatttgaagcggtaaggaaatgatttaacatttctttgtgattgcaggttggcaatggttgatcaaaagattacaaccatcacaaaaataagtgtcttcttctccaggcttctcccatcgtttcctcaccaaattgaaacctgattcctccgtttgcatcatttcctcaccaacttctatttgcttcctttgtttgctacatgaagtttcattcgtgctttctttcttcttcgtctatattaagtcttataaaagagaagtatttggaaaagtctgttgtgcccctacctagaattttgacacgtgtggcttattgattggcggatttaaacttctaattttatttcacttctgcgttgttttatatgctgttgcgttgtctctctcaatcatctctttctccattttttgcttcgtcaatcttctcctcttttcctttgattttttttgtttcttccttcatgcagacgattactagcgattccagctccatgcatgcaagctgcagcctacaattccaatcgagaatgatttttttaccacaacacactcaccttcaactatcatctttttttttttctttcactacaacttggtatctattttttttttttttaaaaaaacttccttttctctgcgagtattttctactatggccaaagaatttgtaaagggatctgttcatcaaaatggcgtcgtcgtcataaaccccaaaccaaaatttaaccataattagtaaccaaagagaaagacacaactcccgtcatcacaacaaaaaaaatgcctttaatattgaattctattttttttattcattgattaatttaatttaacattcttttttaaaaaattgtactatattttttataagttatctttgaccttaatgggggagatacttttaactcttataaatattttattagttttgattcctttgatgtcattaatataattattgttttattttttaagtttaattacacattttatcattctactgcgataattacttatgaattttattgtgtaaattaaatttttgtaaatttgactattaaatgtttttaaatacattctatcattaaaaaaatttaaactacacattttatcattatattaataacaaaccaatgttttcttgaagaataaaaaaattacgttatttatataaattactaacttctttttattgacatgtcaccattg

SEQ ID NO: 4511 - DNA, 1600 bp, Glycine max
  Soy_ogl_5085 Gm15:24241701..24243300 Cluster 19
ataaaaatactatctttgtttattattttaggaatgttattgtcatgtacgttacgctgtatttctgtccatgttgtaataacaactataagcctgtagtttttacacacctaaagtgctagatctgtcgttacacccacaaatgattgttcaatttattagttaaaaatgtgtttcaattagttaacaggttaacaacatatttcctttccttaaaagtgctagatctctcgttacatccacaatattatttaggtgttggtaaaagaaacattttctaaaaataaaagaaatattttgttcgcatgatcaaacttcaaacagtttaagtaatatttgcatgtacgtaatctataattaaattcttaaaattattattcaataacaaatggaataaaagtaggcactcctgtgctttcttgttattattatcttagaaggtaggtgaaaaaggatgagaaaaggtgaagaagcaatttaattgagaaagcgtaacaaagtttattttaagtcaccgtttatgcagacaatatgttgggagactgggagctctccgtttctttaatcaactcagtttgcatagttaaaatatcatttatcgtatgatgacttcaatttgttttgtttgggtacatgacttgaaaaaagcagttaactacgttcttagcaaaccatagcataacacaaacaatttcttttatccgtaaaaattaaagatagataccaaaaaaaattataataattcatctaccatgattaaccaattattaagctctaccctttagtagcttaatattatttatgtcgtattatattattgcttataaaatcagttacttcaagcttatattagaaattaatgtatccaaactatactgtttgggagttatagatctgaaatatagataaattttttatatttgcttgaaacaacataatgaccattgaaaatattatttacccaaattttgatcatttttatacgaaaataattgaaggtacgtaatttgtcgtttttaaagtgataataaattaataaggttgaaatacttccatcaataagttttcttaattttctaagtttttgtattcttgtgttttgctagccaacctctatgaacaatcagttacaaaatgtgagtcaataatctttataatatccacccggaatcgagggttcatgcatgcacctttatagccatttgatttggcataaaaagacatccacgattagtgggggtcaccaataatagaaggccaaataaaaattctaattgcaggaatgcactggtctaagaatgacgcatgtcttagttcgaattcatacgtactaattaacaaaattagaaagacacatgcatcaacagtcattagcaattactgttagaagtggaggataggccagcatagacatcaagtggttcaatctcttgctttagatttttctaaaacacaaatactaatcagcatcctaaaggcaatgatatgattaagaagtttaaagtaaaaatatttctattgaaagatgaaaaattatgctgtttatgatttttttttatgttttcctatgatttatataataaatattttttttaatttc

SEQ ID NO: 4512 - DNA, 2900 bp, Glycine max
  Soy_ogl_6076 Gm18:20720701..20723600 Cluster 19
aaattgttttgaaatttgttcatgaccatatccataatgcttcatcactaccaactgcattaataagaatgcactttcatgactgttttgtaagggtacgtgcttcaatctttaagcttctgccatttttacttaacaaatacaatgttattgttagattaaggttaaggagctaactaagatgaagcatttcagggatgagatgcatcagtccttctgaacttaacaaccaatcaggctgagaggaatgctcctccaaatctcatagtaagaggctttgacttcattgacagaataaagagcctagttgaagctgaatgccctggtgtggtcttttgtgctgaatcctcactttggctgccagagacactattgtagcaacagtaagtactcaattgttatcaggaaatcttaagagtataagtacaatttcttattcacctttattatctttacactttccttttgagaacaagaatgacccatttgctggtttatgccattactgacattggctttcagggtggacctttcatggatgaatcttgtatcatttgttttttgggtttgattatttatgctatgctatgttttttttattagttatgttatgacatgtggtgtctgtctacatatgtgtgatcctatatggtatggttgttgtatgtgtgttggaataagtgggttctattgttattcatatttccaactttgctggtagatcatgctcttgtaataagaaccagaatttcttgtgctacccacaacgaagttaatttatgtttagtctttttttatgtactttttcactgctattctcaatttaattccttgttcggtttaattgaagatgaatgcttgttcatttattttaaactaacagaaaatgtgaatgaaatatccaaggcaaaaacaacacaatccaatatatgcaaagtggtacttgtgatcttgtgttctataaatatatttcttctagatcagaaattttacttggttattgataaattgattattgatcaataacatctatcacttcggaatgaactaatatggttttaagcaaaaaagaaaaactttgttaattgaacaacaaactttgttgaccaataatttttcacatgttacggggtgtaggtccagtattaaatttaagataaaagaaaagggatgtgtgaacattgcttctgttttttaaaacgtgaagatttttaatacattttttttataataatgacaatttatcattatttgacacttattttttatttttaaaaactcccaatttataataatgattcaaagcatataatggtgatcacaaatttctttactgtgctagtacttaaaatctaatgtactgttatggcaagatctgaatttttttattagattacagttttgtgtctagctctacctatatatcgtctctgatgatggttattatactttatgcataagaaattatttgcttaacaatttgtactataataattggaactgagacttgtgctcatagaagtgatactactgttgactatatttgatgcttaattgatataggtaagccagtttaagtcatcaagttaaaatagctttttggtgatgctaaactgaaatttgcgttgggccctttatgaagtttcaccatcttttttttttcggatctgcccttgtatgtgattttagtttttttttttttcctttaattagaaatatacatgattttaagtttaaattttttctcactattcaagtttcattatttttacaattaagtaaatatttagttgttattaaacttctattactttaaattcttattttctaatcaaaatctttaataacttagttgactaaattttttaaactcttcttttgttaaaaaatcattaataaaaattaaatcttactgttcaaatcccccgccccccaatctttcaaactttataaaaatttcactaactttttttatgttccaaatccatcgtaaattctcaaatattggatagaaaatgataatttcagaattttagataaaataaaattgacaataggagtaaatttaattgactttaaagagagaaaattttaattgccttaaaatctaaaattgcatacactcttttttaaattgattgaaagtgcaattaagtcttgttattattaaattaggagagtttaaccttttctccaaacaacaaccggaattgttccagctggaatcattcttattacgatttttcacttacattttagatgttaatgcatgaacagtggatttcatttgtatcatgtaagtgggattttagttcctggtcattgatctaggtcatagttattggatttcacttgtgtgactttttctattacccgtggaatataagaaacatttactttatattatattaaattgaatttcattagctagatagtggggtgctagatagtggggtgttatattaaattgaatataagaaacaatagagctggtgcacctagcatggccaagactttgaagctaaatgggcaattagataacatcagggccttacttctggattctatgggcaggttggttgattggacacataatttattctactccactccctgtagttatatatctttttctacatttgagtagtgatgaatattcatgcataatatttaaattaatttaagatattgttttcaccaaacatgtgcaagttaaatcccatgtgaatgagttttttttcctgttgtccgctggcctggtatggcacgtttgtctactagaattttattcctttttactttgattgaaatttacccatataaaattcaatgcatggagtttttttttatggaaaaatttaatgcatgaagttgtcggagatactttatggtattttctt

SEQ ID NO: 4513 - DNA, 1891 bp, Glycine max
  Soy_ogl_6109 Gm18:48960801..48962691 Cluster 19
gttatgatatcagaattaaacacaataggttatatatgtgttatctttccctttaaattgtcttctgtatttgattgaatttttgtactgaaagcaaattaagaactaaaatattgtgaaattttgacttgctatgccataagatatatatgaacgaaataactttgatgaaattatcattctgtgagctccatcggattatcaaattatacaatataataataccaatggatcgatgaagttctctcgtcattttctatcattttcgttagtttgatattcttaccactcattctggtaaactacatattgaagttagttaacagcgtattacattgatcccgtggttgctattaaagttaacgaatttagtttacttgacgcaaacaacttaataactgtaatccacatcaaatataagataaattcgttgaagcttatttattgaaataagcgtttatattaataaaataagtttttttttaagtatgtttgtctaaactacttatactttaaaaaaaattgacttattttaaaaaataaattttatctgtttcttacaaaaacgtttatataaaatatttattttaaatttattttttaaaaaatttaatgaaacctgtccacgttttgtcttttgttataatgattttcggtgttgcaatagtactacagacaaaacgtttcttggtaattctattcatcattttggaaatactaatctgagtgtaatgaaataactttaacacgtaatcaatagtcaatccttaattttttttcatattcaaaggtagtttagttataaagataatttcaggaaaaaaaataagattttatttgaataaggttctccatataagcatttaaagggaataaaatgaaaagaaataaaaattaaataaacatctcccactagttaaaattagtttatatataagctaaaattttatctcatttttttctgccaaaaatttattttaatttatgtagacactaattttagtttatagaaaatatttattccacaaagaactgccccctggagattgagtttacacatacatttttattccattttattttacgctaaaaaaattgtcgtttcttcctcctttcatgtcctatcaaataatttgatattttataataaggattataaaggtttaattacattttgaatccttatattttagcttactggtaagtttattagttctattaattttaactacttatattttattcttatagttcatcaataatttaaattaagtctccacatcaaaatttcattcaataattaacagaaaatgggtcatgatgtacatattatattgttttgtataaattagcaacagaaaaatgtatcaagtctttaaatataaatggaaaacgaaatgtataaaatataacaattcatgtttgtttctttaaacatcatccagttctttgaaaatgtatataactgtcatattagtatctaaaagtaagaaaattaaaaataataattaaaaaaacaaactcaaaaagtgtaatttttcactattttaatctaaaatttaaaagtactagtatttgattgagcgataatattaacctatttttaaggattaagataacaataaatagttaagtcatacgtgtagtttgtttaaactaaaaaaaataattttaaaaaagtatttttttaagcaagtgatttttaataatcaaatagaatttgtttcttacaataagtaaacaattatttttttaaagcagaagtagtttaaaaaatatactaaaaaataaaatgtttcttaagtattttttcaataaataaatatgaacaaactgatctattattaacagatgttaatatttagtttctaagttgcgattttttaatttt

SEQ ID NO: 4514 - DNA, 1800 bp, Glycine max
  Soy_ogl_6718 Gm20:31304301..31306100 Cluster 19
tccttcatatttaaatataagggtaaaatatatacaccctcttaactctgaattattgccctctatcagcttacccgtcttgcattatttttttctttaattaagtatctcttctaaatgtctcttccaaaaacactagaaataaccgaaaacaaattacaaattccaaatgcaaatgatcccaattatcaaatattttaattagtataaaattaacaacatctagttcaaatacgtaatgtaaatataactatataactataactacaaaaataagatcataaaaataaatgaataaagtaatattaaaatttaagataatcatttaatttcagagtaagttttctgtgaactatggaaaccttgatgatgatggaaatgagaaagttcctctggagtcccttttgttgaatctgtcagccttggagatgaggtttctattattgttattgatcagccaaaaagtagcacatctagggcaattaaagtcgcacctttcactgtttcatgcaaggaaaatgatcactccaaaccagcacatctaggccaactaaagtccagtcttcctctatttcctgcaagaaaatgcttgattttgacaagatcaaggttgaaaagtagctgcctatgttcaactttatattgttatcactgtgtcaattgtttagtatttaagtttagttttctaaagccacataaatcagtcactaggctgttgtaatgtgacatagttcatttgtacgattgttgtaattttctgttatttttgttattccagttatttcctgttgtgtgtattgttgagtttgttttataataatttcttaagactttttccatctaatttttctttatgtctttatgtaacgtttaatatttttattctcctctacaaatatattgacaaaatattatgtcagaatataacttcttgagatgtagtattagacaagatataatttttcagttgctattgcacaagattcccataccatattttttctatatttattaattaatgtaatgatcctgaataattaatcaacgggtaactacattattaatcaaatgtaatcatcatgcaaatggtacaaacactatcatttatttatacatataaaaggtttcccattgtattgaatctctcttggtgttaaaagatgttcatggcagctttctattaattatatgtccttgtaatctcgaaaatgtccaattagtctcactaaccagtcctataatccaaaagaggcttaccaagaagtagaatttgctgaagtggatggaaatccatgcttttgacaattgaaccttggttgagagtcatcacaacagtcttgggcaagtcatcagaggaataggagctctgaccatggctctggccagagtaagcaacgggaagcaaatttactggtagattactgatctgttggaacattttaacagggaccaatcatatacaatgaactatcactctaaccagtacacttttcaaaactgtatagtggataaaacatattcaatgaactatcactataaaatgcatgtgcacacaaacaacaatgaaacaaagggaatgcccttaggtatagataacaacttcaaactctcatttttaaattaagaaaaaacaaagataaatactaaggagcaaatagaaagcaggtactgtacttcatctgataatccaaaaggtcttgttctcttcaatacatgatctgaatcagcatccatagcggggttattggtaggaggggttctgggctgctttaaaatagctgctaccattatcacaagtaa

SEQ ID NO: 4515 - DNA, 1400 bp, Glycine max
  Soy_ogl_631 Gm02:43543001..43544400 Cluster 19
acacccgagtccgcttttagcattagaagttgtatttagagtaattttagaagttttatacttttaaaaaaattgcaagctcttatttgtactcacaattggttccttggaattttactaaatggtaagattttttttttttgagttgtacaacatttgttttaattactacttgtatatatcattattatggttaattgtatattttaggataattgatgatgcagataaaagggtaaccaaaattaattaatgataacggtcggatgtgaaagaagaagcgagatgtggaagaagaatcagaatgctgaattaagatgataaatttcatgttttatgttttggaacctttgttaatacgtgacagtgtgtatttttttttatggaatcctattttttattgtggcgaactgttatgttatttttataataataagctttctaaatttttttcttttattatgatgattttttttatcaacaaacaagaaaaactttattatgtaagaggaaatagggtacaaggggtacccttcccatacagcctttattatatgatgaacttattatttcttgtgttagacttcaccaagttgtgatatgtgaatgtattacctatattaaataatgatatttaacatgttaatttaaaattttaaagtatgccaaagtttttgagagcacaaagtatgacaatgttattggccattgaaatgttaggaaagtaattattttacctaaaatttatatatctttatgttgttaagaaaaaaactgtagattcacgagttaacccatttggcctttaacctatagctagaagattggattagactagaaaattagggttatattgacccaaattgatagttctacaacatattagagaataattctttttttttctgaatagagaataattctaaattatcttataatgatattatattttattaattatcaattttgttaatatcaaggaagttattaatcaacgaagttatatatagtttatggtgaaaaaaatataatttactgccacaaattaaatttagtttgcaaaagaaaaaatgattaataattaacgtctttctatttacctatttagagcattggatacttgttaagaaaattgaatttagttaattaaatatgatgcataaattattataaaatcctaacattgtattcataaaaaaagcactggatccttaattctccctaatcttgatcgatttttctcaatttgtttttccccaagtaccccatgcaaatttgacttgaagatgtagtgatcaatgctagctcaaaagaagatccgtttctttcatcgaaaacgacaaaatgaatcgttaggtatagcccaatttaagtgggaagctaatagatttattaattaa

SEQ ID NO: 4516 - DNA, 1700 bp, Glycine max
  Soy_ogl_849 Gm03:4644901..4646600 Cluster 19
ttgtggtttgaactgaagaggtaccaaagtaaaaattcaaaatctaaccggatcaacaagactgttgttataaactaaatcatctctacttgcaaacagataacaaatgcagaggtatgttcagattataaaagcatcacagttaattatgtttgtgtagaaagatgatagctggaaattgacaccatcagaaacattcgtatatatatggcctgcagattttcaacatttgaaaattcaaacgaatatgctcacaccaataaaattaaatgaattgaatttaaataaaagaaataatttactaacataacatgactgacaaataaccttgtcaagcaagtagtgagagattcaatctaaaatttgtgtttatgaaaatatattcattgagaaatacacgaattcacccaaaaagaaataattttcaagataaatagaggggaccatgaaaatgttcaaggtaggcgctgaaaattttagtgactaggttgtctctattcagcgcgttccatgccatttggaagaagaaccaacccttccaccatttatagtcaaatatcaaataacaataaaagtttgatgacaaattgctttatagaggagtttgacacaaatcacgagttgattgtgtgcattatagaattcccatcacataacaacaaaccaagaaaagacaatatactatcgaaacatggtaatatatcatttttgtctgccaatagaagctaatgggatttcgatattactacatttgtagccttcgaatatcttaaaaagtagtatttgaagttcaagtgtctttgaaacaactcaacaaacaccattttgatattaaaaagaataggagttagataatttcagcaacacctgttttgaaacgtgaatgataagtgtgcaacatttcgtcacatatgtacatccaagtgaaggataaaccatacaaggtaaacaagagaagcacatactttttcaactcattttgagtgaaaaacaatgtcttaggtacgacattgaacgataaatttggatctgataaatgggatttgaagttttaatctcaaagtaaaaacattattacctagtcacttagccggccagaattggaaaccaatccagaatactaaataccataaaaacttcacaaacgttactgtaactaatattgatgtccagaaggtactaaaagtgaaagagctattatagtagcatcacactcctataaacatattttttctattgattaaaattcactaaaaattatcgaatgaggataaataatcattaaaaatatgatttttaatagatttcaaccaataaaatagagtgtgttcttaaaagtgtatttctaacatttctcattatagtaatattgatttattggacaaggtatagctggactcaattgacattgagtgagtttcacaagacatttcaattaacttatcatttttttaattaattgaaaaatctgtttggctgttagataaataaattttttaattaactgaaaaatctgttggatcatccaattaactgaaaaaggccttttcagaagtgtacaaaataattaatgtattttggaaacacctttccggaataggggggcatcagtgctgtcgtgcttggtgtttggttccaccacttcgtcgaggctgcaaaagacttctccattgcggttaaaggatgaggcatttgttgat

SEQ ID NO: 4517 - DNA, 1900 bp, Glycine max
  Soy_ogl_2304 Gm07:9343501..9345400 Cluster 19
ggggtattttggctaccatatataaagcacaattcatggcaatggctaatgtacaagggcggcaacaaaccaggaacctttttctcttcctggtgtttggagccattgcagtgctttaaatgctgttgatgttcagagaagttaacttaactatgacattttttggggcagaaagttaacttaagagaaatgattttttgatgtatgtaatacttgtacatcttgtacagattgggattggggtgtatttgcatccttatcattatcaatactatacctttcgccttttaaaaaaaatgaaacatatatattacttttttagtttgttgagagagagaggaaaagacaaaaaattatcactacctttctcaaaattaaggaaaatgtatagaaatatatggcaatagcaatttgttatttatcatcacatactttcaagtataaagttcagttactacttttcaaagcatggctgtggctgagaaaaatgaattggggagtaagggagcacacggtagctcatcatgtgcaatgttctgcgtaattgatacagcgtgaatctaattcccgctataaagatattgatttgattttttgtcttatgaacacaattactgtggtggaaattagcatttgcttttatatataaaaaaaaaagtaatcaatttatatacaatactccttccattcttttttaattttctgcttttaatataaattttatttatttatcatttttaaagtccaagataacattaattcatttttttttgtcaattatacctttattccaattaattatttacatattttttaatacatgctctgaatctaaatttaaaaaggaaaagggtaagatgcaagtacagaataacagaaatggaaaaagatgaatgctctatgaaagatcaattagaagaagatgataatttcgtaaaaagagttgaggactcctttgactgcatgcaagttgaaagggttgaagactccttcgacaacattcaagatgaagctgactcatgcttgcaagaggacaaaatgcaagttgggagttctgaagttgatcaagatatggctcctctttggtgattcatggaggaaaacataaagctccaatggactttgacttaaatgcaaaggcagacagtggttttgatttaaataaatttccagaagaagaattttctgaagagggatctcaaccgctggagagaaagatgctaaaaattcttttacctgcgttttataatttagagctctgtagtaatgaaataatggtgtcagtatgcttgatactgagatattgttaatgcttgagggttcttgatagcaggtctgttatgaaattattgcggtcataggaagggtagttgctattgttattatagtatatattgtttcttcaaatcaaaacttttggtggtaattaagcattttaagaataaaattagagggaagtttaattttgtttaaaaggtgttaattgaacaaagaaaaatgcttcaacaaataccaaaaggttggctgggaaaagaaacgttagcttacattcaggaaaacacgttagagataattaaagaaatttcaaccaattggaaactaggaacatgcgttagttatggagagagagaaacatgagtataccgtagctatgaacattgagaaaaatatggtgagggagaaaggacttaataggaaaagtgtccacaattttattaggaaaagagtgaagaaactgtatttgttggttacagtgaaaatcccctaaacgactattatatagcaatagagggaatattaatatacttgcgtatataaaaaaaagtaatacatactattaatatatcaaatattatttggtataatgtgtgatattattagtatgaatacattatgtata

SEQ ID NO: 4518 - DNA, 1532 bp, Glycine max
  Soy_ogl_4276 Gm13:26307669..26309200 Cluster 19
gaacagaaaaaatatatatgagccatatgcttaattaatgccttaagttttagatggagttatgattttcgattctcttgatagttctagtcattagccgattaagtcttgctactttttcggattcgctaacaaatagtatcaatatttagttagacctgagggggagcaagatccttatatccaaagtattgtatattgatggcaatgttggttagataatgtgtcttgttaatggtaatattaaaggaaaccactcaataaaaaatatataagaaatgtaactcatatacccgatattaatgaaaattagtctctattaattctcttaattctcctaatcatcattactgtattaatcattctgagtgctcactcggacttctatagtagttcttccaaatatgtaatttgaattgtaaatcattcaaatccaattcccatatttttaatgatgatgagtccgaatatgtatttgacattgccaaagaagattttgagcccttatgtgctgctacagaaaccggtgaaactaaggctggatgaattaagattggatgttgggagtgcatcatacatttcaatggagaatgtctgtgctgacaatttagccaatcatactctgcaattggattcccatgtgctagtagatgctccacttcttgtcgcctttgattctcgctaatattatttctgtggtgctggtacccgagaagttgtagttttcaccttcttccttttaggtttctgcccaccccgaggttataatatttgatataatattataataaaaattgagatataacatatatttagtatttttgttgattgaggttcgagtttagtagtttacaacataattttatcatcacaattattatgttttaggtaagtgtaggctaacagcataaacctataaagatttatgcttcccataaagcaatctatctgtagagctgcctttctaattaaatttaaaagtgcgccacttaaaatctaggactagttagattatacatagaataacaatatttaacttctgaagagaaaagaaaataagaaattgtaattcataagtgaaaaatcgtgagaataattttgtcgagtgccaactacatagagtatataaagataataattgcattatttaactaaactaattaacctctcattcaagtgaatgaaaaaaaaaatataatttacaaaagaaattttattaaattcaaattttataaataaaaaaacttaattgataagagatttcactaaacataaataattaaatttttaaatagatattaattattaataaaatcaataaatattttacccttataacacgaaaaatgaaaaaacaaaaatgaagttcagataaagaaatatgctccttcgtatgaatttagggtacggaattttagacaacagcatatataaacctacctaatgctcgtcaaatactttttatatataatacttgtataataaaatacgagtacgtcgtttcgtactacatatggatatggttaatagga

SEQ ID NO: 4519 - DNA, 1600 bp, Glycine max
  Soy_ogl_5042 Gm15:13419201..13420800 Cluster 19
aatattattaaatatttcctatgtgaagaagtagtcagagtgaggttaaggtttagttaaatagttagttgcaagttacttaaatgtggtagctgacttagtgatcctatgtttgtcttcttgtttgaaacccttcaatcgtaagttttggtcgatggatttttttccctcttaactgtttcatgtgttagttttaaataattaaacaattatcatgcacttaattactctcaatgattttatataattcacatgctttgatgaaacaagaaacaggggattttagcttaacactttctttggactgaaagtatcgacttttaggctttacttaggtactactcgggctttagtttagctaattttaataaatatgtttcggcctataaaaattaatcgatcctttctttattgttatcaagaatatttttgttctagcttagcagctaggaaggtggctagtttaccttaattaatcagatattgactacaatgttataaggacatatggttcattgatctattgaatgatgaaagtaacacctaaaactcattttcagacacaagcacattgtatgccaaaatgtttagtagttttctgaattcttatatgtgtaggtttcatccaaaaagaaagttgaaagttacttaggagtgtcaaatgggaactgtatttgaaaggctaatttaatagcaatatttgtagagaaataataataatttgacgatttaagtatttaagaagttaatttaataatcaaagtttttaagggaagatcaatttagaggcactatatataattattttatctatcataaaactggagctttactaattagtttagaatgtttgtttctcctttaagcatactttatgttaggttaattgttatgctgctgttagatctctagcattaaagttttaataatagtacacaaaatataggataaatatgttttcctccctctaaaatttttgtaagttggatctctagccggcttttgtagcaaattctatttgttcttcgcgctttgggttgtggggcttactagccccagtgggagtagtgtttaattataacaagatatagtactaatgtataatttagcctacataaaatttcctaagcttaatcttttgtttttgctgaatattaaataattataccataaataaaacttcttaagcttaatcatatacaagaaatttatatttgaaaaagcttatgaattattttcgaaaaacataaattgaatcataatacaattcagatgatcaaatcatctgcaccgaatcaatttcagtaatcttaatgtcaaatcaaattattaacaccgcaagtccaatgatctacagcaattttgaattagctaggtttgacggtttatgtgccacaactaattaattaatataatctaataattagtatgaaaattaagatttttgtgtcaaaaatgaaaattaagatgctgtttggatgcgttattcaataattatttatactaaaaaagaataagtttctttcataaatttaaatctatttgtgtattttagattttttaaaaagtagaataaattttaatttacattacacttttt

SEQ ID NO: 4520 - DNA, 1200 bp, Glycine max
  Soy_ogl_5110 Gm15:42715501..42716700 Cluster 19
gcagaacctaacccaagaattgtcaaagccccattattttttaaatcaatgtcaaagactattgtccttgtttgtacatttctaaccttcaaactcttgtagtaaaaccttagtttcaatagtggtaattttcatccatggattttgtgaagcatgcataagttaactgagatacttaaattcattattcatttattaatcaccatagaagtaatacatttatttgatcaattgaagttctgtcattatgtgttgttttagatattagctgacttgcatgatattagctactgcagcagcacaattgaggatttttaactgttctaatcacaaaaagattcaaaagttctcaggtcctactatgagtctcgtagatttctctctatatatatgcatatactctatcagtgcccttttaatttgtcctaaaaacacgcgtgcctttttaaaaaaagattgtctttgcaatgattttcttgtttttataacaattatttttagtttaattaacagggatcttttatctatttatttttatattgtcattgcattatattaattgtccataatttttaaaagttgcatgcaattgtttatgcgcctgaatttaagatccatttatcagataagagcagctgttctgtctatgaagtcaaccaaagcaaggaagctactggaagtgttactggctgcatgacaatcaaggtttggtttctctttttgggctttcttctgaaaggtctcttgcctatgctggaatgctctaaattttctcttgtttgttcattgtttagttgcaatattaaaatgaccaaatgttattctaggagtaatgtttagtagatggcattttactcaaccttctttgacttgttgtaatttatgcttggaatagtaaaaagtcaaggttgttgctgactttctgtatgtattttctaccagttgaatgtgaagtatcaaggttactgtttatgctggcgcaagaggccatagaggaggatacttttgaaactattctagaagaaatttgaccatctaattctgagacaagctcaaaattcttttaatgttattgtagacctggaaaactgttaaatgaaccttgtagaatttattgctattttacccctgaattgttgtttcttttctgtttgatttaccaatctttaatttgacaaataagttttcatcaatatttct

SEQ ID NO: 4521 - DNA, 1696 bp, Glycine max
  Soy_ogl_5121 Gm15:43674601..415296 Cluster 19
ttgatttggttttttttttataataaagtccagaaaacaaaccaaaccacaaaaaatgttttttttttagattttttttattttgtgattttctatttaagcggtttttgaattttttggatcaatttaacgatttgtaaacgatttggttcgaccttaaataactcctattaaaagagagtcttaaagattgccttgttatggctcctcatataatatcatttcatttttatgagaagctttttttatctgcctatgtaaagccttacaagaagaggataaacccctctatgtaattaaataaaatggataatgaagaagaaacatattagaatgaaaagggagggattaaaacaaattactatttttgtaaagaaaatcactatttagataaaataaatattatttaatcaattgaaatttgtttatcatccatgcattatgcactagtcgatagagatggtaagatggactattcaatccaattcgtgatgcaagctataacaagttagctcaaaattttcttagcttcctgaatcgaacgtgatcgaattaagctaaaaaaaggcccaaagttaatttataagctcaaaatttaacactcaacacatcttaccttttttattattggatctgccaagtaatttgattgattttgtaacctttagatcaagagtttgatttattcaacttataattagactccaccctttaacacaatttacttcaaccttgaatcaaatactacttcaattctaagaaattaactacctagccacccaaaattcattatctagaaacaccaagtgtcaaaaatttacttcagccttttaagtcacccaagacctccaaaaattaccatggttacaatattcgtgtcaaaaatgcaaaccctaatcacaaagatatagctatttatccaatccattcacactgaaccaattttcatcaaaccctaatcaaaccaattttcatcaatccattcacacataacctcataaccacccacttgagacccattgcacctctataaagtataaaccatcatcagagctaataatcagccacttgattcatagcctctatgttgtagattccaccccatcatgaactctatatgtgcctgtgtcgtacccttaaataagttatcaataaaaagcattaaccccacccatcgtacctgtctacattgccaaacaccacccattgccacattattcccacaaaagtttcttttccattatctcgctattacgaatttgatctttagtactatttttattaggtgttagacaaaaaaatattactaaaaattacatgtatagtagtgtctctgccatgaattacagaaccatcaccactcaactcaaaacatatgatcaccgttaagcaaggtgttatggtctccaagtcgataatttacttaaatgtgagtttctttccctagttaaagagtattgtgcttggaggtgtagtgtagtacctaggttccagaaaattgtgcatgtaggcgattataacttttgaggggtacattttaataaccaacaagctataaattcatattcatataaaaaaagttagttagatttaattactcaattaatttctatatttaaaaaagattaatcctatgcttaaaataattttcttttagtccttacatatatcatttttaatcagtatcaatccatac

SEQ ID NO: 4522 - DNA, 1550 bp, Glycine max
  Soy_ogl_111 Gm01:20036551..20038100 Cluster 19
ttgtttatatcttaacttaaatactctattgaatactttgttctatgaacatggaaaatataaaaatatataacaaatggcgatgaatgtttttctcgaaagtcttaacaaaaatttatacttactgaatattttaatttcacgatagtatcaacagaaatttccacttaatttatcatataaagtataacacagaaggatgaacattttttttatatcaaatcaggtagaaaaatttatactaaattcaaagagataaacttatttattaaaatttttggtccaatcaaagttaaatttcttttatataattaatatatatttaattacataaaaaaaatcaaagtaaatcaacataatcattatgcacaaaattaatgtctaaattaattttaagcaaataaattattcataattttattctacctggaaaaaatttaattttcttttagacattgatatgcatacgtcaatatatcaaaataaaaattactaatgaaatattgcacatagtcatgatcttttttaatataaaaataagtaaattttttcacttaattcccaggatgaacactttatccgtaatcgcattaatatcttaattattatgataaatttatattttttattataataattttaatttgaatgtaatttttatgattttctctttcttcatttaaataatttattgaatattttatttgatgaacacacgttgataagctttaacttaatatataggtgccctatatataaaaatataataatcacgtacagttagccttctacgtcgttgtccaatcttaaaatcatttcaaaaccagaccttcgaagtctaaactcgcatgttaccgtagtttacgtgagttgcaatcagaaaggaaaatggtgaatattatactccaaaacactattattttatggtcactttttaggtatacaataattatgtttaaaatgcatgttataatacaaatggaggtagactacagtgaaaggggttagtctcttgtaacatagtaaattaatacttgattttttttagaaagatgctcatatttaaagtatgtttgatccagctttttatttttttattaaaaagaaaaattgtaccaaatacatattttacaaaaaaaaactcttaaaaagtaagtaacatatttttatagaataaaatttaaaaacaataacttttaattaaattagttgggagagttttttatactacttacacggaacttgtttatgcattcccttcttcgaatcccatctagatcaataattttcacttatttctcaatttgagtgcttcggtgacttttgtatggaattataaagttaatttggtaattgaagaaaaaagtggagaatcccttccaccaacaataaataacaaattaacaaataatattagttgataaaagaaacaaaactggccttttcattaaataatttttaatttattataataaattatgcttatttgttgtgaggtcttcatttgttttatattattttttttatatgaaattgtagtgctaatgcct

SEQ ID NO: 4523 - DNA, 1000 bp, Glycine max
  Soy_ogl_2801 Gm08:34794201..34795200 Cluster 19
tttcaattccgtgcccaaattttcttgtgtcattttattttttggggccaatataatgtgtctcacgagtcccaccaaagcagttcttggcccaaggaaatgcatgatagctacttagcttcttatctagttgagtatgaaattcccaggtccacctatccagattcagctctatactctagattttctttctttatccattccaaagttcttttcagtagttgtttgattgcatataaataaattattctatgctgtggaggatttgtactagcctgtatatcattccgggaaaccagtagtttcctcatctcaatttcaccaaaaatatctgtcataactttctactagttttgaaggaataaaatgatttcaccctagagttcgtttgcacaaccggaaaataatcacataaactaaagagaagaaaataagttaataagcttctttcgtgaatgataaatgcaacatattttttcacatacctttttaacaaattctttcttattggtttaaatttcttgcaaattacaaaagattaagatccaatatcatatttaattattctcgctcatgattttataatgttcaataaatttcaaccaataataaaatatgtgttaggagtagtatgttagagagtgtattattaatattcatctttgtgaatataaattttatctaataaattaaaaagtcaaattattaatatataaattataaaaaaaaggagttagatatttaagtcagacacaaaaaacacactgtaatatgtttatttgatcattaccaccattattgtatttcaattattttttacaataattaaaatatagagtaaattatattctccttcatgattaattcaagtatataatatttaattctgttttttaaattttaattagagctttgtaaacgtccattaaaaaaatattgttaccaaaatatcttttacactatcatcgatatattgaaagatataagtattacttgtgtg

SEQ ID NO: 4524 - DNA, 1510 bp, Glycine max
  Soy_ogl_6063 Gm18:18572191..18573700 Cluster 19
tcaattgcagccgtcccactgtcccagacgctggaatagtggaatctgttaaacaacgtgcctctaccttcgtttcttttttctctcttatttgaaattaatttgtttaatttagatttaactttttcaggtagaggttggataagaggctaaactaaaacataagtcaacataatacaacagttaaatatatcatcattgcgtacggaagaagatgcatttaataccatttttttgactttattctaattaacgtcattaaaatttaatgaaaaatgtatccacagtatagtttatatataccatgtatttgcttattgaaattaatttttctgaggataaaattatccaatttgatcttaatttattaaattatgatataatatgaaagaattttttgttgatactatttaactcaaacaaaatcaatataataactttattaattctttattgtaattttgcaagtaacctctacaaaagatttatcaatttattttttcagtttaatttattatatcaaattctcttttttaataaggaatatcaaattctcttgtaactgctataatagatccaacattttttaaaaagttattttattttattatagttgttttaatgtcaaccattataataaatttaacttattatcgctgatagttttttaatcgttgtaaaaaaattatattctgatttataagggttcatcataaaatcatataataaatctgccatacaaaagtagaatttggaattatgtcatttgaatgtttcatccatcccaagccttttattaagaggtcaatttgtttaagcttaaaagatgatttttttaaaggtgattttttaaagaaatatatacgatttatttcttaaaaaagtagaaaactatattttaaaaaaaatagtttaaataaacacacacaaaaaatgaaaagttacttatatttatttaaaaagtacttaaaaaaaactgaaacaactgatccaagatctctcttgtcaatgacctatattgttgaacaaatactaatccagttgaaacttgggtgactgtgataatgatatccttatataatacaaaattgatgaacaagggtttttccttaaggaccttagccaccaaaaaactgacattgattgtcaatccccatcatcgctttgcaagtagtgcaatattgaaaaatgagaatattttgaaaaaaaaaaacctatgtttcctttcttgttttgttttgctaacttttctatttaaatcaatgcttctacatttattaatgttatttaatttttataaaatttcatacaaataacgagtactatttattataatttaatgattagattaataaaaaatgtaataatttttatataataaaatggtataaatatgttatgacttacattcataaaaactactaatgcttttctttttttttagaggaacataattatgtcattttttttgtttttttagaggaaacatggttatgtcttttcattcaga

SEQ ID NO: 4525 - DNA, 1959 bp, Glycine max
  Soy_ogl_835 Gm03:3860742..3862700 Cluster 19
ccagatatatcatgttacagtttttaattatttcaagggttagttttatcaacacttatgattagtttgaaagattctagttacttgttagttttttatcttccaactaaatgtttagtttaattttatctaatataatgtattatatttttttttcaagttattttacttaaaagagttgacaccgtggtctaagagtatgttatatttatataaataaaaaataatctatttaacataaaacatccataatctatgacacccaaacaaaaaaagtagaagaaaaaagaatcacaatctttttcttttgttctccaaaagttaattgaattggaatcgtggatattgtacccaaaaaaactgggatatcgtccatagacatctctttttttggcttaaccatgtgtgagtggtttcaaaactgttgagggaatatatattggtatggtacagaccacagagaatgagaatatttgtatcataaatttgaccaagtctacgagaaggttcatggctgacatggatgatatgtgaagaataataaactaatgcggctttttaatggatttaatatttttttataaaactattaacagtatttatatatacccatgtactgcatatacgagagagccttcttttatttacataataaaaatacacaaattatcatacatgaatttaaacaagatattctgagtctcaatcccctacgtgtatttactatttactcgaattacgttaacttggacatgatattttatgatacacaattataataagaaaataaaaattaatgattatgaataaaaaaatacacggtcaactaataaaaaattgtcattgatatatagtttttaagattattattattataatagttaataaatttgttataaaggaaaatgctacactgtacgaagaaaggttgcagcaccaaaagagacaaataattatatatttaaccatccatgattttcggataaatttaaaatatacttagtatccttttaaaacaattacacgtgttgtttggtatgtttcatgtcgatgattcttctaattcgtgtaaaatagcatttctctattatagatatatagtaagtttgtgatcagataaaagtgcaaaattatttagtgttagggcatagtcaatttgtttttttttttttaaatttttttttacatttttaaccaaaagttacacaatcatgatagaaatattaaaaaagaaagaaaaaacttctagtattaaatgatccgaaaatattatcattcaatttacttcttttttttaaattcaaaatcattcatttaactaatttggctcccgatggcagaagcataggatttcacagtgaagaatattagtattattagtactttactaatgagagtttccacaagacctccaaacccaaaagctactgatattattattaattcatgataattgagaattatgtggtactgataccatcaagttgagacttgcgaacattggctatttgcatacgtgccaaaagagcacttgaagatgagttgattgattagtttacttgatttctaaaaatattcttggaagtttaggcaagaaatctccattcctggttcgtggatgcaaaagtgcttggttatccaaaagaaagataaaagacaaaaaaaagggagcaagttgtgagtttaagtgtaaaagatcaaaactcgagtcatgaccatatttcttgtcattaaattaagtcaatgttcttgtgcattatcaaattcaaaagatcactcaccaaaaaattcaaaagattaattacttaaaacaaagcatattatagaaaagcgtattagtaattattaatattgtgactaattttaaaaattgttatattttatatacacttaattttatcataatcttccatcattgatattttattctacagttatcaaccttgaaatgttgagtaa

SEQ ID NO: 4526 - DNA, 1649 bp, Glycine max
  Soy_ogl_5053 Gm15:15006652..15008300 Cluster 19
gacattgcccgtctattaacttgtcacttcattgagtctgttcaagcagctgcatgtaatatttttgtagtaaaatatgtttttaaatttttcatcaagtagtttgagttcataaattgttttaaaaaaatgaatttaaaattattaattaatcacaaattatcgaatatcatcaattgattaattttacaataattatcataaaattatatttattctaattttaattaattaacagtatacaacttttattctgacaaaatacaaatatatatatatattaatctccacgtgaaaagtaaaaaacaaagagaactttttggaagttttaaattgtcataaaataaacaattgaacatttcgttgaaattttgtagtggtatctagaagtcatcattaattatcttaaaccgcccaaaataaaattaaactgtgatggtaaaaaaacctgttagtaaagcttaattgcgattaaataatcactagtaaagcttctttttttctatagtttgaacttatcgatctactctaatttattaaaaaagttacagtaaatctacggcattgtttaatattttttgggggaaagaaatatatgatagaaaggggttgggcacccttaatcctataaggcaaggtgccagtaactatgagagattatcttacaaaattaccatacaatcctaaatcacaatcaattatatttaatcatagttaccaaatctctggatgttgagaaatttctctagagaaaaatatccactaaacgcgattttagatacttttagtaggagtcaaacctaaacttgtagaaacgtgagagttttcttttaaatccttgactatttatgttaatccgtattgacccattatttatcttatatatgaaagtctacgaagataaaatacctgtgaatattatcatcattttcacactggttgttgtcttctgttttcccccttctgaccattgagtgcattttgttaaccaattgagactttttcttttattcctagaagataataaaccactcattagtaatcttctctgatcattgcgaatacgagagtggttgtgaagaaaaatataatatggttccaatacatgcccttggaatacatcaacttcaaaacgaaaaactgactagaagtagagaatacgtcttaaatgtcaattgtagaacgtgtccattaattgtatttctgaattatgctaatcgttcttcttttcttctctaacattgctatctgtgtttgttttaaattttgtctcattataattgttataattgttgtgtctaaaaaaataatttgttctaatataacattaattactttttttcatttatgtcatttataattaatgatgaaaaaaatctagaaataagtttaataataatacaagattaattttataaaattattattattttcatctattttttactttttctcaatatgtataaaataacctaaaacgataattattttgagacaacatgaatatttttatgtgaaattcacttcttttaccttctactttaatttaaaaaatctattattttcaccttcactattttcatcctttaaagtctaaccaaacacagtgacgtctctcacggtacacaattttgacataaattgcgaac

SEQ ID NO: 4527 - DNA, 1642 bp, Glycine max
  Soy_ogl_1333 Gm04:41220459..41222100 Cluster 19
attaattattaatagtttttaataaccttgtgagtcactactattttctttaagaaacataaacattctgaacgtgcccatgaaaacaccaaaagctgtaacagcattgaagactaaatcaagaagtccttagtattactcaggaatcaggattcatatttttgcgacatccctggacaccactgctgtgcatattgttctctgaagctaatatcacgctccaaatttctgttgtgttacttttgtattctgcatgatcgacaaaatccattggtcttatgtggttcaatttgagtagtgttacatgcaggttgttatctcagaatctaaaaatgagtcaagcacacaacaatgaaaggatgcaccaattatgtctcacgagttttgattacgtaagtttttttttttatcttcatcatacaaaattagtgtctaaaggtgccttttttgagaaaaagatatgttgaattttatatataatctacattaaattattacaacaataattaaaaaatgtaaaaatttattatagagtatattttcttcccaaaaaattgaattttaaggtaatttacggtaaaaaaaaaaaaagtttatcctataagtctacatttctctacatacttaaatgacatttttttcattcccattggttatatttttcgtaatagttagatgttaacctaaatttaggtaaattgttcatagccaagaaattactcgataaattatttaaatcataatagagaaagcaatagaaaacatatttacacttaatatagattataaaaatgaattaaaaatatttaataatttagatattaatgggatcttaagaaaattgtttatccccgtgaattatggaaaaaatttcctaattacttttatgaaaaaagaaaaatctttcccatgtgttatattttgtttattctggtgaattaagtgaaaatttctcataaattaagtgaatcccaaatagtatttttcctatatcattgtgcagttgtaacaatatatatagttcagatatattcaaatgtatttaaattcatcattatcttagttataggttcaaatgtatttaaattcattgttttagaggtaggttgttttagtaacagtagactcaactttagcatgtgtatttaaatttaacacttaatagatgtgacacaaccacatttatgttatgtatttgatcaaagaaacaatttcttatatgtaataggaggtgcaaaaaattacataaaaaatttgatttctattgataaaatatatataatgaaattgtatttttgttgtagtccctcttatacaatgataacatatttttgttgtgtatttagtcaacaaaatcaccaagctttcttgaaaaaggtatttttgaataaacaaattttaaagcacacgttggatgtatgaatagaaaatttcggggtgagaataacaaccctttgaatgttatgttagacccaaattattggccatcaaatccaattttatttccgatcctaaaaaccccacacccaaatgctcgcttaattcgaggatttcaactctgtccagacgaatacaaattagtattatgtagatttaacttggggaaattataggactataggagtttcatcttctccttata

SEQ ID NO: 4528 - DNA, 1219 bp, Glycine max
  Soy_ogl_4783 Gm14:45865301..45866519 Cluster 19
aatataatttttcaaattttattaaataataattgagacttatataatacagtaatttattaatgataatttcctttaattataggtcttattttgtggagtgtggtatgtgtgatgcggaagcgagaaggatcaagttatttgtttgtttgttcaatgttcaaagtttcactttagaagatcaagtgtagtgttttttaatatttaaataaaatagtatcattttattgtttttttttctctaaaggataaaataagttataacatttgaaaaggtaaaaatatcatcttatatttttctaaaattaaagaaataaactttaatttgaaaaattagaaagaaaaaaactgttaaaaaatttgtaatcctgaatactttgcaaataaaataaatcatatgaaatgtaattggaataggaattagacttcagacacagacacacagataatcggtagtaatccatcaacaaatttctttttttttcaataataataatttacaacaacacgcagaataaacaaacatctatgctggaaacaaaaaccctaagattaggaggctggtggattcaaagaaagaaagaaaaagaaaaacaagagcgaaatcaatcaaatcaaaccaattttacaagcactaaaataattaattttttttttgcagaaagcctttaaattaaattatgggaaaaaatgtatttaaattttatttatatctaacaaggtaaggatatgtgtaagcagatgaagataggtgaattaagtaaatttcttaggggtttgttgtcctatttagtggatattgaaaagaatgaaggaaggtacctgagggagggagagagagagttggagaaaacagaatccctatgttgtgttctctgactcaccttttgagttatgagacatctagggttgcaattgaaaaaacaaaaacaggaaaaaggaaaaggtatgagaaggctataattgttgacaatagttaaatttgtttaaatttatttattgaaataagtatttattttaataaaataagtaattttttatttgtttagggtgcttgtctaagggagagtctgtttaaattttaaaaaataactttaaaataaatattttttatataagtattttttagaagcaaattaaataagatttatttcttaaaataagcagaaaatgattttttaaaaagagaaataaattagaaaaacacattaaaaaatag

SEQ ID NO: 4529 - DNA, 1300 bp, Glycine max
  Soy_ogl_2573 Gm08:9121201..9122500 Cluster 19
aaaaatccattcaagcggaaaagctaaatgtgttctattatattgcaattattttgttttttactgaatcttatattgcaattatatatatgactatatctgataaaaattatatatgactatatgagcatcatgaatgaaacgaataagcctttgtaggagtgcttttttttttctaactttcactgatactaaatattagtatcttattttctttttgacaacaaaatattaatatcttgttactaccttcatttttaatcttttacttgtctaagtttttttttctatattgattaagaagtatatttaatttatacaactttaaactaaaatttcctcatttattgttttacaaatttctatattatttaactaatcttatttttcaatgcaaatttcactatggaataatattcaggttcatcactataccttgtaaaaattaaagttattaatatttgactaaaaatagtcttaactactcctgtatggccgaagtgaaaagcatatatcataaatccataatggctaattaatgccaaatggagacacatgcccagttatgcagctgcagccgggaagacaaattgtaatttctactgctaacgtttttacgactggtaagaatcggtatatcctatggaacaatgcgttcataatattcttgtgattgtggcctttcataggattaatttccttattgttgaagcattcttctttttctttccttttattttatctttttacatataataaagataatttgaattgaagtaattaacaaaaaaaaaaacaattggtttcctcatatttatgcgttctcttatggtgataaatcgtcaaattactccaaaaataatgttaaaagaattaattttatatatctcaaaattagaattacacttatgtaatttaatccctttcctttttaagatcatatttccttatatataaagttatacccgtcagctagcttggggtaaaattagaagattgtatcctcaactcgtttactgcttttttatttattatttgatataaccataatgctaatctttttccttcaagttagttcaattttctcctctttttgtttcatattattattattctctaacttggggagatttttatgaccatctttattaaagctttcacttatgcttttaaagtaagttttaacatagatgaatggatataattcaaacaaaaggtttgtagtaacaaaaatgtgaaacaaaagagacaaaaatctatatcaagctcattaggaaggatttggaattcctattaaatc

SEQ ID NO: 4530 - DNA, 1856 bp, Glycine max
  Soy_ogl_2728 Gm08:16464122..16465977 Cluster 19
aagtgaaacaaatttatttcacaggacaagagtagtaatagaaacatctaaaatatgaaacattttttttatgaaatacacatgaaagtacggactcttttttttttttttaattcattgttacaaccgcagaataatttctaaggatctacaataattagtttgctttgggttctattaaattcattgctccaaccaacaaaaatacttaaaggttagttttaggttgtcttggcatcgtgaccaatgcttaatttgtcgaagttaatctttagcgtccgcttcttagtagttgacgctaaagtggaagctatgacaaattataaaaaataataataataattgaaactaacatcataatttatttggccaaactaacgctaagaagagagggaaaacaacgataaaaaaaaaatgttactattatcaatagtttggctttgttgccatctcaatgcctctattgttgctcaagtgacacatgatttcctcttatattttctcccccttttctcatcccttccattttatcttgtctcgctccatctctgcttggcactaacacaaactagaattcccgttcaccacccatcaacacagaacattgtcgttcaaatttatcttgcccaaaacctaccatctataatgaaccccacacccaaaacttgcaaccaatagagataggagagaaaattagagaagaaatagcagtagaggaaaagaagagagtgaatagaatgagatcgagtgaggtaaggatgagagattgagagaagaagaaagagagggtttaaaattaggaggaggaggaggcaaggaaggttttggtttttcatgctaaaattcataatcatttgatatgagttttatttggtatgactttaaaataattcacatatcgatatgtaatatgtatagttcaatcaatcataaaacgtgatttcaaaaacaacaagaaatgattattatgtcatttttattttttaatccatagatcttaaattgcctagtctctaatataagattaagctaattaggttaagttttcttagaaagattaaggataaagtggtctttttaataaaatattaaattaaaaatcaaaataaaaaataaaatttattgtaaatgattaaattatacataatacacaatgatatgattcattctaaagagatactaaagtaaccatttttattttatcattattagagtttaatatttagattcagaggactttcaaatttagatggagttgacactatttaatattaaaaaatcaaaataaaatgagattttcaaggtagtgttcatgtaacattggctaggtcagtgctactagtgttgatatcgtggtcaatgccaagctttcaactctaatacttacatttctgggagtagttatgaagaattttccttaacaatagtataaacagtaactatactactaattgatcattaacattttgcattatatttgacaatatttttaaacaaaatttaatttatttgtgaaatttaaaagactatttaactagctaatttaagccacaactctcagaaataacttctcatcgtagaaaaggaaaaaaagaagtatagaaggaatgacaaattttctacactgtttcatcaaagggcagtgacattataatatgaaaatatggcaaggtcaaaattgagagagagagagagagtgagaaaatcgaagaaggaaccgattcttatgtaatttaaccttcccctcaagttatctaaaaaaaaacttcccctcacgtgccaaggatttgctatatatttcgttgaaataatatagagttaggttttgactcgagtgggtgaccttgctaactggc

SEQ ID NO: 4531 - DNA, 1500 bp, Glycine max
  Soy_ogl_380 Gm02:4701701..4703200 Cluster 19
cattactaataaaaaccattcttcttggacttggagttgtgagtggatagtgggaatgacgagggaatgtgtgagagactgagaagatttctaggtgggtgtgaaatattgttgtggagtcattcatgaaaataccaggtcaactcgtagtttgtacggtttttctattgtggcttgggggtttgtgttgacaacgccctccagtcacatcaaaccacgtcaccaaataccgtagctttgtgtataatttaataaatttaaatatattaattactaattagtactatcatattgaataattgatatattaaatgtactcgacaatatataactaattatacaaataaccttttatattaaattcttcttattcttcttacttcatacctcattttatgaaggaaatgagtaataaaaaaacttagggttggcttatttaaaaaaaatgtattttaaaattaagaacatattttcattttatgaatttattttattttctagaaaatatgaaaaatacttttagattattcagtcatagtttgaacgtattgtaaaatattgtttatagttttttttgctgagaaaaaatattgtttatatatgaagttcaaaaataaataatggtgtatgtttgttttatatatattttagtctaatttgtttaggtttgtcatatatttaaattaagggtagaacactattttaagagatcaataaatataattttttttagatcaataaattaagggtacaaataatataaaaagagtcaatgtgcattgttgaaaaaattgggcttgaagttgaagttaactgttgtcctgacaacactaacatagctggaatgttttgagcatatcttgtaaatatcaaaatgacttgggaccaatgtcaaaacttcaagggtgaaaatatctacaactttcatggagacacataaacttaattagactttgcacactagcacccaatgccacattgttcaccatcaaatgagtattattcatttgtcattcctgaggcagaccaaatttttgaaaaatgttgcatcgaccgacttccacccaacggtactaatgtatccatgacgatttgattttcatatcttagtggacctagggtcttttgtgatttagaaagcccaaatttgctatttatttgaagaaactacatcagtgggggcattctttgactcctctaaggatcgcaagtgagaaatagcatgggaaatcatcacccgccattgaagccttgaagaaattggaaacaattcttcaagatatatgaccttctcttcatatttatcttctttttcttcttctttttatctttataggttaggatgaaccttgattttaaacttttataagcgatatctcttttaaatcatttctgttgttatgtagattaagttattaaattcatgcttaatgttttttcatttttggccttttgttgttgcatggataattttagtcgaataattaagctagctaacct

SEQ ID NO: 4532 - DNA, 1241 bp, Glycine max
  Soy_ogl_510 Gm02:12062101..12063341 Cluster 19
tgagtgctattgtttcattaacattgaggcaacattgaggacctagcctgaagcattcgaatgtgtgttttgttcatcttaggccaaaaaattggactatatctcatttgaatgtgtgctttgtaaccaaaagctttaaagatcatgtgaaacgaaagtctattcaatcataaacaacttcaatttgaccggacctcaaaagttcagctttcaatttaattgaattttcgcattctctttcccaagtctttcacctaaaaaatgtatatcaacttgatattttttttagttgtttaagtatttcaacattccttgcccactgatatcataataaattaattaatgttgaatggaagcacactattcaacataaaaattaattaacttttataaagtaatagaaaaaagaaaagcttacgattacaaaagttgggtaaggtagcacaaaggcttgtgtttgatttttgctatttgctaataaacttgtatatttctatctacatagtcagttatcaaggtaagtcaatgattaaatttgtttatgaacttaaaatttgagttgtgctaatgatttttataaaattcacgtggtatttttttttattaatttctttaatcttttaattatttcgatattacctcatttacacacacaaaaaaatcaatataaaaatcatctaaaagaaacatatgtttgatctaatcgaaaaacagtaaaaaaaatgaaatatgtagtaatgaattaaaatattttctaaagttacaaattctaaaaaaaaaaaaaagtttcatgtgacaacttcataaaaagttttagttttacactgatttttcaatacctggcttgcacctcggctcgtgaattttatgcattattgcattctattgtcaggggaaattgcgggacaacaagacgatttacggacatgattggataaagtaattttttttatcaataagaagaattgaagtattaattttttttacatatttataataagtcatattttaactaacagaattaaactcttttaataaataaataatgcaaaaagtaaacttaatctaaataagaattagtaaaacaaaaacaaataaaatctaaagattatatgtgatgatatcacgtgataatcatatatttattctctttaaatacattaattaatatagattttatatctattcaattttattttattttattgatttaataattctagtaaatcttaaattaattg

SEQ ID NO: 4533 - DNA, 1693 bp, Glycine max
  Soy_ogl_116 Gm01:37064808..37066500 Cluster 19
tatttccccatccctaattgtaccttatttactcgttaagaggatttttggtgtcttatagtcatccatgcagtgaggcattttaggattagcaacctctgttctttattacacaaagtcatgacacattgtgagccataggaatttcaagcctactcttgtcataaacacaaggaaattgcatagtgcaccccctgctatagcatattgccactacttcacccttgtttttgcatcgtgaagccgcatatgcttgtttctcaccctgcactttgctctctcaagtttccagcagccaaacagttgttcatgctttgtttgtctctgcaccctctgcattttcctatccctcagcctctctttcatccttttccaaccaagcccaacactgcttctccaattttgatttgagtactttagttttgaacatgttatatagaaagtatttggtttggtgtagcaactgctttgctgtaccattatggcatactgcactataatgtggggttatttaaccacagtgagtaaaaaatcctgccactactgggttctttaaaacttgctcttgaggacaccaacccaccaataatattgatcaaaacagagcattggagaataatagaagtattcaacatttaaactgggaggatttgacccaacaggagttgatgatatttgaactttttgtatgtacaattttctgaaggtgttatcctaataattaagaaataatttattacagtaattacaaatcctttaattagcttgaaacacataatttagaatgaacatttgagttttttttacccaaaaagaaattaatatgagactatatatcattttgctaggacaaaatttaaatggttatgttgttcttgttaatagaaaaaagtgttagccaagaaaacaaattagaaaaataaccttaatttgtggggctactgtggtggtgagatttggcttgattaccatgcttcaatcagttaaacactagtgggacttcatttcagcagccaccaagggggagtattgatagatacccattagttatagttagatagtagaataattggagtttgttagttgatggctggaatgattagaaatataacggatgttgcctataaataggaagaaggaggggttgagagtagttagtcaatttgagagttagcattgtggctaggcagagtcttggatctcttgaatatgcagggaaattatgcattctttttgttcatcaataacaacatgttctgtgtgctgaacctgaacctgaaccagtttctaacattgccatatttaaaatgctaaacctgaaccaagttcttccattagagaagacaatcatagttacttagcttgtcactctaccttggttttaaggagttaaaataattcaaataagaagaaactatacaggttaaatgattaagcacgtgcagacaaccacaaaataaaagtggatcagaaatttatggctgctatagtatcaaatgccatcaagaagtagaactcaagttattaaaaatcagtagcaactgagttccttaaaacctagaagctttctatttatcttgcaagtcacaaaccaacatttaaaaattgtagcagattccaaagccaatgttaatgatttaatttactgttgttcccaaaattagatttatttaacttatcaacaattctcatt

SEQ ID NO: 4534 - DNA, 1900 bp, Glycine max
  Soy_ogl_877 Gm03:34768801..34770700 Cluster 19
attgtttctaacgtacgtgagtatacgcgagagtctagatgcactatatattgtgttaatcttggtgaacaaatcgaaattattaagtacataaaaagatatttggaaatttaaccccagcatagaattcattcgatcatccttaatttctaacaaatactacatatatacacttagatcgcacttttacaccaagaaccactcaatagtactgatgaacatttagactcggggaaattagcaaattattattatattgctaaaagtgcttacacttttgcctgaaaatcccgcaactttgacacttgcaagttgcaagtctgaaaacaacttttatatgtctaagcttatatttatctcatcatttttatatgcttgaacataaacactaaaatggctggctggtatagattatgctcatgaactttaattaataggttaactatatgtattacttcatgtgtttataaaagcttgtcatacaatataatttgaacaagattattgttcattttcgataatactaaagagttctaaagtcgattaagaattcaagagagatcatatctatttatttcgtgtgattgggtagaatgaaggattcacctgtctttattagatgatcaacaaccctttaagcttcatgtttgaaagacgttgacgtttgttcagttagtcaatccatatcctaacatccatactcccctaagtgacaagtatgaaaagaacaaatacttgcttggtcagtggttcatactcatactacaatatttcaataacctttcattttcttaaacatgttattacatgcaatttagtgacttaccaaaaatgtataacataccaaactagttctataattatgagtaccagttactttaattttcaggattataataatatcatttattttttgaaattattgaacaataattacattaattaatctctaatgaaactaaaacaattattttagttgttaaaattaattaatattttttatgatttaaaattaattaatatatataaagctaaaatggatggattttagtaattttaaaaattaaaatgatttcaaaaaatttaaaaattaaattgaatgacctttataaattaatttaatatgatagtctataaaggaaatactatgatagtatatgattgttgcaagctacatgcaagggaccgatgcacatatgacaagcccatattagacaatatcatgggctgttcctttttttttcttcatgttattgcttgttgaagactccactttctcctttgttcacattcaagcccaaatgcaactaatgtcaaaacaaaattataaaaagaaaaaatgtaataaactaattaacttcatttcctttgttcaaaaacacaaaaactaacttacataggctttttcaggtttttcatatgcaaatataggtcatgtttgtttttacttataataatccatgatcatgtacgggtccaaatagaagttgtagttggggactacatccacaatttatatgattgatgaatcattgttcaatttttgtacttttataatgtaatattcaatcattaacaaattaataatgacgtgagggagtgggattgatcgtcctgtgaggtagcataagatggatcatggatatatacacccatgacatcaacacttggacaatctattgtttttcttttgaattgattcattttgtttgagttgattattgattaacataactttttaaaggctttcccattggctaaccattggatttcaatgggtctcacagaaacacagtgattaggtatctcttttggaagctaagcattaaatttctccctaggggctacactagaagccgaaagttgagattagtcatatcaactatcaaggctataatat

SEQ ID NO: 4535 - DNA, 1300 bp, Glycine max
  Soy_ogl_2361 Gm07:18836401..18837700 Cluster 19
ccttgcaagtccacttaactctagtatattatccttcacaagtctcttcaggttcaccctacaacaacattgctataaactcacacaactaacttaaaaaacacattccccaagtatcaatcctttgattgaacatctaatttttttcttataggttctttttgaaagagacctttcaattaagtgatataagtatgcctaacaatgacaagatacaatcactgtataattctcacttgaccatctcttgcaaataatgacttgtgcactaaaatccttgtaaacgactaaaccagagattggctacctgaaaaccaccaaagattctatattaggcttcgtatattgtttctttttggtgctgaacaataacacatcaaatgctacaaaataatacttttttaattattaaagtgcttaaaagttatcttttattcaaatatttaataatgtaaaaataactatatttatattaatttttaaatccaaattctatttgtctggcttattaaccactccttccatcatccctaaatatgttcaatattttcaattttatttgtatcatttttataagattatttttaagttattttttgtattatttattttttaactcaaatatccttaattactttacaataatgttatgtattataaaaatatattatctttcttataatgatcagataaaaagactaacacatattacctaattaagtgaaaaagtaattgagagaaaaaaaatgaatgagttttaataattttaagagaaattttgataaaataatataaattattaacaaatttaatgttattaactatattaatcaatttttttaaaagattgcaaattacttaaagagattcatatatttagggaggagtatattttgtttttacgtataattctaaaagaataactcgagatttaattcacataatcaaaacaaagaacacatcccgataataacttacttattttatacagtaaatatgttcgtgatttccaaagattcactccaaattgggcatctatgtctttgaagaggtccacgctaaacagtattgtcgtgtacttcgctatttctatcatttttaattctaatacgtcaagctacaatagagtgggtgaacctataaattcggatcaaacttcacttttattttctttttacaaaagccccagtatatttttatttcagaatgagtatgtctgtcgttttataccagtctttgctaaattatttagaaatggaattattaaaatattagaaatctcccgccataagtaaaagta

SEQ ID NO: 4536 - DNA, 1500 bp, Glycine max
  Soy_ogl_3417 Gm10:10080001..10081500 Cluster 19
tcacggaaaagcatagtttgagtttttcaaaagttaaaaaaagaaaacagataatactaaaaaacaaacagatacaataggggtggtgtgagtgtagtcaacaacctcgttattacggcgttacttgctcctcctccaccagggatacccaacaaaacatgagacatgaaagttgaaaactcaaccttaacctcaaactaacccttgctaaggttaagttcctaacatagtacagatagatatacacgcaattcgcaaatacattatgcactctttcgctctcatttccaaccaaaaaaattaacggcttacgcggttccatttccagcggacggaatttcgtcgggaaagttcccattccggtttttaagcattccatttccttcttcgtgtcttaatttgtaagagaatttgaatcaatttactaaaatataacaagttatattacaatatatatttattttaaagtctactgattaaactatatgtaattgtaaacaaaaatattaattttatatataaatttgaaattaatacattatttcaataattaaattgcctcaatttaatcagatctcaattaagttggatttggaattaaataaatagttttatcattttcttatatcatcttatttgtgcaaaatatttatgagatctcaattatgtgcaaacttttttatgtatataaagattgaacgtgaaactttgtttaaagaatgtaagttgagtgtcactcaaatcaatctaatgttgatatcaaaaatttaagtcagatataaagatcattagaataaacatgtgtcagatacaagtatattttattatgattttcttttttaatttgtgtctttttttttttacaaatcacattacactcagaaagtttaataaaaaaaattatttgatatttcttttgttttttattctatgctatgtttttaaaaatcatataatagaaccctgtatatccttcttattaacaaagattttttttttataaaggaacaaaataaaattaagaaaatattaggtataattctactaaacttgttccattacatcaaaagagtcttacatgtcttacgagttaaaatcaaagatgatttataagtattttttttctcttaatccatcaaaatgacttttaaagacaaataactttgagatctatatgaacctcaaagcgaacaatatatcaaattcagttatcataactatgtagcaaacctaagcacaaaacaaaaccttaaaggatttaatttgagcataatttgtccttagttttttaatatgacactgtcatattaacgagtattgtaaggagaaaaaaaaactagtctaataaaatgggagagaagtggggtattcatatttacatattaaaacaaacatcaaagaaagcttagaagttaaactttacttaaataaaggaaattgaacgaaattaatcgtttttttaatctttttgtcgttttcccaatgcttttcttttacaaa

SEQ ID NO: 4537 - DNA, 1088 bp, Glycine max
  Soy_ogl_3423 Gm10:33831589..33832676 Cluster 19
gtataatcataacactcttataatatagttgtgtgagtctatattaattactacgtaatttgatacgatgtcttctattaataattttttttttattaagatatgttttacatttctactaataaattaaaaaatttaaaaatttaaaaagaattaaaattgaatgatttttctaagtttatcctatatttttaaggatacttatttaacaatcatggactggagccaaaaaaaaaaaagtccacagaaactttccaaaaaatgaggggaggccatggtcccctttgaacaacaaataagtccgcccctgagcacattggtacattcaagccttgggtgaatgtgttgttttttgttttcttagaaggtatctttctttagagataatttggttctatagatagtcaacgtttaggttcttaggaggatttgaatcttaacttataagagactaatctcttccactatgttcaatcttaatttgctagtagggtgagtacattttgttagcatataacatatgctttgggaaaaaaattgtcctcaattctggataattttaatatactctcacacacaaaaacaaaattgcatatattgtcattattgcattcgaaattcatagttttttagttccattttttttttggaaaaaataaaagaagagtaagttattgatcacattatcaaatatccggcatgcaattaccgacagcgttgtcctttcaaaaaaacaaaaataaaataaaatcgagagcgttgtgtatatggatgtgaactttctttgataatatgtattattttccattaatattttctgaaatgaaaatttagaaattagctccatataggtgcaaaaaggaaaataatggatttcagtacctctgactcgagaaatacttgagttcaaaaagaaaaaatacatctatatataatttccttctgactagtcatcatatagaatttccatcgcgaactaagaacaaactattataagtgaaggtttgcctacgtgtagcagctgggaatctttcccgcaaaatatgaagtataaaccaaacttttttcagttagagatgttatacact

SEQ ID NO: 4538 - DNA, 1368 bp, Glycine max
  Soy_ogl_4046 Gm12:15426401..15427768 Cluster 19
taacattttctccaaagagagagagagagagagaattttaaaaaaaaaacaagggagtttatgctagtgagaaaaataaaccaagaaaaaaaaacaaaaacttattagaacacttagcattaggcagggaatattttttcctgcataaattgatataaaataaagaaatgtttcatacaataactaaccagaaatgaaaaacaattgaatgttctaaaatcacattgattaacataaaaaaaattaaaaattggagttttaaaattaacaaatatctaaaattaacaaatattcaattttaaaacttgtatttggtagatttaaaaattcaaaatgacggagtcaatattgaaaagagaataattagagattaaaaaagagattaacatgaatcaaaaattaaaaagatttgcaaatatgatagtgttaaaaaggattgtaacaatagtaatcttgaaagcatgtttgagaactgattaataaaaaaaagaagcaagattgacatttataagggtcgtatgaagctacaaaccagttcagttaagatgtggttacaattaccatatgccaatttcaatttttgaacgtttctacaagcataacagtaatttggaaagtaattaatacagtgatatacctcaaaagcaattgtgtctgtcactaaagaaaatgaatatgagatacaaaagcttgcagggcataactctaaaaactccaatccacgaagctttctcagtctcaccaatttgtgtctaaccacatcaataaaaaagttgttatcttcttttcaaaactgtagaaatatttgaaaagtataaggtatgattgtatggaaattaaagagagaaagagagaaacaaaaaataacatactcgctgacattgcaatgttttatgttaaacagataaagcttcttcttgtgccattcgctcgcactcaatgttttcattttcgttattgagagtaactggtacaataggaagaaagagaagaagctaattaaatgcaaaaaataaaaataaaaatcagaaaatggatgaataaaaatcggaggaatgtgcagttacatgtaacagttaaagcctaaaagatatcccatgttgttttgaagattaatgggaaatggaaaaaaagtaatgggagccgttttgtacagtatgaaggaggaaaaaaaaagccatggtagaaacaataaacaaaaattaaaaaaaaaagaagtcatgagacccacagtacagagtatgccattacaattgtttttgaagtatttaaaggataaaataatctttaaaaatgaaaaccaaaatgtagttaatgcaaatagtatttgctttatctattgttataaattataaattacctccactt

SEQ ID NO: 4539 - DNA, 1815 bp, Glycine max
  Soy_ogl_4164 Gm13:8976601..8978415 Cluster 19
aattaaattaggaaaaaaaatcaattggtaaattttgttaaataatataagtttagtgataaattttacggttaattctttatgtaaaagagaaaatcataaattatttgaatttaatttatttcaagttgaacttagcccacccatcatttgtcgatttcggtgttactggctcggtgtctgtcatggtctatttcacttggctcgatgtcaattactcgaagagagagcgagaggactttcgacaacattgattttttgtctatgatgatccacacagttgcattgtggcctaggacttttaagcattaaggcatgggatcttcaaaatcacacacacaaaaaccatttgaagtttagacataataatcgcttttggtggaaactattttgtacaaatattatagttagaaaaaaaaaagtcattctcaaagattgcaaatggcaagtcagttttaaattctaggtttcagttctacgatatgctaacatgtttctcgttttgattttcctttcgttccaagttagaagtcagaggtaatgcagccgtattagagacttccaagagccacatatgcctcgacgcgggttgccgttggtacttagtataagtagtcaaagatttgaatataagaactcccactattttcgtaaatgagttcaaattctcctctagtttggtgggcaaccaccccagagatgtttcttgacgtctagttagtaattgtaattgagtttgtaaggcctgtaaaataattgtttttttattagtatccgttgatagcttcaacataggtttgattataattaaaaatttaattgagttttttaattattaaaaagttctatcaaatcttttttttttcttcttcaaaattatgttaattatatcttttccatcaattttgttacattgactaattaatggaattgactcatcactctcttcggttcctttctctaacttattcactcaaaagtcatggtcaccacaccctcaacaccatcaatctcctccacacagcccaaattgtaacaacttaatttttcataatgtatgataagtgtttaattaaaatagaagaaaagacaaaatttaaatttatgttatttaatgaattaactaataaaaataaaataaaatatcaagtaaatctaacttaattttttaaacatgatgtgagtatattataaatcttttattactttgttgaatttctatgaataaaaaaaactaattaataaaagtagcatgaaactctgtattgtgtgttttagtgctcttttatagtaattgggtttgattttgggctttagcacatttaagaataggtgtgtataggaaaaatgtttgaataggtaagaaaaccccaaaactcacacacaacccgaatctgcgaagagcacgtgaccacccaccaccacaaacacaactattaatcgtcactttttctttttaaaaaaaaaattatacttatattcactacttagtttgtgaaagaggagactattgtccttttgagatacttctttataagaattttaggagaaaaaataaaaaagcaaaaataaaataaacttatttgataagctaaaattaatttatgcacaacttaagataatttatttttttatagagaaactacacaacacagcttctatacattagcataagcttaatttatagaaaattttacccaaggtgccgtagtcttacaataaagtgtattggttatcgatatcacgtcccagtagattatttttatctgtgtaaaatttttgtaggatattagtcattcaaagttcaagaaaatc

SEQ ID NO: 4540 - DNA, 1492 bp, Glycine max
  Soy_ogl_2093 Gm06:46341409..46342900 Cluster 19
tgctaaattttataaaagaatatgtattgctatatatagttattccgctcaatatttctttgtatatacattaaaattcaacgagtcaactgttaaattaaaaatttatattgttgacaaaccaagtttgcaaattttcatataattttgttataaaaaaaatcataaaactttgaaactatatcataactcatttaattaattttatttttaaaatcaatttaactaatcttattataacattccttttgaaaaataagtaaattagttggtcaaattataaggattagatcataactcacaaggatataagtttaagtttcgttgtcaatatgagaatcatgttaataattaataagtagtttataagtattttttgtaaacgcttaacgaaccctgaagtatgtcatcgttgattctaatgaaccccagaatctaattcagctaaatttttatcataaaaacattaactttactataatatgactaatgtgatttatgaattatatattaaaaagtcttactaatcagtaaccttcagatattaattaagaaattaaactgagaaaatatttattgtaaaatcataaaaagatgtaaaaaagtttttaacaatgcaattttgtatatttgagtaaaaaaataatcttgtttttagtttcttaaataatatacaacagaattgatagcattggcctatattaaaatagtataaagtcgttgatttttcggtggtagtttgctttcttaattatgtgatgccgaagttcaactgatcacatctttttttctttccttacggctcttttggctaatcattcatcctcttctacatacatgcactttgccactcgtgctcttcttcaactttgcttacaataatggctagctcaaagatttatgacaccgaacgtgcatcttgtcggtctaccttttagccaaattatgcctctaaataatggccctccacctcgatctcttctatatctcttggaaaaactactttaattaactgcatgcacaccctcaggtgaatattgtcacatccaacatatccaagaaaataacctataataatggagttcttaatggattactatcattatcattatataatagtacggtccaacaccttgaacatattctggttctggtgggaattttcgtggccggatgtggattttataaaatgtttgtttgatgagatgaaaaaatgaatgctgcaaattaaaatagttgttctgtatgagagaaaaatgtagagtacgtaatttaaagctagctaggtattgattcccaagaaatatcttctttaattaggagggcatgcaattttaaatgtaatttttcatcttacgttgacatttgagttcaaacctaattaaatattataacaatatatgaatgataaagagtttcacaaaaatgttacaaacataaaagtttgactattttttcaccaattgttttgatgctataggaggcaatattt

SEQ ID NO: 4541 - DNA, 1444 bp, Glycine max
  Soy_ogl_2094 Gm06:46347057..46348500 Cluster 19
accactattcggcatgatcacatgtgttatcattattacgtgacaagctatgtctatatatttcccctctctgtacgttctcaactaatgcaaatatgattttcttctgcctagattgcaggattagttaaagaaattccaaatttggtaatcgacaataggtcaaggtaaagtaatatttctgcaaaaagtaatgatcttcttcgttaggttcttaccctaaattggtcatttcatcactaatgggtttggtgaactttcctctgatagagttggttaagggttcagtgagaaaagtaaatatgatacagctaaccactcctaaacaatcgagtagctgtgtaccttttcttctttttcggtcaacggctctcattacccagctaagtgatgacatagttcaaattaattcaaggttgtgtcaagagagataatattactcttcaatctgagtcaccatcttcatataaatgcaagtttaacttaatcttcacaatctgtgggaaaatgccagcaaacaatggataactaaggctagttctgatgtttttaattggctccaatgtaattcctgtgcaaattaaaaaacaaatcccccattaaatgtgcatcataatttgtgttttaaatatcttaattgtaaatttaacctcatagcatgtgttttgttaagaaaatatatacacttaacacaagaaaaataattgtatgccatgaaattatcataattttaacccgtctttagatgacaaagatagttttttctcgttatttgaaaattttgactatttgtgtgattttttttattaagttgatcgtaaatatatagttgttttaaaaaatatcatataattcaggattatatatttcctaccaatctctatatgatatattattaattagtttttgcaaattaataaaatgtgattacatttaaatgttacataaaagaaattggctatgatcatataattttaaccatgtaataatttttttagtcttgaaacatgcaatagtttcgtgctagctagcaaccactatttatgtggaaaaaaacgtagtaagttttgtgtctagttattaacttttcacatcaagaaattcttccttcaattgttgcataaacaatttcatgctaacagccactattgtgaaaaaaaaacttagagtgagttttctgtctagttattagcccgttcacatcaaggagttcttattccttcaattgttgcataaacaatttcgtgctatgagccactatttaagtgaaaaaaaacttaattatatagagtgagttttctctcaagttatcagctgttcacatccacctcttccttcaattgttgcataaactactcgtgtgagtctcattatagaatcattatctgcctgaagtctcatcatgatcattatggttattatacatcataaagggtgagagttg

SEQ ID NO: 4542 - DNA, 1605 bp, Glycine max
  Soy_ogl_2791 Gm08:22493901..22495505 Cluster 19
aattcaataattaacattaaagatatatttactagaaaatcattttgaagtttgacgtcttaggtaaatttaaattataaaatatctttcatatgcaattccgatctagcaggaccacaaataatgtttgagtttgcagtttaacaagttcttcgtcatttgagagtttttcacaggataattatgtataattttttaataaattgttttaaattttttatcttttcaaaacagttgattatgccgactaattgatctaataaattcaaataacaacgttaattaataaggatattcacagtccaatattttttatttatttatgaaacaacattttttgaaaccatttatttctcctaagtatttgagtatcaacacatcaatcaatataatttgtgatgtaggtcataaatgtactcattacgacaagaagttaacataaacatatttttaaagtactttaattagacattgtaaatgcattatagtactatatttacttttattttgctcgattactcgtaaatgtttacttaattcaaattagtgcttcggtcacgctagagattggaccgtttgtaattgttggaagaattattgtcttctgtgttgacatgatactaggcatttagagacaaacactatttttgagaatttcttagaataagtagaaaaaagaagaagttagatccatgtcgaagaaatattaatacatttgttttatttttttaatacaaatgtaatttttattaaggagtctaattcagttggttatatagaatgatgcaggattattgtaaatctcttgtatttaattcttatttattaaaaactacaattgcaatttttttaattaaatattggagaaaatggtatacaaaggcgtcgcaactcttcctacttttatcataactggtacatattcgagagtagtcaattttgtaggtccgtttaatattcattccttttatttataatctttgtcaacaataataataattacaccattttttaatacacagtttatttggtatatctgaataataataaaaaaaaactctaagctgaataaaaaaagtatatttggtactaaatatcaacgaaaaaaattaatggagaagaacgttccacgtttcataatcaaactcatgttcatgcattcttttcgcccaaaagcaactttctttgctcgcgaataacgataatttattatatgtaatatactggacaatgtaagacaataactagtgtatttagaatatcaattaaaaaatattaatatactttatgatatttttactatacttataacgtgattttttaataattttatcattgattctttaattaagacataaatcaaggaaatctataatttggtagtggcacgttgcacttgcacccgttagatcgagcattgaaaatatgacacttgtagtatattttaaaaatattttacttaatcataacagctacttgatttccttaaaaaaaagttattagattaacaaatgtctaattggaattggtctgtattgataacttgaaattgtacatattgtttggcgaattatcttttgttgacacgagacaaaccctaatggt

SEQ ID NO: 4543 - DNA, 2000 bp, Glycine max
  Soy_ogl_4043 Gm12:15321401..15323400 Cluster 19
aaatatcctagaagaaatcatatgcaataaccaaaacaacccggaaaaaaaggagaaagcgtaaaagctggaaaaaacgtgtgggattggaatgttgttgcctatgtcaatggagagactatcaaggaagagagactgggagaaaaaaaatgtatgggatgacaaaaaaaagtatcaggatattagctgggattaggtgagattatttggtgggtttagtatttataacagccactaaaaaagtcatataaaattcaatcaataatataatttatttaaatctgtatgattttaaatagcaaatgatttttttaagtgataaaaaatctcaattctataccattggatttcattgtctcataaaaaaatcttcataaaatattacatgttttttttatcttttaaaaatgttgattaaatatcacaagagttttataaaataaaaaagtcttttaaaatcctaattaaatacacccttaaacaaggaatatgatattatgacattattttagtacagaaaaaaataattataattatcagtatatattatggagatcttatctatttatcatttttcttatttacgaacgaatttgtgattatttcttctctagatttatatatttaataaatgtattttaatgcaaataagaaacttatataaaaaagtaaacaaataaaattattatttgaagtttattttagagtctattctactagatcttctttacttatttccattttcttctatctccttatttggaaattatatgtttatttttcttcttttcaaataatttagagaaaatatatactttttcaaaatatacattttcttttcattaccaaacttttttttaccacgacttagctagacggcaacaaaatataaataaatatttaaaaatatttagaataaatacaaatgcacatgatttttctattaatctatgatatatttacttaaattaaaatatatgtatattaaatattaaatgtatgccttttaatatgaaaagtggtcaagggtattagtataaacacatattcacatgtttttctttttattacttttgtcatattttattattttgttcaaagctttctttcctacacttttgatcaaaatttattgtgatgtttcctaattgacttttgatggtttttccttttaatatataaattacttatacttatgtggtattttattagtttgttcaaacctgacaagatttattttgatgctttcctagctgacttttttttttatagttttttcttttaatctataaagagtttgaatagtcatttgcttttaagaggtttgatctttgttataatttagtttagttgacctcgttggcaaaacttaatttttaaaattaaatttctttgtgaaaaggtttaaataaaatacaattcaatgttcactttttttttcttgtttcaacttcagaaatttctgttgctatttattttgatgaaatccatcatatggtaaactcatgccgctggagtaaccgtaaggatagctaaagagatatgaattggttaagttgggaaaggttgttgataccaaaggagaaacgaggcatggggttcagggatttaagagggtttaatatagccctccttggtaaaaagtattggtagattgtccagaatccaaatccaccagtgtctggagttctaaaggcgagatacttcccaaggaaggatatatgggatgcttagcttgatcacaacccaagttattcttggagaagtatacgcacctcaaaggctcttgtgaaaggagcccactggagagtagggaaaggaactcgtattcaggtgtggaaagatccatggttgatgtataatatgtgtccttaattggatttatttccaggaatgagcgaccttgtggtggctgatctcatagacaattagagaggtagctaggacaagaatattgtggagggagtcttcaacgagagggatgctagggccatttatag

SEQ ID NO: 4544 - DNA, 1104 bp, Glycine max
  Soy_ogl_5104 Gm15:42197897..42199000 Cluster 19
caatattctctaaaaacgtatttttttagaataacatacatgcatcatggaaaaactaaatagttgagcaataaacgtaccaatgattatctcaactacaagaaagaactttatgataattaatatggggcctcgccacccatcaatgtactcttagagttattgttactttagtaggtgaggatgttattgattgtgaaccaacattgagttatttacacagaaaaataaaaaaaataatggaaaatcaaacaattatataatattaaccttatgtaacacgttgggattatttagctggtatgttcacaaaaaagtaactataaatggaccaaaacagttgagaaatattcaaatacctaaaaaagtccgtatggatcaaaacagttgaaaaatattctaatacctaaaagagtccgtagttatatccaagtaataatgtttggaattaaatattgaagaatcctttgacctttttaactctcttctgcccttttttctttctttctttttcctccttttgatgacaacctttcaatctgtaaagggtcatatgtatttggcttcttctaaactaatttgcttggctatccaaataaaaaagaaaacatttatgtatttaaatacttaaaagattttacgttggtcaaacgaaagttggattcatcataagagactaatccttcgagttgagataacctagcttgtatcctgttgtagacactagacaatacctgagaaacaccaaaacaaagttaatatgtctaatcttattggttacttttagaatatttttctcaaattatgtcactttagaatatgaaagaaattttttttcttcaataataccctgaccctcgagaaataatttcactagtacatatatataattgttcttttttcttttatatagaaactataattgtacaatatagttaataagagtatttaatcaaataagactattttatcatgaaaattagtgcaataaagatgtgtatattgccttaaacgacaaataaaatgagatgagagaagctattaatgacctaattagatttaaatcttttagatgtttatataattttctaaattttaaagcat

SEQ ID NO: 4545 - DNA, 1036 bp, Glycine max
  Soy_ogl_6099 Gm18:48059565..48060600 Cluster 19
taactttaacacagaagttaaagcctaccgaaagtgatagcttcaagatctcttcttagatcttccgcagtgaggttgtttcttactctactgcggcaaagaacatttctatgtgtttttgggttgtctcctccctaaactaactggcattgttccatttggttgtgtgtttttttttttagcactatccaacttgtttctccttttgggtgcgtcaattagattctgaggatctaagttggaagagctaccaccgttctaaaaggccatagacagttcaaaatttatgatttttttatctataaaaattgaagataatatcaagaaatttataatatttacctatcctactcaatcgaattaaatttgattggtcccaaaatcttaatatgaagacagcgtcactactcactagtaatcaatccatccattgatctgcatgtcacagaatagacttgatcaaggtgaatagaaacgttcaagtttaataaatatcaatactgattatgtatatataaaaaaaatcaaattcttcttatgtattagaaaaagaatttcagccttgtaattcaaaaaaattcataatacacatcgtttaggcttttgggacaaacgataggtagtttgaataaataaattaataacttcagtagtactttttatagggtcaaaagaaatttaccctgaatcttctcgaactacaaatgtataatttagtaatatatcggaaagctatttaaaaaaaaataaaaattataagtttccattctctttgtcttctctcggggctggtagttaccgacagatacgttgattttcacaaatgaaaattggaaacttctagccaatattactgatataaataaataaatgatcataaattaaggaacactaattatttacaaatttgcatgcatatcacactggtaaacaaaattaagtacttagtatataattataatgcattcactcataaaataataaaaatatacaaatataaaatggtgtgtaaaacgatgtgttactagcattatta

SEQ ID NO: 4546 - DNA, 1400 bp, Glycine max
  Soy_ogl_2746 Gm08:17436701..17438100 Cluster 19
atattaaaaaaaatatcatgcactaataatataaaaaagtaatttgcattggattgacttgatcggttaattggtggtggtttgtgcatgttagtactagagggacttgggggttttatatggtaaatgttggccatgctactaatattctcacacaacacaaacatctattcgaatacgttttatgatcgtctggaatgttggatacataaaaggaaacacgaagaatcttcttaattaagtatgactttttttttttttttttgtcgtgacagaaagactaacacgcatcttataaaaaccaatttcgagtgactatattgtaattttcttttttcaaaggattaaattggattaaacagctattttaaggaacaaattaagtattttttttcccatcacgtgaagaattatttgacaaattagctttgaataaaatatctaaataaaatcataatataagaactaaattgaatatatttgataaattgatcagcacaactgaataaattagaaaatgaattgaagactaatataactatagaatcagaatgataaattaattaagtatttatatcaaaatacctttaaaaagtatttatataaaaattaattcaatatcatatatttaaagaatttgcatatccttttttctttactacaagaatttgcatatgctatcacttatttaatcacacaataatgtttttccatttaattaagtgtatcttcgaaaggtattttcatttttttctaattaaaaagtttgtttgatcttattcataatatttaagaaaataagttttagtagtttgtaacattttatgttatattttataaataaaatatattttattattagttttatttaaaaaaaatagaaatatcagatattatatagtataggatgacaattatgaacctttctatattttttcaaaaaaacttaatacccatacttttacattattttttcttttatcgttcttttaatttttttattatgttatttatgatattataactagttggtgcctcataaaaaagagattatctagtccaagaacattcaagtatcaaatgtaatatgtcttcttaggttaagtgttagggtttatgtagaaatttttggtaactgctcattgagaatcttcccgcaagggtctatcatatcacaatctcacttattgctccaagatccctgggcatgtcctccaaacagtaaactttgtgtaatagctaaggattggatgacatgcatagtggagtgctagtgaccataaagcattgatcgctaaatgaggtgtgatgatcaaatggagtgcccaaacagtgaacctaagaggtcaaagggatatacaaactctgcaatcttgagtgcataaacattaaatgtaagt

SEQ ID NO: 4547 - DNA, 1422 bp, Glycine max
  Soy_ogl_4721 Gm14:6610479..6611900 Cluster 19
aattccacatcaataaatttaaaggaggtataacgaacaattaaggaaaatttatttatcagttgccaaataattagtaataggtatgtagattagtctggtctaacatcaatctgttggcttaatcccgtggtttaacatatccgtaccatgtgtcttgcttttattgcttgtacataattgaagttttggaatagttgaaatgatttgtaagacgattcagaataaaattatccttgaaaacgttaaaatgactaaatgaatgttgactttttatatatttttatgggtataagtgagttggactcaaattaattaaacccgtttaaccattaacttttttcaaaccaacccgtgtgcaaatccataatcaaacaaaataaagtttgcttaatataaacccgcacaagttgagttatgcagaccaattctcaaactgtgatttaattatatgcttacccccaagcaatagaagaaattattatataatttaagattataattcccattaatttttgcactgacatacaatcacgtgttaggctgtgtttgttacaatggagagaaataagtttgaaaagaaattttatactttatttcatgggacacacccctatcgacaattgacgtgtaacattactcatgctttaaatatcttgcgaaaagtaaagatccataaaaagatatttacatgttaaaataaatgtaagaaaaaaaataacacaataagtcttgacaaaagccaatataaaacctaaatgtactaaacaataacaaaaatctctaaaatatgtgttaaggagaagtagattaaggtaacatgaatatgtcaagagatttgaattgtaaatcttataatattttctttgattgttaaggataaaaaaaaataatatgaatatcaaaatccataaatattaagttatgcaagtcgattgcaatcaatgcatagtaagaaacatttgaattgctatacttcttgaattaatggttataaagaaaacatcatcctcaaagtaattcattactttctcttaataatgtgttgcttgtgactcaaaatttgttgttcagtctaatggatgttcagtctaatgagaattgtctgttgtaatcagattgagaacagtctaatgttcatcagatggaaaagttttgtttcattaatttgacacacatcaaattgttgaatgttttctgttagacttatgttgttgagtcttagtgacttggggcctataaattaaggtcatgggatctttgtgtaagtgtaactaactctaattagaagtgtgagaggtattgagattgttgtgagaaacataagagagaaaacattggttaggtagggaagagagagaaacagagtgtgaggcttggatttttagggagatttctttttttaattcaagggaacagaac

SEQ ID NO: 4548 - DNA, 1187 bp, Glycine max
  Soy_ogl_4765 Gm14:43218501..43219687 Cluster 19
ataattttacattttggatttgatcattttgataacaaaagcggggtgcaggaagcaactggggagatgaagaaagcaacagcccacacaagttttggggctacaaaacttgtcagcccaacatagaagtaatgctgaccatacacacaagttatatatagagtgttggttcttttcaccaaagagaaagaaggaatgactaacttgggctaaaaacaatgttgaacagcctagaagaaaataaaagagttgcagcatacaaaaccttgggtcaaaagggcagaactcaacatgaagaaaatagaaattagtgtaagagttgactaaaaggttaatagcccaacaaaaaagaaaaaaggaaaataagcccaacacaaactcaatttaattaaactaattacatattagtctaactaattttgttaataactcgcctaaatatttttaatatacttcattcttaattattcatactttataaaatatttttgtcattctaataccataccattaatatacttctttcaaatttttattttttctacatatttaaattcattaataattgcaaaaacaattaatattaaatattatcaaaatacaactttaattttctagccatagaaaaactaaataaaaaagaagaaagggatcacattttgaatatatatttttttttatgataaatggaagtttaatatatgaatgtgcttcgtgaattgaaccttgtgattctttaagttatgaatatattctcgaccttcaagcttgttcttatttagtttcacataagaaattaagactttttttatgagtgaaattaaggcttttaatcaagaagatttatttacctaaaaaatcaagatttaaataaattggtaaatttgtccagaaaactagagaaccaatctaaattaatcccaatttaataatttatagctgattttttttttttacattaaagatagtttccaacctacactcgaagactaattttccaacctacactcgaagactaatttctttgagctgtagagatcattaaagtatgtattgtctcttttaacaaatttttttttcatacacatttatatttgatataactatttaaaaagttaattggaggttaaaaaattagtatattaaattataagaatttggtataattagttattgaagtagctcaa

SEQ ID NO: 4549 - DNA, 1200 bp, Glycine max
  Soy_ogl_3857 Gm11:16927901..16929100 Cluster 19
ttaaaccaaggataccctaaacatgaaaaataaaatagttgaaaaaaaatggaaaatgatactgtatttgattcatggatgtgagtggcaagtggaaacaggatgatgtgtggtgtcacgtggataccaaatgtattcgaaagaagaaactaggaaggcccagtcttgacacatatgggactgaagctagtagctaatgctatggtaggatgggtcatgtgggttgcaaagttagtgaacaatcatttcattcaatcaccctccactctacctttggggaccaggatcccagtaattccatttatcctcctaatcttttatttaacatctacgttttaaaattataatcaccaattgttttaattattagagttatataaaattaatctttaaaatgattcaatgttgattattttgttatgagtttgttttgtaataattaaatttggcctttaatttcatttttattaattagtttggtctttaatgttagaaatgaaaaatgcgttgttggaagcttccaatttaattagtaatcatcacttccaacctttacatatgttaaaaacttaggtgaagagttttattatcaataataatcatatttaacttaatcataattatttcttttaaatttttctataaatactagttaataagaaagatttgaattcataatttttttctctcattttttttaattatcaagtaaatcttataattcaataggatgagtatttaaattcaattattaagagtccaatgatcttcatataattagatcatctacaaaataccctctagtttagaaaaataatttatttttttaattaaaattaatacaattaaatattattaaccaacttaattagcttggattaaatttttatacttatatttaaaatcgaaataagtaacttataatacacaacttgaagagtgaaactcttactcttcccactttttcaacaaaaaaaaaatgatgagaaagtaaaattttttgtatgcaaaaaaaattaacctttagatatttcatttcataatattacggtgcactctccacattttatcaccactctcttcaattgcactattgctgatcatcatcatccccacctctgaccgtgagcaccaccaacctcctccgtgcgccgccacctccgacattacccagatatgagcaaatgcatcaacctcgac

SEQ ID NO: 4550 - DNA, 1400 bp, Glycine max
  Soy_ogl_4578 Gm13:39634301..39635700 Cluster 19
tataatctttttattttttattattattcttttttatttcatatcacagtatttatctttttttctctttttcttaataaatacaattacatcactacccaaaaacacaaattaatttcaagctaatgctaatcatcaaaagtcactgttaatgactgttaccgtgttagagtgatggccacaaagtaaggatgtattcatgaacgatctaatcccatgagaacctaaaaaataatccaaaaagtcacagttcctcaatttgcttcctaaactgtttattatgtctctagactttttctctaatttttcttatttcacttttttctacgttcaaatctatcttaatttactctacctttcatatatactaaagagatgtttatgctgatgtacggactcacacttgtatttgagtattgataaatataaaatatgtcaatatatatgtataatgtttgaaatttttgtttaatggaatgataataatattaaaatatctataggaaaaagaaaatattaatttaaaaatgtattcctaattatatggtagaatgttttgaatgatattagtgagattatgataataacatcttgtagtgagtggaagattatataataaacagaaataaatgagttgttgcatatgtataagaatttctaagattccgctcgcacttttataatgccaacaattatattgaattgatactggtatttaatatttacttatacttaataattgaataaaatgtcaaactcactacaatcaattactcgcgagtttcgtccatcgcagatatgaagtgtatatagtatgtataaaaaagaaatattaagattgtaaaatcattcgcacatgccttttctctaatattccattttgatactatttataagattcaaactaaaaataatgtttaattttttacaagatccaattcatattattttgtaaaatcattcgcacatacattgtataattagtttttttaagtggtaataaattcttaaaaaagtccaaaatgaaaaaaaaaaaaaaagtccaaccaacatatagtgacttttgcgtggtggcctaaataatcattgtgttataggtccacaaaaagtgtctcgatcctcactagcaattaaaatgaaaacatcccgaggctcgcaaaagttacattatctatctatctcatcccttgcttttgcacacatctatgactactactattactatttgccccgagtgaaggtgacccatgatgactcacatttaccatgcatgccgcggtaaattggcactaacgaatctccatattgaccattagctacctagtagtagtttctaactactcgattcatttttgctacctcgtcatgtccttaataaaattagaaagcacaaatgcacc

SEQ ID NO: 4551 - DNA, 1100 bp, Glycine max
  Soy_ogl_2821 Gm08:38717701..38718800 Cluster 19
ttaactagtggcttaacaagtatataaatcattgattcaacttgtgaacctctgggtcacatttggtatacacaaggaatgttttcttattttaaaaaagtgatctgggaataaaaagtttttttttgtttaacagaaaataatgaaaaacatttcctagatattagagatttctaagatttttttttctcttacgagagatgtcttagaataataatttaggaatgaaaattttctataataatttactataaagttagtaaactttatatggtaattaatttgtaaatatattactatcaggaaagttgaataataatctaacatatttttataatttttttagaaattttatttctgaccatctcatttctagaaaaatgatttagttaagaattaataatttttttattttatgttatctaagaaaatgacaaaagcaaagttaagaaaagtgagttatatgacggaaattggcaaaattatcgaaagagagaagacgcaattcagccacacaaaaacacttttaattattttttatgtcaagtaacgactatgtgtaatgttttttgggagttgtgttattcgatccttaaacaaaaaagaaagtttttaaaccagtatataaagaataaaaaaatagggatcaaaattcaattcttatacatgataatagggtctaaataaaaaatattcatatgcatataaattgattttaatttgtataaaaaataaattaaaaatatagaaattgaaaaattaactaacaaaagtttcttatgcgttgagaacaccccggacggttcattagaaaaataactacaggtgctgtcaaaaaacaattacatgtttttcttttactgaaaaaaaaaaatacacgttgatagctcttaaggatagaaaaaaaactactttattttttgagaaaaaaagaaacgtacttaacggattggtgctgaatgaaaatctagaatctagagttgtggctagtgggggacagtggctagtgggggacagtctattgtctgaagtctaaataatggattctaattagataactatataattttttttttcaatgttggtatataatttttttc

SEQ ID NO: 4552 - DNA, 1121 bp, Glycine max
  Soy_ogl_17 Gm12:15761070..15762190 Cluster 19
catggagtagtacaaatttgattaatccatgacttgcgtgtccaactgattcaaaaggaagtcaaattgaagtataaattttaatacatacattaaaatattttgtatgccaataactccttgagtgatataacataatagttagtagattagaaataatagagcttatttatttcataggatcaaaaaatatgcgaagggttttgcagcaaaccgcttaatagatgggaaagaaaataaatataagaaccccttttttcatttcttttctttctctcaaacaaaacacgttgttaattatatttaataagatacattaatattattttaataagatattttaaaaaataatttagtttgttaaaaaattattttatttgaataaaataaccaccggaggtgtttaattaacatagacacattgaaattaaagtatttcaattcatacttttgaaaggagcaataaatatcttactctcttgaatattatataggtgaaagtgtaataaattgttaattatatttaataagatacattaatattattttaataagatatttaataaaataatttagtttgttaaacaattatgttatttgaataaaataaccaccagaggggtttaattaacacaaacacattgaaattaaagtatttcaattcatacttttgaaaggagcaataaatatcttactctcttgaatattatattggtgaaagtgtaataaattgttcgctttggccgttcttcgttgcaaactccggcaactctcacagcaacaataacaatgattatcttgaagcttctctccttctcttaggttactcactctcaagtaagttctctcctaattgtaggtgttccccaccacttatttggaaaaataatctattttttgccaacttccaaaaaaaacttttgacaacaaagcgattattttcttagaaaaatggtatcccaatgtgtgaagagcttttcattcgatgcttcaactgtggcaaatgttgtcctaaggttagttctaatttcactttcttaaatgttcaatttttttttctatggcaattcaattaaagttttttttaggctacattatctcttcgttgtagagatacaaat

SEQ ID NO: 4553 - DNA, 1200 bp, Glycine max
  Soy_ogl_2840 Gm08:41052501..41053700 Cluster 19
atgaaagatcttggatcttaatataattaacacacaatttaattaaagatggttttagaacgtgtatatctctagaagaattcttaattcatatccgtaatgttgatttaattatggaaggaatcttaatttcatgcttgcaatcacgatccaaacccatagggaagagaatgagaaaaaattgctctgtccagtgactaggattttctcacaagttatacatacaaaattgtctaatagaacaatgaatcaatgatattttagtcatcaatgagaacaatgaacccttaccaaatataagtccaagctctcatgcccattcacttaaaacatctaaataaggaccagtttaatttgcttaaattaatttttttttgggtaaaaaacatgattttttaagaagtagatatatatgagccgcttcttaagaaaacaaaattgtttttttttaaagaaaacttaagcaaacagaccctaacaaatatctatgattataattaaaatatcacatattaatttttataaaaatatcatctaataatctaaatcaacctagtacttaaataatagtaatctataaaaacatccaacacctaataattgaggcacaactataattgagacttgcaatcaaattctcgtgcacatgcatggccttctcaacatgtctaatatgtagcaatgcctaaccacaacctcctttatatgtaaaagcattcatacacgccacaccttataatattacaatgtgccaactcaagtatatatttgaggctaagttccgtgacattatacctgctaggtggctcaaaaagtcatttggagtttggacatattatgaagttctgctagatttctctacttcatttcgagggaaagtagagcactaagctagtttggtgtacacaccacgtgcaaacccacttacacccaaactggcttcttaagtttaacatgtttgttggtttagtagcacatggttaccggtataacttcactatcttcaattaaaaatgcatgtcttgagatattttggctaatgttttgtccccatcaacttgataggtaagcaatatatgattatcaaagttaaaaataacattttaaaacaagtgcatgtttggattaaaatttacaaatttaaatttgggttaaacttaagtttacaaactgaatttgtaaaagtattaatctaagttt

SEQ ID NO: 4554 - DNA, 1200 bp, Glycine max
  Soy_ogl_6140 Gm18:52616001..52617200 Cluster 19
tacaaaccaatttaaatatttgagttgtcggattcatcaaaataatttgatccgctggacactcttagaagtatatatgcagactatagtactgcacgaattacctcagtttgtagtatggaaatgaatttataataagtgtctaagaaaaattgttaattaataaacgatgctaaatgggtcgaaatccaaagtgagctcatttcttcttgttcttgcatgagattccgcctttcaaatagatcatacactgcatgttcctttaaatttctttctttctttatcagacaacttttgagtctttctgcaatataagactttataattccggaagacaccacaccaggccacaaaagtctcaaatgcatatataattttttgaaaatatttcctgttactaaattaaagaaagaaaatgagtttatacactttttagatttattgtaaacatttttatttaagagtgcgagaagttattttggagcctccttttgaattgtattttttttatcaaccagattcgaacatgagatgtttaagaaatttaatccaatttcacttttattaacaacatatcgatatgtgaaaagttatttgttagcgaatttaacttaagtgatgtaccaagattttttttttattgtctcactatatactttgaatccacagccttcttatttatatatcctttaatttatttctaacataccaatgggtgatttgttctttaacactttccctcaagtctgatttagtttagttgtaacatgatttagtctgattttgttctttaacactttgaatccacagccttcttaacgaccactgtcccaagtgatgccggtagtacccctttttttttttattttggtttctcatttacttttgaagtataaaaagttttccttttagcttgaataaaatatattttacttttgttcatcatcataactataaataacagttttcaaaaaaaaatttatagtaagtaaccgccaaaaaacattaaacaaatattaacttgtttaatataaagataaggatttaatcttattaggagattagcattttgattttaagattaagataatattttaattttgtcattttctttaagacattttagttaatttttaattttttttatatctaaaaaatttgtctaattgtttgataaacaagttttttctagtaattttt

SEQ ID NO: 4555 - DNA, 1722 bp, Glycine max
  Soy_ogl_3120 Gm09:36000401..36002122 Cluster 19
ttggttgacctttttttacgtaaaagaatagacagattcatttcaaaatcttattggacttgaacgtttatgcctgggtgattgtggggttgttcagttaccaagtttcattgtcatgatgcctaaactgttttcattggaagctgtatattgcatggggtggaaaaagtaggctcaatagtatcttcaaaggtagataagtttagtgccaatagtagcctcttgcataatgatttcttttcaacaagtttcacgcagcttgctcaggtggaaactttaagtctacggggcaataatttcacattccttcctggatgcataaaagaatttcaacgtttaagaagtcttgatgtgagttattgtgagcatcttcaggaaattagaggggttccaccaaacttaaaaagaattcagggcaagagcttgcatatccttgtcttcctcgagttcaagcatatccctcttctggtactgcttcttgcggagatatattcagagactaccttgatagatttgttcttgggttttgggttaagcttggggaatgttcctcaaatgatgaggctgaaatatggggtgtttatcatggtatgaagattgcgaggcagtataatattaagggtgtttatggtcatatttctaaggcagcataacattccaatgagggatgagattgcaaggcaacatgattttggtaaaattgttgtggcgttagactcgctgaaagctattggttttgtgcaggatggttgtcctactctttcatgtttccctctgtgtcatgagttgcaagctctaacctctgctacaaatcactcatactgaccagcctgctgattcctttgccaactacggtttatccatgaaccaggctgcatcgattttttgtgcttctccctccttttgcaaacctttcattcagaatgattggaaacatggatatacatcttaaataaataaatacctcaatataatatttatttattacttttttgtttagttttagatttgtccatacaagttgtactatatataaacaattgaattgtatttatgtaatttatttgttgtatatttatttaataatatatttccatttttattttattttttgaatattagcatatgtgaattaaaagtacaattgcaaattttaattaaaaaattattttaatactaactaatttaattttttgtaaacaaattctattaatattaacaggctgtatatgtttcaattttataaacaaatttaacataaaaccttttgtaaatatatggtgtttaaatagataccttgcttggtagttggtacaatttgcctttgggacaaaatggaattataaaaaataataattaagtaaccaaaatgttgtaaagtttaagtgctagaagttagctaaactagtattcacatatatttaaaactgaactgtctgacgcttgcaacaaaattataagtgactctttaaaaaatatgaaacaacaaaagcctgttgggactttgttactattgtatcatgttaaaatataaaattataaccgattgttaacatattatttattggactcttaaatgagtgaattttaaatcataaaaaataaaataaaaaatgaagtaaaagtccaatcaaattctattttcaaattgagcttaaatgaccttttatccttttgttgtttaaaaaaatgagcttaaataatccttataaaatttgatat

SEQ ID NO: 4556 - DNA, 1500 bp, Glycine max
  Soy_ogl_5980 Gm18:7445701..7447200 Cluster 19
ttatagtttaacaaaagattttcataatagtcttactcaatgggttcgaacttaattgtctcttatagaagatatgcggatgtatgaaaaaaaatttacctccaattagttgtgatgaatgcttgtgcttgttacacactcattgacccaaaccacacggtcttgtccaagtaggagctttttgagttactctttttataacagagacatctattctatccattattctgaatgtttcacttttactgtatggctagttctctttgaacagatagatcgtgctaagttaaaaaaatccagtagatatttattgtctcagtcagagaatagaggccaagaaaaaaggatatgtgggtcttaaaagcatatttgtgttctggaagcgcttacttggaagtggcaagaacgcaaaaatccttgtcactcgttgtaagggtctcactgaatgttctggtcatatatatcatggaggctaagatcaatgtcaaaatccatactgagaagctagttgattttttcatttagatcacgtcacaaattgaatatgataaaacttagatatagctttttatatgatattagtgttgttatctaattagaattagaattttattttgctaattcacgtaataaatgctggcattataaaatcagtataggtaaaattaggttatatatatgttaggtaaaattagattatgttatagctagaacctgaaaaactcgttagaaataaaaaaatactagcaagagttgaaaggtgcacgttaagctagtctatggaattaagtgaaaatctaatataataacattaaaaataattaaacatttaagttttgtcttatttaatattaacattgtttaattggagtttgaccttacctatgtacttaattatacgttgacatcaataggtagaacagtagaaagatttattcacaatatgtactatggattaattgagcacattagtgatatcaattctctacaatataagcaagttgcacgtatatatatgcagctcccatttatcattttctctagaatttatcagtataggtaaaattaggttatgttatagctaggaagctcaaaaataattagatcgaattaaaaagctaacaaggagttgaaagatgtacgttaagttagtgtatggaattaagtgaaaatctaatataataacactaaaactaaaagtaactaaacatctaagttttgtcttatataatactagcattgtttaattggagtttagcctcacctgtgtatttaattatatgttgacatcaatatgtagaacagtagaaaggtttatttacaatatatactatgaatcaattgagcacatattaattattagctttcgattgaaaaataatttatcttctgcctacaaacgggccaggccacagtattgaattaacagaccccaccttactattagccatagaatgcattattgcaaccttttattgactgtccacgtcaatattgtta

SEQ ID NO: 4557 - DNA, 2219 bp, Glycine max
  Soy_ogl_1594 Gm05:4908241..4910459 Cluster 19
ctggagtgatcctctctccttctctgctttttaaccagtatcttgtctcttgtgatgatataaaaacaaagcaaagcatctttcacacacatgatatgaccttataaatggcaaagaaagctgatactacagatcctgtggaggtgaggtgtgggatgtggccaacacacccactaagaggaggagaggtgagggatgaggtcaatgcaaatttggatgacccacttaaaataaataggaagcaaaaggctgacactgcttcctaccgcccttcctcagtgcaacttaatcaccaatcacattgaaaagtataaccaaaattccactcctctagtgcttttctcatagacaattaactacgtgaatatgcttatctcttcctcttatgtattattaatcccatcaaattggcccctcaatgtaaatgcacacacacattgcatcatatatgtttactccggacctgcaaattgcatggctctaatgaaagcttttatctgaagctaatcatctaactatttacatagacactttaggaaaaaaaaatggcaaatgtactggggaaatataaatgggaccaagaatcagtaagaggacaagtgattatcacaaatagcagcaagtgggccgaattgtaagtttacaaaagtcaacctgtgctcattattatgccttattagatttgttattataaatatattgctcgccaacaaagattggatcaaaagaggattaattaaggtggttttgggtttccatgttccattacatcactgtaagtcattatgcccttgacctagctaggaacgggataactttccttccttttcactgtcctccaaatagaagatttatcattttagccggggataattgtaagtattgaaatgataaccaaataaattatctacttgattggttctgtgtgtgatcatgagattcatgacaattttgcatgaaaagcgtgaaatagctggcagcatttttgactgagatactcaaagaagccttcacatttgtctgcaacatgggtttaaattgcgaccacaatctcaagttattttgacactctataatcattgcatcacgatcacaacttcaaccgcatcagtcacattttcgtgcattgtaaaagttttttgactcatctataacgcgattgcaatcgcaatttaaaatcatgggttgcagtcaaggttttgaactgcagtaacagatacaattctttcaatgctttcttgatatggtgagaaattgccaacaaatacaattaaatgctgttttttttcccgataaccatggtattggtgcgagagacataaatcctattacttatgataattattattgattgcagttaaatgttgctataggctataaggttaaaaatacggtaacaaactattttttaacaccttactagcagtaaattactaaattttacaaaggagaccttaaagatgagtttggaaaattggattagtctgtgcatgtgattttttttaaagcttatatgtctcgtctatcctatctgtgaaacttctaccatttgcccttttcagctacagaatccagattgatcattaactagggaaaagctagtttcagaataaatcggagtgctgtactttatgattgtcattccaattatcttgttatacagtatacaaacttttctgtgactcagtgatcatgatgtcagttggacattgatttttatttgattagataagcctaataattaagatgaaggacagctatccaaatgcttccaaaaaatgattattttttaaatatttgttgattattaaaaattcatatataacaagaaaaaacttagctagtataaagaactgatgtatgcattttaaattagagcaccattcttttagtataaacctataaattaatttcctttatataagaaaatgtataaaatgagaaaatcatttacaatatattaaaatttaaatcaatgacagatataattttactttcttacttcatacacccctttattttaatttttttaattagtctcaataatatattatttattctcttcattcctatttataagacacaaattagaagtaatgcttatttatttttatgagacttaatctataatatttcttgcattaatttttttagactgaaatattcttatttaattatattatcaaactggtagaagaaagaaaagtattaatgataag

SEQ ID NO: 4558 - DNA, 3270 bp, Glycine max
  Soy_ogl_4051 Gm12:15762318..15765587 Cluster 19
ggtccatgtttgaacctcgtcagaaaaaggaaaggaggtcaacctcatcagaaaaaggaaaggaggtcaacaaagctacgtgagggaaaactggggggaccatcagaacatctcttcgttctatttcactcgattccttgaagacacaacagaggaggaattgtggcaacacttcaaaaaagcgggtgatgtaagagagattttcatctctaggaagaggaacagaaatggaaggagatatggttttgcaagatttaagggaggggaagacgtgaaccagctagagaagagattggataacattgtcgtgggaggcctaaaactgtacgttaacataccaaaatatggtagagctacacctggagggacacaaccagagaccagaattccaacttttgctagacaacacgaacaggagggtagaggcacataccaggcaaagaagtctgcagcggttccgggcctcaagcgtggatcatttgcggacgttgttgcacggagaaacccacgaatggaccagatgataccatcaacaggtgtgagctacataagccacagttcaagatcagaagtgcaccttgacataccgctatctgggagaaaatggctgcaggaggcatgggtggggaggttaaaaaatctcaccatgtttgatagacttgaggaggacatgctctgggatttcggaattaacatagtgccaaaatatatcggggatgacatggtcttgctcctcggtctcacataagaaaagacacaacaaatgatggacgatgaggatgaaggaaggagtgctctattttactcgctggaaaggtggaagctgaaggtgcgagccggatatagacttacatgggtgtagctgtggggaataccattaatggcctgggactcacatgagatgagaaagataatcgctggaataggagaagtggtggacgtagatgatgatgtggaggaactgcggaaaatggataggactaggatcctactaaaaatgccatggccgatgatgattcaacatacagtacgagtccatattcaaggggaaatattccccgtacacgtaattgaggaaagcggtgcttactccaatatgtgtcgatgccggaatggtgaggggtacaacacatcggaagacattctatcggaggaaagcgagatggcctcgccgagggtgaggaggacaatgaagttgcagaaccgaaatcaaaaggaggaagtgatggaccgttgcggagaaagtacgatggaggagatggtggcggtggcggaggaggacaaatcgtgtgcggcggaagatggatccaaacacctattacccgttgggcacgatccacaccgtgacccaacgaacaaatgcatggaccgggggacgatgatgaataaccaagcagtggtcagtggcgatagtgacgacgcaaccaaagaccaaattgttgaacttgttatggtcagcgcaggtggggcagaaatggcttcgcttgatttggtaggagaaacgcacagcaagtgtagaacccaggcaaagctgacagaaggaaagcatggaaaaggaaatatgtgtgaagaagggaccgttgcaatgtctgaaatagctgtgacccaaataaaaaagtcacgtgacaaggaagaggcagaaatagatgggttaggctttactcctcacacccccaaaactccaatatctcaatagcaaaacaatattttgaaatcccaaggaaacaaagcacaccctcttagtgtgtactctagaaaaagatggtgtaaaaagaaaatagagccaataggcccaaagaggcacctgaatgcagctttggaccaacagggagagctaacacaccaggataataacaaggatgacaattcgaagataaatgatcaacagcaaggggaccattacaatgcatcagaccaaccaatacaagaaaataattatagcaaggaggcaaagaggttgtggcagatgccaatagaattgggagttacatgctgggatgaagaaagaagtaaggtgcagcaactagtacaaatggaagaaaggaacatcacaaagtcagagagattgggaggaaggaaaagggatcaatgaatatcataacatacaatgtaagaggtttagggagggggtaaagtggccgacaattagaaggatggtcatcaaacaaaaagtagatatgctatgcatttaggaaaccaaaaaggaggtgattgagagatctatgtgtcaagctttatggggggattcggaagtcagttgggaagctcagccagcactaaacacagctggtggcatcttgtgtttatggagagaaaagatattcaaactagagtggattcaagaggcccaattagtcaatattataagaatttattcactgtgtgatatccaaagtaaacgagtattatgggattctatcaaataattgaaaatccagagccaaggtggattatggtgcataataggggatttaaatagcattagaaatccttcagagagatttggtgtgtgtcacaggagcttggaggatggtgggtctagagaattcaatgaatggattgaagatatggaggttgaggaagcgccttgggtgggtagcaaattcacatcggtaagaccaaacggcacgacaaagagtaaattagatagattcttaatatctccttaatggttggccaagtggcctagctcagctcaatacacattggagaggaacttctcggaccattgtccgatattgcttcgctccaaaagtgttgattggggccctaaacctttcagaatcatggactgctggttatttagcatgtcattcaagaaagctgttgaggagagctggacatctaaccagcaaagtgggtggggagggtatgtcttaaaagaaaaaataaaagcactcaagaacaggctcagggtgtggaacatagctgacagacagttatcccactcggagatgttgatcaggaagcagcttcaggaggaattatgggtggcagctcaatcacatgagttgttactaagacagaaggcgagatccatatggatcaaagaaggtgattgcaactctagatattttcatctgatgataaatgctagtagatggaataattgcctaaaagggatgctgattgatggggtatggtcggaggagctggcaacagttaaagaggcgattaggttgttctttgaaaagcacttccaagaaactaaagtcgtggacctacattggatgggttatgcttctagaccatagacaaccagcaaaatga

SEQ ID NO: 4559 - DNA, 2606 bp, Glycine max
  Soy_ogl_139 Gm01:41734595..41737200 Cluster 19
ttggcattatctcctaaggttgttatctcttctagattatttggagttgtttcctatgatctttctttggaaacaacctaattcaaatacttctattgtagtggatatcatcttattttatgtttccatttatctttaatttaaatgtttcaataatttattgtaactacttctattgccttttgttggtggtatatatattcatccaccagccactacataattcaataaaataagcagtggtatactttaatatggtattagcttagccctagcttaacaacacctttttccttcattcctcatggccatacctaccgtgcaacctctagttgaaaccaacaccatctcaacccttcccatcaaattgaatgcaaacaatcatcatacttagcatgcacaaatcacacatttccttgagcttatgacatctatggctgtgttgatagcacaaaaccgtgccgtcctgcaaccattggcaacagtgccactgttactcccaaccctgcctacggtctttagaaatggcaagaccactacatattccttgctcttattggctaatgcaaccctgatgcacaaattgtcatgacttccgcaacatcttctgccgatgcttggacacggatatacaagcactatggcaatcactctcgtacttgggtgatgtttctcaaggaacatctttccagcgcctccaaaagcacttctagtgttggtgactatcttcgttcaatccgaatcattgcggacaaactttctctcatcggtcactttgttgatgacctcgacctcgtcatcactgccctcaatggccttggtccttccttttgtgaattcactgcgtcaattcgcacaagggacactctttttctctttaatgagtaatttgacaagcttattgattttgaaattttcatgcaacgttacgaacgccaacaacagttgttccccaccattgctaactttgttggccgctcttaaggttcttaccatgggaagaaattcaccctctctcataaggcctccttcaactgcaataacctatttcctcatgacaacaatcaaggtgccaaatgctccatgcctgtgtgccaatattgtgttacacggggtcacatgataggttaggaaaaccactcatggctaggttcaagaaatgattggccaagcaatgaagtcctttgccgaatgccaacggtaagagaatgagcaattttgcctctctttgcaaaatgccataaacacaattctccaaccttggtgtcgtccttttacagaacatccaacaggctcaaataacaatgcttggagttgttgctgcacctgcccctacacttgcacttgtacttcaaccactctccatacctacctttcttgaaccttcaccacaacccttggctctgataccaacaccacctccatcctctccaccactttcccaacctccacaaccatctcaaggctgacgatgactttagctatctttgaacccatttttgcttatgacaaaagagaaagaaataggaattttgattgtaatgaaaaatgtcttatttaataaaagcagtcttgaagtatttccttatatattctcctttacttgttatttgttatatgccgctactatagtcatcatacttaatatatgtcattttcttgtcatgcttgaacttagggggagtttaactgcattacattgtctttagtatcttaaaaactccgtttatacttgaagcgaaactctactaaaaacactagacgatatacattgtttattctttatgaagcaaagtagttacgtatttatgcttaactatatattcactctttgaggattaagaatacttgtatttaaatcaaacatttatttgtgaaagccaggagtggcttagtgttaaaaaatacttgagttcttagactcagaggaagtctaagaagatatcagaagtggtgttgagaatacttgtaaagccaggagtgacaggttaggataattgttttgtaataagttttgattagtggaaccctttactagtaagtaaaagagaactggatatagctcaggttgagcgaaccggtataaaccaagtgttcttacttctctcctcaattttttattgagtattcttattacattttttaacattactttacaccaagtgcttaattcaaaaactattttaagaaccttttatctgtcactgaatgaccattttgttcttcactacatattctttttatccacagtggacgaccagtgtttaacacaatattatcatattattcttgttattgcaaaaagtatttatctttgatatatacattattcaacccccctttttgtgtgtgtttcttgtagtttcagttggtatcagagcttggccttaagggttgagtatctaacaatactaaggaaaagatcctatatataaaaaatatggaagaaggatttgccaccaacaaaccacctctattcagagggataaaggatgactactggaaggagtgtatgatatcccattttgaatttattcatatagatctatgggatgtggtagaaaatagagattatataccatatgatgactagatgaacgagatcc

SEQ ID NO: 4560 - DNA, 2480 bp, Glycine max
  Soy_ogl_1317 Gm04:39295189..39297668 Cluster 19
ttgcgtcagtcttacactctggtgttgtttccttatgtgttattttggagtttcttcactcttacaaaggagatgggtcgtgcctgacaatcttaataagtccatctccatcaataagtcaataccataaattgtaggaactcaatcccttcaagtatacaagtgtcgacaaagaagaggaacactaatacacaatgttgatgatgtaaatgattgctctggaattaaaagagacatatactctactttagtcctgttgtttaaatctttctttacacttagattcagcattataggcgactagattcgaggatgtataacagttacatcataatctccctggtgcagtgaaatatgaacaattcctctgttatttgttgttgcaatattaggcccagtttcacactcctaaatcagcttgtccacaacatctccagctggagtgtttttgaaagtctcatcagttagagtcgtgccgttgaaaccaacttgagctggaccaaaaaacattataatcccttcaacagtaggataagagtatgtctctcttagtatctttttcaagtattgtgcctactctagaaacaagaataagagaaaagtaaagggaatgcagttagtcacatgatatattgagatttctttgttttttctttttttgtaattgataaaaaagacaaaattggtgtcttttgcattaagtggccttttagaagaacttgtgaaaataatttgatcagtttaatttcctaatacttcaagtgaaaagatttttatactacgaactaaccagaaatcttcctatgatttttaagataactattataaaagtaccatacatcatagtttgagattgtagacggcataaacaacgtttacactgcttgtacattctaatttgatacatataagcttattttcatgaagtttttgatagagtttagcaaaataaactaatagtactaaacaaatttacaacatgacttattgtgtcatacaatatactactgaagtttctgttgtaagttaaaaataaatgttcaagaaggagaagtttattagaatattttctgaagttgaggaaatacctaactaagaaccggatccacacttggttctgtgagccaaattggaactccagttgtagcaagaagatcaagacctaagcaccaaaaggattttggggtctttcggcatgggtcttgcaatggctatgcactgcttttgtcgtcctaacaattgtgtgcctttttctccaacattggtgtcataaccatttggaagagaacctataaactcttgtgcattggttgcttcagctgctgcaattatctcttcctctgtggcacctccctctttggcataagctatgttggcacaaatgctttcattgaaaaatataggctctgccaaacaattaccaaatcatccacctaggttcaaggcaaaacattacaggagtttctaacatattagcctacaaaaacaatatcaggagagaaacaaaaactaataaaaataaaatgataaacctgtaaaaattctaaaattaaaacatatgtttcccatacacaactatctatttggcctcctccctttccctgtacaatttaatgtataaagggttatagtcttcagtcttcaccatcagattatgtcgtttaagtatataacctcctctaaatttatcttcctactttcagtctttaagcattttgagccattaggacgttaccagcttcccactgatttggcatatcatgtcgaaaaagggcaatgagaaccattacggcaatcctttggagttccgaagtatatgcaaggtttcttgcttttgaatttcacttcccatgcgaccgtatcaaaccttgtaaattcttaagactcttctttccttgcttatgagtaccatgttctttaaccaggcatatgtaatagttgacatctttgacagcaccacttgtggtcgactgcatctgttttgcaactgcatgcatgtatgcataagcagaaggcacaaccagtgtcttcaattcactggaggaaacagaagccaatggtaaagcttgattgttagaacatgaaaatagtaactgattaccttttttgctggaatgattattcactaatctttgaaaatttgaatatgaggcctagttgggtaattaaaactgacatgttgaagttcaatatcagtagaaacgtcttctaatgttctaccctcattggtgctggagttaatggtaggcttactgtcaagaattttaaatattgaagttgcggaatctttggccttgttagtgtttggtgctacgacaatagtctggaaatgcctatgtctgtgattgctaaacaaaacaagacctgcacaaaatttctggtgagaactagatcaaaacaaacatcaaataaagatagatcatcccaaggctgtcattgattgatttcaccttgaaaacctctggaaagttgctttccca

SEQ ID NO: 4561 - DNA, 1213 bp, Glycine max
  Soy_ogl_1323 Gm04:39412888..39414100 Cluster 19
gatttttataatatcagtgtatttaaatttaattttataaacaaaatactgttcattacatgtggaaaaaaaaattggaggtcgtggctcctaaccactctaagccagccatggtcatatcactaaaatacactattacaattatttcaattatattcctttttcgtacataagtgtgtgtttgccaatatatactatatgtgtacgtaatttgtttatttatatatccgtaattgtattaagagtttgagatagacagcgacagctatcggtattaaatggataaaaaaaataagtcttctatgattatccaatcacattctatccatgatgacaagtaatcctcaaatataactgcatgctaagaatcttgtgttaataattccataatctagactccttaaaaacacaccacgtcaaagtctcaccatgattatactctatccattcgtttccttgttctttattttgatttcctttttaaatattatctgggttgaatacgcatacatatatgctcatactttctgatcgatatagtagtgtatatgtagcttcaattatgaaaaattgaagaccccaagattacgataggttggaatttatcaaaaagcttaagagttggactattaattacttagactatcgatcacgaattattttgactattttgcactgcgaagggtagctatttattagacggggaaattagaagcaacgcgtcccaaaatcatcgcgtagacatgcgtaatggcggcacaggtccaaagttaattgcatcatgcactaggcactagcaaacaaatcatgccgagcaattcctttgtttttttcgtttttgaaatggcagcaatgctgtacttcctttttttccaaatggcatagagacacgtcacgtatattaatttttgttttgttttcatatattacaatacaattcttaaaattaggatttgtccagaagctagcttgcgaggtgacagttgtttttttagttgatctaagatctgtaacagattttctaatgtggtaaacttgaatatcttaaaagtaaaatatacaaaacaaacatatatataggtaattcaataaaggtctgataaagacaattcaataagtctaatataatctcctaaaattagtacagtagtgtaaaatttaaatatagataatgatttatttagttagataatttatgtttaatcatcttcaa

SEQ ID NO: 4562 - DNA, 1700 bp, Glycine max
  Soy_ogl_1341 Gm04:41944701..41946400 Cluster 19
atttttaagtaacattaaatatttgaattttttatagtagtctttttcaactcaaaaaaattgtctttcgtgaagaataattacagtttcttagaaaaatatgtttacatattaactaaaaagaaaatatttaaaatattttaattacataacaatgcatgattagatggtagtgtatttcaataaatttttctttcatagaaatgatgcttaagcccctttctcaatataaatgaactaaaaaaataatataaaataaagaaggaatcaaaagattttacagtgtttgggtttccttgaagaatttaattaaaatgtatcgacaatctaagaaaaaaaattacaatatcatataatcacatattgtcatagtaaatttctgaattttataataattatctttaaaattttactttagattatttttatttagtcgactgtaaatattttcatataaataatgcataaaaaataaactctatattcaatcccataaatgggctataattttattaaatcaagcttaatcacgggtatattttttcctagatactcttcaagagtttcaagattggttgtatggagaactattctgagtttcaattttgatctcttaagagcctgttgaggaggatttttatgggttgttatagaaaaagtgtaacccctcgatatattctaggttcgctacttaaaaatattaacattagagagaatgatatccctagctaactagttaaaaaattgtcacaaaatatatcagtgatgaaatttgtgaccaatgcatatttttagtaaatccatcaacctactaaacaacctgctttatcttttagtaaaaatgattctatttatgcttctctttttgactttgttcactttgatgtttggggtaatctccctttaacccttcatgcaaacataccttatgaaaccaccccttcccaagattcacggccagatgatgatttagatccaccataaaatttctccatgtgatcgggactaacagttgagtaagagggtaaatgaaattatttttaaataaaagattaaaaacaataaactcaaaggcaattgttaaaaatagtcttccaatcaccacatcatccaaaggtaatattttggtcaaagaacaaaagaataaaaagggaataatcaatgtgcttaagtggtgtttgcttctataaagtgaaacagtatttaggaagaaaacacggtaatcactaactactaacatttcgacacttcatgctttggtgtacgtaagactcaactctgatttaacagaatacataactaagaaataagagttgaaccaaatcaaactatttcagaacttgagaccacttcaaattctatttccatcttcatgtataatgtattgttatgaggaagatctaccttcatttctcttcctagctgacttcatggttttggatctcaccagagctgacaagtgagttgacgctgctgccttgtattgcatctttggatttggatccattagaaaggtgtgaagaatgagctgttggctgatcatctggtgtcacttccttttggactacctgctttaggcgtctgatcgcttctgcagcctctggcattgctatgggaggaggttgaggaggaacccacgctcattggactggctgctgactggatgcagcaggtgctccattatactcaattccattatc

SEQ ID NO: 4563 - DNA, 1300 bp, Glycine max
  Soy_ogl_2035 Gm06:38792001..38793300 Cluster 19
tttaaactgcattaattcttgtatttgttgcttgcaaatttcctagaattatagtaaatattttttgcgtctatccattacatgtttctagtgaaatgcatcagccggtgggaaatttgagattaataatgcaaaatgacggaaaaaaactgagttactagttttaaattgtaaagctagtatatataattaatggttttagaacagatgtagtaggctctgcatggcttgaaattatttataggttttctttctttcctttttccttctatttatattttgagctggttttctgttgagccttggcttgcttgctccaactcagcttcacactagtttggtgctccagttcttggtaagtttctcaattcacttttttatgtgaaatgttagcaatggggttgaacaaattttgttgtttaaattccttctgtttagtttttttttctgttggaaacatgtgattcaatgctagtaaagagctaaatgtcttcaactagagaatgagttgctctttgcctttgatattatgttaattacttatgtagagtccaggattctgggtcatgatgctgataagattactactactataccagttcctagctagaaatgtccaacaagtatgataatgatgactttatttatatatttggaaagcaacaaatgatgctaagttttattcttcactgtagcataagtgtggcaggcaatgccaaatctaaatataagatatataagatacatagaagcttaataggaggtctgataaattctaaatgacaatttagagaacttttatctctaattgataatatgaatagtcttctaaattctgatttgtcccatcaaaactgcagatctgtataataaatttgagattcgaagtgctagcaggaactttgagctcagaaacatagaaacaatttacatgtgctactcagggatactcctgcacatgttctattgttctgcctaaattacctatcttactacaaacttgaggatagatttacgtgtagttttttcagcaattttaatagaggtgatcaggtgatagcgtacagaataaaaaagtggataggcagctcgcttaaagtgaactctccttcaaagattctcctcttaaagtaagtatctttttctagagatcctttaatgtaatatttccccctccactatataatgctcccttcaagttgcattttataagaaatacaacaaatagttaagattttagttgaactagttctaaaatgtagtaatttaataccttgatttaaaatagaatagaaaataa

SEQ ID NO: 4564 - DNA, 1700 bp, Glycine max
  Soy_ogl_2812 Gm08:36255701..36257400 Cluster 19
cttaaaacgcgagttcagaccaagtagtaattgactgatccaaaattaattctcatctttataatagatggtgtggatttaattctctgaataatcttttggatgaacactttttgaaataaagaaaaaaagcaactaaaacatgagaggcctttatcaatcgtcttggttagacaaagttagtatatatataatatatagcaacattccctttcctcatgattcagtagaaaaggtcactttggttgcaaactctttgcctccatcaaaacaaacaagtgttgtgttcatgtgtttaatcagtactctgtaagttgtatattctctctctaaatctgcaaggtcactttttctttttcctacttttcagaatttattaattttccgtacacttcccttctgattaaaagtttcttttttccgtattcctacgatttttattactttttaatatatttttattatttattaaatttcatttgaatttcattcgctaaaactttcatacttaattttatatatattatgtgagtttgtttaaacttaaaaatattaaaataaacattttttatataagaatttttttaagaagtaaataagattttcttcttaaaataaataaataaaaattttaactagaaacaaatttagataaatatacttaaaaaatagaaaatcatatattttaatgaaataaatatttatttcaacaaataaattgatcaattattcatataacattttttcttgtctatgttacatcaattttatcacacatttctttctttttttttattcatatgtcacccctttggtgtaaaatggtgaataacttagttgtacataactagcatttctcataaatatttgtgcatgaaggtatggatgaagtacttgtctccaagtaaattataagctatatggggttcagtgactcatgggtcacggaagagaaatagagaaaacatgacatgagggcgcgtgattaacgtgacagttgcagatagaaaaactctcctttttgttgttcatcactctgctagtggctcaaactgtcattttacaacttacaaaactgcaagaagctcatgacacacgcatttatctatctatgtatatcccatagaagctctctgttctctacttctcatgattcctacaccgaaacttctggccccaccattcttcatcacttgatagttccccctactattcaactgcaagcaatcatatgtatgaccacaaacataagcaccgccaatattctggttttcttaatcattttatattcttgtagtttcattttcgttttcattaagattttacgtattgcattaccatgaccctagcttaaagtatttattaattttattaataattaatctttatcaaataaattaattacttttaatggtcgatggtttaatttcctttcagagactttgtaagtttaaaagaatttgaatttaatttccaataacatgttgatattaagattctatataattgaaaattataaaattgatctaatgattggaaagagtaaagagaaaaggaagagaagagaagttacctattcaattcatctcaactgacatttttaaccaaactaaaaaagttaataatatttactgataaaaaaatacatatttaataaaatatcctctcttaatcacatttcttcaatattcaaatttgaa

SEQ ID NO: 4565 - DNA, 1906 bp, Glycine max
  Soy_ogl_4030 Gm12:9443495..9445400 Cluster 19
tatattctaatgaaagttagagaaaacccactgaatgtattagaaaccatgtgggtatgagacagaatttacatctgctctcagcgataattaaagaagtatatgttgttttaattaacaaaacactaccaagaaataagccttctttcttttcttttgtttggggaagagatagagcaggaggtaacgagtttgtttaattatctgattcccaaaagaattgtttgggacaaaagatatcgccaacaacatccaattttgtttcgggatctcaattaatgataaattatcaatatatgtgttaactataagaattcatgtaagtagaatatttttaatttttctaaaatattcttttatgtatcctttttgaatggcaagtttataagggttattttttttgtttttaatatattaaaaaattatttttatctaatattttttacaaagtatcgtaacgatttataagaagttaattataacattgaattatcctatagtattattcgttaaagtatgttgaaattttctaatgttagaattaaagagggaaaaagaaattaacatgtaaacttgctagttattgatatgctaagtatagcaagtgttattatattgcatagttatcaattaccacatgcttttagtcgagtatgcttaaattatatatatgtttaattttttagctaaaagaagattaagttgaattctatcagcttctgacacgctttcaattatcaaagagagtccatgagtcaaaacccaacgtgactcacacccatgccttagaatatcaaatagccattaacaaaaaaaaaaaaaaaaagaagatatgagctgcacttaggagaaacgtaatcaataaatgtatgttttttatatgagctgtcatgacttttgaccaaggacttccataaaggaagaagaaagttttcgttaagtagaaaaagtcttatcctatttgattaattagttaatacaaaatcagagtctgcccataaatttatttcctaatgtaccaaaaaaagagagtctgcatgccctataaaagcacattaatttctattttaaaatcaccggaagtaaacttttttttattcttattaacattttactaatttatatatcagaaaccgcgttgttttgatacataagctaaactataaagaaagactgagaatccataacctgaacatcaatcatgacaatttgaaacccttaaaacgacagatataaatcataaatattagcacgagatatctatattataagggcagtaggagaatcctcatggtaagtaacgtttgaattattctgctttggtgtttccataaactgacaaaacgattatcaaattaataagctaacctctcctagttaatttaacacctaattacaatctagcgagtgattagctcactgcttctgacgtgcatcgtgagtatgctcattaaataaaataaaaagagttgaaaggaataaaaaaaagtgagtatagtatacaccttattgttggtgtaaaaattttcaaggaaattaaaatggaaatttcaccgaaaggtaaatgctgagttttctagaaagagaattattaaaatattacaaagttgcatttttcacaaaagctaaaatgtaacatttttttatagaagcgtgacaattcattgaaatttattataactgatcattttgataagtttataagtagtaatttcaattgaagtttataagttatagtttgatagaatcctttttttaagtcaactttgatttattttttttaaagataaaagtgaaatttgatagaatcttataaatggtatttccaatagatttttgaaagagaagacttggatagtgattaaaataatgttaattttcacaaaagattaaaagctgataactt

SEQ ID NO: 4566 - DNA, 2000 bp, Glycine max
  Soy_ogl_4039 Gm12:14932801..14934800 Cluster 19
tttgtgaatgtagtacaaataaagcctttttttaatggaaaaaatcagaaaaggataataaatttttttatataaaaaatgtttaggtcctcgtaataagttttataaattaattaattattttttatttttgaaatactattaatagattaaaaattttgagggatctgaaacggtccctttcttgctcgatggtgtgacggcaaagcaacaattcaagctcatattttaatgaataagattaaaaaaaaactcccttgttgaattgtcaaaataatttattggatcaaggcacataaaaaatgaaaaattgaagaattggaagcatacctcgtgcatgtgccccaaggaagcatgccaaagagctctgtgagcccatcttccctaaaattacatagccacctgaaaattagacatacccaattgaattcaagaggtagaattaaattatatacctaatgtcataatactgtaagtttaatattttttatccactatatgaattttgtattttacttaagttatatccaccatttgtaccattttttatttatttatatactgtttgactcttcttatgtagaatttattctccaattttatttatccaataattttaattctatatttttttctacagcaactattattcacaatgaaaatatgtatttttttagttttatggaaatatgcataccttaccaaaataatctcaagtaattataatttcgaacatacaagttcccacttcccacattttgaaatgaaatacgaaaaaatagcaccattttcaatcgtttattaacttgtatataactagctccaattcaaagactgtgcaacacaacaattggctagcatggaattatcaataaataaataaattggctagcatgaaaataaaaaacatggcaagcaagacaatatagctttgatttgaacaccttctttaatgcaatttcattatatcgacgaagtgaaaccccagcagaatgagcatccctgccagaagcatctttagattattgtttttttctgccttcacccttacaacatatcttaataagaatgataagaacttatgattacaaacaaaaataaaacttcttttacaatttttagcaaatagaaactagtaataataaaatgaataagaaaatagtgacacaagtatttggtcaattgggaagtacaataaatgctttactgccttaggaaataaaacagggacaaggaaataaaaagaactcctgaaaaagttaatcaactacttacataagctcaaacacaaataatacaacatttcacgcattctccttccaaaactaagtgaaacagactacaagaacaacattggttttcattcagatagaacttattgcaccaaatcacttgcagttcttccttatgccatttgtcaagtccatatctaagagcatatttttcatctataggaactccaaagattaatcagccttgcaagtttcaaatcctcataaagaaaaataagagataccccatgtcaggcccctagaacaactaaaaacaacaataactgaatgtccaatccaacactctaatttacaacgaagtgttagaataaattctaaaatccaaacagaaaccactattcagccgcccaataaactcaacaatattgcaagcaaattaaaggtgaagtatgcttacatttgacgaaataaaacttataatcacaatgggttttctaccatactgataacctatcattccccacaacatagatgtgaaaacatctgccaagcatgaatgcagaccctacaacatttttctttcacatgaagatcataataaagtaccccccacttaaaccacttaaacgcatccttcaaccttgattaacagaatggaacttttgaacccatttgattcaataaagcaatgcttttaacttcaaatgttaaaatcacataatacattaaatcaatttaaaagaaaaatagaaaattccaattcataac

SEQ ID NO: 4567 - DNA, 2347 bp, Glycine max
  Soy_ogl_4047 Gm12:15435254..15437600 Cluster 19
gttccttgaactcttcccctgggcctccataggtacatgctgtctcagcacattgtatgcgctcttagctgagtactgaccagttgggtcagattcccacacccactggtcaccaattgtaggtctgattctgagtccctccacttcttggataaatgaaactgccatctaaatctcattgtcaaagaatggtctccgccacttaaaatctcattcccagccagtatctttgtgagttcccatgttctgaattaattggttttgctgttccgatatggtgtatagcctagggtacttctccattagttgattcccacctcctgtccatgaatcctcccaaaatggtgggtatgaagcatatttatgctaaagggtgttgtttgtttgtgttattttttgtatggcttctcctttattttgaactccaacctgagaagtatttgaagcaaatgagtgattttaaatttaatgatttttttcattgtgcatctctgctgatgggatttcattgtgcttttgttacatgctgtagaaggtttgaagtcgttgaaggttttgctgatagctaaactttttttttaaatgaattatggtctagtaatccatttagaaaatatcattttgtgtggtaaatgttttcccaactgattgtatttctcatttgtagggggaaaaaaatgccatataaacaaatcaattgtgtacacacacatgttaagcactaatagctcaacaatatacatatacattttaccaaaagagtacttcatggctcaatgaagcttaagatagcatttgaatgtatggaaacaaaatttttccaaaaacaaaataataaaatgttaggaacccaaagagagacaataatgactaaccagtcacacagctaacacagttacccacttaacacccatctatttggtatctttattcctgaaatggtattcaagctttactcatattctaagtatttgatttgtaagactcgatcagaaaaagaatttccagtggtttaagattaaccatcaattcttcctagcataagttatgctgccaaaacaatatccatcaatactccaggcccaacatttctgatttctctaatgagctgtcaatgattgctaattcttcccgccataaatgtatgtaatcaaactattggttaattattcaaagaaagcttgcaagtgatagaatcatgagcaaaggtgacaatagattcaaaaaatttataactcacttaaaaaagaacctaatgcactgtaactttttcataataatacctcaagttgcccgagacttccaacattttgggagttacttccaataccaagtgagcgtgatgaaacatcagtgcctccatgcaaacgtttcataagttttacacacatatcccttgcttatgcagccttgtttagtgcatcttcagtagccaaaaattgttgaacatgagctttctgtcaacagagatacaacaccagttcaataactcctcttatgacaacaaaatatgcagtttaatgatgaatccataacaatgttattttcatatgtgtacctgattgaagaatgcaagtttggattataacagcaatagcatatgtaatatccttgtcaataagaacaaactaacagaacattcattaagtgtaagtttggatgagcgaggcaaaattgattttggttcaaattgattttgaaattatgagaattatgaatggatattttacctttcatttgatgaatttgttacatcattctgtaggttttcttgaatatcctgattatctcctgttgcagtcaaattaatttgctaaacactaaattatgctgccatagtattttcggattccattgggagcgattttagccattgttgattttgtggtaattgctgtttcaaaattcaaactggtcctgtggtcattgctagaaagtcaattgtgccgaagcctcgaactcaggtatttatatgtttcatttgaaaactaatttgaaattgttgttgtatgcaatactggtatatttgtaacttatgctatgcctctctacatgacctttctttcatgggactgatatcttgatgcctctctacatgacctttttttattggactgatatctttgaagtattgactgtgattttggctctcagaacttgttaattcttagtgttgaatgtttttgtatttttatctactgctcttctgtatatatatgttgtgtctgccactgcccagccctctaatgttgtaggaaagaatattcatctatgagttttcctctctcccaactccatagcttcatttctgtctctggcctccatatatgcaaagctttgaataaaa

SEQ ID NO: 4568 - DNA, 1500 bp, Glycine max
  Soy_ogl_4733 Gm14:12922901..12924400 Cluster 19
agataagtgatttctctcaattcaaacatccaagaccacttatataaggatattctgagattgtttttattaaaaggattcaagggcatttcttgaaagaaggttcactggtttaacggggaatattatggaacaaatgctcatttggtataaggtaaaatgaagctaggagttgtggctatataaggatattctgagattgtttttattaaaaggattcaagggcatttcttgaaagaaggttcactggtttaacggggaatattatggaacaaatgctcatttggtataaggtaaaatgaagctaggagttgtggctatgaccctaatggtctattttcctttttctgaattacaatagccagcacaaagtttcagcaattaaaattctttagttgcgtgtaaacttattatacatagaagtgtggtttttctatattgtaggaaagtttatgattacaataataaaatgggagcaacgaggttgaccctgagttagtaataatggggtcagtgttacttattcatctcttaattggcatctcacaaggtcgaccccaactgtgcagaaaatcaaatgcttttaagcatcaaaacatcattatatgcaatagtttttacttgtctgataattaataggagaaaaacaaataaaactttcaaattcatagacataaccaagttctgttgttatgcatgaacttgcctgcagtaacgttactcataaaaactaaaatcattgaaattgaacaaagatacattcagttaatcaattttacaaagtcattcccacgatatataacaatgaaatatttattccttagcagcaagatacttcctgttaacatctgtaccataacaggaaaaaaaataattcagaaattcaaattgacaaaactagtagcttgctctctattctcagcttatgatgtcttagaaataaaatgacttgggagaaaaaaggaaaaaaagatttagccacattatgtagattcatcccaaagaatgtgttaatatcttcaatataacatttgtttttgaagttatcaatgctgaatgcataacaagaagagtgaaactcactgaggacttcaactgctgagagcctttgtttggggtcagctcgtaatccagctataatgttgtttctctgccaattcagtatcactcaaataaataaataataaaagtgtagagactaacttgatacatgacatgtatttattactatcactagaatgaatgctacgcttaggcaatttgtctcttgtcttgggcttttctgccacattaggcatgttctccaaagaatccatcaaatttctggatttacgttaacaatgcacttttccagcatcctgccaaacattatttcataaagcacttacattaagtattaaaaaaagtaaagatggatttaaaatgagaagtaaagaaagcttaaaacatatgtatacaggagatataaatcaagataatgccaaataaaagatacaatta

SEQ ID NO: 4569 - DNA, 1796 bp, Glycine max
  Soy_ogl_5087 Gm15:25121635..25123430 Cluster 19
ttgtttggttggagagatatagaatgaaaataaattttaagatggtttgatttgaaagaatgaaaaagaaaaaatataatgtttccaaaaatatcattttatccttattctagataatttttttcttgatgtttaacaaagccccccttatggtcgattattttatgtgtgcatggcttatttgattatgtcatgaacgtaatcgataaagtggtcattaagaagaattacgtttctacatatttcttggtatatcatcatgaaaatatttgtgtgcgacttacgcactctatttttttgataccaaacgatgaaagtctgtatatttattctcacttcacttctttagatttcttttttatatatatttcaatgctaccaaacacaacaatattattcttaaatttacaatttcgaacatgtcaattaacttaatgtaattcgacaaaatcttttatagatctttcaattcgataaaattatgtttatatttcttatgaatatagttttatattttaaaatacttaagagtctttatttattaatttgacttggatccacaaaatatcatcctcaatggatgggaaagctctcccacaaaattttgaaatcccgtttcccatctctctcatgcccatatccatttttttattttgttatggaccaacctcttctgatttcaagtctttggggcttccttctagtctagtggctaaagcatggtgatttcgatagtgactaactggtcttttttcatacctcgtaatggtgcaatggtggccaattgttctctcctgtgactgtgatgctgagtatgagataaagctcccttaccttgcgacacagctatataccaatttgacgatgacaactagtctcatgcctctgaggatttggaccaagtttgttatgcttcaacttcaaggatctttcaaatcactgttgtccgtatgaaagagttcccagagtattgtttggagtaaattatgtaacatatttaattgaattacatgttccactgttataaatttgaaattcttatctttaaatatttttttctctctaagaattactattttctcattaactagtgtgttagccgttcgatgcacggattaacttcttactctaagatgtagtaattttttaaatttgcatgtaatagtataaaaaaaattatctactcaatttttaattgaaaatttaagtcatttatattaatttttaattaattaaaattggaaaacatgaatttattatttaaccccaactattatcaatttcaaaaagcatttattttaaaattaagaatgcatttataatttttttaataattaaaaataataaagttgagaagactccataaggaacatataagaaaaaaaggtttggacaagactccaaatcatttccctgttagcaaaacaaataattttttagaagaatgattgctatattaaattaaaaaacggctctttgggaggagagagaaacatttctgaggaaaggtttcaaaaagagggaagcgtttcatctaaaatttgaaattgaaagtacaattatcatatttaagcatgcaatttcaaattgtccgattataatctaatattattcttgattagatattttaaaatattattctatacataagattagattagattaaaaattgatggtgattcaaaacaatcatttaattatattttaaagtttatatttttgttacttttttgcatttgaaattacctaattatcccttaaagttttgggtgggggggggattttgtgcttgtatg

SEQ ID NO: 4570 - DNA, 1915 bp, Glycine max
  Soy_ogl_5993 Gm18:8445901..8447815 Cluster 19
ttactatgaatacaaaaaaattaattatatttatcatttattatttgaaatcaatcaaaatttaaacatgcaattatcacatgtcatcttcccttttaaaaattatttcaattaattacaaattatctgcaatcaatcaaattgtttgaaacaatcaaaattgaatcacaatatatttttgaatcaatcaaatttatattttaaagcatatatattttatacaactgcaaatcaaacacaaagttagaaatcatttttaaatattttgttcagatatgggaataatcataatcttcaaattaattatcatattttgttggtataggtctattgattttatacgggccataattggtaaataattttacgacccactcttaaaatgatttgattgattcaaaataaaaatagtctttcaaaaatgaaaactaaaaatattttcagaaaactaaacagcctgttttgaagtagaattttaggttgaaaaaaataatgaatatgaatagaattttaaactaaagtattgatcgaattttgaattaaataagtcagttacaaacccaaaagaatataagtaaggaaataaatattaaaaggtacaatttggtatggatttatatgagagtgtccactgtgatttgtgagagagtgacttattcttgttaagctatgatttgggtggtataaggatatttgtgagagactaaaattaaactgtaaagttcaggggacaaattattaagtagaattctaatatagaaatttataatttatagacccaggatcctattttatcatcaatccaatcaccattcacgttttttatttttcttatcatggaatagattgttttaccttaggataaaaataataaagaataagcttcttctcatgacagccttacaaaaaatacaaatagctaccaatacatttcacctaaactttattcattcattcatattcatattagtaaaaagtaaaaaatccatcatcccttacaataaaaagcagaaggggatacatctattacagaactaaactactttacttaaacaacctcttttgaatcctaactataaaatcaaaatcaaaacctaatataaaaaaaagaaccaaatcaaaattccacaggttttctaggaacacagctgcaatcagcaatcctcctgcaagcttggcatagtacttaaaacaaccaacaacatcatcctacatgataaatgataaaatcagagataaaaataaggaagaaaagctaatggtaacatcacttgttgttttggcaaaattaaatgtaaccactcaccaggtttgccagtgctccattttttctctctgttatctgggataaagagaagcacattaaggtgtccacacatagtaaaaggtcagaaagcataaagggaaaaatgtatataaaaggtatataaaacggaagacatatagtaaaagaaagaaggtatcgttgtactcatgtagaaaacaaaataaagacagaacaccccaaaaaatttaagcatttatgttaacgaacctgtactcatgaagtttttgagataaaaatcgcaactttaatgtgtttttccaccttttctgcacacaacatgtcaaaaaatatatcgaaccattacacaataaaaaaagggcgaaaacacaaaaagctaagcataggaagcaatgagcacgttggagaaggctgaggaacacaaaaaaatgtaaacttttatatcttgagaagtcagaaaacaaaataaaggtagaacacccaaaaaaatttaaacttttgtgtttacgaacctgtactcttgaattttttgagataaaaatcgcagctttaatgtgttcttccaccttctctgcataaataaacacacgtcttctaccattgtagttcaagagggaaaaagagaagaat

SEQ ID NO: 4571 - DNA, 2616 bp, Glycine max
  Soy_ogl_6033 Gm18:12792001..12794616 Cluster 19
tcagcctcatttgaacataaagggcagagggaacccgtgttcaaaaaagcaactttgtcaagagtaagcagccggttccttttagcaagccatagaatgaaagacatcttagggaggattgctgggttccatataatagaacaccaactaacagtaggcttgacacctctaatgtattcatagactttgccaacaagcaattgttcattggtgatctaagattgaatcctctttttggcctcttccgtacttagctctttggagataataaagtcccttatttgaatgttttctttatcaaaactgaatctgatgaaaaagtattgtaattccacacatcgctctctctgaaatagtaatggtgaacccaccgaacccatagagaatctttcttacaatgaaagtcccacaggatacgggaaagaagcgcaagattccagtccttgagattaaaaaggcctaaaccccattcttttttcggagaacaaactattgaccaagcaaccaagggcttgtttttgccaatatccgctttgccccacagaaaattacagcacgaagctttgatccggtctagaacagattgcggcaaaggaaaaatccccatccagaaattcacaattccttaaataattgttctgataaactctaacttacctgcataagataaagacttcttgctccatccctgaatcaggccactaatcttgaaaaacaagggagcataatgacatacatttaatctagatgatcaagaataaagttaccccctattgttataacttgatcaagaataaagtcattgcccttgaaaggtgttgggctttgtgctagagaatctaactcatctttaactcctgtatgccaccaacatcattgtagcaattaagcgtttaatatgcatagtcactccagaaaatttcttatcatgtaagtgttaaaaatgcctcttatatatgccatccattttcacgacatctcttcctcttaataggcagaacatagggaactcaaacctcgatccaattgaagcataccaaattcaacattctttagcagttcatttttaagtaaataatttatttcaatcacatcaacaaattatcttaaacacgtcaacatttcaccttgaatacatcatccatgtccatccaaatgagatagaaacgaaaaagaaaaaaataaataacaaaaccttttatctcattactattactatttgaaggaagggaactaaagtaccataacaacaaaaaaggaaatgtagtgacgaaaagtaaaacacaaatattaatttgcaagattttgaaatatgatatgtgaaatatagatgagtagggaaaataatataggatcttttaaaataaatttatccaaaagttaatttataaaaactctttcatataatttctttaaagatgaattttaatttatgcaaaaattaattttaatttatagaaaatttatttccattttattttcttctcttataaaaacttttggataagtttattcaaagagatcctaaaaggctatatagtgttgtcttgaccataacattactaggaataaccacgaagatagataagacaataaaggaaaaatgccatctctacacagtggaatttgataatacgattaatatgtacaataaagatatatcaaaactctttaataaagatatatttttttttatctcttactctcactagatgtgaaatagaattgaagtgtccactaaccattcttgtattttgtaattatataatgcgatgaatatgttcttattccaaatggaagagaggaaaaaaattatcccactaagataattttaatcaataaacagacccatatgggtcgttggtataattagtatgcacgtaaacctaattattatcaaaaaaattctttagtcagaaaagaaacgtagtgtatatatttgaattttttgtttaaaaaactctaaattaaaatccagttaaaagcctatttcttctaaattttgttctaaccgatgctcagaaaataaatcaaaatacactgtagcgtattctttgatgcttgtggtatgcccttggtgagagtccccaattcacgtgtatcccaccataaaaggttagtatgttaagatacatatgtatttttacattaaatttagttcacctaattgatttgattgatgactccctcaactcatagttaaacgtgtctctggcgttcaaaaagggttccaatttgcttacctatgcctgcacaatcaaacaataactctgttgtttggcggaggaaattatgcctatactcatgctgcctggtagtcaaagaagattattctccccataaaacacgaccaattaaatgcacaacaaatatataggtgactagtaaacaatcacatttcccacgtcattatcacaactatgttttcaaataatagaagtggattttgtataaaatgatttttttgtacaaagttggaaaaaaaaaagtacgagtctttggtttgaggggagaaaattaatagcaaaagaacactagatgaaaacaaaaaatagagcgaaggacacgcgcgtacctgccacctaaggacaacattcatatacgtttgaaaatata

SEQ ID NO: 4572 - DNA, 1312 bp, Glycine max
  Soy_ogl_6083 Gm18:23708389..23709700 Cluster 19
ggaatcaatataataaaggatagataattcaaaataggttattaaattaaatccattggtaatatctaagacgttgtattttttctattagaataatttcctaattaagaatctaagattgaatataagagtttgtattttttaaaattagaataacataaagtagatattaagaacacaaaaataataatttgaataatgtttgatacaaaagatacaaggacaggatgaaaaataagcaaattttaatatatattagtaaataattatattattacattttttaatataaaaagtaaactctatggaaactttttaaaaaaaaaatggggaaatgtgcccttctccattcacttgcagagaattttgcacccttgtctacggactctataatactgcctgcgctatatattgcttgccttgcctttttgttttaggtttgcacggatcgctttaattgcgttgtttcctattctcacgtttgatcatccagactatactattctcgatcttatttgattctccctatggataaatctctcttgtctacacttagaaataaaaaagatataagaaagagaaaaatatacatgtaacaaatgatatgatgagaaaaaaaaagatgctacatgcaagtgtacatatagtactcaatagataattaattatgttatacgagtatctatatatatataaatcaacattgtctatcataaattgttcaaacgtacactatctatcataatttattgagattattagttaggcttaatgtattatcacatttacgatccaattaacaagtttttagaagagaaactgtaggtattacaaaagggacaaagtagatatgcagcgtgaacagaaacagaatacaaaataaaacaacttcaaacttcttttggaaaaaggtatcagcgtacatcttcacactataatttggagtataaagtatgtgtttatcaggaaggccggggtttgcttaatcaaataaaaagacgtgaaaagtatgtgatcagataagttaataaaacataatcgtgagtcatatcttaacggttcttctcttctctcgcctacagccaaactgtgagcacaggtttacacccagggcaatatcagtgttgcctcttcaatttctgtctatctatcagtttatatctccgtcactatattagaaacagcttttaataaaatccctgtgcatgcttctgatgcatatcatgactgctaagtgatcgattgaccctttctgtgaaaatctgcaacctagctatttcctttcattggcattgtagacatgcattgacga

SEQ ID NO: 4573 - DNA, 1000 bp, Glycine max
  Soy_ogl_6110 Gm18:48994501..48995500 Cluster 19
catattgtttacaagagctccaggaccaaaagaaatatggcagattgtgctattgtttgtgaggaactatggtttgttcaatatccatgtttatgattttttttaagtgcctaagggatttgtgttgaatttactaatttttatacacagtcactaaagatagtaataaccttatcacatctaactatttctaattagattacacttttacatatagaatattttctccaatttaaattcattgattagtgccgggacccaatctatttaaatattagctattttttctttcacaaaatctttttgtttccttttatagtattaattgtgaaaataattatatttttcaatgtactgactttttaaacaaaatctacatgaaaaaaaacatattgttggttatctcaagattaaagttaagctgattcattttgttttttttttttttttgctaggatcaagacgttagtattacttgctttttgatactggcgagggatcctagaattccaagaaatgacatggcctataaggtaggaaaaaagaacagttattttacaaaacttagatgcagtttttaagtatttttagttgtactattttttaatcaaaattggggttttagtttgatgtttttgtatactagtgttgttgcttggtatgagacagaatgaacgaactaattctgtgagaatgtgagatggaacgaaagatcgtccacggcactcgagttttctaccacgacagcgaatatgaacgagtctaacagtgacgccttcccgctaatgatttataaaacttattttaaattcattgtttcgcataataaaagtgatagtgatattacattgcttaaaataaaagtgatagtagtagtgattattatgcatatcgctaaatcaattcaaatttattgtttgatacaattaatacaatagtgatataaattaaattaattaatttgtgtctattattacttttctgactaaaaaaactaaaa

SEQ ID NO: 4574 - DNA, 1803 bp, Glycine max
  Soy_ogl_6123 Gm18:51076880..51078682 Cluster 19
taggtccataaaatcagaattctggattgccccccttagctctctccatatcaaatcatacccgctttttgatgagtaatatccactttggtcatgcttccatatccatttatcttccctatgaggctgaacttgctgctgagctaaatccccaataaaagtatccgccaatagtagctctgattcaaaaagatcccttctccaagtgagattccattcccatccagtgctgttgttggttcccatgcgtgagatggttgtctgtttttgagaggatatgttgtataaccgtgggtatttctcccttaaaggcatggcagtatctaaccacggatcctcccaaaatctgaacttgtctccgccccccaccatctagccagtttcctttctaattgcagaattctgctgctggtgcagaattgagatgatgtccttccaccaaatggaatcttgattagctattgtgccttcctccaaagccctccaatcaccatacttagaatctagtatttttgcccaaggctcctcgtgcttgtgaaaaagatcccattgccattttcccaacagggctgcgttaaatgtcctaagatctttttcactccaaggccacctctgtcttttggttgacatattgtcttccaattgacccaagctatcttcctctgctctaaattactaggttagacatgtggtctttgataaatttttgtgaatgttatcatagcaagcttttgataatgaatcaaaattgtacaattcataggtggtttgaatccttaatcagcctataaacctctagcttaacaaatttctaagtatacttaaaataacaaaattgtacttagaaaatgaaagcaacattacaaacctctagcttaacaaatatcataataaaaaccttcatgaacctataaaccgataaaagaataattacatatgccaagaacatattacaattacaaaatttagcggcaaacagtaacatggcatttaggagagaattcattttcaatcccaggtcattattttcaatccttgaatacaaagaggagcactatgcaagtttgaaagattgatgctgctgctgataagtatcctttccttataaagcccccatttatttgcccttgtcacctcacatctacaaacacaagtaaataaatcacataatggaaatcaaccacaattccaaagtatattaataattaagattaggcatacctactttttcatctttgaatagtgtgtctctaccatatctgtacagtatcataaatgttcttgcctcaattcttgacaccctgtagtgttaggatttcctacttagcctttaaactctttatagtcccataactgttggcttctccaaacttcaccaaagaaaaactcgagcagaagttgcaatgcctgcattcattcaagaagagaagatatttaccaataattgatgttcaaacatagaacaattttatatcataagaattaatttagtaatgcaacacaaataaagttatgaacgctccttcctagcatatgcttcaaaacctgcacagttacattaacctcagacagccaaccatcaatcaaatcacggaaaaaaaagacatcagaaaatgattaggaagaacaaaaatgagaactagatcatctcccttgagcctgtaacaaaaataggaagagtcaagcagcaaaaccaaaatcaattcaccagatagcataccaataactctgttcatatgacaaactagagagaacctaagcctacagaaatcaaggttttcatatgaccctaaatagatttat

SEQ ID NO: 4575 - DNA, 2300 bp, Glycine max
  Soy_ogl_6722 Gm20:31637401..31639700 Cluster 19
tttaaggaacagtttttattttaagggatactcttagagcattagccttggcaactaaacgtcgaatgggtcgaaggtcagttttttttttttttaaggaaaaaaagaaagagaaaattaaagagagaattctgtaaaaaagaaaattacgggccatgatcaaagtggtacatccttcacaaaataccaaaacatcagggtacaattaaagtgaataagtagtaacacattgatgcagtaaaaggcattgtgagtcactctgaaaataatcagcagccaaaagctgtaaagatgctagtgaatcagtggattttacataatgcacttgtgtacacagtacactacaatggacctactgttgaagctccattactagaacatcagatgcagggcctattttttattttttttttaatggtttttgtgttatgaaattgacagtatcttttttgctgtaaagaatacctcttgtatcaaatattatgtgaaggaatctgctgatacaggtaaattctatttctcatttagtagcacccctgttgtcattgaagcttgcagggattttattttgatgtggaccaagcaacaaacaactaacaaatgaatgttaaaaccataatgcattgtttatgccatattatttctgttgtctctaaatcatcaataatgcttggaatctttctggcaatgtactaagtgtctgtcttgcttatacttaatttccaaggtgtgaacttactgggtttgaaggatgagcctaaccgccctgcaatcaaagtgaaaaacatcaaatgtcacaaaacaaaccaataatgcttgcattgtttcttgaatttcccaccacccatgaacatttcactgaccagaaaatgaccgctctttgtttcccctcatgcaatatctacaagtcaatgctggaaatgttaagaagccttgacgatggagttagcattatgaaagccaaatattttcctcctcacacatctgagactgaaggtttaaactatcaataacttatcctctgctgcctggatgccaaactgaacacttccatgaagcctagaggaaaaaaacagtgatccccatattacagcattgggagaaataggcatattttcgacgaaatcacgagtctccagaagtaaaccagcccaaccaagatgatctgcaatgcgagaataatcatctagctctggctgcacaccatggaattaaagtaaacttgaaattctttgacaagacctccatgccgacacgaggataaaacaccatggtaagtaacagcatgtggattaaaaccttgctttatcatctcttcaaagagtataattgcctcttgtgcaagcccatgttgtggatagccactgatcatagtgttccatgtgacaacatccctgctcaccatattttcaaatatgtacaaggcatcatcaattgccctacatttggaatacatggcaatgagagcattatcaatgtggaggtaagaatgaaaacccatttgaattatttgacaatgagcacatctcccatggaggcactcagaagactggtgtatgtgaaacaatttggtctcgaatccgaacccctcatttgttggaagagcttcaagcacacgtcaagactgcattcttaagacaaaatgttgggttcctagtgaggaatgcattcatttcttgagtccttggagggaataattcttgcgggtgtgaacttgaagttgagaaaaacatgacccaaaacttggtttgccaagtcaagtattttcactcacgtcctttaatacgtgtatgtggtttgggtagagtgagaaggagacttgaagaaggatgaggatatgtttgagtaagattctattgaaatatatctaatgatctacagaatgataaactaatagagagctatcttaactcaatgagaagttcatatcaaattagttgatgatattatatatttgattaaatatttcaaaagattatttagaaagtaatatgagaatgagatacttctgagttttttttttatcatgaaatcatttctgtttaatgacgttaatgtcttgttttaattagttttattacctattttaattggaattgttacctctttaattgtattaattagcaattatttctaattaattactattaacctttatatcaaagaaggttttgagagtaagtgaacatcaaatcccttcctctttctctgggtgagtttttggatttttcttacaaaaaaagcatgttgattctattgttcaaattaattttggaagatcatgttatattatgagggac

SEQ ID NO: 4576 - DNA, 1100 bp, Glycine max
  Soy_ogl_2358 Gm07:17581001..17582100 Cluster 19
cggtaaaaaatttattggctacaagctaatttgaaagttgtacaagtacatattgcttcttcctttagcacaaagttggagacataattaggatttattatgtgtatttgactatagccaagagcccaaaagggacttaattttctacatttgtatgtgctaattcaacaaagtttgtgatatatattattctcttgtgtggttgtgatatctttttacatggattagaataaataaaacgtgttagataaatattatatacttttactttacatcaatgatctaaaggtataaatctaaaatgatagttttttagaacggtttgaaataaccgttttaaaaagatcatcacgttttagagctaattcttttgtgttagtgacaaaatgggggaataaataaaatacaataatagttggtgtatttttattttatggagttttagaaatgttaagcacctgtttaatttcatttaccatccgggaaaaataatgaacaaaattgacaagtagataaaaatcataaatattcatacaaattactcaacaacttagtaaatctatactatatagttacgacattaacaaaatgttaagaaataattattgcatatgtaaatcaataactacttttttttaagttattattagtttttttaaaaaaaatcttgtaaaaaactacattcttagaagttattatttgtcaaataattattttttaaaagttagtaaatatttaaataattgaaaaagaaaataattgacgctgccacccctcttgcaaatccctccttgattcaatggccttcctgcatctcgcattcgccacttattttaaattttttttgtttcggatattaatgtgacaatgctttagacttttaaggatcaaaatagtgttttactcgtaaatttttatgcctcgtttctaaggggaaaaaaaaacagaacttctcaaatccatatcagtttttgcaaattcaaaaacactttacacataattatcgaatatggtcttttcccggttaaaatgaaagaaggaataacatattcgtaaactcagtgacgggaaaccgaaacatagacatcagaacatcagtt

SEQ ID NO: 4577 - DNA, 4087 bp, Glycine max
  Soy_ogl_5996 Gm18:8555924..8560010 Cluster 19
atatccatactttcaaaaccactattattggcataaggtacacttatccctgtgcaagcctatcatattttgcacatgaggtataacagacatattggacatacaaggatgacaacatgtagcatttgcatttctggttttgggaataaaagaagaaatctaaaatgaaaacactaaggagatttatttaccaaggaaaaattaggggtaaagaacaagaatgcaatggtacaactatgaattttcctattatatcagtacacaacatgaataatcacaattggtgtagttctataactagtgttgtatgatcagaacatgaaaaaaaatacaacaaatttctaggaatacaaaaaagaaagtgacatttaggaattccctttaatccaagtaggatctgatgccagacaaattgttttgatttttatcatatgcgcagtctctgctatcaaattgataataatactaacaacagttgaattagtaatgctcctgatatattgctcgaaaacctgctcttgatgcctgatcatcataagtataggaggaagttgcattatgcggcacatcaaaatcctctctatacagtggttgcaatgcagactccggtaatttgctctttgtactgtactgcttcatggtattaatctctgtgttgtgttttctttccagcttctcaatttgcatcttcaaattttcatttgcaaagttctgtataacataagaataagaaatgtgttaagacggaacatatgctcattctcctcaaccgcagttactggttttaaagtcacattattctccttttttttatttgcaattttggcatttgataatgaggaggtccgagaagttagtggaatataaatgatataatccatcttaagaacattctctgtttcctttttcccttttagcagctaaaacaccaccacatatttcttcttccaccacatcaagttgttgaagtttgccgtgtggcaacaccaaccaatccctccaccccaacattcttgtctctcaccttctttgacatacactggctaaggattcctcaaacggagagtgtttgcttctatgaaatttccaaactatccactttattctttgactcctcgattctttcaaatcttaaacactctttccctcacactgcattctttcggaaagcttcatttaaaggaaaacgcccaactcctgactgtaccctctggcattcaatacttacagaaacttgaagttttcattgtctggaatatgtcaactgaatttgataagagcattgcttccaatggaggacaagatcattggaagatccaacatgtgccccacgttagcattgcttcatctagagacatgttatgccccttgtgaatcaaactaatgatttccttgtgattttggaagagaccgggagtgactattagaggagaaggcaccaattaattaattcatcatcaacttaagagcttagacaggtgaggggagtgagtacatcactccatattttgagctagggaaatgaaggaaaatatatatacttggtttgctcctgtttgaacatgtttgaagtttgaagaactaggattttgggtcccccactacaaaatcctagctagggcttaagcatttggtcttaattattcttcgttattgtagttgttttgattcttcgttattgttagtatgtttccatttcatttttgtggtgcttgatgtgtttttaaatttggtggcttatgttcgaatccatggatgcaagtggtaatatatatgtgcggttgcattccctggtcatgcatggagaaatttggctctgttctgatttttggtgttttgatctgagcttgaaagcattttaattcttaagttattatatatgctattttgatatatataggaaatgtgatgtttatacgattgtgaagcttagatggtacattcatgttgaaaaaagtgattgatgttcactttggatggagtattctatgttttcacccattctgttagatttgtttaatgagttgtggtgtgttaaagtttaaagggaaaaaaaagtattctatgttgatacattggttctatccatttcatgcattgctgagacgtatgttggatgagctttgcaaagaaaaaaaggaggaccctcccaaggatgtttctaccatcaagtcgttgacaaaagaagtcagaaactgcttgtgcaataagaggtatgttgtcttgtttcatgacatagggaatgaaaaattttgggatcacatgaatctgctgtagttaatgataaaaaatggaagtaggatactaatcacaaccaggaatgagaaggttgcagaattttgtaagaaatcttcattcgtggaggtgcttaagctataagaatctttaagtgaagaagaatctttgaaattgttcggtaagaaagcatttcagaatagttccgatggacattgtgcaaaagaacttaaagacatatctcttgaaattgttagaaagtgtaaaggtttacctctagtaattgtggccattggtggtcttgtctcaaaaagatgaaagtgcacctgaatggggtttgtttagtcaagatctaagtttaggtttaagttatgatgatttaagtggaagtataggaagctcaccccggtcaactcttattatcatgggaaaatatgaaaaattatctgaacaattggtaaggaaaatccctatataatgctattgaaggttcgggattacgttatgttcctgaaaatttgggaatttattctacgtgagatacctacagtgactatagatgattggaaggatattggagaatttattctacgtcatcttctagattattcttcgtgttcaattcaatggaaggatattggaggcataataactttgtagaatgatattcatggccttgttcttttcttgaataaaacacgcaaccattcttatctaattcctaaaataattactgttgcctccttttctcttgtggtatttgcttcatttttttttctctacaacatcacgcatagaagttaaggatagaattgtctaacgtacagtacatgcttgcaacaataatagtcattgttttctcattagaagagtctcaccgttataatcctttgtattattgtgctcagaattggtggatgttgagatcgaatgggttgagttttttattgccatgttgataggcgttagaattgagacttttcttgttattataaatgtaaaatatgttgctgtcatatttctgatatatatcaatttcgtcattttgtagtaggtggaattgggtgaaaaaccatgttttaaggaagtgagtaagctatgtcagtattagttgtaacttttttgcttgtaactttatattttcaccaaatgcaagtctctctatgtaagctgaaaacaagagaatgaaaatacacttcccattccaccaatttctgttgtgtgctcttatgctgctctcttcagtcatgctcttatgctgctctcttcagtcatgctcttatgctctcttagtttttagtttgacgataagttcttgaacaatttcattgtatcatttaagaagaaattaatctggtgtttttacagggttgcaagcatttatttcgcttaaattttgtgggtttttaatgttctattatggttgaagcacaatgtggatttatatagattagattgagttaatttttcctaattttaatgctttgatccactttttaccatcatgaatttcaggaaagctatgagagaagatttgtaagaggtgtttccaatgttgtccatgttagactcatcataattaaaaccaggacgtcagaatgaagctgtaaatagtgttcttacagatgcagacaattttttacaactggaagatccccctcaagttctctttttccggcccttgaaatgatggatatgtgggtttgacgatcaaagtggaagattcatcatgttacggtaagagttgttcaccaaaacgaaaaagctaaacatgtaacgtaagcgaaaaaaatgtggatttcatgctaaacatgtaacgtaagtgaaaaaaaaagttataaattgtcagtcc

SEQ ID NO: 4578 - DNA, 1397 bp, Glycine max
  Soy_ogl_179 Gm01:46992501..46993897 Cluster 19
tatgatatgatcctatgagacacaaagagaaacacacatgagaaaaagtaggaaaaaaatgaatgaaggaatctagttctcacatttttttaaaaaattgtcagtgcatgaacagtaacttcatccatttggcgttgttttgagccttgccctttagcacatcttaatagacgtgtggtgattgttaaaaaaggtattatatatacatgcatttgaaacttgaaagtgaagaaaagtttctgtttatatctgcaatttatctaatattctttcattgctgatggactaagatcaatcaaactagactcagacctatcctcaaatcagtagcagcctttacaaacgtggcaacaactttgctagctaattggattggtattcatcaaaatcatcaccaacagcaacttgtaaataccagactaatgcccttaaatgttgttatatctcttatactttttggcttaattagttcaatctctcgtatatatagatttggatatgaaataggacgaatataattagtgttaaaggatattgaaaaagtgttaattttttaataattactttaaaaattatatgaaaaacgtttatagttaatcgacagtgtaaattcttacactaaccgtgaaacaaaatcaatttcatattaaaaataaatatgtatgatgcatgaattatatattatgatcatgagtttaattttcatgcagtatttggtataaataattttacattataaactaaaattagaaattatttcaattattatttttagagtaattatcataataacacactttataattagataacatagtcagtatgttttagttaaaattttaaagtattagctagtatgatatatatcatattataatcatagacctataatatatttttttttattaaatctatgtctatcaaacaacttctgtgctattgacacaagttaaacaactatacaaattaaaagtatatatataatactttttagtgattattgccaccagcatatagcccaacacatatagaagcaacctgactagaaattacgatattataaaattttaattaacaacattacttttattctctatttaattttgagtcaagtaattaaattattgtcatttttcatgctacttgcagtgaaagtggatgataaatatagggtttttttaagaagtgaaatcgctttgcttttaattacgcttgtttaccattagtcaggaaaatgaaaatgccgacaaaatgatagagatgaacatcaaactaaaaagctaattgcatcaatttaaaattaaagttacaataataatattataacaaccaatattacgtgtattttgcagatatataactagatgtaatgtgagtgtcttgaactggttcattga

SEQ ID NO: 4579 - DNA, 1278 bp, Glycine max
  Soy_ogl_154 Gm01:43526401..43527678 Cluster 19
atatattgctggctaaatccatcatgtgaggaaaagagacaaacccgtctcgtacgatatgctcatagaattttttccatcagattttctttccacccaaataagtttacaaatgcactacttgttctgtttcgtaactggaacaaacctagcccgtgaacctgaatgtcactcgcaactctcatgtcaagtaacagattaaggagggcgtggcatcaggcatgtcctttttggactctccctactacttaaacatcacctgtcaatatgcacaaacaagctagccccacatagaggccccaacacatcatgcacaatataggattcttcattcccccgaataatatattattttatatatggtacgtatcaaattaataataatcatggccagacaatttagcttcttattggaataatatatgcaaaagggtcttgctaaacatgataggttaagaaattaagcagaaaacagaatagattaagaaattaaacggaaaaagtattttttatgaaaagcataagaaaataaaagaacgaaagaagaaaacaaaaataatatacaattttacactttaaataaaaaaaacattctatttttaattttttaacctgcgtcttaagaatactaattagtatttgtttatgcaaaacttttgtagtaattcattttgtagggctggctttaaatgccagaaattaattaaactgatttttagatgttagctataggtagctagttagcagcataatgtttgtgctgtgcatgcaagcccctcattcatgtcatgtgctgtattttatacacatattctggaatttttttattggtagcgtatctcccgagtttgctgtgttcctctagttctgtatggcatgctcccaacgtgagccgcatgctaagtcatattctatgttgaaaccaaatcacttaataagtttattattcctcatatcatagattattcatagtagtttctgtgacatttcaattttattataggccaataccctggtcaatattaggccgctagaataagctaatttaaactagctaatgacttctgacagtctggccatcattaggaagatacgtagctgttcctttattataaattataatatctaatttggagattgtgaacataattttctgcactctctcaatatattaaaaaatttcaacccttttttctcttctctttttaagaggtacatttcacacatttttaattaactaaccaaaaaataagtcacgatcatctcaaactatcttcc

SEQ ID NO: 4580 - DNA, 2471 bp, Glycine max
  Soy_ogl_156 Gm01:416701..43996171 Cluster 19
tttggtaaccaaaggcagaagtacttcttacagataattatcttctctatgcatgtgaattgctcagtttttaaggataattgaagtttgcattcgtcttaattaaaataaaattccatacttaagagaggcactcaaggtccgcattgcatgaaaaaagggaaacagaaaatgaaatccctttacttcaaggtccctttgtcaggcaacaaaatcataggtggaagcaaaatttgatattgaaaagaagcaaaaatataaaaaacatgtttatagatttggacaaagaaacaaatcttcatgagagggtattgccaacactaaaaaaaatgaaataagaagtttaagtttcttactttctcacgtagtcaattaacctatgaattccattttgatcgatataagaaagtggatgaaagagtttcattatattagaaatgtccccaaatatgtagcaaggatgggtcaccatcatacatgcttacttcgtaacaacaacatagctagcaagaaaaccccgaatgaaacctcgcataccttgtacagaggaattttcttcactatagcagcaaccttgctgacagtatgtgacactgccaaaataacattgactccaagcttacactttcaactgtagaaaaggaagattcaataagtcaaattcaacatatgatggtagcggactatgattttgctgtacaaactaagagaggcataattggacacaattccttattgattctctcaaaaggcaagcatgttgacctcattcaggtcacatatcagtgttgacaaatatcataaaaaactcaaataggcattaaaatacaaaaaatccaacactcgggatacaaatgcaccttccaaattgtaaagattccatatcaatacaacacaaatatcaaatatcaacaattgtgttcccatatgatttccaataatatctttcctcttataattccttaactagtgccctaaggcaatggtaacatgagccgccagttaaaatcaacaagaaatctatcaagttttttccgaacatgtccatcattttgagtattcttcctccaagtaaaccatcccccaactgtatccatgtccataatccgcactcactcatcatatcagccataagacaagcacgagggacaatgtaggatccaccagagacacctgaggggcttataatttcattaaaatctccaattagcatccaaggactactaatctgttgtcgcatatccccaaggtgttcccaaaactactttcaaatgctagccgcaggagacccatagatagttgtacaataccaagtgacagttctattgttgatggagaacgtgattgttggggggggggaataaagtaaagaacaagtaatatcaattactgaagatagtacccaaatgccacttgaatggtcaactgcttcttgaataaacaacggattgaaacccaaattattccaaaaagtttctactttggaaacaagaccatgggtctcgaaaaccagaaacatagatggatggtgcaaattaactatctcttgaacatgacgtcttgaagccttacccaaggcctccctgatgttccatgccacaatattaaaattacgaaacaagtccataataacagttgtgcatggaatagaaacttggtactatagtctacgttgttgcattatggttacccaaggatgtctcaggtatcatatcttgctggcccaccattggttggtcggttgattttcccatctccataggttgcatttgatcatcctcatttccttgtagtacaacaaatctgttgggtgaaatagcttacgagggaactgtggatttagcgccaaagcccacgtcatgagttagtgcaccgtaactctttttcgaaggtttcccttggttcacctgactgtggttccaaacgttgtcaccctcaatttgtttgtaggacaccacaataattatgtaagttattataaatcttctaatacatgttttttatccctacaaatcaaatatataaattgaagttaagttagaaaaaaataaaagtaatatatattattacatcattataaatattaataaagggatttaaaactattatttttatataaaagaaaagtatatacatgtaggaaaggagaagatttcaccctcttatttcttctttcatctaaattctaaattaaataaaagagaattataacaatttatttattccttcaatctttctaactagacattatataacaaagtatttccttaattaattaattgtatatataagccatactttttttttcttctgaaaattagtacagacctacattaattgatatgtggtgtacatacccctacctaacttcaaagatttttcatactatatattgtctattataaaaaaattaggtcaatttaaacattaattcacatttattgtctaattttctcctcatataaaataag

SEQ ID NO: 4581 - DNA, 1200 bp, Glycine max
  Soy_ogl_177 Gm01:46886601..46887800 Cluster 19
tatttgagtccagtaatatttattatttatcaccaaggtctaacataactgaaatatgattaacttttttaataatattgattcggattcaattcccttatcacagctatgaagaaaattttgttgcgggataaaatccacttcaataatttatctgtctcggccagaattcgttttaactgtgatagtgaatttcgtttttcaaccatgttggaagtagtagttaaaatttgaatcttgatactgcagataaatcttactcgagttactgtttactttcactgtgaattttgaattcgtgagaaatcattgattgatataatgatatatatggtttgttatttatttttaataaaaaatatcagttgttagtttttatttgtgagaaaatttaaacccagaatctatctctccctttcttcgcccttcaccaatatttaatcttatgtctttttatatgctttgttataatttgtaataatctataatattaattttgacatattagacattaatttctagatttattacgaattagatataatttgtttgaaaataaattttactgtaattttatatatttagacaaacaaacatagtatattatttgtaaaaggaaactgttttttacagcatttgtaaaagaaaacttaattaatagtaattaaaaactgtgtcaattgtttaattggtattttgtataaattttctttcaaatttgttaattaatgaaaggtatgatttgcaattgttaaaagatggccaattgtcgtacgttgattcaatcatttcattggatttaaaagtatctcacttactaagatttggtcaagcagtataatcaaacaagtggattcacaagttgggcttgattcccattaatgtttctcaattacatgaagtttatcaatagaacttgtgacaactttgagcaggtttatctttcctattcacaaactttcattttatacatacatatatatataaagcatcaactcatccactcagaaattaagtgcatgctagctaacctaatacattagaggttaaaatatacaaatgattccttaacttattttttattctaaattgatacttaacttttataagtgcataatgcatagagatgttggttatttgggccattaaaccattagttttgaacttaaattgtacgcgttgatctgatctttaattatt

SEQ ID NO: 4582 - DNA, 2158 bp, Glycine max
  Soy_ogl_5991 Gm18:8439243..8441400 Cluster 19
attgtggttttgcaggaaaatttttattttagatgtattttattgtgaagagggactgaattttcatattgttcatacacgggcgcaagaaccttacctttagtattgcactgagcaaaataaatataaataataaaatagtaaaaaaagaagacaatgaaggggcagacacgtggatcgaaagcataaaagagggtcttgcttttgagcaaagaagcaagcataagggacttgttgcttgtataatagaaagagatggacaggtgtcaacagaacagaaaatagacagtagacaggtgtcaacaggatagagaaaaagttttagtctttgttttaaaaaatgtttcagtctataaaaataattttttgttatgttaaataattttgtaatctctataaatattattatttaaaaataaccttttcttatcctaaatcaattttaatctaattcagcaaaaaaatattataatcatgtataaaaaataatgttttagaacaatttttagttatgtatatgattacgggacacaaagttaatgtcctttgtaatttaaagttaaaaaactattctagcaatttgaatgtaaaaaaatatgcagcttaaattaatttgaacatatagcattttaatagttaaaaattgctaaacttaaatgcaattttgtttttttaattttatttaatctacaatttgatctctttattttataattaaaacatttgattattctatttttaaaaattcacaactatgatctctttattgcaaaatataaatatttggtttttatatctttaaaaatccacaatttttgtttaatctttaattttttgtatattttatttcttttttttactttgtgctgttgttttccaaatgcaggacgggaatgagagaatccattgcttatgttactattggcttgcttatttagtgaagaagggtaattttgtgggaaacgaaaatacaaaacacaaaggttaggaaaaaacaaaaaacttttcccggtaactttaaaaaactaaaatgttcaataattagaagcaaaaatattgaaaggtcacaacatggtgggataagttctttttttttttctgatcaagtaaatctgaaaacagaacatggatattacattgtctgtaaaacataagcactggaataagcagcaaataaatatgagatgagcatagcagagaatgtgtaagatgagcagagtagacaacaatatgcctccatcaataatgttcagtttactaaacaataaattcatagtacaacagttataaattactaatataacagattaaataaaacatactcatttcatttaaaatcaaaccatgaaaactcaaaactcactgatacattccttaacaatgtcatatgacaaaacaaaatttgaaagccaaaatttatgtggaatacatctcaagtgcatcagaaatatactccatgcgtaggatgtttaactctggcagaaaacaaaataaaaatgtttttatgaaccaatactgatgtgtaaaagagaaataaaatttaagctaaggtgaaaaataaaaagattaaatatttataatatatctgatgttcaaagtcaaataagtaaataagaaagagaccatgtaattgacaaaatgttcataaaagacaaaaagatagaaaaatcaaagtacataagctaactctaatactcccaattctttctttggcggatgacaatttcccatattttatcaatggtcctgtaatagaaggagacttcatcaccgtgggagaaatcattatctgcaatgaattgataccatggttggacaacatatctgcgcctaactccaccatcaaccaccacaacattccactgtaatggtggtccaaatctcctgagaatggtcatgtgttgaccgcaggcatttacatgtgtaatggcacaattgggaagtctctgcatgggaaaaaaatagcatgatatataagcatgaattaataagcaacattgaaaaggttttcattgttaccagtggtcctggtgcaccaagaattgattgtgcgatttcaagtgtccaaatatgttgtcttgacataacttctggccttccgcaagtctggcattccagtgagggaacgaaataaagatcaaacatggatttttcgttg

SEQ ID NO: 4583 - DNA, 2100 bp, Glycine max
  Soy_ogl_6010 Gm18:9627401..9629500 Cluster 19
gggttcttaattaagtgtcactcaatcgttgcactatagcatgggtctggcgcaccatacaactcactttaggactttttttcttttctcactctttgttctttggacggaaattaaatggccattggctagaattttcacttgtgctctaagattcacttcagaacacaaccttttatgctctaagattcacttcggaacacaactttttatgctccaagatttttatttttgaagacaaatgattagataattttaccaaagcttcatctcttttctttgataatttttcaagggctttagataagcatattcattctttttatttttaatatctttggtcttgaatgttatgagttgcatagcttgtgcttgggtatccttatttatatgctttaatagattttaggtaacattgtggttacctattaaaccagcagtatgcagtaattcagacctaggtagcatttactagacaaggaactgtgtaatttgtgtcaagaacttttgctgcctaactaagaatcatcccctaaaacaaccaagtttttttaatgtttctgcaaccgggtgatggttcatgctcaaagattactgggacttcactgttggaattttctatagtatttcattccctttatgttatgtagtgttaattttgcctccttttgctattatgagtgtgcattatgtcctaaaattcctgcttcagactttgtctcctataatatagactcatgggatataacaccgacatactggactctgctttaatttcttgtgttagtataagacacgataagttgaatacataatacacaaaactttactggtcatcacaggcttatttttgcagctgtttagacgaagcacacagcaacttcgagaccattttactgtagccagcgaagtactcagctcaaataaatccagggagaatggcctataaaaatgagatggtgtcagtgagagcaacttgagtatctcccgatgacctttcctagatagaatcttcaatgagtggaaacaacttactaatcaagttgctcatgaattggtaattagtttgatccaattgggcttatggatttttttttctttctaatttgttagtttgtttaaacttatttgttttttaaaaaaatttatctttaagtaattttttgtgttttaatatgcttgtttaaattgttctgcaaaaaaaaaaagtaattctctgttaattttgagaaacaaattttatttgcttattaaataaacatttttttaaaagtgcttattttaaaattacttattttaaggtaaaacaaatgttccttccctttagcctctactccagaccttatatcattatgattaattaacgcggttcttacaaatgctgttgatactatgaaatgtgtttcaaatcatattgaaattgaaactatgggcggtctccagcatgatatattaattgatggagcaatctttgtggtgttttgattctttaaattgtctaaattaaatatatacatggttcatatttgtttggaaggtgacaagaagaatctgcaatattaagaataaagaggatatgaatttggtatcatccttggtcctgttctgcattgtttgtttcctgttttttctcagcagctcactagggttttcttaaacctcacctggtccacacacttactgtaattataatatatatattattttgcatttttcaatttttcctaattatttaattactttttttttcttatggtaagaaagttactgagtttaatcatgggttgtttggaactttggattgtcagcccaagagattttcagaaacaaattatgaccaaaaatcattttttatagtttattttgaaattttttttatatcaattcctattatacaaaatttaatttaaagtaaatatttaaaggtttcataaaattttcattgacttaacgtaataaaacatttattgactaatcctacttttactttaaatataataaaaacatataacctcaaaagtgtaatgctaaatatcttcataaaaaaatatgcttcttaacttaaagaactaaaagaaaaatatgtataagtgtgaggaa

SEQ ID NO: 4584 - DNA, 3008 bp, Glycine max
  Soy_ogl_6410 Gm19:37139001..37142008 Cluster 19
atggatattccattgtcttaccttggaattcctgtaggggtcagctctaaaaataggtctgtgtggcagcccattattagcaaatgcgaggctaaacttacaaaatggaagcaaagaaatctatcaatggggggtagaataaccctcattaattcagtcttaacagccttacccatttatttgctatccttcttcaagattcctaagcttgtggtgcaaaagattacatctatacaaaggaatttttgatggggcagcctccaagactccattaagattccttgggtgaggtgggacatagtctgcctacctaagagtaaaggtgggttagggatcaaagatttgattaaattcaacgaggctttgcttgctaaatgggggtgggagttggcaaataatcagaatcagttgtgggccacaattctattgtgtagatatggtggttggagggatttgatttctcataggaactgcagtttagactctccttggtggaaagacctcaaggttatcttcaagcagcagcaaagcaacacaatttgtaaaaatagctttattttggccataggtaaggacggtccatggaatacaaaccaagtacttattggcttgacaacaaaaaaaacactcattggaaatatatatgtttagcaattaccatagactcgctgaacaggaatggagaaatatgacataattagatttttcctttcacaaagaatgtagaagaaactaaagaccttctcttttaggggtacaaataatttgaaatataagtagaaattggccttctgggcagagaagatgctaatgaggatgacaatttgataacactagtgcattgactagaacttgctttagacttggtcatgcaaatttcatcatgcttatgtgtgttacattacatgtattacaggtgtatgcatgtgaaaacagaagagaatgtccatgaccttgaatggaggaaagagatacaaaagcagaaaaattgcataaaactggatgatgttgggctttcacataatagaggaagagagaatatatatatgtgtgtgagtgtgtgtcaatctcctgcagaagcagaaggaacaaaaagaagtggaaaccaagcaattccaaagtgatgatgcacagagaagagagaaaaatttgagtgacccaagaagagatgtttttctttctttaaactgaccagaggaatatctttattttctatgtttaattttttgcttttttctcttgcagagggaacaaaacagctataaaggagcctaaagagtgtgtgagagaggagttatggggtctatatatatgaagatggcaaggcaagtgttgaaaaaattgggtcggaagaataaaaaactcacagtgaaaacttttttttttaagaaaatgtttcataaatactccatatattatcctacacttagagagaaaataaaaaagaaataaaaaatataaatataataaaatttataatgtgatagcaaaaaaatattgatgatgtatttaaaatgaaaaatgattcacctacaattatttttaatcataaaaaaatgtatgattatttttttaattacattacgtaagaaaaaaagggtggaatttggggtgtcaaaatctgagtgcatgacacagataagagttgttaaaatacataagaaaccagttctggacttatcaagggctgtgtgaaaccagttccagtaaaagaaaaatgtacatgtatttatattgttcacattaaattcttggtatgaaaaaaaaaagggaaatgatagtggaaatgatgggggagggtggagtaaatgaataaaaatgcagttttttataggttgcaattgttctttgcttctaattaatgagaacataaatatgcaaccttacgcagcacattgaaaaaataacaaagtaaaacccttgcagaggaaaattttcatttggcaaacataatacatgagaaggaaagatagaaaaaaaatccagttctcataattaatgtcaaactcacctatatacccatcgggtcaagtggcataaatagatgtaaaaggatgtgttgtattgtcgagcctttgtcatgtctgaataatgttcgttataaaggtgaagggtctaaggtgttagggaagcggagaaaaaagagacaaactttttgccaagaacataaagaaaaaggagggaagtgaggtgtgtgaatgcgtgggtcagagatgagccagatatgctgtggtcatttcatagcacttgtatgcagacacaataacgtgggtgggtatttggcttgggcctctctctaggagcatgtggagtctgccaaagagtgagggaaaaactaacaaaaaagaaaggaagaggtatagtatattttggtgtgcttgatacttcaaagaacttctattcattttagaggtttatttacagacatttttatcaatcaagtgtatggagtaactaatagtcttaaaattcaagtattaagtatatggaagtgggttaaatactttaagcaagaatttttccacttataatatatgtattcaatttgacttaatcactactaaaagagaaggtctttagtttcttctacatttcaaattatttgtacccctaatggagaaatatgaaatagttagatttttcctttcacaaagaatggagaaatagggaaccaaagcaagattttagaaagacttcattgtgatgcacaggagttgagaaacctccaaatcaccatacaagatttgatgaagaaagtagacataaatgagaagagcacaaaaggaaaaagtgttgagtttggtgaggtgaaagggcatcaatcaaaattgacatggatgcatttaataccaacttactgtattggcagtaagattgctgaatgaacccatggtaaccattcagtctacatcttactgtattggcagtaagattgctgaatcacttggcaaagcatcaatcaaaattgacacgcatgcatttaataccaacttaccaatcaacaaaaa

SEQ ID NO: 4585 - DNA, 1400 bp, Glycine max
  Soy_ogl_525 Gm02:13061301..13062700 Cluster 19
aaatttgctgcttaatgttttactttatgtcttactcaaatgtattttcaaaatatatgatatttatatgtttccaaaaataaactttactttatcattcaaccgaattattatttaaaacataacttaattttgttaatatttaatatagcaaaatgccaagaaacgtaccataataaacactatttcatattttcatttgcctaactttagtttcattttacagtgtattctctcttttagggctatctgctcgacacaagaaagctttataagtgtcatgtacctattcatccacacagctagtggcgtctttcccataaaaggcattggtggcaccgtggagtcactatcatcaagggtgtattcttttagtataccattttcttggaattagaactatgagactgagggtatactagttttggttcaatcttagatttttcaaaatgttaattattcaattctttggattttttgtgtttttttactgtattaattatcttatatggtttaaaaaatttcacaattttcatccaggcgaatctgatatattaatttcatatcttgaatctttgtttgataatccattttaacatggttttatgcatcaatggtgaagctactttgtatagcttttacgtcactcactaatttgacctgaaaaatatttatgaggtgatacactaaatgtttatttaaatttgagagagaaaaatttaattgaatcttttaaaggataaagacgaaatttcatcaaataaaataaagacgaaaacaatttttaataaaagaaataagagaaaatatattttagctagataacgcgtatcattctcatctcttttctagtatttaaaatagggcaaaacaagtatttatttaggtagaagccatatatatataaactcttttgttccttcatagtccttacccttctaaacagaggaaggattgcgaaatgccgaaatgccatattttttcctccttcatcaatccttcgcttgcttttctacaaaatcatacaaaccataaagttatatgcatattgttcattgtttatttaaatctttctttttattatataaatttgacaatttaattgaatgacatggctctaatatttaggataaaataaatggtgtttaattgaagaaagaaaaacttggatggagtgggacgaataaaatatgtttaaaaaaatgtggatatattctccctattcgctatattctatcatacagttgttgattaaatagaggcttaaagctgatttgaagtatgatataatattctaagtctttccaacaaatattcagctgatcatattttgacgtcacgtgtcaaaatgccataatttcttgttaaaagaaaaactaaaatattaaatgaagtatgag

SEQ ID NO: 4586 - DNA, 1071 bp, Glycine max
  Soy_ogl_4041 Gm12:14955094..14956164 Cluster 19
atagtcattagtagttaattaggtgtgtattagtgagggagggagttagttaggctagttgggatggctgatatagctagtagaagaaacctataaataaaaaaaggaggttgagagagaaatcatcttaccatttgagaaaggattagactcttacatagtacggaggtcctagtcttttgaatatccagggaaatcactaattttgtatcctcaatcctagcctaaggctgctaccacattggcatatatagcaattgagatatggggttcattgataaagaaaatcattttttttcctttagattcttacacagatggttctctagaattccataaaactgaaaagaaaagatactccaagtcatcgtgaaatataatattttgtaatcaccactcaccacaatattgagatataaatatagaaataacagtttttctttaatttgtgggatttcaatcaattaaaccagtagcaatttctctttaatttttggtagtgtttatttttaagtcttactaatttttctttattttttcaaactatccctgtaattatccatcactttgatattttttttcgtggttgctgcctttctagttgtcattagttttatttctttattaaaaataaatttattataatgttttgtgaattaatagcttttcactcactgatcgatgtctgctggacagctattagaccagaaaatattatatactattgtgtattggaattaaaaaaaattcaatatattcaagaaaataaccttaaagtccattattaacataaagttttgatgaaattaaaaataaattactaaatattacttacttaatttatgcttttttcatgactaaaaaaatagtaaattaaatttttttattctcttttaatgacttaaaattattaataatggataaatatataactttgtcaaattcgttatcctcttttaaaaacttaaaattatcaataattgataaataaataattttgaagaatattttgaatatattatacaaaaatttgttagcattaacttaaaaatataaataatttttaataat

SEQ ID NO: 4587 - DNA, 1089 bp, Glycine max
  Soy_ogl_3098 Gm09:32965101..32966189 Cluster 19
tgtaattgtagttccaattgcaaaagtccaagccttagaagaagaaaaaatcaattccaaaatttaaagatctcaaagtatttttttttttaagaatagtatcacacaatctaatatatacactattttgaactccatctatgttaatgattaaaatttattaagaactacaaattttggtaagtcctattttttagttagtgatgtctttcatataattctatagcttgtattactttttaaccaatagataaattgtgtgttagaagttatagaaaatgcttcgagtacttctcatatatttttttatttgtatgattttataatttcaaaaatctaactattgggttttctttatcttttaaaactttggacttctagagctataataatccttccgaaaatgctactcctcattttttttatttgtatgattttataattccaatttttgggtttttttatcttttaaaactttgaacttctagaaatagtgaaatatatataatgacccttgggaaaattcaagttctaaaagttaaaaattcaaggcaattgttatttctacttctcctcttcactaatacactttttttttcttttttattttctaaaatatgcttgtaaatgcacactcctccctcatcactttctctctcgcgttcttttgaaaagaaaagaaaaaacactccccttatgtacaaatttaccaattgcatcatacccccaacgttttgccttgtgtgccaagaatcctaccatgcatctcaacatggagaggagccatgttgaagaaaatctcaatcccgtaaactccaatagtcaatattgttcttaattagattttaccaaacgctaaacatcatttcattcaaagaaacccccttctcccctcttagatcctttgcttgcctaaaacaacaccaatttgaacccaacacctgctcaggaaaaagatgttccaagttagaggaaagggaaaattgaaaagagagggtctctgatggcaagtgacatggaattaatgatcaatgacgagtagaaacaatgttgtaagtaaagagaatgataaagcagaataaagctcaa

SEQ ID NO: 4588 - DNA, 1102 bp, Glycine max
  Soy_ogl_485 Gm02:10892278..10893379 Cluster 19
caaaatgcataggaagtaaattccctttagaaataaatattataaaaatccacatattcacaatacatgataacttgtgatttggataatagtatacaaaaaattaattatattatcaatgcactctaattaaattattattataaacaaatattatcaatgcactctaattcaataatttagtttatcttttattgattctgaataatttagtttatctaatgcactattggagtaccttatcgcctcatcattttaatgaatgaataaaataacaaaaaagtggttaaatctaattaaatatattttagatttacaatatactttgataaaaaaaaaactaattacaatatactagtatataaattaaactgtgaaaattataattatgtgtatatgggagtgagtgagtgtgtgtatgtatttttaaagtaatatgtaaaagtaaaactgccacaaaaaatggaaaacattattgaatctttttttatcagaaacattattaaattgagtagaaagaacaaagataaatagtcatcatgattctggccgttgcaaatgctttttagtttttaatgaacatcgatatttaagatgaattattaatcatttattaaattttaacaaatctctataataaaagtactaattaaaaacattcaataagtcactgagtccgtgatatttttgctaaggaacagaaagttctaaactcttaagtaaaggaaaaaaaaattggatgtttttagataagcgaagtgaagcccaagattcgcggacacagatcctcatagggatttgaaagagagagatccgcgtggcagttaatgtttcggatcagagactaggacgtacggacaaaccaaaccattgtatctccgaatcctttccctctctctttcttacttaatttacgctaacacccctcctatgtacctctgttccttccattctgctgtccatttccaattctccttctcactaaaatgtcatttcagtctagagaacactaggcgtacatgttagtattatgctattatctcgttaattaatttaatagctggataatgtatgaactaaaaactaaattaagtgcatgcaa

SEQ ID NO: 4589 - DNA, 1238 bp, Glycine max
  Soy_ogl_4194 Gm13:21965663..21966900 Cluster 19
gtgaatatttttatttatgttcaaccatttaattacaaaatatattttatcatttaattaaaatattataaaaataaaatatatagtaaattgttttatatttactttaaaatagtatgcacaattagaaatgacaaagaaacacataccctgcgtatatttgtagataaaatttgaaataaatactaaatgagtatctttagtgggtactcacgtgtaatgaagtagtaaatgtattgtcactatctgtttgttctgcgtattatctgttaatattaatatatttaattttttttactaatcttaaatacataaatattctttataaatatttttttatttgtatttacattttggagtataattttatttggacttatattttagtgtacttttatttaagtttatatcttagagagtaatttttagataattttgtttgaagttcacaaaatttctttatttagaattattcgtaggcatttttaattgtgtatatggtaaaatatttgaataactttagttgtaacaattaaaattatttttcaataaaatatttaaataaataaaattacaaaaaaatgtttgttaaaatatttttaaactcttttatttttacaaaaatatccatgaatacccgtagatatcacggtaataaaaaaaaatccacaggtatgcttaacgggtactatgtgggtaatgagcaaacacatgacaattatttatacgggtaaaaggtgattacaacctaggttcgctcagctcattatcattcctatgcccaatcttatattcaattttttgtagaatttttttaataaaacacatataatgtaaaactttctttataaaattgttggaaattttgtagaaggaatggtaagaggatacagtattacttggtgttttttatcttcatacatgcaatatgagagaaactaaaattagctggcacatgtcttattcatttattattgttagcctttgaagacagcaaattcaaagttgacgtttcataacgtctttaaaaaaacttgttctgttgtagctataatagattttgttaagccaatggaataagtgtctatacgtactgaagtataattggtttaggcttttgggagtgagaaaaattattggcatatgttgttacttgatattgattcctcaataaagttttgaccttcaaatagtgaggacgagcatagtagagagtaaggacgaggaaggaaactact

SEQ ID NO: 4590 - DNA, 2209 bp, Glycine max
  Soy_ogl_115 Gm01:37002092..37004300 Cluster 19
aaatacatttgaaagtcattcatacacattatgtagggttctatgcttaaacttggttcaacctatgcttaagcttggctcatcccatgcttaagcttgaaatccaataactcattttctcttgctggtcatctcacttaagcctagtggagcctacgcttaagcttggttccagccacgcttaagcttgaaaaccagtagcccattttcccctgcagatcatctcacttaggcgcaagtaactcttcgcttaagtgccgcaacctcgaaaagctttgaaaaagtagtttttcactttcaatggcttccaaatcaacccaaatggggtcctaaccatcttaaacatgtttccccacactaaatactcgaaacaacaacaatttacaagttctaaacaccttgacatgaaatctacaagaaaatgaccttaagtgttggtttatggagaactaacttcctacgcttctataacacttctaatgaaggatactccataaccaaacaagaataacaagagtaaggatggactaactcctacatacctcagttggtgcatgaaaatggtgaagaatgaaaggtttgattgaagcttcaagacccaagaaaacaagcagtcaaggcaagaccccttcttctcatcttctccaaagttcaactcaaaccaaaaatgaaaatgatagcagtttagggataaatgggatagagggaaagagagggagagagggctaaacatgtgaggttaggccatatttggctggtttcttttttggaaatgttgttgtagaagattaagatacaattaggcaaaacaaaaattgtttttaccaaatgaattaaatatctagttaattatcatgggtattgatggtaattatacaaatcaaagagtaagcacaattcatcatgcatagagaaaatctacacttagtgaatttacactgtctaaacttccacaatgtaatttacacagtgtaaaaatcatgttctaaagagattctaatttctattgaacttaacacataaaatagcatacatataatcaaaattttaaattaactacttgaattaaattctcatagtaattaattttcaatgtcaattatatttctacaaatcacacaacacataactttatataatatgagttaaaattttgagggtgttactagttggagcattctagattagctaaagctgcgggaatatagtagtgttatcttaatattgtgagtttacattttgcaaacccagccaagttgaagctgggagcatataacaattttatgaaagcattataagtatactttatacaaacctaataggttcggaagatccaaatttccatattcaatagaaccatattagctaagaatcataagcactcgtaacatgaagaatggtgatagcatgattcgactaacataatgcatctttcagcttcctttttacgttgccaactacaaaatgcagggggcatttgtcgacaccaaaattatgttgcaagaaatgaaatttaactagtgaggatttagcaaaattttcagctaatatggaattggctaattttagtgttaactagatgatgataaagtcagtctgattgaatgtgtagctgactattttcaatattagctgaatttgtgaataaggtcaatttggttgcgtacactattagttcaattggtacctggtgcaaaatgtgactgattggtagcataagaattttgattttttttttaaaatggtttgtggtggttaaaactaatcaatgataatgctcacttaaaaataagaagttattgctaatttcttcaaaatttgaaatataaatcaattggcttatggaaagaaaggatcatccctagattttagaaacatttaagtgcaattaccaaaagggggatcaatcacatttagcggaattcacgctagtcaattgagtttcagttgctatcagttgaatttaactgccataactaactgaatcaatgtaaaattagcttaatgactatcaaaccaagcggtttagtggaggatttgagtttttatcctataattagccttgtacttaatttcaagacaaacaatgattacaaaattaagcctattttatcatatttaggctaaaattattacaagtattctttacacaagcctctttaggctcaatcatgacttttctttttacttacttctccaaggaatttac

SEQ ID NO: 4591 - DNA, 1994 bp, Glycine max
  Soy_ogl_1318 Gm04:39302583..39304576 Cluster 19
accaaatcatgtaccactgacaagccccaacttaacaccttgtttttccgactctaaacatttcttcctgtatatatccattacctttgattcggcacaaaatgatgcaatggttttgatgataccaacaacatcgtttgccactttacttgcctcttcatagttttcctacacagcagaaaaaatattctcatgatgtttataatgcataatttcattaatggaattgagaaagttgcaactaaggctaaccttgacatctccactgaatcctttaagaaacttcatctaaaaaatgttcatgagcacgctttcttagagtactagtcaagcaattaaaatgaaataagttttattagaaaatgttgtcataaacctacaccacaattttaatacatttatgacatctaagattttgcaatgaagcttccaggaaaaactaaatttcgaactacaggaagtagccacctggtcctcacctttgttagttccacaagtcacttgattccccaaaagttgcactagtttccacatcagtgcattcgccactagtatactatcctatgaacatacatacctttaaatatatgtcaattaattgtcttgtcaaccaactgattcaagaaattcttagtgtgttaaaagaatatgcatggtacaattctataataggaagtcatcacagtttgttgtgggttcatttcataaggctataataggttagattgttcctaatattgtattgttttactacatgttatgattatttaccccatcgtccttgcagaatatatctgctctttagaacaagttattgttggtagcgtttactgaaacattggtaagtccctctattatctctattcaagattttcgtatttttttcttatgttttgtctgttgtccaacataatacaatagaaatttgtcagacaagttgaataattggctgacacgtgtatctgaaaaacctagtctactggtatttaacaactattactttgaagttaatatttttcatttttacacctatcaataattacaactacatttttttttcttttaaatcatcatttccccttgttccttgtgactcatttgtctgactattggctgatgagtggaatatgggcttgaattatcaaaagttagttttttcccactaattaatgttttcaccatcttacaaattctaactgtgaacatgctttgtattgcacatagaacaaagctaaaaagccttcattgaaaatcggttcattttttgtgcatttgaaggtgaaaagtagttgacctcaagttcaaattcatgttgattcacatttgatcgatgaagatagtgttttgactaaagaagatttaaggaaaccccagctgccacctagtaaggaaaagtttttattcatctatttgtcaactagcattctatgtgacattgggctcttagctgaaatgtttatgctataggtgattgggaaattgggagcacaagataagcctggaaaaattgcacctgtgggatagttgaagaagaggaaaaagtattcaacttaggatcgataatagagcaaattaataatcctcaatcagcttgtgcctttgtatgcatttgctttttcttttttcttttgcattatgtagtttgcttatgctttctaaggatgtctttaataagaattccttttttgttttttcacattttgccttaaaatatgtaaggctatgttcaataataatgtttaaaattcatatggtctttaaacttatcataacgcaattgagattggtatttaaaatcatggttgtacactatagttaggtaaaagcacattggtgtttcaatttgtctaccttagtctttaatctttaacatatggttttattttttgtaggtacaacttcttcactgaaagttaggaagttaagtcttcttttactactagtgtaatcaagtccatagttttgtatactatagcactccatcatcgcactag

SEQ ID NO: 4592 - DNA, 1800 bp, Glycine max
  Soy_ogl_1623 Gm05:28197001..28198800 Cluster 19
tgagatcgattcctcaagtgaaccaaaatatgaaaagatccagacagtcatagattaatgtcaaaagaaggaagaggctcttaatgattaccgaccacttgtactttatcaactaggcatatatttccatgaaatttcattttcatacatgaggaaagattaattgggacaaatatttgcatgcgatttcattttcatacttaaaataatcatgtaataataatataaaataattttacattattattcaatcataaattattatatataataagttaatttattttaaatatcatatgataatttttattgattaacagtgtcagataatcatacacataatcattacgttaactcttcatcaatatggatatgagcaaaagagaaaagtaaaatacaaattctcaactccaaacaaatgagacagttaccaactcctaatgtataaaaacaatcaaacatagcacaaaaagaaaacaatcagccatatataagtggaattgtggatgctatatacagtactagtactaggagagtaatttcatatatttcaaggattattatgcttttgagtataaatatagtcaacgtgagcggcacgtgttctcctcatcaagcattcatcctctccaacgccttcacagctctcatcaaccgcctcagcactctaaaaatatcaaaactatactaatataccataaacatagccccccatcaattatatataaaagggtcttgctatctttacgacactgattaaaaaattaagattagaagaattttattaaaaatattgtatgaaaacatttaaaaattaaaggagaacatatttttacacatcttaataaaacctttttcctcttcacctccttaacccttagtatttgtttatataaaaatgaatatagagcattaaaattcgacaaaccaacctgttggtgcggtttggctaaggattcttggtgaaaagctggttcagggcgtatggacatggcatggacgagcatggagctgagtaagggtgaggaatatggcagtgaccttggtcatcttctttggtatcgatggatgaaattttatcttactattaaagaagatagaaaaataaataacgggtgcttagaataatgtaataagagtgagtaaaacaaggaatatatatagagagaggacgcattttgaagtgtgaaccttggaagtgagtaggggctttatttattgtagctgacaatcaaagaccaacggcatcgaggcaccaatgtgaaacaaggagatacataataaatgaaacctcaaaggctcaaacacatttccttttttattttttataataaagtagtcaatgaacagtaagtcacatgaatgatgaatagttgataaaatggaggggaactaaaccgagtagaaagaaaaaaaggctagcttggaacttccattcgggttggaaattgttacaaaatgacatgaaaattgattaaagaattaaaaataaagtatctttaaaaaatattattattatatttttatcatgacttttaatgtgatttcacatagttagtttttagtaaaattaaatcattttattattgatcttttagccagtagttttgtcaagatgagagagaacaagtgtaatcaatcataaacttaaatcattagattttatttgaatgatcatcaagattaaaacaaaaatgcatatatatataactttctagagtgatcatgtggccaataaatggtatgcgtatctttgttttattaaatgatgtgaggatgttgtataaaattaaatacctt

SEQ ID NO: 4593 - DNA, 2032 bp, Glycine max
  Soy_ogl_2353 Gm07:17194522..17196553 Cluster 19
ctttatggatcctggtctcgaacctcaccatccctccggttattgtgatcgccaccctgaggagcaattcatcggttattgccctgaatgtctttacgaagagctcacagttcatgatgaaaactcttccacctccacccaagtggagtcccatgcaacttcctccatcatttcttccaccaaagctatttttcaacctttcactgccatgtgtggacccaatcgaccttgctcctcctcctccttcctcctcatgcttcgccgcacaaagtctttatttggcaccttcaaatcgcaaagaaaatccaacaactttccaacccacaacaccttattgtctctcttcaaccaagatgatgaatacaaaattcccagagaggaaccagaagttgaaatgcttaatctcgcttcatcttcttctatcgttcaagaagttgaagaagatagaggaacaagagaaatcaaaggaaatgaaatcatagaggaggaattagaggtggaggcaaaggagacaccagaggcaatgaaggacaccatggatttgggttcgcaagcgaacaagagttatggccatgatttgaagggaatatttcaatttgtttctttggttttcaagaaaaagcttcaaaaaaatggaggcagaaacaaaagatgaagaagcatgggtgaaacaacgttgttgtgggggtcggggacacttttttgtgtgtgtaaataatgcttatatagtcttactatgttatcttatgatttgaaactataaagctttgatttttaatatttactcgtgctttaaagtttaaaaatggaaccttggagctaagaccccattttgagacactggacagtgaggatggacccaagttgctagaagcaagtgttaatcttggacataaaatcctaatatatcaaacaacccttcatcaagagaaagtttggttaagaaaacttaaggaaagtgcgagttttgtctaaggcaatggcttgcaccagattttttgaccttagacaaatttgttaacttaattttcattattaaaagccattcttaaataattaacaagcttacgaaaaaattaagttgaaaaaaacatatctagactagttttggtgctcaatttaaaaatcaggtcaagtcaaggtaaaacgatagtttcaatatttaattaaattaattgattttattcaagagaaatgttaacgatatccataatctatttttaaacctctctatgattggttgcaaacatcattagtaccatattataattatttttttatggaaaggggaattaattactatgttgttatattggatgtggttattaaatatttactatatactaagttggcaataaatgttaaaaatatatagccatatcaatcatcatatgaaaacttaaagtttaagtagttactaaaataaaatagatgtcataataatctttatatttatagcatattattggtgctgacatgtgttgttcaacaatctctacaagatcaaacataaacaaaggtaattttcctacacaatcgacttttcttctttcttgatttctatatagtacacatctccatgttatgcatgataacataataattgcaaatatatattttcattagaaaaatgaatacataaagtataattgcaaaataaaatttttaataactaaataggcataattaattaagcacttttccctttctatttgtgagctgagtaaaagttgtgataatgtgaagctttgtatccaaatttatgttgtaataaaatgcatgattaaattcctagcttattggcgttataaaaagcctgaaggcttgacactaaaagattacgtgagttaatgctagaatgctagtgaaaacaattaggtgattttttttaaattaccaaaatggataaattttaaatttattaattaagtgggtatagacaaatcgttgttttaaagaactttgtttttaaaaaaatgattttgtacaaattttttaaatctaaattaacaacaattcccattagggactt

SEQ ID NO: 4594 - DNA, 1942 bp, Glycine max
  Soy_ogl_2818 Gm08:38045859..38047800 Cluster 19
attacttcaaatacactaaggtagaatgttagaaaaacatttttaattgaatatagttacatggttgaaaaaagaaaaatatcacaattataaatgaaagtcttttatgtgtatgatttccagcaacttcaaaatctccttgcttgtaatcaagagcaatattaacgattgaggagagcataatatttgaatccaagcagcttcacaattcctaatcaggaaaaagattattaaaaactgcaagtattcataaaaactgcaacaagattgtgccaatcaccaacagaccagattaacaaatacagataaaaattattagaatttaacaatatccacttcatattaatcaatgcagaggtttgcgatgattatatcatgtaaaagatggttggtaaattgtgttaatacctatcacccacggcaccaaatgtgttgggagagtagcatgctgccccactatgaggattattaatgtagatgggaagtaatccatcatcaggaaatgttttatttagcatggtgcaaaccaatgagtgcattgctagaaaaattgcatgcataagcaagtaactgatgcccttagctacgtgattaaaatatacagtcaagctccaacaaagtacaaataaggctagtagtagttgtacaaacagcctggcgttaataaagcatattttaacacgtaaagggcaccagcactgcaatgtttgcctgtaattatatctgactttttaccaacataaatgtaaccaccccaacccaacacgtaccatattgcaatgtttgcctataatttgattataaattttacatcaaaacatgtcacaaaaagcaaagaaaaattgtaaaggatgtcgtaaccaaagtgacaatgaattaaaaagaaaaaaatgtcaaagttaaaggaaactagcaacgattaatagcagcaaagtggcatttgagatgttacaaaattaagctgcttgttgcttgaatgtccggtcttaatcgataatggcaaacattatgctctaaaattatagttacagaactcttcggctatgatacttttatatttgcacaaataatatttttaaactgataagattaatttcttttgagacacatattattcaaaaataaaatttatttctttggataaagtcttcttttagttatagattgaatctttgacgtcacatttaagaaacgtaattatttatcaattgacttagatcattactttcttttttcttttttacttaattatagtagaatacttgatgtcacaaaatttggaccaactcattttagcaataatgaatcaataaaatagcataaaaatatgtcctaacaaccctcggagacaaggtcgcaatcctacacagttattgagtggtggggggctaactcattttagtacacacactttcccccactgactactcttcatcatcagtctcttgctgcatctcattctttttcttttctggcaagccattatttgtttgatatataaaacctaaccattgcctttttgtatttttaaccttgcttttttccgcttttgtttagtaaaggggtccaactaataatttggatgacccaaaaggaaataagcacaagtaggaaacaaataaattacgttaaaagaaccaaatgatatattgtttcttttcttttcttcgggtcataagaaacaaacatcacacctagaatatataatatttagaatttaatcaggatacattgtgagtgtataagtttttctgtattaccaatcaatcctgaatcatcatatcatgaaaagttattaatatttatagtaattatttgagaaagttatacgtaaagttattttaatggtttctattgtaaaaaattgtactaataatttgaagattaaactatcctatttttgtatctggtattggtatatatataaaagtagatattaatg

SEQ ID NO: 4595 - DNA, 1022 bp, Glycine max
  Soy_ogl_3100 Gm09:33089301..33090322 Cluster 19
tactagttatagtttatggtgatgatacctgaaattataatcaacatcactggtccaaaaagacatgtaatttaaataggattctctaggttttctattggcatgacagagaaataaagaaaatggtgtaatatgttacttgctcttgcatataacctaacatgggtaccaaatacaatatggatacccataatctcaatgtcctagagccatgaagcaactgctggtatatataacaactactgttgaatttttttccctatatgtttatttggtacataaaacattatcttaggggattgctctgatttttatatttaaactgaaaaacattttttttattagtttttctcttggacaggatgaacatgattgctttgtggttccatttctttcagcagtccatttagatgagaatgtatacagtggagaaattggagaactagtccattctatgcaccctttggaggaggggctagattctgtccaggagcagagttggctcgcatataaattgctttttttttcttcattacttcgtaactacctacaggtaatgcccctctttctctctggtatttgagaatgagaaatgcctcctctttattctttattcttgatgtcatgtgtcctacttcttatctattgtgtatttggttcaactttgaaatgcattttataacttcatgattttgtttgatttaacatgaaaatttgagaatactttgtgaagacataaggctctctcagcagtgagagtatacacaagttttatttcttgcttatgttcttctaatttgcctaatttcgtgattttatgttctaagcatctaatacacaagtaataaaacaaattaaattatttatatcattgttgtaaaaagtaataaacaggtagtgaaaagaaaaagaaaagctgccactttcactgttgaaagcaacaaatgctagctgtctcaacgtggagagaaaacttaagttgaaaaattggttccaaaaaggtcactagttactctagattc

SEQ ID NO: 4596 - DNA, 1200 bp, Glycine max
  Soy_ogl_3105 Gm09:33857301..33858500 Cluster 19
tagttcgatgtgactccaatttaactttggactcttcatagtagaaaattatgctccctttagattcagacttacaattccatttaatttcaatagtccacctgatattgtcgtgtcaggaatcagcctacaacgaataacattcctctcatccacactgcaatgtacgaaagtgcatgaatccaacaactgcaaccaaaggcaaagtttatgctgttttgggattccaaccaacaccttgattcacgtgggtgtagataaactgatatatataattcaatacagatcgctaaaattcatttgaataaactgaagatgaattaaattaagaataaaaaattgaaattttttattccattaaattatattgtgaatctacttttaaaaactatttcaatccaattcaaactaaatattacacgttataaagaaaaactaaaatgtacacgtacatgtcatatataagcataaaacggtgagatattaattgaatatcattttcagagatcgatttatgtgaattcaaagacggacaagcattatactcgaaagtattatgcaagtttcaagttgtagcaagtatatagattcaattaataaccattcttagtccaaacttcaaagtattccaaggttcaaattatagagcacaattgtacatcaaattttcattcaatatcgaatattgattaggttttagaaagcatgaagaacaagaataaaagctcttagatagttagttaatgtcttaatgaaacttgaccttctgaaaatgaaagaagaaacccccaaaaggcgaatttaaaatgtggcaaaaaagataccatgcataaattaattaagacatgagacaaagctttaaacataagctcaagcacgtacatgccactacttgctgataatcccatatgctgggagaacaaagaggagacttcatactcaatgaaacacacccaacacttgtggccaccacccagggcctaggtagcagaatggtcccatgacagcccaatgccttcaatattatcttacccttttgccttctagtatgtttcatgctccacagtggttccccagtgttgtgatgacaatgctggggtttttcctcttgtttattttttctttcctcatagttcctagttttacccttcactctaacacttgatcaatcaaaatgttataaattggaactaaaaaatt

SEQ ID NO: 4597 - DNA, 1400 bp, Glycine max
  Soy_ogl_3899 Gm11:34168901..34170300 Cluster 19
taggagtcattatttctctttaagacataaatgtattttgagttaacatttaccattttttataagaaaaaaatttaaaaattatcatccaaaattttaagataataagttattaaaataaattttaaaaatattaaatatattattttatgtcatttgaacaaaacacttcaagaactaaagcaaaattataaatatgataaaatgtttctaaaataaactaacaaaaaccaaaataaagaattttataagaactatttaaaataataattttataaagaccaaaataaaaaacaataaaatacaggtataaaaatgtatatttaaacttttattatatttgcattgtcatttaaataaagagaaaaaaaatggtgtgaattgtaaagtgagaacaaatagtaattctctgtagttgaattttgaaccatatcaatctcaatcataaaagataaattataggtacattaaattataaagtgaaattccgaccaaacaaaaaattatagagtgaaatgtaagttaaaaatttctccgtcattgaattaatttaaaacagcatgatagtgcagttcttgtctcccttatcaaagattatgacgtcaactaatgactaatgagtccacagtcgatgcccttcgtcagctaattttctagctggcaattggattttgacagcaaacccgaagaaggaaagaaaagaaggggaaagtgacgttgatgaaagaaagttaattgcattaattaatcctctgatctattaaacatatgcatagaggaaagtgatctggacaaggaatgggacatagatcaattgattttcattcagtttaatcattcacatgttgaagtgaacaccaaaattgactacgttatatagttaatttcaagagtcgttgctcgttaattatttatgctccacacaatgtcatcatctatccttccccaaaaatattgttttgcaatgttgctgactgctacattccatcttccttataaaattaatatatgatactataaatatgtaaaataacaaaaacatcgtcctcctccatctcctggacgtacacgactcttcggttctctttcttctctgtcactaataattaatatagatgaaggctacaagttattaatatggtatattacataattatcagataattgtttttttaagtatgtagtcaagaatttgatgatctccaaatctgggtattgtacaataaaatatctattaaaaaaaataccctttactatacgttccataagaataccaagactattgtaagtcaataagccaagttcaaaagtggcaacttattaagctcgtggccttaactttgatatagtggaactgcaatgttgaatatgctgcagtagcagctcttgaaatatattgt

SEQ ID NO: 4598 - DNA, 1031 bp, Glycine max
  Soy_ogl_4049 Gm12:15650470..15651500 Cluster 19
gtagaattgtaaatgcaattttaattataatagaaattgaaattagtttaaaattgtagttttaatgtttggactgcatagtaagagttaaaatacaattacactatattcataatcaagtttcagttttcacagtattgaagcttttgaaaaaatattgaaatattattctcaattcaaaaaataatttttattcatcataacggcaatcttatttttttttcttattctttcatttaaaattaacttttcatttatttatttgaaatatggtaagctcacaataggaatctgactccaagatattgtaacacagtttgggtatagatccagtatatatcgtttcccaagtcaggtctaattcttgttgaaaaacattaaaacaaccgtatccctgtactgtacctcaagaaattctccatataaaaacacatgctttagaaaaccccttttatcacctttctgaaaagatttgcttaaatttggtcatatgtgtttcatgtgaagccataactacctagagttcaaaatcctagataatggggaagaggaagaggaaatgtggaagtcatggtactcaacaacaacaatgaagtgaagaccaaagtaggtaaaagagtggtaaagggagagggtctagaatgtgggttttagacctaattcaaccccaaaagttagctctagggtaagggttgacccccacttatatattttatcttggccttatttctagtcagtgtaaaacttggattttttccaatacaccccctcatgcccaacacttttttgacttggtgcgtggatgacatggtgagtgacccgttttatggatctatgataggctctgataccatctagaatgtgggttttaagcctaactcaatcccaaaaactagttcgtaggatgagggttgcctgtcacttatatattctatcttgaccttatttttaactaatgtgggagttgggtttttcccaatatagggggttggacacattggtgcattcttgtagggaggatagtgtataga

SEQ ID NO: 4599 - DNA, 1500 bp, Glycine max
  Soy_ogl_6011 Gm18:9762101..9763600 Cluster 19
aactcaaagaaaaccaatttaaggatcaaacttgcaccccttaattagcatcaaacttgaccatatttttttacaattaaaaggccatacattaacttaattaataatgattgaactaattaaagtcagattaggaacaagaccaaaaggtagtgcctaaatgaagcccaaacgtaagtctttttccacttgaatcaaattaccaactcagtctcttcttcatattgggtttgaggttgtatgacttgatcactctagatgctccttaggtatctttattcttctccctcgttgattcctaacccaatcataggatcctcccttttagctattttatttttactataatatcaaaagaaatttgttgtttgctaacaatttaaattagaaatataggttttacctgagtcatcttttagaaaacaaacaatatatattgcatatatataaacatattgtaacactattattttgtatttttcttatttgtgcatataacattaaaaaatgacatacctggattcttgtgcatatacgatatggtatcatttaaatttccaagccaaagtttcttagcaaatgttatatgtaccgatctcaacaacggtgtgttaagattagctcttgaaaatgtttccatgcttgaaatattgctcaccctcaatatttgtaagttaggccaatcaaaagtttcactctgctgacagaaactgaccaactttggaagaaccttgagtacaaggcattcaattttaggaaaaataatagacatattttcatcattatcactagatatcgcctcttctattttatcacagccacacaatcttagtaatttgagtttcccaagattctgggcagaagaaagtgataataaacttttgagactatcacagtggacaataaaaagtgacactaaattttggaaaaatggaacttgaggttccttatttcaaacacctgtcaaacctcttaagttactcaatgctaatacgctcagttgaggaagcatttcttgaatattaagatcgggtttttcatctttaaggttgaacacctcagtcaataattcacatttgtccgaagtcaatttttttcaggttgttgaatcttttgatcatgctagaagagatgacactcaacaatttgttttgttactcaaagtcatgttttctagttcacaaaatgattcagaaggacaactgcagtgccaaagcttcttagcatcttgatttattacatatagtaccttcaatttgtccaatgacaactgcaaggaacaaatagtaattttcaactactgaaacaaaggtgaatacaaaacaaagtatgaactacagtgtataactgaagtaaggaaagtagattgtgtagcacagtacggtggcatgccgcatgtccttcatattcacatttaatcatttataaaaatagtaattaaaataaatatcatgaaatgtgtgtaaaaatataaagttgagaagatttgattttcacaca

SEQ ID NO: 4600 - DNA, 1300 bp, Glycine max
  Soy_ogl_6015 Gm18:10370101..10371400 Cluster 19
tcctaatgccctaatcatttatgattccttcttgttaactaccgtctactatgcgtgaacacttcttgttaacctacaaatttcgttgtcggtcataagctaggattcccaattttcatgtgaaaatgtaagaacagagacagtgaatatataaattctattaataattttaaaaacagaaaactgttaccaaaccaaattaattctattataatttattatgtatcaaaaaagctgttaaactgtaggcttatttttttataaaaaaaagtgtttttatgataaaaataagcatttttttttttgcttttttatgtgataaacacacagtgtctaaccaaattgagaccctgaaagctccccaacaattcaacttgggtaattgaacactctccaaccttgtaggagagatgttggaagctgagagcaaagtcaccaccttttgattataataaatctatcaggaaactaatatacaattagctatggcatattgtaaaaccagctagacatgtagcacaaattgaacattcacctttaacactctcaaaacggattaagagcactaatattactataaaatactattaataaggtcacttactaacattaattagatcaattaacttttaacctatcatcctcatttagtctaggtactgatattctttctcaatgtaagatccacactaattaaacaaaacaaaattctgagttaaattttgagtagttaattatcattcattcttactaattgttaatcttggaactgtatcgtatgttcaatttaccactccatcaccactcacaagattaattaccttgacactttatgcccgagaattctagtcatctatgtccagtgaaactaaaagttaagtctaaatcattattacttaacacctcaagtcttaaacacaagttcaagttagattactctactccatttgcatacttttcctttacaacatataactagtttcaagtttaaggtatgcctcgcaagaataatatatatcctgaaaagtctacttccatagttaaaataaaacacaagtacatcactcttttattgcacacaatttcatgtcatactactagttctctcttatgcattcttcatgagttttcaccaaatttaagtgagattcattcctttcaaattttcaattaagtctaaccatctatgaccttactaacgagttttcttgcctatcaagacactaaaactccattccaaaaactgattttgctgtcacaaataaaaaccaaattcactcaatctttttcctatatgttc

SEQ ID NO: 4601 - DNA, 1875 bp, Glycine max
  Soy_ogl_6090 Gm18:43708001..43709875 Cluster 19
ttttaaaagagtatacttgtgagagaaaaaactattgaaataagtcttttttttttactcaaatgaagttggttaaataaacttttaaactagtttaataaattataaattagcttaaaaacttactaaagtactcattttaaaagtgggttcatatgtataaaatgctaacatgtaagtctaagatggtgtctgcacaaattttataataccattggttataataatattataaatataatagcatgatgattgcttaaaaaaatataattgcatgatgatttttttacattaatatttatttttaattttttaattacttaattaagccccaaattatttacataactaatctcctttattgttcactgtgctgaatttgatttggcaggacccaatttcacagttcacactgtatttttttttattataagaaaaccgttgggaattcggtcccccgaccagaatttgaatgttttttatgtttttttaatttttataatattaattttgtatttaatttttaacatatataaaatatatttttgtttattatttgtactaaatttgttatggtgatgtgtagtttaagttgtatttttagtgtgttaattgttaagtttgagttaatttagtattttaaacatccaaattggctgttgcaggaggtcctttgttgtttgattttgagtgagtgaatgagttttttaatttgaactttatctgagtttcatagtttgcatgttactgaattcaatggtactaattttgcgtcttgaatgtgttaaaaaggttcaaaatcgtttctaaaaactgaaaaaatcacttttgaatggaaaaaggttgaacatgtgggtaactcatcacccaattttcaccttgatagtttggtttttttgcttccactttaatagagttgcttagtttgcatgtcaatgcatcccaacggtacctatttggtgtcttgaataagtgttaaaatagttcaaaattattcccgaaaactgaaaaaaaaaacttttaaatataatggaaaaaagttgaacatgtcggtaacttactatccgattttcacctcaataatttggttttgttgctttcaccttagtagagttgcttaatttgcattccaatgaatccaacgataccaatttcgtgtcttaaaacattgtaaaaatagttcaaaatcacgtcaatactgaaaaatgataatatcgtaagtaaatccaaaattatatcttgttgtaataccatactcctgcaagatccgagcacccgcttaatcttgcattcaatgcagacacagaagataagtcgtgattgaagtgtatgtacaacaatactgtgccccttgtccagctgggattcatctgagccacaaaagcaaacttagaaaacaaaaagaaagtccacttatatgaattggttgtcagcaactgaggtatagtatatatattactacggttcatatacggatgcatggcttcacgtaagttggctaatataggttcaaagggaaattttcagccattaccaaatgttatggcagatgctagttagacctactccaactatcaaataagaaggaagatatttggtagagtgaaaatagagagggagataaaggaatagagtgagaatataagagattgctgatagagtgagaatataagagattactaattgtttggtagagtgaaattataagaaaatattcaaaaattttggttgaactcaaaaaaaaaaaattctatccaagtgagcaaggaattgcacagaagtatgaataaaacctgcaacaaccattatccagcccatgataatcgattaaattaaagcatgaaggaagttccccttccccgttttctaattata

SEQ ID NO: 4602 - DNA, 1140 bp, Glycine max
  Soy_ogl_6132 Gm18:51929461..51930600 Cluster 19
gtcttataaatagaaaagaaggagataatttagaggaatcaattcacatcacatgtgttttaagaaagggaatgctcacctacattgacattgagataaaacaaagtttaataaaatttacactctattaagctggaatttaaaaaaaaattaactaattgttaattaaaaaatgttgtcattgatttagtatcctttatagtatttttttttccataaaagaaatcacgtttcattcatttgtttcaattttttcaaaataataaaaaaattattttaaataatttatcgtaaaattagtttttttttttataaatattttatagttgtaaataaacatgaatcaacttttatcttttaatctgaaaaataatcataaaactagtttacataaaaatcatttttttaatcaatatataacacagtgaggcttaatcacaaatttttttatgcattaaaattattgacttttatattaattactttaaaaatattattttaattattaattcacaattataacaaaattaagatcaaatttaaactttaaatgaaagggaaagacattttcaaagatgcttgatgtcactagcttctattgtcgatctaaacaagctgcaaaacagaagaagtgagggggaaaaaaattatatatatagtccctttggcttagacaatagaagatggggaatttgaagagtgtggcagtgttgacccaatggcaaaccatcacccaacagacaaatccccgtttgaacgggacagcgtgaagttgatgtcttggtgtcgatcaatttacgtgtaacacagatttccgttacatggatatacatctcaaattgcaaataacgagattccatagttgtataattttattaatttactttttattttctttaaatctacgtgctttttttttaattaatctgaagctaagtgcaaggtggaataaaggctagtttgaaactttagtacatatagccctttcatcaataagctctcttttatgtattatgaaaaaaatttacagctatgtataatgaaatattttagagcagtgttatatatattttcaaaataagttcgtgttaccttgagtgcattgaacaattaacacgaagttgttcaaaaataataagg

SEQ ID NO: 4603 - DNA, 2000 bp, Glycine max
  Soy_ogl_6371 Gm19:8881201..8883200 Cluster 19
cctactttattatgattgctgttgttgacttctttaccaagggattcactaatccggacagattgagcagctcatttataactatgtactcacttgttcattcaatatgataggttttgttttattgattctattctaatattctaattcaaattctaattaatatttatcatctttattaattgcaaggccaagttgtaggagcagcagcattacccaaaattcacattttccattatgcaaaatgatgttacttttttccactgactgcggaacacatttgacttaccattgtttcacgtctcagtaatcaatggtcggaattaagtagttacatagcactattaactgataagaaatatttcaggtctcgaggttggtgcagaataaattgaaaaatggaatcacagcacatgagccttgcaggaatcactattcattatgtgaaaacttcaaaggcataaacaggaacttagggtgttttgacgttagaattttataatgtaagcgaaatttatgagaatatataacaaaatttaatatgcacaatattatttataaacttaattattatgtgaaaaaaaaagttaaaaatagatgctttgtaaaatttaccacgagatcacgattcccgcgtaacaaccaatttttttagtattgtcattagtttgtattttccccatgaacaggcaagatctagatagctagctcgactatatatagacagcggtatattttgcagcactttttgcaaatgtacaagaatgaattaatttgactttttctctctgaagtttgaatgttagataaaatttaaactatatacactttaaaatttaatcctatcatgctatcaccatataatcctattattaatataatatggcaatagattgaatttttattagatatataagtaaaaaaaaatgtcatttttggtcatttagtcttagtgtttttttgtcctttaagttttaaaaatcatattttcgttatattttaaaaaaatcattttgatactttatttaattttcggtttgttaacattatcagtgttttacattttgaaataattaattttacatgtgacgacgattaaaaattactactatgcgtaaccaaatccctaatccatactcatgttctttaaaccaaaacttagaactccaagccaccacaattgcaagcccagaaacaccaccatttggtactcacttcgaagaagataagagaggacataatggaggaaacaacgacggtgaagctcaccatgcacaaccagtaggcaaaggtcgtgatggtgcccttcatcctcgcacattggtcatcaaggcacttaagaaacacaaggaagatagaaaaaatacaaagaacaataagcataacgggaacatctcccacgatagaatctttgatattgcgagggtgatgaggtcgtgctccatggcgaaggatctcaatgacaccattaaggagatgttggggacttgtatatcaattgtgtgcacactgccaacttcttgaggtacttctccaatgccatgcgccattgcttcatgaatctagcataggtcttctctagctagtcaaaatgcatcactacattgaactcgaaggtcacaatgtcttgcttcttttgaaaattggtgacaataatgtggaggtagttgtcgaagtcagattgacatgcaatgatgtcatcaaagttgtaatgcatgtagcctcttaaccttgctcatccaataccaattgtgggtatatcaactttctcttcagtggacaagttggaactttaagactcattggccaagtcgcaaaggtgttgttaccagaatcgtctttccttatcttcatataatgttataatatttcttcatatataccaatgattctcaaacatacccaagaacttctgaaattttttaccttggtttttatagactattttggtgcttttggattttcaatcttcttcttgttcaagtaaatggtgggaaatc

SEQ ID NO: 4604 - DNA, 1000 bp, Glycine max
  Soy_ogl_2012 Gm06:18984001..18985000 Cluster 19
gagacccaaaaaagtgaggcttaatttttaagctttaagcttttgaatattgtaagatgcgggaaaaaaaaaggtcaagataaaaaaaatggatccgcaaattagcaatgatatatgatataaacataaaattgaaaaataatacaataacaagatgaatatctacaaaaataatgaaggttgcaaccaaatcaaaacacaaaatattcttacgataattcttacaacactttaaaattcattttttctctaacttcatcacatgatcactcaatttatctgaatttttttttctcttttctcttcctatcactttctaatttgtaagaattaaaaaattgtacaaagttgacgtgcagctataatttctcgatcagttagaattgagtcagtgatctgttatacttgaagcagaccgcaacaggcatccccacctcaattatcaaagccatgttctccccttcctcccactcaatataacggaagcacacaacatgggattgaagattgtgtccttcgtacaattccctttctaaatatatcctaataattattaagatagatgaaatacataagcatataatactcatggtgcatgtttggaaacttaactaaaaaaagcaaggaatcatatcaatttagttgaagaaaaacacaaatggtttataactattaggttctacttaaaacataaaaatcacagactttcttgctataaactataaatatcctccacagaaagttacccaacttgagcggagtaggatcattgtagacaggaattttttttccatatatttaaaataattatatattcaaaattatctactaacgaaggtaattctttgaatatttagcataatcatatatctgtacaacttaatcaaacaagataatttaattaatcttgtacagtttcattaaacttgtatcaaccttttgacttctattcctttaatttatctccacacatacatatgccgagtcctatctcctgcca

SEQ ID NO: 4605 - DNA, 1400 bp, Glycine max
  Soy_ogl_2784 Gm08:21923401..21924800 Cluster 19
ttttgtgcagggcatgcagttgattatgcagcgacctcccctttaatttatcccactgagcactgaccctcttacttccatgcacacgctgcaaatttgcagcccacgcagacacacacactcaacttaggtacataaatacttataactcacaattaacataattcggcaaacaactactaccaagtaatgagtataccgacactatcaaaatgtgattcttttgtttgattgtttgctttctcccctttcccagttgagcaagtattcttgagtggaattggatcttttctctgcgggatatgattaatgatcttgttaaggaaagaaagacataagagaatgattatcatgatttggtgttatgaaaaggtttactagttatgtttctatttttcttgtgtctttctcttttaattttaagagataatcttattttagcatgttctgattatttaaaatttgtcactattggtcctgtttgcagatgggtgcatgcatggcgtctgttcggactgatttgaatcttggatttcacatgaaagaaagaaaggcttggatgtacgttcaaaatatcactcacaattaagatttatattacgcaaaggttatcaatattaaaataatatatatatatatatcaatattttttttatctctttaataactgaaaaaataataatcaaccaacataattatttttaaaaaaatcatattttttttattataatctctctatctctctttatttcgataaatatattaaatttaatataaattgtattaagataattaatatcatgtattttaataatttttatattattttattttatgttgtccattatttgttaaatgatatataagataaaaaattatcttataacttgtatatttgtcctgtggtatttctcttgtattatttagtatcatatctttaacaaatcattcgaattcatagtcacatatctttttcatttatgtaaatatataattttttttagtttcactaatattttattttattttcattcttaatttaagaaataattaaaaaataaaatggtgacatgtcatttttaattgtgtgatacatgttgagatcatcttagataatcttttgttaatgtgatacttgataatgttatcattttcaatcacgagcatcaacatttttattatggaattagactatatgaactaagaacaaaaggtttaacacttacagggataaaagaaaccttacaagaactaaacataaaaaatacatgtacgcaaaaatatttttaagcttttaaaatattatggatgttatttgaattttacactaaattataagtattttaacaatttaatcggatattttgaatgaaaaaattgtgggagaaaagaaaatatac

SEQ ID NO: 4606 - DNA, 1100 bp, Glycine max
  Soy_ogl_3097 Gm09:32088401..32089500 Cluster 19
tttattttgtaggttctagaagtttttgactcagtgagaattcattctcctggctttgttaatttagaaacccttgtggtaaaacgtgatgcattggatttaatatctgatgaagaagtaaattggatagttcggtttttacttcagaactctatactatctctagataaagaaaagacgttgaaagttatatacactaatacgctgcttaaaattcaggtaaatattttacaatctatttaagtttttactttatcttatgttttcatatgtcgttggtgttcttattttaaaactaattattgactaagatattgtgattgcggttgtttctatgttattttttttggctttgagagataacattttgtaactttaggagtgtgttactctgtagaaagtcgaagagacattgaatttgttattaattgtttttaagagtgtgaagttgaggttgaagtgaatgttgcagaatgagagattgaaatgagaatgaggacaggatcagggacctcttactttgttttgcttcgcatgatgaaatatttatgttttatttattgtctctttatttatctcaagctttcttagacttttattgcttctcaatgagtagctgatgccatacgctaaatcttttatcttttgctattcagatttggtgaattattattgttatcgttaaggaattatcacctaattttcttttattcctcaaaattgattacattaccaaaatttatcatatttgtttatcttatttaactaagttagattcgttgttaattatcacctatgtagcatgtaggacaatagcgtgtgaaatattaatttaatcagttgttcggcttgaatttttatatatgtctgttaacatattaatttcctatcagaaaagaattttgaaaattatttatacaacaataattatgatactatttttttcaattcatctctgtgtatgcgacttagaatatgttatgatagaaggataaaataaaaagtagttgggagtagttaaatacagaagattctatattattaatataataattgctataaaacaatttttttatttatctccttctctattacatcat

SEQ ID NO: 4607 - DNA, 1669 bp, Glycine max
  Soy_ogl_4268 Gm13:25782432..25784100 Cluster 19
caagaataaaattatatttttagcattaaatattatactttttaaaaaatgatactcctaagtaaaaccgttcatataaaaagtgatgcttaccttcagaaccctatctcttgaataattatatatcacggagtgctattctctgaactccggtgcttgaaaacatacatatataattaagatgacatatttgcatctttttctagtggaatttatgtcttctaatgcaagtggggaaagtataatctgattttgcagtagctaggcaccgatttgtataagatgtttcgtttctatattttgttttacccttcaatttgtattagctttagcataaaccatcaatattgatcaacaaagaggagcataattggcagataacaagatacttttatactattcagacattagtaatctttaaatgaaggattaaaaacggacactttttttctttacaaaaactacaaacgaattctgaaatagttgaggaatgaaaaatttatttaaccctccttgttttggcaaacttaatctatcacatatgaggggaaattgtgtagcaatgttaaacattgtctaatattcttttttcttgttaaaaaaaacattgtctaaaaacatttgtaaaaagtatatagtatttttacactgtttggttgacatgaaaataaagagaatgaaaaatagaagaaaaaaaatgctattttcctttgtttggttccattaaaagcgaaacaaataaaaaaaaacctgtatttatgggctctacacagaaagtgtttctccccaaattaggaggaaagggaggaaaacaggtataaactctaaaccaacatgcatctacttgcccataaagaaaatagttatttaaaattttatgtaataatttgtttaaacttttattgcaatgagtggaaaaacaagcacgtatatactacaagtcatgcgttgctagttttttattcaaccagttaataaatatgaatttctatcgtgtaccaattaatttggagtattgatacggttaatttagcaattggaatcaaattgtattattatattttattttaaaacttaattataattttaataaaaaactttattttttttaaattgttaacaaaagattaatttaaagcaaaaaaaaaagtaagaatatgttaattagcataataacaagcgcgatatgacaacaatgcatcaagggtgtgttttactttcacgagtctcttcagttcaaaacgaaacatgaaagtgcaaagttccttagtcaggcactacaagtgcgaaacttccaattcaactaaaaggagaagttgttcactttaaaaggcattgttgtgagttacagcacaaactcccaattattcttcttttcttatttctgacatgtgtcaactttcttttatgcttctgatatccgaaaagattgtgaaaactaaaaacaaaaaagtgcatctaaaaatgatcaattttgcaagctgactaaggaatttagcatctgaaaccagtttcctttggtgatctagttctcgaatttggaacaactttcattttactttggaatttttaatttatcaaaacaattcagcaaaaagagaaaacatttcactattctttcaactgcactgcactgttaacagttaagttcaatttttagtataaaact

SEQ ID NO: 4608 - DNA, 1200 bp, Glycine max
  Soy_ogl_5091 Gm15:33304501..33305700 Cluster 19
gatcatttgatagctgattcttttaagtttttcagaaatcttaggttagaaatcttaaattctcacgtttgatatgtatatcttaaaattcattcctaggaatcatttcttaattgaatttcattgagtttcctacaaaacactctcatataaagtagagaaatctaacttttccgagttaaaaaagatatatcatttttattaaagaatcaaaattgccataatttattattttcataaatcataattcttggctaaaaaaactcaacttattacaaatgccaaaaaagtttaggtactgtcggagacccaattaaaatttgatttatgtcaaatgaatttggtctcaagattagaaaaatatcattgttgttttttttttaataggaggaaaccaagaaaagaatacagaaaaacaaaaatcaaaacattagaattttttttatcaaatttgatgactcatgatcccctactactttatttttatttgttttggtttgtttttctaatgctttacaaatatattttatttacaaattaaataatcattttatccgatcgcctgagtttgaatcaacccaaattttgaagttgattggatttagacttattttttctctaacctgcactcaattacatcctgtccacttgattgattacacaaaatttatacgtttgttgttgatacttttagcaaggaacatatatattaatagaaactaaatttgattccatgcctcatggtctagagagtgattttttttttttttttgacataggtacagagtgatattttggtgaaagaaactcgttcagaaattttaattcaaataaagttgaaacgaaatcattcaaaatgcatgggaaacctccgggaaattatctaaagtgcttctgtttaagaacattataatgatttaacaaattttttttttttaaaaagaacactaattcaacaatttaacaaaaaaacaaacgaaggaaaaacaataatgctggaactgtacgttttgaaacgtaataatccatatggaagtctaaaagaaatgaggatcatcatgtgcgtttcaacctaaaagaaaaagaaaaacaatattgtagggaaaacaaagtagagtgcggtgttataaacaggaatcgcatattcaaattcaagcattttaattttgtcatatttatcttgacaatcattatcaatca

SEQ ID NO: 4609 - DNA, 1670 bp, Glycine max
  Soy_ogl_2064 Gm06:43581901..43583570 Cluster 19
agaaagaatgaaaaaagagtaccagcagtgctttaaaagtgacacaagaatcctattacaagcaaaatgaggcatctctctccctcaccagtcaccatttccgcatcacatggctgcctttgatatcgtcttttttaatcttcatgtttactagtccatttactaatgcctttcttcattatttcttctttttatatcttcatgtttacaaatccatttactaacctagtagagaagcctctacctttcacacaatcgtcacaatcatggaatttcaagaaatcattaccctccaaatatagggtataggaaaaaaacaagttatttaaatttaggtttccttaaaaacaaatgtaatctaattcaaattgaaatccgttgtagtgtgctgatcaaaataataacgtgagtgtaatgctactgttatgatttgtttcaataaatttgttgtgaaacatttaggatgctgttgaacatttaggatactgttatgttttacagtattgaattctttttttctttggccctcttagtctgttgtgaccaattgatgatgatgacgaggatctgtgtctcttgctcttttgtttagtttagtacgatgtgaataaacaaaccttgcaagccgctgctgctatttttattttttgctcaatgttcaaaaagaattttatatttaagagagggtgttaaattaaatatgactgttgaaggttttgaacagcccgtttgagtggaacagagaggaaattttatgctttgtggttgaattcttagttatgaccactaattttctatatggagcaaacttttaagaatgtatacctaattttcactttctaagggatttgtcttaagaaacctgaaggtttaagactacacactccatttaccaatgactaaccagttgtattgaggtgatctaaaggaactgataattaaccatattttaaaaatattaaataaagattttaaaatcatataaaaaagtattgtcaatctacttcaatgtgatttcatttcagcacccttttcctataagtatcagcgttggtgatgattaggttgttatatttatactatatatttgtgtattttgtctactttttaggcttttaccttctatataaggtctttttttttccttttgtattggttttgaaaggtatggtgtatattttaacctcttcatttatacggtaccttccaaatgcagtttctaatcatttttgaacattaaattaattaataagtaataataaaactattcaggctgttgctcaagagatagtgtagttatacgttcagtaacttaattgatagtatttagcataattaagtaattaggattttattaaatatatgaattttggttaagggatcaaatttgtagaatgatttatacatatttaatactgaaaaatatttcatggtgttaattaagttgataataattgcttacttaatgactaattgattgatcattgggttattagaaatgagttgcatgtaaattttattcaatattattttataaaaatattattgttgtgtagtcttaattttatttttttatctataattgaattagaatgtggtggctctacagctaacagccatccatgtccaaaaaatgaatcgtcttttaacggagttgaatgaactattgg

SEQ ID NO: 4610 - DNA, 1757 bp, Glycine max
  Soy_ogl_5990 Gm18:8258218..8259974 Cluster 19
gaatttgcactgtatgactgatagtggattagtgatgtgaaagtctttatatttacttagcctatgtatctatctcatggaccttctaggtgtttgtgttgcttcaccgttgtctgttgtaactagggtgtggcttcaataaatggcctttgtacatacatttctagttgcaacttgcaagtgtttgatactcatttgctcgttgttatttgctgaagatattgcatttttctgatacagtatctttattgtaaaactatttcgttgactttgccatgtaagggactatctcaaatatttaacatcatccaattgatttaatctcttctctcgcacataaagtacaaaaaaggtgagattcctatatcaagtaaatactgcagatgtggtaattgttaggtatattacatgtatttcatgtggatacctgtgtggagaagcaacacagcaggaggaagacaccagataattctgctgattaggattactatacctttctatttaaatcttgctttattttagtttattttgtttctttatgtttccttatcttgataagatctccatattagaatccccgatttcagatctttagcataactattttttatttgaataattgttagttgttatcctattaattacggaattgttagatacgatcctataaggttctctttttttattctattttatcaattaaatggtttgttacgatccttctagtgagggatctctttgtacgctttccaattggcagcagacctgattggaaaattatcaacatattattagtctataaatgaagacaagcctgaattatgaatttgtgtgtacccatttttccataattccaattataattatgaaccctaagttaatgattaatcaccgatttcctcaaaggtaattgtaagcctatggtcaaggtctaaaatactcttccccctaaattaatcctcaattggtcatttggaatttaatttagggttaaagatgaattacaaagaggtttgtaaaaaggagattcatgccaccagtttgaccatgtaagttttatgaatcctattgttctacacgttagttaattccgagtagatgatcactaacaattaattgaatatgaatcaaagtgattaattctaattaatataaatgagaaaactataaaacaatacaattaacatgaataacatcgaagatctcaattaaatatggaattagagcacatgggtacaactatatcataatatgatctctaggaatttagtcaaccaaggtcacaatatagccaaacatcatagaaaatagcattgagaatgaaagagatcaaaatcctttatagaatatgatctcaattgttccccatgcagttataaaactccaaaaacccttttgaaaagtaattaaaggctagccttaaaaatgtatccaaaattatcatatgtgataatttgtaagtgaataacaatgtaaaactgtcttacactgacattgtaatttatttttcataatgttttaagtttaataattatgcattggaagtataacatttcttactctgtcaaccatttaaaaattaccattgatataacttctacgatagttaatgactattgtaaaggtaagaatactttttatatatgataatttatgagtgaataacaatgtgtaattgctttgtattataagtgcatagcctaatttttcttaaaaaaattccgcttaccttgctcattttgaaaaaatttggatca

SEQ ID NO: 4611 - DNA, 2100 bp, Glycine max
  Soy_ogl_3521 Gm10:43698501..43700600 Cluster 19
taagatttagacaattatattgttgttataaaaaaaaaaaatacacgtacagtatatttccttctcagctcactttttttaaaagcttttcagaacttctaaatgagagataaatgaatattattaaaagttatattgaaaaaaataattttatcttattatttaatcataaatttattaatttttataacaattacattaaaagttcttccaatgaaaaaatataattcaataataatgtaaaattattttaacaatttttttttatagattatgacttttatcaattgataaccattgaattataactaagtgaaattcttttaagatcattttttcctttaaagactcaaagcattatgaacaattatttgctattatttactagtttatttatattaaaatagaccaaaatatattacatattaatcactgaaagaaaggaagtatagtattcaaaacaaaaatgaaaagataatacagtatcaagtatttttttatgactaaagtagtctactgttatgaagttggtggtgtatatgatccattaccaccagtttgattggtcttggtcgacaaataaagtctgatgtttatgcagtcggtatggtatctatttcattaccacaaagttttaatgataattttaggttcagccgtcaatttcgggttgctttttccctgcaccttcttccaggtggttacaatttaatatacacgtgaacataaaaatggaaaaaaaataataatttcaggccaatcaaatgccatgaattaaagcgttgtctcatactctcattaatttatttgattaatttgtactgtaagacagatatttataacatattttctgaattgagttaatgtaccaaatataaaataaattgtctatccattccccccttataaacagggtgcgaatgtgcgatcaatagaactatttcaatataaattgtttagcaaattatttttgagaaaaaaaatagctaaacaatgtttaaaagaaaaggtgtgttgtgtgtctatatggattaagagggagagccagagaggagcattgatttgctacatgtgctcacacaaacatacgtgctcattcactcacaaatttatttcaatttgcaatatcaaaatcatattcttcttctccctcttgtttttgttttttttccaatgacatcagaatacacagtcgcataaggtaatatataattaagttatgccaaattatttcatggttaaaaaatataaaaataaagtcatataaagaaaaaaatatcaatgatatgatactaaaatatatagaaaatatatatactaatttcctatatgaatataaagttgcttattagtataatacataatatagtaaaaatgcattccttatattaggagttcatcaatttctgctttaaaaaaagagttcaagagttcatcaatttctataaaataaagactgcagtataatgcgattatttgattttgttctttcattttagttttttttttttaattttaagacacgtattcctttcagtctagaatataagaaaattatggaatatcatttagttttacttatttaatttttttctaaactatctttcattaattaaatttgatgtcaaaagtaagaaaaaatattgaaaaatgaaataaaatgtatttttagtaattaattttattaaataggttaaaattaattcatacatatatttgaaattagataaaatatttttgtgaacatggcatatgccacatgtagaaattagaaaacaaacctggcctgcctcccaattttctatatatcttaaacaaattgcagcattagataaacattaattgtcctttcaagtcccttagaagatagagtataatttttgaatggtgaagaaaacagcatcgttgtcttcagaagcaggcccacccgagagtaactcaccgtatattttggcttttgcatgcaactgagttgttggtgtcttgctaactttgtattttcactttcaatatatcaatgtctcttactgtgcctcataattagtaccctaacatacaaacactaaaattagtggagtataatcaatgcctgcaactgca

SEQ ID NO: 4612 - DNA, 2352 bp, Glycine max
  Soy_ogl_158 Gm01:44059601..44061952 Cluster 19
tccaaccccaaaggaaaatgtcatgtagattttaaattacaatgattgaaagttgaaacacaaatttaaccagcatgctttgaagatctattcaagtttttcaagatgattacgtgggttggccacgttggggagaaacgtggcccctccctgtgcaactagatacatgcatcgaattgcttctatactttattcatattttttttattcacaataaaaaaaatattttcattatcaaatgggagaatattatattataaaaaaataaataaatgttgtcgtatttagaactttcacttctgaaaaaaaagttaatctaagaaataatgctaaatactttaatttaaaagataatatagaatttaattaaaatacaataatactataaaagctttttatactattattcaattgttgatcacagttgacatatatgctaaatttatcgatttttataataataatttaaaaaaactcacctcaacaaaatattttttaatcagtcaataatgtaaagatttttacacttaaaacacgtgctaataaaactcaatgacatatagacgacttaaggttctaagagaaataaataaaattaaaccgttaattattttataaaatctaatataaaatttctgattatctaaaatgtggcaatcctttagtttttttttttttttttgaaatagatgtggcacagtccttgacatgtgtatgattctagtggactggattattttttttagtcgactttagtctttgttttcttttttttaggaatgtatcatatagacacaagtcataaagacctatttttaaggcgtaaaaatcaggttttgtttctttcaataatttttatatatgtacgaaatcaaagtcttgttaacatgtttaaaaaactcagttgtctatcaattatactgaaatttattggtcctttccatgttatgttatgccgtataatttagacattagtatattttaatttgagaaatattagtaataggacaagctctccactgcacatttattattggataatttgctggataagatttatgcaagttttattaaataatgtaagtctcaatttatttactaaaaattacgtagtaaattttatccaataataatgtattgttaaaaagagtatatattaacaatgtgcttttaatttttatggaaacatttttcagttaaggttttctttagatactagagtttgcaacttgattataaaaaacgaaattgttcttccttataaaaaaactgattataaattttggttcttagcatcagattatacaaagttgttatatgggaaaagatactaataacaaaaacaaatgtagagaactcttctatattatattcaccactaattgtagaccgaactatagttgggacgtcgtcaaaatctcaatgggctgtgatcctgaggacttcatttttcagatccaagcatggctatttccttgggataaatgacacggacattactattagcacctccaaattactaataacaactcaattttagttttattttttcgcaaagatcaaaatatcccaaccctttctcccattaaatcctaaacctttaaagaacctcacactcactcgtaccttctccctctccgtcgcaaacacttaaccttccttaccctcttcatcgttctctccctccctttttcctgatgttacattgaagattgctttatttccattttcctcaaagtcgagctttctctcaaaggtaagatcttgagcttgaattcatttttttttatttttataatataacaaaaatttgtttttattgtgtattcaaattagatacacaacaaaaatttatatccattacatgtctttgagttgaattgaaatacatgcatttttaatacgttgattaaatttatgtcacgtacgatatatcaaacacaccaatcaagtgggccctagggaggagcagacatgtccatctcaatataaatgagcattgttgatagtttctactcgtagcagagagctatggtaatgttaaaggagttacaagctaccatgactgattatatagagctggaggttgttgttgcactagggtaaggcattgaataatatttaaactaattattacaaaagtcaatacttttagcatatttgatgataaataatattggatcataatataaaaaatctttattatgtgagggtattttaattaaaatcgtattcttcttattattatgaattactataaatgaaacacatgaaatttaatttaaaattcacttaacaatcctttcgaacataaacactccttatgaggtcaatcgaataattcatttatac

SEQ ID NO: 4613 - DNA, 2149 bp, Glycine max
  Soy_ogl_2069 Gm06:44080652..44082800 Cluster 19
attagagataatattttaaaaagttatcgaatttttgaaaacaatttaacggatagatgactaaggagatatcattgtgccaaaattctctatcttcagcggttccttttttgaaaattttctactcatctatctaatacttatcaattcaaatacaaacaatgatcacctgcgctaaatattctaaaaacaaatttatggctcataagaatttcatctgagtaaaattatttcattataaaaaataattacaatggttatggtgctgatgatagagtaagtagtagcatcatgtacgacaatctttggtgcaattttttcagttttgtctgccctcggtcacaattaggttaactatagttagacaaaccgatttacaattcacattcaagaaatcctcatctaaatgaaatatctccacaaccttatctaaattactcccatttctctctttatcattaattagttaattcaatgtgaattatatgactcttctatatacagtactagtgatgaactcatatatgtgataatatatacgtagtttttttttttttttaccgaatatgcagttataagttataactattccttgtaaaaaaaaagttataactattaattaaaaaattaatgatcatggattatgaagttattaaaatattaattgttattttctcattaatgattataaatatattttgtactttagagtgaaaagctataccaataaatcctacacacattttccttttataactatacatttgcatactacggctgcatatcaaacacagttacgtgacaaagttgaagatattataattcatcagttttaaattccccacttagagattgctatttcacaaagtaattatccattttctctaatatttatgaataaaaaaaatacttatcttctagaaatgacatcttataatatgctgtccagcccctgtcatttttaatggtgcatttctagaaaatgcttctcatgtcatgcacgatgcatcggatatagaccatgtagggagtatataacttgtaatataaatagcacttaagcaaaaaagtcaatatatccgttaattaaactaaagtttataatacttacaaatataagataaatatatagttacttgtgtacgaatgacaatttttgttttccatgcaaacatttcattttcatatataccctaattcattccatgttctcactcattcttactttattcatacaaatctacaatattgatttccattctataagcatctcaaatgatgtgtttgtataaagtatatgaaagctattatgtacatttttattcaaaatctttatttttcatttgtaatgcaatttttttataatatcatttaattatgcattatatataattaatatgtcacatgatcgtggataatataaaaaaattttaattttatattaatatatgctttttgcatacacttttgttaaattttatttgagaaaaataaataaagagaaaaaatacttatttttatcttatataaatatttacattttttctcttttgataaactcttaaattacattgtctttcttcatatttaaaaaaatattttaacccttaaaaataatatataatatatttaatttgttttaatgtgaacagatctttcataatagtttatcttcttacgtaaataccgaattttaaactactgttatcaactttgggagtgatattccaaagtagccgaaagtgacattaaaagttatacaaagaaaaaaaaaacatgaaagtttgtgttttttttataactattcacctgaggtatatataaagtaatgtggattaaagtatatagtaagagggaatagcgtatatttttaaaaacataaaaaggtatactataaaaatttctttgaacaggatatcgtaatttatcttttattatataacttagaaacatgttataaaaatgaaattatagacttaaaaaacattagaaacttcatttatgaaatgaaagattaagctcgatagtcataaaatcatttataaatcctcttctctatggtttaatagtagttgtattagttgtgaaaattatattctaatattagatttgcactgtaatagaatttttgaaataaataaaattttgg

SEQ ID NO: 4614 - DNA, 2449 bp, Glycine max
  Soy_ogl_4756 Gm14:40559152..40561600 Cluster 19
agttgtgttttatatagtaaattttatatacgtagtttatccggctattaaaaaaccaaaagttatgatgactatttgtttaagattaattttcaatcatgttttcactcgctaataacaaaataaagagaaaactcatcaaataaaatatgatttatcttgattttaaatttgaaacaataaaaaaatattaaaggtaaatttacttgatattttatgtactacaatgataacaagttccaaaaccaaatttcattcaatttacaatgctttccaaaggattgatccataattcacacaaaggcatgacccatatatatgcatcaacaaaagcttagatttcctataattgccattaaattaataattagtaatatagtagggacgggtactatagtcactcagaccagcatccattcccagtaaatttttgtgaataaatacatgtttgagactcatcccaataagtaggtatttaccctacccgtatgcaaatatttttgcaagtatttgtaggatcggagtatactttgtcatccctaatatggaagcaagacctttctaaaaatgtaagcatgttaggtctttagaaataaaaaaaaaaatttatcaaagttttgaaataaagagagtaatgtatgcttattatttcaagtaacttagtgtatatttaaattaaagttgacaaatttacatttggattaaacttaaatttgtaatatgaatttgcgaaagcaattcaattcttctacaaaattaaattttcagaaaaaattttaaagtactaacacatacttttaaaaataacctaacatattacgaaacccactttactcttcaaaaatatgctcaacattcaaaaagtactttttaactgttaatcaaacatatccttattcttccatgtttatggtattagatccttcagtaacgggttgcactttagaagatgggaaaatttctaagttattaggacagcataggcattgttgatggaacaaccggcaggtgagtgccagagtgatatggatggaaatattcgaaacatcacataataggattcacactattttagtaaatttgtttcttatagtgtatgtttgtcggtttggcattggctatttggctttgtgacgttatactcaattttatacaacagaactcaatatttaaaatagatattacatgagtagcgaaattactctagcctgcagcttatcatttttgaataaactatgatctagtggagagttttaaaactttgacgggattaaaatgtacgaataattaactataataatcaaattcttctcgtatatagaattccagtttgaactattttattaattttgacaaataattttcttattataaaatttcaccatacatagggttaggacagcttaagcttgtcctgcatccaactcttaattgtttaacagcttaataattctttaagctctaaacccagatgaagtaacttaatgatattcaaatttatttatagagattgtagatatcttttatggaaaacaatcttacggataagttcattatagatgaaaaatctcttctaagtatttaatgcccatatccaacaattaggctcaaaaccactagttgaattgaaacaatcacacacctattgatgcacacacactaaatgatattcaaatttaattaagattggctctaaatggaatatatacttgaaagagtttatttataatttacttgaatttatcctacgattatgtaagtgtttaaacgaacatatgaaaataacttataatacgttcatgcactattttcaacttatttcaacaagtttcattagacaacttataaaaacaacttacaattcatgtgaattgtttaaccatatttcttcttccattataggaacaatttatgcacaagtacttagatgataaaccttgagtgctgtttagataaatttctccaaacacttgcaagaaaaacagaaaaagaagaacaaattaaataaatttctcataaactaaaatagcttatgcacaagtcattttatataagttatctcgtattagtttcttcaaaagcttttatttaaacttgtcttatactcaacatttacttaatcttgtgacattttgtacaatattttttttttaccatgaattttctgtgcgagatacaactagaaacgctgtattttaaaaaattgtaatatgaatattattatgaatatctcattaatgtaatgattttaaatgttgaaagctacagacctacagtccatattatagactatagtggaggtcctagaggacatctgggtttttattccggatatcaaggtaactatgtaaattattgttaattactataatgaagatttttacattattttgattaggatccagatttaatcaagaaagaatcaaactcccaacattcaaaatatgac

SEQ ID NO: 4615 - DNA, 1700 bp, Glycine max
  Soy_ogl_5147 Gm15:48093101..48094800 Cluster 19
agcaaaaaattaagaataacctaaactaactcaatcctaaatattttatccaattcgaatttttttggagaccaaattcaatccactggtatccacccctaatataaactggtcacttagtcaattttcggatccaattttaacaatatcaataacggatctaacgtgggactcttaaaggaataaagggttggacacttgagcttttatacatttttttcgctttgaagtatgtttaacgacataccaaacaatcactttaatcaatgatcactgcccacttgaaaatggctgttcatggacctataactagaagaagaaattcattaccccacaaaggaattatctatctttaattttcctgcacttttctttcttttttcatattttaaagtgttcaggactatgattctccattacgaaagcaatttgttcgtcttagaatatagaagcaatttattcgtctaagatatatcaggagcattcaaaaataggattacaatattttgaattatcaaattaatctaaaaattagaaactgatgaaaatattgagaaaaaaacacattttggttaggtttattaattcgttcattttcctttgatttttattgttaaaaactgaactagaacaacgcaaatcacatctttaatatatttatatttcttttcctattatattaccatataaaattaatttttttgttaaccctaccagaatggtttttggttatgtaggttcgttattattatgtatgattttttattgtttcactagctacttatgattatttaaatgtcatttttaactgttgattaaactctaatgattattagattttgaatagtcatgtttgtgtttattttgaagtgtaattattaattattaaaattacgaatctcttaatattaaatctattgctaatcataaatatgttgtcatatggattaatattaaatgcagattacttttatattaatatgtaaattatttttcaatgtaatataaaaataaaatttatttatcactaatttccttacagttaaactatatttaattcaataatttgtaaaataatatctttattatccattcaataattaattttcaaattatgttactagcttgtatcaaaaagtgagagaaacagaaacaatttcacacactcaaactctaacctcaatatatactaccacttggaccgaaagttgcattcaaaattctcacctgaactcacctcaacaagtgggatttgaagtcacttttagagatataatttaaaaatacacctgacaaagtttcatatgattcaaggtccgcattatcacaacaacatccatatcggtgataatatattataacaaaaaattagtaaggtgcttaaaaagaactttgtcttgatgtctgagagcacacacactacatcatcattcatatatccacataaacagttcacatattcaccagcaaaaaatgcgagcattattgtttacctaggttctatagtatagtgctctcatcaaaagcataaaattaatagacatttaaagtcatgctcaaagatattttgtgtttgacactttctaccgcatatgataaaagggtatctggttcaatatcatttttataaaaggcatatatacatttgcacaatcttttgttatcttctaagattcctcattcctggcctcccaccatac

SEQ ID NO: 4616 - DNA, 3588 bp, Glycine max
  Soy_ogl_837 Gm03:4421201..4424788 Cluster 19
tacatagtaccttacaatccaaaattactaaaaaaacatcaggcacatataaatattgaatgttgtaaccaaagtacttcaatcaaatatttatttaaatacataaacaaaggctatgacagagtgactgctgttatggtttttaatagcaatgacacaactcaaaatgttaacattcacaatgacgaacttaaagaatatctagactgcaggtaatattatcttaacctgcataatttatttgctcactattacttttactgatcaatctatatggcaaatacatttctccctttgaagctacttggagaatatttgcttttccaatccacgggagaaagcctgttgttgagagattgcattttcatcttccaggtcaacacagtgttctttacgaagatcatgatgatatagatgatgtgctatccaagccaagcatttcagattcaaaatttctagcttagatcaacaccaataaatgttttgttgaaggcaggagtcttacttattcacaatttgtgtcaaagtttgtatataataaaacaaacaaatcatggcaactcagaaaaaaaaaaaaaggatatgccattagaagacttatatgggtgccaccaaccacaggagaattgttttctttaagaatgatgcttggtagctgcaaaggacctacttcatctgaggatactagaactgttgcaaatatccaatatgcaacatatagagaagcatgttttgtcatgggttttttacaagatgacagagaatatgttgaagcaataaaagaggctaaggactggggcacaactaattatcttaggaaattgtttgtattaatcctattaacaggtgccatgagcaaacctgaagaagtttggaaccaatgttggcattggctggctgatgacattgcatatcgacatagcaaatcaacaatgaactctggtaggtcgtgactattttttatgttgcacaccagtggtcataattattctctaacaacttgctttttatttcttagaattgcatatcaatgatgatactcttagaaatttgacattgatttaaattgaacaactattgcacataaaccaaagatcactgaaagactatcctacaatgtcatatcctcaagatatcaatctaacaacctacctagagaacaacttgatattatcagagcttgattacaacgatgatgcaaccagatcagaatttaagcatctttttgcatccatgacaggcaatctacctattcatataattttattgataacaattaacatcttactaaaagatgctcatcaggaattataaattgtattgatggtgttaattttctattcctaacaggcaatctaccctcatttagctgtttccatcaacaacaaaattattcttcatttctatataacattagcttacctataaatgcagatgaacaaaaaacaatttgcaatagaattatccaagctgtcaacaacaatgaaggtgagatgtttttcctatacggatttggaggcacaagaaaaatattcatatggagaacattggcaagttcattgagagcaggcaatcaaattgttattatagttgcttctagcggcatagcttctctattattactaggaggcagatctgcacattccagatttaagattcttgtaccaatttttgaagactcaacatgcaacatccatcaagggacttaattagcagaattgttaaatcagacaagtctaataatttgggatgaagcaccaatggcccacaaattttgttttgaagcacttgatcaaactccaatcaaatctttggaggcaaagttatagtattcggtggagatttttgccaaatactaccagtcatccaaagaggaagtcgcttggacattataaatgcaaaaatcaattcatcttatctatgggattcgtgtgaaatattaaccctaacaaaaaacatgcgcttacacagcaatctagaatcagttgatgaacaagaaactgccacatttgctaaatggattcgggacattggagatggaattataggtcatgaaaatgatggttatgctacaattgaaattcatgcccacctactcattactgaatatgatgatccaataggtgctatagtcaaatcaacattcccagacttacatcagcaccacaataatcttcaattcttcaaatccaggacaatactagcttcaacaaatgaaacagtagaacagatcaatgattatgcactatccttcattccagttaattatctcattacttatttaattgtcatttcttcagttaaaaatatgaccactgaaattggaattttataaaccataggtgaccacatggaatatctaagctctaattctgttgacaaattagaaaccattgaagattcctatttccaaaaaattactactgaatttcttaattcattgaccacatccagtttgccaacacattctatcaagcttaaaattggaagtcctataatgctcttaagaaacctcgaccaaaatcaaggcttgtgtaatggtattagattagtagtaacaagactggcaaaacatataattgcagttgaaattatttcaggcaaaaacattggcctcagtgtttatattccaagaatgtcaatgtccccttcacaatcaccatgaccttttaaacttttgagaaggcaatttccaattatgctctcttatgcaatgacaattaacaagtcacagggacaatcgctatccatggttgaactttattttccaaaacctgttttcactcatgatcaattatatgttgcattatcaagggtcaactcagcaaaatgattgaaaattctgattcatgataaagagcataaaagtatgaattccactaccaatgtagtattcaaagaggtgttcggaaacattaaaagattaatttgacttctttaatattaggttctattcttttgtcatgatttccaaaacattgttattttactaaaataaagtcaaatacaacaacatattacaagttgttctctaggtaggatgtcaaattgatatcctgagcaaatgagattgtaggatagtctttcaatgatctttggtttgtgtgcaatagttgttcaatttcaaacaatatcaaatttgtaagagtatcatcattgatctgtaattctaacaaataaaaagcaagttgttagagaatgattatgactatataatattatttaacttattagaatcttggacctaaaatttatgatactttgttacccttatcaattgtacccaattccattgattttacatgctaagattagaccaacaatattctaatgatcacaccatcaagtgcttcacaaaaataacaacaacccatcaataattttaaaaacactacctccttaatcaaatatgaccaacttgacatatcagaaaaattgctagcattccattgaatggctttccatgaactacagaatatcaatatatttccatagcaaacccaccaccatagcaaaatagaactcttacacatgcgatcaaaactaaccaacaaacgtatagcaaagcaataagacacatgacacaaa

SEQ ID NO: 4617 - DNA, 2101 bp, Glycine max
  Soy_ogl_842 Gm03:4579043..4581143 Cluster 19
gcttctctgcactcatgcatgctcatgagattgctcatcaaaccctcttcctcacatagtataaaaactgttgcctataaaaataaatgttagtagtcactcagtgtatgattgaaaaaacacagaaaatttgtagatcaattgatgcaagagctttgtcacttgccccacttagcttgagcaggattatctacctaaaaaatatttgttgcctaccaaaaaagagtattgacaaaccattcactacacacaaaaaaatcaaagaattaatgaaaaaaattagtaacgaaaattggttactcgtcatggggtcacaaattttactgatgattttgtaaaaaaacttgaaaaaaaaatgatttcattactaattttaatttttctagcaacattctttttatgatttgttgttgtcataattttttttatggggaaagtttagattccggaagttcaacaatgttaaaacagattttaagattcaataagtgtttctagaaatatttacaaattatctatcaataaaattttcaaatcgacaacaaaaattaaattcaccttgttgaacgtatttgttgttaattggattaatttttgtttatgtgattgacttgttctcatagattttaaatgttgtagaactgggaaggttttaattattagcaaggttggcataattattgaaaaatattctagtgggagaaatgtaatctcgcctgctgcatttagtggattactattctggtttacctattcctgattcataagtcgagaccacataatccttttactagtttaatctgcactatatgttaagtgatttttatgtgtactttcttcaaagaatatggtcttgacctttagttatgcatgcgtaccatgagaatatgccatcctcacgttaattagcatttaattaatttgttgggaccagttaattgaacagcatttccactgtacgaagatgcttaacatcaccaaccagatcttcagcatatgctagcatttctgggcattgcccaacattaaaattttagtacccaatctcggtgtcatgatttaattaatctgtttgcaaaaagcttccaatgctcattggaacaaagatttagtttatacagtagttatgaaccgtttcttaataatttaaaaaagataaagaaaaaagtggaattggttctacttttgattatgataaatatgctgactagtacctttaggatattgacaaagaaattaatagaagatttttttgttgacatatgtaaattatgttgagtgactttttttttattttcttatgatttttacaattcacactttcttttttttattttcttaatcaaaatgacgcttattatcaataccctttcattatttattttacaattcatttgtgcgtttatccaattaattaactttgctgttgatacttttcagcaagaattaatcgtagtttttggttcttcagaaaggtggcaaacacgttcaaaccaaaaaattaattgcaaaagaataacatgattaggttaattaatcgtacggacaattcgttagtgtttgccttacataataccggggagaaggatatgctataataataatggcatgtaatactttatatatatcttatcacttagagaattcaaatcttattattaatataacttagcccaacctgtaattttctatctcgcaaactcccctccctcatgttagaggaatgatgacaagattaggtttgttgaaattatcgagattttgaaatttgtttacgaatatgaaaattgttggctaaaatggttttcttcccccttataattttcaatccacaatttttgtctcccatctctgaattcaaaaacgccctcttgtaaaaagaatatgcactaaatcactaggacatttattttgtatagttcatattataaacaatatataatatgaatcgttgctgtccgagttattaattgtttttattctaattatacaaatttataaatcagacagatttctttattgtacaatatgtaaaaacttatttattagtattcaatatgtaaacgtatataaaaataaaaatctgtaaattaaatatttt

SEQ ID NO: 4618 - DNA, 2400 bp, Glycine max
  Soy_ogl_4354 Gm13:29854501..29856900 Cluster 19
ttgattgattaaaatcaaatttatcacttaaggaagggtcaaagacaatagatataatgtttgctatattaaaaaaatgttaattaaaaataactaataaagttaatacaacacatatttcataaaaaaaatctcttgtttaagtagtaataaagaatttgggcattttttaaggaagaatgtccccttactttaaatccgtttaattaattaaacaatgaaacatgaatttcaaagatatcattctttaactaaggaaacaaaattatgttataaggctctttgcccttttctaatttcctttatttttttttctcccacttataatgcttattatcattcttatcttgcctatgaaaaaatgccatttcccatgacacatgctttttaatttatgccggtgatccattgtcataatgtagcaatcaatatggttgtgtgggggcaaatgacaagtgtcacctttatgtgcaatcaaaaggctttgtgggcccacgaatatttggggtttgaccttgtctaaaatccagagttggatgcgttgcacgtatggcttgggaccatcaaacttcttgcacggtttaatttggcgttgatagagcagattcatgaatgataataaagatgtgaaaaggacacttgtgcacgtatttgggattttcttcaagaaaaactatactacactcacattaacataacataacatgaagtttaacaaaagtttacttatacttcatttattccataatattcattcgctaatcttaaaataagtatagaaaagtaaattttatgttattataaaattaaacaaattatataggattaaaaaggtaattatttgtttcattaaaattgtcattttggttattttacacacatcaagcaaattggataaattgattaaaaaataataattttataaacaattgccttgcttcctctcttttttttttcttccccccatcggccgttctccttggaaaacaaacaaatttaaataatacaactcaaaatcactctcaaaaggacaaaaaatatattacaagtttataactcctgtacccttcaaagaaaaaaaattaaagggaagtagaaaataaacaaaaaaaggataaattatgtttttaattcatatatatatatatgtctgtcttaaattctccttttcataaaaaaaataattctcgattaatttgaaattgaaccaaaaaataagtaaagtttgataaaaaaaattattttcatcaaggatcaaactcgataatacttaaatgatttaactttaacttcaatacattaatcacttcacttatgtccaatcacttgattttctccgaatattatagaatgtttactttatttcctataaaaatttcatagttttagctcttctattcatttagaaacaggtgtttttagtctttgattaaagaataaaaactacaccactttcaataaattttgaaactaaaaacgtattaatttttttaatactaaaactaacatttttgaaatattctgggggaaaaaattatccttctttttcattgaccataaggtgtcttgatattctccactcaaggtttctaccatctaccaatgcaaagttttgctcaataaatcttaaagttatagtgtcccgtacggtcaaacatatacaaaaaaaaagagagtaaaacccaaagcataactttcaaatttactatgacagaagacatttttgaaaatcaaaatcaaactcctttgaaataatcatttaattaagaaaaggatgagggttattacttatcaccaaaggatattggtgacaacctccgttggagaaaatgaccaataataaaagagaaccaaaacactacttcaacgggagaaaataaaaaatcaaacagaagaaacaaaaaaacaccacaaaagaagtgaaagaaactggggtcggctctaaggaaacactctcagttccaccattgaatgatgtatccttcatgtcactgtattaatatattaataagtagtaatagttaagaaaacagatttataactaaaataatataatggcgaatttgtattaactaatttcactgcattcattattcaataatatagtataaaaaatatatcgtgttcttgatatagtagagaattttgttgaaaaatgaccgactaaatgcatttttttcatcttataaaacaaaatatgaatcttagattacaatttatatcttaatggtttattagaaaaatgatgcccaagatgtgaatatcttaaaatttttttaggtcaatactaacccgtgtcttattagaatgcaaaaaaatatactctcctataattcaaaatacactcttataattttttaataaaatattttttcttttaattttttaattaatccttaa

SEQ ID NO: 4619 - DNA, 1310 bp, Glycine max
  Soy_ogl_119 Gm01:38609901..38611210 Cluster 19
ttagctctagcctaacgcaagacttctttatttttcaactatctttgttcaatctttatatacttatgtattctttatatctattgtatttgttatttatatttcagctaagattatatattttttatttcaaatatgttgaaagtgtatgaatttattcattattgtaggaacgaaatttctttttatttattttttcttcatgtataaatgtaaatgttttatttataaaattaaataaatttatagtagttattattaaactcgcaaaatagatatcattaatataatattaagatattataaatatatataactttattatcaataaccctaaattttcaaaatgtaaaataaatttatttatttttcaaaccattgatattttatctacgattgagatttctgcgacacgaagctatagagagctggttgcactagagaatccgaacatgttaatatgtacttaaattatataataaaataataaaactgtgattcgaaaattgtatgattttatttttctcataaggtagtaacaagtatgattttatttttctcatagtatgtacaaaactgtgattcgaaaattgcggtgactccagaataagactttagagttgtagtattgagtaatgacttcaaagaaacaagtcacttcactttgcaagtcacccacgtgcaaatgtgaaatggcgcacaatttcagttgatcgatttacgattatgttttggtcttaatggatgtgtactgcaactatggttcgttatttacttgtttcctttagtttttgtttatttttctgtttaattacttaaacaacttttaaaattcatttgtatttgtgtgtttcgttcccttaatcttaaataagattttgagtttcggtgtataaatgaaaaaaaaaaaacatataggttctttctaacacttcttccacaactgaacttcatttacttggttaatttggttattacacatataggtttctggaaattttagagctttacaacttttaggcctatatacaatttttgttattttattttcttcaatccaattcctctattttaaaataaagttaaatatatttttagttattataatttattttttattttcatcctttcaaaaaaaattatttagttttacagattatgtttgttttattttttatccttaaaataatttagatagtacatcaaacaatgaaaaaagtatgatgttataagaacttaaaaaaataaagataatttgtaaggattaaaacttttcttataagagctaaaagaaaaaaaacattaaatta

SEQ ID NO: 4620 - DNA, 1328 bp, Glycine max
  Soy_ogl_5102 Gm15:40835673..40837000 Cluster 19
gagaaaatagatttgagactgttacgttagctagattacccatagaacaaaacctttatacatatataatagataaattgattaatgtgttatataaaactaaaattcatatatgaattaataattcaatttattaattactaataatttacaatatccttaattattagagttatatgacacaaaagaaataaaaatgaaaatagaaaaggatgtgaattgcatgataatgattataattttattttaataagactattgacatttgtgaggtaacactgcagtagttttactcttaatttgcattgcttttagttgattttcaaagatatacattatagaatttggactgattgtttgattttaattgctgtctctcattataaatatacgtttggcaatcattttgttttgaatttcttttaatatgttttataaataattctatttattattaattaataatttataaaatttaaaatttggtagataaattaactataacaatgataaattaattcttataatgtagttgatgcatgacaatttaaagagttctttaatttttttaaggaaaaagaaagaagttaatgattttgatttctggttatatttactttcataaaatatatgatatttattttttattagtctaaattttaaatgattattaaaaattaaaattagtcattattgattttctttgtgatatgtcaaattttcacccggctaataaaatgttctgattccgtccctgtataaaacagttatccaaattattttaatattgaaatataatgcatataaaaataaataaacttaaatttcatggagggccaaggcccccacaactgaatgtgagtctttacttgcctaccatattgacatgatagttatgagtaattaattaagatattttgaaaagttataataattactatatataggattcctagttgaagcatttgaatatatttatgtcaaagacctaagctgtgatatgtggacacttgactactggattttaatatatatagttcgtacatggtttcacaagtgaatcaacacgtggtttgcccaggtatcataggagacttaattagcgagattttgggcatactaccttattagttttttatttgtgtcttagtgtaattatacttttaggctagctaggttaagggacatgtagtctatgcgccggtcacactttaagagtgggttgtgacaaatcaggtccttcttttcttgaaaactttaatcaggttttttatttttcaaaaatgcccaatgtgactttttatgtccaattaattaggttgcaaatt

SEQ ID NO: 4621 - DNA, 1387 bp, Glycine max
  Soy_ogl_5043 Gm15:13426014..13427400 Cluster 19
ttattcatgatacatgtaaaattaaatatatttaaatatgaaatatttaattttaatttatgcattttacaattcaaaaaaagttaataactcattacaaatgatacatgtaaaaataatatttttaaaattaattaaataaaacaaatattttaatgatttattgttttgttttaaaataaaagattatgagtttaactcttactaaggatctgatgaacaaaatgaccaaactttttattctaaaaaaatataacaattaaatgtcttaatttaaaaaaaaatcaaaatcacgtatttaaaattataaagaaaccaaaattataatttatccgtttaattttaatgccgtgcatatagagccagttatttttgcactgttgtacctcaaatgtgaaacagaatatttttcttatcattaattagctcatatatcgctgatggttaagtaaatatattggtattttcatgcattttttaaattattgaactgatattgcgttatttgttttggggataggtcgcgtgttcgtgaaatgttacttatgtatttttattttcatttagcatgttgatatatattagatattatctcgtcttaaaaatgtaatcgtcattagcaaggtcctcaaattgttattttctttattttctttttaactatgttgttgtagtgaaatatctattagttttatatatgactaatctcaccagagttattgataaaaaaaataatgattaatatgttaatatattatgatttattatttatatacgatagttgatttttcattaatgactaacccgtaaaatatatttattattataagaatattacgtaaaattaacattattcataagaatacaaattttttcctattttcttaagactagctgcatcattcacgtatttttgcttggcgctagtggtccatgttctttgaacatggatgatggcttagaacgcagttgaatttatgcggagtcgatgagtggtatgagaagctagtctttaatgatggaaatctgcatcttcttaggaagtgtcactaacaatttatgctaatgaatcggggcacgtgagttaaattctaaaaaaggtaacatgtccttctcaggagttattaggcaccaatgtaataattttgataattattataaaaaagattgaaaatttaggcacagggttcaaatatacaatatattagaattaggactttgagcaaaatatacactttcagaatatttaatttatatgtaatttttttaaaagtgagggttgcacccccaacatgagtgtgattcgccactgccttctacgaaaatatctgttcaaggaattgcaacaactcatacattaaacaagattagacaggcttaaaaagga

SEQ ID NO: 4622 - DNA, 1500 bp, Glycine max
  Soy_ogl_1894 Gm06:10540801..10542300 Cluster 20
aagaatcccaattcataaatttcattaatgtgtgatagcaaaataaaacagaataaatgctcttaaattttttgttaagttggtttcatactagctagtatgaatgatgaaatgatttcaaggggaaaagtgcaataattttcgtgggaaagagaagacgccacccagttttgactgagccaatagctagctggaactagtttatctccaatagtaataataactggggcccctgaagaaaagtgggagaaagaagactcagttacggaattactacgttaattagtaagtgcaaatctgacctatgaaggaacatctgaaaagcctctcaacgaacaattgaaaagcaaaaaaagtgcattctaaattaagtactgaggtggcataaatggttgttaacgtcaactagccaaccaacctatatatccagaatgtcattctgtgccaaaaccagcggccaatgttgattatgagtcttgttaattacgagtgttgttagaatattagtttaaaaaaatatgaataatataattttatatttttttgttctttaacatttatcttaaaatacttattagtatttgtcttatttaaaagcatactgtgcactgatttcttaagtacatttgctataataatgtgtatgcgtagagtgaataattggtagcacatgcaaaatatgcaatttttcatgttagtagttggtagtaatattttaaatgctagatctttgtttgcggatcgacattaaatgtccaattttgcaatttgcataattgcaaaatcatagtactagtaaatctattgttgtatggatataatataacagtccaatacttcaatctcacaagtcacaaccccattcccttattaaaaaaaaaaaagtcacaaccccattccattttgccagcctgcacaagggtggtaagtacttgaactcaaactaataaagtgcaaattaaatcgtcttataattaactgtataaagtaccccaaaaaaattgatatgataaatgtcaataaagaaaatcaattcaaaaaatttaaatacccacctcaatttaaaaaatgaaaaaatatcaatacatactaaatatgcattattatattgtagtaataatttaaaatacgattccaaaaatttaaaattattaacttgtttaatgattcatacagttttagttaaagtattaattttacagtcttattagtttaattatgattgaactgtatttaaatcagtgttaattaaatatcattatattgtactaatttccttgactgaatatattgcacgattatcttaaccaataagtcgttataataaagtcataaaaaaaattaattaaagctatatattaagagataatacactaatcatattttatgtcttttaaaattataaaaaaataatattcaaattttaaaataaataaaattatttgcacttttgaccctctaatgaataatttttgttcctcaaattttaattgtattgat

SEQ ID NO: 4623 - DNA, 2000 bp, Glycine max
  Soy_ogl_4082 Gm12:34056101..34058100 Cluster 20
gtatatacattcattgtgctttccttaacgcccaattttttggtgcacctgatggggaaagcgcagaggggggacataaactaattaaaatactaagaaataggattactttgagctttagctttgcaaatttcaccacatcaaaatcaaatcaagctttagctaagcccaatgcacaattatttcaaatttcacctttagatggtcgatttttcaaagagagtgaatgcagtccacatccacaacaaccaaaccatcttttgctttcaattttgtaatgtagaaacggaaagataaagtacaataaggataaataatatcctaaaaagccaaagcttccatttgcatattcccatttgacccccaatagtttgctatgttcttattatatatgtttctctatctatagccaatgcacgttgaacgggcagaacagggattttgtgggtttgtagggcctttttatttcattatcacgtaaaataaatatcaaactttttattatctttatgattataatttctcttttaggaatgaccattgtcttgattagagaaggttacctgagtcagcgagctccacacaacagaacggaacaggaggctgcgaaaaagagaagtcgtagcagacaagtacggttcattctaacagcccattgcatatttttaatgcttgtaaggcatcttcaacgaatactatattcactttcagtatgagtatattaaattactttagataaattctgaaatgtcatatacatttaagatatttatatacaattttttttaatatgataaaaaaatattaagtaattcatatttttacttcttttgttgaatttgggtttaaaaaattattttttatttttttagagaaattattatttattcttgagaaaccttgaagaggaattgcttatataagattcagatcttaaagtaaagaaacgcaccgtatcacctgaacttgcttcaacgagaataaaaagttaaggaatcgtttcttatcttaagatatcaattaagccactgtccatgaagaggtcctaagagtacttatgctcacacgtcaatttgtgtttggtttttcttaaatataaatttattttctttaatttaaattatgcattgctttagtttcattaattttttctacttttaaaattaagtaattttttctatttaaaactcacaaattttcattttctatctaaatatttttaaaaatggatttaaaatataaaaaaaattaaacatttagaaatgaaaaattaataaaacttaaaatattttatatatagcatgtgaaattaaggttaaaggggttaagttttaaactttttattttaagttcttgattgatgaaatttaaacaaaataaggtttaaaataatttcataaatttaattggtgaatattttgagtaaaacaatgaaaattttaaaatttaaggtgaaataaaaattaccaaatagaataaatttactaaattttaaaaataaagagacttaattgattcatatattataaataattaacacattaacctctatttcactgaatacttgaatttaaacttgagagttgagacaccagttaagctggaaaaaattagttgatccgttagtagtaaatattagtttatttaaaaatacctttttttagggaaatttaaaaataccttgtcaatcaaaatcatgtataattcaaattaaatagataaaattacaattaaacatttttcagcaatccttaagaaaattatactctttatcccaccgtaagcatacattaattgataatgactatattgctgtgaaaagaaattgataatggctatattgattacatattaagaattgatagacattacaaaatgaatttctgaatgtcatatacacaattttccccctagtcatttcgtaatgtttgtgccacgtttaaccgacttgtttgacgtaaaaactccaaaggaaatgataccgtttcttcttgttcata

SEQ ID NO: 4624 - DNA, 1944 bp, Glycine max
  Soy_ogl_5143 Gm15:47789201..47791144 Cluster 20
caccttactttcaactttcaagttgtttccttagggttttgacaattaagtcttatagatacgtaatgaagagaatgaacagccaaattaaacaattataagttcacaattttatcaattatcataaacattgcatcttcaaaatataattaataagcaacccatatttttaccatttattctaaatattaataccttaaatagagacataggtactgaacatgactatatatgatgataggcaactttcatggaaaagtgacaacgtaatacacgcaaccacgtatggaagctagctaaacaataatggactcaacacatccatgtctatccacaacttcgaaattcttgccatgaataggtggatatggacaaagtgttggattcagagaatgcattgtgtatgaaagcttggcaatctcgaattaattagaccttactagaagttagattttgaagggaatttcaatggaagaaagcctacgcattcaaaaaagtaaaaaaaaaaaaagataaagtcgtgaccacaaaacaaattatatccttacaaaagttcaacattaattattagaagttaatgcatacccccttttccccttttcatacacgaaaaagatgtattatcactttgattttagaattttgtcgcatatttgaagtccatcaaaatatctcgtctatattcaatgcattgtttttatttttaataaaaaaaacttttcgaaaattttgtcccatgtaaactcaagacgtatcacaaatttgaaccgaaaaaattaaagagaaagaatgtaatttgtttggttggaaattcttttttacgcaaagtttacgtttctagaatccagatccaaggttagggaaaatataagttctagattcaaatgaaagtgtctttggaggtattttttctgtttctttttaattgtttattccagaagaaattttggttttcttatttatttcaaaaattgaatgttatcagaagcgtcaccatcttaattatatatatccttatttttatttcaatgtaccgaaaaaatacccttgctttaatttattttatgcatatagcaaagaaaagacggaagtaattaatgatagaagaaatataagagtaataaatgagaggtaaattataaatataaaagagacaataaataaagctgtagataaagattgcgtttttttaaggaaaggtaaaaattacgttaagaaaagttttaaaaaaataattttatcttcataattacactattatttttatttattttatgcatatatatcaaataagggagagaagcaactatagaagaaatattagagtaataaatgagagataagttcattaataagagagacagtagataaagctagagatatataaatattaatagtacgttaagcagttagaaaaaaaaattgttttatcatcatcaaattatatatttttttctttttgagagaaatcaaattacacccttattttactttgttctacgcaagaaaagagagagagagaaaacgataaaagaaatatactactattaaatctttctgaatgaaaaaaaatatatattagagcaataaatgagagataaattaattaataagatagacaatatatatgaagactgaagagataaaggaagtttgaaaattaatgtagttaaaactactagtacaatgcgagtatgattttattttatattctatttaacttatttatatttttttttacagaaaacttatttatacttctaagtgctaatattttttcgagcaaagtgctaatatgttataaataattacatttaaacattgatagttaggtaaaactaacaacctttgtttaatattagccggaacaattcattatctttgagaattggtttaatttctatattcaaacagtgtttaatatttgagcccgaacaattcatt

SEQ ID NO: 4625 - DNA, 1208 bp, Glycine max
  Soy_ogl_830 Gm03:3579100..3580307 Cluster 20
ccaaaaatggatccaatggatagtgaatgtttatcggttgtgtcatatgtactaaagctagtaatgtttattttggtcttcattcaggacgtggttccttgcatagataggtcagaatacttggctttggaaagaagaggaggcaaggcatttcttcctccccaagttgttgaggatatcctagaggaacagatggtgtggcattctacccatagtgatagttacatggtaaatagtgattacaaaaacattgatggtgtatgtttattagacaatgtcaaagtctaacttattctttcattattattttttatttaaaaacttaaatacgaaaaagatttataacaactcacatatatgtttaactaattatttcaggttgctttaatacttactttaaatatgtttgtttgaagtcacttattaagaaaataaaaatataaagtatttaattaaaaaaatatttcatatattaaaatataaaaattagtactagttttgaatgattaaaagtatttaataaaatatattaaatattctcttttttataatgtgaattaaatgctgtttcgcatatactaatacctatattctattcttaccaataaaaaaaaaaaccgaaaatagcagtctcatggcaaaaagaaagaagacaaaaaaagaatgtttcctttaaacctttggcatacataataatatcatttatctcatgataaattaagcgttggcaataattatcattcgctgaaatcttcaaaaattcattatgatgcttacgtcagaagctcaatcatccatcgaccaacttttctcttcctttaaccattaaaaaataaacaaacttttataaattgtaagttgcttaaaatatgtcaagtgatttagttagcaaagtccaacagcagtccaaacaataattttaaggaaggaaattttctctaggaaaaaattatccaaggctgtgttacttctttagtttgctgtcaaaaaataataattatacaaacattttatggaaggaactggatagaatagtctaccattgcattgtcatctcttcatcaaattgttaaataaaaaaatattaataatatatagagggaaagagagatcaaattaatatattattatttgaatttattcaaattttgggtcgcatgatatttgtaacatgtatctacaaataattttaccaatgattaatcttt

SEQ ID NO: 4626 - DNA, 1300 bp, Glycine max
  Soy_ogl_1260 Gm04:6608801..6610100 Cluster 20
tgacattgccaattgacaataaactcaaattattgctttcccgtgaccctacataaattttagctttagtttgaaaattgaaaagcgttaacataattttaactagagtgattactccctacctaaggagtattaaaattatttttaaattttctaataaaacatctgttattactacttgtttagcatttataacttactttctcctctcaagtataagttaattaatagtattatttaattttattttttttaaactacccttcattaaaaaaattataattgaaaatataacccaacttaaataaagatattttgggatggatttattaaacatggtgaagttaattataatttccttaatttagactaacatttattttgttccttatcgatagatgtcataaaattggtgatttgaccaagtccaaacccactaggccaaaatatataatcgtgcgagatcgagttgactcaaattttattcaaatagaaattttaatcgccaaacttaattgtatattgtgccaaattccttctaataaaaaattaaacatatttaatatataatttttcaaaacatatgtaactatataaaataaataaaaataaaaatgtttaataagatcaggtcaaataagtccaattttttttttcaggactcttttcataactcaccttacccatcgagccaattaggctgggccaaatacggctgtatatttcatgcttgttattcaagaaacttactcgactccagaatgatgatttctcatggtgattagaggaagatatttgttgtctataataatccaatctatttgaagtaaaaatgtctttcatgtataatatttgtgatctataaaaaaaaattaaacaaggtaagtgttatcatacactaacttaatacaaaagaaaagtgactatttttgtttgcattattttagttttttaattgttatgaggactcttacaagcgtataaaaatcatatgctaattgtaaattaaaatattagtctttagacttgtgtctcttaatataaattttgtccaccgaaaatgaatttaaaaagtttacggagtatcatggatgagcaacttacacaagtcacataaactaattaatggaaaaacttaaaaaaaattaaaatagagaacatgtaccatttaaaatgaaaacatttacaatcactagatcatcagagaacgagtttgaaatcaaaatctaacgaaaggatcaggaataagttaagttactctcattcaaattataatttactagatagggatagatgtaag

SEQ ID NO: 4627 - DNA, 1447 bp, Glycine max
  Soy_ogl_3801 Gm11:8744195..8745641 Cluster 20
ttttaaaaagacagactcataatatactatatactatgctatacaaaattacaaagaggagagagaatgagaaaatgaaaaatgggtaaattaaaatagattgtggaaagttgaaattgtctacttacaacttatatcttgcaatttaatggtaatgatccaatgaatatataataattcaattaatattgaaaaaaattaaaatgttgctgctatttattttaaatttatatatgcaacatatgtcaatctcaccatgacctacaaaattatttatacatgacctacattattagtttaaaacaaatttaacttaattaagggaatttgaatcgttctagttgtttgatccaaagccagccttcactgacctttttgtgcaatacaagatgttatatcaattaacctaccataatattctagtaagaaaatggactttcgattctctctctccctcgatctctataattagactagaaaattacaagtcttttttataatataataatgataatgtcgagctagaccttttatattgaacttttatgactttgtaatgtaaaaagttttgtatctatatctcttcacaggtattaattaatatctaggtgtgtgtgtgtgtttttatcaaaatttataagtaattttaaaggcgataaatattcaaaatactttttcaaatgatattatattaagagagtgtagcttagttagttattaggatatatgtgttgtaaattctttcgtattatatttaattttttaaataaaaaatgatattattatgtaaaaaattaatccgagaggatttatttctgcaagataattaattagtctctcaaagctaaggttttttttaaaggtctcaaagctaaggttgtttgttttcataattaaagatcatcattttcttatgattttttccctttaaaaaaatcataaaaaaatatcagtacaaaattataaatactttggttggttgctagactacttgagctgttgaagacttggaaaaagaaaagtcatctaatttataacaaagaaagaaaattaatgtcgaaaaatacttttagtagctagaatttccccccgtttaagataaagaaattacaaaactaattaagattatggttgggtaattgtttagccttctccaacatacttttactttattaaactcagattattaataagtttggttgtctcttaaataatttcttcacctgtgttggatattaaattgactttcagttcaaagcaaacatataggttgcttttaaaagtacagttttaagttaggagaatttaatgaaaaaatattaaacgtcaacaatcaatacttcctttttttactcaacactgtgttttatcttacccaccaacattttaagcggagtactttaataattatgtactgtcattctaaattaagttactactaatatgg

SEQ ID NO: 4628 - DNA, 2200 bp, Glycine max
  Soy_ogl_555 Gm02:14933101..14935300 Cluster 20
ctactaaatctatcctggaaacacttgataggcatcaatggccacagcccaatctcaaaatatattttatgaacattcacggtaagcaaaatttgcccaagaggtgactttggacctttggtgtagtctaaacttgatcccaaagaaacttacatctgcctagcatttagacaaccaatcgttggtataaatttgagtgtaactagagtatttacctggttttaatatttgttcactgtttagatcatcttcaatcattccctgaagtacttcctctgcttctcattttacttctaaaaaaaccccggtgctttatggaacaaatcatgagtcgaacagtatttttgaattttcgagagctatggtagttgcggttctccaatgtcatgcctgcctttggagaaatccttgactagattagaccttgtttattcaagttacctgaagttttaataactgacaaatcgttttattttaaataattacaaatgaatttgaataccaacaaaatgacgatttcaatttttttcatatccaacttttgataaatataaaatttataccatttaagtaatttttatttcagaaatggttataatttaaactatctaaaaatgattaatatgctaaaagcacttcaaacttattttttcattaaaatttattttacaaaatcaaaataatttgaaatcaagcttgcaaatacttttaccccaatatactgtattccaccactcactgaatctttcaaccaaacaagagaccattttgagggaggggcagagaaccaaattaatttcaatctaaaatgtattgtagcattgcgcttgtccgttttgtattggatgggcttggagttgcctaggactttcctgtgataatgtcttccagtccaagcccccactgcaagtccaaataacttgagtggcttagtatatgaaatatgaataatcatatatatcaaacactctatcaatggtattatcttgtctatcatatttacaatttctctccccctctaattgtcatttacatgttaggtgtccatctatcattttccaattaatttatatgaaatggacttttctgtttttactctcccactctccatagtcttttcttctcctcaaaggtttgttttgttcaaattgggttaggaatgatgagaatatttcaatattcaatgaatgtgatgatcgaatatgtttaattaggcaatcatcaaatgtcaaatcagttccaatttaatttaaactaagagtacacagattagtaactaaatgaacaacaacaaaaattttaaaataaaaactaaattaaaacatcacattccatgtggatcgttgatgaagaggatacaattttagatcccgtgcaaggaaggtaaggaatactcttgtccatcgcgaaggaaatggtgttgctattttcttaccatatatcatgctcgtcatcttcattatttgattactcctccaatccgggggagaatgggaagctcaatgtagtctagagaaagtacagtgttggtgttttgttctctcgtttcttggtttctagttcttaattaagggtttagcccttcctaagttctcatggataaaataagaagattggccataatttaattttagccaataaaaacatcattaggatgacttttaatgcatatagaacttatctttgatattatcataatcaacaaacttaactgtatatagtgttttgtaattgaatgataacatttgggatttcataccgttaaccttaaaatacaagaaaaaaaaaaggccgggcaatccacacggagacaaacagctattaggtttgttctttcatcccgtgaccctctttttttttttttccacgaccttttatgttaaaattctcattggggccattgagctttgacctcagacatatcatgatgaggtacccaacgatgattacttagccaaaatgtgataaagctaaaagtttgtccgggattatgacatacatgatttgattttgaaatgtccacagtgtcactatagtaaaaaatgatgttgctttttccccacacttttgcaagagattctaaatcataccccttatggtttcgtttcactcttcagaattggatgtctctccggcaacacaattttggagcgaaatcaaaatgcagaaaaagaatcgatgtaggcaaaaacagcaacat

SEQ ID NO: 4629 - DNA, 1200 bp, Glycine max
  Soy_ogl_911 Gm03:36609101..36610300 Cluster 20
gcccaagacaacagagttaatgattcatgtttcttatctttggaattggaggtgtggtcattgctgtcaggtggcaatctccaggggaatttacaatcatcacaattaaatattacggtgtcactcaacccacataaaattaatttcatcattcatcatgctttaaaaaaaatattaaaattgaaatataaaatactagttcctgaacctcgtatgaaaaacagcacttatgatatttgattttaaaaaaatattaacgatatttttttattcatttttttataaaatgtttttaaaataataaaatataatatcattagttgctactatttcaaatttcaatatgttttttatatttctaataaaatgtcaaattttaaaaggagataaatttgagaaaagtcgttctttttatgaatataaattcctaaaataattatgaggtaaatatgtttttaattttttaaaataagaaaatgtatattttttgtccttcaacttacgataaaatgtaactttttcattattttttgacaaatagatcgattttagatcttcatgctaatttcattattttggatatttatccggctaatggattaacaattcatcgtgatcacatatcatttttccttttacgtgatctaatgttaagagattaaaatcaaacttgtacatatttagaataataaaaaaatattttatttactctaaaaaaacatattttattatattgaatattatttaaactctcatatttcatcacacaacacaccttacaatatttctcgaataaatgacattgcaatgataaatagtttaaacttttatacttcatcacacaaaacaccttacaatatttttcgaatgactaaccaaagataaatgaatattgaaaaataaattggttgtgtcatattagatgatgtcaatcacaagaggatcattaaccaaatatggtcccaagcaaccttgatagtaaacttaccacttggaccgttcaccaaaatgaccctatctctaatagcaatgttgagcattcgataactaggcatggtactaatgatttcctctcatttagattatccactaagctagtttcattcacctcattctccttcaaagattacccccaactttagcttcctctccaaagccataagctaaaatgaaatttgtttccaaacttgttgataaaga

SEQ ID NO: 4630 - DNA, 1264 bp, Glycine max
  Soy_ogl_6428 Gm19:38543537..38544800 Cluster 20
ggctttcatgttctgatcaacaaagtgttaattctatggttttcatgttctgatcttcttctaaaattaaagtgagcaagaacataatcatatccagtaagaaagtacccactacatgcattctgaaattcaccccacctctttaatacgtgccccacatcaagctcctcctattttgttcttcttcttttcaattatcagccatggcatcctcttcctctttcctttttcgtctcttccaccgtttcaccttaatttattaacaatctggattgcaaggttaaaattattttttagataaatattgttgttcttccctctcactagtgaaactaataaaatggggaacctgtataatgaatttataattggagtgatatgtaatttagtctccaacctatattacattgtacctttttttaaaaatatcatactgtatccgataattaggttttggggctacttgatcatgttcataccacgtctgcacttatgtaatatacatcaattaattcatttgtggcactgttataaacttttctttacgtaggagtgattatgtcattgactaatgtatccaatacacaagtttattcttccttttttacttaatcatatatgttctcaattatttttctttttttcattttcttcttccttagaataaagaaaaagaatgtctccgatattcaacatgcagtagtggtcaattatttgagttacataagtacacattgttaagaatcaatattaaacctcaatcaagtatttgactttgttggattgttgctcagtaacttgatctatccataggcatgaatttaaacatgggcaaggccattttttctactttctctcgagagaggctgttgtggacccttcaccttttaggcttttacctataaaaaacacactcatttttaagcataagaaataaataatattaatgggtgagacttagttgcccttaccacatatgctgaatttgtgaagggagaattgaactcatttttttagaataagaaaatgagaaatttgaagtgtgtttaaaccttaaataccaatcttataattagttcaaaacatcaaagtttgtagaaatattttaaaatcttactagagagtcaaatatttatatcttaattaattgcaataattaagaaaataattttaaaatcttccagaaaaggaaaaaaagcatgctaaaataaagctattcagaaattttaggaaaaaagtgataactcaatgatagttatacata

SEQ ID NO: 4631 - DNA, 1227 bp, Glycine max
  Soy_ogl_2545 Gm08:7684374..7685600 Cluster 20
agtccattacttctcaactttttaaataggacagaaaaactagtaatgatgagctgatgataattgagtaacaaataaccatagagaccaacataaagaaaaaagaatgataaaaactcttattagaatgtttttaaataggattgaaaaactagtatattataaaatgaaaaatgcatttaagcggaatatgattgaaatttaatgtcttgtagtatcaaaatccgtgattaactactatgccttattaaatcaaatctctagtctcattaataatattaatttatatttttgtttcttgctttagctagatacatattgatagatatactgaagctttggaaagactcacatcaatcttgtttaatataatgagaagtttaaagagtaccactaacgacaaataggatgttctaaacttttgaccgaatcactaacacaaacataatagtactaatagaattatgaaaaaaatagaagttcaggtaaagtgtatatagcattatgctttctagttccatcttgatgaaagtttgtttaactttgaatattcaatcaaacattaaaaccagaacaaaaggaataattactttttcccttttaacaaataaaaatgtattgttcttttgttgcaagtttttgctagatgtaaaagcacaataattttcactatacacgtttattttatagtttgataaaattaattttttattgttacatgtgtaatgaaaaattgtgtttaaactaatcatggttatagaatttttttgtaatttgataaattattaaaattagtaattgagattgcttatatttgaaaataaataaaatttgttgtttatctttgagatgaaaggaaatactaaatactgtgtaatcccattttacaggccaaaattgttgtataagtatttgatgaggtacttatgactaggatgtgttagtttggagagagaaaaaaataagaaataatataaatgatcaataaaataatataggatttatacttttacacttttattttaatttaatatttttatttcaattcacatttgttttcatttattcccactctattgaacgaatcgttaggacgctgaagatcgatctatctatctcaggcagaagaaaggaaaagacggattactaattaacgtttctccccttagagcatcatcactggtaattggtaaatccttgactcgttttttttatgcttataaaatt

SEQ ID NO: 4632 - DNA, 1554 bp, Glycine max
  Soy_ogl_6461 Gm19:39615001..39616554 Cluster 20
ttttaaaggctaaaatcagaataatattattgagaaagaagtatgagtacaaggtatacccaggccaaattacacaagatcggttatattacaagaataaaattcaaaacccaaatattaaagcaacaaactaaacccatgattatccgcattgccttctcagcgttgcacctatatccaatacccccgaaacaccaccaattcgaaacagccactatcaatagatcccaaaagataataatatctgcatcaagaagataactaactccttttcccatcttctatcatgtttcatttcatctatttcttttgggtttattcaaatagttaaagaaaataaaaaaaaaggaattaattgcacgtaatgttggacacacttccaacttacttttgaagtggtccataattcgtggtttaacatcgaggaagatgatgtgtaaaggggttgagatgaccaagctgtgcctcgtttgatccttcaattaagcaacaagtacactatggtggtccaactttaggtgtgctcgcatcgcatcgcgtcttttcatgtttcaatgcatgtttataattggtataaataattgagactatttttcatatagtaggtaatggtggaaattttttcaacttttgtgctattttgatataagatttacgtgaatttttttagtattttttacacttttgattctaattaaaagtgcatgtaaaatgttgataataaactataaagcacgtagctcatttaaattttaaaaaaattcatgtgatttaagtgataaaattaacatatatctttaagtactataatcacaacaaataagtttctagtttaaataaaattaaattatatttttttaaaataaagtctcatattcaaatcttataaattaaaaatatatatataaagtaaacaataatactctactaatgatcaatcaaagttttcaacctaacaataaattacatttttacccttgtttagttggcatgaaagaaaaaaaaaagaattgtgtggaaatgtagtgtgcacaaatttcgtggtttgggagatatgaaatgcatgaaacatttgaatttttggatggatcccacgggtaaaatctctcgttcagatgcaatgagaagttagtggaatattctttttttttttggcaagctatacatacttttctctccaatgctggcaagcgttgattagttggtttgctctcaaatctcatcccctcttacatgagttgatttcttttattacacattaatatcccttgtttttttccttattaaataaatttaatttaaatattttttattcaattatatttttcttctatcaaataatatttatttttattttatattttagatttaaatctattttttatccctataatttagtatttttttgtctctgaaaaaaattattttaattattgacaaatgtatttttttaactttttattcttaaagtgttttagataatatttttttcattttttaaaagtatttttattattcaaaatactatctaaaatattttaaagacaaaaaata

SEQ ID NO: 4633 - DNA, 1491 bp, Glycine max
  Soy_ogl_74 Gm01:3203810..3205300 Cluster 20
gggatagagggagtaatttaataagatcttaatattttttttttggaacaatttttataaaaaaattaaaattaaaattataaggataaaacataaatattatatcactataagttgtcaacaattattatgacaggtaaatccaaggatgcactggtggaagcacagtaaaagccagcaatacatgtttggtttaaattggttcacgaaaattcgtgaaaactatagctcgtaacaaatagtactgctcgtgttccgaataatagaaagatgattgacgaaattgtatactcaatgaaaagaagctaagagtagaactatgcaaaataattatgatttatatcgtagatttttcctggggtattattaactgtgtagttgtattaaatctgaacaacctaaccagacaatctacaagcacatgcaattaatatataactattgtttgtgttggaaattagtcaaattacagcaaattcttccttttaattacataccaattcaaataatcaaatagcatcttgcactgtgtaagtgcgtatatatttgactcatttaatgtttaaaacattttgtcaaatgttaataatagtaataataacacttaatgtgttgttatttgcaaacggcattcttcttccttccccgtttctagaccttaatttacttgtatacatcaccaaaaaagacagaaaaaaagttgtatgttttgaaatataatgataaatttaaagttataaccttctaatatactctttttaaataataaatttatagttttcttgcaccattggtttcacttgttttacttagttattagacttgtttaacaaaattcgtatcatagcttaaagttcacgtggatacaatgaaatctttactaaatttaaagttagtaatacaaccaacccgttccttttttaaaatcatcaatgttagtgatctctcaaatcctttctttcatcactaacaagtaatggaagctatattatcgatttcatacgtagatgagccagaacctttgtgtgctttgtttatattgaagccacactttcctgaataattgattaactttatagcataatttgttattctcataatattatttgtagtttcacaactttctcactctttctattataattaaagtgatatgtgatctttagtaagattagtgcaataaatttaccacttaaccggcatcattttgtaatgatatactaatcggtccttatgcataaaatttagtactaaagaaatcaaaccgaaaacttttttgtggaccatttctatcaaaaaccatgtgcaattgcggcttcaatttgaagcttatcttgtggcaaaaactactgaaaaagcttagtacttcggataccatgtagtacagggcattgagtttcgcttcatatgggagtttgatttgatatcttactaactccttgtagggttccactcatagattaccccacagaaattccgtatgttaatgtg

SEQ ID NO: 4634 - DNA, 1500 bp, Glycine max
  Soy_ogl_1379 Gm04:43948601..43950100 Cluster 20
tatgatctatgtatataatttgatcactttcaatttttcatagtcaattaaaagtgaaattagaattatttaattataaaattttcataaaaagatccgtggctataaaaataaaaaaaatagaataataatgaaattgatgtatggtgaagttacattcatcttccaaataactcttggaaattctagagatagcgttggctacccattgctgtcttttgactcacattgaaacttaattgcgttgagtggtgcttgtgtacgtcaaagatctagtaacttggtctttctttctttcactaccaagaaacaaagtacggtgtttaaatcagctgataaatttgggtgcttactgttataattattgggttggcatttgtggcgaacattagatatcatctcatgactccgaatctatatctgtttccacaatgataggagggggacccacatcttaacatgaacctcttcttaatgtcaaccatgcaaatgcttttcatacaattaattaattggttaattgcatcattttttactgctccctctcgtaactgtgtacctattaactaatacccttgtaacattattgtcacgtacacgtaggactgagctcgattcaatcttattttgacatattcatcttaaataataattaaaaatagaattcatcgcttatatatgaaattttatatttttttattttcataaaaatgacagataataaatgtacgagtgatggattacatcaatataatatttaagactgaactattaaaatataaatagaatactgataagtaacctttaacaccttacacaaacaaaattaaaagtgaaaaaaaaatgaaaagttactgctaattccgaattttaaactcgactcaaacctaattgctggaccatcccaatttgactggaaactgtctcatagtttattcaatttaatagttggatcaaatgtgtttataatttcacattgatgtcatcaaactagccataaactagattgacctatgtgatttaatttccttccagcggagcccaaagaagaatcgtttcacaacagtcaaaggtctgttacacgctgcagtctgtctcccattgtttcagtcttctgacaaactcagtactgaattactgatcacacaatgtagaaacgagtttcatcattgtttagtatatgaaatcaatgttttaccaatttgatgagtttgttttattttgttttttaactcatcaggaattaaaatttctcaaaatattaaaatttactatatttatttaagagatcaaatctttaattgtatatataaaaaataaagttatctgtgaactacactatatcatattgattatccatgtatttaatcaatgatccattgatataatattaactctttctaatttaattactagtttgatttctataaaaaaatatatatttattaatctcttaactttacatatgcatttaagatactagttaacttgactttaagt

SEQ ID NO: 4635 - DNA, 1289 bp, Glycine max
  Soy_ogl_3929 Gm11:36814612..36815900 Cluster 20
caagcatacacaaggttaatcactgattatctaaactataagtttaaaaattcaaaacaaaaaaatcaaacatgcatattcaaacaagtaattgaatatgttcctttgacgagtagtcaagtagtgaaggaaaaaatagtcacgaatcatgatgaattgatgacaatcatttctttaggaaacgttaaggtgaaaccgaaacaaattttcactcagtttacgagacgatgaaacatatattcagtactgattgcaattcatttttttaacaaagtttaagtgtctcattatgacatatttatattttcgtattcttgtagtaactttaaaattgggtaaattcgtgcaaacaaataataacttgtaacaactaacaagtctaacaattcaatgaatttgagattaaaacgtgaacctagaagggaggaactaacacgcatgagaactgacatatcctataatcttgactaggggctatatattgttcccatacacgaaaaagctagccctacacaaaaattcaatttaagtaatataagtttaatttttttcagataagatttttttttaccatgatattgatgtgaaatatcaattaatttgactaataattaatcttttcaaaagaatttgattaattactttaatgaaattttatcttttaatcatttttttctcagacttaaatttaagactttagagaaatagaattcggtatgactcggatgaatgaaaaattagtttttaatatactattaatgttcttaactcaaataaaattattttatgtaaaagatatttgtagtttaaattaaaatatagtaatttttaaagtatagatataagtgtattttaaatatattcacattgaaggctattttaaatatattcacacatatataaaagtatattttaaaaaaaaaacgatgaatctcccttacaacttcctttttgaaaaagatatgacaactagtatatttattgtccttcattcaaataatgcagttgataaatcttataattaatccaataatggaaatgattaataggtccattccaatactcaaaagaaaattgtgagacccacaatgcaggatggatcgatttcaaataagtagcttgaaaagaaagaagggaatccaaatcagtaaagcagtgattacttcgcaaccatgctactgcaacaaaaatgatagccaatgccaaacatgatgaaagagataaagtttgcatctagtactactatggtgtttccaaaattaaactataagccacctagcctatcctat

SEQ ID NO: 4636 - DNA, 1200 bp, Glycine max
  Soy_ogl_6865 Gm20:39381401..39382600 Cluster 20
gttaatttgatggccatttgttactaaaaccagaggccattttctaaaattgtttataaataaaataaaatccgtgtagtattgataaatttggtcaatcccagctcacgaaggagccgcttaaacccacaaaagcctccattatctaattaagttgacatctaatatgaattatacaactatgatttacattgacgtatactttgggctatacaagtataatacattgttttccctgcttgagtacttggaatttattgtatattcatctaatagtttaaatttgttaatgatttttaataatataaaaaataattattatttcacagtataaaaaaaattattagtatagtattttaattaaagttctggtcatctgtcaaaaaagaaaaataaagtcgtggtcaaaattatttatgaacacgaaggaaacgatgagccaatacattgacgaaacgctcctcccacagaaatgttgtcccgtgaaaaacgtctcttcgcgcattgcccctacgtcaaaaaccagaaatcaagttagaaacatcttcctttttagaaataagatgatgattcatgcttcttcttttcttttcatgcttatctaattatctttgacccaatatacaatggtatgtctatgattgatttatccatataccagtatatttttagatgctactgttctattacataaatattgcacaaatggaagctgcataaataatagtatataatctaattttgtatagaaatttaactaaaagtcaattataaagtcaccatctcatcgtttgtttttctgttttgttttagtttgaatcaccctacaagctgacttgctctcttccgttagagttcatttaaaggcttttaaaatttccaacccttgcaatatgaaaggattaatttgtgtgtacgaatacgaccactccggttgactttcatctacaaatgtattgattctattaattggatttgttggatccatcatagtcccattatacaagctgcaatgttcttattcttcttctttttttttcaattcttttacgtaccaactaccagaaatttactatagattacggatcataattagacattacttctcttggagtcatatatataagaaaaaataattagctttacactaattaagaaaataaattgatattatttaattttattaatctcaagtgaaaa

SEQ ID NO: 4637 - DNA, 1451 bp, Glycine max
  Soy_ogl_429 Gm02:7016101..7017551 Cluster 20
cagtagggacctggtaaggtttagtagctaagttagagtctctagaaagattggtacaaagagttacatgcataagtctctcggggatgctagacatgattctcgtcatgtttgtcttgctaatgagtcctaagtattttagtggaggagagataataatatggaattcagtctagagcctcaaacaactaagcaccaagtgacttgagtataagtgggtcaacttggtcattgtccataacaacaacaaattttaattaataaataatataaaaaacacactgaaaaaactgtatttattattattattttgtccttttcttatagaaaaatgggatggagcaaatgaactagcaggagccagccgttgaactctcttctagactgaaaacaatctttgaaagttttgaaatgttttcaatatatatataaacgtttcgaagtgttttattcttgggtctgggtttgctgattgtatttgggaaagatttatgtacttgtttaatttgcttccaaatgaggcacatcttgtgcttggttaatttgcttctaaataaattaattttgcaagaaattaacctaagtctttttattgtcagaatagataactacaaaatagtctctacagaatagataactacataactcaagtgaagcaccttggtcattattgatgccaaataaaatggataaaaagaaaagaaaaaagtatataaaataaaaaagaaatatcagtgatgaaaggttgtgaattatgtacagtaaaatctataaattaaactcggatcaaaattctcaaagccatatattgtatcctttttctctggtaaaggccatattcaatattattggttgataaagtccagcacgttgaagcacgttgtggggtcactacaaattaatggatttattgaattcagagtacaaaataagaaaaatgaaagccaactttatcactttttcctctttcacatataattggaaaactatttattatttacaatgagaaataaaaacagaaaaactgactcaataactctatctaactagtaatagtaattttttttttttttgatagttaagagattatgagtgacttttaatttatttagactaattttacttataatatgtgacagttatttgtctaagaaattttatacataatgaaaattaaatataaattattctgttgatgattttcactcatatatacataataaaacttatactattacatcaatcttttgaattaaccaatactaatgtattattcatcggcaagacgcttcattacccacactgttgcaaatggtccctaataaaaattcaaataattggtgatcataaagcgttagaaggttgttagccatcaaaatattcattctatttattatgttaggtcgaatataactgaatttgtcaccggttacttccatttcataaataga

SEQ ID NO: 4638 - DNA, 1427 bp, Glycine max
  Soy_ogl_1683 Gm05:35157601..35159027 Cluster 20
atttctcacatatttttcttaaaccagaccatcaaacatatctcttcatttctctttttttttttttaaattatctcttcaatttttatctattatagttttctcttctaaaccaaatacagcttaggagatgaaattgtcttgtaaaccattacagtactttttggcacatagataatcaacttgaaattatctaataacatttatgtctagcataaaaaacattcatatttgtttatatgaaacaaatatacattcttgaaaacaaggtttgatttattttagattttaacaacaaacgatgctgttgctcataaagaagaagaaaattgttaattttatgagattttttaaaatttttttgagaatttaaatatggataataattttcattctgcatacgcttatcaaggtatgttaaaatagaaaactaaaatttgagcatgcatataaaataaagtatgaaacaaaaaaaatgaaaatacatatttaaattttaattgaaataaattgaaactgtaatatctaatcacaacttatcctataattaagaattattaatttttataataaccactataaaagtcttacttaaaaataagttttaattagttaacggtgtattataattaaattatttaaaattttaaatatgtataataatttccgttgtgtaaaaacttgtcaaaaatatgtttactattttatacattaacaacaatatgaggattgaatcctcatctatttatcctaaccctggtcactaacccagtggattactttacttatgaaagtatgttaaagataaaaaaaaaaaaaaactaaaatttgattttacatagatcatgcaaataatatcagtataataaacaagggtgagctacattgcttgtcagcaaacaagaaacagcagaagaaggagttgaggagatgaattaaatcaggttgtcacattgacatggcagttgccttcaacttttgggtcaccgcatagaggtacaatgtgctgtcaatgacaatgacgacgaaagatgtcctacagtataactaatacaaattccaagattaaacatatatatttaaggagaggtttaatatggtagtcattgtaaatattagtagaaagatagaaccttcacaaaggactaaaaagaataaaaccgcgttgttcatgattgtcagtttgttagaaaagctaatacgatacttggaattaagaatgagaattgtttgaagcccttgtatgtagaatacccaaaatggaaaatttggaacatattgcattaaatatgtgtagaagttaaaggaaattatacttggaacaggaacacgcctattttcattttctatcttctttttccaatcgtatttgtaattaaaaaaaaaaaaaacaccttatttttcttttgttccctatttttaaaacc

SEQ ID NO: 4639 - DNA, 1700 bp, Glycine max
  Soy_ogl_5593 Gm17:8868201..8869900 Cluster 20
gagatgaagtcataatgagaaagaggacagcaatttccatcttcaagtgtgataactttgattgtaactacattgcaggaattatagtttggtctactgggatacttgggtatgattcaaggaatcaccaaagatttttatttttatttttgacaatggccatacaaaggttttaagatttcatatatagtacttcagatttccaccaaacgttctaatatcttctttttttaggatgaaatcttcaattttgaatgattttggtttaccaataaaatattattcatttttattttgttgttcttgtaaatttttatttaatttcttcttgatgatcttgatagtctttcctcatttttctagtgattgttggcctagaaaggatattattcattgacaaattttggttaagtgacattgcttgtacaagaaatgtcatttattttgatctaatgataatttctatttagcaacgtatcttatatttaagcaattaaaataagatatgatgttggcgatgccgttaggttcgaacatcattactattgtacaaagaaaaataaaaacataagaacgtgtacttgtgtagcagcaagaaagtctccttttttttaacgtgcaacaactaattttatttggagggggaaattttgcggcttatgtttttatgatgctcgtttgtgttttgtttttggtaaaaactcaagatttttttggtgggtcttctatatgagcagtctttttttttttttttcttcatcttctttggtgctactatgatacactttccactgttattgttgtcattggtgatttccattttttcttagtagtgagtaggccattttgtagtattattgttgattggagaatcttttttttttttttactcattgttaacacggtgcatcatatatatatatatatacttgtctaattactcttttatcattcaattatttttttgaattttattatttaagtttttattatatttgatcattatattttttttaaaattttggtgcattttattattatattggtaacaaaatgacttttttcacaaaaaattatgtcaaaacacgtcgttacaaatttaacatattggtaaaatgcgtaaaaaaaagttaaatgataatattcataaaataataatagttaagtagtaaaatttgtaattaatttttttaaaaaaattaggtcatgtggtttttacctcatatattaagaattttttttacaaaatttttaacaattacttatcggttgaattatttgaatatttttatctattgtaaaagaaagcaataatatattttttttgaatgcgaaagcaataatatatcattatatgatatttcaagtttttctttatacaaatttatgattattttcttaaaaaaatattttagttatatcgaaaaggcatatttcattttttttaaagaaacttctaaacatacttagagaaagaatctgctaacctaacatacaaaaaagaaagaatatttgctaatatacaatcaaatatcagatgttaaagcatgttggttagataagttggtcaattaggattgtttaacaaagttgtattctaataattgagatcctatattctaaaactcgttaagtgtacgtccaacaacgatttagccgttcaatgcaggggtatttaagtattttcagaaccgccggca

SEQ ID NO: 4640 - DNA, 1600 bp, Glycine max
  Soy_ogl_5181 Gm15:49787501..49789100 Cluster 20
gtatcttgatttcctctaacaatttttaattgggggattatttgtgtaaagaacatgtcttctattggatattcctttcatgttcacagaattgtccttcttgttttgaactttgaatttctattgacttagataatataacttgtctgttgctatgtgacttctcagttcttgccagtgccaactacttgtttgataaaagacctaggctaattgacttggcttaactttgactcttcactattatcccttgatttttgtcaaataaaaactctcaatattcagggttcaataatgtcatgatgggtgttgttagtgtgtgtttaagttaaaaaaaaatattgtcgtgatgacgagtggctcattgtccttttgttttgcactttattcgttgattctagctaatggtgagaatttagctcctagtttcgacatccagtaacaagaataattattttatgatgtggtagatcaaactatatatatatatcatagccacaaagcatactaagaacattcttcggcaccataccaatgtactagcatgtatcacaatggaacaatatcattaggtggaagaaattacaacacctttctctctcttttgtagaatactctctctcttctacaaaatactactaccactccatctagatctctttatcaaaggagaatactactactaacactcttctatagaaggagaatactattactcagcgaatctttgagaagaaactaattattctctcttagtgtcctttggttgttttattgtagagtggaattatgtaaaaaaatttaaaattttgtatgggtcccttattttcatatgctactttaatttaaatatttcttctcaattccatttcttctactcaaccaaaccactccttagtttatctcttagtgtacaagagtatacaagagaaacactttaatttgggatgatgataaatgttcaccaaggcttccttatataacctaagcttggaagccaaagggaagaacccactgattttgggacttccacatccaacaaattataccctatttgagtaagattgtcctccacctccataaatatataagtggttaatttcaacctaaaaaaattaatccattgaaaaagaataagttgtaatcattcaccaaaaacaatagtttttatcttcattgaaggcacatttcctcacattaaatgcttttactttattgtacaccaaatgtacaatacaaaatattgataaaaccgatagaaaaaacaatacatgaaaataggggttctaaaatagtttcacttgattttgttacgctagattaattaaagcgggtttgtactatttcttctccaacttctcattattaacacagctatctttgggtggggtatcgatacatcatgttatgatcatgattcatgatcactgaactacttattatcttccacaaatgtctttttggtcaatattgattgaagacatgagcatgatatgtgtcggaggaaccaaatgttgtataaataattcaatatgatgaacttgtttctgcaaagaattgaaatgtggggcacttgacattgaagcttaagagtatattc

SEQ ID NO: 4641 - DNA, 1264 bp, Glycine max
  Soy_ogl_3774 Gm11:6623330..6624593 Cluster 20
taacactctttgagcattttaacataaagaaatatagaagaaatgaaaacatacatacatattggatgtcaaataattaacaaagtgacatataagtatataactgatataaggttcaagacaaattaaacaaggatagaaaggaaaacaggcaggcacagggccaaaaagagtggctgtctactgtacaatttcagcaaaacaaaaatttaattgctgagaaggaaagaagaacatgaatgaagaacgagctgctgaaaaggatagaaattaggttatgggtcattgagggttcaatcccatttaagtagtctctgaaatcgaatcgtcagatactaaccacccattgtacgtagtaaaaacaaggaaaagtaatcacctctactaggaccactaatgccccaaaggaattctctgatccttcaaaagtaacattaatttttcatcatccaacgataattaaatgcagtcaacatgcattgtaggtacttcttttcatttattaaattaacgaacgattttctttttgttcacatataagtcagcccgatggaatatttttatgagtttaaaaaagtgatttgttaaaaaatattattattttccaactcacttccgctaaaaaaagtcaactaggcttgttgcgcttaaaacaggttaaaaatgaaacaagttggtcgatccttacatttgatagaagaaatttatggaattgaacaagtacaaaataattaataggaaaaatatttttcaataaaccgataagtaataaaaattaatacatttatttgttttatttttctcatttattatttttttgtgttttaaactatactaacaaaacatacacttattggaataatataaatatttaacatttaaatgtttaaaagatgaggttcaacttcaagtagtaaaaaatttggacaagttaataataagtacgttttaatatctctctatatattttaataaaatatgaaacttctatcaaatgaacactttcaaaattataaaagaaaaatgagaagcaagaaaacaacatgcatgaatgcacgccacttaccctcttccaaatccttcgtctgcaaatcatcattgattcccatagctgccggaatgagtgaattgctgcccttggcggttgaagtgaacggcggaggaacctcatcactcggctgtctcatgttaccattcattctttctctatgaaacctgaatctatactttcactgcctgtgagtttatgagaaggactctacgg

SEQ ID NO: 4642 - DNA, 1700 bp, Glycine max
  Soy_ogl_4371 Gm13:30802101..30803800 Cluster 20
gccctagaaagtgggctatttttcactcgaactctaaatctaaaactttatgtgggctacgggcttatggccattggacatttatatctgcacctatcatttcacatcctttaccgttccagaaggacttttccaaaatagttattctagaatattatttttcatatttttgaatacctattctagagtaggtttttgaagtgctcatcctattattcggggatataatttagagtatgttattctaaaaacctactttgaaataggtatttttgaataaaaaaattatattgcaaaatagttattccaaaaaaatatcctatttggttccagaatagctaagaggacccggcaacctcaacatacaaagtcttgagtccggtcacagaatatcctatttgtgtgtgacagggaacggtcgaagcaaagttgttttttgcagaaaacaaatatttgtaatctactactcctatgttacaaatggtagggtttaaattctatagaaaatatttttttaaataaccttaattttgaatagattatttgtagttttataacaaattttacaaagaaaacaatattgaaataattataaagaagtatcattttctcgattcgcaacattatactcaagatttcatgacgaccatcactgtgacgtgaatagattctgtttgtcatacaaaccaagccgtattttaaaaggcaaaacaaaaacaagtttgagtttgactgtcataatttcaatttgagagatcaaattatatctccaactcaatactttgactaccgtccatttaatttgtctaaacgacggaaaaacacgttatcgggtaatattacaattctactactgagagttgttattttgtaaataaactcgggttctaaagtatacaaatatatataattaaattaaaagtaagttcacgttatacaccttttttttatataaaaaaaaaaactagatgatcaaatttattattatgaaaacaatctcgtgtgaactgatgtatctgcactgtgtggtggaagatggccaaatccgcatgtgtttcttattgtgatgatagtagcgtagcatcaaggcgtatcataaaactcatttacagagtagtagctgtcccatgacacctaactaaaggttataattcattacaaaaacacaaaaggactgttgtcactttcaatcaatacgtttaacaactggcaatggcaaagaagacgcatatatattttgggccacgataataatgaagataaactgtttttttttttataaaaaaaaaaacttcgatgcaataataatactcaaggagtaatgaaacaaaacattgtacattttcatttttcatattttcccttcaaaattacccaccctttcaaagatatcgttgaccaatcccgtattttctcccaatctcccaaaaaaccctaattttttttcaagttgttttttggtaatttgacttcaagaattttacttttatatatataaatgagagtaactgggtaaattatagtatagctcaacactttcctagcttacttctcttaacctttttgtgtcattcaacttttttcttttcttttttttgcacagcatttattctagagtagactaatatgaaactgtttacatttttttatttatcaaaactaatttcaattatatttttatgttactgaacctcctctag

SEQ ID NO: 4643 - DNA, 1100 bp, Glycine max
  Soy_ogl_245 Gm01:50323701..50324800 Cluster 20
agcttgatcctctgattttctaggatcgtaagtcgttatgtgtatccggtcgtggtcgatcataatcgtctatttaaggatatcaaatatagccatgatcgggagtttggcacacgtgtcaggataaatcggattctcaaagctaaccatgattggtattttgaaatacagaccaagatagatcagattctcaaagctaacttgctagggcccgactcaaagggtacacttataaatttaaaaatataaagaaataaataattaatatttaaactcaaaatgaacatctatccaccaattatttgttggtttttcttatcatccgttttcgcaatttgctcgtacttcatgtcgtgtttcctgtacataaaaccatataaaacatttttgtctcgaatctacgacaagaaatcttgtctacttttattcaactaactcttctggaattagatgggttacgtctctgaatttgaacgcactcctgtattaaaattttcaatactcgtttgaaaatttatgagttgttggcgtttttattttgtttttagttctaaaaatctgaacaaaatgtccaagagtggttgcatgcgcgcggtgatttgggatttgcgtattgatatttttttttagataaaggatttgtgtattgataaagaccaaggtaatggagaggatccatttccaggtcatggaggttctcgattattggatggatttgctggttgttgagagtgaaggttgcttgtggattatagtcatggtggtcggtggagtagcgttacataactaaactattctctactataaatacctccatcaacactcatgttattgcatgaaaaatggttaatggatactcatatattatttaacacttaaagagttaaagagagaaaacaaaaagaaatgtaggtattatagttattataatataatggaaagagacatatagaaggaaaaaaagatgattgttgaaggagttgtttataatagagaatgatttgtgtattattactcattataatacaatagtaatagttaaaaataaaataaaaagttaatatgtctttacatgatactacaaattgtatcaagatatt

SEQ ID NO: 4644 - DNA, 1451 bp, Glycine max
  Soy_ogl_3819 Gm11:10185550..10187000 Cluster 20
aaaaaaacaaattaatactttaattttattatcataatttcattacatgttgatacatctcattaaagtgaaaaatcgtttaatatgaatttttgaattaatgaagaaaaagttaacaaccgagagagtatagtgctttctaatcgcatgacattttaatttggatgaaaaaatataaaattttacaacaaaaaatcgatttatgaaaataccataaaataatataaaaaaacattgttgcatcgctatatagacttttttttaccctttcccagagtcatcaccccctccagattaagctcaatatcggcctgtaaataattaaaaatgaaagattaattttatatatatgatataaaaaatcattaaaaaaaacatataatatttaatcaatacacacactcctcattttgtttaatatgacacaaccccttacaaagtaatagacattatactgttaataggatgcacccacaaacattctttcacacctcgatctacgtacacccatatcccatgatttgtatgaaaggcaaaagcagttataagttacgtagacaagactatactgtgcagccttagattttcaacaattctattatgtattgttaattagtaattaattaaagtgtttgatttttatgtttctatcattttttttcactttcactgtgtgtttagttacttttggaagaacgattggtataattgaattgaatcataaatagatgaagaaaaatactagaattttaaatagttaatgtcgtaagtgctttatacaaattaaagaagatgtgagatcgagagagagagtcatacctcagtgtattctttcctaattaaaatttgtttaactacgtaccactcaattatatataactaaattattaaaaaacatgtatatatttttttatccataaaaattaaagataaatatcaaaagatatgttcaaccaattatatctcccttaattgaatcaaaatcatatgtacatactactacgtactatgtaattgcttatccaagtcgatgaattagaaattagttttactccgtccagggccatctaagaccaatactgattttcatattcattcataattgatacctaccatcatctttatttcccacgtcttgtttctagctgttttatgatcagaatcatatatcctaagaaaacgttccccgtatcataatcccactgccttaggagatatagctagtccgttactctggtggttgcactttcttaatttattgctaggtttttaatggcaagtttgttgttggtaggaccccctctctcatctaactaaagtcatgcttgcttatttatgaggtaatcaacatgaacagtataaaactttggcttaaacatgcagtacacagaaagcatggaaaagctgaagccttcggattttggaagtttcatcactaattttagctagct

SEQ ID NO: 4645 - DNA, 1000 bp, Glycine max
  Soy_ogl_5312 Gm16:5221401..5222400 Cluster 20
ggaagataaaatttgtaaattttttaaaagttggagataaaatgaaatccttaaaaaaaagataaaatggactaaaatattttttaaagtaaaatttgtgaaaaataaaaaaaagataaaaagtgtcattaaactttatttctatttgattttctaataaataccttgagtgttgagaacatccattagcaagattcttacgaaaattgcagagaacggtgagaaaatgtggttaatgcaaactacaatttagaatcatgattgagattttaaacatttcattcatataccaattaacgatgatttaattattggttaacaaggtgcctcgttggttatcaaactaacacttctaggcaattgattcttaattcgataaccaacacgtattcacacggatgactattaattttctcgttgttaattgatgtatggcaggtgtcaatctcatgtgtaacaaaaccaataatagaatcccttagcgagcaaccgtcacgaaaattctctaacatttaacgactagttaaatagctgtaaattgggtgaaattgtttgcggttggaacctcttcaataatctctttgaggcgtatctcctcgcagtcctaacatatcattggtgtcttgtcctatagtattgaaaatgtctttccgttttaccacatttcgttcagaaaaaagaaaacctaaaccaataatctagtttcaagtatcttttttttttgtgcctggtcctgttcatgttagtgcttctgattgacacatggaatgagagagagataaaaattaaaaaacatcatcggtttcattccaagcagcatgcttgtgtttgtagtccagcagcaaaaacagtggtgagcactactactactttttaacttaatgctgtaacttcttgttcgctttttgagcgtgtggaaattaaatgatcttcattttcaccataataataatatagcagtttccttttagatcagtgggtttcacatgctctcaaagtc

SEQ ID NO: 4646 - DNA, 1400 bp, Glycine max
  Soy_ogl_4669 Gm14:5120701..24100 Cluster 20
ctctataagtaatgattctcaatttcagcaaaggaaaacccttctcttgatttctagtttctagttaaaactgaggcttttccttcctcttatcaaactggcctctcacttttcctttatccatgtgagcttcaacacttcccctagctcacatgcaactcatagctcttaattaaggattgtggtttcctctcccttacctcggttgaggtgacctttgaggtcttaaagctcatttctaattattcatcgtcaagcttggtttgggcatgcatatcctcttcttctttttttttttttttcaatcttagtggctatgcatgcgggtttcacaaggtttggaaatggaggcagttgaagcaagctcaaagaaaatgacgcatttttctgttctaatatggattttaatgacaaaatgatgcataatgacgacatatcacaatttacaatggcaattacaaaatgtgaagacatatacctaaagaggagatgaaatcaatatttgtcactttagatagaatcactaaccgtggaatacgaaaaaacccgtctttgtgtatgacgggctagaattttttatacaatattatatcatactatttttttttagtggaagataattttataatatcaagataaagacatgagattcctcatttgagcaccaagtgaggatctaaatatttattttttaaatagaatgtgtgctagggttcccatacaataattgctgataacattttggaaatagaatagaggtaattaaagtttttttttttacaattggaaaagttgttttgtgaaagacagaattttagattttgaaggctttctcattcacagtttattatcgtaaggctcctaagattcttcaagttgtttggaaacctccgtcttgtcactgggttaaatgcaacatggatggggttgctaagtgtgctcttggacctgtgggttgcggggtattttcagaaattatatatagagctgctttttgggtgatttctctttcaatttgggattttttttttgctgttcatgttgaattaacgggagttatgttagctattgaaaccgctcttgggagaggttggtttaagttttggattgaatgtgatttcatatttgttcttaaaactttcaagtctttcaatgttgttcattattgacttagaaatagatcgctaaattgtataaatatcacttgtaatatgtcattttctctttctcacatttaccgtagggataattgttgtctagatagacttgcctctcatgatatctttgctattggttgggtgtggtgggatttcaattcctttcctcttttattagggaagagttttatagacataaatatgacattccttgttatagattcaaatgaatgtgcataaatt

SEQ ID NO: 4647 - DNA, 1007 bp, Glycine max
  Soy_ogl_1573 Gm05:3415301..3416307 Cluster 20
attttgaattattcataaataaatggcagttgctgttgttggagcctgagttagtaattaacgctgcagtggtagatagcatgtggacataattatgttgatgctttttctaaccaagtaagtaatgtgtctaaactctaaacataaaaacacagtccttaattaataacatgggttatataatgaaataatttcccttcattgtgtcgagagccaaggatattaaaaattattcaatggatttgaataagtccatgttctctatccaattccaatccatgttccaccttttaatgaattaataatcgggccaaaaagtagttcctatacctccaccgagtaaaaataaaatgaaatgaacttgtaaaagttttgattcaaacataaattaagattgccattgcgtacaagttttcaatagtactatatatttcggtcttgcgaggaacactagtagcaattgaagccacctcccacgctcatgtgattgtgatgctattgaaagcgtattgacatgggacaccagactggaaagtgggtgggtgggtgggaattataaaaactattctagtcgcgcaattggcaacattcaaggacaacgtaccaatcttcaaagattgataattgaatactaaaaataggtgttatattaataagggtgtattcgatttctgcggtcaaaaacataaaaaaaaaatagaaaaacttgtttgatggatgaaatcagatttgtcttgcgtgtttatcatgttctttcttcatctactttgtaacaaaccatattttctattgataaatatcttggttataacgtagagtacagacttgaggtaatattttacatcagataagaatgaaattaaagattgaatatcatataagtgagaataatactcataaatctaagttttaagattttggattaaggtataggttatgttcacttatatggtttgttaatgaccaattggttaaatctcactagtatttactctcctcagttatgt

SEQ ID NO: 4648 - DNA, 2800 bp, Glycine max
  Soy_ogl_1274 Gm04:7141801..7144600 Cluster 20
tttaatgcaaatctctatagatgagcttaaaagattggtaggcccattgaatccacttgtctttgagatgaagagtttattaatctaatcacttatgtgaatgtgaaaggtacttggaaacacatcaaacgcttaagtcaatgtttaaattagtatagtaacagtatgtgaaaaaaaaagtgtatttactcaatgtctttgcatgtaatatatttatagaattcatatgtggatgagtcacagctttgaatgtgggtgagttaatactagaccatttggtcatggcaatgacgtattcctaattctaaaatgttttagagttcttaatgcatgatgtgagtggacaacaaacattttatgcaccaagcatatgaattttttgtgagcttcaaatagctcatctaccaataagagtttgtacccaatctcttattctctgcaataacatatattgttgcattcattgtccttgtctattcagtttctacgtatggagtgaagaaaataaaccaaatggttagggaggtagggggaatatataaacacaaaactatatcatagaacacccaaatatttgagactagaaaataatttttgatgagttgaacggtcaattgggtgatattcccttcgatcaacaaccttacaaacaatttccttaaccacatgagcaacataaatggttccacttttggacttgatctcttattctttgtaataacatcacattcattgtccaagattttttttatcagcattcatcgtccaaatttattcactttctagattatcttcatgtgcatcgacattttcaaaagacagggcaatgccctcttgattatcctattattgtccctttcatttcttcgtcaagatactactctagcctttcgttatcagtcatattagctaggatccatctcaacaaaattgtattgttgattaccaactattttcaatgaacgaaatcatagtcccaaatatttcattgttatggaaccttctcaaacatccccgaagtagctataatttatagctactttcgaagctaggttttgatctacagactacaatctatacaccatcaagtcgtagagaaaccatattatagaaaagaatattctgcacacatgtttttattggaaatttgtgggtttatttttgcaattaatttatagggttataaatgtttattatgtgtaacatagcagtagctaatttatataagcattttcttgctcaaatatttgggtattccgtgattatgtttaaactttttttcctctctaaatttgttcataggttcatgttacccagttaatggatatttgtaccatattaataattacgtgatttgttataactcctatattgattgtagagattttttttaaaaaaaaaaagaaaaaagaaaatagggacttatttaatttttttatataagaactaattaatataaataacgtacttattataggaccaaaaggttaattattatcacttactatccttattgtaagcttaaaccccttaaataagtctctctattttaaagaattaggactggactcattatcgaggaatattctgagttcatccaaaaaaaaaacttccctaacaaaagattttttttaacatattgttaaatagataaaaaagagagactaaaaaaaactatataaactttaacttatttaattttggggagtgttgacccaaatggaggtttggaagtacgttagctatcctcgtggccaaacaagaggtaggaatagaagaataggaggacgtgggtgagactgtgggatgagaggttgtggttatgggaatgaggaggatgagtattttgcacgcagtgccgatgaaagcaacaatggccttcacgcctgggtccacattcatccctttctctttgtgcttggggcttgtcgtcaatcacacgccacacacctctctctcctcctccattccctaatctaatcaaatttcttaatattataaccacatatcatcaaattctcattcttattatataatactacatcacatgaaaaagctacaagacatatataatgtaacatgaatacgatgtatctgaaatataatagctaatctatatacttatcctcctctttccgtcttaccccacactctcagctttattgccatatgcattggtatacactacatactttgctctagctcttatcactactaatattttttttaggttgttcctactaatattattaataaaaacacttgtaaacgagaaaaatagggtttggatactagtgatgaggttggcgtacccctttgccttaatttggtgggacatgctcgtactgtgtgcttctcttttaagctatgctgattaagactttattactttgattgattccattacccaaattaaagcgatattactctctctctcaaaaaaaaaaaaaaaaaaactctaaggataaataacttttcattggtgctctataaactaatccattgctactattggagcagaatgtggaagatcgattgaggataagcttaattttagtttgtcttagaatgcggaatgttcaagaatcaaactccactttcactgatctgccattataccttcttctttacccaattattttatgagaactagtaatttaatttacccatatggttgagaagtttggaaaagaaggaaggtgatatctatacacatatatgggccattgccttttttattgactttacagattcattttcggcgaataaaattgacttggcgatcttcttttgtgctaag

SEQ ID NO: 4649 - DNA, 1624 bp, Glycine max
  Soy_ogl_2531 Gm08:6906701..6908324 Cluster 20
ctaattgatactttcacaatatttatttttgtggataatatacttataagatagattaagtttcgttctaaatatttgattaaattaaaataccttagttaaagttttaaatttgttatcttcaattattattattattaatctggaattttaaattttatatcattgtaagataacgtagtaattcgttaattaatcatgattcaagatatataatcgaatcaatttcaaatagagattatattttcctatagctctttttatagttttgtgctcacaagtaattgtatttgtaaggtgtaactgttggatgaagattgaacggattaaaatttaaatgtgtgttagagtatctataatatgcataattacttatatgagttatttatcataattttatgggtcttacaattttataaaaatttaaatattttaaacaaaaattcattttaatattaaaattgctaaagtgaatgctttagcttgcttataattaaacaattcatataagtacctcaatagagattctcttaactctaattactgagataaagtgcgtgtttgaattaatattcataatttaaacttgatcagatttttacttcaagatgcatcaacaagtgagttgcttttgtgatcaaccaatgagttatgtaaagatgtgaattcaaaaacgttaaaattatgaataatttgatcttcgtcaaatgattatgaattgttgaattaatgcctgcaaaattgaatgcaagaatctggatcccaaaagctaataggcaaatctaagtttgaaaacttaacattagcactagctagctaatagtaggacaataagagatacacgcgtgatatataaaagctggatatagagaaatatatgttgctaaatgatagatgctaagcaacaaagagtgtaggaggaccaatctcagttccggacaaaattggaaactgaaaatgactgagattacattgtgaaaaaaaaaaaggtttacctcattaacattaacagactacgagacagcaccactttattgcattgtttttgtcaaatgccaaccaaaaagaggacgtggatcacctttccctttgatgtttctttgcttgggcgaaatagttgaaacaatataaaaagaaaaaaaaagaaaaattacacatccaaagtaatcatcatttaaatgttttggacaataatttagaaagttattaaataattctatttgagaaagttgttaattattaattttttttaatggaaggaatcaaacacacaatctttttctcattcctttctctcttttttgctaaatcttttttcttttaccattaaattaaccttataactccttaatgtgttatcttattaatttgaagtgaaactaataaataaaaatgaaatttgaatatcattgagctggtaaattaacttacaaatttaatcggtagctttgagttccggtctagtgtatataattacattaaatataattatctctagaaaggaatatttgtggtcatataaaaaaaaatatttttagaaaaggaaagagtaaaaaatagtttagttaaatatataattaaatcactttgatgactctccccattgaagccttatatcatatgg

SEQ ID NO: 4650 - DNA, 2095 bp, Glycine max
  Soy_ogl_6241 Gm18:58120501..58122595 Cluster 20
ataaaagtgaattaattggaaacctaactacaagatatcggaggaggatttactacatagcaaccatgtaatagctaagtacgtaaaaacttaacacctacaagtttaaaacgtaaggttggtgttgtcatgcctcgggtgcaaaaaataacctgttgcttgatttaattaccgacagaaaagccaactagttcatattgttgatactaacttctctatcaatatagtaacgattgtttgaccatttttgtccttcctcaaaattcacaagttcatgaactttatattccgaacttgtcgcccattgcatatcccatagtatatatcatgatttcctcttagaaccaaataatcataaggaatgcgcatgtccattactcaccacgtggaatcccttccaatgaagggatcacacaagaaatcgatcctttattgagtgattattttttttacagtaaaaaatttcaaacacctaatttacaattttttttatcatactatatcatcaatcaaatcaatcatttttttctctctctcaaagttataaacaattcatggttgtccaacaaatatttttcatcttttatccactcacaaacttttcatcgtagataagaatgttcctaaatgcaccaagttgacattacagttccacgtgggacggtaacgttagaagcaccccatttacctgtctcggaggaaaacatgttcacttgaaagctttcagccatagccatggagatgtgtgcacgacccaaaaccttgaacgagagtggtcacacatgaaatctacacgtgccgattctagttcatgacgcttacgtaatggtggcaaaacaacgaattgttttgtaaaagggttgcacacgaaatagtgaatgtaacaatggctgagtgctgcataggataagatcgtggtgcgtggctttcactctaactcgatcacgatcttgaggctaaaaaaaagggagaaaattcaacccttttagtatattagtttctttttattggaatccatggagaaaagcatcttcttatatatcgtaattagaacccgaacgaaagtgaaagaggaggaattgaacaatgtgtgcgtttcaaacacacgaggggataattggtgatgagttagacgtgagtgaaggtagcgtagatcagaaatcgcactttggaaatttgttaagggatttgcattgaagaagaagtgaaggttaatcggtgaagaatttcaaaaagtaggtcttcgctcagttccttctatggttgtgggttttgaataaatggtaaattatgctgacgttgaagcctaatccgtgcttcgtgcttctatatataatagggttattagctagtgattgaatttgtttaagttaccaaatttctgagttttgattgatatattagctacttaagtgattaaatttgtttcaatttctgatttctaaaaagaatgctagctatatacatacgaaaatgttataagcaataaattgatttaaaattaaaaaaataataattacacatgacattcttaacagcaaaaatagaaacaatttgattgaaatattcacttaataaaagatatgaataaattgatttgaaaattaaaaaaaagttacacataacattcttaacagcaaaaatggaaacaatttgattgaattttttacttaataaaagatataaatctaaacattataatatgctttaaaatacaattaatatgtggatttcaatatccaattataatcttggatttcatagaatttgttcaatttctcaatctatacttatattaatttatttctctatactctatattacatacacaagaaaatatttatctttatctttttatatatataaataaaaataagagtatatatgtaatttaaattttccgctcataacattatggtaaatatataattttcattttctcgctcattttaaagctaagaaagtatactaacaatgtctaattgagacagtggatcggagattttctttctcgaagttgtgtatcctagatatttaatctaattttactttatatttgatatgaccttatatatgatctaaaaaaaatagatgc

SEQ ID NO: 4651 - DNA, 1500 bp, Glycine max
  Soy_ogl_281 Gm01:52125301..52126800 Cluster 20
agtaatttatattttaatattttattgtaaaaaatttaagaataaaacttatcataaaattttggatcaacacaaaaattattaaaagttatttcaactttgaatcaaacctcaaaaacatgaaactaaacacgcaccaaatatagtttaattttctattcggtttatattgtgcgtgaggaaaatttatccagcactaaatgttctaggattttggtttgcatttttcacccagtctggtacgatgtttgtgactttcacatgcaagttattgagttattcatacttcagtgaatttttttttttcgcaataagagtaagaccaactgtagcctcctttgggtcgcttcttcacgttatgaaggcccgtcctagctgcagctttgtaaaaatgtttatggctattgagcatgattcttgaattgcctttttaccaagaaactgcatcatcatcattcttgaatttccaagttttctctgatcacttcacaagagccctttaaagaagatttatatggcccaagaattttggaaatgcgcaagtacataaagaccatgactgaatgaaaagaaattgactagtttaatttgtggtgtatcaaagcaaataatgaaatgcgttaaataattaccacctttgttttgttttaggccgttttgttcactcaaatgttcaccatccggaatgcatttgaggtgtatcaaagcaaataaaggttgtgcttctggatggagcatagtctgatctatttgttgtttgatcaatataggacacgtttgaatcactggcatttatcgggaagataatagacgtgttgatgtcctagccaatcatgcacattagatggacatagactttgtgatgtttgaacaacctcctactatgttgagccatttgatttaacaaattctttaagagtcactttttctcgcattacttcagtgtaatttttattttgggctttctgcctctcccattgccgaaaaaaataaactgaatattgggggctggtttaataaatttggacttgtcatttcttttcaaccaaaaaggattgtgcatgtaaagccatttaagactgaactcaattcttttttatccccttgggttgtttcagagttctgaagtccatcctggaaacaaacactccaaaactacttggagttgctattgacccctactaaggggttaacattttttttattccaaaaatgttcatcccacaaaattgtggttttgttgtataatcgcctacaaaatttaaaatgaaaacatgttttcattgaatatttgggtcttactaaccaaataatcttataatacttgttataatattattaagtaatttttattaaaaattataccataaacacattaaaaataataatgaaagtgcattaatggttttttgtaaagaaatgtttttaatttttgaattaatactttagtgttttttctcattactttttattttattttataattataaaccaaaagta

SEQ ID NO: 4652 - DNA, 1800 bp, Glycine max
  Soy_ogl_402 Gm02:5465501..5467300 Cluster 20
cagttcaccttccagggcattcattacccatgcaacaaataaacgcgttatactaaatagaaagctaacgtagttttttttttaaaaaaaactttagtttttattttcttcatttaataaaaattaataaacctaaagactaccaactggcatgaagctattctaagttagctcatgaacttgagtttgagccttagatatataataaaaaaaattaaatattcaaagaattttttgttatcatagataatatttttattcatctagagtagattgtttctattagatgatacatgtagtctaaattttttaagaaacctaagaaaaacataagcattcaaagagagagttttgttgtacataagccatttaaaaaaaaaaattgaccttatttgattttcactactctaccatgcgcggcacgctaacaactacttccaaaaactaaatggccgaaagcaaaacggcaggcaacagcttctaattaaacaggtcaaaaagtatagtacgtactgagtcgtcacgtatgttaatgtcattgtcatgtcctcaacacgctaaaacaagtacctacaaactcgtgctgtgcaacaccttcaaggattcatggacatcatttccattgtttgtgaaattccttgtcttaattagcagtgccattacatatataacatggcaaaaatgaaaaatgaatacgtgaattctaccttgtaattacttataacctaaccaaattacggtttcatagtattgacacttcagtaaccatgcatattcttaaacgcaacattaattattcattaacttcatattcatatttttattatattattattattgttacgtaccccgatactgcatatataggcttgttacagctgtacttaagatatttttcgataaaaattaaagattaatctattgaaatacttaaatatatttaaggaattatcctttctcaacaaaagttttttcacatatgaatttaaaaatataatattataatcatatatttaaagaacaaaattatttgttagtaatgtcagactactgaatagggttcttgatgaactgatccttaatcttttggtctgaatatcccgtccatgtcacattctcatctagattattatttgaggctacttttgtcaccgattacagtactcactatagtagtgtcactcaactcgctcatgcatgttgaaagaaacgtcgaaaacaaggaaagagcgtcttctatgcagatttccttgtcaccggcatttgtacccttgacaaatgtgcaaggataagttcttgttcatcaacctagctattctatgtagatgaataggtttctgtttgtgcgattatctcttaggcctaaccgactcaaatataacccctttccttccgtcttcatcatttttaaaaaaaaatataaatttggtctcattcttggtttctgttgttgatgttgtttcctgctacatttgacgtgtgaggtttatcttatttttacattgtaccgagccaggtgggggccacttaactaagcagcttctcgataaacattgagatcccattcttaattcggaaaaattttagtgtccgccccaaaatgggatgaatatgagtggtagaggtaaaaagaaaaaagacaaagattaagagaaagtgtaaacgtgacaattataatatgataaaaaaagaaaataaagtaaaaaatgaaatagatatgaaagtgggtaaatatttatagggtctcgtaaactgtagtgttattaaaaaaattattataaaaatcatgaaaaaacaata

SEQ ID NO: 4653 - DNA, 1622 bp, Glycine max
  Soy_ogl_407 Gm02:5800201..5801822 Cluster 20
atgggattcggcgcaccgtccgaacagaaaaagcagtggtccccgcctttgttggaatgaaccccactaataataatgagtccaaattcttcatctttcaaactttatatcccatgttgtagcccacttcaccacgcatctaaagtacataatgtagccaaaagagtatatattatgttttatgatatatacaatagctcatgaataatttaaggcaactcttttattatggacgtaaatgtagctcgagtctcacgtgaatggagctggggcaaatattttaagtggacattataaatttaaagcttgattaagattctttactaaattaaatacattttcagcaaaagtaactttacaattgtttttgctgaatttagtaaatttaaataattttacaaaaaaaatcattatttctgtatatctctttgattagttgaaattagggacggtaacgagacagagaaggagtaagtatttcttaagtgaatatctatgattttctaaaatatttgtggatatctactacttcgtaaatattttttaaaatataaaactaaaaaaaagtataaaatacaaaagcttcacaccgtgttcaagataatgaacccaacgaagcacgttgattgtaaattggcatttatgttggtaactgaatagtgtatatgcagatgtagtggaaatgtctctggtgtagtatttcatgattttggtttcaacagtcagcactatcttgtgcatgaacttacctgcggcacactgagagtgaaagagtgagaattgtgaatcgaagctattcattgctttgtaagcagaaatttgaaaaccttatttgattttatgagagttctcgtatttcaaatcgtgtttgtgttgttgctggaaaaaattgtctagtgcttgaaaatgaaaagtattttagcctaagcttgaggctcatgctgtcctatggtcaacctcagttcaaacttcaaagtgccggattagtctaaagaggtgttagcaccttagtctttcgtatttattttaacacactttataatgttagttaaatttattaaaaattacaaaattataagtaaattttaagcaataatagaaagatatattaaaaaatgtgtttaaaaaatgcattgatggcatttatcttaatccaaattataaaagcttgattgaggtcaacacctctttcaagtacaagatttctaaaatacaacggcaaataataaatcataccttggcttggaataaaattattatgtcaatgcaaataatacacttgcattaagatatgggtgagaatatacactaaatgcgtgtgtggtgtttactggagttgtgtgaatgtttcgaccaaagaaaaatggttgtccgatattttgtttataaagtttttggtcaaacagttgaattacaaaatgttcacacacatagatactagcctaagattgactactttagattaatacacctgcctcgatttatgtatcttcaaacaattgccttaaaacccttttgcaaagaaagcatagcctttcacgtgatcttcatctatctttatagccttcgagcatgttttacttcaaacttctctaaggttgtgtttgttaaaagatgatagg

SEQ ID NO: 4654 - DNA, 1385 bp, Glycine max
  Soy_ogl_1265 Gm04:6884316..6885700 Cluster 20
caataagaggattactttttttatgtgcaataaaatttttttatcactcataacaattttatataacaattttatttaacttgaatatgattactttatgtaaaagattcatgttacctatactagtaaataacgaaaataactgaattgtgatttttttttctttttaacatgggttaccaattttcttgctttatttgttgaaaaatattctctatttcttgatgtttaattttctcgatctgtgtttatttttgttcttcctttctgcatgaagtaaatatttttctgctaactaccaaacaacagtgtcatctttatgcgatgagaaacccaacaaggatattatcacacccaccgatcaaagagttccaattggcaataattatttgtaattttcaaaaccgtttacaactatgaagacgcctaacgataaactcagcatcccaacgattgtgtggtagcgttggatggtggtttgtcttctgattaatagacgcgttgtaccatttttatgaattttgttcacgaattttcgaataatctagtgaattttctcaactcctcgtagcttttccatcttgtgcaaaatttttgctaaatcatttgagagtctcatgtaagtttagtgaaagagagttaaagttaggggattttcctaatggagattttttttttctttttctgagaagcaaaagaaaatttcattaaacataaaccacaaaataaccatcttcctatggttcttttatcattttgagttgtaatttttttttagaattactaaatagagacattttttaaattaattctcagttaaaaataaatcgtaaaagtagttttgattttattaaaaaaatcataaatctttatatgaattcatatagatttaagatttttgtttgcagtatgataattacttttactacttagaattaattgaaaaaatgtctcatttggtaatttcaaaaaaataattaattccaattggtaaaatatcctcttcctatgctaccctttaccatgaacacttccataataccaatacaaacctcagaaccacaaacactatgcaaataaaacacccacgaaaaaatcataactaccaaataacactatcattccagagtatacattatattatcagtccatattaacaataaccatcacgagtctgatcaatcatctcagaaaaaagaagcagctacactgaataaggcaagagctacactattcatataccaaaactgaataaacaattactgtatccattctgcagtctgcactatcaaccacaatactcccatcaaacaaacctttgactgcaaccaattcaaaaaccgtcatagctagtatcataccgtaccatcaataatcaaatgacc

SEQ ID NO: 4655 - DNA, 1475 bp, Glycine max
  Soy_ogl_1781 Gm06:3229654..3231128 Cluster 20
tcatcttcaaaacctaaattttaaaataattaaaattatttcacgatttcttttacaaatatttataaaaaaagaaaataaaaataaaatacatttttataattggaagaataatttttttttaatcaaacactccttattgtctcagtttagaaaccacgtggttcagcacttcagcatctatgatcgtattttcttttctcccttaagtaaaaagggactttcatgactaacagcatttgtaaaatcttataaagattaactagagtaaactactatttaaatttctgaaagtgtatagcattgttatattagtttctaaaattaaagaaaattcaaatgagtctgtgcaattttaaaattagaactatgtcgcatcttctaaaattagaactaattcaaacacttctacaagaactaaatagcaaaattttcatacatctaacatgatcatattagaattttccaataaactcttaggtctacaattaattataatgaacggatgaatgttatgatgaatttggtgtacttaatctactgataaaaatgactaattatttataaactttaaacacctaattcttattagtgtaaaaaaacgtgaccgtagccactaaattcataataggagatctagggttaataaagagtaaaactaagtctcatgtcactacatttaattgcttgatagaatttgtcctattgaaaactttataatttagagcatgttataatgcaatagaaggtttgacttcttaatttcaataattcatataatgcagacaatttcaatacatttgactttgtctctatcaagtaagtatttcaatccgtattctaaaaccacataaagtacgtgtcgtctttgatatgaattttcttacaaaccattaatcagtataaccatcgcgcgaatatcttgggttgttatgcgttgaatacagaaatcaagagggccttatatgcagagcttttggctgctccaaagctattgaaaaagcctttgataagccatgaaagaatctttggttggaatgcgactctcaattagtgatcctagccttcaaggatgtcagcatagtcccacggcagattcaaaatacgtgggaaaatacaatttggctcaccagatcaatgaacttcgtggtgggtcacatttatcgtgaaggtaactcatgtccagatagacttgtcttaaatgtcaacactatacaagatttttgctggtgggatttcacccccacacttctcacttctctttttgtacatggcagatatgttttttcctattacatgtttaggtagatttttgcattgtttcctcatgggtttggtctaacccccaatgatcctcgtgtatcttttgctttgattattaatatatttggcctttgctgttatgaccttttgcttgttgaggtgggaacctaattgaaattatgacaaatacttgatctcagtttagtgtccat

SEQ ID NO: 4656 - DNA, 1600 bp, Glycine max
  Soy_ogl_3192 Gm09:39316001..39317600 Cluster 20
tccatatctttaaatctggccaattatcatcactaattttaattttacttgtgtatttttcattttctgcgcctatatgtacaaattcatcatctctcccttttttggtccaatctttgtagacagacgcctataaatggtggaaagctccaggaaagttaattcaaaatcttgcaaggtttatgaagatcattccattatttttctggggaatttatgggtgagtttttatctctttttcatgtcaactggcttccgcatgtgatccctactctcgttgacttcttgttttcaccagcaagggatttatgacgaggaatgaatcaactaattttctttcaatatggaagatattcatatactcattgaacagttgattttagaaagaagagtggtattcaattaccagggctgggtacaaagcttaaacaagttagtacaatttgttgtcaagaactatattatatgttaatatatatcacagaatgttcaactcttgttttcagatctcctataccattcaaaaatccattgtatatcgtcgtgggtagaccaattgagctagagaaaaatccagaaccaacaatggagcaggtatatataacaaatgcatatactatcacccagattttgtactaagtaacattcaacagagccacacatgtcacatgatccagctagtggtaacaagttttcaaaaaatacgtttgtaactttatttttattggataaaatttatgtgggtccctttaaatatatggatcatatatgtgtgaatttctttgtaatttaaaattaacttatgtataagttaatttgtagaattttatagttttttaaaggattattttaacttacatataaactaattttagtgaatagaaaagtttattttgtcttatttcttcttctttttttgctgaagtgattttggataagtttatccaaacaaattcactttacttgttttcaagttacaaagtaaataattactgacttgtgtgtggggaagagagtaataggagagttttatttaaaacgctacttaaggaaaaattaggatttagtgacttctataacctctctctccaaagctaacattaccaatttattatgagttatcaactaatgtgaattgtagttgagtgaactttttttaatcttcaattatactttgtttcaggttgccaatcagtttgttgaagcactttaagatcttttcgaccgacacaaagttcatgctggatatacaaatcttgagctgaaaatattttgacaaaaccatagtctgttggtccttgtgccaagatttagttatctacaagtaaagttatgcatttgagttttgtgaacaggaaaataaaaatcatttaggaagatttatccccataaggtagtgtttagaacttctaaaagttcagacgtgaaagtaatacagcagtgaaatggactaaaaatattgcaggggtgtcatttgaaacgtctgaaaccaaagtggaaagagcatgaaatgatgcaggacccacacaaaaaactttcacttcaaaaaaagaagatgaaagcagctaaaatctatagtaaaaaatgaacaatccaaaat

SEQ ID NO: 4657 - DNA, 1157 bp, Glycine max
  Soy_ogl_3235 Gm09:402801..177957 Cluster 20
tagttaattggttagtctaaaaaattattacgtaagtggtattttttttttaacgaagtctaatcagagatactctactctggctatggtttgagtatctgtgggtagtttggtagattagagacgtattggaaccatgaggcgtcacgtggtgtcacataaacatgttggggacacctcatcctcactcaccagcttctactctagccacagtcatttcacctttaataaataattaacaattaacaattgggtgtttatttatttcaatataaaaataataaagccacatagatgatagaacttttgcataaagaattaaaaacgaaagaaaaagataagagttttggaaggctttgtggtctgaaaagagctgatgaaactcccactagtgcacagaacaacgaggcgtaattcttggtatagagttgtaagggtttttatagaaagaagggacacgtgccctgttcttatgttccttagatatagtaaaacaaaaacgccgtatgcgaaacgaggaggtttcaattccattgtacgacagttccgcatgtggttatagttcacatgttatagtgttaatacggttaattgattttgtttcgttacgtaacctaagcattacagtctttcactataaaatgttaatgtagttagtttcccatcgatttctaatacgaattaaaaatttctttcttcactagtggatatgtgtaaccctagtccatgaatgaaaaggctggtcagacagtgttcgaaaaagcaaagcttgtaaatcaacaagaaagatggctgtgctgcttaaaatagaggcaccatcattggtgtctctatgtatagtgtatagggaatattaaatgatgaggatataatataaaatttgctcaatttttttccttaaaaagaaggttatggataatattttctgtgtcgagtgcccaccaatataatttatataacatgacttttgaccaaatgatgaggtagtcgttcatatatggagtttaccaatatatgtaatttgtacataaatatgaagggaccattcaattaataatgcccttatggcctaacattgtagttgtttaaacagcaggaagcaaaagtaaaacatagaaagccataataaaaaagagacgaagaaaaagattaatctg

SEQ ID NO: 4658 - DNA, 1900 bp, Glycine max
  Soy_ogl_3302 Gm10:1403701..1405600 Cluster 20
atgtttttatgtaaaaatacaacaatttacattagcaatttattctgatctttatttttagtaaataaataaacatattaatgtttttttttacctatttctgtccacacagatgttagcatactcgttaaaaatagaaaaatgtcagatagacatttcatgtgctatccaacattagagagagggaaaaaagaaatacaaatatacacataatagaatttatgatatgattaaaatagaaataaaaaaaatgagaaatattgataaagtgtttaaaataaagagtgatttgtgtatcattattcttaaaaataacatatatagattatggagatacaattataatcctaattagataacaatgttaaaagtatttaagaattacaaaaaaaagaaatggcaacagaaaattattatcattttaaaaatattttcgagacattattattcaatggaaggaaaaggagacatcagacttaaattcccaaaaaacacgtttttatgtattgccacttccattttagaaaaacaaataaggttgtctccttcacgaccatatgataggaggagggaccatctctgtaagatacgtagacctcctaaaagggaccaatcaatcatcctctgttgagtgaccctaatcaatatcaccttagacaacatatattgactagattcaaatatgactcatgagggaaatactcattccactgaacgcacagaagggtaatatatactactatatatgtagagtaaggaatctattaacagtcaattctcgtgtgtacgcgtgtgatgtatatatatagaagacatacgtacgctacattgtttccttagataatttgctcgtgtttatttttagaccgagagttatcctatatatattgtaagcatttttactcaaatcggatagaattattatgataaaaaacttatctttgaatacaattgtatattcaaaattctaattcaatgttactgaaccacgccagttaattcacgtgattagtgataaaaatttcttgtttaatactatttcttggtgacacatgatgtctacatgcattacatgagcatgagctgagtggagattttacgaaaagtgtccctgtgaatcaacacaaattaggatcccagattcattctttttaagttttgaacccgctaaaataaagcagcgtatgcaagtaaaactgatcgattcaatcatcgttatgtacttcatcttccttcactccaatgtgagacaagaatttaccaatcacagacaaccgttcctactaattcccacataattaattaatgaaaacaatagcgagcgagacaggctcattcttggtcccagttcttgtgcaatcacttcttattataacggtgttgacttagaccttcagagtgtgactgtagtacatacaacttggaattggctttcgtttgattaatcatccttaaaatttctgaaattaaacgatgttaaatatgcaagtatacccgattagataatatctgtgtaactattcaaatttatgttctagggttgacatatattgacagatgctgttataattggaatggtgaaagtttttttttcaataaaaaacaatattgattgattataaatgatgatatttcagttcaacataacacagcctaactaaataagctccaatgtccacttattttctataagcatgggaaagttattcgtgtatgttgatgctagaatctagatggaaccttgctatctcaggacttacaaaaggactgcaacttatgatgccaaaagctcaaagcaaatgttattgggaaatttccttacccactcatgttttaacaataactatgttaaatatatattgagtggattatattttaaatgatttaattgagtatgtta

SEQ ID NO: 4659 - DNA, 1600 bp, Glycine max
  Soy_ogl_4558 Gm13:38824501..38826100 Cluster 20
agcacaatggggttgcattgatactgccaaggataactctactcttgcatttatttttaacaataaatagttcttacaatttaagagataactctattaattcttagttgtgaactttataaccgtgaaggaaaaactatataggaatccaccggctatgcaataaacacataatcacaaatgtacggaacaaagggttattttcacactaaaaccattaaaccattcttacactttttaattaagcaatattgaataatacgtacttccaagaaattattcatatttaaccactataccttttttatttatataaaaaaaaaaaaaacgttaagcttaagactgcttacatgcaaaggaaaaaactaccgttttcgttaagaaagaattgcagcgtgtttttttaacttctgtaattagggttttgttttcctggtgaaatctcaatatatattcttataagttttggtgttttgatttttgagtcagttatatagaactaattttttatttgagtcttattcgtactgaaagtttcttagctcttctcaattgttttctgtaggtaagaattacatatagtctgctttacataatattgaactcctaagttcattaatcaatctatctatatgccttcttaattaatgatttagcgtctgttaaacaaatttactgctgtaaaaataacgtatacgtaaaaaattgcgcagaaaattacattttcgtatatacgtaattaatgcaatgtgagaatcttgcaggaagagatttggtaccagtttcttggtcgaactgtctttggagggctacatgcaggtggtgcagagcaattaaattcgtggaaccccccagccctgcccaaagtcacatgaattccgagacagaagaaagagagttggcactagtcatagttatcgttaaagtggtcacacaaactaacaatgataagcctccaaactccataatacgaggtggtcttcatccttgtcttatttgctgcggtgagcttagtaaaaaacaaatgtccatgagatttatttacggctacagctagctgcgcgcttcgtacgcttactgaataatgcgtccgtgcgtgcatggagcagtgtcacaccttgtttcattcaggatatggcattgagcaattttgattgcacaattttaaaactaattatttcctaaattctctcctcgtgttctttctctattatatatggacaaagtttatttgaagtttaaaaaaaaaaacaatttctaaatcatacatgcacgtgacgatcgatgtatttactattacctaaattaaagtaagttaaatttattcaaccataattttaatgaaggttccaaactaagatccaaatacacgttaatgaaactcactagctagtagggtcgttctagtaatgagagattaggatagatacatacttaagttcgatcttcattaatattcctgctgcatttgtaaaaataaaataaaaaatacatgttggtgcgttaccaaaataaagattcacattaccaaaaaaatacatgttggtagatttggttaatactttaggttctttctttttctgtagaggttagttagagc

SEQ ID NO: 4660 - DNA, 1800 bp, Glycine max
  Soy_ogl_6652 Gm20:231201..233000 Cluster 20
aatgacagatgaatcccttacctcatcaacacaacacagtgatgcactacatgtaattaaaagaaaaaaaatccataaccagttatcaaataccatattcagaagcctcaggtgcaatcttctgcagataaactaaaggatgctcaaactcatgctctgatgggtggtatgttggacactccggaatcgtattggttcattctagatcagctaaatcaaattttctcagtttgcgtgagccatatctcgctgtccgcggagtaattgaacttttaccagtcattgttgttgttcttcttccacatcttgaagcttttggtgcacccattttatttgatctttttatatatcaagcatctctagcatcgaattcttcttcagagacaccaacttccacccttggaggcttttcctccaacctaaaatatatttaatagttattaggcaattagacattaattactatacaaatttaccagattgcaacaatgaaactaacaaaacaaatttggagaaattaaatggatgagtatgcacgtgatgaaaagcatcattataatttttattttgtcactcagattgttgagaaaatatcatgtatagtttactttgttttgcatagaaagtttttttgcaattagctacacatagagaaacaagagttcccttgatggattgatcaatttgctagaatttgaaacattttacttttattatggactactttccaaataattccggaataatgtggcataaaataaaatcttgttgcttcaaaatggacatgaccacaaaagtaaaagctcatttaatttgctacttaatttagacaccttttcccctcaaaaggaaagttagagatttgttggggcaccagacattacactaggaaatcaaaataatcttgaaaatcttacagaaatctggcattcaaaacaggctttactgtttgatgcttgcctttggttcccatgacagtcagaaaaattgatgaggagttactaggaactaggaagacggttgtttcttggagagatacaaattaataaagagatgaaactatggtgactaaatagaataaaattttgtagtaaaaaaagaaagaaaaaaattctccattaatgttttcattagggacaaactgaatgtaaatcaatgttcttacagataaacaaattctccattgattgtgttattttcataaatacactgtatataaagccaaattcatgattagtactttaaatttgaatattaaagcatgttcaagttgttagtgaattgaaactaatagtaagcaaaacatcaaagaactgtcgcaaccagtgcttaaatattttcaacttcaaatactgctttatatgtaacgcgtcactacccaactttatgagaggcaaccaatgcatagaacaggcaaagtaacggaaagcgattgcattaacttttattcaggaagatcttcaaaacaccacaaaaaggggggggggggggggaactatgcacaagtgttttcctgaatctgcctctgaaattaattaccactggaatgtatataaagtataacaattataaatttaaggcaaatttattattgttaatgactaaattaattacttttcttaattttgataaattagataattgggttggaaacgagggaggagttaaagtacagagatggatacattggcatatggcatgccatgcgtgattatcatgacatcatcatcaagatcacaaggaataaatacacagtcaaatgatagtgtatacactacatagacaattaatactgcaagt

SEQ ID NO: 4661 - DNA, 1542 bp, Glycine max
  Soy_ogl_6840 Gm20:38330559..38332100 Cluster 20
gcacgcgttattcttattttcatagaattactatgagaagggtaaaaaaactgaaagggaataattttattagcgtaattaataatataaagacttctactttgcgtataagtgtacaagtattgattacaaagtgatgcttctcttgcataagcatatgaattgatttcagtgttattaattttgatagatactagcaaggttgaacttgcacatactgcctggctagctaccaagttattaatattgataattattattaactattaatattcatatttttgcttctgcattatacctgggacacatgctagctgtgttataggccttaggcacctaaacatatgtatattaaaaaaattgagacagaaaacaaaataatcggaactgagattgaaattcccgttatggaacagcttcccaagtctttagttccatctcaccataaaacaaggcatacgcacacggcacatccatgttggttatatacatctacataatctaaacacacacacatttttaaatgattaaaattaaaagataaatgtacattaattttttaagtatagtcatgtaacttttaatcttaatattaaatatttatatatgattgtatgacctaaagttagattttatacatttttaaaatgagaattgttcttatggatgagagagtggcattggatcactaacaccaaacaaaaccaaaatgtacctaaatatttagctactattaacctatagctaattatcatttctgaagaagtttaatgtagagttataattaatgcttttatatcgttcaaaagaaaaggtaatattatttgagagcgagggcattggatcaccaaacccaaataagccaaaatatacctaaatattcaggtactgtttaactttagccccagatatcatttcttaagagaattgatgtagcttacacgtttatatatatcactgttttatttgcaggcttttatgtatcagtaaaagactttccagtcccctttaatttatattccatgtttatatttgtagaggctacaaaaaaatagtttaaataatccatatccatctatctagaattacaaacatcactatataataaagtcaatagactaaataaaaaatcatgcatcaattgtatatatgatgctgatcatcatgttcaatgttgtaatcgatcatatatctcagcgcgcaccagtggacagcagaaatgaggagcattacgggataagtggcaacaacgtaggatgtggcttcctctcatgcagacaaaagttggccacggtaacgaagccaggctcggtaaccgaacctagctacatggtcaacgtactatataaatggtggctcatagataaggaaggaggagtggagtggatatagggttggtttggcctttgaatatgagacaggtgcttttttaggaccttctttggctacccgggaattccgtgtcaactcaacatagggaaactaaaccacaattccggcctttacaaacactactttgcactttccataaagtcaccctaa

SEQ ID NO: 4662 - DNA, 1355 bp, Glycine max
  Soy_ogl_1278 Gm04:7412501..7413855 Cluster 20
tggtgcattaattaagtgttaagtgagtgttccgggtgggaggaaacatagttatgaaagtggcatttggtccattgaagaaggaattttctggttaagcggaagacaagttgatgtagcgtggggaaaggatttggtgaattttttctgagtgagttgcattattatgtatcaatgtatctctttttggtccagcaagacactgtagcgtgatatttaatgttactcttatttgctgctagcactgtaccatttatgaattgattcatcatcgtcatcaccatcttttatgctgctggcatggccccgtgttctgttatgcaagcctgtcatcactcctgtccgtaaattcaaagttcaaaccgtatggtggaatgagaaatcatggaataattctaacaatttttaacacattctctttataaaatttgtatatatggacatcacattactgttaggacttgggcgtattctacaacgaatgattttaaacttaataaataaagaaatatttaaaattaaagctatattagaaattacgtaaaactgtaaaaggatgttgataatttttttctatagttttttaaataatacattgagggcacttattacttcttcttttttactgggagggtaattattactagttggcgttaaagattaacataataatgtaactggcgtcattactggcctttgcatgaattctagaaaattattaaaaaaattatgttacccttataagttataaatattaattaatgaaagatatgttagtaaaaaaaagattataaaataatacagtcaacacatttaaaaaattgtagtaaatcactttctctttcttttaatctttcaatatcggagaggaaaatcaaggaaagttgatagagtagagtgtatgaattttttaaaacatattttttatttctataaataaaaaaattaagttacaaaaatacgaaaggcgagattttaatccatttctttcttcttccctttattctaaatctttgacctaaataacacaataaaaaaaattctcttacctttttactccaaccaaatatgttgtaaatttataaatttctcgttgactttatttatctaaaatctaattatatctgtctaggtttttattttattttattttgggcagcataaatacttccactcacttggtcgttgggtaactggcatagcagaaggtaccccttttgcgtctcccctgaaaaagtagtattggtatgtttgaataagagaacaaaaatagtgaaaaacaataaaatacaaataataatgtattttttttcttatcatgttttggttcgaagcatcgaccaataataattgac

SEQ ID NO: 4663 - DNA, 1389 bp, Glycine max
  Soy_ogl_1282 Gm04:7668794..7670182 Cluster 20
ggtgattcgagttcatcacagctaggtgattggagtcagacatcaatttccttatggatagtaaggacatatttatagagaaaaaatgataaatatcttcaattatcctttagctaaagtctaaattttgagtttttagtttgttactgacacgtaaattaatttcaaagttcctcattgtgcttttgtggtgggtctcattcaaaagctagttggactcatatactgagtattgctatcattcttccttaacttaaatatcaaattaagctcaacgtttttgtaactttgtagcgtaatcatatggttctttgcagtgctattcctgctcactaatactactggtaagccatattcaagttttcaatctgattttaatgacatgttagtcatgcttgattggtgtttatgtggttttagttaaaaattttctaaataatgcaatataatagtaaatattgatcattaattatgtcatattaagcactatagtttcccaaatactattaagcactatttttatgcagttatgtcctctttatgctctagtcacacaaaataatttgatttagcattttttcattaccataccacacaaaaataatatgattttattatatgtgaacaaataaaacaattgagaatatgcttagtttgatttattttttaatttatttttggcatcatttataagaaatattaccaagccatgatgctttacctacgataaaactaagacaaatttaaaggagtaatgaagttaaagagaagagattatagcatttgttttatatgcaatatgtgatttgcttacttcttttcaggtccttacctcaattggtaacttttcattctgtacctctttttcttttttatataacctaactttttaggcacttgtaatatgccatccaggttcatctattaattggagtgtgtattcttgcctttcactatgtatttttatttatagaaagatgaaatcatgacttaattgaaacaaattttgaaaaagtgcttaaatatagaaaccttgaaatattacttataacttactctagctttatcaaggtttcaactttggttgagattgttagtgactgtagcatacttttttttctcattttcttgtaacaaaagcttattttaatgccacaaaaaattatttctcaagaatatattttggaacatggaaggggctgtcttgagatgcatgttggagctgtagaacctagtgagcatgctttagtggttgacgttttgattgcaacaaatggaacactttgtgtagctatggacttgtcatgtgagcaaattctttcataaatggacatttattatatcatatcagattatagtatgacattgttttacattgaatatatttta

SEQ ID NO: 4664 - DNA, 1500 bp, Glycine max
  Soy_ogl_1819 Gm06:7115301..7116800 Cluster 20
acaaacaaaaatgtatgtattaattaattaggcaatgcgaccctctaattcttttcatgttcttaatcataatagaagctttattatattgatttgtcaataagggacttgctattaataattttaaagtatgagaagaatttcatatatcatttcttcaatatgttgatgatacctttttgattggcaagacaactcatgcaaaattattgtcttcaaagataattttcagattttgttttgaatatgaattttcacaaaaattagtgcaatcggggtaagtggggtgaatgtaaagagatattccttttaaattattggcatgggtttaccgataagagccaacttaaagaagattatagaagattgacaggtataacgacatctaagttttgtctgaaatataaagttgaagtgtaagttcaggctgaagaaaattgaaaacaaattacaattaggttaaaccaattaaacttgagagggagggttgaaaaataaatgttacattggtggattagagtatgtaggtaaagagggtatgggtctaaaatgcaaagatatctttctacaaataagttatttaagctgaaagtccacactactctttcatattctaagaaatacctggaacataaatatttcttagcacccttcttgaagagtggtttccaagcttcttttttttttttttttcattttccgttggaaacagatttatcatttagaattatagatatggcacaatgaaaagtatttaattctttaaagtgtcaagtatgattaaggtgttcaggagtaggtttgtacaagatagatgataacgagaattcaaagggaactaaatatatgtttcttttatatttatgtaatgcaaattaaaacaaaattaagacaaatcacaatatatataaacaaattataaccttttcttttaaatatgtataacataatcctgaccatttcttgtaaaagaataatataaacaaaagtactagtttttttaatttgtgcagtattttacaaaataaatagacaaaaaataacgatatatacaatattcaataacaaactggggagactgtacccaaaaaaaaaaaaactgtggagacgatgacacatatgtcttgcatgctacgttacctttcaatgagaatagtccatcaactgcataatcatatgttgccacttttcacatatttaaaataggcacgacgaggccgccccatatagcccaactataaataatggcatgatgttggttgaataaacgtaaagaaatcaacaataaaagataccaaaaagtagttagagaataaagaaggattaaaatatcgccgattgtgttttatgaggattttccaatgcattaccaaggattcaaccaaagaattgccttaatctggcaacaagtatatattcacctttccctcaaatgtcttatcacaccagcccatttctttgaagggaacaatgaatgagtggcctaagcccttttgagag

SEQ ID NO: 4665 - DNA, 1400 bp, Glycine max
  Soy_ogl_1868 Gm06:8812301..8813700 Cluster 20
ctcacaatgctataattaagtatctcgctaatcctctcagtgcttccttataagtctaattgttcaaatccaacactattacaagaaaaaaaaaatacatatctcaaatgacataatacagttgcatttgggttgatcatgtgttgatggtttagatctgcgtacatgcctaattgtaattgattctatgtatatattttttttcaaacaacatgtgtcgtaacattagctgcatctttatatatagtactccaaattgtaggaaactcctaaatataaaagggatatataagtttgaaaaagaaaaggagaaatcaattatttatttatatatgcaataacatattgacactttcatcgatattctatgatatttgacgtaaaatcgtgaatttgaaagagattcatgcatggatggtggtgactaggtgtatagggattagggaccaaagccatagattattatgcttgtcaggggcatacacaccttctgtggcttgtgttcaaattagagggataatgcatacacgtatgctggctggagtatggaaacgtacgacttttatcatcattttgataactttaggtgtcattgtcgtgatttgcaaagtattttcgtcatactctaatgtgttgattctggcatgtacacctccattaattgaagccgaaacataaggcatgcgcaacaaattaagattcactgattagattatcactatagaggcgaaagttgaataaatgtaactttgcttttctggtggatcagtgaaatatatgtgtcggtagatctggtttgcgcacgccacggatgttcacttttttaagctctggtgcagccgcagtaaactgtgtgttaaatgtggaaggtgggctaaaaagtggctactaattaactaccttgtacccaacgctaatgaaaaagatagggtagttgtgtttactgcctcaaatatgctcatcgtatttattgagaattaacattcacctacttccaaaaattaaattaaatcctaatctaagttgaatgggtgggtttgttaaaactcatttttcaaaaaataaatagttattttcaaaaaatgattttcttcttattttgaaaaaaattaattttacctatttattgaaaaaacatttattttaaagagcatttatgctaaaattattttttttaaattttaaacaaaccaatcttatattttaacaacccaaactttcaaacgttgaatcaataattttctttttttctatctttttttttctaactacattatccattaaattaatcatttttctctctcaaatcactcaagattgttcaataaatatttttcaattagaatataaatgtagactacagttacactaaaaaattaaaatgataattattttttgtt

SEQ ID NO: 4666 - DNA, 1300 bp, Glycine max
  Soy_ogl_2215 Gm07:5408901..5410200 Cluster 20
agccccataagggcccattgtatacaatcagcctgtaagcgcagaaaccgaagatccgtcttaaactccctcacatatccacgtatgggaaaacgtctcaagccccataaggacttattatctaaatattttggggtttgtaatatacttgagatatgcataattttaagaacttagaagtataaatgaatcttggtgaaaatttaataaaacttgaagatgttttttttgttgataaaaattaatgttatgattggtgagttttgcttacaaggattgaaattatttaactgatttaatttgtggagattcaaaataatttttttataaaaaaaatcaatattttagattgaattttttttaaggtttcctcttttcttttctttttaagtttaaggggagggggtaacaatttgatctaacacactttgatctaatacaaagaaagttataaaactcaaaaaatatttaaagaaatccttatatttattttattctaaaaagacaaatgaaagttccaacctgtgacttcttaaataaagagtttatcttactatcacttcttagacataaattgaataaaactaaggtaccacatatgcttgattttaaaaatagaggaatttaatttgttatagcaagcgtggacctcacttctccaccacccatcactgagcaagtttctcgtacccttcaagttgtcgtaaataaaataatgtaatgtacggacgacacacccaccacactctttcaaacatgctcaacccagattatgtgatctgagcaacacgtgctcattggctcattggtttcatacagtcccattcaatatcattaaggaatcgtattatctatataagaaattttgtttccctcctcttcttgagacttgacatataaagagtgtttcaacaactttccctaaccatgcaatcgattctcagcacatgacttaattattttgaatccaacacaagtcaatgcaggaaagcctgaatgttacacaattctaaaggtcactgccattgcttggcagaagaaaattggtaccaaccttgaaaaagatgttgcctagttaaaaaggtgataacagaaatgagcaaaaatttacaaataaaaaatttgtgacgacaaatcttaagatttttttgttttggcaatcaaacataaaatatttgaatatgcatgataacctccatttttagggaaaacaaagaaaaacatgtagcagataagtagagatataatacaaatctcatggaaacacatcaaaataaagtatccatgaatatatgcagct

SEQ ID NO: 4667 - DNA, 1368 bp, Glycine max
  Soy_ogl_2316 Gm07:9967214..9968581 Cluster 20
tcagtcaaaaaaattaaaaatattcaaatgtaaaagatcatatttaaatataaatttttattcttttttatttagtgttgcctaaggcatgactcaatcaacagttagatattaatcttctctaaaacagagaaactatttttctttattttttaatatatactatttactaattgcacctcattttattaaaattctaaacttgaattctatggtttatttttaagtaccaaagtagcatccattggatttcaagaaattggtttagtgaagttagggtcttgcattctacgtagatttgagtcttcattcttctccccggaataaaatgtaagtatttgtttaatctaaagttttttcatgtcttggactacatcgtcattcccttcctctaaatttcaataaatccaaaaaaaaaaatttacaataagtagtattcatttattttatttgtagatagattacatgtatctctcactagaagcaaatttgctcaaactaactaagatgactataagtgatgaagttatccttttaactatttaacacaattaagatcacttataattaagttaaaacaatttcacataagtgttcaaaaattaaataagatccctttttttcttcgtctaattcatatataattaaaagggattatattttgacaaccaaaaatttcaaacatcggatcaatattttttttcttttattattacactacattatcaatcatttatttatctattctttctttttctctcgagcttatgaactcaagcttgtcaaagaaatatttttttacaattaaatgattaattatatgtctcaaacaacagttgactccgtcttcccctttactctctccttacacgctactccgttaaatttccaaaagctcatactcatcaacatccattgaccaacaaactcatcgtctcaaaacaaaacaagtatgtaaacaaagtgtggctgatgtttttccatggacggttttacccaagagattcgtcttgttatgtgtagtggaaaacttgcaaaattgtaaactcacttgttggccacgtttgatgtgggatcatagcataattgatgttttccagatcattggaaaggtacttgccaatatgaaaatggtgatagcaacatcattggcgtgaaaccccgggccatccacagagtgagagagataaatacaatattagacatctccatcgacttttttggttacccaatcagaatcatgtaataatgttaccttatcatctcactgattgacctagtattattatgcctttgtcttttgttctgcatgctgttttcatctcttattacaaagaataaatggtataattaattagagaataaagt

SEQ ID NO: 4668 - DNA, 1900 bp, Glycine max
  Soy_ogl_3005 Gm09:5044701..5046600 Cluster 20
tatcacatggtttacttttacagcccaaccttaaaaatactacaattgtcatatgaacaaataaatcaaaatcttcaggaattaaatttaccttttttatatacaaaacttattattccatcaattttattttctactactaacaaaggtcaaatagagacaattaaagtgcatgtacagaaagttatatatgtcgaattagtttacatatataatcctcatttatcatcttatgtttatgatacatttttctgaatgcatgagaaagagagaaataaagtatttccacttctgaaaccaattattagattttcgttttttgttttagcatggtattgggaaagtcaaggcagggaagcactcgtctcacatggagatttttacaacttatactaacttatgaaatgaagacatatacattactaggtagttaatgtatggatcaaaatttaaaaagtattcacatggagggttatcatatatttatgatcatttcataaatatctcataaccattattagtgtgtgttggttggtggcccttgtggcctctgtcttatttgtaattgtttgagtattcctgatacctgcttatttatatattcacttgtttgtttgccggaaaaaaaaaaaaaaaaagcttgagcaatgatgtatttcaataagtggtaaagaatgtgatcgacggcgaaggaaaagtgcctctttatttgctaactactttcttacaaaaatctagacaacgccattataagaccaaaactttcagtttcacaatatatctcaccatgtaaagtctacaagacatgcaaactgacaatagtaacttttcttgaaaattaccacaatatcatattccttactggattggagtcggtattccttagtataaaagttttgatatattaaggatacaatataacaaattttttttattagaaagccaaaacaaaaacgaatcatttatgagaaacctaagccatatatatatttaagtcaatttataatcataataagaatacatactaagaatatttatgaatgctttctattcttaaatttaattatttattatatttaatatgaaaatgtttcaaaagttgatataagtatattgggtgaactaataaggacacttttttcatatatttaattaaaactttccatcaaattcgaaaaagttgaatctcacctcttccatatcaattttatttgaaacatgtgctaaaaatatatataccttgaaagcaaattttgttaggaaaaatcttttttattttaaaaaatttacataattccaggtatgctagactctccaaacaatctcccacgccatttcttgtaaagtaccatgcatagatacataattatcctcagaaaaagttataagagctttatctttcaatctttctaacccataaaacactaagtatcactttcattatatttcgataaagattttagctctcccacattcatcattatattcgatgtgtgaaagaaacgcgtttgctctttgtgatctagaccatcgtaaatcagtttcatcacttgatatacctctaatggagtaaaatttttaagtttgtctagcatactctcccattcttccttattttttccacgaaaaagacgagccaaaactttttagaattaatggaatgccatgggcgtaaccgaccaccctttgtgatagttcactgtactccctttgatgatcactttggttaaaggcatccaaattgaaaagttcaagtgctttatcataactgaattgtctaagttggtatgtcttaaagactttgttagccttaagcacttgctcatgtctagttgtgacaattattctgctgcccaatccaaaattatcaagatgcatgttggaaaatttccttcttttt

SEQ ID NO: 4669 - DNA, 1200 bp, Glycine max
  Soy_ogl_3564 Gm10:46169701..46170900 Cluster 20
tattgaaaggatactaccttaaataaaattgtctaagaaaaatatcagaagaaaaaatgtgtcatttttttatgattaaattgaagtttcactggctagtaatttaacaatgaaattgtgggtaaattgctcttattttcattttcaaagagatgttgaattgttttaatttcttacaagttacaagtattctcttttagagagattatattatatttatcactaagaagcttggttcgacacattacggagagagaaatcccttattccaaaagatcgaccgaattccattggtaattaataacgtgctaaaaaaaagtagaaatccgtgtgatgacttgagttaaaagagttggattgcgtgactttatcgaaagtgcaaagcactaggatttgtggtttagtttctgagtgtgttgcgtccctttcagccaaagttgatttgacacggaattcccgggtagccaaagaaggtcctaaaagggcacctgtctcatattcagaggccaaaccactccactccttccttatcttatctaatatctatgagaagaatgagccaccattgatatttgatactagtatagttgaccatggagcatgttactagctaggttcgcttaccgagcctggcttcgttaccgtggccaacttttgtctgcatgagagaaagccactacctacgttgttgccacttatcccgtaatgctcctcatgtctgctgtccactgctgcccgctgagatatcatcttgccatcatatattcttcatgcatcattttcatcactatggcaaaatttagttgttccttttgacttatatagatatatttctaatactagattcatcaatatggattatttaaattataggtgactcgaaaagtcttttattgatcataaataataacctgcaaacaaagcagtgatatatataaagttaatagtacctaaatatttaggtacattttggcttatttggtgttagtgatccattgtcactctctcattttaaaaatatataaactctaactttacgtcatacaatcatatataaatatttaagattaattaaaagttacatgactacttataattacagtacatttatctattaaaaacgcgtgtatgtgtgtttagatatctagatataaccgatgtggatgtgccatgtgcttaggccttgttttatggtgagat

SEQ ID NO: 4670 - DNA, 1456 bp, Glycine max
  Soy_ogl_4719 Gm14:6448601..6450056 Cluster 20
gagtataagggttttaataaattaatttgtactatttgtataaatatatataatgagaatatgagataatgtacagaacacatgcaatgcaaaatggaaagtaaggtagcaaaacatgtccacaggatgtctgcatggagaatgtgacccactcctacttggactactgtaatccatatataaccaatctttgacccatccattgcgctagaaattttcattttacatgacggaggcggaaataatttgtgcatgaaaatcaaatttgtatcctgaaattaatttgaaaaggaattataaacagtgtcatgggcttcactatttatccgattgctctgagcagagcaccgacattacttacattgaactaagaccctacttagagaaacttcataaaaaatttaagagaaagactatgaagataaaataaattgaatatcttaatttagataactaaaatcaacttatctacttaaattttataaaaactctctcatctaatttttttcaaaaaattaaagtatacaagctaattaattttaactttttatattcttattttcttctttataaatttttatggataaatttattcaaataagaccaatttcataatttgtaggtatggtataggctgtgtatgcagaaaacaaaacctgatgaattaccaaatgagccaactcatgaaaagactgacttttgagaccattgtgaggtcaagcgcgttttaatttttgcgttgggattcaaatgccggtgctcctatattttgaactttagtgaatagtgatatcattgcattttcttttaggaaacatacaaaactataaatgcaaaaaataattcgagtggagggggccaaaactgaaaacttgtcttcctttatatatatccccacgtgctttttacgcggttttgatcacttcatagttcaaacctaaattcaagcctttcttgttattcataatgtaatagttttttttttcctgacagaggcaaaggcacataaattcttctcttattcgaaatatatgtcattggcggtatttcgttatattttttttttctttttatattatcatatggggtgggaggggggttggtgtgctgaagcttcatataaatttgttttggcataggaatgaaggatatggttatatataattaattaatattgtgaagtttaaacaagtaatgaagaagctgcaatgtgtcaaatgtgatcaaaagccaaaaggttctgatgctttctttatccccaaagttaaaacgtcaaattgcttgcaaactacgtgttgcctttcactttttttttttaactcgattattattgtatttttaaggtatctaagaaggactataatgtgctgctataatgggactacacaagagcaatactagctagtttatggatctcatgtctcacttttttttatagtgaaataaaataatcttg

SEQ ID NO: 4671 - DNA, 1200 bp, Glycine max
  Soy_ogl_5483 Gm17:3554401..3555600 Cluster 20
gtccaagctttctgaaatatcttcacgtgaatgcgatacctcatatcatgttatattcgaaatgatatatatcttagcagatagcacatacataattaataatttaagggaagccgccaaaaattagtaaattatcgatgttattttttacttgaagttagcttctgaacctttggataatagtaacttgtatatttcagctcctttaatagataatatacaagtgtagtggggaccaatgctcctttaaagagggaagatctgcagaagagggatatgtatataactattacttgtggctgggatttaattccggaggttaatttgtggcagtaactgtattgacattattgtagttttggcagctataacaatgtaatcgtaataatgcagctttgaatatgacaaattattacaattgcatgcattatattgttatttcaataatcttggtgattaattattggtttttctgcatatttatttgaaatcagagtctgatcattcattacccacatttcaatcctactttaaaactctcattactggtgtaaactagtgttaaatacctgacatgcactacttactacagcatttatattagatatgatgacatgctttatattacatattaaaaagatatatgttcaaagtaatggaaagcaatcaaggcatgctaattaaagtaagaaatgttgatccaagtaatgatatcccgcaacaacacgtcagggaaggcaaacaataatttttaaaaaaaaataagcacacgccaatgatcacaaatccacgtgaaggtcaataatagcatgacattggtttactgagaagtggagcaaaaacagttgcactatgattcttgtgtagcctggtgtcggtgttaacaaataatcaatttgcgagcggcgagcctaacttctcttctttatgtaattttgtgcattcttttattattttagatgaattgagtatgtggttttgagaattttaaagaaaagaagcgtgggggtgtgtcaagtgcaggggacaaaaacagaggacatattacggcattctaagaatttatatgtataatatacatatttcttaattcctaagaacacttagaagggaaggttccctccaacagttgttcgtgccgtgaacctggcttcttgctggcttctaagggctccgtaactgaatttgtattccaatttc

SEQ ID NO: 4672 - DNA, 1700 bp, Glycine max
  Soy_ogl_6474 Gm19:40558401..40560100 Cluster 20
aattgatttctattatagtagtaaccaattgaagactacacattttctttgttctttgaaaaatccgtttttattttattgccagtcataataaatggactactgcatgagatggtttctgtcaatgaattttgtaaatttcttgaagagtgtccctggtgttttttttttttgttggggggcgggttgagatttactcgtcttaggatgctgaatgtagtgtattccataatggatatcaataataataataatataaactccatttagttttcatatggtatggagtttatgagattaaatttagcaaaaggagggcaaaaaaaaggcaccaccagtttataattgtatttccaataatttcactgggatttttttcctttctatttttacacaattttttcccctcccgatatggatgtatgtggaatctaaaacaaaaaatttgggcattatgttttatttttttgtctctgaaatcactttaaaatgactatatgtccaagaaattttttatagaatgttatgtttcggcgtttagcaatgctgatgtctatttaatttctttttaggatgcattgaaaaatagctcttttgaaatggctgttctggagaaaaacagaaaacatcagagatatatattaatttgtttcaagacttcaaattgaccttgtgctactattaatttttatataaaactctttttatctactttatgaaaaaaagggtgttacaaaggagaaagtgcatgagaattataactaaggcagttcgcatttcgtaaacgtttttctatttataaaaaataaaaaataaataataggtgatgtttgaatccgtatcgttgattcaaacactcgacaccccgtcgcacatgagtagtgtttgaatccgtatctggtgcaattctgacgcaggatacacctatgtgcgattgggaccgtgcttcttagctatttattaatcacaataaaattaatctccaaccccaaaataaggacaagaaccatgattaacaacactagattaaaagatagaaaacctaattcacaaattttgcaaagaaaaatgtcaataacatactattttaacacatttttaagacattctctcttattggttatttttttaaaaaataacaaaagtttgtaggtttcatgttacttaatgactttctcttatgatttttgtaatttttaataaattttattccatgataaatagtgtgataaaagaagtgtgttactaactcttttttataactaaagaggattccctatttggtttggttactcgtcttatgtaatcaatcatattactgcaattaatggtataatttgttttggatatggtatttgtatataattgatgccattcaagattagcaggttcattggaaagaaaaaattatactttttagaacagttatgacaaagagtcgttttaaaaagttattttttagaataattatctaaataaaaaatctaaaatgacaacattttataacaataatcattctaaaaggtcataactttttattacgtgattttttttacaacgtccttataaccgttgttaaaagtcacttttaacagtctttttctgtagtagtggctgttgctgtattgctttgataatgatacatgagttttcaattcactttatatacatttgcttgatgcccaggtgtctgcaattgc

SEQ ID NO: 4673 - DNA, 1701 bp, Glycine max
  Soy_ogl_6493 Gm19:41740618..41742318 Cluster 20
gtcaatcgtgatctgcaacaaaaaatcagaaatgttttaggcctttaagatgtcagtttcggaagttttaggggaggtcacgttaattccttgctttttcttatactgatggattcaatctgctctgtttgttttgggtgtttttagtgtggctacatgctcgcccttcattctgtcaaacattgcaggcttgcggtctaaagcttctgcatattttgtcttgtgctaatcctcctctataatatcttatgcttaaggttagtcttactattaattagttcaatgtttttagattatccaaaacatgaatttctttttgtaagacaactcatttaaatatttaattcaccaagtcacatgggttgtccgtggttgatcattttcagtctaccttcaagataagccaactgtcaagttaaatttgtttagggatatagtttttctaaaataagaagatgcctaaactttaaatagctgcatgcatgtattggtcatgtgaaagtgtaaatgtgatacagtcatatccaacccaatatttgatgtcacgcattaattagtgatatagtataataattagttagttttatgattgaattatacttaaatttaattataaaatgatattagatcctagcttagtaattgatattaggtgtattaagtcacttgttatccttattaggttgttattggacaattagggagatatcgcgtcttgcacattttacttttgaaaaatgcttaatggtatgaaaacaaattggtacgaaatgcacgaatgatgtggctcatctaatctacttttatttgttttagctttcattcacgttgcctccttctctgtgtttttggtttttttgtcagcttcaattttccttttcttttgcaatctcaattcctcttgaagacctgatttcactcaataaaactctctctactattgatatgtgctgcgtgtctcacatactttatcatcgtagaaggagaaataagagaagtggtaggattgatcattgatgcaatggaattaacaactacaagtaatatattatgctcctcatgattttgtgacacccagtgatatctttttcttcgtgctttgaaattgatatcttagtgacacgcaatggtttaggttgtattcatatacttaaggctttggtactagtttgcgagattatttttttttatagaaaaaaaacagaaaaagtttgcgagaactttgaacaattagcggaactgtattaaaaatttgttattttatttttcatttagaattttatttattactgtatttcttaaaataattacacaacattttcgtgcatttcgtgccatgaatcatcgtactatatagcattgttctttacttttaatatgctcagttcttgacgtgagctaagggatacagttaaaaatttcacattaaccggtgatgtaactaaaataatatatataaatagaagatagtttttattttatgaattaattttagaatatgtgatcaccaagatgctttatcctactttaatgagtttatgcatcaataggataatatttgtttgtcctactacttatttcatgttcttatttcttattctcatgagaagttaagttaaaaaacattatgaatcatttttcctaattcactttcttatgattatttactattatttcttttaatatttttattatcattat

SEQ ID NO: 4674 - DNA, 1500 bp, Glycine max
  Soy_ogl_1253 Gm04:6333701..6335200 Cluster 20
tatatggctagttaattctattaattgctaattcattttttgagttctaaattgattgagttggtgcatgtttaacccgtgagttttacaacactgatgtagtgcaaatggctaataggaacatgtgcagaacacaggaagcactcacatggttcacatgttagttgcagtagcacacaactcataaagacaaacacattatgtcacagacgtgtagtgtagcttgccataaccttcccaagtaatcattcctcggttcacattcttatttctttgtacatgccatcaaattgtacaaaactgtagactttgatgaaccttaacaaataaaaccaacactgcaggcctagtggcataaatcaaggcagaagtagaggaaagggagcaactgcttgctcataggcctatggattcttcaaatgtgaaagaagactaaaaatacaaaagtgaggaaaatcccttcaacatatcaaccaggaaagggggaaacaataatgcattagcataaaatcagaattaattagttagaaaaattgaagaaaaaactaacggcattttactacattcaaaaatgcttctaaacctaaacataccatgaaagttaataaaagcataaccaggaggtctccttgcaaactacatgccactagataagatttatggaatttaactataatttaatccaaagaagtatgaattataaaaggaagaatctacaaaatataaattcaaaatttccaaaaacttggtagggaaaattgaaaagttgacaagtctattcgagaaaagatactgcttgatggtgtaatccaatgtattgtagctaatcttacttcaagcctcgaaagcataatcaacatcctctctaggaattatagagctttagtcaactaattttttgttctgaattctgtcaaacatgtataatttctctctataatgaaagagacataaaataaaaattatcataccaagcaatccataattctattttttcttctttattcccactacaatatagaaagagagaaaatacattctgaattacgcccagacatatagccttctcctcatatttgatgatccgtaactatagaggataccctcaaatccatcaacaattgtgggctgactccaatcctagacaagaaagaaaacaatccaagttaccaacatgcacactgttttatcctttcacaaaaaatcatattttaaacgactttgggttagggaaagggaaactcgatgagaagtgaagagaaacaagaagctgaacaaggagttgaagaactaagtaacccatcagtctcattcactgtttttggtatgctacaaaaaatgcaggaacaaatcttcttgtagaagccaagtttaattaaaccaagatccagtttcttctacctactttgctttgagatgttgagatctaaaacaatgtaatatgaaagacaagaaaactagatgaaagaagaagacatgaaatattcgtaacaaatgagg

SEQ ID NO: 4675 - DNA, 1243 bp, Glycine max
  Soy_ogl_4668 Gm14:5119058..5120300 Cluster 20
cttttgaactatgtttatgtttatgtttaaattgcttcaattccttaataattcaaaacgttagtgtattctgtagatttattttttcataggaaaatctgctaagaaatttttgcggattttgaaatcgcaaaaaactgattatatatctacgagtaaattacctgcggatttgaattatttttgaatccacaaagataatattaacgctcgagaagtagtagaaaatacaaaagagagactagctgagaggaaagaagagccaagtacaaacatgcatgcatatacctagatgaactccctcaaacgaagcagctcaacaaacagaaacgaagccatagccagcaccccaaccaaaacctccccagcccgggctcagagaaggccattaagctcccaccctctggctatggcacaacccagaaagacacagcatatggctagattgccaatcgagaaaacttgtttcctacgaatttttgtgaaaaaacgccaggaaaatccgcacctaataagaaaaattctagtagtgtgattacatgtagattatacttctccattgaccgattaatttgctgcacatatcttgcatttcaatttgcatgctagccaaagtacaaaatgtgatatgtggtttagttataggcacaaccggtgacttactccttgcataaacaagttaatgggtgatgccatcactgtcagaaagacacagagagtgcaattaaaaaggaaagagttgacaagattgtattagtgggggtccaagtgtgtatagaatgaattttggaaaaatagcagcctagcacaaatcaaagttcaacggctaacagtacctctgctttcccaaacggatataagaaacaagaacttttttttttttctcacttttctcttgtctgatcaatccaccaatgtgctaaccgttgttgttggtggcttatgggcaaaaagcctttggtacggtccttttgttggttgggaagatagttgtataaagagggagagacatttgaatttccgaagcatctaaaccacaatcacaagtcttatatacattgtactaaaaaagaaaaaaccaacagagagaccgaaaggaaatgtttattgatttatgtacttattgctctatgaaatcgagagctattcctcttggaaataatgctagtctagaatagaaagacaaaacttacaattagatgcaaagtgattatgtgcaaattatgtcttaaaatataattac

SEQ ID NO: 4676 - DNA, 1700 bp, Glycine max
  Soy_ogl_1871 Gm06:8836401..8838100 Cluster 20
ttgtgtggactagaagaacgtcgcacatgcatgaataataatatcccccgtggtctatatttgcttgcgtatagtttaacagtattcctatttatagaaatacagctacgcctaaaaggctgcatttgtagcatttaactgtttttgggtcttatttttggtttaaaactatatctatctttcatgcgctgcaagtaattaaaattattataagttatgaaattctctcccaatatttaatataactacatgtttaggtcttaaaatatgtgtgaatctaggtggaaaaaagagaattattttcatttatagaatgtcactgaaataaaggtctaagacctaatacatattagaagttaaactattttattatggttgatttcttattctggatcggatggtcttaagggggcctatatgtttaagtggatatgtgagtcaattaaatggccagcaacataccaaacatcaaatatgtaacgtaaatgcttaaaccaatatgtgagttgtccctgaatcggtgggaggattcactactttacaagatttaactttgaaatcactaattaagttgtaacaaattagagaaattgattcacgctggtggtgtctaatgccttgctttgtagaaacaccgacgtgttatttcaaggcgtgaactccgcgaatggtggaggggatatgtgtgaaggaggctttgaattttcatattcacaggtgaagttcgttccatgcattggtgcacaagtcaaaatctcaatctcaatcttattaaagaggctgaactgaaaacaacagcacctatcatagagcttttctcacaaacggacaagacccgtgttccctaccaaaaagggtgtcaactcaaaaacaagaagaaacacaggacaaacgctagcgcaacaaaattcaccagcttcctacagttccttgtctgacgcgtaaacttggagaaattgctccacattcaacatcgtgttctgtgtgaagaaacatttattgtgtgtgtgttgaccgtagactagtacaattaaattcacatactgttcgtttcgttacagtgttcttcttttactatttttttcactcctttcgtaagttttgttgtttaagtaacaaagaaaataagacattctagtttatgtgtgatttattcctcaaaggttcaattattgaagcaatgtatccttgcaatattgtgaatgaatcgggcaactaaaataataccaatttttttcgggtaatttgatggatttcaataatcatgtcaaagaaggaaccgaaaaaaaataacatgcagggaccaaaccttctttacccaacaagtcaacaacatcttcccaattttagagaacccaaaagaaaaattggatgttaaaatacattttggagtacattgtcctaatcaaatgttaagaataaaaagcacaagcttcgggtggcgaagactcatcaaaccagtaaccaatatataaatatggtcgtgtaattgggcctacttgcacatattcatggccccgttgttacactcgtgttttgtacgtaattacaagttcaatttaaggacttatggccgaaaacgcaagttaatgactgaaaaaaaaatcaagctccaactttggacaaaaaaaagttgtacctgttattctcataacatttcccaaaaataacatcgataatgtgagcccatgaagtgttat

SEQ ID NO: 4677 - DNA, 1532 bp, Glycine max
  Soy_ogl_2319 Gm07:10198669..10200200 Cluster 20
accccattaatattaccaattgcatatctcattctcacagttcagtttcgaagcccagaaaacagaacttgcatcaatcaaaagaaaattcaattcatatatactagctataacttgcatatgatatgatatgatatttacaagggtgggagaatgagggtgtggggaatgtcgccttggctcgagagatctatatgatatgatgtgtccatgcattcactaatcatcagtttgtgagtgttttctcggaccaggcttcattcccctcactccctcctctctcgctagatcgatcttcttttaattaatcttttgctcatgctgcatgcacattatattgcacgtataatgtattcaattcatgcacactctatctcttcttagctattttccaatctcttacatctttcatacataggggcaataactacgtataccaagaaccagtgatgtataccaaatttggagatgcttgcttggtatgcacttttcattatttctcatctcattattattgctgaaaggaatgcatatattcatatatgtataataaatttaggctgaaactattgcctgtactttctttttttggatgggggtatggcataaaatgatttcccacagcttcagaaaaatcattgcttattgaggaatggatattaaaaatgagttgtataggaaactagattgggctctggtgagactgggcccattaaaccagagctaagtctattgagggcttcatttaagggtttgaatgagtgtgggtgaattggagagaaagctgtgttatcttcatatttgcaaattctgatcgacttgacatgtcttaggatatgatcccttaatagaagacttgtataataaactattgtaattttatatgaatttaattaggatacgtagataatgtaagtttttttacactagttcaatcataaattgattttttttgtaataattactttaaatatatcatatttaaactaatttttaattagttgagaatatacattttttttacttaatttaacagtatatccaaattaaattcttttatattgccacaagaaaaagggcattgtaattctagcatgcataaacaaaaattggtacatgctaagtgctgtttgttatcaaactcctttctttatgcaggtcaagatatatatcatggttattttttcatcagtattctaatccttaaggttacttcctgacaagtgcttttacagcctttgtttctgaatttcacagagtgagctaaagtacgttaaccaataaaatgctgattattcatatagctgataagaggctacttttttcctctcgttttctcggtttaagtgtcaccaactgcatgtacaaataacactgaatatggttgtaaaatgttcaatcaaatgttcacataataacaacaaaaaatggttgtgtttataggtaatttcgtaatcattgatgcttgtatgtgtgaatgctgtacaagtacttcactaatataatgcattcattttgtgaagtctgctggc

SEQ ID NO: 4678 - DNA, 1500 bp, Glycine max
  Soy_ogl_2668 Gm08:13861901..13863400 Cluster 20
gcattaggataactaacctagttttaatacctatgtacgatatagagtaaatactctaaagagtatactatactaactaactaaacatgtgtaagcattattttttttatccataaaaattaaaaataaatatcagagaattttaaaaaaactcagttatcttgttaaattaacttaactagaacttcctccaaatatcttaatcgactttagacatgtatttacgtacgtgaaactttaatttcaattgaaaaacacttctagaaacacacaagaaattgtattcaaattttattctaaatattattcacggttggctacacaaatactgcattgactcgtgattactttgaaatcaaatcattattatgggagtttagtttgtctcacattgttgcctctgtcacattccagaatctagaccttgtttaaaccaagattcttttggcctaaaagcaccatgctttgtattggatgccagtttctgattggctaacactcttacatatctgaactttgttcagaggtttgacttcagtcaccattcattgaaacaagagtcgtattgaacaagggaggctcaaattaactcacttctttttttccccctaacatggaaagttaacccattttatcattagattattagatattagtaagtttgatttgtgctaactcatattgtgcacggttcccagcaaatatccaagtacacaagagattcttatatgtacgcgtgtgacttttatgtcctaaacattaggctaagtttaatctctcctcaattttatattattatttaatcataaattattatttaaagtattttaaaatttaataaatttatcatatataataaattataattaactaattatataaaactttttagactgtataactttttttttctctggactttaactagtgggatgacagtctttcacctaaaatatcagaacgttgaacatgcttcatttttgtaatatgtaattttattatggactatataatatatagtcatgtgcacgcacatatacactaatttaatgaagccatgtcctactttctttgacaaaactaaaaccactgttcctcttcccatcttgataatgctcgcatgcaaatggtaggcctgacataattaagacagatacattgatgatgagtttgcttgcacattattatgaaggggtgtgtctcctagctgagacaaaggtttggtttcttgtgtagcctatatatgatttaagaataggttggtgtgttcaaaattcttataaacaaatccatagtacttttaaccagggttatatataattaaaactaggcctagctagtttttttttttttactcttcatatatagtaccatacagatgatgtttacaatttaaactccgtatttgtgttcaaatatcttcttccccttataacagttcaccaagccagcattcttgaatcattatggcaaatgtagttccactgtgtataattaata

SEQ ID NO: 4679 - DNA, 1400 bp, Glycine max
  Soy_ogl_4155 Gm12:38648301..38649700 Cluster 20
gctttaatactttttcacttgttactacttttactacctgattactaacaatgacgcaattaagagacatcatacgttatggcaatgacatatatatataccttattcccaacaacattaattgaatattgctttgccatactaatgccacacgccccattttctcaatgtggctctttatgtaactttccattttcatgctagtatctggctggcatctctgcttcacccacactggcaataatttaagctgttacaatcgtcacaataggacaataggagagggggccagggtaaactttcatgcatgtttgaatagatcgatggatgaaaaggcttcaagatattgttggctattctcaagggtcctcttcactacctgctctaaggttaaaccttaccaaaaaaataataataattaaaaaaaagttacaatgttaataggaggtgcattaaatttggagtaaaatgaccagtgatgacaggttttttaccggaagaaaaaataaataaaaaataaaatgacctgagctgaaatctgaaaattcagatttgagttgcagcagaagaatggtgacgaaggagttgaagaaaggttgggatttgactatggaggagttaaagaaaggaaaaaataaaataaaaaatatatattaaaaataacaggctcattctagtttcctttcttgaatctcagccacggaatattttagtaatatatcctacggtcaattcttgtccctcatgggtgacaaagtaacctcacggattcgtattagacaccaccttaaatttgtccctcccacaactaggtataaactatatagtacacaccaagtccaaaattagactaagaacccccacgtgaaaatgaaccaaagacactcctcaagccatccctgtgtacctcaccctctacaactacctattaaatgtaacaaaaaacaaaataacgagaaacatttctccttgctaaaagcaagctaatgagaaagggaggatattttagaccatgatgatgtatttacaattagacaaatacaaacaggtgacttaagaatattagttaaaaaacttaaaagtaaaaatattttatttagagatgaaaaatcatatcgtccattatcttttttatattttcttatgatttatataataaatatttttttattttagtttcttgatcaatgctttaagaagaccattaaaattaaattaataactatttaagatgtgcttggatttaagatgtgcttggatttaagatgggaggatccaaaagtatatatgtgtaagtgaaaatgagtttcaaattatgtttgattattcctaaaactatgtttactagaatttagtttgaaaattcaatttaagaaaagtaactattaggatacttttac

SEQ ID NO: 4680 - DNA, 1250 bp, Glycine max
  Soy_ogl_336 Gm02:2929368..2930617 Cluster 20
aaaatatttattttgcaagcactcaatatttattattattatttttaacgaaaacaatttcatatcaattttatgattaaaaaaaaattcattgggagtagctaacaacttgccacttgaattgtgattggtcggtactaagttgtcttgtaatagaaggacaacatttacatacaggaactcatacagttgtctcataattaatgcacgtctccatgcatcatatatgggataaaagtatatcctcaaccttttcatgctatcataccaaaaaacaagtgtctttgcgtctgttcagcaacaaagtggctttagaaggtgttagtgagataatgctacaagttccatatttttcgcaagccatcttttcctcttgagcctgacctcatatttagagcataaaccccaatagatattatagcagctccaatcaaactgcacaacaaatcaaaatccaacaacttattaattacaaaaaatacaatagtatttactactttggcgcactaacattattttcctcacaattatatattaggctttccaagaataccaattaaaaaattaaaaggaaattttttttatgtgaaaatcataattaaatataaaaaaattataaacaacacaatattacgtatttcaataaaaaaaattccttctattatttgccttctagctatatgtgtgtaccttccaagatacagagtttctcccaaaattaaaatacaattcccatggctagtgcaacgaaattcctaatggatagaacatagcaacatatataggccccttctttcgacacgcccatgcatacacaacacttcgcgtagacatcgcaaaaattgcctacaatgcaaaaatcatataattaactacaactgtaaaataagggcatatactcatatgtcccaaatgtacaaaattattagtttgcatgaaatagtatttttttttcttctttattctagtgtccatacttacagtatagattatgcacaccaactccatatcaggtttaagtacccatgccttaggatcttcctctgcaacaaattaaagctaccatgaaagataggataacagagaaactacaactaatggttgttagcattagctcttcagggtagtctttgatagtccatgtctgcataatgtatattttgttatgtgaggacaaagtgtcatcatgtataaaacatagttattaggaattggtatatataatcttactttgataaaaataaaataaa

SEQ ID NO: 4681 - DNA, 1500 bp, Glycine max
  Soy_ogl_755 Gm02:50147901..50149400 Cluster 20
tattgaccaattattacaaattgaaaatgagtaaggaatagagacagaccttcgagggagtatggatgggagatgcaaatttagactttaattagttttattcattaatttagtttttaaaactagttatttatttgttttttttattgatgtgacatcatatattcactgttggtctatttctgtgcttaaaaatcagtttaattgtgatattgtttggaaagcaacttcatttagaaagaaaaatccagccgttctaattcaaaatgtttgcactaagttgtgactagtttgtagtgcatgatttgagttttaatatattcccaaaaccttaattaaagtacaattattttttgaaatatcttgaagtacaattattatacatgtgaagtaaatgtttacatatttatgaaacaaacacgagacaccaataaagctctgtaaagcgtgaattctggtgtgcccccaaaaccactttccaatcctgaaacaggtccctcctccaggccaagctaagtgtgcataagatttaattgtattgtgaatatcattacgcagtcgaaagactaacaatgcacatcccaattgtatatagtaaaagctcattatggtataaaaattgttggcatctaaaaatatagatattttgatatcatgagagagctacaagagactacaatttggttcaagattagatattggagtgattgctgaagtgtgcacaatgtcagtttcatatgctattgttatgagatgtgtatactcttggggattgcagagctagttgcagcagtaaggtattcccaactaatatgggggtgtggttgtggaatatagtgtacagatgttcaattcatcacaccattttaggacaagattttcgtatttttggggagatgatcaagggggcaacttcattcctcacttccacgatattatcagaaattaaaatgtgttactattattgcgttttgatcatcaaaatcacactcccaactgaaattcgtttcatacatttgcttaaatgatggttttgggccttttttgggtacacaaataaaattttaagttctgttggcccaaacaacaaaaatagcccttgtgcccttgttaactgttagggaattctttctgcaccccatttttcttcatgcaccccacaataataattaaaagataaatttacccttcaatcagcatcacctatcataactagtacggtaattttatccttatgtttaattttttatttaatataatgaaataatataaataatgctatattataattttgataatttgatcttttaaagaaattatatttaatgagaataagagaaagtgccaagattttgtcaatattagaagagtaaaagattttgccctctatgtgactcagagccagaaactataattcattctcttggagactgtgtatggacaaaggaggtatggaaaatgtttagtgttaattaccaatttactttctttcagcatgat

SEQ ID NO: 4682 - DNA, 1768 bp, Glycine max
  Soy_ogl_1033 Gm03:42045633..42047400 Cluster 20
tggtttctcaaatttggttacaacattttattgaaccatttaattgatattaaaagttttaagaagttttttaaaagcaaaatatatatttataactatcaagaagggctatctactgcccaaggtgtatagagatgcctatacaaatttttaagagaatatattagatgtatgttaggaaagtaaaattcacctcttcattagatagaagagcattcaaaattaggaaggagaggggagagtggatacacaaagaaacaaataattttacacattttttatccagatagggctatatatgttccttcttgcattttcttctttaacttttcgtactacatacaacaggttttaattatatcaattcattccaaagaaagggatggatacaagtaggaatagtctcaaacttttgcgagctaacaaagaatctagacgttcttatcgaaaaatgaacaattcaattaacttacctacaaataaaactcatataattaagagtcattacagaaaatatagccttcctacattttgacaaaatgcaaccaaactcagaattaattaaatagtttgtggaaaaatattgtacaaatacaatttgtctacgttcattaagcattatacgttctatgtgaggatagtggaaggttagtattgaataaggaggtgattgcattgtgttgtgaccttgtgggaagtcaatgagtaccatcgaaagtatcaaaagcagtactccaccgaagctttaatttgcctaaaccaaactgcttatttcactaaatactaattatacccttgaagcagccggggacaaattaacgtaagtagcatatctatagttagaacttaactcgagctccaccttttgttgagcttattaactatgagaaagcccaatgatgatttagttactttctatttcaacaggttaaaaaaataataaacaaataaattttctaattatataatgaataaataaataaaaatattatacactgattttgtatttttaaggcaatgattatttttaacaaaattttttagttccttaacctatacatgatcattccttaaacaaataatatttttttagtaccaaaggaagatagatttaaataattaaagctcaaggtaaagaaactgcaaaaccataaaaacctaggtatacctagaagatatgtagggactagagagcttcttcgagatcttgagagtggtcctgtgtacgtgtgtttgcctgaagaagatggccatgaactacacacacatttgtagctatactcatgcagaagaaatttgaaacattgaattaaagtgttaaactgctgccttacaacataattaggctttgacctttaagatttgtatatatatatgtggtcctgaacgcgttggataacattgtaaatacattatgcatgtgatgagtgaactttattcagtagctagcaagtaaaatgtttcactgagaggaatttctaaaactacgtcactaaccctagctaccacacataagtgatataaataactcactatacctaactggcctaagaaatatatagttttgaaagactgatcgaaacagaagcaataggcaacaactatatgtgactctacgtaaacggcgccgaacatggtcatagaccactacgtgggtatttagttgttgttactttgcctcatccaaataacgtaagtgcatagagattctagctagagaagatcaacgtcctcctacgtgctgttatttgcaactttaatatatatg

SEQ ID NO: 4683 - DNA, 1800 bp, Glycine max
  Soy_ogl_1784 Gm06:3395801..3397600 Cluster 20
tagagtttattataaaaattcacaaacaacgatctgatagatcgatttaatgactcgatgaattaaaccatacttttaaacttacaatccaaaagaaactaggttaatttggtctatctgtttggatcacatggaacaaattaaactaaaaaaatataacccaaaaattataattatatttgtccaattttttaaatgtaagatatttgaaaattaatatataaaaaaacaaatcaatttgatttcgtgtccaataggctataccaaactatcaaataaatgactcatgaaaattagaacatacttgacccatcattttaagctttagtccgtcgaaccgaacaattatttacactcatatagtcatatgttatccttttcatttttttttccatcacatctattattttctctttgttttctttcatctctattcatttaatccctgatctatcccaaaatgaaattaagaacatttaagtatttttccgtttttgtgggtgagactcgcatataatatctcttttttcatgaagcgagatagatttctctcgattctttttcttatcgcaggagtgcacataagtacgtaaggccataacacttaacagcatatcaaaggtaacaaacgaggaaatattattatttaattaggactggaattcatgtatatatgtttagacatccaaaatgaatgcggaacaaactttatttgttgtttggaatttagtggtgtaacaattgaaagttgctgagtttgcaattgggcccctcttactgcaagaaactcgacaaagcgagttaatccatcaagacaaagcacaatcaaagttgaagggggcctaagcactaagcagtataccttcatctggccaaacaacaaattcaatcaattctcacatgctggagtttttggaggtccagcattatgacaaaagcaagcattcatgaaattaaaatacaaattaatgttggattggaccatcctttgctactggatcagttaatttcaatcatgaattgatcaatatcaccaaatgaaggtgctagctagacaaaaaatgaaagaatatcaacacccatgaagggaaaagaaaaataagaatcattaacaaataacaatatagtgagaatcttgtgtggggtatctaagcttctatggccatccttcaagaaaatgacttttaagtctcagccaaattacatgtattccaatatcaaaccacaaatttttaacaggcagaaataacacatacgaataaatattcacacacctaagcactgctagtatgcgactaagatatataagaacccacataatacacgatctttaagatatgaatcatatggtagctgttaagttgcattctcgtaccagaaaacggacaaaaccattgggaaccattttttagaagccgtattatgttgaattcttacgttttttcggggacctccctgattagaacaaccagcaaagctcaagtgtatccgcattagtatgattaactaaacacatgtaattagaaaagcgtgcgcaattttgcatatgcttggacgcgcaatagtcatggcgatcaaataatagttatctttacgttgctggttgtttcgtattatgcgacactttcgaatgatacaaccttaaagtcactcagcaaaggttgttgaggacccaagagttacaatgacattggataatgattatttgaaaaggaaaaaaaaaaaactgtatatatagtcaatcattaaaaatgttttctttaaagcagacatggtttcacaactaccgaattattgact

SEQ ID NO: 4684 - DNA, 2100 bp, Glycine max
  Soy_ogl_3620 Gm10:48497401..48499500 Cluster 20
ttctatttatcttttctttctgtcaacaaaacacaccgctgtaacaaaaaaaatactcatataattagataatatgaaatataaaatcactcataaaattcgtaacaacctgaaggacaaaaaaaaaaaaactttctacaaaatactatgatccgaatactaaaaaggctgcatcttgaaggtttcttcaacgagccgccgtccacttttttctagaaaattaactagagagcaatcaattatttatccgagaaaacaggagaacagaatacgataattttctttacttaatcaaattttctcatcatcagcagtgtctttatctttatcttttatgaaaataaaaaatggttttgtgtttcacaaccttagtcaacgagacacagacatagtaaaagccaacgtggacggtattatataatttacaattgaaatacataaacgttggctaagcaaggtacagatttacatcataataacagtgatgaattgaaattgtttagcttagacacatgattaaattatgattagacgcatgtaacatatatttggaagaatattctacatgcatcacaaattttgactttgatgggaaatataggggagggggaggatgaattttggcacttttgagatcgctcccacgctttgttcacgtgcaatactgaataaataaacgcatagggctgcctgaggcatgtgacacagacatgcttttggtgtctgtgtgtccgattttgcagttgctcataatacatgtacgatgtgtgggctcttaattactcatttcaacaccctccttgcacatgatcgtgagtgtgacactcagcaattagcatagccacccaatcccaatggcttaatgctattaacattaactacactataccaacccgtgtcacattatttgtcaccgtcttcataacgctccaattccaaacagagttacttgctgtttaacccccaaataataaagatctagataaacagtatcaaatatctgaacaacattgattaaaaatcatatttatcataaaaaatatgtaattttacacattcaaataatttatcttttcaatttcttaacaaatattttaagaacagtaattaacatttatggataggttacatgacagcgtggatagggattaggattaggatcagggagggaggtagtgagtggtgggaatattgactcagctgttgtcagatacgaccctttgagggaaagatgttgatgtcatttcaaacgggtattgtggcggtgtgtgtcctttggaattgtttgaatgccacaaagtcattaaccagaagatctaccccttttggcttgcccttcggtgtgtgactatgtgaccactcacacttcgaggccaggtaactaattttgtggtgtgtcaaataaatatgcgggtatgatgcaaccatgatagtacaactgttgctaacattcatgtgaatgtgacttattcagcatctcaaacatcatcaattttattttagagggatagaatagctatagctagctaggtgaaccgaaagaaaagaaaatctaagttgggaattgcgattcacaatgttttgtttggtcactttccaaaggcttgtgtttgtttctaagcaatttgtggtttagttttctgaattaggaactagtgccacactaaataaggctgttaaccataaaaagtaacgcatccaagattgtttcgcttactggaatcagttaatgctgttcaatgctattattacaattcaagcgtgtgaattaaggcgtgttcgatagttgtaagtttttaagtttcttaaaatgtgaaaattaaaatatattcaaataaaatagagttgagaaaattatctcacttttataaaatacatttatttccatttttaaaacaataaagatagattgtgttttaaaactttcggtagttaaagtgtactgatcaacgatacaaaatatatagttatttgtttgatttaagtttgacagaaagtatcgcaaataaaattgtataaaaactaaatttttacaaaatttaaaacgtaaaacaaaaactaaatttttacaaaatttaaaacgtaaaacagatatttacc

SEQ ID NO: 4685 - DNA, 1300 bp, Glycine max
  Soy_ogl_3999 Gm12:4599601..4600900 Cluster 20
ttggcactccccattgggccttgctgaataaaaaaattggtgtataaatagcgaaaaacaagaatgttggtaacagtggtcctcacgaaaaaaattggtcttaaccaaaaaaactaacaaaataaatcgtctaaattatactttaggagagtaaaaggctgtagaagcacattattgacaaccccaaatattttcgtcgagtatagtttaattattttcggagcacaactaaaaaactttaaactaagaatttatacaaatacgaaatatttcagacaataaacacaatttatcatatgtaagaagagattttacttaagagaaaacaaccgagagacaccttgcatgcgtagttatcatatatcatcaccatgttatgtgtcgagagatcattaataagtagaaatcaagtggaagcagtagtacacttgaagttttaagttatttacatcattatattggcgtcactggtaatgacaaggcttagtagcgttaaatttgcatataatgattaatgagcttatcgtgtcctcacatgactttgattctttaggtaaatgaatgctatattgaaatttcgaggagaattcattgcataaggtaatctaacttgatataatgaatgaggggaatgctactaataacttacatggcacgagtgataaatagtatcttacaagtattaatatcggataagaccatgggactcttgcagttttcttttttttctaaaaagttaagttggctcttctgtcttgtgaccacttaattttaagtaacctatttcaaaagtcaatacatttattatacattataattctatttttacaattggaaataagctcaggaaaagtcttgtgttgttagcatacgtttgattttctttaacttttgaaaagaaatttcgtggctgattttttttttttacctttggttgtaaaatattcaaaataataatagcttataagtaaaagaactccaactgacatttcgtatttgaagaaagaatggtgtcatttgagggaagacggcgtcaacaacggcaaaatgtgtgcaaaatttcgctacaccgatttcagctcttccatcacatggaccccaccgccgtctggtgacgatgataataagataaataattaaattcattcttcttaaaagtatgataaatgaattcataaaaaatataaaataaaaatttaatttctgtaaaaatatataataaattaatcctttcatcttgtgaaattattttatttgtaatgtttaaaaaataatttaataataaattatacttttcaaa

SEQ ID NO: 4686 - DNA, 1700 bp, Glycine max
  Soy_ogl_6939 Gm20:42581701..42583400 Cluster 20
gcaagttagatggttggcaccatttagaggtcgattaattagtagtaaaattgtgttaaggtgggtaagtttagtgtgatctcacagctgtaatgacactaaaacagccattatggttagctaaatatctgactaactgttcaagtctctttgaccatagcattagacctcaaagcaggtgaaaagttatgtaacaattagagactataagttaaagatcaaaagaaccaaatgttgcaagaaattcttgcacaacaatggctgaaataacgaaataaattaacttagtcgtcactcgtcattgctatttgaccatacctgccatatatgttccccccaaaaggtggggcttagagtactttttagaatgattgcaatttctttgggacctaattaactttgataattctgagtgtcatcttcggttccttttccttacttcttcttacctgtttaaggtggatgaagcgtaggtaagcagtgaccaaatttagcttcaaacttaaaagatgaagtggtcacaaacgcttccttaaaattaccccattatttgttaggtcttttcctaaaatatgacatgaagattaaacacattacttgtggaaaaacgttaacgtttgggttctaccaacaaactaaaaagagaggatggtgcagaaaacaatttggtcatcaattgaattacagaattatgaggcacgcgctaacacatctatgtcaaaaactttatgacaagtaagagcatatatagtgtgaaccaaactaatcgacgttgttgatatctgatcttcaatgtgttggctgtttggcactaccgaccaatttagcgaatgctttaatttgttttatttggacattaatgataatcgtatcacttacaaaatatgataatgatttattggaaaaaaccgcttaatttgttccttattttattcgattaaatcgggattgatttggaatttgcatgtgaaacaattaagaaaaatactctctgggtactttgacccacatcctttttccggagcacttttctacatttaaagccaactttttgactcaaggattatgcaatatccatggtcaatcagtcaaccttttggattatatatccactaattattcaaaaaaagatagccacacgcttgggtaggcttacatagccatcatcttcaccgtcatccaccatctcatgcttgtctttggaagtccatgccaaaatcatttgaagagcccatggagtgattttcaaagtaattattttttttatcagcaaagaagtaattaattatttattattcaggatattttatgaggatgaagatctaggtatttatttattattcgggatattttatgaggatgaagctctaggtattgagcattggattttcaaaattcacgatagtttttcattaaggtagtgtttagtgtgagacacatattgagactattcctaaaaatatatattcagtttcttgatgacatgatattaaacatatgaattagtgatgcaaattcgacactcattatatacccatattctgatataaaataatttgataggttagattaagtattcatgagcttccaatttataagtgcattattggacaagacgatgatagatataggcaataggcgtactcaagtcatttatatacattcttccagtaatggtttaggagaattcattccttgac

SEQ ID NO: 4687 - DNA, 1800 bp, Glycine max
  Soy_ogl_1089 Gm03:44725501..44727300 Cluster 20
acatttaggtatgcttggctttcttctctcacactttcgtttatttttaaacttattgaatccgtcatttagatagcttaataatattttaagtttaaagtttatttttgcaattaaggatgtatttgatttttaaaaaataaaaataaaaaaatgattaaattaaaatagaataaaaaaattcaaattccactaaatataatacaaaatttctttaatatattatttatctccatttaaaaaaagcctaaagaaaattctactattggtaacatcctcaaacggtagatagaaccataaattggagggagtaataggggaggggcacagagacattgtcgaaaaaaggtgttatcaatgggagggagcaaccgataacaagaaagaatcgcaattgtcgaacaacgtgacaagtgtaaatctacgaatgacttttttgaaatgctcaaatgatacccgctcctgtctcggggacagaaaatcaaccttattatttttatttttattttgttaacaaacacacacaaagcaaccaaaccacacttcttttctcccacatagtatcatattctccattcaacacctcgcccccacgtgtacgatttcacgcgttcaacgcaattttcgtctccctcctcacatgttgatatttttccatgttggttcacaggcataaagagggaacaagaatttctatgtttggatctaaagaaacggcgaatgctagcccaagaaggaggcttgacaattataaatattcgaacggaaaatatttaaaaacaacattaatcagtatctttgcttcaccaaagaaaattaatcagattttattaaaaattaaaaaagtagaaacaatatttctatgttactataatagtaattcaaaaaaaatattattacaataatatcaccaaacacgtgaatttgaatttgaaattattttagtttaattaaaatgttttagatattaaatacttctggtaccacattataatatacatgtttttcagctgataaataaaacttgtgttctaaataaataaaaaaaactattactataataattgaaaagttagtatatttttttatgatttaatccgtgtctctaagaccctcgttaacagaatgaaaaagaaaagttaaaatgttccccgccaccccaaccataactccataaggttgctttcattagccatcaatttgtcatttggtctccaacaccgagtatttgcgttgaaccttagaaaagcagcgtgtaacctacattccccttttgttcaatagcaggagtaaatcgtctgatttttctaatacttggcgtctccgtcgtctttgttaaccccctttaggctttagtaattgagttcattagccagttcagagtctttccgtacaaagtcgaatagatgaacaatagcggatgcgacacctctttaaatttctacttttctttcttgtgaaaattctccccaaaacttgcaaacgcaggaacggttggttgctttcccatacagtactcattctcattgattcttattttatcctatcttaaccacctaaccagttttaagtatatactgattaatcgaatgacaatatactctttgttataagagattgatgtctcataatcattcttattatgtattgaaatgtttatacaagattttgatgtgtatttcagtcgaaatacccaaccaaaatttattttcattatgtaattaattatatatacatgttatttgtaagaaaatatttttttaaatagtaatcaaatttattatgatacaaattacttat

SEQ ID NO: 4688 - DNA, 1401 bp, Glycine max
  Soy_ogl_2248 Gm07:71901..7451001 Cluster 20
aaatatttaaaatttttaacttgaaatttatttcataaatgagtttaattttggtacataattgatatttttcttaagtgattgatgtaaacataatttatacactcaactaatttaaaaatatatgagatataattttaataatagttaaaacaaaattcaaacttttttaatgttttcacaatctctagttgaatgataatgtaaaaaaaaaaaaaaaacagacccattatattttaatttagttctctaagaatttttttaaaaacattttatgaatgaggataggttgtggacattggacaacgcggaaaaggtcaccttatcatcagtaacattttattttatttttgatggattacaaaagcaagaggattaattagaaacctatagggaaagagatatgagtcatacctactcttaacttatcaaaaatacatcgaggataaaactcaaacacctaaaccattgtcaaggtcgaaatatatagtttgcttagctaatgcttcatctacttgattaacttcttgaagaatgtgtttccaagtcacatgtccctgaaagacataaacaacatgaattcctttgatcaaattataacaaagatgttgcatgcagcaaccttgaaagaccaatttaatagcaacttgagaatctgagtcaaccctgatccttctatatcctctcatccctgaagtttcaaactaaatagaatgtctctcaattttgcttcctcaacagaatcaccctcgacatggatttattttcaaattaattacacttttctatcagtaaattagttacacttttaaactaaataaaaacaatacactttctttttatataaaataagatataatatacatgtgatgattcccccattttaattttttttacttctaataaccaacgatacgatatgagttttgggattgatgtgtttggttcttatcccattgtgcttgaattgactaaactctcattctttttatgttgttgatgttgagtaactttatatctcttacttttgcaattcaacatcatatcagaatcgtctgtcccccgctatatcgtggactagagcacccaatgctataaaaatatttttttaaaagtcaatcgccattatactttgaagttcaaatttaagtaacataaataatttgtaataaaattattcaagaaattttaaacaatccctgtatttgaaatgtaagcataaatattgttttactagtaaaatatatagaaaaaaatagaaaacaaataaactgaatcagacttttggtcgcaaatcttacctgcttatagtttgcaatatttttttttcatttctttttctgaaaacccattaattgaatctctcctcttcactccatttttttatgcttctcttaatta

SEQ ID NO: 4689 - DNA, 1038 bp, Glycine max
  Soy_ogl_4990 Gm15:11287301..11288338 Cluster 20
aattgcatgcacaagagatacataaactttctccattccaagactcaacgcatcacgtgtccaaaatcaggtaactaaactccaaacttccaatacatattgatatgcttgagcacatataggtggagtttttacctattttctctgcatgtaccatataactgcagttgctcaggtttactatttttgaaaaaaacataatcatgttttcacgttttttatgatcaacattcggcttctcaggtttcaatcaaatatattaaatttgtaaatcaagcaattcaacataaatgattaataagttaaaattgattttttggataatatctgaataatttcgatcatttgtaaaaataatttttgataagaggattttaatatttaattaaaaaatcatttctttctcctatcacaatttaatattacttttatctttttcactccatattgatttttcatctcccaacaaaagttgtcattaaagagaagagagaaaaaagagatttttttttaaaaaaaattacatattaaattattataatgtcctttaaaaattattttaaataacaaatattaatttttgtcttaaacattttgctgtttatggctgatgcatattaagcccctctcccacacatatgtatgtattgtatatttttaaaatttggatccaatgcttccaattcagaatcatttgggttgtctacaaatgacaagacgcgtcctatcctttctcgattcgttttttctttaagcatcaaactaattgccatcaattcaacttggattacatgaagatacgacttttctggtagctgactttcgagcatagagaacacaaagcttataaattataatggctggaaagtttgagaatactagaaaagtcacaccccaaaatccaaatgaccttttttgggtatcatttttatgaaaaaaaatctgtgattttaagctgagaatattcacttgcagggtgcagcatggtggaaaattggcctgaaagcgcttcatcgagttattcacctaattttaacc

SEQ ID NO: 4690 - DNA, 1174 bp, Glycine max
  Soy_ogl_2984 Gm09:4094127..4095300 Cluster 20
attgcggtaaaacaaagggatttttacctttttttactttggcttttgctttaattgagtttaaaggagcataaataaagggggagggagaccaacgagctaccatggagaaaaggatttatggaaaaagagaacaatgggaggaaaggggaaagaatttatctttgggaagagagaaagcagagattacattattgttaggaaaaagttattgtaattagagccgaaacctaaaaagatgaatgggaccaatgaggttcatggagatttgtataaaataagaattgaggagagagaaacagagaagcatgggttgggttcgtattggaaatgttaccgttaagttaatttgaagctatgagttgtaggatggccgatgggtgtcaagtgtcaacaatctagaggccataccatctcacccttttaaccctccattaatatcacattacttttttcagtttttttttaccagaccagtgtctttttttagcatattctcacaagacttttaaattaactgttaccttatcggcttgtttggttggatataaaagagtggaaagaggggtcatcgataaaattggatttatcttgtatgataaaaaactaagatcttataacattatgtgtttaatctatttctatccaacatacctatatttattatagaaaatggaagaaagaaggataggaaaacatttttttaattggttaatgaagagaaaaaaaattaaaaagtaagtgaaatcttaggtcatttctaatgctagaatccattttatggattcattagtgcaacatataatttaagagctttcaatatcttatatatttcaatgctaaaatttactctaatttgagttcttaaatcatttttattgaaattgtttttttctctccttttgttaattgtttttgtgataaaagcaagttattcaaggtttttgtgcaagataaggtttttctttttctttttcaggtgaatgctaactcatttctctccaatgcaataattaaataagagcataaactttactataagaacctcaacaaagactagtgctgggagatgcccttaattgtctttctaaattgagaagaaaaaaagtataaatgttgttttatatattaaatgactaatatataatgtgtgtatgtatgtgtattatgttaa

SEQ ID NO: 4691 - DNA, 1200 bp, Glycine max
  Soy_ogl_5577 Gm17:8092301..8093500 Cluster 20
tattatgcactgtcaatgtaaacaaattatactatcaaataatcaaaataaattattaatataattattataaaatttaataaacttgttgttctaactattcaatctaaaaaaaactatatactaatccaaaattgatgaaattacatcaaaatttttaaaattattattttgaatcattgttttgcataactaatcaatttggatccattttcgattgatgtttacaacaaaaacttatacaaaccgaaatgatattctttaatttacatttattattagagaaagaaaaactcttcattaataatataaaataatattatattattatccaattacaaattacactatgataaaattattaattttataataattatattaaaagtatcataaaattagtttttaaaagtttggataagtgattaacaataaatcatgcattttgacatgaaaaatttctaagaactgggtcatctagatttcgatcaagtaaaaccaagaaatgattcagctttctaatcaaacaacgtcgcctcaactgatctaggtcacgtcatgaacaacaaatctatagacagcacttacggtgtgtggtgtactagtgaatcatctggtattaattagttggtacgtaattggtattactagtactcgattgtttgcttgaaaggaacaagtttaaaaaataaccgttacttttcattcttattatttgatttgttagagaaaagagaatatatataaaagattggctcgtatatattcatttaagatcataatgagataattgaatttataatatcgagtctcatacatttggctcatcgcattctataattgcttgtctcatatgaacaatcaagatctaaatgtttttagccgtgactcaaaagtaaaattttagaggtgcaggagatagactcattaatcctaagagactttatctagtgaaagtgttaggtttgcaagctataagagtgtgtaagaatactatacacaaaaaattttactcgatttttgtgaaaaacatcattttaaggaagtagtttacccatgtcactcaattgcaaatttttgagacagaaattttctgtccattgttttttttagaaaaaaaaaagaagagagaatgagagaaaaagagaaatacacgtcattaaaaataatgtgttatcctaagaaaaagattaacatcaa

SEQ ID NO: 4692 - DNA, 1700 bp, Glycine max
  Soy_ogl_1019 Gm03:41561001..41562700 Cluster 20
acttgtatctttacttctctcgctcattttgaagtccatagtggctttatttttagcaaaaggaccattaaagctctggtagaaatgcacaaaaagattttttttttatgacaaaaacaaaaggctggttactttacatttgatttcttctaagctcccaagttcgtattctctttacattcctcttatatatgaatttcatacaccttttcaagtgtttttcatcaagtagcactcttcgcttctgtgcagcaagtatcgatttttgtttttttggtgaatcagcaagcatcgaatgatgttatttttatttaagtgacttttttttgaagatgattcacaaagaagtttattaaaagaggttatgagctttaacgtgataaactcttatttattattcgtttaattaagttattaaaatagaccaaatattagtctagacagtagatgatatattctcacctatggcacgttggataaggtaacgcgtgactctagtagacttggggtttactaccacaccaccattttttttatttttagtgaaaatttataattaatcttgtagcaattttgaaatctaattttgcattactaggtaactctattaattagataataaaataattaaacctacttttgggacaggaattgaacatgaatataaatatatattataaagtaaataggtaatatattatcacttacacattctaaagatattccaaagggatatttaccctttcaaattaacttatctaaagtgatgagacgtataaaacgtgaaagtaaaattgtatctaccatctaccgttgttctaaaattgcttaagtttgagttattttaatttcaattaatgtttaatatgtctttattttttctctatatatttcgttttaaaggagtcagtttgctttccttcaaatttatcttttcttttggtaaaatattattcccttctcgtgtttatttgacttttgtgttatttttatttatgtttaaataacatctttttgaaataaaagaatcacatgaaaacatatttttgatatattttattttaatatatatggttaaaatattttttatctttatatgacattagtcttaatgaaggggagtattttttaatataatctctaaaaaagtcaacagatgctaatcaaatataaaatataaaaataaaatgttttatttagaagaaaaaccctaatgcaccataaaatgacacttgtatattccacttgtcatcatcaatcctcttagatatttgtctagtgtaaagaaatggtgggcccggtttcacaatctcaactcaacttgaagtagctgcagtgaagggtatgctttgtaacggacaaaagcttttgttatcccttgttttttgggaaagagaaggggaggagagaggtgtttcagaagctgaactgaggctgtgttgagggaagatgagattttattaacatcatcaatttgctttattaataagatattattagctattaatagatgtaccatgtccacaagcaaccgaattttgcaaggaagaggcttttgtccttaaacctagccccagctaccgctctagcggttgcatttgttttcactcggatatttcacgttaccaggtgtagtagtatcattttactttatgacatggctatgcaaaattttgccagaaagcaagaaaaaaagataa

SEQ ID NO: 4693 - DNA, 1600 bp, Glycine max
  Soy_ogl_744 Gm02:49317501..49319100 Cluster 20
ttgtttaatttgctatctttcttgtccgttcctaatttcatactccctggctcgatctcatccacgtttctattgtgcattaataggagttttgtcttgactatcaaatatatacaatgacaacttgatgctgagatattgtgacaaatacttttcgtctgtatattaaatttgaaggtcacgacaaacttgaaaattataccttagttcatgtgattcgattttttcttcttcttaaaataatgtaaagacggtctaaacaacacaagagcaaaaaaagagaacgaaaatacgatgaatcagaaataataataattttaattgtttgtgaatgataacaattatagtaataacgttgaaaaacttaaagaaacctacatatatacgcctgaaaatagttcataataggttaatttgccagtcacctttgtacaaattaaatatcaaaatatattcaccaaacattgatttaatgacatttattacaatttaactagttaaaataaaatgaggatactttaataatttgtagagtatacaaaccagaagagaaaaaaaagaagctcttgtagtagtaattaattcatcgcgaggatatgaaatagagactcttttaaaaccatagaaacaattattaaacggcggagtctgtttttcatatgttcgaaaatggaacatcatttagacatggttataagctcaagaagattcttaaagaacgtaatcgaaatggatgactctgatgcatgcgaagatttagaaaatcgagtatattatggatgccaaatctaaaagtaaagaaaaagatgaaccattatgcaacttgcagttggtaaggcacaatgtagtacagtattattcatcatttgtacccattgatatcatatgccacttgaaaacaaaaccactctactttcttttataacatatgggaaaggacctgctaactagtattttattaacagcaccgataaaaaaaaatggtgaatagtttttattaaaattaagttgctgtaaaattatagtgaaatatggtattaatcatattttctgaaacctttttactttccaataacttattcaatgttttaagacatcttattaattaataaattaatcatatttctgaaagcttttttttttcttttcaattacttaatcaatgttttaataagacatcttattaatctgtcaaaaaaaaaagacatcttattgattaataatgtttacaaagaaaaaaaaatactgaaaatcatcgcagtcaaacaaaaaaaaactgataaccactatagtctattaaattttcaattgccccgatcgctactaatttttctttaaagcataggagatatggattgttaaataaaacaatattggaagtccggatattaaataagagtttcattaacattaattgttgattgaacaagttttactaaccatcacaagttctgtaaaaaggttatccacggtatcaaaccgtcatcacgtttataataactacgttaccagaaaaaaagacgaagttttatgtataaaattaaaaaaaaaacgaagaggtttttcttagattaacaaggtaccagaaaggtccacaata

SEQ ID NO: 4694 - DNA, 1419 bp, Glycine max
  Soy_ogl_2452 Gm08:1524001..1525419 Cluster 20
tatgctcattattcaaatgattattgaatgggtttcgaaattaatggttcaagtttttttccgtttcaaccctctcatccacaaatataaacatatatagttcacacattaaatatagactagcacaatcaacaaggattactttcgatcgatataaagttaagagaactgcattctctaagaaagaactaaagtccacgactaacgcgagtttgggttattaattagtttcgtggcaacacaagctttataattatgcctgatttaaaaggtaacaattaacgagaatctgccagttattacaatcagagaactgctatatggtaccaaaataatatcacacgaattgcacgaaaataatacagcattgaatataaacagagttgaatctgataaaaaaaaaggtttagtctcttttaaagccataaaatatacttcaaatctcagttaagaaattcaggtgtttacatttaatgttggattattttttaagtatcgccatctttataagagatatacatgagaatttggttttttgagaggagatatacatgagaataaaaatgctataatacttgtagaaatgaactaattactacttatttttagttgcacgtgctatcaagagaatccagagggaaatggacaaatggaaagtatgggaaaacgattgagagccaataaaaaacgtcgggtctaagtggatgccaaagcaaaccacttaagctttacagcacattaatccttatatatttatttgttgatactcctatatatatcatgtgaaagaaaaatagaaaatgaagtagcaattaaattggagacctcaataacaattaacaacattaaaaaaacatcattattttcttcatttatgtctataagcaatttcttttggaaaggtaggagttggtgggcatttgacttggaggtatttcgtggccccctggcttatacgaaatggttttctagaagcacacctatccacaaattctgcctttctctcctttgttttttcccctgtttttctacctctgctttttgctttaaaattttcatgtatgttacatgagtttttttcatacataaattgacgtgaattttaactaatagtgaagtatttattcgacagaatacgtaaaattatattattagtatttttcgtattaaaatgaggaaacatggaattgcgttaaaagtagaatatgagtagatattttatcactttcataaatggggacgaaagtttactatatatagttagatatatttgtttccataggggattgaaaaataatgaattatgaatatggagaacgtattttcaaagctcaataaagtaaaataacaattgttaatcaataacgtaaatatgcagtttttcttaaagtaatttcagttatttttttaaagatattt

SEQ ID NO: 4695 - DNA, 1399 bp, Glycine max
  Soy_ogl_2502 Gm08:4592201..4593599 Cluster 20
tatatgatatcatgagaaggaataaaatcttggaacccaaaaaggagaggtatcaattcactcacacttaagggaaggagagaaaagcatgagactctacactttcccatttaatttgggctcttcttttattaatttttagtataatatttctaaggatacgtttttggataagatagaatttattatgaaatggaggtattttttattccttatttaacacccattatctctcttttctgggtatcatatgccatcttttttaagggccctcccacaactttttgttccatggggactacatgttggccaccgcatatttaggcctctaaaactatatagaaatgcaaataatttggcatatagaaattcttctttacgtcactttgatgaaaatcacctcttgtaaaaaaaaaatatagtataaaataaaaattaagatataaatccatatgataaatgataaacgattatgaacagaaaaaaataagaataatcaaatcttaaaacaaaaacttatgtaataacagacaaagtttaggtcttaaaacacgttaagcatatttaaagtgaagtccttgaaaaaaaagaagtaaaagttagtctaacctaacctatcaggtgttatatgggctgtttgtaatggaccaaaataaaagcccattctcaaaatccagccctggaataaaagacccaaacatgtcatccaaagtctgcactgcctctgacccattttaactcagtaatgatcttgctaaccggggtttttaacaccaatggttaagagatcaataaaaaattctttataagaaaaaacaggtttgaaatatattaaatattatgatagaaattataataacaaagattattgtagacattatagtaaattacactttcatcatgatttttaagtgttgttgcatttcaattataataatattcagcatcttgtgcttttgtaagtattgttgggcacggcatttcaattaattataatttgacaaaaaaaaaagttggctaagcagaatgttgcattcatacttccacacgataattttatgcattaattatttcagaaagaatatttttcttttgaagacatccaaaaacattattattcaaatctatacgtgtgttgttgttttctaaaatctagtattgttatatatatatatgtgttgagaacaagatcagttaaaaagttcattctcttttatttggtttatgaaattttggagacttcttgtatatgattttttttatcaatgaaataaatattaaaaaaatttaattaatccatatatcttgacatttccatttaactaattgagttatacttctttgattttctaccaccatattgtgttggggaggtgtgagaccctaattagtccagatc

SEQ ID NO: 4696 - DNA, 1300 bp, Glycine max
  Soy_ogl_3389 Gm10:6405401..6406700 Cluster 20
gccattcttcactttttgctgttaaagtaatccaacaaattttacaaggagtgcaaaagtgatgcaaatcgaacattattctatttaatgttcttatccaactatatacatagagcgtttaagacagaaataaatattgccacaaaaggttgaattcttgtacatcttaacaaataaagctttgctatttgatgccacttggcacttgccccaaatgaaagttatgcaacttgtggcaaccccaaaaggtcattctattcacaaagagtgctagcagaatattttctcacatactctttgaacattcttttcataactggatgaagttcatgtcgattaactaaatgaccggaattcaactctttatttaatcgatcacacttcttatttagtggaattcacatggagatcacccaatcataaagttatcaaagagtagttgttatcatatctttactacatatcatgattcatgactagagagttgagtctatactcaaactatgcatcctatgactatgatcttttgctaaacgagtgtgttaattaaatcttaagcacaaaaaaagagttcaactcaaaatataaaaaataaaaattatttttttttcagcaaaaaggaacaggcatcacatcagggatgaacatcatacttgttgatcctatacccaacaaacctaaaaatatgtatatataaacagcaagaaagatacacaatacttaattgggggaagtggggaatcaaatccaaggagaagccaggaaaacctgtaaaacggaagcccttgcttatatccaggggtgaacccaagatttaatttaatgtataggggccaaaataattttttcttcttcactggaaagatagaatcaaataaaaatataagcattaaaattcatacaaaatatttacatattttctaaaaagatctaagaatatataataaagaatagagactatatttacatagaaggtattaaatatatttttaaagacttaaaatttacaaatgacaattttcaatttgacatgccaccaagatttaaaaagaagatttttaataaatttataataaaaaatgatatttatgttaaccatatatttttccggcaacattaacaattgattgtgtgtccatgttgaaatagttattagtttacttaattaagagtttaataattacgtatggatataaaatagttttacaccatcatttcattattgttaatataatttttaaagtaattagcataaaaattaataattttattatacatggtcagttgtaatttaataata

SEQ ID NO: 4697 - DNA, 1900 bp, Glycine max
  Soy_ogl_3461 Gm10:39907801..39909700 Cluster 20
tgaaggtataaaaagcatttgcttgttccccaaacatcttattatcatcttgctcctgtttatgcttcaggaacctagtgcttgtcccttgcacctgtttccctggaaggaaacaccgaactagacccatttttattattattaggccaagcctgagaagaaaaccctctagaaaaagaaggaacattgatattgttaaatggtggtgaagttggcaactggggaaacattgaaggacccctaggttgaggggtagcataagggtggtcaaggttgactccataggagcgatgaggcatggaattagtattattcaagaaagaataatgcatgtgggggttgttggaggaagacccaatgttcatgttattgttcaaacttccaaaatggttgggcctcataaacctgttggcaaattcaggattcatgtcattacgaagttgaagtgtgtgaacttgaggttctgcagggtttggggtattcatcagaaaattcctagtcattagagcattattggttggtgcaagttcttcaccaccatcatcttcatcaccttcatcatccagtacaagtttattcttgttagttatccatgagggtggctgttcatgattgtgccttccatcataagtgataattacatttttattgttgcgcgaatcccgttccacgtgtttccttacgaaacacccagcacttgcgcatttgtagtatgccctacaatagatatccatgaaaactactcgttaaatgcatatgaatgatatatatatatatatatcatactaggatgaataaaatttagtctctattgtgaagtgtgaagagaccttaatgtcaatgactataataattaatgaggatgcgtttatgcatgttgatcgaaggatgggagaaacaaaacaatacataatttttcttgggtagaaaatacacaataaatggttggggttgtaacaatttttttttttttacttttgctgttatttgataattaacctgttgacattagtagagatagaaagacaaatggtatggttgaggggagagaaaagagcatttcggaaagatagtcattatgagttgtcacaagaaactgaaaaataaagagtgaaaaaataataaatgtcacaagtaatgtaaaaaaataaaaaatgagtatatagacataaaacattattaattttttagatattaatgctatgcatgagataaaaattaaatatcttcctaattggtgggcaataaattttaagatttatatcttatagtttactttttaataattaatttgtttcttctagtaattaatcaatttcaaaattaaatatgaagcaataattaataaatagaatatatgtaggttcacacacacttaattacaaaatatgatatatgataaatttattatttttttataatagttatcttaaaaataactcaaaagacaatttttaattggttatcaatgtaaaaaattacacgttcacagtacatatctattaatttttttttaaaaatattccattactcatcagtcatcatacgtctcttaatttttcatttcctttgttattttcttctctattgatccctctcatctacacactcatttcataccctttccgacgaataaaaggaatcattattaatcaaatgataagcagatatgcaaataagtgaaatagccatgagtataatattgtcaaactgaacaaataaccatgagttatgcaatttataacacatagcatcacatatgcatcatatcatccatgttgtaaagaaatatatataaacaaacttgcacatgcagcgagtgaagagagagctgaacagtatacctagggtatagacatcccttcataatcttctggccatatttgcgccagcgatatcc

SEQ ID NO: 4698 - DNA, 1315 bp, Glycine max
  Soy_ogl_4654 Gm14:4640686..4642000 Cluster 20
tttatactaattaacttaaaattaatatgtatatacataaaaagtttcaaaggagggagaggacacttgggcccttgtccacccctttaaatcgaatgtccctctatgtcagattattgtaaataaaaaaaaatcttcaaatatttaacaattgtataattaggatttgaatttatattatctgataaagttaaaataattcattcatgtcatttaatctatatattgatggtagaactagtaattaagagggtaagacaaccaactgattagagatgtttttttttatatatataaaacttacaaatttagaattaattatcaatcaaacgacgaagaaaaactaccggtcaaagtgctttatcaaatacttttttaggtagaaaaacaccctatattgttttgtaaaaaactatgagaagttttttagcaaaactttagtaaaaaaactgaaagataagatgtaacattattattattattaatgataaatttattaacttttataataattattttaacgatcaataaattctagttaattaattgtgtaaatttttttatattaaagatgtatacctaacatttttaaaaagtaaaaacatcttattttaggattaactatcaatttattaactaatgaaattttatattaaaaatatatatctaacatttttaaaaggcatcaatttagtttccaaattttaaagctccaattaaatcctcaaattattttaatgtattaattaagttcccaaataattgattccattaacagcgttaagtcggagactaaattgatacagtttaaataatataaaaaaccaaattggtatttaagtttttattttattttcaagaggaggtggacagagaaaagccaagtgtctgccttctatgggccccgtgttaactttcgagtttcgtgtgctggtgctccggagatcagatcccggaaactcctttgaagattgaaatcggacggtccacgtgacccttcaggcttcgcatcaccgtccatttcgatgggaaaaaaatcggaaggagcaagcgtgcacgatgcaccatactggtgattcacgcggcacctgaagatgaagcactgcacgaagaaacagaaaatcggaatacaaatttggccagcagaggaaccaaacaaacaaaagccagaagaagaagctcttggattggatcatcttcaacaatgttctctcgattctttcacaaatctccaccgcaacagcgccctcaggtacataaacaaacgctattcacgctcattgcagattctagcatcttcgattttttttttctg

SEQ ID NO: 4699 - DNA, 1149 bp, Glycine max
  Soy_ogl_6343 Gm19:2457352..2458500 Cluster 20
taaatttaaagttgaaatatatatcacctaaaataaaagtttaacgacccaactaccttttgcatccttgtgtcttcacgaaaaaagagatggagtaatggtgatgtcgggcccttttgttcaatttaggcataaaagagcatctacgaggcagttgaagaacaatgttctcacatggtgaccaaaaatagataagagaaagaaaaaaaaagggagtccttttactttagtcttccatcaatatcacagaccatcattacataaccgaagatatatcagagttagttaaaacattacgaatttttgtcttactatattacattattattcttctttagttttgaagaagctagttatgcctaagagaacataataatctctttttgttagatgaccctcttttgaatttttatacatacaccttaattaacccgatccactacacacatgcacaactttttttttgttttttggattcgtgatcacatcaaatatatttaatatgcacttagtttttgcattgcacatttaagttccatagctgttaaagtgatgtaattatctccatcggcagctgcaaattgaatttggatgtataaatgtagtgtgcttagcgatgtttctcgtaaagttttcaagagaaaaggaaggtaaatttaacatgtaatgtttgagaattttctcagagggggaaagtgtgcatgtttagctgatattgctgtaatacagaaaatgttaggatatcgatcttttggccctattacattaatctcctgttcatctatatcaaaagggtcatattattcatacatccaacaattagtgtggttagttttccaaaaattttatcagcaaaaggacataatactattttcgttcttcttttttataagaaataaattttaatataaaatatactaaaatttatttcttataaaaataaccggaaaatatatatgttaacaggtacaagttgtaccaatggattacaagaaaatttggataaccaaacaatgtaaccctagctccatgcaggatcctaccccaacatttttatatatctcctatatatagtatgatagacaaacccttcacagcacatagtttcggaaattcctaacccaagtaatattaacaaaagccagagga

SEQ ID NO: 4700 - DNA, 1200 bp, Glycine max
  Soy_ogl_1349 Gm04:42527501..42528700 Cluster 20
tttatgtttgaatttgcttgccccaaattaagaaaaaacattgaacccacaaacccgtgtgagtttgcttccagaaaagtgttttcatgtacattccagaaattagattaaaatatgaatttccaatgtgactttcgtttcatttgttccatattggctaccatgacttcttgtgcataacatcaacacaaattctcttacaaaggtaagaaaattttaaaaaattaagaacatgactcttgcctcctctatttcacagtgaaagacaaacgcacaagagagaggaaaaaatagaaaactaattccacattggcaatgccatccccttcgtcatattgagttgcttccgtggtgaagttttcttcatcagatacacttatggagagaaataaggaaagtgtattttattgggtatttttgggaaaacaaatcaaaaggaagtgcagtagcaacaatggggaatggaaatagcattagttttttttttaaggcaaacaagagaacgtgtatatatatatatatatatggaattatatcacaagatgtgccattaattccaagccagaaatcgtatacatcaattttgcagattcataaaacagaatttggatcatcctgaatactacaaaatacccaaaaagcgtcctccaccacagaatcctactattaagccagacagattatatataccaagtaaacatataaatctaccgatcaaataaatattatgatgttataaaaaagagagaaatataaaaaaataatatattatataaatttaaatattattattcctagggaaaagaaattcacgtctctctacttttcttttaaaaaataaaacataaaatgaaagaggaaaagagagggagaaaattgaataaaaaatgaaagtgtgcaactaactttataaaaatgaaagtgtacactgtacatctcaagaaggaaaaaattacatgtaagtggtgatttaattcgtagactttgttataaaaggttacatgttactaaatacacactagatgtccttattaggtaaatattcgcaatacacggatttttaaaatgtaaatagttttttgtatgttctctaaggattgttaggttggcagcaccagcacgtttcaatattcttttagtatttacgtgttagtataataggaccaaccatgaaccatgtacatacactacggttgtcgt

SEQ ID NO: 4701 - DNA, 1452 bp, Glycine max
  Soy_ogl_3935 Gm11:37062901..37064352 Cluster 20
atatcattatgaaaccactttgtatggagcttttgcgatttttatttttcaataatttgactcaaaataaaaaaagaatgttttattaaaaaaattgaacattaaaagggacagtaaaaaaatgtctcctttagtcaaattgtatttttaatatgcatgtgtacaaaacaaaaaaaaaagtgggagataaaaaaatatatacattatttcgtaaaatataattagttcaaataacgaaattctttatcaataacctaaatagctccaaattttatgtgggtacatggctaccaacaaaattaaatataaatattgatgtcatgtgaaagtgactattcatgttactaccatacaattatttgtatagacctttacagaccctttaccaacaacttattagccagcctaaagcaatccacaacaacatactaaaacgttttgacttggggagtgatgatctgaaatcccaatttatttataaagcaatccacaacaacatacaataacttttttggagtaataagcaataacacaatttggggactggctcaacgagaaaatggttaactggagaagataaattgcacatacacttatcacttatttgatgtttgaaatgttattggttggaaaaagaaaggaaaaatgattaataagttaatttagaagaaaattgtatatatgatctgttggtaaaccatttgatgcgaatctgccccctcaacttgttattttgtggcatgacacttggatcttttggtttgtctgcatacatatgttgttctttctgaaatcaatctccctctcgttgtcaaacactgtcctacgaatcctatgctgctcttctttctctctcactctcaacatttcatctgattggtgtcaatcccatcgcggtttccctcatccgattgaacattattagctgtatgttcccatttatttgcaattctctctaaacatgcatgcaccttcagctgaattaatctttagtggacatgtgcaaaaaagaaaagaaaagtaaagacaaacgacattcaacaggatagatttgtgttgcatgtgtttaattaattgataccattgcatatactttaactaactaaactcaaccttaatagctagaagataatatttcatttttcgttttatattttttagttttaaataaagtaaatgttgtgaaattcaaggagtttaattatgaggaagtgccatacatccaaagattcgaaccaagtatctctttcttcctctttctcaattcaatcatcaactcaattctattatttcttaatataaatgaatctaatttttttaaaaaaatattttaaagtaatataatttatatttaatttttttttactttaaaagaaagttaacaataaaatttagcataagtttttatgcaacttaaaagctacccaaagttatctaactcaaaatcaattt

SEQ ID NO: 4702 - DNA, 1375 bp, Glycine max
  Soy_ogl_331 Gm02:2719201..2720575 Cluster 20
gtgagtttgagaaaagttctattcgttacacagtgcataaatgataaaaccatacatcaatacacatcattttatttcagacctaggaactacactataagcgcttggcagaaggaagccttattgttggaaacaaatttcaatatgcagttttaatacattggtaagaaagcacaactagatgtaagaaagctggtgagaagaaaccacgtcaattgaagcgatttttttttttttcaaaagatggaagaaatttaattctagatgtatataaaagatattttgaattcttaattgaaagttgaaagttgaaaaatacagagtgatccttaagttttgattacttgagcaatttaaactatttttggatgttatgttagaattcaggaggtgataaaaaaaaaaatctgacttataaggaaggaaatagaggagcaatgctaaaatttatttgacagtgtttgaatgcttaaaatcctaaaatttggtgaaaataacaaattaaactctttaaatttttaaaattattctcttcctattgttggcaagatattaaaagtcaagagagttatttctagacatacataagaagcaaaaaatatatagaaaggaaggaataacatccacaatataccagcacaccaatcataatattcactgcctccatgaaatcacttcaacacagggaacgtgagctatttttggccagtcctctcccatttctttctcacatcgtttctctaactcgggatggcaaccccaaatcattaattctttcagactgctaaggagacttaggcttggtggaagacatgtcaacttgtcacagttccaaatatgcaattggcgaagcaagggaaggtttccaatgcaatcaggcaagaattctaggtttggaagagactctaatcttaacttcttcaggttagtaatatgttgtaaagcctcatgcaaaccttccacctctttgcaactgacaatccacaaatcctggagacatgttaggccttgaaaaccaactggcacattcagtaatttaggacattgagtaatatgaaatgtgaaaaggcgtgggaatatgttttccccatcctcccttgataaccttgttaggtttggcagcttcctgagaaacaaactttccagagccatgaaaactactctactcctcatatatgtattttacattaatcatgttatctatccttagctccttcaaagaaggcagtttccccaatgtcggaagttggaaacagcttttgcaatcctctagacttaaataagttaaatatttgagagaaggaaaagacatccattctggaaaattgacacctttatatccttccaccctcaaactctgaagttgttgggtatc

SEQ ID NO: 4703 - DNA, 1200 bp, Glycine max
  Soy_ogl_391 Gm02:5180301..5181500 Cluster 20
tcaactaaaaatagaaaaaaagacacagcctagggttcttatgacttcaaaaaccctggacaattcttaggacttagttttcaagcatcatgtcatccttgccaagtccctccagaaacatgatacatcatggtaaaaatctgtcttctcatctatctcactttaattttattccatttttctctctatctctcttcaatttttctaattcttgatctatgttattgattcaacggctggaccctcagaatcagttaatgtttcttgcttcacctcactcacacccctctcaagaatagtttctctgccttgcatgccaagactaaccctcttggactcaccttggccaccctcagaaccccagcaattcatcaccataaaatccaatacaatgatcgaggccgtgatacgtaccttgtaaccgcacccaacgaccatgaatcgattatcaacttttcctttcacaccatgcagccgtgaggaaattcttctgtccctcacactgcatgcataacaaacaaacccaaattaatcatatcaaaattcaacccagagatccatttcctactagtacagtttttttctctaaattaattgataaattttgaaagaaagaagtattttaattacaaagattcttgatctatgaaagaaagattcttgatcttagcatataactaatgatgggtaattagtgtaacacacacgttggttttttttttcacacaatttaattagaaaagttttatcatgtgtacctgcatgaatccacgtccacgacgttcttttgcctaaccatggaaaataagaatattgaactatgcgtgattgcaatctttgtcaaaatcagtagaaaagaaaataattaggtgatctcctccattctctagggcgtcctactcagttgacacttcttgaggaatgcaagtctctcgccgtcgatacatcaaaagattcaaagagaatgggttgcccggactccttgaattgatgaagatacaaaagatagctttagcaacacacgttcttttctgcttctcttttcaattaataataatcagaaaatatagaaagtagttttgagacacattcttcattttataactaactctagtactctgccccgtaatacgtcaaagtgcaccgttatatattgctcccttgattaattattcaccctttcacgatatccaaattaag

SEQ ID NO: 4704 - DNA, 1337 bp, Glycine max
  Soy_ogl_1558 Gm05:2684501..2685837 Cluster 20
acacatcacattcattaaaagcatgcaattattcgttccttaaacttctactttttcatacgatggtgcatttcttgcatttcataattgtatgtaatgacagtcaaaaaaacaaattgtatgcaatgcacacttcacattcattaaattccatcacctagagttctctttgtgatacatttggcgtttggacaaccttgtattttttattttttttagatccgacacagatcaagggtatcttttataattagtagttatagttatgagcctaattttggaagatgtaaaatactagtaggagaattaataagagacaattattctacctgcttttttattcacatatatagttatatatacttaaaagagttttagtcactagccactccttattggtggacatccttgcttatgatcctatctatggacacctacccataacgtaagcctgcaaatccaaccaactgttgtggtcttgtggagatgagtcatacacgttaatctacatttttttctgttttgcacgaatggtcttagtctttggtcaagaactgaaggactcaaggaatgatctcgaattttcagggttttttttttcatattttgatttgtatatttatcttactatatattttttgtagagcaaaatcagcaaattatatttactctcttgtgattataacttattatatttgcactctttacgtaaaaatgtatttctttgacactttcttagcgttttctgttaattgactgcatattttttgtgaaagatccaaataatccttcttaaaaggggttccaatagtaagttaggatggatgcaggtaatcaatacctgctgacctacctcttctttctctttgcgccgcaatcccaacctttctacctcaaccaccgctccaccaaacaccagcgatgtcaccctgaaccgccgccgccgcgccacccaatcggcgtcgcctaccgctcaacctcatcagtgaccaatcaaatttctctacattgcacatataatattccactatcctgcatttaataaatacatttgattcctccatgcaaaatgtaagcaaaaccacgagcatgtagtcttctcccttcgcgaacccgatccagaggcacataaaagtaatattcatccctttatacaagccccaggattcacagaccattgagcaaaagagtaatcaaaattgctatcataactcttgatccatgaacatgaattaattaaaatgtcttgcatagtacctgtttgtgaaaagttttacctctgaagatgatattgttgtagtccataatacccaagaaatgcaatcccacacactcct

SEQ ID NO: 4705 - DNA, 1500 bp, Glycine max
  Soy_ogl_5179 Gm15:49680201..49681700 Cluster 20
agggacaaagacactctcatgcacacactttgtcccccttttcttttaaattttggaacatttaaatatcataattaataaccattaaaaatcatcactatgataaaattaattgtcatataaaacactaacaatcactagttttagattggaaaaaaggcaacattgacccaaatttaagagatgaaataacaaaacaaatgtttaaaaggataaagataaaaaaattaataaaataaaagaccaaaaatagatttcatcctattcatgaacataaactattttacaaattttgcacaaatcatattttaataattatattcatttttacttttcctagctattttgaaattactaacttctatcctaaggagattcattaaaaacttaaaatttatttttttattgaaaagtgtaatggtatactatattctacgataatttctaatgcaatcccagcttaaaaactttttgcttaatttcttaggtgcaggctagaatgggaaagcccctcatatctcccatcatggaaactggtccttaagatataataagcctttttcgagatatgtataagactagaataggcatgcacactccagaataaatttaaaatattaaaaaaaaaagtagcctgtaactattgtaggctatcatcttgaaagctttaatttgatggccattccttcacaaagcccttccttcttccagaccaaaccaccatttgcaccagaagatcaaaacaaaaaaaggaggggaacatagctaatgaaagtaaagaaaaaaagatatcaccaccgtcacagtcacagatcccaaagctcttgcaccaccgcactccctcttcatccttcatgcacggtgttggcgttaacaaccttcatattgtcttctagattttttttgtgaaagggcaatgtgaaaatgatttaaattgctcataatttaattgttcataaatcatacaaattacaaaaggttctggatactaaaatgggtgtagaagagttttttcatcacaatagtgtttactggaattggaagccatcaaatatggactcacaccaactatttcaagttttcaacgttggtgctctacaataggatgatcatagactacttttttagtatttttttttttaatttactctagtatgggaatgtctacgatagtcttacacatatctcaaaaaaaaattatatcctacagaccagctttgtttcccatgatgggagatgtgaggggcttttccattctagcctgtgccttatttcttaatcattatctttaggatattaattaggatgtatcttctccactgaaaattgcttacaaaaaaaagatatatagagaggggttgactgtataaacattttgtaccattttgtttttgtgtgtttatctgtctcagtggagaggatccacacacactatttagcatgatcctttctttttcccctgaaaattctattatctctggttcctcttgtttctgggag

SEQ ID NO: 4706 - DNA, 1400 bp, Glycine max
  Soy_ogl_6858 Gm20:39149801..39151200 Cluster 20
tgctgtgacaaatagatgaccaaattatctggtcttttatggaatcgtaatgtccaatagggtattcaaatgtctacctggcactcaattatttctttatgcagccgatagtttattaagtatccaaaactgtattcttatgggaggattatgttttggtatgaaattatgcttttaacttgattcttatagactgatagtaatcttttctccaatatagattgtgaattcttgtcactgctctattttttttcctgtttgagatgaaaataaatcatataaaaacaaatggagaggagctggttggagtttgctcctcaatattacatatccccgtttgtgtatttagcctttttgtcttgaaaatgaaaacaacagcctttagtttagtgtgagattcgtaattttgagccatgaggaaaaagcatgtatgtatatacatatacatgcaaagtgccaactactgtcagccaaggagatagagtacatacatgatgaatctctttattattgaagagagggggggatagattttttaattattcagagattacattataagggtgaaactataaaaatataacatgatattaaataaattcatttttttaataagttccaatcatacctgattttttttactgatttcaacacataattttcaagtgttgtggccgggtggggaaggtgctaatggaaagggagctttgtactgtaagtccattgttagaacatgatggaagctctattccacataccttcattggttgtttgaatatgtatatgtacatactaatatttgttccttctttggagtctcatgccttagtctatttggcgttttcttattttcagattgagatatttgcaggtagctgcttaactgacttcatgactctttgtttcaatttcaagtgcagatactttcaagggattcctgaggcggcagttccagagaatgagcagaggaatggatgtgcatgctgatatggagatactccccttaatgctgtagttgaaactctttaaattctttttggtcatttttttaagaatgttttattggctgtagttttgaataaatgcatgcgaagaaggcccagttggagactccatgtacccccggtccatacgtcctccagagaggcaaaacagaactcgaaataacccttggggagagggatgagcttccattgttttactggactccatagctatgcgaagcactgacatggccccaaacagcagtgtttttgtttccgacatggacacacaccaaacacatgttggacacgcatttgtcatgtccaactttttttttaaaacctttcacacgattcttgacacggacacaactaacttttgttattgtttttcaaaatcatattttttaaaatctt

SEQ ID NO: 4707 - DNA, 1200 bp, Glycine max
  Soy_ogl_1262 Gm04:6808301..6809500 Cluster 20
ggaataaaatttaacaagggacataactagataaagtagagaccaaatctcgaatttgatctcttacggatgcagatcaaacgaaccattagatcagaaaccactgctacgaactaacacggggatctatagataactcataaaatgaagtgaaatcttcaattagatggagcagttataaggaatctattaaatggaaaaagaaaatagatgagttaataataaattaaattacaaatcggcagattaaaaacagtaatggtatgtatatataagtggtaaagttaaacttacagactcaaaacacacgagttttactgcagaataattaatcaaggattcataatttttttaatagctaggtaaaatgatattatcaattgatttatttatgtttttataaaatctttattatatatatatgtgtgtgtgtgcgcgcactgcaaactgatacaaaagcagtaatcctatcaaacatctcttcagttgatgcttcatagtactggaagattgcttcatcggaaatcccgtccaagatctatctagcagcaaattatcgtttgatgaatgaaatatacgagtgttgatcacactagaggttctttttaaattatataatagatgataaattaattaacatgcatgtacacatgcaagtaattaagtgaattagatgtgtatgcctttcttaattagcatgtaatatgcggaatagataacagtaagtgtcttagatagctaggaatatgtggatctgagttgtataaagaatgtcacagttctaagaacgataataatattccacgaagaacaacttttttcataggttagtgagatatgattaaaatagcttgtattgattaattttggccatatatatatgattgggatgttaaaatgagaataatccgatgcaaaggcatacagataaaagttggtcgagaaaaagcattagattccacatttttcacttggaaaagtataaatttcatctaggaaaaaaataaatggaacttttgggttacatagatggatcgttttatttgggtaaaataagatgatggtacgtggggtgggtggagggttttggacaagtgtgatcttttgtacagcttcctttaatttcattggtttcatttcatatgatcacatggggtcatgcagacacttccccatacttaacattatttatttattggt

SEQ ID NO: 4708 - DNA, 1434 bp, Glycine max
  Soy_ogl_2595 Gm08:10572967..10574400 Cluster 20
actgtgatgttgatctctcttccattaaaataaattgaatacaacgcttaattgagactatagtccgatttttgtggttttagttgctaagatgttcacactcttattttttatatttattttatatatttttttctgtcacatacctttgtaatataaaaagtatatatatacatcttgaaagtaaatattgaggatatggaaatctgaattttatattgataagtgccaagagataaatgactgatttgaatatatttttgttttgaaactctaatgaaattatttttttaatccttttaatctgtattgatccctaataacactcttgtaacacttttttttccaacttacattttgttaatagattaaagtatgtagtttaggttatgagctctgaaagatcaaggtgtggagggttgatttgtgatcatcatggggcttggattgttggctttggaaaaaaaaagtggggattacctcaacttttgtagatgagctttcaggtattcatcagggtcttcaagtggctcaacagaaaggaattcagagtttgattttgcaaattgactctatggtcgttgttcagtgtatgaaaaggaattcgatgggatgtgtgtctggtttgtggttaattcaagccattcaaggactgatctcaaaagttttatagtgtcagtataatgcatgtctatatagaagctaaccaatgtttgagcatgctccaactgtgttgaagcctttgcttagttttgatgctggggtcttttttcccctcatttaatctccttgtagttttgttgttttggattttttttatccccttttaatgccaaaagaaaaagtatgtactttaggtcatgttgaattctccataacccgttaatatatttttaggtaaattttcagatatttatttaataattcattgaagcaattttaaataaaatttatattagataaaaataataatattgcgttctattactttgtaacaaaaatatcatatatgcttattttatttatgattttttgtatttgggcttgtactgattacgccacctccattggacattgagaatgttgttttgttggcccaagatgcttttgctttatttttctttcatttctttttgcacatcttgtgttgggctcagctatggaatgatccaattctagcaattaagagcaatttatttatttcatgttagaaaataaaatattaagaaaagtgaacattaataaatattgtatatttatctattgatataattaaactaacggtgtatattattagtgtacatcatactgataatgtaaacatataataactgtattagcaaattaattttttctaaaaaagactttttttttgttagaaaatagcattttacttacataaaaggaaaaaaaacattttttagtgctacaaat

SEQ ID NO: 4709 - DNA, 1200 bp, Glycine max
  Soy_ogl_3382 Gm10:5396601..5397800 Cluster 20
acatgtttccaacaccccctcaacctcctttattttgctcacccacgggccacgacttttctctcaggctgtgaccctctttggtcacccacatattatgatattgttcgtcgttatggtatcgtgttggtccacttatccatggtgcaaagctgaatattttttccacttaggggtagagaccctcatctactagacatcactgatgacttattactatgtacacacttcaaatctcaatcaataaagaacatacttaaaccaaagtaactccaaaattcattccaagaatatacttcgaatttatttggatataaataacataattcccaatcaagttaaactagaatttgtttatgttgtgtttatttagaccaacgaagagatggcgcttggtgtctattttccaagatgaatttatttgggagataattctacaataatgaggatcccaacatgtcactcaaaagttggataatcgtggtgtttaaaatctattaaaaatgaataatttattaatgtgagagagaatggtcctacttttattctgcaacgttcacataaaaataaggaataaacaaaataaccttgtttcaaagaaaaaggttgagaggattgtgcagtcaaaagcaggattcgttgatatttttttcttcttcacctttttggttgatgaattcgttaatgatgcgtgtccatcttaatcatgaagttgcggtcctatcccaaattgatcttcaatggcaattttttaaatgaattttttttagttcttatattattttttccccaaaatactatattattataaaaaattcatatttatattttcatttaactatagtttaattatgtataaataaatgttattttctattactatgaaacagtttctcaccgaagatacatattttatccttaagaaacttttcttgccaaatagatttactccaatgaggaattaaatatatataaaaaaaaattacttaagaaatccttgaaaaaattacaattaaagatgctctaagtaactaataagttgagaatagtgattatgggatctcctactacaatatattgtcaaaccaagaggatttaaaagaatttaagcaaaatttagttgactataaaaataatttatgaatttcatgttgttttttaatcaaagtatttttttttgtcaaaagttaatgattaatc

SEQ ID NO: 4710 - DNA, 1400 bp, Glycine max
  Soy_ogl_6169 Gm18:54298601..54300000 Cluster 20
ccctttgatttagttttaatacttgtgactaacagaataggtagacatttcagtgattgggctttgtgggataggttggataaggcactttctctttgtagtcttcatttttttcttcacacatttttttataattttaaaatactcaaaatgcccttctccaccccctttcctttctcttttccttctcaatataatctccttcattaactttccttcacccacatccccttctctagttaatttcacttttcttccttgcaagttgcaaacataacgaaaactaccttcggtaatgtcttataacataactacattacgaaaactaattttcttaaatattactatagttatattatggaaactagttttcgtattgttaaagaagtttttagcaacaaagaaatttttattaatatatacctgttgaagagtacaagtagtagcgaacaaggtcctgtaaaaaatacaaagattacatagattggtcttattataacaatgaataaaggccacacgcaagctggctacaaaaaagatatttacaagtgtattagagtgacctgcatttgtaatttgctgaaaatctctgtagcatcggctaattgctcacccacagtgtatttccacccattccatacaatgtcaaagcagtattgagtcatacttttctaaaaatacgttttaaaaattagtttgcccaaaaaatatttttatcataaaaatatatacagagaatgcaaaaagaaaatagggttgcaaatatatagaatccccttccaatgctttgagaaatttgctttgggtcactatgtgagttgtattttaattcgtctaggcttggtttttggatgatatatataatatcataattataaaaagatagtaaactaattagaaatagaaaataaaactaatcaatatatcctttattcttttgagtctatattgcttgattttttttaaatgataatacacgtgagcatgttacaaatcgaattttgttatcctatctaatcttgttttataaactaatttgcatttatttccccaagtatcgaaaaaaataaattaatttgcatttattattatagttatttgtcaatctaaattgtaagattgatttatcagctgtgacaactagtcaacttatattcttagtgagaaaggaaggaatacctaaggtggaacgggttggtacgtactcggtagaacttcttttataaatgtttattttattacaatttatttaaagtcaatatcaagaggttggcttagttgggacaacttgttgactccaattatgttttttcctccgaaggagcactgctagaacagttggtgagccatcttttataaagttgtatttatactatattaaaaattatgagattgattta

SEQ ID NO: 4711 - DNA, 1471 bp, Glycine max
  Soy_ogl_6306 Gm19:366101..367571 Cluster 20
tcattatagtctcactcccttttattgctctcctccctcaaaattcaattgttaaatcactatcaccacatctcgttttcaccgctaccattgtcatcacaatgacatcgtgccaccatcacaaatcatgcatatcatttccctttcaatctctctctcgctgctctcctcaaatcttgaaaaccctattgcgacaccccatcgttgtcatcacatcatgccaccccaccaccatgtacaaccacaacatttccatttcgaactcaatctcgttcttgctcctcaaaccctataaattaaccctatcacaacataacccgagcatatttcatattcacgtgaggtcttgagttttttgtggaaaaaagttcattttgatccaaaaatttcgtggcactaatttaaagatattatatagatctaaaaatattttttaattaataaaataaaggttttttttagtttatattcaattgatgatattaagtgttactgtgatcgctctcatttgaaaggaaaaaatattgatttttttcatgaagtaccatgattcggacccaatgcattttcatttagaaattatatgttcttaagattgcattgatcatgcatcattaatggtgctccatgtggagatgataattcaaatagtaaaggaatattttcaccctggagaaataaagtggaattgtttgaacttaatcggtaatctcacatttgaatcttaaatatgtcatggagtttgagttcagaatatactttattttttataaataatacttgtgatctaaaaacctgattatttcctatttattttctcaagccaaatgcatttatacatcgttagattctccaatacaagcatacaagacacattggcttctacacgtttttgtaataattttgagatccgaattatcacgtacgccaaattaaatttctctttttggtatatgtaacttcaaaccattcttcgtaagaagaacaattgaaagacttggggtagcaacatgatcttccaccacttgaacacgatacttctgcaaaatagcagctgccaccagcttcatttgaatgaaggacaagtctttccccaagcaagttcggggtcctgcattaaaagaaatgaattttcaagatggtacataaacaatacctcctttctctgagatccatctttctgttttgaactccaaacaatcttttcctcatgtttcttcaagtcttcccatcgcatacaaaataaataatatatttgtaccggaattaacacgatgatcaccaggaagcatatcatcagctttaattgcttgcttggtctcgacacgtataggaggaaagaacctcaatgcttcacatatagcaccatgcagataaatagtccatgttggtaatgccaatgataggctattctgtcgtctataattatacaaaaccttaaggatgactatggtaatttactgttaagaat

SEQ ID NO: 4712 - DNA, 1500 bp, Glycine max
  Soy_ogl_1676 Gm05:34781701..34783200 Cluster 20
aatttttgacagtgaaaataaaataataaatggttacttttttttattgatattactattactatgattttgtaggatagaatcaattatatgttatccaagtacactagtactagtagctagtgatggccgtgatcaagagtctgaaaactggcgccagggtggaggatctgggtttgtttgatgcgcttgcaaatgtgtctgtattttgcaaagggtcttgataagttttgtgtcacattttgttaggcccatttctaccgagtggtccaacccacataattaccaattggcagagtattatctgacatgaatggtccaagaggccatgtagcattaattccctaaagccctcatacattttcatcccttggatcatgagatcattctaaacacattagcttctacaccagccagccaataggcaataggctcaaaactaaaaaagaaagtgttttcttattctataaggtaccgaatttaggattcatcccattatggaagggatatctatgtaccatagcacctaaccattccatgcttcggataaaataaaaatatatagcgaactaataaagttgttttcgtgttattaccatgttgattaatgggatagtcttagatcgagaggtcacattcaaactttttgagaaagcaatttgtccctgcaaagtagctcaagtggtagttatcaggacaagggttggaatcttccctaaaacacaaatcattgtgtttgatcttccatcaggaaaatgttttgctccttaagtgcagttgattcggcaacatagccaccaacaccccaaaacaccataccatataacataaaatataattaaaaagcacactcgcttatcttgcctcaacctctatcacacatagattactggttctagtgaattcactttcataatcgaatataaggcccacattgtcagcaatatgctttggaattttgtctggacctgattctcttgagaagttggcaaacaccccgaattatgttagcttatggatcggtcagtacctacataattgtgctcaaatttgagatccttaagtcgacccacataggctgaagtagtagccgggtaggttgtcttctttagagctttacaatatggaactgtatcaaatttcccatcatctttcttttcaaccgttgctttgcatgagccatctttgctttattgcttagccacaatggattcaaacatgatctgacaagctgtgggaacacccaacatttggtgtttagcttgttagcattattgaatcagtcttcaaaatttgttgctctgcccgttggggaatattattgattattgatatgattagccttttatgtggcttatagcttatgggcttatagtatggattgttaccattagactagcccaaatacccaatcatgagctatagttagattatgcggaaattattacctcttaactcatttttaatttttttttatcaattttaggataattttttaaa

SEQ ID NO: 4713 - DNA, 1499 bp, Glycine max
  Soy_ogl_4296 Gm13:27092401..27093899 Cluster 20
atcacaacaacatttttaattataagcaatatacaatacaataggtatataataataataattatcattataacagttatgatatatgattttttaaaatgaattaaaagaatgtaattttaaaattaatttaaattgatgcatgaaaatatgttctttataatgcatcaaaacaacatcttgctctgcatcaaatgctaaaaatatgttaatatctccaacttcttgtttccatgcttttgtgcacatcatccctcattgtatcacctgcacatttcatctggtccactaagaatcctaaaattaaatcaaagaaaccttaaaaaccaaacaattgtacacgtctcacccattattacttgaaattatttttcctttctgcaacacaaaaaaagaaaaaaatagcttatcaaactaaccggctaaaacaaaactaaaccatataccagaagtccttacttctttctgaggtaggctcgaagaaattcttcaatctaagattccttccgcgcaagactaaatttcaaaaacacaaacatatattacagaatcaacaacaaaataatttattttaaattttaaacaaacgaactttaacatagaggaatcaaagtgaggaagacaatacaacattgtagtacaaagcatcttgcaaaaacaaaaccaaaccaaatagtaacatcaatttcacaaaataaaaatgcatattagaaagaagagaagcaaagaaagcaaaatcttatcttgaaacaagctttacgatttccaaggaagaatgatccaatgaagtttttccacgcacggctacgatcatgcaaggtcaatagcttttcgttggatacggtatccgcagggagctatagagaagaagagagagaagttagggtttgacaaagttggggttttctcaaacaaattaaaataaaataggggaaatgtaaaggaaaggattagaagcatgttgatcagttttagagattttttttttcattttttcactaaactctattacactcaatttctttagcctctaaagtatccaaaattggtgatgcattttcggggaaaccaaattgtttgaatcccaaaagatttgatctccaaatttgttgaacctctaaacagtttctgttgagtagataaaaattcaaaagaggttgtatacgcactgatacctgcaccattgtgactctatcaggaaaaagaaagtccaactttgcacctttggatgcaatcttccatgcagaggatcataggaagaagagcaccaacgttcaatgttcatgtttttcgcaaaaaggtggtaaacaaactctatctcatttgttgggatgctcaaatagacagaatagctttgggtttcaacttttgttttgagacaacccaatagtctcctaagaccaagttaattgcacaaaagaaagcatgttatttgaattgtaattttgaaaagattattgacagtgtgacacgtctaaaaagttgccctaacaatgagc

SEQ ID NO: 4714 - DNA, 1921 bp, Glycine max
  Soy_ogl_6654 Gm20:423780..425700 Cluster 20
cttgctttgaaaatatgatccatgacataaagaaaaaacgtaaggagggtttgaaaatcaggtaacctctctaaaactgcattgaaaatgtttggccttaccattggagacactatgatcctaacattgaagttgaaactacccactgcacaatcaagctccaccagttttgtgcacaatgatcatgtatgttaaggtgatttcaccctggtttgtgcttggcaagatggctcgatattctaaggagttttatcactgaagagtgaagctattgtgttcatcctgtgatgacttgcaatcccatggatcaaagatattgaagcctatatcgagttttccatttttcacttgcaaagcaagcctgtgtttctaaattatagatattcaatgacattaatttgaaccaaaaaagaagacttatcaaggtaagtaaattaaggcctttgtctttgcaatgcagccaggtgtgaaggagaactatccaatcattgttgattctagcagagaaatcaagcaacacaacctgagttttctcttccctgcaactactgaggggaacatggaagaagtgttgagggtgattgattcattgcaaaaggcctcaaaattcatggttacaaccccaacaaactggaagtcaggggcccagcttcctttgcaaaaatcaaatccaataattgttatttttactatttacgtacacaagtgttttttttaatcagcaaagaagtatttattgatgggaaccagtggtgccaggatgttcatattacaaacatttgagtatattttgtatctgcatcccccaacagatatagctatgattcccacaccttgactcacaaattgaacctaaattttccctaaaccagttaacattatacagcagaggaaatttcaatagtaagtaaagtaaccatcctatctttgttgttccctccctatcagaaacacaatctccagtgcaaattaagatcagacaaattgatgcgcaatgtagccctcaaaaccagttagttgaagaaagagcagatttcccacactttggcttccagaaaaggaactaatttgagacaaaaacagatgtagcagagacactgggcatcctactggagattattttagctttatcctacatgccatgtcctgaacttaatcaagtctagcacactgtctatgtttacttcttcattattgaagataatgttgtttctatgcagccataaagaccatacagatgcaaaccaaaccaccctccaggccttcattaactttctccctttaagaccaaccaccacaatgctgtaaaaacttactcgtagtcgtaacatcctcaggtagtgccacttgggttcccaaccatttgtaacagtgattccaaatttggtatgagaaggtaactacaagtgttcagtggattcttctacttgatgacagaatcggaaagtcgtgtcattcctgtccagcacaatgtttctcttattaaggttgtccatgatttgtattctgccaaggagcatcctccaagcgaatgctgatcactttggaaagaactggtgtatcccagaaaatcctatgctcaatcagttcagtcatagcaatatatgcccccttgcactcaatcagttcagtcatagccattcatcagcaaaacgcaaatcaaatagttattatttttactaattctgtacacgagtgcttagttattatttttactaattctttccagagctatgtataccgtctttcacactatcagttcagtcctagcattttcattaggatttcctttcctagaattttggttctgttgttggccatattatacagaaaataaaataaaaaacaatcatcctcactgagacagcagagctaacaaggccacaagctaaggaaaaaaatgaacattctcagcaaatca

SEQ ID NO: 4715 - DNA, 1131 bp, Glycine max
  Soy_ogl_3762 Gm11:5994970..5996100 Cluster 20
attttattaaaatgagtttcactcaattcaaaagcaaatgggctccatattaacaataatcatggttggtcttcaagtagcatgacactagggctccctcaatgtcattagtggatcagactctatgctaactcttcaaatactcggtctttatccatatgcttcaagcatatgtattgtgaggggaaccaaagccctgacttcttggcaaagcttggctcttgatcaaagtattcaactccagatcccagaatcttccccttcccggttgaggcagcttctgttagcatatgcttgcagaactccctttactaggaatttgcttgttttcctctttgttcttttgttcagttgttcgttgtttaaaaaaaattaacaataattaacaaaaaaattaaaattttaaaataaggactagcgtaatacgaaatgggttaataattagtttttatattaaagtattaaaaataataaattaatacattataatcttaattactatttctagcgaccttcgaaaatatttttaaaaaataaaataagttcatttattagtataataataaactgatgagataaaagataaataaaaataaataatagattttaccaaaatattttttaaaaaaaatctgtcactatattattgacctattggtataaaataaatatctacaaactttattaattattaatatctaacaaaaaatctaaataattatttttggtaaaatctctcctccaattacaatttttttctatccctctaaattttgtttgaaataaccaagttcaattctactagctagaccaaacattttagttataatatagtgtatagattaaaatagtgtttccatatcattacttataataaaaatatataagtgaagcaatcttaggtatggtagctagccaaggtaagaatggatagtttcttttgaaggaaaaagaatggatagttcaccaaacagacagcttactttccgcatgaagaaagttcagtgataaagaagaaaattgcaatacaagacgtcaaattcaaaactagttaggaggacaataccatataaagacccatcaaaataagttcctatggttgaggtcccccgcagggaacgcaaaagcaca

SEQ ID NO: 4716 - DNA, 1200 bp, Glycine max
  Soy_ogl_4898 Gm15:4034001..4035200 Cluster 20
gggttgtagtgttccctttacatcttccaagtgaaatacaagatgacaaacacgttaagaaattaaaataaaatagtacagtactgtatttgttttaaagaattattttagagatattatcggagaagtattatttgatttttttttatagggaaagtattatttaaagttgaatatactaaatgcttgcttttttatttacccaacaagaaatgctgtcacctgtttaaacgcatgatgtgggtaaagaatgaattgaagccgataaagctggtcaactaaactagaggtgatgaaacgaagtaggactgcgattggtggaattgctctcctctacggtggacccgagcacagttaaaccagtctcagggtccaatcataaaaccgtgaacttaaagcatggatcagtgggacccactcgcatgcacaaaaatcttcacggacgagaatgtgtggggtccaatttgactcattaaccagtagcattgctgaggtagatcctcactgtaaagcacccacaacacaagttgcattcaaattgaattttaagttcatgaaaaaaccaatattgtgttgtagtaattcagaatgagaattatttgatgaatttgtaaggtaaacttgggttgtaaactttaaaattgcagcaagtagtggaaaacagtgagttgtactctctgctctgcatatactacctcttgtttttctttggtgtaataatggtccatgcctacctgcaattcttgatataattattcatgccccaactttcccgctaaaacttgtcaaggaaacttgggcccattcatccatgtgtttggtatttcctttaacaggataaatcaatgtatatatttccttcactagacaaaaatcaaattgcttaaaccatactcctaagtttatatagttcttatttatacggggtaaaggattatcgctaggcatcctgatcaatggtcatgtatcattacctttttaatcatcacaagtttcacaggagtacgtagtaaataattaagtatcattacaacttggaaattgtacttgtacttatgcacctctactctacacttaacacttcccttttggagttctatttattaggtaaaccaagtctttataattagctggtcaattgattactataaaaaagcttcgtccatttctctctccttatgtgtgatgtgataatcccat

SEQ ID NO: 4717 - DNA, 1000 bp, Glycine max
  Soy_ogl_322 Gm02:2270401..2271400 Cluster 20
ccacttccaggatatattctcttcattaaaagcatagctatgttttagttgcacgacttgcttcaactgtttgatttgattttggtggtaatgtggtactattattttattgattgggcaataagtaattaataatgtatttaaacatcaaaaacttataccaatgcagtatttttcataatatatgaaacttcatgtatggtcttgtggacgtggtattctttgtttctttaataggagtatcttttttcgttcatattttccgtgtgactagcaaatttactgcatgatttcacaaaatctttggaatgaagactaactaatgtgtttccatgtgcccttcagcataattaataatatcgattccatgaacatggatatctgtatcaattggaaaggaattattccaatttaaccaatattctcgaatttaaattttaagtaagtatataattatgtcaaatactcaaaaaaataatttaacacatacaatgatcttatttgtctcaagtaaaattatctatcatacatgtagtttttaccaaaaaaaatatgggatagtttgcaggacaatatgttgtctggatttctaactcgttggaatcgttcactacttcactctggtgaacgaaccaaccaagcattataaccatgcattatgataattacaaactcacaaaatagcaatcaaattaataaagctagttatgtataaacgtgaggccatttgatcccgtttgactttatctggtagcaagaggtatacatatcatatatgaagagtaagaccttaatgtatagcttggctatatataaactatacagaaaatcctatgtcacttgaaaattgaaattaatacgtcgaatagcttacgtattcattgtcctttagaccaacatacctagtggcccattggttatttatagctctactgacttatacatgcagatacactgaagattcgtatagacttaggaaagttaattgaaaagtttattt

SEQ ID NO: 4718 - DNA, 1001 bp, Glycine max
  Soy_ogl_2467 Gm08:2484601..2485601 Cluster 20
attgttaatattattgttacaccatcaattaatgtagaagctaaaaaataaaaaacaaaggggtattggatgcatttcaaaaaaatcataagggatgcaaatggagtacttagagaggtgtccggtgttataggagagaaaaaattaagattttttttttagttacaaaatggaaaattactgaatgtaataagtgaaaacctcaacaccacagacaatttactcttttatttatactccaaaacgactttacttcgtaacatattcatgatacataactttgcttaaatttcacctaaaaagaatttgctaaaatattttagactgaattaaatgttttttctttaaaatagttcttatctaatcctcgaacaccctagatatggtggaattataaatttttaggttactctgttcaatacaaacttattcacgcaaatataatagatttttttaagaatgagcaaattttatctctgtttgaggagggacgtgctacgaaattatatacaataagtaatttaaaaaatatgtttagatgtacatgcaagtaggtccaccccttattagaattggtagtgaaatatattgttaattgcaattctcaatacaaaagttatatgttaactagcttgtgtgtgatctgttgtgattggtgattgtaatttactgagcactcggaaattcaagaaaactaccctccaattgtagatactggcactgcctctcatttggaatccaacaccaactccaaatctccagtccttaattatccaaatcatcgatctacttatatccaagtcccatttatccctgttccgtgaatactaagtcgtacttaatattggtatcaatcaaatggattaagattataatttttaagtaaaaaaggtagtacctattgtagagattgtatgttttttggggtatttcagaatgataaaaaaaaaagaagacagaacacaagacactgcactactaagagattatatttagggtgg

SEQ ID NO: 4719 - DNA, 1263 bp, Glycine max
  Soy_ogl_4104 Gm12:35882886..35884148 Cluster 20
ttaaatatgggaaaaatttacacgatataggaagaaaaggcctcagtaaacaaaggaaataaggatggtgaacaaactttaggggccttcgttctcgattctttagggcagttgctatatccacttctcttctttgttatattcattctcctttttaatttgttttctaaaaatatcctattttaaaaatacactcccctatagatagttttgagaaaatcaccacccccgaagaaaacctcatgcaacccttaatttttgcacccaaacaacacattggagaccttcggatattgaatgtgggactcggattttgaagagaagtcttaggtagttggagagagaagtaatgatgaaacatccaccgcaacactagatgcttctaatcttgtaactcctacattgtgctgtcattagggtgaatttggttctttattatacatatattcagagttggctcgcaggtagtgagcaagtctggtgtattgcatctaacattattcaagaaaacattccaattatgtttgtttagcacttctattagtgttttttaaattatttgattctattttatgtctacacatgagattttagaattagaacctttgacatctttagaatgctaaaattcatagcaagtttgaaccttaaaattcatggctgatttttcaaaattatcaacaagggaatgtatttttttgaaagatggcgtttttggaagacaaattgaaaaggagagtggataagtaaagactaaagtggatatagcaagtcccttcattaggctgagagtggggagttggagcttggcccaaacaaaaagatggaaacaaaaaaaaaaattgtcgtggtttgttttggtacggtgttctttgctggtgccttttttgttcaatcctttaaagtggtttggagggagtgaaaggaaagaaaatacactaagacaatatttttttttctttgtttggttgaagaaatttgttttttaaaacaagttaatttcatgatacaaaattttaaaattttctttcttctctcattttgtttgcttcctacctaacatagggttactgtttccttcctattgtttttatactcataaatcctaatagccaaagcactaatttcacttcgacaagtgcattagacacgagtttatatgactagaacataacaaatagttatggtatacgagagctaaagccagagacatatgcacaaactaaatttacctaacatacctttttaggcttttaaatacac

SEQ ID NO: 4720 - DNA, 1600 bp, Glycine max
  Soy_ogl_6603 Gm19:47023901..47025500 Cluster 20
ccttacatttattgggttgaaaaatgatagaatcgcatactgggtcacacctttagacaaaacgaactactgtatgatattcacatcatattccaatggaaaattatcatagcacttctcgctctcttattcaatgtatgggtgaaagaaaataaaacgacgtacgtggtcgtttctttcttctagtacggatgagtttgattgtataaaaaaaaatatttaaattaaaatagagaaagaaaatatgagactcacagtaatttttaaaagtttactcatgaataataatttttttccaaaaccaaacaagcacgtggttatgattacaggagaatatggattataatatcgcctgtaatctgtttgtgatcggaaaagagatcatgatggaaaaaaaggacgtagtaagatcccttgagtatcctagtgatttgaatgttcaatgcaagtgaatgcgcacattagttaaagcgagtcacttaatgcaagtgaggacacttctctctctcgacaaaatcgacacatatgtatataaacagttaaaaaaaaatgtagatgtaaagcttgagcacgcgtcaagacatttgagcttccctgttgatgacatggtgctttatggtagggacctttggtcgccagaacgtgaaatgtgttccaattaataaacaatatcactatcggagtttcaattcgttgacgtcacaagtcctggagcagcggcaatgataaagtcctcaaaattattattaagataaattctaattaatattcttaagttattgatcaaagaatcaaagaattttttattaaaatgtttaaaatcgtgttatttatgatttttttccactcttcaaatttgataaatgctatcttccaatttaattaaaaaagaaagagataaatatgtgaataaaagaataaaaataatagtaccttgtcctctttttttttttttttaaattattttcttcacctgtatttccactctttgttattttcagccaacggtaatcccacggactcaagtgaagcaaatgcccaaggccccaacccaagcacacgaaactatgtctgtgcgtaagcgctgacgcgatcctcttgatctcactatcctattaagctattttattttatgctcgaatccactgacctaccatggcataaaaataatcttggagtaaattatactctattactatgacattatgaagatatattcccactatgggcctgaacaattgtattttcttagtgtcatttcaacttgaggagagtagcacaattacgacattgggagattgaataacctcttatcgaatagacgtctagacagactagacgaattatgttccatgtcattttgaaccaaaaaaggaatgacacacttatgtttgtacacataaaaattgaaaagacatttttttttttaaaaaaaatgattaagaattataaaagtggatcattctgcatttgggctaacacttgccacaaagatgagctcaattttttatcattaatatcatattgttttcattcacaaaatttaaatttaagatattgttaaaaaaaaccaaatctaataccattcgttttaacaatt

SEQ ID NO: 4721 - DNA, 1000 bp, Glycine max
  Soy_ogl_4093 Gm12:35485101..35486100 Cluster 20
atgttttttcaagtatgttggatgaaaataacctagtacttggcaaatataatatttaaggcttacaatataatatttaagctaagatgtcaatcatatttagcaaatatttacttcataagaaaatatttaaaatattaaaataactaacagttatataacatgctcgtttatgtccaggaccaaattccatgtaataattaacatttcatgtatagttgtcacagacagcatccaaacatggcatgccgatggcctatgggaactaaatagataacagttgcacttatagagataaatttaatattattttaactataggtacaaaattaataatgtgctatatgtataaagaataaattatgaatatgctatagcctgtttcacgagagatttgatggtttgaagtataaatttcaaccttctagtcctcttttccaaactagcatagagatagatagagaaatagagagagttcgggcagtcatcaacaaaaaaaaatatgaatgtgctatacatataaggattaaattgttgtatatgtttttttttttttggaaggcaaattatcgtgcacgtatagagttaacacagatagaaacaacgtcatgatagtatggactaaataggtaaccgttgaatatattgaaattggtttaatacttttttaattacagaaatcaaattaattaagaattcgttatattacaaggactttatatgtgttaaagcaaaaaaatatttattcatcccctgttgcaatgttgctgctccagagtttcatttctttctccaatgtatccaaaagacagtaggattatatttttttttcttctttgggttcataatatgcaattgacttataaatggttggattcacgagttaacaggaaaaaagtcaaaaacaatgtgacatccactttcagaagcaaagctcttcgactaataattaaagttgaagggtactattagaaaatcaagtagaagaaacagtaaaact

SEQ ID NO: 4722 - DNA, 1000 bp, Glycine max
  Soy_ogl_4845 Gm15:886201..887200 Cluster 20
ttaaatagtggattaacatgagaaaatgacttttccaggaaaaaaacatatttgtcacaaaataaattttccagcctcatatttaatttttagaataaaatgattatctgttaaacaaactttcacttaattttttagaattatatatgaaacatgaaaaatcacataaaaaaatgtgaaatcaaacgtgctaaacattactcctgcaagacacgagtcgttttccaacttcattgctttaaaggaactcgcatatcaccctgctagctcctagctatcatataggaacgaccaaataagaatctagaaagtgtcgaattcatcaaccaaatagctatcataaagacaaagacttggtgcttagtgtgtgagcagcggaaggaaataatggccatgtgatagggtcggttatatattaaactaagcattaatgatttttgtgttaaggatttggttgttggaaacgttttcgtcatccttttatggtttgggttcatagtgtattgaagtgagaagctaaattgtggccaaaacagaagaatttcctaaaagatgaacgttggaaataggaagggaaggtattgagaaaagtaacgggctaattaagactgcttctcagtacctccccttgtctgctttgcttttatatgcaattacgtgtaaggtatagatatagtgtggatcttttaatttcttattcaagagctaataattttgaaatactagtacataagtattattcattaaagaacacagtagtatatttcttctccagatttttttaaaaatacagtaaaataattatatttcgttttctttatgtttcaaattatttttcgttataaattttgtcacgtttgttctgtgatggaaatgttaattaatgtattctgaaaatttctgtctcaaatgactttttttttcttatattgatattgaacatgaaaggaaaaaagaaaaaaaaaagatgagggtgagatatctaaatgtgtcatgcttc

SEQ ID NO: 4723 - DNA, 1124 bp, Glycine max
  Soy_ogl_5912 Gm18:2985277..2986400 Cluster 20
gcttacataatttataaataacttagctcatttatacttctaattattttcatcaaaatcctaaaaagagtttcattattattacgaggattaattcggagaaaactaaaatggaatttttttcattaatatttaatcatgacgacgatgattattagtgggttggagaaacatataatctctatcctaagaaaataataaaataaaacacatggaggaacatagctggcccgaaatctgtaattcagaaatgcattggtatgatggaatcgcgattacgagtgaatataaagagactcactaagttagtgtgctggagttccacaattagcatcgcttcatttttaaactcaatcaatccctgtcctgaccttttggaaagtctttttatagctacttcttgtccaattagtagttttcccttttttttaaaaatattgtatctttatattaagttctaaagtactagcaaaaagaaaaaattataagcaaaagtaataacattaccttgtagacgggtccaaagccaccctcccttatcttgttggtggaagaaaaatgagcagttgcctcaagaatagtttgaaagttgaatatatgcatatcatcacttgtccttccatctttcctttgttctcttatttcattgtaagcaatagaaattgcagtgtttcctccaatttcagacaataattttgttctcttgtgattttcgactgcacatcatgcttgaaagcttaaaggcagtgatctatgatataatatatttaagatgcactccatttaaatattttatttatatgaaggagttgcacagagtatggaagtttactcattagtcatccaaggctcattttatttatattttaagattattatatactttgtttacatatgcctactaatctttccttcgaagtagattccaacaagaaaagtgtattagaatggaagataagatgccaaattattgaaggagttgcgcaaggacttgtatatttacaccattattcaagattgaaagtaatacatagagattaatttgaaaacatgcaacattttgttggacaatgagctgaatccaaaaatatcagattttggcctggcaagaatatttggattga

SEQ ID NO: 4724 - DNA, 1000 bp, Glycine max
  Soy_ogl_6221 Gm18:56985201..56986200 Cluster 20
acatggcattaattgctctcacatgtggtgggacgcctctgccagtatgctagtgtgacaccttccttccaccatgaaatgctctccctctcttagtggggattctgttaactaggttgcttatcctttttcatagaggaggtatctttcatgcatatatatgaccttaattgattctgacaaagtgacaagggtttaactatgacctcgcttgtgattatccattagtgtatcttatctttcttttttcaagggccggtaaagagaaatggaaattaggggggtgcggatatcttgtttgaaattgaatgtcccatataaaatttttccatttttcttattatagcatgtattaaatttttttcaataaagacatttctcaactgatagtaaaaaattaattactttttcaagcataaaaatcaacaagtacattttgtttctccaaacaaaatattcttcatacacatatgcgcaatcgtgttgcaaattgattgactaactgggctcatcatgttcatgaatcatctttgattctagatagtcccccagccgggtgtgtgtctttaggaagactttataggagttgcaactcctaggttcatgcttttgtagtggttttggcatcctttaaataaataaataaaagtaattgaacctctacatttgaccttgttagtttttataacatgtatcatatatacaagtatttgtcatttgtatgttggtcacatcttgtgccaaatccatcatagtcatttcattagtcaccatactaaaatgggccagtttctccttcattttttttctttccctctatggaagaaaataccaagaccccaatacgattgtgcatgtgggtagaccatcaaactcgacttttatgtctctatcaacgcattacctctgaaaatgtcttgaaatcatgttccatatcaacttcttgttgataagaaaaatgaaatctttgttgttctagagtgtgtggtttctactttct

SEQ ID NO: 4725 - DNA, 1000 bp, Glycine max
  Soy_ogl_971 Gm03:39571001..39572000 Cluster 20
atgttgttttagctagttttcaattttcaaaccatacccagtcaagctaaactattcatcaaccacaagaagaagcacgggtcaattcaacatttcaaatagcactctctctctatgtatatgtctggggctaccatatgcacctacctttcaccatccatatataacatacaaacctctcattttattacaacatttcgtcatccaaaaacttcaatttttgtaccattgataattaagttactatatatcacagctagagatcgatggcattgtctaacaggatgatcctcttcataatgctactaataatcttcacaattttggttacttttcctcaatttggagcagctggcagagcattacaagaagatcagtggttaagagaatacaatgggcatttgttgcagtcttttcaacggggcactccggtggtatccagtccagatccaattcgtccataacaaaccttcaaacgtgaacgcacacggctaattgaaacaaacacattcttactcaaaatttcataactattaattctttttgcttgtgcttgctgagaaccccatagcatgcgggggtcccatgcaagagtatagttggatgtgtattatattcttttcatgcataattctattgtaattgtaatctaatacaattctttaattgaaactaggaattgggtgataatataatccctagctagctttttttttttttttttgcacagcaagaaaattatattatattaataaggtgaaacgaaaaagccacaaggagtgaccttcctgtcacaagattaattataacaaaatccacacaaatcaaatataaacaaataccacctctagaagtgactcaatacaaaagaggctcccatcttgtaatagtacacgagctagtacaaaacgtaactaaatccttgcactgaccatgaacactaccagccatacatgtccccaaaagtacaaggaaattatcctatcaattatacaaggaa

SEQ ID NO: 4726 - DNA, 1100 bp, Glycine max
  Soy_ogl_1585 Gm05:3730801..3731900 Cluster 20
atccaagaagatgagccttttttctatcaaagtgaattgacaattgaacttcacaaaataaatggaacctttttcagaagtaattaacatgaattctacatgtgttagtcttaagccactagatgtcatccatcctcttgatccggatgaagaaatatatcataatcaagaggctcaagtttggccatcaatcattgtaacccaggtagaacaaacacagctagtagatgctagcatagtaggacaaataatgatgaatgatgaatctgacacaataatacaagattctttgactcatctgaagaatttgagactctttccaaccttaaaatatgattcagaaccagatgatcccaacttatttccaactcatgaacccgtcaagcataagtaatgaccttgtaatttatgcccacttgaagaaaaataattatctatacttttacttttttgaaataagcatgtgtgagtgtagttatttgtactaaagtctatataaaatccgagtgagttagttgtttgtatttttacttacccaaataagcatgtgtgattttagagtattggcagacttagacttagaattgttggtagagtagtttgtctatttgtaagctgtaagagaggagaaaaaagaaataagacatgtgtttaaaaaataaaacaaataaaagttatggatctttaaacttctgttacttctaaaaaaaaggtaactataattaaattgacatgattttgacaattcgtatgcaaaatattcatattgacccgtcaataataaatcgaaggtgatgaattcgatttccaaaagtgtaagtttgaaaaaaacttgaggactcagcagctgagtgcggagttttcaaaatgaactataagtagataaatattaaataggttggccttaaaagacaaagaaagctgatttatggtacgacatttttctttttcatggactactcatgttcattattcatacttttcagtgttcacaaatgcttctatcatttcaaagccgtatcatgattcataagaaactacaatatcttactagtttcagttgtttgtacatattcataatccggttcaaataatacata

SEQ ID NO: 4727 - DNA, 1007 bp, Glycine max
  Soy_ogl_2553 Gm08:7985901..7986907 Cluster 20
acatacctgatcgattcatcttaatcttatttataataagaaatattcttttcttataacatgcacggatacactgtattcttttgaactaagcaataccaggaacatttttatatggggtctactctgtgagcaaatgtccgatcttcttcgtgacagcagcaagcatgcttgtttaatacatgaattgaataacatgatagatcaaaatatggtaagaaaaaagggactgtttcctcttaattacctcttctggctttgtcgtacagtgtttggtgatatcttcttaaataatcaaggttagggtcgaacgtgtcatgaataaaaccctctcttggattcatgttttcctgacaagaacaggcgagtaaagtatatcatatttagctccttgaattttagtgaatctcgttaaataggaaataaatacatttattgaatgagatttacattatatatatttatactataataattctataataggaagtgttagaagaatgtgtaccattaacgtttcttctttcaccatcactttcttctaacttttttttagcgggggagggcattaaaacccaaaactaccgtccattaccaccttttaactaatggggtagaacagaagcctgatgttatcctagaaaatatttaatatatgctcatttttttatttctatttcattaattaatttttcctttttctatattttttttcctattttaactagtaagatacccttttttttactacagaaaaacatccgtatattcacacgagtcattctcgtattcatgcatgtttaaaatatacttttataatattaatttttttatattgaagatgcacgtttattgttactattttatcttttcatgagttgatgattggggaatgggaaccaaagacacaggagctgaaagacaacaaattgtcttgtcaaccagaacaagagcttcacttccgtacgaattcattcaaacactttatgattaaaggtaattttttt

SEQ ID NO: 4728 - DNA, 1039 bp, Glycine max
  Soy_ogl_6577 Gm19:44821699..44822737 Cluster 20
atatgttttgctctaagactgatgctagaatgcatgtttgaggttaaaaaaaatgtactattatgatgttatttcaaaattgtgaaagtagcgggcgaagttaatcatcaggtggaggtgcgcctgagagtttccaaaattctcaatcgagttggaagttcattatagtatatattttcaaaggtaatgatgagtaagtgtaattcaggttttcacttcagcaacaaaagaatggaaacaggatgtttttttgaaatagttgatttttctgaaaggctaaaatccaaaattgaactcaagagtttgaaacttttttattaatttaattctttatatataaatgaaaggagttaattatatttcatttatataattttaagtaccactatttcgtcgaggaaaaaaaaatacaaaggaagtgtggaggacatgtatatgacagtatgagtgtatctaccgttgtatgccacatttccactctgtactcacaagactgctgctttccgtagccgttgggtttttggagttaggtgaccattacgttacagccgtgacaactgtttttgaaagattcggttcacgctatttattgttttttttctatgacggagaattgttcttttgaaaaataatcagtgatcaaaattgttattaacgctgtatgaatcttgtagatgctcggtcttccgtataaaaataccaaataagaacctcttcagttaattttatatgcagccaaaatccagttaaccttaagcgtgtgtttgatagcaccttaattcgatcaaagttgttcggcaatgaaatgtacttaaattctttcacccctgcatttggaacaactaaattatgatgaaagttgttgagagaatgtgggcccacatgtacattctttcaccccctgaagtcaatgataacgtttccatcttatcctcatttgtcctgtgtgtggtgtgtctcgttttcatcctcacctcaaaattgaaaatttataattttttttcttttaatatttatctgatcaattgtagtttgaaac

SEQ ID NO: 4729 - DNA, 1500 bp, Glycine max
  Soy_ogl_1643 Gm05:31651001..31652500 Cluster 20
ctttattctttgtgtacagaaaacaaaacgtggaaggaggaatggtaatttggttaaagaaagacgtcaacatttggatattaaattaaatcgaatcaattgtttgatatatagacgagacaagaggggtaccaccaaagacatggtttagagtagaaagtgaaacatcaacgtaaataacgaagcaccattatttgcgttgttaatttaactctttgctgagcttacattttatcactcataatcctttttcgtgatttttatttgttgtcggtttcgggctttcagctgaaacttcttatcgtggtcgatatcaatgacaacgataccgtttgctttgcacatgccagtgcaattatattgtgagggtttgctgcataaactataaacgccctgataaatttgcgtgcccttttgaaaatttatttgcataaaaaacataaattagaagagaacaaatatttgaaaaaattagataaaacttttaatttagtctttcaaatttctatgtttcactattaatagtgtctctatcaattatgatttgttccttccaaatccacttcttaattcgtctcaagtatcccttcttttaagatcaaaactttactttaattaatcttttacttatttatttatttaagttgaagttttccttttactatattaattcttcattctaaattataatttaacattaaagtgacatgcccatttttttaaaggtacttttgttaacactactaatgattactttgtccctaggtaatattattgacatttaaccatataagataagatagtaacagagttaacataaaagaaaaaaatgtttcattaatttaataacttaaataattgatttatataaaatttagcttaaattacactataaatccttttatttttattaaattttaaataagtccataaaatttaacacaagttaataacaattagccagtaggattcagcaaaaaaaggcccgtggggatttaatttatcattttaaaaataaattataattaaagactatattaaaaaattatcatagaaattcatttagaaactaataaattgaactataaggacctacatattaatataatctaaaaattaattataaattgaatttaaatttaaaaataaataaaaaggaatgtgtttttaatttgttcttttctatatattctaacttttaaatgttgaaattcaattataagttgactgtttgacccataattgatttgatttagtttaaccattacacgtctctaatatttttaattaaagatgtttaatatttttttataccataacattggtataaaatatatacaaattttactaataattaattttcatcaaaaaaattatctaaccatctttaatgaagtagtctctaatatctttgaatatagtatattaattattcttgttttctacacgtagatctctgagatcaaacttctcactgcatatttaagaccacgtacaaag

SEQ ID NO: 4730 - DNA, 1374 bp, Glycine max
  Soy_ogl_3984 Gm12:2929601..2930974 Cluster 20
attttcaaaagaaatgcttaattgcgggtaatgctttggtctgtttcgaagtcgtgagggttgacaacaatgaacaatctgtaattgttactctctaaaagaagattatataaataaggaaacttgtgtaggtggccacgagaccatagtttttaattatcaatgatcggtgactaaaacattgacaactctctagtcgaccccttacaatgtttttgtttttagtggaagaaaaatgtgggcattcaaagacaaagatagtgattgaatttttttaaaaagatctcttaattattgtgttttgtttcttttcattgtttaagacggagaagtgcattggaatcttatggaaactagagcctcaattttttaagtattaaaaatcaaattggagccattttggcatgttacttacccgcttcttttgttctaagcgcagtaaaatacaattaataatttttaatttgatgtaaactagactactattaaaaatattaaaataaaaattcaaatattatctctccccaaacattaatttcacatccaatttagtttagtttacaacaaattaaaaattaaaatactctctcttattaattctattttagtggtttagtttgactacaaaattgaagctatactttttaattacaaaaaattattaaataatcataactacaagttaatccttaagcgccgtaaatactgttttaaaattctacttcactaaaaatctactaattaaattattaaaataaaaaatccaaatattctctctctctctgaacattaatttcacatccgaccaacaaaaaataggaatatatatcaagtgttatatcatttaataatttattttattttaaaactatttaatactcaatattatatatataattgacatattttaaaaaatatataaaataaaaattctttaattatatacttatgtttgttgaatagggataaaatttaacataaacaattaaagtaatattctctctttaaatctatatatatgcgtatgcgaatacaaatgaaaaaaggtttggaacccttgaccatgtagtcttaagttcaatcatgagattttatatgtatgggaaaaaaaactttgtaaaagacttattattttaatgtctaacccatctaactaatctcggatacgagaatactataagaaacaaatacatatgttaagtttaatggtttaaaaaattcttcagatattaacttttatttttaaatctttcaaataatttatacttttaatatttcttaaactcgcaaatatttaaaaataaaactaaagattctaaagttttatgcagaaaaaaatgatagaatttattgtaatggctaaaaaaaagaagc

SEQ ID NO: 4731 - DNA, 1197 bp, Glycine max
  Soy_ogl_4370 Gm13:30705404..30706600 Cluster 20
ataatgaaaatattaaataaaaaaatttgatatcttaaaaacataaacattcaatatattttatatttattatgaattcaatgtacgcccagaaaccatatcttttttcttttttatttatttatgctagaaaccacatctaataatattgatttcatttatctctgttaaaacaattgtctttgtaaggtacttttttttaaagagtctttgtaaagtacttgaaactcgttatatatatactagtactatcttaaggataaaactaaagattaaagcacttttttcttaaaaacatttattgttgtccccatgcatattttgatatctcctgtcttcactttaattagttatctttctgtggttgcaattaagtttaggaaaataaatttgttgtacgtatagtttgaaaaacaattccaggatcgagtacggtatggtcataattaatttacaattcaatataattgttctattttttttcttcatgcatgaattgaaataattaaatattaaaatcaaatcaataacgcaatacattagttttttctaatacagaattttaatcttaattagtttagatatgataataacaagaagaacaatacttaatcttaaatcaaggttcctttaaaaaaaataatcttaagtcaaggcatacttaaacttagtctagcttatatttggggtaagctttaaattaaagcgtctatacatttggtttgtatttgaatttcttttcttgaccgggttgtgtagttcgataactctttcatagaattcttttagtcctatgattgaataattttatataaaaaatatttacataaatgcagtttacaattgttttcttttgatatatatcaattaaattctttaagatatattttctgagaaaatttaaccaaacatatctaaagtatccgcatacaatactttagatggctacatatgcttttttcatcatttgagctctaaaaaatacactaaaaccatatctaaccgtgagcccttgattttttttttaatttaaataactgttgcagcacagagttgcaccgttagagtttaaactttaaagatgtatgagtcacttataagtaataattgcttcaggaagctatgtattttttctcatagaaaaagtggccccaagttgtaaatcaatggaagaaattcaacaaatccatatcagta

SEQ ID NO: 4732 - DNA, 1900 bp, Glycine max
  Soy_ogl_4409 Gm13:32380201..32382100 Cluster 20
actgggtttgatcctgattaaaaaaattatttatttttcactcaaaatattatgccttttatggaatattttagaaactgggagtagattagcgacttagcgggatgaagctgtcctccattggatatctatttcattttcttgtcaactttggtcgaattaattccccactgtttcagataccgctgcaaacattaattttcttttccaaattcaaaattgtttggtactctctgtcttccattttctgcagagctctaacagcagaaggctagggaaagtaaacatatgcaggaagtgccagaaaagaaggtcatccatcgatagatataaatatatagagaaatagagagaattattagtttatcaaattttataaaatgatgtattcattaacttttatttggttaattttggtccctatatattgtttttatcttaaattgttttggtcgttataaatttattttttccaaatggaccttgtaaaattcttctttttgtttcgatcaatgctattttgttttattaatcctttaatatatatccatctttcattttagtcactataatagttgttttttttatgcttgtcactgtaataatttgttcattttgaataaatctctttgaataatatttaaggactaaaaactaaaatacaaggactaaagtaaataacaagaacaaaaaaataaaatacaaggactatttaaaaaaaacaattctataagtaccaaaatcaaataaaagcagtctatttgataagagaattacagagataaaaacatttttaaacgtacactttatacccgttaaaaaaactaatagaaagtaaaaattatagacgtataacaaatttaataatttgtaactatatttaaacattccttaaatgttcttaatgttgtgttttgtttcaggaagtaagctagctaaatccttacagttttattaaaaaaaaaaaaaagagcagaaggaaaatgattgacgttgatttgagattcatatcgtcgtatatcttctatatgaacattagtgccgattgaacgcagccaataactaagaaataagtgtttagaccatatattgaatgcccttaattaggaaagtgactcgtttcatatataaggtcttctatttggctaaatttacttaatttatctacagtggtatgtactattgcagtcataatttggacccactggggcctggtcttgtgaagagtttatgagttcaaactccattatgaatttgtgattgtcaccgtatacaaaaataaatgaattgcattcataattgggagttgaattctgatcatcgcatgcacttgtgcttgtagtccacgcatcccgaatgcagtactgcagatgtgattgcagaaacatttgtgcaaaaactatttgcgcgtaaatttttttgtaggtagtaattgaacttaattataatataactcatgcaaatgtttaactaattaagtccttatttgcgcgagcaagttgggttttaaattaaattatctacaattgtgtaacattgatttttaattcataaattaaaaaaaaggttttgttggagtatatctgtagataattggcagaaaaacctccacactcggcaggccgaatctatgtctggcaacggaaaaggataatttttttttacactttttttagtcttcaattactatatttttttaattttcctttacacctagtctacaattatcatctctcccatcacactattaattgaaatatatattatcatagtactaacttaattttccaagtttagaacataactcgatcagttattactcaactttcattaaaaaccttcatgccacgtcgtgcccaattaatacgatgatgagtgatgttcaccctacaccagtcat

SEQ ID NO: 4733 - DNA, 1500 bp, Glycine max
  Soy_ogl_4945 Gm15:9314601..9316100 Cluster 20
gttgcaatcagcaacttattttaattgcatatatcaagggatactaacaaaattaaagattgatcataaacagatcagctgcttaattttctctgctgtgtcagacattatttgtcacatctagcctcttcaatttgagactgttttcaagtattatatatggctggttttttagtgcattgcttaaataaattcaaaacagaaacgtgaggccacagaattattcggcaagaactcagaaggtcaattaattgaattggaagatgttgaaaagaaaatggtcacctctactgttattatgaatgacaattcagtcaaaactcaaaactggcaaaatgctcgagacatctggagttgtgagatcaacaaggctcccccatgcttgaatgatagcatctttccagccgcgtttcttatctattgctaaacaaaaaaatgagaataaatagaaataatatataggttcctcagactcctaaaatcttacaggacgacaattaaagtaagtgaggtcttgaagaaatttacaaggtctgcaacttttgaaaccttattactaattcctcaaaataatactagtggatctgaaattttgcatcatgtttattattgttgctaatatgtggatgctgaacatgttagcaaggcaaagtgttggttgctttcggtcccctctttctctatttcttttgttattttctttgctttattacttattttagttctttcattcaatcacttttacaattctcttattgcttcgtgtctgtcagagtctaacactatttaaaatctctgactgcttgatgtgcatggcaatttttaagaataactgtttgacataggagttagaattgctgataaacataacacgaagtactgacaagccaagacaagaaaacactgcttgagagatatactgtcaaggaaactcaggtcagtatgtttaattttgaatattgtgttgcctgcatcaaactctacaatttgccatccgagttaatctagtcagcatatttaattatgttggctttttattttgaaaatcttagtatatttggagcctcacaaaggcgctggcttaatgtcttaagagttattctttatcaggatcctaaactgagttatgctttttattagttttctcattcaatattatctgttttcctaaactgagttttaaaaaaatataaatttctgtttgcatgttattaagtaattgtatgtggaaagagtccctcatgctttcacatatgcatcttctcaaggttttcttagctgtaattcagtttcataattttgaacctcgtgtactatttacattattggcatactatttttcttcaattatgctgccatttttaatatttattttaataaaaaaaattctgcatcggttcggatgcaaactgatgcagaaactttgttttttgcaccagttttcagaagaactgatataggaagttcaaccaaattatccgtttaggcataaaccgattt

SEQ ID NO: 4734 - DNA, 1800 bp, Glycine max
  Soy_ogl_2388 Gm07:35854401..35856200 Cluster 20
ggtgtagggtcccatgcataaggacgagaataaattaattaacttgcattggaccacctgagattcttttagaccatatgcatgcgctttgaaacttcaattcattgtagttccaaattaaattagacagagactgaattgatgttctttcattctcacttgtcatgactcttacaaagggaaaggaccatccaccatatttgactgcatcattctcacctttaacgtagatttatatagcccatcaatacattaattttctaaatccctcagcacctaataaagtcaccaatactagctgttttctattgagtttgtctttcttcaattctatgttcataattgacgactcagagtcacccaacttgtgcaggttcggttgacttcaaaacttgcaacatgcaatgcaaatggagatggcccatcataacctggaaactggatatattgaataacgaaaagtcaattaaatactggttttgtgatcataatactttatttctaataatgatttccactaccatttataaatttatcgtttaaattaggacttgattctcgcaactaggacaattatatacacaattcgtaaccttttaaacgaaaaactatataaaaaaatgtttctaaataatgacaagtgaatagattgtacgtatttcttacgttgtctactcaccatgattttaattgggcatattagcctttctaacattacaaaaaaaattacgttggttggcagttttttaaaaaagaaaaattgacagctagctgccacttcaaatgtatgagacatttaaaatattgtattaagcagtatgatgtgaacatgcctttataaataatgaacaacgaataatcatattaaaatacgtagttatgacgataaagtgtaatatatataagagaaaattagagcataccttctcaaggataattttaaatagctccaatatatagaacttgtctctggttgtgttctgcaatattctattagttattatcaatcttttgtgtatgatatctcagttggtagttcttaattggactggctttgatattttgtgacacatgcatacatatacaaggaatttaataatattggtgtaagttcaaataatccattcctcggtattttaacaattttatactgaataaatttatcacaaaactcaatttacgtaatagtttttatcatataaattatatatcttcaacattttaaattaatttaatgcactagttaaaggattaaagattaaaatatttcatagaattttttttatcaataatccctattctaattttcaatagaaaagtgcttaaaacgtactctctaaattaatacactcttaatttgtatttgttaaaatttattaacaactatataaaattaggaaagatatttattaaataagaaactatcatatccaaaaaaattatgatttttttaataaattttagtcaataataaagaaatattcaaaataatgtgcataaaaatgtgttaccaacctttctcttttttaatataattacatcacaatttttataaaaaaaagtcatttttatttattgcttagtagttttaggatacttgttttatatattcgcaaccatagctagtaatacttaagtagaatacaattctataggcttgcaattagaggggggcaatggtcgatatttctgcataaaccattgaataacttttaattatctgtggaattctactcggaattagatatgcctctttgaaaaaggaaaattataagcattacgtcatgtttgtaccatttt

SEQ ID NO: 4735 - DNA, 1671 bp, Glycine max
  Soy_ogl_4333 Gm13:28685801..28687471 Cluster 20
aattgttgatattttataaagtagtcaatatttatgtaagcaaatatcagtttattggataagatattggaacaatatcgattaaggaaaggattatcaatatttgctcgtattaaatatgtatgaagaaatattagagtgatagccatttatgaaaaatagataatgtgatttgaacatgtattaaaaatgtcattgaaaatactaataaaaaagtaaattgtatgaattttaatttgtaagaaaaaaaccaaaaacaagacattaggaaaaatcattaaaagatatctcataataaataatatatttaaaaataaatttagccttcaattcattcaatagtattgtcatgttatgtgattcatgtaaacctagcataaatcttttgttgttattatacttaaataagtcagtatgttaaattttaaaaaatctaaaatataatatttttaactagatgagtttagataagtaatctaaaattctattatattaatatgaataaggatgatttatttaataagagaatatgtgtttgatttttattatatataaaattttcttgaacgaaattaattccaatgaattgggaaaataaagataggtaaaattaggtctaactcaaatgaagttataggcttgcggcgtgcatacagattgcagacatgcacgtccacataaactaatcattatattagattaagtattagttttaacttttaagtaaaataaatcccctgaggattccctctcctttacacgacatattataaaccctgcaccacagccattcacaatactataatatgatttggttctgcctccaaaatcccaatatgcatagcaactggatcaattgaaggagatgttctgaaaatttaactataagaagttaagaagtgagctttcctttttcataaaaacaaaaacaaaaaactgatctttcctaatagcaaaaataacggtatttgcttccacttgtacgaattgctactcatacattttatatttttaatacttcttttacctttttatttatttatggaaacagggattaagttgttctaagttaccttacatatctgtcattctttaaaattatgtcagttgcaataattaatacatttagtaattttataatttacccatatattttctttcatacagcactcaattgtgaacataaaaaaatgtttaatttgatattttcctctttttttataatgcattttcttgtttttttactgattttttttataaactccttaaaagaaaaaaggaaaatagaattgcattatgtatgatggtgcttacttttgaattcttcattgcgatcatgcatgtgtggatcacgaacacttcacatgattatgtgagtgtgtttaaaccatacgttgacaatttgttaattgacaattgtgactaagataaagatccaatatcatatatatatatagggtcaatttctagccgttactatattatgcaaaaaagaaaaaaaaaaggaagtagaatagcttgagaacttggaagagaaacaaagaaagaaataagaaaaggaatccctgtttaatagcctccattgaagaagaataagatgatcatatttttttctaatgataagcaaagggaaaatttttctactttgataaatcagactggacaatttta

SEQ ID NO: 4736 - DNA, 1646 bp, Glycine max
  Soy_ogl_5911 Gm18:2962729..2964374 Cluster 20
gcttttaaagaggttaatatgagaaaacttctgtatattaaagaatgtataaactaaattttaacttattaaaaaatcttattatttttttctcataaatatttatcaatgtagaagtttattcaaatagaactttaatcataaatcatagacacattgcatagaccgattgtgaataaggacaagcagcgaatccctgaatcttacactaaacacttgctagcagaggcttctggctcctctcttttactagtagctgttgagccaaattaaagtcatttcaagcgcaaatctctgaagatatattttattgtgattcaagttttgtctattatatagacttctctcttttttttttaataaaaagcaaactaattaagaaaaaggaatagatatgaagcatgctatgatatattttgtaattattaaatgcatttttcttaaagagatcgagcttctattcaacttgatacgtaccatgaaatgataaaagattgagggctgtggaacccagttgatttaaaaatgcattattagtactcaataccactttcagtggcctggggtatgctttatctgggcacatggcaatttattcataaaaatgaatgaacatataaacaaaaagatttttcttaactcaacacacaagtaaacaggtacagctagtgttaagatcgatttttcaatgatgagttcttcaatttgattcccgttgagggaaatgaaatcttttcccttaacttctactattgtattgcagaaaacaacatgtactcgtaattaagttttatttatttcgcaaacagggctggtttagggtatttgtaaaggcattgaaacttgaaagctagcaaatcttttctttcacgtttggttcattgcgatgtgtgcaaattaaggtgcaaacacacacttaagactataacattgtctgatactttgtttgatatgtaatatgttttttttttaaaaaaaaatacatgtcttttttatgggagatggtttctctcgaaccagaagaattactataaatgatgaaaccctttctccaaatatttaatacaattgcattttcaatagaactaagactcaaactcaaaaatatctgttaaattaaaagaatcccttgtcatataatatgaaatatatgaatagaataaatatattgtggcaatatggtacttgcttaagtcaccttacataaagaatggaaatctcctaatttttaatctgagaattattgataacacattgtcatatatacttattttaacatttttaattaattattaattgaaatttatcgaattaagttaactttatttcttatttaaatattttatatacaattttataaatttaaactaatgataaaatatgttaaaaaaacgattcctcttaagttaattgaaattgattccagttgttcatcctgagatttttcaacagaaatcaatggttagtttttaatcaaactaaatataataatgtgtaaatgtttcaatacttatatatagggaacgtttttaatacaaaaagttcaggagagaaaatgttatttcacgttaaagttaaaacatgccataagtcacacttcgggagaattgacatggtttgattttgcttaatgttcatagcagcaa

SEQ ID NO: 4737 - DNA, 1395 bp, Glycine max
  Soy_ogl_1663 Gm05:32635806..32637200 Cluster 20
ccaaaaaaaataactttttctttgaactgtcattatctacttcttgcatgcttattgtgtagcttagcttttcttcattactgtgataacatgtgcacacacactgcaaggatgcttcttctcatatcttttcccttgttctctttatatatcggtaagagattaaaaaacataaaaggaccgttgttgaagaaaaatccttcttatgctcttgctttttccggatcctttacggtggaaattagattcgatcactttttatatacttattttcataattagtaatgtctccaatttaaccagaaagatattctaaaactaagcaaaaatattttaatgacgagtgagtgacgacagaaacgtcaaaccttgacgttagaaggccactcaaagaaattggggtttcaatcttcgttttgtttatgggacctggttatttgataagggttcaggttgggtcgatctttcactgttcctctgtttcattttgaacccaatttgctaagactgaaaaagccctaacaagaccgaaatgtttcttctcacaaaaatgcaacttgtcatccaacaaaaacatatgcatacaatgttgatatctgaaccacatgtttttatttatccttcactctttatctgaaacaacgttatgttttaatttatttaataaaaaaaacattttagtttatttagatatctgaacagcatgttttcattttatttatggaacaaaaaaaagcatataatttatgttaatatatgtatatatataaagaatttaatcatattgtactgacaatgcaaaagtttttcatactataatttaatttaagtgtgtgtgtatatatatatatatgataaataaattttctataagatggatagtctataaaagaatagaatggattgaaaaaaattgaatacttagatgttagagtgagtaatggaaagaaaaaaaataaatcaactaactaatgcataataacattaattgttaaatcagaattttgtaaaaaaaattaataatgacaaaatatttgggtaaaaatattaatcaaatgaaattaatgacacaataaaatttccttaagaaacaaattttgtttttaataaaaaaaatgttaaatataagccgcgcaacacatttaagataactattctagttgatattatcatctcagtatctcgaagagtttaattattcggactgagtaattatttattctactctatagcattattcattttttatatatgaaagaggctgtttttacgacatatatgacaagatgagatgcttgattaattgatattttctttatttgagataataaactacatatttttgtaatcaggtatactgcaacgaactcaaatattaaatttactaaaattttc

SEQ ID NO: 4738 - DNA, 1601 bp, Glycine max
  Soy_ogl_2326 Gm07:10489501..10491101 Cluster 20
cgaaacgccacgttaactatttaaccgcttgtgcctcccaaaattccccaattcaaacatttctgcctcttgggttatcctcttaaaatcctttctttgttttttttgcatgcctagctaagtttgctttagatatttatgccaacaatttagttgcctatagtatatgtggaatcatgggggaaaatgcaagccacttaaacaaattaagttagcaattcagagttggggaatgcataccacttaaacaaagttaccaattcagagttggatatgtcttgaatcatggggcaaaaaatgcatgccacttaaacaaagttagcaattcagagttggatgtcttgaactgcaaaatacagtacctatctgattaagctacggacggtgccaaaataaaaaaaatacaagaagtgaataaataaagctactttatcctaatattcagagccaattacattaagtatagtttgtataggtaatgtgaatatgtagatgtggcaatataatttgacagcaagagcatagcagtggctaaataggtagaagattgagggtttgggtttggggaacaggctcattgttatttgggtggtgggtggggtgggaccccgcttcagaagtcatacagtggggcatctttttcttggatgatgagcaagctgtggtgcggaaatccatagccacttgatcatggaggcacatgaatatataacaacttctgcctttgaacttgtagtagtagtatttgtttatgtatacatgcatgccgttggaaagcatacattgcctaacccaaaaaaactgtgcagaatttacttttttttaatccttggatttatcagaaaaaaaaactctaactaattcataattcaataatgaaataaaatttaattaaaaattatttatcaaatattaaattcaaataatactcaaaagaatttaatcaatacattaatcatttatattcaatttttgtttaaaaaaattgtagagtatatattatgctttgtgcaacttcactcgtctattaattttacctataaaatctaacattgtaattaacattttattgcttattttaacaggcatagcgtgttctagcaaacatccatgaagacatacctgtctcatttcttaggcttattaaacaacttctcttaattatgccaattgaatttgagatagaattaaacacctggcttttctgacttctcattaacatttcagcgcgtaatataatctaatcgttcttatagtatcttactttgctaatgtttatatatatataaaggtaaatatataatgattactattcgtgtacacttagatatgccctcataaccgcttgcccggctacaaagaattctcagagaaatgggagggaagcataccttatatgagctaaggctattcatgaagaaaaacccatcatttcaattcaaatcaaataaaacccaatagaaccttataagtgtaacataattgaaaagaagccttacatgatgaactaaggttattcttgaagaaaaacacatcatctcaattcaaattaaatataacccattagaacctcactatcttttcgttaatacatggtatac

SEQ ID NO: 4739 - DNA, 1479 bp, Glycine max
  Soy_ogl_2337 Gm07:14776022..14777500 Cluster 20
cgaatagtcatttatttcattttattcgttcagaaccttgttaggtcataaatagtataatatggagtcaatagaagaaaaaaaaaagataaggatgaacagagctgagaaagaatagtgaaaattaaattatggcaaagagtgagagaagggacccactgcttttggccccggcagccaccaaacacaaacagaagccctcatttttggcttcccactcctttattgttcatccctttgtcatttcttcctccaagatactcatactgtactgccaccatacacaaacttccctccactacaccaatcaccaccgtccattcacccttaccctttgatctatcattccatatggttttggaaagacaacttgtttattttaataataaaatatgaataactaaacatgtatactatgtatagactttataaaagtctaaggcagaatattgattcaaggaattaaagatttagtttgaactttcaccttatttataagtgaaagttctaattctcataatgctacttttcttgtttagtaggtgaccttttcctgaaagatctcttggtgtctaagaccagtgtagtaattttgtaggtgaatatctatttacagtctatatttatttgttgataaaaaattatgaaaaaaaatacatgtgaagagaaaaaaaactcacaaattgttaataaatatgctaatttttataaaaaaaaatcttaaacttatattaaaaataaatttaattaatttatgtaaacaatttaaacttttatattaataatatatggctattaaactcaaaaattcctatgctttttttacaacataaatcaacatcaccatttagtgttacaaacgtatattttgttattttcttttctcaaaaatatttttctttaaagataattttgttcaaaacatattctattaataataaacaggcatctctcattaaaaaattaaattcctaattgatatatattacgttaatttattgttttgaaatgttgatatttattgaattgaattcgtcaataaaaaagttattaagttattcttttattacgggatcagggtgaacactatcataagttgagttgaattaacagattaaactaacatgtttaaataagattacttgagtctttttgctgcttatatgaaagattttcctacgttaaaagccgaggaatggctccaatgccattttgatagaactgccaagtagtgtgtaatgatttctacacgttgacactgacaataatgtaccgttaatctagtctaggaaattacttggaaacaaccaccttttcagaatgatttttttcccttttatatattatatttaagcattttcatgaaaggaaattaatttaatgcattctttttccctttaaatgccacgtacgtattttcaaaataattgtgaaaaatcaatattcgggtatcttttaacctttgaattttactgaaat

SEQ ID NO: 4740 - DNA, 1552 bp, Glycine max
  Soy_ogl_4078 Gm12:33793149..33794700 Cluster 20
gaaattttaaacccaactttttgcagggatgctgatgtccaattccatacttcaaaacaaaggcccaaacagaatggcccgtcaaataacaaaacccgggaaaaaaaaatgcagaggacattgtttatgttcttcttactagagcttacaggacatgtgccatgatgatcatcttaagttatacccattccagattccactgacaaacacaaggaagcatgctctttcattagtaaaattttataactaaagcatgctcgaaaatacttctacaaaactactataattgaaagaagagatatctctaaataatacttatcaataaaattgatagatactttgcatatatgataaaaataaaaaaaaagtatttaaacaaaggaaaactaatatacctttaagatacttgtgaagaaataaaaaaatattaaaatattattataaaaaaaaatgatagtcattatataagaaatatgttttattatgcaattaatttacaactatctacatcaagcagaagattaaatggagaagtagttgaatgtttagtgtaactttagatcgcaaatacttttcaaataatttaatattggaaataaaagaaaactgaaaatttgttgaggttttttatacaaatgacattttagagctgaaaaaagataatttacaattttagctaagatatatcatttttaagtttttcaaaataaaaggggggaatcaacaacattttcatttattgatagattaaaacgtcttatgtcacttccaattttagcaacatttatagaatgagcattttaattttagttggaaaagttctaaataatagattcaaggttctatataagctgaaattcaaacacattatatcatgaatcaattatatgaaaaataataaactgggtgtgaaaacataaatgattttacattacataggtaacatcataacatgtctatttatgcaagaacccttcagacttaaaagtcaactttttcgagaaaaatgaagacaataaaaaccaaactcgatataaaagggttgacatgtagctaaagatctcggaagaagcaagaaaaaatgtggtatgatatgactaatctatttctacatatattcaacgggaattttgaaggatgataaagatatcactatgaaggatgatctgattataatgaaaagaaaaagatcctctagactcttatcttgtgtttttttttttatttattaaatatgttttctgtccttttaaataaagtaatattaatttttagtctaaaaaatcaaaccatttcttctttataaaggacaaaaaactgacatattttcataaatgatagacaaagaatataatttattttcgaaagaccacaaattaactttgtttgaaactaaaagcatatccttttaaaaaaaatgttggtatcgcttgttttgattgaatcaaagaaggcgatgaaaaaatagggaagtggtttcccatttactatacaatatgaatagaagacaatgcataaggcgtagaagtaaaggctagggccatcgttctta

SEQ ID NO: 4741 - DNA, 1500 bp, Glycine max
  Soy_ogl_4231 Gm13:23680201..23681700 Cluster 20
acttagtgtaggccatagctagacagggcgcagcaaaaagattcttgaaatgcacaaaaagatagttcaagcctaaataaaaggcaatttgcctaataagatttccactttttattggtatttgtcaagaccagctctttgagacgtgagacgggcctagcaatttctttgaaggttgaacaactttatgttacataacaataattctcccatgccttttttttttctgttttataataaagtctaaggagtattgactttatagtttatattgtacactgtacagcatttgattttatatactccatggttttgcttttcaaaacccttctttattccttggtcaatattatttattggtacagtcttagtcaatacttgataatgaaaaaatctgtagtctaactaaaaactaaagatgaaaagaggcccaattgactttatatgtgctacttgtattttatgggagtctatcaaaaaggatgaaaagatgcactctcctctctctcgaccaaaaacaaaaacccatgctttcccaagacccaattacagactccagtgagcttggttcaattttaatccaaatattaatcacgaagttcaaccaacacattcaataagtcatgctcttcgtgtcaagaaaataatcataaagaatgtataggattttttttttaactgtgaagaattctttggggttttctaatttagaaaatttgaattcataattgtagttgttgggtagaataaagataaatttgataagtataataaatattaaaaatgtgaatagctatattattctacccaaaaactattattatgtcatatttaggagatgctatctattttgtaaaaaaaaaaagatataatatatgtatattaaacttcaaaaataagaaataaaaataaaaaatcttttcttaaaccaaataaatataagtatttcacaaacaatcaaactcatatcctattcttatagcacgcccatcatcatagttttgagtcttttgacagcaccataattaattttagttttgccctttaaaaaatattttattactttaggtttttctaaattttaaaattttgaaaccaattactatgactccattttttttataagagaaaaaacaaaaacaacaaactaaaaggtagcccgtaacagggatgggaattggtaggatttagatacggttctatagtatttgtttaaaaaaattaattaaaacaatgattataattatagtaaaaaattcattcttaaataatccaaacataacatgaaaaatatacatataatattaaaaataagcaaacaaaacattgattcatccaaactcaaatcataaataaataaaattacaaaaataatcatccaacataacaattgttaaagtcaatgatataatcacttaacaaaaactctaattaaaggttttctattctttgataataatattagaaattagaaacttataatattagtcacaaaaaata

SEQ ID NO: 4742 - DNA, 1604 bp, Glycine max
  Soy_ogl_5736 Gm17:36883046..36884649 Cluster 20
taattattaaataagtatggttacaaaatttaatatcttgtgttaaatattaatcattaagtaaatataacgcttatttattcatgacattgatatgtgtttttaatgagtgtttgagcggagtagttttgtgaccgagatgaatgctaataatgtgttatatccacttctatatcttcataaaactattgagtttgttagttgttacattggataaattaatagtgacaagcaaaataaaactgatttttgttttatttggtaatcaactgctcattttatatgaagtatttgcatgattgagtaggcaaaacttgcatcttcaaaattttatacacggattaaaagtgttactaaaatggtttcgcaagtttcaaataataataataataatagttgtacatattacttatcttttttaatcataaaatttaacgtaatatataaatgaatgaatattacaactactactattattattattattaatcacaatcaaagttttggatttaaaaagatttcaggttttaatattgaaggattgctccagcaatgtcaattcctcaagtctttttcttatgcgtccttaatgaccaatttgaaatggtaattaaggttagaaacttttaataataatggaggtaaagaatgtcagtggttaaataaccaattaatttttattaatattaatatgttatcaatttgaaagatggagattacaaataattgtgaagatacggaagatgtaaggttagaatgtaaagtaatgagattttagtaaggttagaaggtttaaaaaagatgtaagacaattaggattgaagaaatttctttttggcatatgtagaagatgatttatatataatatagatagatacctgggtgacacatactttttcaatttataaaaaaattaataatatttaattatgtttcatatataccaagaatagtggaaacaatagtaatctagctagaatcacttaataatttttctcatagaaagtatacttaatctccttgtattatatatgaataaaaaaactcctcgtacgtactgcagtacctatgaagtatatcaacttatatatatatatatatattacatgatacaattaaaatgcaatatctgtatcatcacggagacagcattaactaattaagtttattcgagcataaacattttaagcaagctaagttaccctgttctgctcccaacagtgtcctcccccctccccccaaccccaaataaataaataaatgaaataattaacttggtaaagaggtagaggtagtcatgtgccttcaaaaagcaaggaatcccaagattttgtaccaagaatgaatctttaagatatgcttattatataagccagaggttataaacttatttgaatattagagaggagggccaatgatggtgcttaggataatcataaatgagctcataggatcttgtttggatacatctaatgcgcgaggatcttcccacatgtatttgaggaaccaactccaaggaagtaactttctcttcgaacttttttaatgaatattcttgtcttgaattcttcatcatgtttgctagttccagctaggaaatctct

SEQ ID NO: 4743 - DNA, 1817 bp, Glycine max
  Soy_ogl_1283 Gm04:7780484..7782300 Cluster 20
tatacttatatcatcgttcttttagaaagataaccgttacgacaattacaatctactacgtaataattaaactaatcagggctaaatccatgatttacatcgccaaaactatacacttttttaccacgataactgccacatgttacttgtcgctttttctaggaatctaactaatcattaatcatcagcgtcattgattaagaagcatttaatgtacttagaaattactttattaaatgctttctacacttttaacatactagtgagactcacaacattacgttttctttttggtataatatttttttgatgaggttttttttttggggtataatatgaatgtaaggatcaaggactaaagaaagagattcctgaatcatggaattaaaattacagtgcatatctaaaaattaaaaattaatgtatttaataaaaaattattaaatttaaaagataaaaattatctaatacctaacttttaatttgaaataaaaaataataaatacctaggcgttattgatttcattagcattgggctcaaatttttgaaacaagtcttgtttcagtcttataaataaaaaatatatatatataatcaaaagaaagaaacaactatagctgattcattaataatcaataaaatcaatagatatttttctatcaatctcatagggattaaaacaaattatcacaaataaaaaaatattcttaaatttttattcttcaaactctaacctcgtcttatttttctccttcaaaacttttcttttttaacgtcctcattcaacatttcctgaatttttttctcatttttcaatgaatatattgttttaagagttaaaaatagtacaataatttatagcataaaaaattagaatgttttttatacaaatatgaaaaagaagagagaaaatacaaaatagtgcataataaaataaataaaatgatagaaaaagaaaaataattattataaaaaaatagataaaaatattagtatatgagtatagatgcattcctactcttctaaaagactaactagtcaacgcccagtaggtattctaataatttatcatgtgaatattttattctgccactaaacctcgatgatgatctgtgtgaggggcgcaagttgtaaccgaagagatattataacgcctgctctacgcagctcccatgcacaccaccttgtgtgacacctccatatataacgacacgtgccacgttgatttgatttgattcccacacagtaaaattcacaggccaccgcttcaactcaaaaatacccgtgtactccaatgtactactacttcatcatcatcttcatccatccatccttgtgcatcaaagtgggaccactgaaggagattcagtctgtaatttttactactgagtgtgactatgcatatactcctccttgctgaattattagtggagtccggtatggctatgtgtacaaccccaaatttaccctgacattaacctcggattacagtgtggtaattttcataaacagtagtaaaagctagatgtcagttacttcaactttggagtagagtagaacagactagtactgtttcatgcatgtctcagcagcagcagcgtagaatagagtacaaaaaggtgaaaacaattcattggcataataaaaaagagtgatcagagacatccacatgacccattatcctttcttggtgtgttagtaagccaaaaaagcccccctccctctctcaaacacccttgccctttttcccattggtatccgcctcctacaccactctgggcaagtaggcgtatcctttcctttctatttgcatggc

SEQ ID NO: 4744 - DNA, 1100 bp, Glycine max
  Soy_ogl_4726 Gm14:6872301..6873400 Cluster 20
ttgaaaaaaaaaatttcactaaaagtgatcattcaaattttttaaccaagattaattattgatgaagccgataaatattttataccaataatatgataatatatatatataaaatataatcaatattttttatatttaatatttataataaacatttaataaaataaatatttattatgttcatcattaaatatattctggaactaaaatcacaccattattaaacctaaagtactgaaatcaacatgcatgctaacgaggaattaagtaagcattttaaatggatcaccatgtcaacataaaatcatattaaaatcatcaaggaagtgtcacatcaaatgacattagtcaatgtaacatcaaccatgttgaatgaggagattggagtcgtataattataatatttgaagacctaattggtgcagttcaaactatactaaaattgcatatttactaaacttagaaaaccaattagtacaagaagtatattttcatatataatattaaatgtaacaaatattaaatatatttattaaactttttttcagctgaaatatgcttggcttaattacatttttcttttttttttcaatttgttgacacttttatggggattgttattcacactgcccattttgttattgcactatccgctaattttacttttatttttatttttttgtaatctttttatgcaaattccgttcatggatattaattctctaacatgaaatcatacaaaactagtctttgtatcaatttagaagctttggagatggtgaaatagatgaatactttacaccaaccattgacataattttcaaaagaaataatatattataaaaattaatttttgttttgcattataaatgtaaaaagtgaggtgttcgttttaagatacacaatagaaaataattttcatttatgtattgtaaaagaaacacatctttatttcaatttatagtatataatattttttttaaatattgaaaagttttttaaaaaatggaagtatgaagagtaaaaagaggtataaataacaaacctccttatttcatgctatctcatttttggtttgtccttagtgtaatataaatcaa

SEQ ID NO: 4745 - DNA, 1553 bp, Glycine max
  Soy_ogl_1266 Gm04:7016248..7017800 Cluster 20
ccattgtcttgaattgatatgcatgtcttcctgttaaaggagaaagaggaaaagagaaaattttcttatttatttcaagagaagggaagtaaagtaaagaaagggaaggtaggtcctttaatttacttcacaagagaagggaacggataatttggataatatatactatcttttttattataatatatactatcttattcatataacaatagattttaagaaaatttaattagcatagttcaaaaattataaattactctctcacatgtttaaaattcctttaatattagaggggaggtaaaaagagcaaggacgggttttaaccctcctcatttttcatctaattttcttcaaaaaaattaatcaaatgaggtagaataaaaaaaaatcatccttatcattcattttcctctattctccttcaaaaagaaatcataatagaagttcactcttaatcctatttaagagtcacattaggcaaaccactttatatctcgcactctctttttttcattatatacagataagacccaccgatcgagtattaaaaatgtccaagaaaatacatcacatgtgaaatagtagtagtagtaatgcaatttttgtaaatcttcaatatatttcctattcaatgcattcaattttctccttttgtgccttaattaattaatctctgtcttggctttgatcaaccttgattctctgaattattttatattggaaaacatgttctgattccatatatgaagcagaattacgatgaatttgatattagggataggatttcggttcatcaatgcttgcaatcctcttctcttaacctattttctagattagatttattaaggaattagagatttaatgtaaaaattaagtctaaattacctgaggaattagaatttgagaactctatgaaaatcgaacgtgtgttgaattagagatatgatctaagattttaattacatgagattcttatgtggttcaattcaaacagcatttcctttcttagtttacttcaattttcctacgcactctaattgctccataaaattctacaaacaagttttagtgattttatatttcaattttgctatgattcatcttaaatggttgttattacagttttaattagtgattttagtatcaattacagaatattacacgagtcctttgagatgtgacactttattaattaaagtaatacattacgattggtgcgcttaccgatttgtgaacaacggtgcgttttgttatggccaatgcacgtttggacattgtgtaacttttctattttgattgggtttctatttgttgcagtgtgtgtttgtttgctatagtgtgattgcactgctgggttgatgatgtattcattgctaggttaaggattctgttcatttctatacattgttggcgatgggaatgaagacgcattacctccattggcggttttcattttttatttttttgcattttttcatcatttagtgtttgcgtaatcgtcagcttaatcaacactattacgcaacgccaatgaaatttatctttatcataaa

SEQ ID NO: 4746 - DNA, 1700 bp, Glycine max
  Soy_ogl_2385 Gm07:35830001..35831700 Cluster 20
agaaatatacagattccagtttttatctatacaacaagggacgtaccgtgtaagaaaaacatgggacgtaacaatcccattacgttgcaaatatgcatattaataaaagaagctgcctaaaacatcaatatcatctataagagaaagcataacttgagaaagacgttaagaaagttttctttggtttgtttctcattctattccctttcccatgtggccaacgtcaatggtaatttcgatcggttgtaacctattaatctaattctagtattatatatagttttgagtcataattgaaaaaacgattttgtataacaatcgtggattttaagtatgaagtctcaacccaaacctttgactataccaagctctttgtgggtcaattggtttatgttgatgatttgaagctgaattaattaaaataactcttatttctattagactgattaatatataaatacaatcaataacggttaataagctaactattatacatggagtacattaaaaaataactgttgaatttatttttcttttcgtttttcaaaagaatactaaaagaattatgttgagaaacattataaaatttacagattaattatacaagatgaacatgtgcagatcgttagctgaactgaattgttggtattacctactagctaagcattcacttattttgcttttttaaatcgttgatgtaactgaaaatttggagtgacagcttgcactaggtcgagatttaagcagaaacacttaaaatagcgtatacacggaatttaaggaacaatagttataaaaatttagtaataatctttaaaataatgataataattagcaagttagctggtcgaccctgccaagcagaatcatattatcctacattatatacattgtatgatggaagaaattaatggaagcatgtgttccaagaagtttcagaagtcccaaaaagtccataaaggaaataaagaatttattattgatctcttaatcattggtgttaaaacactggttaacaagatcattactgagttaaaatggatcagaggcagtgcagactttggatgacatgcttgggtcttttattcctggtctggattttcagaatgggcttttattagggtcccattacaagtagcctacataagacttttttggtattataattaccaatcttttgattatttttattatcatgaaacattaatttattacataaaaatgtttcttttatacaatttaaacaaaatattattctaaaatttctcgttataaacgtatttaatatacagttcattttcaagtaataaactaaaaaaatatacatataattattttattgaacatttttataattattaatccaaacacacttcaataatgaatttgatccgaaacatatttgccaattatcaattggttaagttgtatgaaaacaagattcacattacaaaatatgtggaaaatgggttaggttaagttagatagcttcttttttcaaggacttcactttaaatatgctgaacgtgttttaagacctaaatattgtctgttattacataagttttttttaagatttgattattctttttttaactgtttgtaattgtttgtaatttataatgtggatttatatctaattctatcaaaaaaatattttatactatttttttacacgagataattttcatcgaagtgac

SEQ ID NO: 4747 - DNA, 1026 bp, Glycine max
  Soy_ogl_3916 Gm11:35955575..35956600 Cluster 20
gtgttagattaaaaagtgctgataaaagtcagtagtagtgaattcaaaacaactacctacaaagtcactctctccaaccttttttatatatccttagaagttgggcgagataaagtaaatatgatatttatttgagttggtttttccaacaaaaagactcatagtatgatattgaaccacaggtgagatctgcttaattttaaatgttgccaatgaattattgtttccaaagaaattttcctttttttcccgttagactaaagggttgaatggtgctctttaaaattaatatgattagtgaagagccaaagaaatatgtaacatacctttagcatcatatgcattgtacaactccaacatcattcattcgattaaggggacagtacgcagcataatggaagtgcgtactcatctttagtgaaagaatatatacataatatataccagaaaaaggtacaaaagtttaatttacaatatgttttgctctgccttttaaaaattaatgcttgaacatcaattgaaccattgctggtgcactgtcattatctgaaagtatcaaaataatgggaatctgcaacttctaaattattagttgtgcacaagcataaagatattgatttatagttatgtggaagatgtaaaagtccgaagtcaagaggaaagataacttgtccagccttcaagttgatatgcagattaaagcctttttcattgcatacttataggcatttatcaaatctcatatataaataacaattatttgtaatgtaaatttgttacgactactattttttaatatcacatttatgcctttcagagggaacttaatttattgcaatactctggtttttcataataacataggaaacaaacatgttaattatggaagttattctcagaatttaagcttaccttccaactcagcttgaaaaaaagccgtacagcaattgaatgtaattacaaattggagcttcaaattttcaacatttgaatattgaagctatagtgtcaattgtcaaactaatg

SEQ ID NO: 4748 - DNA, 1163 bp, Glycine max
  Soy_ogl_417 Gm02:6482201..6483363 Cluster 20
ggctaatgtgcttttgtggctgcattgtgtaaagtgcttatattatgtgaatatgatataaagttttttgtttttctattttaattttttaacttaaatacgatgaaattattttttggttctccaatttttgttttcgttttaatctttataaattttaaaaatagttcttatcactgttcagtaatagtgtgtctgtaagcaattattcttagctaacatgtaatatgacatatcgacatgtatactacattataattaagtgattattgagactaatatttaaaagaaaaattataaaatcaaaagcaacaaaaatatttggacgacgaaaaataaatttaattttttgtaattactaaaatacatcttacgcagttacgcttaaatttttgtttcaaagacgtcaatgatgagacgtcgacaaatgtattgggtctgtgtaagtaataattaaaacagactaagatgagtaagatcccctttgtttatgcttattttttaaagaaacgtttttttaataaaaataagtaactttatgttttttttctatgtttgtctaaattatttttttaaacagttttttataagattttttttaacttagtccttgggtttagtttatcatgtcatcagttatatcgggaacccaacaaaaaacttttttagttttgggatctacatgaaaattctcaaatatttaaaaactaattcaaacatagttataatccctgccacttttataaaaaaaaagttataatccctgacaaatgatgaattgtcatccttagagttagatacaactagtgtgtctataagtgatcttaaaccaaatatcaacagaacagggacagcgaataacttggaaatctaagtcggacatttctccacgcctggagacaagatcatcatccatctgaatctgcttgtgtataaaaagagttgctctcattattaagaagtacatcatgtagcaactaccaaatccacacgtcattcagattttcagtcttttacataaggttatttttcttggctaccttttagttgtattcgataattaataaattaaatgaaaatttgaggatcatgactaagagttctgttgatcatggattaaattgtggcagcaacgttgataatgggcatagcaatctaattag

SEQ ID NO: 4749 - DNA, 1142 bp, Glycine max
  Soy_ogl_3522 Gm10:43754659..43755800 Cluster 20
atacaaaattaattatggttcctaaaagtgtaacgcaatgtcatattaatttgtttttaaaattattatttttttatcaaatatgcccttaaaacttttagttgtttcagtaaactgattaaacttaatcaataactgttattttttggttctacatcaatttaccagttaagttgtgtatttttttaattttagaattgtgtggttgacggattgtgttttcatgtatttatttggaatttaaaaaattttaaagatttatgtgacaatactatacatcatggctatttttctccctttttatttaatttcttgttattatatgtagctacatgctattcaaagattccggttagaattaaaaagggaaagttataactaattattttttttttatattaatttattaattttattataaatgtcaatttgaatgaaaatttgaactcacgatttttttctctttcttcttttatctttttcaattaataaatcaatcttatatcctctgacaaaacaagctaaaagtcttcttcagaaatattgcattggttttctcatttacctagctataaactttcttcgtttttctaatgacttacacttgggaaattaattttgagcttatatattcttaattagctttttccttatgtggtggagttatattcacaaatcactgcactggagtctccctcaaatctcaatgcagttaagcaaattctttttgtgttttgagctgatcgaatggagaatctttgcacgttatgattcttgtggctatataacatcaatcactttcacagaaaaacgactggggaaacaaatgaacataaatgcaactctgttaacatcaaagtttgagcgtttcgttgtaatctgattggtttgagttggagtgaatagtatgcgtatcaaatagattttctggctttgtatttttctcattattatccattatatgccacatgcggatccaatatcacatactctttcggaatgctacaaaatcgtatataggaaacgatttgaagcattatgcacatgcaattcgaagcaaagtaacttgagagtttgtgcttacccatggaccatggttacttttttttttttttacaaaataatttagtgcataagatatt

SEQ ID NO: 4750 - DNA, 1600 bp, Glycine max
  Soy_ogl_3524 Gm10:43802601..43804200 Cluster 20
tcttgtcaagtgttgctcttttgacatttttgtcttgctttgatcacatttagcatctcataataggatgctttgtccatcttttccactattcaatgtgaaagaaagatcaccatataatatattcagataaagcaccttatatagtctttactaatttcagattaagcctactatacatgattaaaaaaaatgtcaccgtctaatcaaccaattggtggaacactgtgagtcatgaggttagaaaagaaagtatagctatattggaggaagtcctaacttaatttcctgtttggaaagtggaaaatttcttttctttttggggggaaagtgtggggaggatatcttataaattaaagagataatgaagttaatatggacctagaattataggtgatagctattagctagtgggagtgcaatctgttcattaataagtactagtcatttttaaagtcattgtagctggtgctaagtcgttgttttaagaaaaataatagtgggtacgttccctttttgtcatgttctttagggctattcatcttttccgtgtacatgccatttgtctagataacctacttatatcttcatatatattaattttgatgctcttttgtttggtcctggctacaaccacagggttcgaattatctttaatttgccatttggtgccgcccttcccccttactttacatgtataaattatagggtgttggggaataatgtactaagatcctgattaatgaatctaaaaaaatttgtagaaatcacaagaagaatcacacaaaaaaaattataaataattttataaaatcttaatgaaaatttttatttttagttccttaactagtaataacaaatagtcattaaaacattgactaaggaactaaaaaacatactttattaggatgtgaaaaattacattacttataactcaattttttatattctcctttaatctctacaataattattatctttttaacttttaatcaatgctctaagaatattgttaagtaagactcattaaatattaaccaatctggtctttatggatgaccaaatttcataatggaatctttcttttgttattcaaaattattggcttatccttgttccatttgggcattttttgctatcttttaacccaatgagcctccattgttcccacccgttatgattatgttaatgggattagcacgctcatagggccctcaaacacgacttcctactaaattaaattagattataataacagcgaaaatgatcacgatgataatgacaaaaagtggctcattagagctctatcctccgcacaaaataattccatttagtgtttaaataataaataatttacatcactaattgctcggtcgcgctttttttctctcttcagtcatcatatgtgagctgaaatataatgaaaaggcaatcaatcatatatttctggctcttgttgctattggattagaagggtagctaactgaaagtgatgacaccaaaaataagaataatgtgagagattaagtccctatttacgtgccgtgcttgcaaaaacttcttatttgggttgattagagagttcaacttcaacatgaat

SEQ ID NO: 4751 - DNA, 1503 bp, Glycine max
  Soy_ogl_4978 Gm15:10793265..10794767 Cluster 20
gtctggtttaatttggacaaaccatttttcaaatccgtcgaattaaacgaaatcatttttcagttcagtccaattaaacaaactattttcaattcaatttgatgcaatcttttgtgctcaattgaaacatcaacattcctacctaaaatattattattacaaatgtcaaataaattaacatgaaccaaaaataaggatgagtaacaatagttattgtctttaagacattgtgttttttgtccgaattgggcaatatacaatcttgttgtccctaagataaaatatttctccaaaatctgagtccaagcattttttgttttgcacataaaaaacccaacaaatatgcttaaaattacttacgataaaaaaaaaagggaaaaacacttttttaaacaagagaaaacacattattttacgattgtcagcaggtaatgaacaattactgtcagtaatcgacttgacagttcaaaatttggagctattatttctcttgtcataatttacttcaagagttaccgaatcttagggtttgctttgtatgggtagcagattctcattatgatcaccaatattacaataatccacctgattgtatatctcatcagaatgatttggaaataatgagtatgttgttatatgtataaaaaaaactactatttcgttgttttagatttttttcttttacatattagaattcaagaaccacttttttatgtcatgaaaatcgtaatttttcacttgaatggggtccaaaaccattaaactagattaattggcttaatgatttacttaaatgtgttaaaaaaatagtcgtattaattggcttcgataaaaaaaaaaagttgtagtcctattgactccttgttctgttttttatttctcaatgataattttttttttgcttcgatcgaaatggccggctaaaaaaagacaacattcattttcttaattatttttctaaagtacataaactgtactaaattgttcttagtaaatcattcaacatgttccattacacagtattcatggttcgtgaagctataggaacaaattactcatttcttcaagcaacaatttgtaagaattggatccataacaggattagaatggaataaaaaataatgaagcttagatagagaattctaagaactggaaagtgagtccattaaaaaggcatgactggtgcaaataaaaggactttcgtgcatgcttccagttacaatgatcatggatttaattatatgaaatcatactttataagcacctcatcagagtccatgaagtttgaagacaaatcatcaaagaggatgttcgtggagtgttacgcgagattggggaggggagggaagagagttttttgttttgttttaaatcaattaattactataatactcttaattaatgaaactgcttaaaataaaagaaataattggattttttttgtctaataatttttggtgttggttgttattatactcatactaaaaaaagtatgagtacatc

SEQ ID NO: 4752 - DNA, 1500 bp, Glycine max
  Soy_ogl_2732 Gm08:16886401..16887900 Cluster 20
cttctcaaacttctgccaagctttcgtgtaaggtgtaaattagcagcgagtcttaattagatttctaaaatgagtctgctaataattatgaaatttcattgtcaatgagaattgaacatagacatgcaaaagagttcacaatcacatcatatggcattccctttcctgctgtactctagaagactattgtaaaacagtaaaagtgacataaataaataacagacaaaagtgttacccttcaaagtatgatgcgccaatgcaggcccccttggcagttattacatgtatgactatgaggaacaatgcgtgaaccatggtttatactaaataagggaattaatggatcttccaatatacatgataggttatgttaaaattcagtctccatttgttttgaggaaaataagcatatatcatttgaacataacttacttggtcatgttaaatattgactaaagaacagactcttgaacattttaacatgtaaaatattgactaaagaacatttgaactttcaggttagcaagacctatattaaaagcagagataaaaaagagaagagagatattgcaagataagattgttgaataatgaaaaaaaaatagatattatataaataaatagtatcatccattaataattggagtgagtgtggctggaagaggcccaagtcttatccaccatcctgggccaagtcaaaacttgccaactagtgaagacacagtcattcccttagccacaagaaaaggaaagacgatggctctaccttgactactttcaggatacatcttttctgtctgctcgtaaatatatggaaacactcttaaatgtgttgttgttaggtgaaattctttataaggttttgtctggagtattaatttgttacgtcattatttttattattaattaattacaacaaatgtgtgaatcaaatcatgtgagatgcagatttttacaggtttaacaataattaatgattttggagtcttggatatttagttgagttatatactttaaaaaaaattatggtccataataattttatctcacttaagttggattgtcctctagtagaatatagtcaatatacctttaatctagacaagaaaaaaaaattataccactaatcaattctagaaaagcttatgttgtgcgtattgttatatgaaagtaaatgaattcattttatttacatgacttatgtaagctaaatttacacaagaacttcagcacatctgatgttatactatttcacaaaagtgcaatccttaatagttgagtttaaattttgacacacaaaaaaattacattgtcaaaaattactttaaaaataacttttaaaatactcattaaatgaatcaatttttttttttactataaatgaaatttcataattaaaatattatataaaaaaaactttatactgtggactttatcttttttataaaaaaaaaatcgaatcctaattaacatatttaagtgatttaaccacctaccaat

SEQ ID NO: 4753 - DNA, 1549 bp, Glycine max
  Soy_ogl_3431 Gm10:37027356..37028904 Cluster 20
ctctttataatttgaattagctagtaccttccgtgaattctctccttttttttttatacatgattgaagattttgtaagaatataataatgtacataaaaaaacttcttgccgtacaattctttcttcttttatgcaatacctatacgtggaatggtcagggataggaaaggcattgtattatgtcgagacaagccatgtgtagaaaccttactttgttttcttaaaaaaaaaaaaaaaaaaagagtaagggaaatgggccgggatgagtttttttaaaaataactgaatataaatttggttttgattcaagatccagaagcacggtttagtcctcgtgcacctcatccctctctccttatagtctgaatagaagtaccttcacattatcatgattcatgaaccaataatttaaaaacttttttcagatgaaaatacatgcataacatgtttctccctcttaaaaaaaaaaacatgtttctctgaccaaggattctttggacttaaaatatataatatacatgtttatgaagcaaactttaatttactcgagcataaagattcgaataccacattacaaattaataatccccaaaacttaagtcattaagcgaaaatacttaattgatttttgtattacatctctaataaatataatgaaattctattataattttatctttatgtgtaaaattagtttaacttcaattccatatacaaaattacataacgtgactttttatttgttaaacgatagaacatgcaccccaaataaaatatcagctagaagacacctcttatctaccttaaaaacctaagctgacagaagttatggtatagttattttttacttagacagcatcgatcgaaaatttaaaacattcggatagatttaaaaacttttaacttttttttttttttatttttacatacagttgaaattttattacacttataatatatcaaggacaaagaatacagtaacacagattaattaacaaaacattgactttttagcaaagaattccgaaagatgtactggtgtaccaccaccgacgcatctacaaggctgttttacaattgttaagatcgcgacaagacttgactgaactactattatatttaattttaatatattactcttaatttttgctagtaattggatctagcttcaaaccattgataataaaacaatctgcgttgcagtgatgacatgatttggcttatgttaaaaaaggttaaatgtgagcctggccagacctaaatttgttgttctattcggctgctgcttcttcctctatgttagatggccgtttctcaattttgtcatatatattttttcatatcaaatatgacagggattcccaatcgaccgaatcagtttaaatctgttcacggtgtgagattattattagttcaaaattgttttacacatgataatgataagaattaaatataatttctcccattaaatatatcattcttatttatgtaaatgtaacagaaccttacaataattctttagatttcaattttatcatatgattgag

SEQ ID NO: 4754 - DNA, 1088 bp, Glycine max
  Soy_ogl_5641 Gm17:12004501..12005588 Cluster 20
caaatatttcatgtataaatatccatttaaatctttaagatctttgcaaaagacgtaaaatttaaggatcaaggattaattgctcgtttgaatatcttggtgtctatttgcaaaagagagaataaatttcaaatatcaatattaagatcaataaggtttagagtgtttatttgcaaaatggtaaaactaaggggatttgagtactcttttcccaaaaaaataatatttaaatgtttttgaaaaaacagaaaaaaaaattaataggtatatcaacgtttgaagcatgtgaaaaattatgattattgcttaccaaaatttgaaaatcaaaccctaaccttgggctatatatatatgaaattatttttggtacatctcatttttttggatacatgatatattataaattatttcattaaatgaggtaaaattaattgaaatttatttatagttgaaggacaaaacttaagacttttttttactaataatatttaatacctgaaggaatattgtataccatatttactttgctttataagtgtctctttaaataagttgtaagacataaattgtgaatgtgcgagtttcataacttgcaattacactataataaaatatgaattattagtagtcttccactcttccttgttttttttttttatatatataaatctattatgtcaaaataaaatatgctgataaaaactaatttaatattttgaaattaagaaaataaaggaattctacttaaacaaaaaggaaaatgagagccctcacagtgacttctctcgttctctattccttctcagacattcaaaacttttgaatatcctcggcagtgggtcattatgttttgtcatacgtaaacattttggaggcgataggggttgttggtctggcgcgctattaagtaaaagattaagtgtctaatatgcaattaagtatgtgacttttatcttaacttggattacttggacaatgcatctgaatttgttttggacttttgggtatccaaggggatatatgataattcagctgtgaatatattcaccacatatgtactgtaatttattgcattcaatattcatgca

SEQ ID NO: 4755 - DNA, 1951 bp, Glycine max
  Soy_ogl_4084 Gm12:34273901..34275851 Cluster 20
ttcatttttttatgcagttatatgcttccagataaacatcccctattagcagaggtaggtagcaatttgctctcccctttgataatcacaaaagtaacttttttatatatgtttttagacttttaattctttatttacagtgcattccaagagaactagatgatccttccccttaccttctggttgaatggacaacaggtatataaaaggcagaagatttttatcatgatgagaatcatttttttcttaaagcaaaaagtatttacgtacaaacataaatccctgctttttgtgtattaaaaaggtgatttggaaagctcgtgcgaatcaaccaaaaacaatttacaagaggaagaaaatagtctaacagtgcaggaactcttttggtacgtaaagttatgaaagtactattttttgaactttgaacaatatcatttacaaatgaaagaactcaagaatttatgaaacagataccatagcgaactgcaatgagaggatgttttcttcttaacgggacatactttaaagttaatgaggagactaactaaaatcattgcacgtttggctcatataaattgcataacgtctttgtttttcacatatcaaaattttgaaatatcctcgttatgctttataggtttttgctgatcacacttcaatcatacatccaatcaatgttccaagaaaatggttatggaatctagagaaacgaatcgtatattttgggactggtgtatcatcaatcatgagaggtaaatgagcatgttatattgacttcaccatcatatcactgtgtatggaaaaataattatttttttatgttgaatgtcaatgcaggtttgtcaatgatgcgaattcgtgattgcttttggagtggtgagaaaataataatattcaatttatcaagtacaacttctattttgggatagtattttttgttaaaactaaacataaataattgtttgtattttataggtttcatttgtgtgagagcaatggatgcaaagacaaaagcttccaggcctatataatctatattgcatcgtaacacaacgactaaacttggaaagagaaacaaaaatgcctaagtaaccaaggaatagggaagtatagaataatgatgtatgggtacttgcgcaatatgtacacccaattacacctatacttctttcttctatctcgatatctctccctctttaagcataaattggcacatgaatgtccataaataatttttggacaactatattgaacgttagtactcaatattaagactcctattatattcatatacttagagattgaaagagataaaaaagagagacagagatataaattgataggtgatctaatcaatgtcacaaaaaagagaaaaataaagaaaaataatgagtgtcaatgacatgcttgtaatattgggtgttcagatataattactaaatttctaatactaatataagttctctgcgattaaagtatgctgacatctaactgcaaattttcaatgtatgtaacttcaacttaggtaaattctaagaggatttaggctatatcctcacacagcatgatatttttcataaatcacaccgcacaaagattcagtatgtctcattcacatcacaaagattcagagtgtaaacgttttctgttttaaaaataaatgtttggtagttgagcttttacgtgacacgtactgcaaacttggaaatgttgaaaacaatttacgatgtttagtcttgtttttccttaacatagaggttctgcgtagtaggtctttgtgcatctttgttagtttcgatactaagaatatcaaatacggtcatagacagacatagatcgtggttttgctttatatgatatactaatatatagtcaaatattgcctagtcttccttaagattcccaattcattaattgtcataaataatttgagaaaagaaactcatttgtt

SEQ ID NO: 4756 - DNA, 1200 bp, Glycine max
  Soy_ogl_6505 Gm19:42307801..42309000 Cluster 20
ggccatgatagattatattaacagctaatttgcccaaaccagataccttacacaatatatgtttaactttgattgatgattgccctcctcaataagagtttatttatcttttgaatttataattgagtgattaatctctcaataaaagggcataagctggttaatttataatgtagtcaacctgtaaatttttttttgccttattggactatgattatattcggtctttatttgtatatggtccagatatacctgagactacattataaaaaataaaaaataaaaagatttacctgatactatatatcttggggtggaattttatctcaaaaaaaaaatcttgggtggaatgagtcattttcacagcactagaccgcgaaatggttgtgcatttctgatttggagtagagccacgatgggatggctctgattagtgatgaaaccagttctgaattaatcattgtgcgtagtctaaaattttttcactgtacagcttgtgtgctgaaggaaattttcaaggagtgacaagaaaaaaaaaacatcttcaactatacaaacaaatagatgagagcgaccattggcgattggtccttcatgtatacttttttttaagaaactggcgcgtcgggtatcaaaaagacttgaagcatccgaactatattggcatccttcaacccaaagatcctctaccaaagcctaacccaaatttatgtataaaagagcaagaacactaacaaaacatgggggggattaggccaaaaaatccatggaaagtcagcaaaatctgtacttagatcaagaagttcattaaaattgcgtgcatagtaatgagagcgaaaagaaataaaatcccaccaaaatgagttaccgcaaagttagctaattaacctatccttcatgtataatcacattcaaatataacttgacactttctaaacaataagagtttactcaatggtacaagattaatatttttttcttggtataatttttaatctaaaatatatattatgaatctacattaacaatatggtgtgctataaagctcgatgcataccttatttattaaaatcaagcatatttttccttatatataggattttgattttttgttgtgtggtttttcaatatatttttactttagattatggcaaaaagtcaatcctataattttagttgtaaaatgctaggggcttcata

SEQ ID NO: 4757 - DNA, 1532 bp, Glycine max
  Soy_ogl_2795 Gm08:23477694..23479225 Cluster 20
ataaatgaacttttttctttttgcttaattagattgttggtacgtaccttctgttcttgctatgagagaatgcatggttatcatttttttcctatgaaaatagctcacagttgcctataattgtacaattaaaatcagagtaaataatatttttttgtttaaaaagtttattttattggtaaatgttagttggtttttatgtctttggctagaacaaatatcatgcttaaattagtttttagcataagatatagttagaggcttcaataagtatacatatacatattatagtatattataataatatagactcacgtggttgacaaatgatttgtcttttagcgtcttgaatctctacaagtctacatgattaatgaacaacacacacaagctcaatataaatagcctacataatcgtttagaagatttggctcaaaattttaatatatatctatatatgaaatatcaagtgcaataagtagtaataccaacaaaaatgggtagctaatagtttctattgaaaagaaacattagctaagcagcaaaaaagaagatatactttttttagtaaatgaacactttaaaagtgtaagataatttagttcataaaaaaacaaaaaattctaatttaatttttgtatatataaaaaaatgtgacaattatattctcccattaaattttgtgggacctaaattgtaatgtttagagattaatttgacctataaattgtaaaatttaaaaattaatttaacattaaaatataccacaagaatataattgtcatacttcagtttcaaattgcattgccacagttggagcaatcatgtccatgaaaaattttcaacaccctcttcaccaatagtcttcaaagattaggaggcggcactatattggtgttatctagctacaagttttactggggcacttttcgcccacaaaagagtaaaaaactactgaattcccctcgtgattgagaaaaatgtgtgtctgcctacatgattttattggttaggaaattttatccatgtggacctaaaattgcaagcttagagcactgaatcattttattaattgagagtgttgtagaaaaaataattttttcaaaagaagagaatgcataggagcgtgttaaacttttatccttggacattatatgtagagttttagtgtcacaaaattcaaataccaacaacaccccgatcttaagataaaactgataacatccataagtttaggtaatgaaaataatatccttattatctttatctatacaacatcctataaatttgaaacataacaaaaatttttaagaactagattattcattttcaaactgcagacatttaggtatttcaacaaaaattcttaagaactagattatgcatatgtacatcatttatcatttatataatatatttgaagctatttttaattttccgtcaatctaaccattcccaattcaaaacttaggttctctaatttgaatcgagaattgatacccttgttcctcaaaattattaataattttcat

SEQ ID NO: 4758 - DNA, 1300 bp, Glycine max
  Soy_ogl_862 Gm03:5517001..5518300 Cluster 20
gtatgcatccagattatagcaccacatgtgggatcaatattttaatttaatttaacacaaagaccattaaatgaatttttttattttgcattggacttaatatgaacttgctaatgttgattttgcaagagcaacattacagtcaaaatatttctttccttgttaaacatgattagttgactaccggattttatttccaattattgaaacactttttattttaaaaaaaattcaattttttatttatttttatgttagtttaatttaaaaattagaattaatatattacctatgtcaaatccttacgagtcaacttttccttatttcaattggtcaacacaactcgtaatattttactttagcattcaatcatttgactatttttaagccaaatttttttatttcaaatacaagactttcaaaagataaaattattcatttgttctctcttctctctccccccatacgcacttgtcctttcccactctctcccactatatatcgtgtttaataactggtcatcaacacatacaactgcacataaaatcgctctatcaatttctagacgttaaggatgaaaaaaaaaaactgagttaatggcacacccctttgaaaggtaatgcttgctttttaaattttgaaattggtcttatatcttatttcctcctttcccaaatatcttctgtaacacccctttttctaactaaaaactacatgtttatttgattgatttaatttcaattttacaaattctagattactataatgacggaaaatatcatttattaaaattttatttttcgttataaaaaaacagatgtgacacaatgaattgcttagtaaaatctttcgctaccatgtcacatacatcaaatttaaagaacggcgtgataaaatttaaagcatgcatcctttgtgaataaacatcacatatataatttataatcattaataatgggaattactccatttgatgtatacattttattggacaatttactcttaaatcacttattaaattttaaatttttcttctaatttaaattaactttccactacttttagattataagttttttttattctgtcatttttttatcaactgtatttaacttctattttttattatttaaaaaatttagacaaaccgcttccgttattataatgtaaagttgattcaagtataaaagtaattcggatcggaagtgtgaaacttaaatagaccaatggatataaataaaagtatatcaaaatgtaaaaaaaataaaaatataagactgatacaaatgaaatatctgaa

SEQ ID NO: 4759 - DNA, 1600 bp, Glycine max
  Soy_ogl_4243 Gm13:24102801..24104400 Cluster 20
ggctaaaagcctctagggaaataaatctgaactatttttaactcatttacaatgaagtcaggcgaaaaaatcgcgaaccttaatttaaaactatatatatggaacctagtttcaaattgtaactcactgtatcacaaattcacaagtttgcggttgtctacccaagcattgaaggacaggatagtcatgcatggaagacattcatatcttttatattgggaaagtagtgtagggtctttgcctcttttcacacacggatcggaaaagcttatccatgcgatgtggatgacaataagctttatcctaggtgcttatttgttttccctttagctatgttttaatgaagatagctcgacataggaaaaggatagttttgtctattcgtgaagttactaatcatgtagcataagaggtgaacaacactgattatgataattgttaccgtcatgctttgttatgtaaattactcttagatgtttagttatgcataaattatatattgagatcaaaatattatttaagcctacaattaaagatcaataaataattaaatatttttaaattattgaatttctttgtgtttctaatatattatgtatttttttaataatattttctatatttatttctttaatttatgagatacagtttacatttgcataagaaaaatgtgctcacaagctataagcctagttacagaaaacctgaataattgtactatatattgatattgattgtatatgccgcttatcactagccatgatcagtttgtgcctttcagaaaattgagctggtgattttaactctgaatgaacgtattgaatcatgcttggcaaaagctagggtactataattctttttgcttaaacttataaacaaacttattagctagcgccacaattcgatgtgacttatttatcccatatgggccgtattaaatgttgatccccacaaccaacatacaaaagggatgagtcatgactagtcatgcgattagccatttacatttttttttggttttctttttctttttctaaattataaaaacaattattttagtataatacactgacaatttatttcataaactaatattatataaagatggtgatacaatattttaaaatttccccatttttgttaacttttataatatttaattttcatttacataaaatcatgtgtgcatgtgtgtatattattctgtgaatagaaaaaaaaaaaaaactgctgcagtaatggagctcacttcatgcattcaagtggcttgtacgatatatcaaaaccaaagagttataaggtttagttagttagtgaagtgagaagagaggaaaaaaaagtcataaattcaaatttctctctcttaaaaaaaattaacatctaacaaatattcaattaatatttgttgataaaataaactaaatatcaaaaccagtttctatatattgattaccattattcgcaattaaattacataatatgcatatatgggcatcaaattttgttattcagatataaaggaacaaccaagactcggctaattgaagaagtttctcccaatttatccacggattaaatgatgatgatgatgagagcataa

SEQ ID NO: 4760 - DNA, 1605 bp, Glycine max
  Soy_ogl_531 Gm02:13715001..13716605 Cluster 20
aaccttaatccaaacatagccaaattaatcgcaaaccaaagaattaatgatggttcagcagaatttcattgacttgctggagaattgaataattttcactcctctcatcattagttctcttatgacttatcttaatttatttttgcccgcagtcttgagtggtattatagtttgctaatgcatggagctaactagcattaaataatgttgacatacaaggtgaaaagatcaaattgtatgtaaaatccagacaagcaagtcagaaataaacgcaaaaaagtttcttctgaccattaagcagtcatgaacttgtcatactatagcaagtcttgtactataggaccacaatccccagcttcaaaagcagagcacagcgtgacccttaacatacgaataaagctagcaaaacagagcacaccgtgcaaaacgttgaaaatgacctaccacgttcttgctcctaaatcctaatacatagttgattagttgtactataatacttaatagagatataataaaacaatttaataataaacttcagtcttcggagtagtttaccatatatacctctttttaactcacattttatcaaatcaaaatttcaagtgtatcaagttttaaaagctttgatacgtggaatgagatgggatatttaatgtctctatataaatatagtggtttttattttcaatatccataaaaaaatagtttttttattcccataatatttgtgatcatctattatggttttgtctgtaagcctgtaaacctgtcataattttttttttggacagaaaacctgtaaacctgtcattagcaaatagcaatcatatattttacattcttgtaaatataataatttgtttttatgttcctatcaaatgcagtaaattttctttagtttctgtaaaaataatatgtttttttttttaaattttctagtttacgttattttttcccataaaatataacgaattatgtttttttttgtttttgttatcatggttcagaaacaaaaagaaaagtgacagcaaaaattacaaggacaaactttttttacaaagactaaaaaaatagctatttttattggccttgattaaaaacatattttatatatatcaaactattcatgtccttgtgagttgaatttatggtaaaactggatcagaaagaagaaagaaaaagatgaattggaatgtttattatgctaagaacaaacaagggggtggctgtctatcattttaccaattcaaatactcaatcatgaactacgctagctaatatcgacatatatttcagttgaaaagtcaatatttagcacgctgattcgagcatatgataatttccagctaaaggtataaaaagaaagaacggaggtccgttcttatttatccatgcatgcatgctcatgttcatgcatgtggttacgcagtcccttaaaagaaaaagaaaaaggcaaatgttttttaggaaaagaatgaaaaacgacatagccaagccatgcatgcatagctgtctttatgtaaaggcaacttctgtccattgaagaggaaactcaaatgattatgaagctctacaatttgttagctactacacttttctcgccta

SEQ ID NO: 4761 - DNA, 1261 bp, Glycine max
  Soy_ogl_4178 Gm13:21061840..21063100 Cluster 20
cgaagataacatttataaaacaaatagctagcttggcacgtaattcaataattcccaaattatggtatgacaccaacttgaattttgttttcaaactacaaagaggcaatgggctcatagtcaagaatatgagtgccaacaaaaccatgagctatggagacaaagaattaggttgagcaacgatgtggcaatgtctgctctcaatcttgaactgcaagaataacgtagatttaacttttgaggacagctttaataaattattaattggattcaataatctagctggcccctttctccatcgcttggttgaataaataactggtctgcgccaatatttctttcgtgcacggctgtccaaagcaatgaatcaatgagaaattaatagggcaatgacacataacatgttctttcaagattgtggggtgaagctttagggaagcaaacaaggtcaggtttgccataaagtcattttctgaaatcctttccacacatgtcattggaatatatacgacagtatacaccataaggaatggctatggacgatctctcgggtcttctgttagacttggaacaatatccctagtcgtcatattctttctttacagagtgctttacttgcctggctataaccaaaaccagagattaagtactgtacctaaaacaattccttacaataatcgtttcaaagaagtatacatttaagcaaatgggagtaaacgcctacagcagcagtattctcgttcaatttagtctctacatttatacagtttttttaattttattttagttcgtaattttataaaatattattcattttagttcttttacattaaaattttcactatcgtttttataaataaactttttgtagaatatgaatggcatgcaatatactcacgtttgtagcaatgtagactacggaaatgaaaagagctaatgccaaaacgatactacaccttatatagaggagacatcaatgaccgttttgacgaatgcatgccataatccgtggggacaataatctggtctcacgagaaccgtctattatcatcatttgccatcatcaataataaccactatatcaaacttccatcattatatccatattcgatcatcgtttgcatcaccccacacatgcactttgcttctcgatcgtttcccttcttagtttgctttcgaaatgactttccaacttccaactaattaaggacatataattgctggttcatccataaccagctaattaaacaagaacgttata

SEQ ID NO: 4762 - DNA, 1210 bp, Glycine max
  Soy_ogl_4238 Gm13:23828901..23830110 Cluster 20
ataaaacatgtttaaattgtcgtccaactcgtacggcaatacatattcgaagactaatctaatagatcaacacaaaaataacacttgaaatccataaatttgaatttggatatataattatattaaatattcagaaaaagaattttgttacacgtaataaaatatgttcgagttgtcgtccaacatgcgacaatgctattttaaggctaatctaataaaccgacgcaaaaataacacttcaaatccactcgtacgcaaaagtaacactccaaatgagtttgaaaacgtagctagttttaaggcttgcagacagtttctcaaacataaccataattctatcggattcagattagattacatcctgtgaaaagctacttttggtctttaaaaatattatattgccttgagcggcgtatataattgtcaatgcgacaatgccattccaattaaattacccgtctctaattaaactgcgttacatgaattgataatttaaaagctataatcaagatgtaatatttggattataaaaaaatgacaacatcgtataaatatcatacaatatttaacaaatacaaaaaaaaaaaaaaaactatattcattgacgcatgattaaatgtattttaaaattcagatagtatcgtacgtaccacacattgttttttgtcagcaagtttatgggtccacgcttccatggtctttgaggctaacgcagtcaagactcgagcctgaccggactttttattgtcttcttggtgggaaaggtctcagacaccaagtcatggcctcggactatatgatttttttttaataaaaaaaattatatatatacacaaatttgttttaaaaattggaatgataagttaactgataaactattagttaataataatttattggttcaactgcgatcaattattacttccagtaaaaaaaaatccaggttaataattcagcaatttttttgttgtataatgggccaatttgtttaaattcataaaaaataattttaaaatattttttaaaaaaattatatttttatgagcagatagaatttgtttattaaaataaacataaaattattttttaagcaaaaacaatttaaacaaacacattaaaaaatataaagcttcttatgttattaaaataaacgctttttttaacaaatagatttaaataaagtggcccaataattcagtgattaagtgtg

SEQ ID NO: 4763 - DNA, 1287 bp, Glycine max
  Soy_ogl_6452 Gm19:39408814..39410100 Cluster 20
tcacatgctacttacacatattgatcatagaattagaaaagatctgcatccatatatccacaagtgatactacatgttgggtatcctttgattttcgcaatggagatgtgggctatcaagtcacggtagacaatatctttttatgagccaacatgttcttattgttcgcaggttgatgagtgggaagggtgtatttattttaacgttagccaacatatatacctatctatcaagatttctatatatataaatataatatttgaggtttttaattttgacaagcgtcactttctctttcaattttactatcttttcttgaaagagtatgatagatattctgttcattgttaagccttattattgaggcagtaaaagaagttacaggtaaatgggatctttttaaaccttgtgtcctcataaaatgtgatatttctacattaattaattgtgtatataattgataaaaaaatacacagaaattcgaatgttcagataaaaaaattatatattttaattttgtgaaaaatgaaaaacataaaaaatattacaaacataaaatttgaatatttttatatttatgacaataaaaatattttttatttttttgttctcgacaatttgaaagttatgcacactcccctacaacgaaatcgtacgctatattagccatcaggcattgaagaagacttatatgtatatccaatgtcagcataaaaaaaaaacccttcgaatctctttttcttctgaatccttcacggtaacgtacaacattattggcataaggaacatagtattgtatcaagaattaaagtattaaactcatcctggtcaatcaatttgctaaaaaaacgaggagtttaaaaaaatgtgaggcataaaagaaagaaagaaaaaactccaactaggctttaaataattgaaaagcttgaatcgtaacaaataaacacgagaaaaaggactatgcattaacaattcttttttattatgtaaataactaatacaattattattaaaatatgaacctatattaaataaaaataaagaaatataaacttccaacatttagaaccctagtgttttacataaaataacaattttgtaattagcttaaaaaatctataatcaacacgtgtcctccagctctcccacgagacacacacatcttgacccatccgtaacattgatctgctgcgataatcgaataatttatgtggcaaaaagtttcagctacataactccaaccgcaaaaccctagccaagtacgatagaattgcataattttctact

SEQ ID NO: 4764 - DNA, 1100 bp, Glycine max
  Soy_ogl_2835 Gm08:40971301..40972400 Cluster 20
catcaatatcattttgtaattttatatataatgtgccctttatacttcaatcagtttaataatactctttttttgtgtaattataaatttcaaatatttgtaatttttattctatagacttcccatttttatatgcgccccataactatttgtctttgttcaacttaacaaactacactcagtaccaaattttttgacatgattaaacactgggcatatgttgaaattaatgatgctttagctattccaaatcaagtttaacaataagacgaagttatttaattcataatttagctattccaaatcaagtttagtttttattcaaatggttgattaattctaatattttattaattaaattgagtgaaataatgacatgattgaaattctttgtgatctatatgtatcgaggattattagtctcatggattccatgtgaaaataccttgcttctagcataacaagaaaaagtggaattattttctagacacctactgaccgtaatcaattgtccttaatatacttttagctaattttcagctataaatatgagtatataaatttctgagttttcaggtgcctgtctatactatagtcgataagaagaaatggttcctcattttaaaaagaaatccggattttttttttagtttttaacaacgtacactaattaaatttgaggaacataaaacatgcatgatgcaaatcactcgaactttctaccaatagacggactacaattgggtatgggtcttctgattctgatatatttatatttttaattagtatcattttatgacgttaaattttatatttactttcttatatagatgttcataaattttacttatttaatatttatgaaataatcgataacctaaatttcataaataattaaagaattatcgtggaaagattcataaatattcattatttgccttaattaatcagtatgaattccagaacgtaaaaagctaacggcaatccccgggtatcccccacacgcgtacctgcaggtacttactagtcataactcatgtgtaatgttaacatgtgtgggggaaaagttgttttatattattgttttttccacctcccaa

SEQ ID NO: 4765 - DNA, 1000 bp, Glycine max
  Soy_ogl_3809 Gm11:9080301..9081300 Cluster 20
atgagtgtaacaaattacggtattttattttaactgtatatcattttttttttactgaatatcatttgcttattcacatcttaagattcaatgcattttaacattaatgtcatcgtaaatcattttgcataccaaaatgcttgaaaaaaacaattttttattataatttaagcatctttcttttataggtgacagacatcaattatatgagtaaagaatgtattttatcagtaataaataacagtttaagagaatatattgaataaaaaatgtaacatatcttttcaaaatttattaaaattatattatttacttgataaaaatacatgtttgtatttaaaaaaatggatatttactttttataatccttatatatgtaatagccttatatttacgggagccatgtgaagaccggcccgtctctatccatacaatataatctgttttagacatttgtgatctatgcaagactagtaaaaagccacgcgtattactcttttggggtgattaatgctttttattttaagtaatctatgtaacgttaacgtactcatacatattttattaattgtaagtaatcaatctatgtaacgttaacatactcatacatatttttgattcgtactcatacatataataagggcttattccttacctacctttgaccacttgtattatttcgtgtgccatattataaataaacagcaatgattaaaaagacaaagaataaacaacggcttcttcacagctaggccgcgagagagaaagggactaacatatactacaataaatagtttaaaatttctcacaagattgaagattccaacaagtatctcacatttttcttctcgctattccagcgaaattatcaatgacatggctgcttcaaacaacaaggccacgagaaggggatgaaaacaacgtagaaaatgagtcatgtgtagttaattattttagctctgttgtaatctatattgcattttatattatgtctttttgt

SEQ ID NO: 4766 - DNA, 1024 bp, Glycine max
  Soy_ogl_680 Gm02:45741677..45742700 Cluster 20
acacttgggagagaattcataatatctttaatgttcaacataagcatatctgacaggaatatgaaacaacacagttacaattttgatataccttgcttctcaaggtgagacaccataagacatttttttatttatttattacaagatagagcctcataacataaagatataactacataaagcagaggttccttaccaacaaattcaggagaagaaattgcatgctctgctgtagttgtgttctgtcctcatgtcggaggaaggtaccatctgaaaatgttaagggtcagcatgcaagactacgtatataacttcaccatggaagaaattatgttgaacaaaacttgattaaatctgaaaaacagtgaactaattaatgcttgctatttcatttggtcatgccatttggtgatgttttgtgtttgtgtgattagcattcatagcatttgtgcacagttcacacatcaaaatgtgcatcgttgaaatgtatgaaaaatcagctggaatagtttcaccaaatcaatatcaattaaataggtgaaacaagttaaaagaaatgtccaaataaatactagtatgaaatatgtataagaatgttcaaataaaagaatgtataagaaatgttcaaataaaataatttttccatctggaagctgcatgtgactttattttaatttcttcttaattttcactatcttttcattattaacacacacacacatattgattaactttctcaagttaaagactcggattatttgttattcaatacaggataaaatttggagtttattcctgagaaatatcaagtctctaggtgtttaaaatgaacaatatatttttcctaaaacattcatacatatgaagaacgaggtgaaaaaaaaaattggaaggtaggaaagggaaggagatgatatttgattgaaaccttggtcaattgttccaagattgcataagaagcctcgagctttgaaataaaaaaaatatctaacattaatagcaacgctcaataatcaaataaaga

SEQ ID NO: 4767 - DNA, 1127 bp, Glycine max
  Soy_ogl_6430 Gm19:38573674..385300 Cluster 20
ctttattgaatcaatttatcagctgtatttgagtatttatccattgttaatattcatattcacattcatccattcaattccattaagtccttggggccgtaatccacatttattccgtttcaaaaagcaaccaatcattttcttagccttttcctattttcattttattattgttataaaacattatagatgaacactcagtggcaaccaatcagatgctaatatgctaatgaacaattagtaagaaaaagagaaataaaaaatataaattttatagataatataaaataaaaaaatatctattagacatataaaaaaaaacataaatgttgatatatcattcctattctattgttattcctgagcatatttgaatcctcttctgtttgcaaaattttctacgattccctttgaaatatttggcagtgggagtataaaaaacaaagggggaaaaggctgtaacgtgtgaggagcaagaattgtgagggagccagagcatgtctggagtgtgattttgcgtgtgttggaaccaaaacgagacagcaacgcagtcgttttggacccccaaaccattatagtaaatagtttgagtttctactacctaaccattgtcctctttcattgctttcttttttaataccaaaatcatccatggtagcatggatcattttcttaagattgctgactcttttacatcataaatatcaaatatctcatcaatgtccttaattttttttatatctttctcgtatcatattatattatcaatcatattataacagattacactcaattcccttcaatttaagacttattacactcatttagcctctattaaaatacatttcttttacaccgtttccgttaactaatggtgttaaacttttattgaattgtcaaaataacccttcttaaaaggggtgtgcttcttcaaagaaaaaagaagaagtcgggtgctgatagtaaagttgaggtgcagatagtaaagagggaaaaaaaaaactttgtctcctcctgaagcacgcccatcacctttctctttcaccgtaaaccaccaaaacctatctacctcacctccataaccaccgttccaccaaacaccaacgccgcctcctaaaccggaacta

SEQ ID NO: 4768 - DNA, 1244 bp, Glycine max
  Soy_ogl_537 Gm02:14077601..14078844 Cluster 20
aaggattaaacttgaattttatgaatgaacaaatttgattgagtgaattgtgatcttagacgaaaattaattatcacagaacagattaagaatttgcaccatggtttaaaaaactgttagccaaaaaagggtcgttggcaattattgaaccgtaccttttggaggtcaattctctgagttgagcaaattacccttattacaatttccaaatttcaaaatttgagcaattcaatcaacatgtgttgtcggtctattattgtccaaacatttcttttttatatgattaattagtttcataaaaataatctggtactaaacagttttgattaaatgtagcgtactaagctagctagtaatgagtttttaatttggttggatgatgggtcacgtgcgaagacagggaggaataataatagatgaatgtgtgaaccctagtgcaatactatgaaggacacttaattcacacttgtgcttgtgacttgccacatatatttttttattaaaaataattttattccaatcaaataagactcttatgaataataatttttctacaaatatttaagatttaactcaaattttattcccatgctgcacttctctgtggtttccaagccaccccaacattatctctacgcaggttgtacctgtgcatgtggggtacgttactgctaccacccactgcactttccatcgagtgaaaaccacgctctagtactctatgcttgggtcttgtacaatgtatatactttaaggggaaaaaaaatactttatattcaatcaaaatggattaacttgtgtagcaaatgacaaatgtgtagcaaaaaaataatggaataacttgtttcttttttaaaaataatattttttttaggtttaaatagaaacaaaataaagaatagataaaaaagaaaaagaaaaataactatggtatattgtattaaataaaatatcaattatctgatattcaaataacaaaatacaaaatacagtatatagatacttttttatttattaaaacagatacttaactgaagttcagtatatctagtaattaattttttggtacaacgctacagtactgcatctcactggtatgatcattaatgtacatacactagttgagtacaagttcctgttccaatttaattggtgaaaccaacttggtggggtatatcttgtaattaagtactcttttgttaataacattttgtcttaaaaaaacaatttattaaatcacgtaa

SEQ ID NO: 4769 - DNA, 1064 bp, Glycine max
  Soy_ogl_4944 Gm15:9312237..9313300 Cluster 20
atttttttagttcagttaactacatttaaaagtttgaactgaactatttttgtggtttgaacaaaactgttaaaaaatggtttttcttaaaaggacagagttgatgcaaacgtttctcacatggaagacaagttgagttttgggcgaaagttcctgaatccaaatccgaagctgtactttgaaaacgtttgcaaataacatcaacaaccaatttcagttttgcaatacataattagcaatccatataacattgtatttagcttgctaaaggagacctttttagtggttcaatcaaaaaatgttaaaatatactactgtcatggtattgtagcaacgggattggtctttccatggatgcaccgtgcttcctttgccttacggtccaatagttcactaactaaactttttcactggatgtctagttcagttaatgaattgttttgctaaaagaaagttcaatgcaatttttgtttacaaacagtttagttattaatagtttagtgcaattcagttatagttaagtttgcaatttttagcttatttgaagagccctagctaaaactaaccaggatctagttaatttccaggagaaggcataaaagatatgatatccatggttgacttagaccaatgactggcagagatgttgttaaaatacatccctgagtacactcaacaaatgctaaaaaaaccttagttaggtacaccccattttgctactattcctgattgtttatcataccctttttcaaatgagaacctcagaatgagaagaaacagatcctgaactttcagtttcactaggtctcttatcagaagacttcctcttccatagcaaatcattttgtcagacctatagtatactgtctcaacaagtagtccctggacgctattaaaaacatgtaagaatatactctcaacaaattagagccttaattttgagattgtcatattgttaatgtaatatccttagaagtaaatcatgtgagcaattttatgtgagaacttacctcacatgagttgggtagatcacctccattgccactctccagtttatatgtaaa

SEQ ID NO: 4770 - DNA, 1688 bp, Glycine max
  Soy_ogl_3002 Gm09:5001113..5002800 Cluster 20
ttcacaagcgtatggttgaagtcgtatgtgtgtagaaaagcacgtaccaattaatattagaatgaaagtaaccaaaaaattatattaaaagttatataaaattaactggctgcttattcaaaaattcatgtgatttttctgtttaattttgagtgtcataataaaaatttattaataattaatattcaccctttcatatttttgcataaaagtatataagattggacgccaaatataagtgtctctgcactaggatttgaatcatgttttgtcactgtatagaaaactagctttttctctggaccaaactctcggttaatatatttaatatacattttgttgattaatttagatgtaatgagtcaaacataaataaagtggcagcggttgatattcaaacaacccatcgtgttattatgaactaaagaatggtcgtttttaactgattaatatatataaacggatttcttttacgtacttcttgacatgtcaaatttggtatatgggaattctacttagaaggattttaaattatttctccctttgtattcttatgtgctctaaattctaatatgacttttgtggagctaattacttttctttgtcagcagttacggttttgaccgtggaagtcatgttcccacttttgaaccgactttcatgcaagtactccggacaaataattaacaatgttttgttggtttaaattcaatcacttttttgggacgataaattgattttgttttatggtgatatgcactccatacaagagcatgctttgatgaaaaggaatgctaaatcagcgaggagttctatgcaaggtacaataaaatataacaatttgataagttattttgttatttgctaaatcagcatggagcaggaggcatgccaagatagaatcattggcgacaaacataatatacaataatttatgaaatcaatgttaaaatgagagccacatgaaagattaaggaaaagtgagaagggactggaaaatgtgtaataacaattatgaatttagatatatatgtcgaaatgagtcacaatttgcgatccaattaaattgatcgcatgttagtttgatgggactggaataaatgacttattttaaaaaatagactgtataacaaccttatttactccacctatatagatcactcgaatttcgtatgtttgagttgggttacaagtgagtttgagagatttttttcttctctcattctcataatcttattttatttgtctcaaagcgttacacttgacgaccagcacagtccataataatgtcctaccctaacccctcaaccttaacagtcaaacccaacatacaacatccacaacttcaactttagcgtccatggtgactcaacaactcaacataaatatgtttgaattttatccatggatctaaatataagatgataaaattttatcacatgaaagtcctctacttcttcaaatgtagaacttggacctattgtcttcccctgtccctacattttcttttttcgtatttaattcagatgagctaatccatttaattaacttggttggggagagttgagttaggttgactattttctggctcactatcaaagtaagttgtactaagttaacttgctttgagtagggttaacctaaatgagacaagtgaactcatttttataacattactaatgatgtaa

SEQ ID NO: 4771 - DNA, 2000 bp, Glycine max
  Soy_ogl_2642 Gm08:12847201..12849200 Cluster 20
aatttcgttggaaatcaattttccctttcttttttgggtttttttagttgcctattttctcaacaactccctcactctagagaagttcagaacacgctgcgagcagtgagcaccgagaaaaatgcataataatagctcttgccccacttcatcaaacggaacatttggcacaacggtcgtcgtcactcgatgatgtctgcagtttgcacaataatgaatgggagacatttaacatcgattgtataacattatagatctgactgatgtaacaaagaacatcgtggacatttattttacattgattctaccactgatgtagattccactgttataaaataggagaatattttacattgagcattaaactgctgatgggaaaaaacactttctgcatatgtaaaaaatgttacttttcctaaacctctaaacgatatttggatcagtatcaggtagaaaaattggttcaaataaacaacaattaaacaaatatagattgccaaaaatgagatcacaaataaaagagagaaaatgacctttgtatctatgaggaagaaaacataattactttctttttgttgaagtttctcgacaaactctcgataaagcatttcatcctccattttgtgtatgtcgtaatgcccatcatccacatcttcgttaatgccatcgcacccctcaggcataaccttaaactctagcatgtaaggaagagatgcaacacgaaattcactatcatgtgagttaaaaaacctccaagcaataataaaaaaaattaacacaacaattcataattcaaaatccacacaaatcaaatcatgatcaatctcgtcgccaaacacaaacaaaaatcatcacaacaccaactcagggaagtattgagaaagagctcaatagaatcatcaagtggatgactaggtttcttatcctccttttcctctatctatttgagacagagaatggcatgaaccctttgtggcatgattcagtaatccctagctagtttttcgacagtgtagtcctcaaggttctacttgtgcatttagtacattttaactttctcaaattcattgagatacaaacacttaaacacttcccttttacgattctccacctccagtttgtgcagctcatcctctatttcgtgcatgtctgctagaaccacaaaggacctttagggttagggtcaatagaaaagagaaaatggaccaatggaatgggaaaagatagggtggtggtggaaaggaagaagaagaagaaaggtgtgacaattaaggatagggtgggcattgagatataacaaagagttgtgcctcttctcacttgggattccttggggcctttttcttcttttgaggtttggaccattatttacatcgattttaactttatctgatgcgaaaactattttttaaattagttaaactgtaattgatgaaaaaatgtttcatttatttacaaattatcaccacaattttttacatcggttgtttaataaacaatgtaaaaagttgttgtaagatttcttgtttaataaccaatgcacttggtttaatttgttgaatgagaaccttttgggttttgtcattctctttgcaaattgaagggacgacaatgtggattcatacccgtgctatgagtcaaccttgcattactcatgcatggttcataaatggctgattaacttacaacagtgcttcgttgttcaggcaaataaggtgacaacaagagtaagaggcagtggagtccaacttgttcttgtcatatgctcaactctagagcttttcaagtaaagctgctacagagggattggattacttgaaaatagctaaaatgcaggtatcatatctgagatcaggttttatgtctgttgttgtccataagttttttttttatactgaagccactcagctaaatttagacataagtttcgatgcttatactgaaccagtatatggaaaattgttgttgaattctgttcaaagaatgcttgtaaagggatt

SEQ ID NO: 4772 - DNA, 1946 bp, Glycine max
  Soy_ogl_4075 Gm12:33612055..33614000 Cluster 20
ccgccaaattaggttatcttgaatgtatctcatacatttattagatctttgtttagtcgaattaaaatctaaacaaataattctatcaacattataagtagcgagtaaactaaactcacgccaatttatctggtgggcgtacaacatgcatggatgaaaggcttagaccttgcctcatcttctttctcttaaattttactatcttgcttctagggttgctcttcatgtacgttggtgggtctcgatccgatgaacagtgttattaagtcttcaatgaaagatatgcaacatgtgttaacagtaacagttgctttagggaatattgaagaagaagaagaacgagaagaacgagtacatgaggtattctctgccctactttttgcccatgtttttccatataaaaccactccaagtatttatcatgcatgatgcatccttcctcaaccttaatattaatcctttccatctatatatcttctttcatcccaaagagatttaatcgacaaaaacataattctagagaaatcaaattcccaattggttcaccgaaatatccccgtaacctattttgtcataggggaaatatacgtacgtacgtggacgaaggagaggattgagacgaattataaggatgattttgtattattatatttttaaaaattattcttagtttcaaaactaatatgttatttaaagaaattttacaatttagaaaaatataaaacactaaaaagtaagtattatatatatcataaaaatattttgttagaaaattatccttaaaactcattttacatattcatgtgttttgttggtttattcaatataaacttaaataaaataaagctatattcaatgaaaataaacgagttgtttcatcatcttgtcttttagagagctaaaacaaaacacaaacttttttttcagaattttttcctacttgtagacttgtaacacgtatggataaaaaatattaatatatatatgattttttgccattgaaattgaaaactaaaaattaaaaattatcctttaagttagtttaacaagaaaaaataaatggaaaaagttaaatcattaaattgttaattggaaaatggtaccaacaattactttatattcacagattgtaaataaagtataaaactcaaaaaaatgtgaaacatttaaaatttaaaagtgttatagtagagcttatatgatttgattgcataataataaatgtttcacatttttttgagttttataccttatttacacggatgtaagtaggttaaattagtatataaagttatagtgagacatgaaataggaatagaaaaaataaagatatacgcatataagaagtgaatgtaaaaaaaaaaaaaaagagtaaataatgaagattcaataagcatggatagaattgaaaattgctaatctataaatacattgataaaatctgtcgatgaatacgtcatgtgtctggttgcgtgtgaaaattattcttacaatcacaccaaactatataatgagtattataaatttttaggaagtatgaaagtttttgcagttggagcgtgctgttgagcctttggtgcaaaaccattccagtaagaagaaaaacccaacagtgtaaataaataggctttggcaattggcagaaagggtgtaaatagtaaaaggcaaggcgacaaagatttgttgaaggcattagattcggaggcggagcgcaactctaacctctgacgtgtttcgcgtgaggagagtaaattttgggcctgcttctttctgaaccttttgtcgcttctacgcaataacgaacccttcgccgtgacattactcatttctgtgtcacccccatttcacaataaattactactaacctacatgcacttcaaatttcaattcatatctctcttcttctatgacttttatactatcccttttcaagttagtctcgtgtt

SEQ ID NO: 4773 - DNA, 1487 bp, Glycine max
  Soy_ogl_6456 Gm19:39420421..39421907 Cluster 20
gttgataaataatagttttttaatataaaaaatgcatcagatgttaatataaattttttttgaacagcaaacagaacttcattcaaggagtagtacgtacgagaagtggtggagacatagagcagtagtatcttgcatatacaaacaaaacaacacttgttacattgaatccactgcatgaaaccagaacatgataaaggaccaaaccacgagattagctttaaacaaaagctgacaaaggcatacttaatgaaaccaattttcaaacaaaagcatatctcaaacaattttcaaatttcaatcatataattttggtcgggcttgttgtaccagcacagcatgcaccacccatccacttacactcctttttcttccggcctgaaacaaaccctgaactctaagtagtacaaatattaggcttcattattgaacctgcatgtatccatggctatctcctaattgatgcaccaatccaagattaagatagaaactcgtaaaggtatctatattcgattcataccaataaataaataagaaattaagaggctttcacagcttttgcatgtgaaccattgctaatatatttcaccttaataagagggacaacgttaacaccacagtatatcaaatcaacatatccatgaacagtttctcttcacaatttcctttgacaatagactgaaattagcaagaaataatgatcaactagattactagaagatgaacaatgccaagagtacgtaaaatcataaaataccacatcaaaatagagacgaacttgcaatgagaaaacaaatgagagtagatatttcaatttgattataaaaaaaaaaaagtgttaggttctaagccttctaatcgatggttttaatgatgtacaaattaaccttttgatctaaatatcatatatatcttgtggttgggtgttattaatgattttctatggaagaattcaagaagatgataattaaggactctatatatcgatcgaagtataaatcataaataacgaaacctaacaatattgagtttttaatcaaagtataagccaagaaagctacgtactataaagttgattgatgtcagaaagctaacactttatcaaaaaattacaattgagtttttcttatggaataatattcattagtattttgtgaagatcaagtcttgagaaacttataaatgttttttttttttttttgcacagtaaaaaggacttatattatagaaatattaaagtttgccacaaggagtgccaattaaaccaggggcggacgcacgttatgcatttactaatttaaatttttcttatataattaaaatatctattttagcagtgatatttactaaaaataataatataaaatttaattatctttttatagtatttatcttgaagataaaatattttatctttttagataaataactacttctcttttataatatttattgggaagataattgttttttttttctttttagac

SEQ ID NO: 4774 - DNA, 1797 bp, Glycine max
  Soy_ogl_1273 Gm04:7137104..7138900 Cluster 20
gttaatggataaaaaaggaaggaagaagggaaaatgtaaaatattaagtttatattatgtttatatatgagaaataatgaaaataatggccttagttgaaagttatcctaaaagtttgagatttcaacagtttacattttactttgtttttcaatatcacgtgtgatatatgaagatataaatttaattttaatttaaataattataaaattggaaagaaaatgaaattaaaattaataaatatgaataaacatattaaagtacttatggttctactcttcagttcaacataaaacatttactcttcaagaggtacgcccatggtttttttattttgataaaggccgatccatagtttaaatatgaaagttactaatgggctcaaatgcgtttagaccatcatctgttgggctacactatgcttatttgtagtgtaaagtttggggccctttatttttcatgtcgaagtcgcggtttttttgggttactatttgcactctttatatttttcactctttctaattgttttcgagatttagtaattgacacaatacttaaactatccttatcctcacaccccctccgcttctctctcccctcaccctctcacattcctttttcttctctattatttccttttcagctctgtttagttttgttttttatatgttgttgttttgatgaaaactatatttttcatgtatgattacataacagaaattagttttagttttcgttatatatatggataaggtacacaacagtaaaaaaaaaattgtaaaaaatattttcacaattatttttataaaaataacggatagtgggaacagaaaaaaagtgttcagatttgagccccagtatttggggtggggtggggtgggaggtgttaaattagacagataccacacttcccggattttggtcttccttcctactataggaaagaatagaaattgtattttgacaatataagcctggattgaccaataaaataccatatttattctcttctgtattttgattagaacaattttacggagctaacatagtcatgtcatgattagtaagctagttatttttgtaattttaagatatgagaaattatcaaaatgggaagggtcttgtttagagttggtaaattggttcatccgattattgcctgtcgggccatgatgagaacctgagatgggccgggcggattttgtttttaggattcatcgatgactcggattggtcttaattttttgtttatttctcgaactagggttaactgtttttttttttctttttcctgaaaactttttcaaatttctacttttaattcctgatctaaattttgatcggtctccacttttagtctttgcatttaagtgataaacataacaacaacaaaaaactatttgttacttatatacaatgtccaacggagtaaaagattagcacccggaattataacctcataacgtcgtaattcagtgcaatgccatatggtaaaaaaggtgagttgcaaaggataactttttgagaaaagcaatatggtacgtataatacttgaatacttagctcaacaattggaatttttttcttcccgatgtacttatacaataatgagcatgaacaatgttggaggaagtgttttggaggtagaggggttaagttgcgagagaatgaaaatgatgatgatcgagtagggtcggtgtgctatgtggttgtcgtcccacgctaaggttgaggtcatgggtttactgtctaccaaatcccagtccccaatgactttaactcgtgtttggggatgta

SEQ ID NO: 4775 - DNA, 1334 bp, Glycine max
  Soy_ogl_1309 Gm04:38609501..38610834 Cluster 20
taagtagattgctcttatgcatacaaaatccattttgctctaccataccaacaataaaacaagtatgccattgaaaagtcaacaaagtagtacctttttacatcttctctagcaatattcgtcaagttaatgttaattatatccaactcacaatttatcataatctgctaatcatactcttcttcaaatgcactaatgtaaaccgcctatttcctccataccaatagtggcaacatcctcttctttgtcataactattatcaccacttgtatcatctgtgtctccaccttcatctattgactaagacatatccaacaaaaatattaatcaacatcgatttaaacacaaaaattaaattaaaactcaaatcaaaaagttattatacaataaatgggtcattataatactcacatttaaatgcatctctgttcctacatttacaccatggccaactatctcttcttcgccattctccatacctatttaaacccaaaagagagacaacacattagttgttattgcatttggccaatgttttccacacccattgttactgcatgatgacaaactttgaacaaactttctctatacaaaactacatggaacaatccctatacaccacaattactaaatctcaatgcaaagattataaattcatctaaaacaccccaaatcaaaatgggggaaaataccttaagattgagatagtccaatcccgctcctaatcgagaatgcaaaccaagatctcaaccgaccgtagtgccaactttaccatattaacatgcagtgttaccaaagattggtttacaaaaccaatgtgggctattcgattaaattttggttgtgacaaacaagaaccatacacgaacccctcaagggttaacctcaatcaatattattttatttaacgacattattatctctttagaatattttaaaaaaggtattaatgtctctatcgattttctttaaaaaaataattcaaaaacataaattaaaagaaccctattataataggtataaattactcttgcaccaaacaccatttgtgttggttgtgcatgctaggcaccacctataatgtgttcattgcttgatattttcttatgtttatatgtaatatttatatcttatttgtaattaacaggaaatgtcgcaataattgaaaatgacgaatagtagtgtgacaacttgaatgccaacaatgctcaattagtgaatcgagatggaacttctaagatcactcttatcatatgcatggtttctagtgaaaaggaagcatatgacttgtacaatgcatatgtgtatatagttggttttagcatccacaaggt

SEQ ID NO: 4776 - DNA, 1408 bp, Glycine max
  Soy_ogl_2435 Gm07:39200493..39201900 Cluster 20
ctgtgaatctcttttataatctttcttttgattgaatagtatgtatgaattgttataaattttctaaaatttaaaagtttgatttttgacggataaaaaaattatttctttgaagtcactttcatatttagcaaccaagtagacaaattaccaatcccttttcttttcttattgcaaaaaaaactgagaaaaaaaactttcttgtggtaaaaaaaaaatatgtattaatgttagattttacctagcaaaatggatatatatccactttctcgtttctaagaccagacctttctcgagaagattgcttctttaaaggagttaaagagtttgttttagcaatagcctgttgacatttggaacaatttttgcttttacaagtaattttttcatgtaactttaatcctactataaaattggaaactgtctttttgacaaaatgatgtaattttttcaattaattaccaaaatgaataaatttttaaaaaattactgagacgggaaagaatgggtagatttggttgtggttgttcgcaaaaggaaaaaccggttttacacagctaagtcgtgtgctaagcatcacatagaattacatcaaataaaataaattggagaagaaaacaaataccaaacctgattacggtaaagactgcatgccaagccatattcatctatggactatggcagataattattcacaagggaaaatacttcatacaacgacaatcttaaagatcttaaacgtcacagtcggggatgaattttctatcaagatgttttgtgtctccttgctaaccaatgaccatgggacttgtctaacaaacattagaaaagtcactacgatggaaatgaaaaatttccacgctgtatctatacacctgtcaacggcttccttagatatgtaccaaaccaaaggatgaaaatgatcataccatatatatattgattctaaaaaagctttgcggatcttgctgggaattaatgtaaaatacttaatcaaccaaaacatgtattagcaacttcagtattgaacaaacagatttcgttttgtttctgaacctttcacctaaaattatccttcaacaacccaagtgcattcagaacaggtaactcttatccttccttgtctgttagctcggggaaaggcgaggactacacatatatgactagattcatttattttatatatacaaagaaacaaaactcaatagttagcatgctttcaacacaaacaaacacaccatcttctgcctgtccatcaagccttggatcataagtacctaaaatttttggtcagcagctttattgttcctcatcgaaaaataaggagatggagtcaacagaattccaatgatgactgtactcaaagactcgcgtttgtatattggttcttctaaaagagaagaagtgg

SEQ ID NO: 4777 - DNA, 1100 bp, Glycine max
  Soy_ogl_2830 Gm08:40909901..40911000 Cluster 20
tctgtaagactgtaactgtgtacaaaagtaagaccagagtgggtatatatagcttcaagtctaatagtgtcttgtacaaaaatactacaaaaataaaataaaattggtagttaattcgtcgttaattaatctctagtaaaagataatatatacaaattagctatgaaatcactacaaagttagtcatgtcctaaactctgtctcttctctacaaaggtctccgaatgtatcagtgtggacactctaagactacaactgcttgatccaatacaaatcagtttaagatcatttaagtcagtcttatactaaaagtgaagcatatcaaattagcaaaggaaacggaagctaggttacgccttttttaaattagataaagctatgttaaatgtagagacatgctactgagttgaggattgggagaaaatgcttgattaaagaaacacgggagtaactagatgcagataatacattaagatatcctatttgatatgtctccaatatgaatactttatgataatacattaagatatcctatttgagatgtttcaaacattttttttaaaataatagatgtctcaaaaacctgggaggtagtagtgtaaaaaactttaatatgttattctaattaaattttaatatgcatatccctctaaataaaagtatgtcaacaatgggcaagttttttttaatgggaaagttatagagcctttttaacccaaaaatttaaatattggaatgatactgaattaatttaaatggaatagaatttttgaaagtcaacctaattttatgatgagttacactccttttgactgttcaacatttcctatacctccaccgcaaaaatataaaagctaggaatgataaaccatgtgtgggagcaataggcgtaatttcaattacttcaattttcctccaaatagaaggattatttagggcccattaatgacatgcttgatattttgtatttttattagttaatgcttcaacgtaacgtttcaaacttattgaatgtttgagatgcttgtaccaagtcacaacttgtttgatacattaactagtttgttgtaggtagttttattatttctatctgttaacca

SEQ ID NO: 4778 - DNA, 2000 bp, Glycine max
  Soy_ogl_5355 Gm16:26877101..26879100 Cluster 20
ccttttgtttacatctcctcccaggaaaattgtgttgtaagttgctcaatctcatcacaaatccattgcggtaatagaaaacaatttataacataagtggggtagattgaacaatcgacttatgagaaccactctacctgccttagacaaagccttctccttccatcctatgagtttcttccaaactctatctctaacaaatttaaagatatgggctttggaccttcccaccattgtagggagacctagatacttctcatgcctttccaccgcctttactacaataagttgtgatcttgtgatagctcttcaatcctcatactagctacattttggctacaagaaagctcagatttgttaagattgatcctttgtctagaagcatcctcataggatttgaaaagacttcagaggtgagttgcctcctctttcgtagtccgtgaaaatatgatgttatcatctgccaaaaaagaagagatagttggggtcaagggagataccctaatcctatggatcattccttgctccaaagatctaataaacataaatgagagagagcttgaacacataaaataaacaactatggggatagagaatcatcttgcctaaggcctctatgtggcttgaattctctaagctgacttccattcaccatcactgagaaagatatattttaaacacaattcatgataagagaaagccaacctattggaaaaccaatagagatcagaacatttttcaagaaagactactccactctgtcatatgctttggtcatatccaatttcaggctcatgagccatttcccccctttattcttcatgaaatgataacattcaaaaagcaatcaaggcattgtctatagtaagtctatttgaaacaaaagcgctctggaattcctcaactatatctcatagcaccctcttcaatttgttggcaattgtttgtgtaacaattttgaacagcacattacacacacttattggcctaaactcacgagcattagcatgtgttggatttttatcttcgggataaacatccactaaaaatttggcatcatgacattttatgtgttaccatgtgaaaaaaaatgtaattatccaattttttttttcttaacggtaatagcccgagagatcaagaggagctatttctgttcatgtaaaacatgtaaatatttgcaaagaagttgttgcttggccaagatagaaagattcgtcatatgacatgtcaacaagaattgtgcttattcttgtagtgcaacatgaaaaatattaaaaaggaaataagtttagcatcttttaatccctatttttttttaaaaaaaattatttttagttcttgaacttctgaaactaattttagtctcttaagatttttttttctgtcaaggactaaaagtaataaaggaaaaaaagttaaataataaaaacaaggacaagaaaatttaaaggaagttgattgcttaaaaaagttaaggactaaaaataaatatcttaaaagtttaaggattaaaaatataataaattcaacataaatttataagaaatcaattgcttatgtaatattttttagtgtgcacaactatattagcatccaagtttttatatatttatatttttttattaattctatttaatttttcaaaaatgtacgtattattttcctggttaaatttttcttcatcgggattattttattatcggcaatacactttatttatttattagcttcttaaaaaaatgttattattagaattttttggttaatttgttgtattaggacgtgctacttttttatagagtaatttttttagttgatcatgtcattccgtttgattatttttaatatagataattggatataaaactaggaaaacctctctttcctgtgaccttctgccttaaaaaaatgtaaaactaatttttcttaagaaaggaaggcgaaggtaaaatccaaataaccctgtttgattttgttgaccaagtttgattaaaatt

SEQ ID NO: 4779 - DNA, 1835 bp, Glycine max
  Soy_ogl_850 Gm03:4780530..4782364 Cluster 20
gaagacacaattttacaacattggtaattggccaaagacttaattaatcacaatagccaatcacatgacagatgtaaaagttggtgctctacttatataatccctctgtcaaacttcaattttatgttatatatgtcgtggtttgtctctcaagggactgcaaaataactggctttttagttataaaatttaagatttaaaagcatattaaatgtttattgggtgctttcatgaatacactatataattcaatctcagatctcccctaacctccaaggcttaagacatataaacacaaaattagtatgtggcatgtcaaagtcaaagaacagtaacatagataaccatagcttctgtgaaccacatgataggcggctgcaagggtttcttccccacccgagtcaaacacacatccccattcctagagtccaatgtataaattacaactatttatggccatctactgaatctgtttgtctgagtcaacctaccctcacgatttcaattagatccatattgtacatatcacagctcagaatcaactaaattgttgaagtggaaaacaaacaaaacattctacggtttaacagaaatgcatgtattttagagataactagcatcaaaactcattttagacaacatttgacaactttgtttctggttcaagatgcatttctaagccatcagagcaagaacattaaatcatgccactaattccatgtaaacacttatcgaacacaatgtccgtcaaatcgaatttgcagcataattgacatttcacattttaataaataaataaaaatgatcagaaaaaccaatcttctctcttacctctcatttcccaaagataacactagaagtccaaccaatcacttcccccggaagggttccttcttgccgttcaggtgctaagctgccattctatttcttcagccaacactgaaccaacgaaatcaattgctattatgctatgttttatagaagttctcccatttcatactatgaaagctatgcactttaactttgataaaagttttgtcatttaacttttccatgtgataacttgatttaacttagggcactggttaagaatcaaaaatggaaattttttgttggaaaatgtaatagagtacttctgtaggatttctagtacaactccaattgtaaaaaataaataaaaaaattcatgtgctctacttagcagcacacactaaattatagagaagctcgattcattttactgtttttatatttttcaattgcttatgcagaagttagtcctagagagcctaaagttcgaggtcaactctaaatagcaagaacgaatccataaaaaccaacccaaatgagagatcatcaaacataaggaactcctaaatcagcaaaactgagaagtaattaacaaactttacttacctcaccaaacttggatccacagcttagaacggagatgttaccggaaggcacagtggaggaaacgaagaagggcacaatggcggaggctaggtaacagaaagaagcaaaaaccttaatggtgggcaccagggatggcacgagagagagggcacgagatggagggcacaaggtaaggtaatggtgggcacgatcaagctgagatcaaagacacttcaattagcaaaattgcgatgacggttttctctaaaaaaatgtcgttgtcttcgttgcttgtaattacgatacttccatgcatcaaatatgatgatttttttagtgaaacgtcatcatttttaggaggggttatttacaacactgccaccgcgtcaaatatgacgatggttttggccaaaaacatcgtgattcatgcactcatatat

SEQ ID NO: 4780 - DNA, 1300 bp, Glycine max
  Soy_ogl_1272 Gm04:7133101..7134400 Cluster 20
ctccgctcgtgtcaaaagccaaaactgacggtggcctatgacacgtgccaagaatctattacgccataaccttttattttcctatgatcttccctgaatttgaaatatcctatacgaggctaccgtaacgtgaaaccacgtgcctatctgccacgtgagatgtggatggatgctcttgctttttcctagtgacactggtaaaagaattaattaataaataaatccttttattaaaaattacgttagaaaatatactataaacattatacgttatatttttataaaatatttttaatattttaatatatatacttttagtgtatatttcagattaatcttttaaaatatttttcagataatcactaaaaactaatagttgtctctttcttttttttttttttgaaaaatttaatcaaatcaatatgcactagaaataccaattaacattctccattatttaattgaaaattattctcaattcatattgtgttttaaaggtttgaaaattaatcgttaagttatcatttgcatctatctattaattaatttatctctagtctttcgattgaaaattattacggtttttttatttattaaagtttgatcctcactcaatttgtaaatttatggttagaactaatgacttgggagcagatatgaaagtttggcttacatacatacatgcttttagaaagaatttcagttagagtctgcgagattaattttgaagttattggttaagcttaagcacagtctaaattctaaaacatgcccatgtaagctaaagcatgcattcccaactcaacataaccgatattgcaggatattttgcacaggcttctcgatgacaaaattgtgcactatcttgtgaaaccatcgtatttatcaaaatttgacgttggttttatgcacgatcacgtaacttggcatgtcccaagagtgtttgaagttttattcgattaatgatctagtcacatggcctgttctacgggaaaaatgttttaaatacctctctattctaggtttagaaacatcttattggcctttttattctttttattcaaaactgtcgctaattttcctcaaagccttcacacaatatgcaataaaaagattaatttgatcttttcccgaaggtatatcatgaataagtaaagtatgaatataggtagtgggtaactaaaaacttggtaactagcttataatctagacgctcttgctagagaataaacaatttgattcgcttttgaagtgaatgaaggatatttctgtatttttcaagtattcttccaaactcaga

SEQ ID NO: 4781 - DNA, 1500 bp, Glycine max
  Soy_ogl_2639 Gm08:12703101..12704600 Cluster 20
ttgcgagtacatgattattacttttttggaacaaccaaataaattatattaatactcggtagcagatacccaattacaaaataattgtgtttaatggttaatcaatatttacaccagagtatcagttaaccctaataatgcttttagatatagttcacgggcaactataaagggaagaatttttttcctattccatacatactccaattgtttctctcggacttgtagtgtgtattcgaagataagaaagtgatcgatgtcggcataaaaagattaataaaataaatcaatggtcaacatatcaatgtaatgcacatatactacaaaatcacagatctctggtttccgtggctaattttaaaatgccacgtgatgcattgttggactctggaatacaagcaacaataatcaaccaaatcttccttgaggaaactgcaatatatatacctatttgtgaaggtgtgaaaatagggttgagtggtggatacaacacaaaaaggataaattacggtttactgtttatataaattaaggtttattagaattgcaaaactctaaaaacttctacatctcaaaaaattaggagtgataatatcaaagtttttaggtttactactattgttattgtagttgcattggatacatgtgtgtaattttccacaatatcaaaagattacgatgaaattataaccgaaaccgcactttataatcttagagctagcggaccaattgggttcaaactagaatttttaataagaaaggttgatgcatataaatttaacaaactcagccaacattttcaatcaatttgaattcaaaatttttgtaacccaacttaattaaattcattttcaccctacgaaaaatatccttgtctaaaccacaaaactgtttttttttttacaatttggggatatatttttttaaaattaccaaatgagaacattttttgaattaattcacatttaggggttagtcataaaagttgtatattactcttaaatgagaactaattcaaaagtatcatcattttaaaaaaaaaaaacccccgcaaagcctattacttacacttaacataatacaatctagtgaataaaattatagaaaatagctttttgattaccgaaagcatccccaataatcaaaagttttcaaggcaggttggggagttcatggttcccccaaaattcaaacgtttaatctgtatgatgttacacgacatcttccaaacttggtcagcaagcatattaacacgatactacgtatattatatatatatgccccatgtgcgaattggagaggactgaacctgctgctataagctttcaaccactgttggcaatcatccacctacatacatgcatcttctatacgctagatttatggaaacaaatcatgaacttaaatgaaagatcaggaaataaattgtgttgaattggatgctaatctattagtaacaatcttttactttagacaaagaaaaatgtaatatgtaacttt

SEQ ID NO: 4782 - DNA, 1700 bp, Glycine max
  Soy_ogl_3028 Gm09:5943901..5945600 Cluster 20
aaaaaaacaaattagattaatatataattatcaagggagattagtttaattggttcaacaaaatacataaattattgtaaatctttagatatctattttttattcttatggataaaaaaaaagattaaggcataattaactaaagggtggctaattcaagtggtatatatttgattctctttaaacatggtgtccaatcttctctgtgaaaaaaaaaaatcttagtgagggagtaagtaatggaaatttcttagttagaataaatggctatgacttcagctctattattgtgcattatagacagtctaaaagggccggcatgcctataatagtacttaattgaaacttgttataattgaaacttgttacatttatattgttcaatcttttgtcttaatataccgcaatactctagtctcaactctcaattacaattttgagtttgtaagagttaaattagtcctaatattattgctttgaatctattaaccaaactagaaggctaacttgttatctcagaaattggttgaaagtagtgacttgtctcatacacggttgttataggcatcatcacaaggactccgaacttgagccacaattaccaacaaggctaagttgtgtgagttctttacgcaacaacacctagatgcacaaacccccaagaattttctaggtgtttcctagaggtcattgatgaaattgtaaggcaagggcatggtcccaattcagccaaattctttgcattttttcagctttggaccactcaacttctctcacaaggaaaattattcatattttggtaagatatgatatggtaggtttgcaacatgtataaaaaaatgcaacaaaaaaattgtgggaaaacttttagtcaagattggttggggacttcaatttttgttagtgtgtgaatgaggcccttgaacaaggataacaaatgccatttgttgaatacaacttaccaaaataaaaacaaaggacggttcttaactaatcctctagtattgataacactaattattaagacttggaggaggcaatagctactagaaaagagacaagtttaatgttggttcaaagttcaattctttaactaatacctaataaagtattgttagcaagtcaatggctatgtcaataaccaatgtgcgtgcagtttgcctaaagcatgttgtcaccatcgaatttgtttaggcacctaattctgcatagctaattatttcggtttgaaagcataatttcccactacattatctccaataatattatgccggtgattttatttgctttaattatacttttataagcaaacccaaattaatgttgtgagagtactgttggatgaaaagctgtgaagttggtgctaggaaaagtacgtttgttgaacttgaagcctcttatgtgtaccttttaacctgaaggacatcataatatataggaacttccttaatttgtttcagttttatgtctggctcaatttatctctctattcaactttaccaatcacaagtttttgagggggaaaaaggagtatctaaaccacgaaacagaacacatatatcaaacaggaaatctttacgttgcattgaattatgataagttttaattttaaactttctggaacttttatattttgatagtgaaagatataattttatatgtataatgaagacttgattatgtaagtattccatggatac

SEQ ID NO: 4783 - DNA, 1700 bp, Glycine max
  Soy_ogl_3863 Gm11:17243701..17245400 Cluster 20
aaaaggggtaatttcatttcataccccaacctctaatttttgtgaaaccaatatgccaatttggtcataggggttatacacatgcgtcaagtttttatttgcactaaagaatattggaaatatatagatgattctccaaagatacaagattagtccagaggggagaagaaaaagaaaaagataatgagttttaattttttgcattaataaaaactaccattattaataattaacattattgataaaaaaaatatatatagacagatggtcctgcctaaggctaagaggactctgtgaccacaacccataattttctccccaaagaatggctcggagaggacaccacgtgtttgttcctatctatatcgtctcaatagagcaaaacaacattggtgtcagtgaagtacacattcactattatttgctttctttattcatcaagctctcaattcatcaacatctattattgcacggatgaattgacgaaactgaaaccatccaaacttccttttttttattttcaattaatccatcgctaaaagctagtggattgaccaaaaacgattaaacttttgagtattagggagaaataaactaaagggcttctaagaaagaaagaaaaatgtacgtacatgttcttccactgtaatttccaaaccctgttagatgtgatgtttccttttggaaaacattattagtattcttaccaattgggtcttcaattcacggtaacaaacaaaaaataacattttaaaattgctgattaattgttttggcatcaattcataatataatgtaaatagttaaatacccatatatattgtatgttagcaattaattgcaagcagaggaagcattagaaaaacaaaacggaagtctagaagaatagggacaggaaggctttgtctacttacaattaacaacaggaacgaggggtaacttaaaagttattgataaatactaatattgttattaaaaaatttattaaagaacttaaaaaagttattgagatgtgcaaaattgtattatttatgttttttttttataattttcataataaatattttttcttaatttcttaattgatgaatactggtagcaacgtcccaatttattttatgtgcaatctaaatctgagtgataaaaaagaatggatgttttccaggcatgcatcaagtttgtctcttgagaggaggtggttgagggcacacacaagacaaagtggacaatggctaacatgtgattgggaacttaatatgtaagtcttgtctccgtgtaacggtataggaatacacttattttatatagcctactacatgttataatctacggcatcacatgatgtacgcaagtattggcatttgccaaatagctagcaccacatacacacacatgttctttgagtgtgttatgtgtgtttaagagttagatgtcttatctctagggcctttacagagagtcaagggagatagataatgggagttggtgagtggacacgttagttggataccaaaatgaattgagaatgtgataaagtagttgattaaaagtcaaccccggatgaagatacctatggtttagctaaaacactagaattgcccgtgtcacaaagcaagaactgtggagagggggaaagggtatcacgggccagtcataaacagcgtatgccatactcatactgtgcttccaatgccatgtgg

SEQ ID NO: 4784 - DNA, 1600 bp, Glycine max
  Soy_ogl_4298 Gm13:27195801..27197400 Cluster 20
aagcatcttccttgaatctttgctcaaaaaaacaatttgatttcttcctttactcttttcaggtcctccacccaagaacctccaatatgcaaccctttaatgttatttctcttccttcttctataaataatcgattagaaaaatctagtgttcccatcccctttctttatccatttgcttcttgatttttgtgccatcaaggattctcattttgcagatagcttccaaacctcactttgaagtaatctttctcccttaaatccctcaaagatagaattccctcttcatctttcaagtcgagatcattgattttaacaagaatctccttggctaatttttgaaggttaccataggtttccttattccataacttaaaggcaagattttaatttcttcaacttttccttcatgacataggctgccctaccatggatatttgtcaccttccaacaattcaccacttcctcttgaaaaccctttccttttaaccatccattgagaacctgaaatggctttggcctaatgtatattacaagaaggaataaattatctaaacctctctattgtgtgaaatttctttttatcgttattattgtgtgaaatttgattgtagatgtaggtaaaagtattacttatatatttaaataatatgatgatgcggctccatgttcaccctgaaatacgaatatccagccatagaaaagatcttgatcaaacttccatactctgttgacacaatattccccttctacgaaaaagaaagtcgatttgaatgaaaaggaatttaaattgttatccaagatcaaataggaagccatgcactagagatcgtggaatctttaaaattgaaggaccaaacctcaatgctcaatggctctaacatgaaaagtatgtatggatagagtctagaataaccagaggaggggcaaagcctattgataagccaagtgtccttaatgaaaatgagttgtgagtgattgaactttcaatactatcggacagaaactttcgccctaggatttattcttccaagaaatattcattggcactagcatttagttattttacctttttttgcgtagtgctagagtatgcttgagaaatattatgcttcttttttatggcctggctatttatttattatattgattttaatatatttttttataaaaattatgtgtattttttattagaaacagttttattcaagttatgtatgacctgcattaataataaaatttatttttaaatatttaatataattgtatatgtagaactcgaactcaaagtcacttatcaaatcaaaattatcttgtgtcaattaataaataaattaagagatcaaattaaaccttttaaaaataaaataatcaaattatacttacaaaataaattaaaagatctagtaattaaacctccattctcaaaagatacaaatactattcttatccttataggaaagcatgtttctttaaccttaacccaaacatatgctaaattgttccaactacaacaaaacgttttggttttcgagaatgtgatttgtcgttacaccacgtataactccgtttcatatatatattgaacataagcaggcact

SEQ ID NO: 4785 - DNA, 1700 bp, Glycine max
  Soy_ogl_5167 Gm15:48987801..48989500 Cluster 20
aattcacgatggaaaatccacaaactagcattttcatatttgaatatcaggccacatgaccacatcaacacaaaaagaaaattagatcattaattccattccaacacttcctagatcaacaactcaacacttttcccgcaatcttctaaatgctcaaaaatagaaattaagaagactcacaaattcacactcacaactcaaaaccaatagcatcaatgttacaagaagacttacaaactaacaaaaaccagacataggaattaggaagttaggaacagatgaaagtgaaagtgtgaaaccacttatggcaatcatgggctgagttcataaaaaagaactccctcttatcgtaggaggagtcaaccatgatgtagtgaacctccattgcattgcatgttggaaaaaaaaaaaaaaaatgaaattttaaggtttttctcaaactatttttgtaaagctgtgcacatttcagttgcatgcatattgtcttctgttttgtttgcttttttgtgacgtggaagagctcctaatacaaaggagactctgtcaatttttcttggtatttttaaacaagttttgattttcaaaatttggggctatgagaaaggagagacttgttggaagactttgttctctagatcagtctcagcggttcaagcctataataaaatctacccgttggttttacaatttccaatttccagatgcaggggtttcaaccaggcaattaaaatgcatgaaatttgagccattgccctgggatcatcttgattaaaattggtagaatttgcaaatagttcaaacaagccaatttgaaaattacctaggaactaggatgtgaagaaaaaacggcagatgatttctactaaaataatgcatgacaaattcacaatgaatttccagctaaaatattgaaactgctgctatatcacctaatatgacaattcctctctaattttattcacattggctatatttttagagataaacattactaacttcaggaaaataagttcaagaactcagtgccacaattctttcaatgtcaatcatcatagatagtcagcttggagaacacaagaggaattttgtaaaagagaaatgcagtaaaaaaataatatcattggcatttatagggtcaactataattaaattatatggtgctaaataagcaggcaacttaatgagtctggaaacaaaatgcaactagcggtagtattttatagattcctaagatgacttaaccctaactagtaacaagagataaacatgttgaaagcaatgatacttattggtattccaattaccttaaagcccttacagctgtgaagaattgaagctcactagatggaatgagaccaagacagactctatcagccacgctctgcaaataaaaaaaatcaacagcttctgttaaattatttccttctacatacatcaaatagtgttaagaattgatggacccattttccttagacatcacacttttatagtcagtattcagtgactcgttcaaaaaagtgaacaacagagtaaataattcaattatctccttcaagtatgatacaacaatcaaccacaaaatttgcttttagattatgttggagtgcttctacagcatggggatcccactcacaagcatatacaagattttcctggcactgctccagaacatgcaaaacaatatgaacacatatagatta

SEQ ID NO: 4786 - DNA, 1100 bp, Glycine max
  Soy_ogl_6514 Gm19:42420701..42421800 Cluster 20
agtcaacaagtttattatatgagcaagttacgttcacaaatattcctctctgtcttcttaattgcatcactttctcactcgaccgattaatggaaaaatatgagtaattttattatatgtgtaaatgaagtaaaagtattatatttacgttagttatatgcctaattaatataaaaagttattgttccagatttgaatttactccaacttacgtaccaataaaaataaaatacattttaattttataagaataaaaatcatactaaaaaattttacacgaaccaaaattatatatttaaatcataaaaaattatatagttttggtgtaagatccagcaaagtcctttagaaataagaagactagattatagtacccatttattttatttcaatctttcttttcatcttatgtataattataactttttactttctagtcagggaagcatgcacatgcttattgaatcacaaggacttttgtgtgtggtgtaaatgaggaagtatttttcttttttttttttgagagagtttaatgaggaagtactagaggtaggagataacaaatcgggcaatagaagccaaaatgagcagtaaagctgccccaaagtttaccttccccataactgcgtgatttaagctagtgactgctatttctgatgaaccaaaggaaagagttcctccaatccaagggactagccactgaaccctctgaactctgaacccctctcacgttatgtacagtatttcacagatccaattgcagaaatcaccagcaattattgcaccacaaaattcaactgccctccaactcaacataccccttcccctcctaaaaacaaccaaagaagacgtcaagaagctttgccatgcatgtcaaaattatactatactatgtatatatacaaagtaggcatgaattagtagtacaaattaaaccgtatatatttatatatgttctcaaagacagttacaatctcactctctcatgtcttctgcaatgtttagccactttcgtactcatattattttaattagtaagaataaaaattaaacgcaagaggttttataataactcattttttaaatcaattaaattagac

SEQ ID NO: 4787 - DNA, 1118 bp, Glycine max
  Soy_ogl_1597 Gm05:5010601..5011718 Cluster 20
aaaataccttgaaagttgaaacacctcttatatccagttaaaaaaaatgctctaccatacaccacatgaaagcatgatgcaccgtagacaaataaatatttaaatgtatattccatcttttaggggagaggagtaatttattttaatgatgttaagttaaatagattaaattgcacatttccttcaatataaaaaagagatgatagtataatactcgcattgaagagaataaatttattctaaacttttttttagaacaaatgattctatacttgagcacttagcaccactttgaaaagttacaaataatttgtacatctagcgtatatagtatctatttcttcgttgatttttaattaatcacagtcttaaaaaggaagtgtagagagagtgctcctagtattttttttttctttgttttctatttgggccttgttgcccgtgttaactaatacccacaaatatagaactaaaaacataaacaatattttaactataactcaatttattataaaaatatatatatacataatccaatttcctttttctttttcttttttgcaaatccacaaaataagcatcgcagactatttttttaattccctttcgggtctcctaaacaagaaaatttctccccgaaagcgtggccaaagcaaaatcatgtatgagtgtgcgactttgttgaagccgacacctcgattggtcctagcatcctaatctcgtaataaagttgtaattattatagggggttcattgcttctaattttaaacctgcatttatcttaacttttcttagaaccaagtgttttagacttgcattttattgatttccattttctttttgtagtaatgacatatgaaaagaataaaatgaaagttgcaacatttgaattacaattgcaattattatttgacctctagcatccatttaccttaattaaggtttaattattttcaagaaagcaagttactccgtactcaattaaatgttcacaatcacgtgcattgtggttttctgttgcagccttgcagttgcacgaacaattgatttgtaagactttcttgcatctttttttgtgaatgggataatatacttctatgtttctttttaagtgtcg

SEQ ID NO: 4788 - DNA, 1621 bp, Glycine max
  Soy_ogl_2222 Gm07:5872080..5873700 Cluster 20
attgagagaatactttttttaaaaggcaattcctattctcaaaaaaccaaacagttacatgacaaaaaatatatgtatgcaactctccaagtcttctttaattcttttaagtaaacctccatattgaagataatgagacacgattaaattggcaagaccactgcccatctcaaccttttatatatagatagattaattagaagaccacacttttgtaaaagccaggacaggagaaaaaaaagttttgaattcgaatcctccgaagcatatattacaaattaaaacaatacataacctcctgttagtctgaaattacatttatattgtaaatcagaacaaccttagttagtaacctgtccaaaatcagctaccaaaaaatgccaaaaaaatgccaaaacctagagagggactaaagattggtaaagcctttttaaaaccactctcatagcataagaaggataattatttaacacataattttgaaaataagtacaaacagatttaacagacaagtagacaacatgtgaggcaaaaagtcatacccaccaacaatgtgtttaaaaactgacttacagtgcgtttaaataaatagtttaatcaaatatttacttatacttttttattaaaggagagtttattctaataatactttttttattaaatttattgacctatataagccactttataaatgcaaatatatttcgtaaaatctattcgagataccctttttaattgataacaaaccttgggaaacattcgtagaagtagagtgcagttatcaaaagaaagcaaaacctaggtttcttccgtccttgcccagtggcttggccaccgacggagtgggtctttgctctctacaaacgttggggttccttctttgatccttgggagttctgactacctcagtctccaaagtttttccttgtttttttccaatcgcgtgccctatcgctttttctcatcttgggctatgaagtagttgccagcttgaactgctcttgatggggaagaacaagggtcgtcaatcgcactcagctgcaaagcaaattatggtgaaaggtactacctcaggttcaggcaaggtgctcgtaaaaaaggcagggacaagttctgcaaaaattgatgatgtcgcacaccaagtgtttaataatttgtctgaatgcagtgctgaatctgaatctttcccagaggtttcttgcaccttaggggacaatgaaccactgatgatgattcatctcattcatgtggctctaagtcattaccgcaactagacgacaataaggctctcactccttgggtcaatctgttcaaagataacagaaactcttccaaaggttttggaatgaagttctcccctctaccctctgatgatgaagtgttattggaagaaacttatttgcaacccttggaagaggcttggggacatagccttattggctatgtggctgaccgattcccaggaaagaaagctctgctggattgttgccaaaaatggggagtcaagttttcatactcagctcatgaaagtggttggctggtgtttaaatttgagtctgaggaagatctgaaccaagtcctctctgtaggcccttacttcatatttcaaagacccctattg

SEQ ID NO: 4789 - DNA, 1796 bp, Glycine max
  Soy_ogl_3469 Gm10:40315305..40317100 Cluster 20
ccttccaatcacattaatattttttttttcattgaaaaggattttttaattctagacctgtttcatggattttttttttaattctagatgtgttttcttaaaaaatatgtttgatagaattttaatatttttaagaatatctttgaaaattcaaaataatttaaataaaacatacataagaaaagaaattaattgatagtattttaaaaaacaattctccttattcccataaaaatatttcattccggtccctcctcctcatgaaaataaaaacaaaaattattacattcatgtgaaccaacaatacaagagaacaattattcaaaactagtaacaatcatgagtatgagtacgtaatatattcgtaagttaaatttttagaaatgaacttttattccccgaaacaaatgcactgtataactggtcacttttgatcccatctctcaatgaaatctttatagggttagtaagcttttattttagatcacatgatctcttatgattctttttcatatttataaattaaaatagttatctagcttgtaagaatcccactctccactttctcatatttaattttgttttacggtagaagtagtcaaatgagaaatacatgatgagtccaataaaacaaccatagactcaaatccaacgactgacaaattaatcatgaaaaagttacaaagacctgaggaaataatgtactctattgtaattataatccgcatccgaaggcatcttggtatatcttgagcggcgatggcaactatttgcggagcaataggctagcacagcagttagacccaagaatacaaaagcagcaacaaacgtatagaatttctctgcagaatacacgtactgggccatggacctattacccttttgggaatcattgtacttggcgttgacttacttaatcactttttccagatcttgagtgttggtaggcctaatcgatttgctaatcccattgaaaagatccgcgacgacttggtcactcagctcggtctgaatgatttccctttgtaccaacagcttcacatcctcacgagtgccaataatagctctcattatttcaacgtaccttgaaaacactaagggtcttttggaatcaattaatgactcgtaagccatcaggtttctcatgatcacttctgagttgacattcaacttgatactaggcaaagaaaacatgcacgttccttcatcgtattcaatgcctgagattcctcctaatttggcaggttgaaacccaatcccagctttgtggagttccgtcacagatgggattgttgcaaccgagcgaacatccttgtccagattcttgtcccgcaaaatttcttcacttgctcgcttaactcctccgacaagcaatgtaacggatttgaggagttggttttgactttgacgggttgataaggaaccatataaactatcaaccgtaggctgaatgagtcttgacacgtattttagtagatcataaatagaacgcaacgcccgcataaataacgctggaatgtgccttataagttcccaaacaaaaaatataatcaagcagataaacagcagaaagaaacctaaaatggcacgacatacggaaaagaatcccaagcacaaggaatagcatctggaacagcatgtgtttcttctgctgttgttaccttcttcttcatccgtagaggactgtggattagattcaaacagtgggcttatgaaaccaagcaaatgataaatcaacacactatcttggttggattgagaaatcgtaagttggctgtttccgctgtctattttag

SEQ ID NO: 4790 - DNA, 1400 bp, Glycine max
  Soy_ogl_5056 Gm15:15183401..15184800 Cluster 20
catgctcaaaatttgaatagaaaatctcaattgatctaaatataattactctaacttttaataatgagacttaggagagaaaaaacacacaaaagctggtgggctagactattagcccaggacaagataaggcatggagggggtctagttttagttgctcaattgaaaatgcgaacttttattatgtcaacgaaatcactattaaatcatctaaagtcaatgagatatcgtatgatatgaattgttgctatttaattaacaaatataccaaagacaagaacaacaaattgatttagcatcgaatatgaagagtaaggagcaccaacaacattggagtggcataatttctgcagacgtagcatccaccattggtgtttttcgtttggtcggtcgaggccaccgagagaaaagaaaagaagaaataggatggaaacgtagaagctgaaaacttgaaatgaaacatcaattgttttgctagtgggtcacatggtttaacattggcctttaaattcgattcactcacctagcaaaaattgattcagtcgataagaaatcgactcatatctcaaaagaatgtagattctatttttattattgatgtgataactttattatgcataatctgtaaacatctctctgtaagtattctttgagtatgaactctcaaatccaacttgtctaaatttttagtaataaaaaagcatgtaactggaaattaagatattgtaataatattgaattacgtgtggactcccaagtgtcccaagccccaacttattcaattgcaaagaaaaaactactagtgtactacttattcaattgcacgtggcttttaaataacttttagttttaattatttacgtaacattaattaattactttttttaaaaatagatgaattacttttttaaaacattagaatgcttagaaataaatgatgtcttgaaataactatcaatattaaagtcttcgtgcttttctacgtaaacttgagcttagttgagagaagttagagacctttacattgtgtttgtagtgaggaaagaaagggaatgaagagcttttatttgataaaattatatctttcattaatcgtataagtttaaatttgttttaattaatatctttaaatatattactattgattttgattttttatttattttttgttgcggcttcttttgttattctcctaaacaaataacagtgtaacttagagggcttgtgacgcttttttaaaaatgcgaaattccaccaatcatgcacatgcagcacgttaatattattgaaatgaagttaaattttatttttaaaaacaagaattcaaagtcaatgatgttattaaatttccatgagagaacatcaacatttgactagaaaatgagaaattcaatcgagag

SEQ ID NO: 4791 - DNA, 1600 bp, Glycine max
  Soy_ogl_5134 Gm15:46999701..47001300 Cluster 20
cttttatttcatgggttttggcttggtccccaggttttgttgttctgttttctcttttttctctaatatattttctgctttctgcttaaaaaaaaaaaggagttctactatcaaaataaaatttgtgtgtgagccattatccaagagtgtgagagaggtttaattaatgagcttttaggtttgagttacctatttgttcaaaatcactttaacactttgaatacatgatcttattaattatatacccttctactaatttctaacccattaatgaaaaacttactctccaacacccatcaaacaattctatagagaaaagccaacaaacatatcaggtacattgttaaaatttgttgagaatcctttaatctttacaatttgtcatttttcttggatccaagtttgaagcaaccatgcctttaatttagtgccatttattacacacatggtaaaaagaattgccaagaaactaaaaatagcatacaaaaatgtgaaattgaagccgcatttcaccaagatttcattgtcaacctctatgtgcacccaaaagtatgatattaatgctgcgtttgtgaagccctcacagccacaagtgggaagaatctgttgtgacccacgatgcctctaaattcacctttctacatgaattctaaagtcctaagaggcactgacagaaattgactaatatttcttatataaacggagaacgccgctttcaactgtagaaacgtctcaaagcttaactctctcccctgcacatgcacaggggaatattggaattgacccactgattgctacgtgaactttaattaaggattaatctctaaaagtattaaaatcatttaaaagattgatttctctcaaaaatattctttcatatacacgggaatatgaaatgaattctttattattaattgagagtaaacattatattaatctatttttcagtgtaatgactaatatctagaagtatggtactttaattcaatttagaaattgatttttcttaacaaatgtatttttacaatccgaacatgtgaatataatttctgactctatatatgcttatgatcacatgcttaaagttatgtatatttaattttataacattaacaccttcataatgtcatgcatagataaaagtttaatttctaggtatgtggaaaacccgttgaaaaggagggaaaaagcagtcccaggattgagtatacaagcataaagaaatataatgttgatttttcctattggttgttgttagttcatgattttagaggcagcaatgagataattggttcagataaatgtcaacttctatcggagtggccagtggataaagagaatggaagtgcaacaaaaggatttaaaattgcacgtaaatgggatactttttcctcttgtttttgaaagggagggggacgagcaacatgatgtattgtattacctaataagcattatttaggtgcataaaatttataaaaagtaccaactgaatttcttaagcccccgaaggtgtccaacattcctcaattagcatgaggacttgaattaacttgtgtcgttttgctaatctggaagtgctattaggcaataaaactatagc

SEQ ID NO: 4792 - DNA, 1155 bp, Glycine max
  Soy_ogl_5910 Gm18:2944001..2945155 Cluster 20
atatatcccaaacaaacacactcaatatactttttccaaccacaaaatgttactccataattttggaactttgttttgttatggctagccagctaattaatatatatgttgttacaacttgccactcatcagtccgaatgcatggtacgatgttagcatgttaaagtcaaaacaaaatgaaatgctataccaaagattactaatcttgctaatcatataaacttagcaaaagacattaaatcgctttgtttacataattatagcaaagttagcatttgtgtgcatttcttctgctggtgtctgcatttggtcacttgctccattctcttagcattaattcgttcacatgattcaaatggacctggattccttgtagtcggagaagtcacacatttacccagttggatgataagaaccgtctgatgaaaatctgacgattcataattcatttcggtaaatccaacttaaaaacacttttaaagtaccaaccgtctgatgaaatcagacgttcatcagacgattcatattcccgattgcgtgactgtatgacagcggggaatccaaatccaacacaagagcaacattagttattattttattttcaattcaaccccattttctatacaaggggtgtttcttccatgaagttagagatggcgtgtacaaatacacatacaagtaagagcagcttaaataagggaatacgatgagtagggcccatacattggagttttccacttggagtaagctacagatgcaatggaaattaggatatgatgtattgtgttcagaattaatgtagacatctctgcgtatagctaggttgttatgctcagcgaaatttctgggttacgtttgatgtatcttttcacatatatagttctctagcataagtgtgccatgcccatgaagtagactagggatcactcactaatgaaagttaaaagagtttacttatactccaatcacatatatgacagttttcttttcccctacacaaattcatatttcgctcaacagttgtacacttgtactgaatatattttttgttctctctacaagatggcatgaatgaattatatagctatggctagtatctctctattccaaagattttttttcctcctgttttacaacaattatactataaaatta

SEQ ID NO: 4793 - DNA, 1400 bp, Glycine max
  Soy_ogl_6672 Gm20:1286301..1287700 Cluster 20
tatcataatatcatcatctggatgcatattttttacctgctatatcctaaatcattgcatttaactatctttaacaaaccctaaacaaaattatatttaacatgctctcttaaaagatgccattatgtataataaattttatatcaaacagcagaaagggtcaaaaccgttacgggacgacgtttgagagaactacaaaagcaaagtcactttcttattgaatgctgcgaaagatagacgcaaagaaattggatcctacaaggtgttaattggtgttgatagccaaagtttaaattaaggaacataaggctatgaggtacttgaaccggatagaattaaaaccggggtagggtagtaggaccctgaagcacacgtgcgaaggtggagcaatggattcatactatatgttttgtacgttgaaaccaatgcaattgaggtagagggccatgtgacggtgtaaacactcactataacaaagtgacttgcgtcttggagtgaggtaacgcaccaacacctatcagcttctcgttcgagagcatgttggtctttgcgtgaactcgtcgtttgtcatcagctccttcctatattatcaattgcacaaactacgactaaccctaaataaaccctaaagtgatttatgagtatttttggtcgttgctagtagttcataagctactatgaattgagtttggtctcctttttattccaattcgagttgtgtgaatataaaaaagtcacggatagaaaataccacataaaatataacccatcagtttggatagttaagaaaaaaaaaagaaattagaaaaaaagtcatgagtttgatttcttgcaaataaaaaattaataattaaccattaatatttgttaataaaaaaatattagatttattaaacatcaaatgctccatacatgaatgttacaataacaaaaaatattattattttttggaagaaaaaaattatatgcacttggttcatattttactttatacccacccaatggtttaaattaatactttttgacatatatggcagtaacttcatttaaattatctaaatctttcactgctgagccaattttaatgaatttttaaatcgatgttgttgtacacgatgatgaaatccggtgcctttatattgatccaacgcggagaatttgtatatttagtataaaaatagttcattttgtgatttctaaccaaactaaagtgagtagaggatgaatggttcttctcgatttattaatttatggggatgataaatgggtaactttaacgttgggttgttgtgcgtatgtttccttcctgccaatgaataacgttactaaactgaaattgttgtgcgtatcttcctgcctcatggagtagtatgtgtttaaggtgtttgtttcaaggattc

SEQ ID NO: 4794 - DNA, 1200 bp, Glycine max
  Soy_ogl_1602 Gm05:5297601..5298800 Cluster 20
tggtaatgggccacacacccccaagtcttattaataatatagcatggcaataaagattgaaatctgcccccatgtttcattggatgtcattttgtgctctttcttttcttcctttttatatggtttgctttcatgagggaattcaataacaaaactcattaattgcaaaacttggaatacgcgacttcagaaccccaacggagaagaaactacaaaggggccgttgtccgttgatgatgacacatgaaaatgaattaatcgagtcatatattatgttccatataatatgtccacttaattaaattcaataatatgtattcaaataagaaagtaacaacaccttttaatgtaagaaaaaattgttaggaaaattgttcacacgttgagatcccaaaaactctaaagttcccagcaaaaccttagagtgtgtgtgaatcttgggttgacaaaagaggaaacacttttatctttatctatatatagaatgtgactcatcaaaggtttgagacctaatattaaaggttcaattatctcattatgataggttcattattctcggtcaacctacatgatcaaataattcacaatccctcaaacgttgaacatgaaaggtgttgaaccaagccaaccggtccaaaactgattttagaagtagcgatatggttgataatatgaaactaattaactaactaaaacaggagttatgtataggaagctgtatagtacagttttgtttttgtcgtgggtgctactgggtagctagctagctgtataacaatatgattttgcattaattggtttgttctttaattagcatttggcatttgggaagtgccaacgaattggtaaagacgtggatatttgatggggtggtggatcggttacagcagtgagccagtgatcaaaggcatacacccactacagaaaaggaaagctcgaatataggcatcctagataaagataacacacgctccttgctcctaattatttgacatgttttcagatcccatctattattagcgttctcatgtttctattgtagtattactttctagtgtcccagaattcagaaacgatgctcataatatgattaaataatgtaatgtgcaagtataaatataaatatttctaaatgttcaaatttattaaaaaaacataagtataattaattatttgaacctgtagttccataacctaaaa

SEQ ID NO: 4795 - DNA, 1800 bp, Glycine max
  Soy_ogl_3008 Gm09:5250401..5252200 Cluster 20
aaaagagaaatagagacaataaaagtatatatttatcttaatagtcaatattttcttctgtactgtgtttgtatttttcatctatattccccatctatcatatttttatcataaatttttctaaatgcgtaaaagataaataaatagtactctcagcagtatcttgtcactagctagtttctgaaaccagtaattacttttttctttccttgtgtactgtggagttgaggaagtcatggaggtagggggagaacttgtgtcgcctagacatttttacaacctaaaaagatttatgacatgaagacctagtaacaatatgaggtaatgtaaggatcaatattcaatagatgccagagccaaggaatagtgcaacagcttagccaattgtatgtgtttcagtattttgtaaagaaggtgatgcagaaggagaagagcttaattctttggtacttccctacaaaaatctagataacaccaacataagaccataactttcactctcagtttcagaatagatatctactgtaagtctacaaccatgcagactggcaatagtaacatgagttatttgaaaattaccacaatcattacttggtatagggtcatattccttactaataacaatacatgcataccattgtctttttgagtaatctttacttctagttgtttctttaagaacttagtaggtccatgtgacaactttaaattataagaaactcacattaataacttcatgttgtaaccaattaagttcttataatatgaaataatacacatcctactaaaatcaaagatttggttgtagtttacaggcaggaaatacctgggttgataggaaatccagatcaactccttttgtttgatgaaatttgagacattgggaagtgctttcccatttgttgaatgaaactgttatatcccaaggcgcgtattgggaagaccccgaatagtagcacctgctacggctgtatataagtaactttgtagaattgaaatcctatttcaaccttgattttaaaccttgtttggtttttggctctggtatttaggaagacagataatatttggtcatacttgatcgactccattattttctctttcaaaagcctcagtcaaatggctgagaaaaacccatcacggatgtcctgaaactaacaaaaacatcatactttatttgaggagaattgttgtcggacattagtttttcaggagcattgttgtctcacgtgggtttcttctcaaagcccttcagttttcgaagtactacaccagagacaaagataagcaatacacaagagccaaggaaacgcaacatattgaatttccaatagagttcagagacagaatatggtgttggattggaacaagtgcagacgagatatttctttgtctccacttgatacctgaatgtgtatgaagcacaaggttactggaaagaaaaacagagttagaaataaggtggaaaagaacatgcagtttattgaagagaaactaatggtttgggtgttagccaggttagtgtagtgtactagacaattctatttgtctatttgatgacgagcttgcagctacaaattcaaatattggtgcatttgattgaatggtttggaaattaaatgtgtttttgtgtattgtcttagcaatagccatgggtggggctataagtcaaacagcgtgtttagactaggattgattttctatacctatccatcaattcaaaataatgaaaaatagactcagagacccaactctaaaaagttttaagcaaataaagaatgttttcaattattttcttaa

SEQ ID NO: 4796 - DNA, 1300 bp, Glycine max
  Soy_ogl_515 Gm02:12401901..12403200 Cluster 20
gtgctataattactctacaaaaaaaagagaatatgaagaagaaaacaaaaaaagaaaatgagtcaaaatatgtgacaattacataaaacaaactaagaagcattggtcttcttggtcacctctataaaaagtttctctaggttaggagaatttttaagtacaaaaataacaaacaaaggctatgttgtatcgtcaaaattcacaccatccaattctataaattctaagcatttgagtggtcttcgcagactctttggaaggatataagctgtagagaagatctataaaagcgaacataaaatttgtattaggaattagtatatgcccaactagaaaatatacaacgttctacatataatacaaggcgcgcaccaaattaaaaatattgatccatggtctttttgactaatgatagataaaaatcttagaaaatcacatcaaatggtcatgttatgtagaagggatgtgtaaaattatcaaaggaaaaccatatcatttttaatgcaaaatagctcatagcttacaattctttgagcaaaaatcactcaatgtagaatcgtaccattggaataaaagaaaaaaggtgtatatatcaactaataaattactatggtgttgttctatatttttagataaaatctaccaagctaacaaataatatcatatcaaataaacaacattaaataaactgacctgaatgtaaccttctatgtagctctagctcgttgttcaaaaacaatggaaaattataacacagttttaaaaggaaagacaaaagtttaaaatttgtgtgcagatatgtagaagccacagcttcaatgaatatagcaacaaatcttttttaaagtagcaaaaaataattacttccataaaatagaaaatgtgatttcttgttaagtgatgaatggttcaaaacaacacaaattataccataaaaggaaaccaaaatgtttaaatttttatgctaaaaagaagattttttttaaaagaactaactaaaagagctttatttgatggcaaaaaatgaactaaatataatcaaattcaatagcaggataatcaaatcatggtgaaaaactgaagaaaggatgagggtgacaggaagcaattaatcacctgaatttaattaagaaaatcaatagagggaatcctcttctttgttgaagacaaaagtcaatatataaaggcatataatctctctttataaaaatgaaagatgaaagtaacgaccctgctactcatttatggtattagatatagagagaaattttatttcatgaatcatgaagtatttattaca

SEQ ID NO: 4797 - DNA, 1197 bp, Glycine max
  Soy_ogl_2059 Gm06:42830701..42831897 Cluster 20
cataagccccatggttcagttttgtgcttacccaccaatagcataaattctcttcctttttacacccatccctgtccaggcttatatttattgcttttacatcccataatacccatttaaagatatcagactcctaccaatatgttatggaccaacaagaatcttcgaaatgcatgctaaaaaccgagccttgcaccgaatttatatatatcccttgaacacgtacaacaaccatagataatccaaagcacccaatgcagtcacaagacctctaataaccaaaaattaaatataaaaagaaagagtattctttgcaaaattgtcatcacccatcaatctttcaagaaccaagcctctccagtctccaccaacgacccaagcctcatcatctccttcgcactgtgtgttgcattcgttgtgtataagcctttttttttttcacgacagagagacttacgtagagatgttattagaaatagcgactttaccaaaaaaagactaggggtacaagaagaaattggtggtgaccgtcgattgaagtttgaatgagagaaaggaagtggacggttttgaaatctggaagaggaaaactcaacctaaaggggagtgtattttgtaggatatttttggaaaagacaatactgtattagtaatgaatggggtgtgaaaatagcaatagccgaatttatttaatatataattaagcgtttaaataaatccaaagtgcgttgaccaatagttacgggtactttcatgggcccgatgttcttatgtgagtatctatgaaactgtatatttttttattcataacaaattttactggtaggtatacgcgagtacaaattttgtttgccgtcccttactttaattaaattgcaacaaaaataaaatgctactttggtatcattaaagtttcctttaaaaaataatatttggttagaatttgttttagttcttttgtttaccttgaggatgaatacattttagagtttaatcttgaaaggctatcatgagaacatattttttttcctatttcataaattttactttagatataatatttaagataattaaaataatgaacaataatctttaattatatactaattcatcattggataagtgtaaaactaataattatttacactattaatgtacaataattaaattcacgttttatttacaaatttatatatt

SEQ ID NO: 4798 - DNA, 1700 bp, Glycine max
  Soy_ogl_3095 Gm09:32020201..32021900 Cluster 20
atggtaggtttaaaaggatgagcttgcttctgatttatctcaataaagttgagcttctttgtttcaacatatattaattcgtgtaatcctttggtcatttcaaggtcaaattaattttaattaattgaaaattataatcattccagattttgatatattttaattaagaatttaaatatattaggtaaattataaaagtagttttactcgtgttaattgtaagaaaaaaaataatttttggtcaatttaaaaacatgtttaaaattgttatagtaattaggtaaattataaaagtgttttaatattatccatagaagttaaaaatggtagttttagttgtattttcctaaaaaaatctaaatactctatactgtaaagttcctttttaatttttaactaaaacaaccccacactaattttaaaattttagctttgaagtgattattataaattagttttatcaaattaacaaattttcagtgccttaaattttatgtaaaataaataaatttgtttttttatgtcgtaatacaaattaatgtcaactaattagctgattaattgagcataagttgtttttttttcaaaaaaaaaaataaaagtatttctaaggttgacatatttttacttttttttctaattaaagttatatggatggtttgtgaaggaacacatctaccatctacgtagggatgcagcttttattagagcttaaaaaggtttcatattcttttatgataattataattcttccaaggaaaaaatatcaccaaataataataataatattttttcgttttatagagttaaccatatcacccttaattttgttatcgatgattaaatacgtcaagcaaaatcatttttagttatctcttcccaaaaccattatccagagtgcgtgtttgggaatgtgtttaatttagacacatgtatctttttattttcacgtcaaaacgttgtaataatgaagaagtaaagattaattgcttcaaaaattcatgtcacgttacaccgacaaccatttccaaacactctatgttaacccgaatgaatgcttagagattttggtaaattggctggtggattcatgtttatggaaaatgtaaatatgatatgctttgtttcaaaattttgttgatctcatgttgtggggctggtgttgcttcccccgacctgcttcaacggtttatccaccttttttttttatttgatgagactatttccttattccggtatcatatgcaaattggagtagaattaagttaaagtagttttctttttagttaccttctcttgtaaaatcacgaaacaaacgagtgtaatgtggataccaagtgtgatcctaaaccacgaaaattaaagtgataggtccaagaacaaaaaagaaaaaataaaaaggtgggtcgaacaaacaagtacaaattgtaaaattgacagggaaattgtcgctatatacccccttgccttgcacactgttttagtgagacaaaaaacacctgtttgcttattccatgattccatccctttgtttgtattcggaattgcacatgccgtgtttcatgtttggactagaattttggagatggtaagattcatttttggccattcagaacagtaagatgggataagtaccatttgaattggaactcggacttttaagccaccaaagcaaaaatatatcatgaattagaaaagga

SEQ ID NO: 4799 - DNA, 1400 bp, Glycine max
  Soy_ogl_5148 Gm15:48097401..48098800 Cluster 20
ttactgttgcacaacaaaaagtatgacaaaagcaattatcttcttattcaacccttaacctctaaaatcaaggatcttgatattttataatcaaatcaacacttgagatttgtgtaaaacctcaattaatctgttgacttctctaattaccttttgttatagcattgtgtccttgcaatgcaagatagtgtgtcccgcatacataccagaaggcaagaagggtgacaaatatacagaacagcaaaacttaacataatccatattgttgaagctagcagcattctctgaatttgcacattatatgactgaaacagagtttccatgttcacttaaaagaaactaaaatctagcagaaatcaatcagaatttttcttaggccttgcttcgataaactttttctattaacacttggaagttttaatagaagaaaataagaaggcaaagtaaatttacttttctaagtaaattgaactcttcgatcttgggcatcaagaggttgtagatggcccacctaagaacaatgccatatagttttttctctaaaaaaacaaacctacataagttattggattttaatatttatacctccctaattaagaagcatacctccctttccttttaatatatattttattactaaatacccttttgcacctccatcaaccccttttttccattattatttttttctctatcaaaaattatatttttttctttattttattgacttccaagtgaatattatactttatccttctctcaaatgaaaacatgataggctgtgttttcattgattgtaacgtcataggcggtacattttttgtcttctacatgattgcatttcaagtaagtaacaactacttttctaaagtaggatatctagctcccacctctaaaatttgattttttaagtactgccgaaaattgcttcttgaaaaataatttcctattgtagaaattaatttttagaactatgtttctttttctgttaaatcatagttccagtaatcactttccagaatatataattgttttttcaagaagtgatttctgaaaagagatcaaggcacttgtctaagccgatctttagaaagattaaggtacttctctttatctcttgattgtgagtggcaaaggaaggagggtgcatgccagaggaacaagggtgcgtggcggaggaataagggtgggtagcagaggaaggggagagcagaaaagtgcttccaggaaagaagtccccaacgagaataatttgaaattgggaaataaattagaagggtatttagagaaaaaaaaaaacaaaaaagagaggtatgttaattaattaaaaggatgtaattatcatttgtctaaggcatgttttgtgctcactaccatttggatttgagttgaactcaacc

SEQ ID NO: 4800 - DNA, 1400 bp, Glycine max
  Soy_ogl_5697 Gm17:15706401..15707800 Cluster 20
cctatgacttgctaagccgtttacttatttactgtttctttaattctcaacttgttattataacttcaaaaaaaaaaaaaaaaaaactcagtcaacatattagttcttatttcatgtgagtgaataagtacacgttcggatttataaaaattaggttcataacttcatacagagatactctttgttattgttccgtcctatactaaagtggtagttaactaccacttgtttaatttttccatctccttgtttgaaattgttagacgtgtcgcggacgcaacggaaccagaatctttctcgttttattcattttttaaaccttgcaaaattaatgatgtataatataagtaaaaaaaatgagttaaaaaataaatggtataatgaagttgagttaaactaaattttatgaggtttgagtctaatttacctctaaaccataataagtccaaacttaatctattcatctgatacttgttttaagatctgatattttttaaaagtataatttcgctttaaaaacttatttaatttaaaatagtaagtttatacacattccttcaaaataaaatgtaagattataaacatattttgatgctcaatactcaatagaaaacaactaaacagacttttcattatccagtaaaataaacacttttcattatcgatgtgaaaaatatttttatggggaatcagacgaagttgtctatcctatactaagggaatggttgtgtcaccgtttcgaggttggtggaagtcaaatttttttaacattaaatgttagttgataattttattagcatatgaaattaaagtgacattttttctttttctttaaacttccaattcactttatatcttcaaatttaaaagttaaaacaacggattttctacgaaggaaggacctgcataacagagaaaatcactctaacatgcaaattaataacaaaatgaagaaagaaaacatccggcatactcttcattattgatgtgacatatatttatggagaatgtatgagctacactattctattctgaaattcatcttcttggttcttaaaacagtttcttatagaaggcaatgggatagttaatttgcatgtcttatgttgaaacctacgaaataattgaaaccgtaagctccatataagactttagaacagtacaaaaatcttttcttatcatccctgtctcgcttctgtctcccagtgttcaatgtaaatggtcgtaattatataagatcaaactatttgcaaggaccataattgcctagttcgtttttgtggctttcggatgagttacgaatccaaagaagaagacacagaaacttaaagtacaatacactagctgttggcaataggcatgtgtttcaatcactattgaaacaaaaacagccactgttt

SEQ ID NO: 4801 - DNA, 1494 bp, Glycine max
  Soy_ogl_4784 Gm14:45867007..45868500 Cluster 20
gaaaaattgaaaatattaatgtaattgatttttagtttaataaaaaaattaaatataaaagatacagatatttaaaacttttaattttaaaaaaaataattgtaaaggaaatattttagtgatgatatggaaatatcaccttgtgtcttatgtcaattaaacaaatccgtattgattaatttttttcttttaatgaataattaattgaaaaggtgtaaatagtttaatttaatatgaaaaaacagaagacgtatatcacaaattgaaaaaaagaaaaaaagaagacaaacaaacctatgtcatgactactacatgagagaaaaagtacgtaaatatattgtctaactcttagaaaattaacaactcaaatttgttatataagaaatagtaataatttatactcaaagcacttctttacatctttatttacctaaagtcataaattaatcttttcaacgcaaataaattgcataaatgacattaggaattataatatttaggtatatattttaaattttgctagtctcattcaataatttccttaatcaacaataataaattatttcacaataatctgggaacaaacattgttctaatttgaacatagtgtttctgttgtgagggagcaacagcaagcaaagaggagagacttctggagttctggagattcaagtgcttcaatttcgaatgcagaaagattcactttctatttcgaaaaaataaaaatctaaaaaaccaccaacatgttatctaattaaaacccatgaaatggagtgacaatctcactattggtttcttttttcagaatttaataaattccgataaagtttaagcaagggtaattaaaaaagtgtgtattgtcggaaattctaaaaaaaatgccattaatcaaactttgcttgttaatccttctcttttgaggttatttcatgtcgatacttttaaactttgtagcagtagacaatagtgttattctttattttcaccctccacaaaaagaaagtgagagagaggaacatgtctgaaatcgcagtaaaaaatttcacaaaagtgtcaattttgtctttgtttacgtttttatgaaattattgttaataaattgttgtaaaagatgtctctgaaagtatcagtttggtaattgctgacatgtgcatgacttgcaaagaaagtgagagagaggagcatgtttgaaattgcagtaaaaaaaatcacaaaagtatcaattttatctttgtttacgcatgcaagacctgacatctaagcatttataaaattgtaaaaaaagtccctaaaagtatcaatttggtaattgttaacacgtgcatgacttgatatctaagtggcatgccatgtggttacctatttgacaggtaacatgtcacatgataatttattttataggattaatgagattctattagtagagactaacttgcttaatgaaattcaaatagaggaatttacttaataattagtaaaaaatttgaactacta

SEQ ID NO: 4802 - DNA, 1011 bp, Glycine max
  Soy_ogl_2336 Gm07:14757790..14758800 Cluster 20
ttattaggttgacttgttttaataaaattaaataactatgtccattaaatctgagaacattttaaatcttataatgattatatcaatagtttaatttttgttagacaaagagtatataacacatataggttaattcaacactaaactgttaacataattcttgttctaattatagtagtataggtagtatcaatgtaaagcgtataataggaaatggagaaaaatatgtgccttactttttttttttcttttagataaaaattattcagcagtactaatgacaaaataagtgtttcctattttaatagcccaaagtataaaaacagttcttttttaatgctttcgaaaattaaggcaaatatttaatgatgattatattgattgattaattagttctccacgaatattaccttctgtcgttgtcacacttccttgaaaagagaagtatcattatcttatgcctacttaattagacgtcagagtggatcaattagtgcatgtgcattgattaattattaaatcaagttttcaacgagagaaaaagtgtacgtgttcaacgatcgaaaaagcttttgctccttgtatacatatataatgaaaatgctcatgtatatgagccacaactattagcaggaattgatcattattaggacatatgcatagacaagaactaaagggccatgtagccaacatatcacacccccttcaccactttgtcatagggtttatgatacgatgatgaacaagatatgtttgtcttgtgcaaagtgattaaaagatccaagatcattgtgtggaattcagagaagtctcttatatttgtccatatatatttcaaacaattaaatgaaacaaaaaaacgggatagcatatatagggcagctggtgattattatcaaacctggaaacatgagaagacaggtggcttcaaatcaggacatcctcacaggtagaaacaatgatataatacacacagcggagttataataattaatagaaacaataagttat

SEQ ID NO: 4803 - DNA, 1000 bp, Glycine max
  Soy_ogl_1062 Gm03:43072501..43073500 Cluster 20
gatgtgtggaatgcactttttagcataggtcatatagaaagtgttgagcaaagagacaggatttaaaaggtaagaggtgtagctggtagttgtagtagcccgtccaagtgtccaacgaattttgttgggtactagtgttaattgggaagacacaaaagtaaggtatggtattggtaggggcaacaaaacaaaaaggaagaatcaacaaggacccaaacctacctatctataaatataatactctttccctttgatttcatcacacatagtaatattattgttagcttagttggctagtggcatcgcccgaaacacgcacaaagaaaaaagaatgaatagttgtgatagtcataatgaatgataatgtccaatttgtccggatagctcgcctggtgctccttcagcgtgaatcctaatcctgtgccttctccaaatttctacctcctacgtactgaaaggagtgccttcatttggtttgaaattttaaaattaaacctaatgtgagactgtagattattatagtctggtctagctaatatcttatatcattttaaaagtatttatttactaataattaggaatggaaatatataatgtcaggttagattttggtacatttaagtcgagtttagttcataattataaaaattatttcttacagactatttttaagagttaatttaacttttttgaatgtctaacgtgacttataaccgtacctaaaaatttacttagcctgttttgtataaagtccatatgcaactcaataagacttaattataagccgaagtagatatgaatctaaacaggccttttttttataaaaaaaatattgataagtttatatttttatattattcttagatataaattgtattatatataaataagtatataatattacttccaagatccgatactatttataaaaaaacaaattataacaaagtctaacctttttttcttgaattaaagtattctggtagacaaaaattatgat

SEQ ID NO: 4804 - DNA, 2000 bp, Glycine max
  Soy_ogl_1797 Gm06:5521801..5523800 Cluster 20
ttttatttaaatagaaatcgtttggttaaaagcacagggccggtgtgcgcccagccaaaaagaacaacaaatacaattaataaattgctcatagaacaagctagcctcccctgaatatgcattaaattaagtacctactaagttctaccccatctaattaactctcccaaaacaagacaaaacacaatgagtcactcataagcaacagcaatacaataaacgaaccctcatagtcatgatatatatagtccgaataaaaatgaaggataaaataaaccagccaattaagaagcttgtatctaacggtgattgcaagcgatgcagcataatctagatctctgacggaagacaagtgaaccttaatttggtgaagatagattggggaaatattgaatcatgatttatatatacgtcaacagcacacttatttatattcttcctttctctgcatctccctctatcataggagtgttaatttttagacacttaaacaattgaaacacttaaattaatatttgtcatgtgttttttttttttttttatctcccacttcatttacattacataaacaatcatatatatttcaacatccacttattttaaacatttcatcaataactcttatttttctctcttatcacatcatataatctatcatacatatttttcttcttcttttttttcactatctctaactaggattgtgtttgtttcaacggagaaaaataagtttagatatcaattttgtactttattgtgtgagattgagatctctttttctttgctttatttaaaaaaaattcttctatttcttttttctttattttctcctctaaatcaaacacaacataattgccaacaaaaaaaatatttttcctattacttatctttcttcttttctgatctcaccctctctcttaatgaataaattattaattaacaagagaaaataatgtttatacataattttgaatctttatcaataagttaaaaaatacttgtaatctttgagggaaaaaacaattctataactattaattaatttttgactcatttctatgttatacatattcaaattttgattaataaattataattatgcttcatataaaaatgagtgaatatcatacattcatactatccacctaataacttatcttctagctaggtctctttttcaatagagatatccacactaaaaatctcatcatcaatgatatccacctctaatgtgtctacacgtacgtacacaaggggtatccatccacgtatctttttttcaattttgttaggttatagctagcttactgtactccactactcttttttagaggttgaaagagctaggtgacgcatgtatttatatgtaggtttgtatcttagcaaaagtatgtattggcatgatatggcatgtacaggtaaggtactgataaaaatcaggtctgaatcgagggcaagactgaaacgggcatgccggtattcgttgctgttcttcgatctatatatccccatgcaaagatatatataaattctcttaactatgcatgcaatgcaagtaaggcacggggcccacgtgtacacatacctgacacaccctctttcaatattctgtcagtttatactgttctatgatgtacatttttttgttttttgttttattgtattccaaaggcagaactgttgcattttgttttgggcagtgataagtgatgatgatacatgctatgaggtcatagttaagaggatcccctccctactagctagcttgatatatatatttcttttattggtgaaagttaagatgagttagatttacataatttagtagcatcaaaatatattttaagtatttaaaaaatacttacaaatcatttattaataaaattcttacgtaataattatatttaaactcattcttataagatatgagtttgatcactagtaacagaatcaatctttatttacaacttgatatataatatagtggtggaagtaatagc

SEQ ID NO: 4805 - DNA, 1519 bp, Glycine max
  Soy_ogl_2311 Gm07:9596001..9597519 Cluster 20
acatggtagcatggcaccaatgatgatgctatgaactctaatataactaaaaaattgttcatgtagggaaatgtcctgcttatgttttcttctaccagtcaaagtgtaatgtaggaagcatttttttttaatttttgttcttaaaatagatcttaagtttcataacaagactttcttgcataattgtaaattttgtttctaaagaactaaagttcaaatcccatttgaatgttgttgtgtctccctcctcgttcacgtgctaatgtaagttttgggatgttggtattttttctattgggctctgagatatctggtaattttcatttatatgtagtctttaaccttttttctctctaaatgttcaagtatttatttgttttacttttgtttttccaattcagtttcttgtttacatcatcatgactttgatcatgtatacctgaggagattggtctctctagacattaacaaaaagagaggatgatgctatctcacataataataaggtcttgaaggttcccaaaatagtaatcatataacattgtaaagatgagaaagtacatatcctttaatgatgggctcaaattttcaactcagtgatttttttttcctttagtatcaaaatttcggtccatataaatagataatgtcccattgcaaaaatccttattttcttatcacaaataaaatatttcctctcttgatatcaacattcacttaagaagtttttgttttaaatgatgcactttaatgatggttgtattcaccaacttttaatgtggtatggtcttatcctttgtctgtatgcagtgactctgtttgctttcatcaccaaaattgctaatggctcccatataaacaacaatttggtaactgaaatgctactaccccttgtagcaaggaaagagttggacctccccaagcatttcatagtcggaataggttcattgagagaggatcttgaaagaaaaatggcagttattactatgtgaattatatgtgaagtttggatcaattacagctgtgaatatgtatcaagtgtaaaattgatgtatcagcttagtgcttatgtgcttatatatatataaaaaaaaaagtacaatgcttttgtaacaaaagggaacataggtccaaagagatacaaacataaggaatagaaataataaaaaggaaaggaatatatgtccaaagggaaaacacaaaacaaggaatgcaaataatacagattaaatatattgtttcttaatgttgctcgtcattaatttaaacggtaaaaaaagttaaaatgaacaacgactataattagaaagaaggataatttaatttaacttagtagtgaaaaatatttttaattttttatataactagtatttaccacttaaaaataagatataatgattcacataatattaaccaattaaagacgtagtaatcatagtaacacaaatattagactaaaaattactcaatgattttttgttaaagataaactatactcattcatgtaataattactaaa

SEQ ID NO: 4806 - DNA, 1400 bp, Glycine max
  Soy_ogl_2833 Gm08:40932401..40933800 Cluster 20
gctttcgttgataatttggccttaaaagtttccttcaaaacctagtataatttcagtatgtcaaagcaaaagggtcttaatattattaaagtagccgttgacagaatccatattataataacagattgatagtttttctatctgcagggaaatatcactttcttttaacattaatactgtctaacaatataattaaaacaaaccaataattacaaaaattattgcatattgatatttcaagagtcacatgttctccatactttttgtggacactaatttccccaaacatgcagggaatgctcttatatattctgcaactcacaataaccctaaccaccctatcatacatgtccaatttggaaccaccaaacacgtggccactaaatctcgatcttttgtgattccaccattagttaattatgtccaatgacaaaactttgctgaaaaatcatagttggcttctgagaaactgtcatcaaaatgccaaaatctttagccatttgcgaagtattttaaaaaccatgttcacatgatcccataagtataacagcgcaatgcattaatatataaatgaattatttttaagcaatccagatgttatcacatgcgttgtttaatatatatagaaatatatagattctcatcgggtttctcatgtaatccgtggataaggttaggggttactctaataagatttgttgtcatatccattaccatgttgacagcatcaattacgtatgggaagtttcaatatctatatatatatatatatttacgagctgccacaaagaaaatactactttgtatacagattagcattacatgatactagatgtactaattaagagtttcttagaatctgacaccattgtttaatttttttctctcccgtaaattctatgtttctgactgttgaaactcaatataccttatagtttgaaggtaacatataagtgagacaactagttgcatcttctcccccaaaagtttgagaaattattagatgatatggaattattatagtttcaattaatccacacacataggcacatacgataaaatgttattaactttttttaaaaataggatatatcatgtagaaattggtcaaaactatatataaacacgtgggataatattgcactacctaattaataatttctcattgtattctcccttttcagtaacttaatttgagcattgatgtcatatgatttcaaaagtttagttagtataccatggtaaaaaaaaattaacgagaaagttattcctacttcaactgttgattacgaatacacatctggaaaaaagatcctagtgttttctttttaatcagataatggaattaacctttgtctttttcgccaagacaagcagaaattaaatgggaagagatgaca

SEQ ID NO: 4807 - DNA, 1693 bp, Glycine max
  Soy_ogl_4081 Gm12:33927401..33929093 Cluster 20
attaattccactgatttaagcttttgtcgattttgtcttttttctaaatgcaaatgacattatattaagaagcgcaatgcacaagacgtgcctgagctataagaaaccagatacgaatattgttgcagcttgtaaacaaagccaagaccaaagtaaacaaaatgaagctaaaaaatgtttacaagattaaaaaacctcccagtcagcaaacctcttgtggtatcacagaaactgaacttcagcatcctcaaattaatattcaaagatatgccctaattagaaacaagtattacatggagatataaaattagtctagcagtgaaaggagagaagagatcgcaggttcgtttcaaatcttcactgttaataaaaactaacaatactaacaactatgattttaaattaccgtcatggttgcattacagtaattcagaaaacctttacattacgagtaattacaggaaaataatatgacttatgtgacagcatttgcaattgtgttgcggtgagtcaaaatatcttgacattgtgactgtaattgtaattgcgaaacgctatttaaaatcatgctaacaactaacatttgtcaataaataaataaatattacaaacagccgataaaactcaggttataaacctcagccattatctggctgattttattttagtttgctagtttactatttggtgctttatttgtcattctctttatggtacaatttttaattttatttcattcggtgcatattatcttcaagcagccagtgactgtataattgcacccaccatgtccagtgctacgcatggctcatcagtaggtacctgcagcagcagcagccgagtaattaatcgaataaattactgagacaaaagaagaaaatcaaagacacgcctgatgttttcacaaattaacctcattttcatatagttttactcctaaaattaacttgaattctaaagccacaattaagtagcaacattccacttaatccgttatgatcattcttatgagccactcgtttgagttatatttttaataaaaaaaaaagcatttattaattaatagataaattaaaagaaacagaagttaaaccctctggatgtctttctaaatgatgaagatgagcttggcactagtgactctgtgtagatcaaaaccatttgtaactattttttaaaggaattattagttcttttaaagtaattaaaaataagtaatcttatcttataccattttttttagaatgagaataatctacacacttgttcatgattacatcttataccatttttttttactaaatatgcagttgacatcgaaaaagaaaaatcagaatataaaataataattttcaagagatatcaatttaacatccgactttgacaattatagtcatcttggtctaaattaattcatggaaacaaattttaaagacaaaattcattgacaattatgaaagtcatggactaaaactaatgtcatagatttaatttactactagtatttataatttcaaaaattaatttggtgtattactatgcaatccacacgtgacatttattccattaggactaatttcaggataattggctgtactctgaaaaatacataccggtcctccctgcagccagagaatgattggccacggcttggagggactttccactcttcatggacttctgtaaagttatt

SEQ ID NO: 4808 - DNA, 1572 bp, Glycine max
  Soy_ogl_4253 Gm13:24824801..24826372 Cluster 20
ttcattcttacaatttaagagaaagataagaagagagataaaataatagattaacaaaagaattgtgaagatttattataagtataacattacatataagaaaagtccttttttttaagataagaaaaatacgttacctagctctcaaatgtgtgatacatgtgcttttggattcaataaatacggtgctttgaatgaactagtaccattgtgtaagaagtctgagacttttcgttagatgctatgtttagggttggtaagtaatccaaagttactgctctagatcgattccattgaagtctaggcccaagttttctgacatttgtttgcactgtgtttcttctagctaggactgcttgagctcgatcgtatcattttagccaaagaattggtttaggtttagctaggttgaaattgaaacagtgaagagtctaagtttttgccactttggtcaaagattcttgcgctttaagggaagtttggtctattttggggtgaccactttaccaactgtgccaagtgttagggtaagggaaacttgggtcaaaaaaagcagctcccaattgactgaaaaagtaaacggattgacaccattgttgtgtctagcatggaatgtggtctcaagtctcttgttcatgtgtacgggtacttgcaattatgagatgggtaaggagttacctggccccacaccatggcctagtaagctcagatttggatcctctatgaaaagcataaaagaaaatatgtataaatagtctcttttttttttttaagggatgtataaaaaagtctttaaaaataacattaactaaatacatttataacctcaatttaacattctaaattttatatatatgaaaaattatgatcaattttttctttaatatatcacttatcatatttatcatttttcttctctttcatttttttatgtctttgtatcacccaaatttactcaaaataggggtgaataatgatattttctttaggttgtgtttagtagaaatgaaaaaatagaaagagtggaaataggcagaagaagacaaaaatataagaaatagagtgaaaatagtcattgtttgatttaagcaaaaaaagtcataaataagatttaaaaaagttgtttggtttgaaaaaaaaaagggaaaagaatgagatttcataattattttaaaaattccattttacttttataaagaaaacattgtttttgcttaaaaatatttttggtacataataaatgattaaattttgtttttagtctctaataatttttttcattattgatccctaacaaattaaaaatcttatttttgttcctaaatttgttttgataacactttaaatattaaaaaaattattttggtaatgctttagggattaaaaacaaaagtttaaatttatcaacaacaaaaaaaattaattaggtaccaaaaataaagttcaatcatttatcatgaactaaacacatatttaagtttttttttttaccgttgactcatatatggccagattgtttaaacttatttattaaaaatgtttattttaataagacaagcagttttatgggtg

SEQ ID NO: 4809 - DNA, 1300 bp, Glycine max
  Soy_ogl_5752 Gm17:38136901..38138200 Cluster 20
gtgaaccacatgtgattcaaatttggtcagtgtggtgggatatattgttgcaccatcttcgtcggttagagattccgtacttcggatgaggtggtgaagcacagtacaatgatgagaggaataattttgtagtgttttcatttataaaaatagaactattttttctccccttcttttagagagtttgcacaataaggagtattattaattatgcggcaatgacggtctccggcctttatcaatttttaagaaaaataattttagcttttaacaattgcttaagaaaaagttttaaaaatatttttaaaacttttttttcaaatatatggaacacatatataacaataaaaaattatgcccctcatttaatttacacaatttcttagactttttttatctttcaacaaaccacctcactacaagtgactctaaataaaataggtttctctttatacttttatcaacatttttatattggttaatagatttaaaaatataaagtagtatgtataaagaaaaaataaattaaattaaagtaaacatacaaatcaatgtataataaaaggaagcacaatactacttatatatctgttagcaatactctcttcacacttatgaagttctatctagattttattgtgaacttaatttcttctaataaaaatttataccttagtttatcatgctgttgaaagattaacccctactagactcaaccccatttttatctagatattatatatatatatgcataaccctcaggcctcaagtgtccaatactaacatgcagagtttagattgatttggcaaaaaaaactaaactaacatgcagaaccaattgcaaaatcatactaacaactttaatttgtatacaatccatgttgaaaattggtgaaagaaaattaaatcgagaagaacacaaaagaaagagataaagcaaagatggcaactactacatacaaggctcttttagggtggtacgtagctggttgtgagtaaccatgtggtcaagggggtctctccaagacactgcaacaaaaaagaggaagaaattaaaaagttgaggtggaagataaacactggggtcgttactaatactaacgctactatggctagctactacaattctttgtggtccacaccagaattcgtcctctctttaatttctgctttaatttgttatcttagggaaagacaaaagtgatgaagattggcgatcccgaggtgagagtttccactagactgtgttaaacaaacccactttcccttttatatatacttcaaagttcaaagtacaatt

SEQ ID NO: 4810 - DNA, 1200 bp, Glycine max
  Soy_ogl_440 Gm02:7502701..7503900 Cluster 20
aattctctctctatcttttttttttattatatcacatgttacatcaatcattttttccctctatctctttcctccttccaccctatttccatatgtacacaagataacaaaatcacaaaacctaaaagttgtttattgtgcaacgatttgtgtcactcatgtggaggataacactcatgtctatcttttattgtgcatttgtgaacaccaaatcagtatttcataagtacacaaatcatcacttaaagctgctatttatagtgttaatcaaattggcctttaaatatacgtaccatatattgagttgagtttactaatacatacacacatatatatagacacacacgtctatttcaatttagtttttaaattggtgcttattctatattatgaaggaccatttggatatattaaattttttaaagaaccaaattgatgtcctaaatatttttagaagatcaatttaaaaatatttctatcataaaagttgaaaaaaagatatatcactacgtctaaaggagtgacaagaaatgtctttaacagcctatttgattttatgttagtttaaataatactcaccttaaaggtagaagctagtccatatagttttttttccaacagtttttgtacatgtctctaacttttatcgcagaatcaaacatccattatatcagcgtatttgaaaaatcatttgtgaatgacaaacataggttgagtaacaaattacaaagatgttacttttgttccaaacgtaattttggagactgagtcggattttcaaacaagcactatattgtttaaccagttcttatgttaaattggacctaaaaaattgcacttgtaagtttgagaggtatcatcatagggggaaaaacaaaaattatttgctcacaaagatataccttgcttctatgcaagattattgtgtttttaaagaactaaaaagaagtactagcttatagcttattggcgcaaacacaattttaaaaagaaataaaaaagcttgggaaatcagaaagggtggaaggagttatgggggtccatatgatatatctgagtacgacaaagggggctaggttaatgataggcatggagaaagatcttccaattatataaacaacagaaaatttattaataacccaaaggagttgaaaatgtggtgttattattattgaatgttcctttttcttagtagaagcc

SEQ ID NO: 4811 - DNA, 1400 bp, Glycine max
  Soy_ogl_5654 Gm17:12773401..127300 Cluster 20
aaaattgataaatattttatatgataaaaaaggagaaaaatcaaaaaggtggattgtgagcttctgaatgaaagttggatgtacacatatacactacggaaaaatctagacagatggagaaaacactaaaaagccattgactaattaaggttaaaaagggttggatctcaatcactcatcttaatttgtttaccaattaatttgcaatgcaatggagaatggagaaatgtcagcttaggtaggtgaggaaattatattgagtgggaggggggatttgaaatggggatacgtgccaaaataagtgaaggcatgaattatggcaatgacagagagggagggtcaagaaggcaacaaagcaacgtggaggcaaaggaaaggaaacaaattgaaaatgtatcagtgacagacacccatatgctgtgacctgtggctatgagatgggtggtcgattatattggtgggagaaaaggttgtgccttagtgagactttgttatgtagccgctagtcccccctattttctttgtaaatgttccttgagtctagccatatatttcacaacaaaattgacccctcccacacccactcacactacaccatcagaataattaaattcatgttttaattattaaaacaaaatatgcaaaaacaaaataaaatgaatgcaacccatgcatttgctttcttttgttttttttttcacccatccaacatgtcttctcacatcatgtgtagttttctttataaaaatcaagagttatacataatttttatttgatatctaattaattctcctcttatttgattgatctattttgattaaaagtgatactcctagtagaaacttcattctcaagttagagattgaattttgaactttagttaaagaatagtaagtatcaaactacaaattttggttcacatcttatgtagttgatgcatagttttctatctgatgtcaatgcagtttgacataagtgattattccagaacgaacttttacttttttcatagatatggatttgaatttctcttgtgtcactttttttcttggtgaataaccctcctcaaggagatttcctaacatctagagactagttgaatagttgtaattagatttaattgcattggcatctctaataatcttctatgtgaacctttgttggtagtttcaacatgacattgacgtcatgttccatagtattgagagtgtcttttagttttaccacttttctttggcttatggaaaaaaagttttctaggtaatttatttcaaagaaaaaaaattgttatgcctcttggtcaattttactttaattagttcatatggcaccaaaatctatcattcatctgaaacacccgggttcctgttcaattcaatcttttaattcctgccaaagta

SEQ ID NO: 4812 - DNA, 1258 bp, Glycine max
  Soy_ogl_5973 Gm18:6785343..6786600 Cluster 20
atttcactactacatctaaccactgcattcccctgctctctcttttattctttttcatgcagtcccttttaatgagtggtctgctatcataaaccttccttcatcatttatgacaatgcttcttcaattgttataattaaatgtttggaaaatataatttgtgatttgtaatgttttccctatagttatggtgcttgattaaggatttgttcatgatgtatagtttgactttcaaagttttttttattttttgacagactttcgatagtttgattaactttatacacgtacatacagacatacattatcccatataggaagttattacattggtaacgtatggagtatattataagtgtattaaaggtttaagttatattaaaaaatattaaaatgcatgtaataatatttgagaataataaactactatttttcttttatccgttagtgtattgaatatttttttttttgagtagcgctgtttgtttaaaagccctcgctgtggattccagtgtgcatattattttttttggtaagccagcaagaaaagatgattctccttacctaactatatattatttgcaatcttaagcttcgtaatgttgagtctgagatattttccaatcttaagcttcgtaaatagcaatggctataaatatagcctcaaacattcataatagtcttagtatttagatggaaatttatatattattagcaacattgtttttatcttttcctttttgtttcaatacctgcattactttatccacatacactgatccttatatgtttccaataacagtgaactttgattccatacataaaatctgaaaaccattcattattattatttatgttacgtagctaaaattagttatatgtaattaccaattgagtaacaggaatcacatggcatgatgagatatggcagaacaatcaatcacagcaaccacaaagtgtgttaaacgttgtaaggaaaaaattacttttcaaaattaaggaatattttgagaataataagtgtgttgtataagattttgataaactttcatactatagaaataaagataagattaatataaaataatataagcttatttgcatttataagatgactgttgtcgtccctgtttaagtcccaaaaataaagttgttttttccttataaacattttataacactgtttgctataaatcaaaacaacatgagggtattgatttgccctataaactaacacacacgacgcaaattaaactgc

SEQ ID NO: 4813 - DNA, 1400 bp, Glycine max
  Soy_ogl_6357 Gm19:3312801..3314200 Cluster 20
tgtagttgtgtttgtatttgtttataaagaagatgaatcaatggatatttgagtctttttactctcgtctaatttccacttccaattcaggtgcctgatttgaatcaactgttaaacttggtagattggatgaagcaggtgggtgatgttgggaatgtgttcataagtaagcacggggacttgagcgtgcaggttttaaccacgctgttcttgaccccggttctggttaaactccaacagtcttcgatcttgttatgtgtaagttcttttttgataaccttagaaattcagttgagaaaatgtcaagttgattagtgtttataacaactgctgtgataagctttttactagcatatcatattaatttcttatatgtatgaaaaagttttatattacattacgtctaatattttatgataatgaatatagttgccttagtgcaagatggattaaggtaaggtagcaaattaggctattgaaagtgtgatttttttaaagttagagtgataatgtgaaattgaaacaaactgcaatgttgggtaatttagaatttagagcaattagttaggtttggcctttgcatataccgattgttccatagtaaaggaaaatttactgacatttttttttgggtgaagttcatatgggtttcgttgtcctattggttttaattaattagctccccatttaatacatctcaattttgctccctagtaaagagtgtgtaggaaaagtttattaagagagtgttcttgacattttttgagaaaaaagtgaaattgacggtaaaacagataagtatttcttgaatctcatctgtaataatgtgtttggagttaacttcaagtacatcaaaagttcaaaacccacttttatgagttgacattgctgcggcaattcaaattggcttcttatcttgaggcactttaagaatcacttttaatttggttttaatgttcgcagcagcgtaattttaagggacgtgagaacttgtagccattgatgaaacactggtccatctatcaagttgcagcatcagaatttttttttggataaatagttaaatttgtttttaaaaatataatatgatgataaattaattcataaaaataataaatataaatttaatttttaaaagaaaatatcataaattaaccatggcattaacattaaatttataaaattattttactgttaaattataagagaaatattaacatcatcccgtcaaacacatttctttatatacacttccgctaagtggttcttctcacctcatgttttaaaaccagtacttgtctgtcggctcttcaaatttagtaactttatatttatttttttcagttttataacaaaattctctctcttttttttttctgatttggcattccctttgaaca

SEQ ID NO: 4814 - DNA, 1800 bp, Glycine max
  Soy_ogl_843 Gm03:4600201..4602000 Cluster 20
ggagagagtaccgttttggattgggattggggccaatctgaacaatgtcaatggtttcactttgtcctaaagtagattaacctaagtaacaagcaatgacattgaccaatgttaacaccaagtacaagactcttattatacatatgggaacagtagatatatactttggtctaaagtaaagttattttgtaactatatcaagacatagtattattgtccacaaaagaccttgaatcctagagttggagcatttatctcatgtaatatatacaaaaataatcactctattggaatatctattaatttgaatatcagagtgtcttttataagtattttctcatttttcatggtgtcacaaccttgtcggagagctcatagtcatccaagaatctccaatcttgatccgctcaagtgcccatccaatccaacatgaagattgataataatagaactgaagtactgaactaagatgctgttgaaatttagaatgtcctctgcataaagtagcataatagctgcaggaccaagttgatgaaaattgatgaacaaacattgaagtatcttctctgcacactgaaatagtctttgcaagtagcaactagcttgctactttgaaccacggacaccaccgcctattttatacctataaatatctatgtgcaaatttataatcattgagaatatgaggcataggtggaaactaaaatttgatgcatgtggcctcctactgcacatgtgatccacaggtgaaacaggaagtctactgcatgtggccatgaaagaaaaaaaatacattgaaagctaaagtgatgacagtatgtactgcaggtttaaatgcatgcttgaggatagtcaatggtttcaaattcacaacttatacaagcactatctggtatacacattgatttctgcatgtttaaaataaaagttagactgaatatttagttataggttcatattgtgattatagacaggatagcggaggtttatagaagggagcaatttttttggtcacaaacacattgatgcagagtatccatcagctatactgatgactaatctgtatcgccaaagaacctaactgaccacttttagtggagtttctcttctcaatcactttttttcatccactcggaccaactacaaaaaagtgcattgagagaggacacattctgtagccatgcatgccttgtgcttgtacttaccttgaacattgtatattttatgtccgatccaaaagaggtctcctatcaactgatgcagttccattttcatttttgcaaagttctatgcataaaatatgacttgaccaaagttaaccatgatttctcaaattctcagttctcatatgttagcaaacaagttcctcgatcaggactttggtaacacatttaagttgtaaattgttgaaataatccttttttaagaagcaagtgggagtataacatataagacaaagtgacaaacttatgtgcagtttcttatatccttttggtgttattttctaatcagaattagagtctcatctagtaattcgcataagaaactttgagctttcttttctattttctaccccaagaaataaatggtggaaatgggaaaaccaaaatccttaatgaagaactctgccttaagattggtaataatagagcagatctaagatgctattgaaacattggaatgtcctcttcgtagaagtagcattatatcagtaggaccatgcaagatgatgaaaattgagttataaacattgaattgaagtatattcttttgaaccgatcttttcaagtagcaactagc

SEQ ID NO: 4815 - DNA, 1100 bp, Glycine max
  Soy_ogl_2843 Gm08:41110401..41111500 Cluster 20
ctgcggaacaatgttgtttttaataaccaagagatggatgcagaatttttatgagactcaattgtggtacatgcttgattatggatattatgcaaaacaaaactaaaactaaaacatatctctttttatgattggagcacaaatccgttggagtgcttaaattgacatgccaaatagcaaaatttgtagctttttgtttatttatgtaggtagctataaaaatactgacaaagaacaagattgatattatatgatcttgttctcattgtttctatttagccatttgatgtttttaaaaattggaactgttgttttggttgatctgatttatatggggtattacttatacccaccttaatataattatatttgtctactaaaaaaatgtttggttctcaatttttcagaaaaaaaaaatatacacggtgattaccacttcttaataatgaaaaatttataaacactaataataaatttactggttgacctaaagcaaagaattaggctagctagtatgtgctggcttatgtctgagaaatgaaaaacaaaaaccttatgcttaatctgtttttttctaccaaggggtgtaacttaattgaataactagctagagtgggtgaatcgttatgaatcttttggtaattatttttattcttacatattaaataaaatttttttttttttctttctaaaggctactaattaattattatatgatatgagctttggaaggtaatcacatcaaagataatcaaagaaggaatcgaagggtcaagttcacaagcaatcctgaattccaaggtcaagaatgacatgttggttaagttaacaggttatatcatagcagtagaaagaagataaaaaaaaatgattttctgaagttgtaaattacttgtcatatttgaatggtaattttataccgtgcaatctgcaccaaaggtaacggaaaatgtacattacaaaaaaacatgggtgtgggaccgtacgaacctagataatgaatgtgtatattcgccaaagttattacagtttgtagcagctttgctttgcttctgtttctgcataagagtggagtaagtaactgagtggtgacactattg

SEQ ID NO: 4816 - DNA, 1100 bp, Glycine max
  Soy_ogl_4236 Gm13:23816001..23817100 Cluster 20
agagcatattgggccaaaggaaagtgaccccttaccttgaggcttatgaggacataaggtagatattgagacggacacaaaaggagcatgcacacggtgatggaggaacacttgtcgatgatttatgttttattgttgtatttgatattttgcattttactgttgtattttatttttgaattgttattgaatgtcatgttatgtatctatgttgattttagtatcatttctgtctatattcttacgtgcatttgtatttaattatcaagttatttctgataagtagtttaagaaattgttttaattaaactcctttaagaaaataaatgccaaatcacacaattaaagtttttcttagaaatttgtttctatatttgtatatatgcaccatatacacaacaaaaacttgttaaaaatgtaatctacactatcataaatgttaaaaattggatggaacatcgaatgtttatctttttttttaaaactatatgaataatcttatatagggtgggtttgtttaaattttaaaaaaaattaattttaaaataaacattttttaagaagtaaataagacatacttcttaaaataagtagaaaattattttttaaatagaaataatttagacaaatatactactaaaatagaaaaccgattattttattaaaataagtacttatttgtccataagcaattgaattgaaacctcggaaatgaaaattactcgggttgtcaaattatacgatgaaaaatacaactaagcccattttaaaaagagatactactataaggaaaggaaatagaaagatgttagataagatgaggacacgacagtaatatataaaagaagaaaaataaattttctataagtgtataattatttatgttttattgtatatatgtatattcacataattaagctaacaaagaggtgccgttgataatacgatttcacgtgacaagatctgttcattcatagggatcctcatgtttaggattctgtcttctcaatggcagaggatcgtatatgaattaatacttagctatgaacatggaagcttcaagcatgcatgcttccacggattctttagcagaaaacatg

SEQ ID NO: 4817 - DNA, 1343 bp, Glycine max
  Soy_ogl_462 Gm02:9960258..9961600 Cluster 20
attcaattaatcgctttttgggttgatcatttttaatttttttgagaaggcaacacttatgcagatttacttgtctctcatgctcacctcgtcagtgaattttgttggtggaatttcattccttcttttgtttctgcagagttcagtaggaataaatatgtgtcgtctaactatatattcaaatagtgtttatattatgggtttggtttgtgcctcatgctttttgtattgccttctttctgtttttgagttaataatgatagtcgcccggtaactaggttggtgccaacatagagttggatgaactaggctatcagtgtttagagtttataaaaatttaagttttaaatataattatattaaatattttgaaggaattttttattatttataataatcttatctaatttcattaagattgcttcctataaaaaaaataatatgatctctgaaaaaaaaagagaaaaaagagatccccacactttaagacgcattagggccacaaaaaatataatcacttcaatcttacaataacatgagtataaccaagccaaaagagtacaacatcgagacctacattattatgaagtaaagaaggctatttcttggagattctatatttttaaaggatggttctagaatggcatacagtctcctttcaatggcaaaacaaagcaacccattgcaagagtcttcggtctcatcatgaagctaattaagctggattatttattgaataggacaagattaagatggctctgtattcattataaaaaaatagtattttaataaaaatatatattctagacctttaatatatatagataaattataataaaatatgtggttttagtcctggaactttaactttgattcctgtggtccttaaacttcaggaaaaaaaaatagtgttttgtttctcatagcagacaattttcactgtgaggatgaacgaaaattactgttttttttttttttttgtaaaattcagagattaaattatccaaaattaaaatacaaagactaataataatatcaatttttactgaaattacaggaattaagaactattttccctaaaaaaaatgtgttactattactcctatgataaattgatgattcagtggaaaccctatgggaaaatgggttttcctttcaactcgtgaagctaatagatttgtggctatgaattgaaataaagcttgcatgagcatcaaccttgaggatatcactataaacagcacttgaactgtatttcatagatgcaattatagcagaaattaatgcagaatctggtcatgttgccctccacttgtcctggcagtgcagcaaactgacctcac

SEQ ID NO: 4818 - DNA, 1500 bp, Glycine max
  Soy_ogl_6667 Gm20:1155801..1157300 Cluster 20
aggagagtgaagtgaacacaagtattgattcattcttcataattcaaccttttgtttttatgcataaaaaaaataataaatcaatatataattacgcatatgcaaaagtgagaggggaagaaaaataacaaaagctagaaagaaaaaagaatttcgacagagatatatgtaggaaaaggggatattctgagttttgttcatcagcaccacacgtgccatcaagccatgtcgccttgtttaaatttacatgccctgattcattgaaatcgtataattttattggtaagacaacaacaatgtgtaacccttaaaagaggcacgtgcgggccatgtcctattgcaaatgaagtgttgccaaattaagaatccttgcacgctagggcacaaagtgtatcaagtcgaaccttcttcactgacacttgaaaaaattcattaaaataacctcaacaaccaaataagagaaacctctaaatgcaaaaccacgtaaacagaacaaggcattaacgtattatagcatttgataatattgccaagaaaattgcaactttgtgaaaaagtaaaaaaatatgaagatgatgaacgccccatagagaaaataaatataattttgacgtgggaggttagagaaagtaacgagttttgttgtggttttgcaaacaatacaatatgggtgaagacatgttgcagttttgttaacaatacgatagaatcatggggttatttacgtttttaaggtaaagatgtctagaaaaaagtggagaccagataaaaaatatttttcttcatctattgttatagattagatgcttttattccagctagcaaccaaaatcatcataacaaggcaaaatatcatagaaaaaaacaaaagagatatgttgcctccacacaggggcaaagctaactgttaaaacccgttatattaactaaaagattattataataaattatttttctttaaaaattatatccaatctcaaataccttgccaaataatattagcatcacattgtttctttgatttgcttaaataattcaatataattagagaacttaaaattttcaataaaactaccttatatacgtccaaattctaaatttcaaacatcaaaaaacaaagtcgaatcacgaagtgaaaattaaaagcagtaaaaaatgttagagttttataaactcgatcaactgcaaaaaaaaaaggaaattgtgaacggaaaacaagagtaaaggacaaaaaataacaaatatatcacctgaagtaagcaaaaataaaaataacagagaatagcgaaatcaacaaccacacaaaataaatcgcaagcttcacgttatctttcagtaaaaatagatattttatgcctaaatatctaacattgatggtagaaaaaaaaaaagtaatgagcacccctattatcaaaaatgaaaataaaggtaatgagcactttaattctgccatttcattagttaacttgtaacatgttatcagcctatacataatagttg

SEQ ID NO: 4819 - DNA, 1623 bp, Glycine max
  Soy_ogl_2538 Gm08:7355001..7356623 Cluster 20
ctagttttcgttttcgaaaggaaacttgaagaaacaaaggtgatattaattagtgacagggcaacagccatatatcattgttcgttatcatactagtttgtccaatggcccttgacaatggctcccatggctttgccctcaacaggatgtgcccacaaaagtccaaaacgggaaaccaattacccgccccatccgttatgagggcattaatggcgtctctctttcaattcaaccacttgaattcgcttcttcacacatttatacacgaccatttgtaggggacctcaaataaaaaaaggtcaaatacatatatatttgttactttcattcgtgttttgttgtatatcagaattttttgaataattatgtaacggataatttggcaggtaaggcctgatattgacttcttaaccaaaattattttattttgaagaagtgagtaaatgtattccttcttaaatttacttaattgtcataatttttcataacccttgaatgagaaatttattgatagactgtggccatgcaaatatatttctcatagaaaagaatagcccttctcttcttaaatttacgttcacggttttttaagcataattaattacgtactcgtagaaaagaataacccttctcttcttaaatttacattcacggtttttttaagcataattaattactcatagaaaaagaaatttaatcccatgaggttggtctaatagagaagacaagattgtgcatctcacataggtcctttatatattattaagtattctcactcattttccttaagggtgaggtaaatccaaatccgttgaattttttttctttttttaacctagaggtttttgctcccttggattgaggcatcattaatcttaatccaaaaaaatttctaaccataaaattaaaaagaaaaaaaaattatgaggtgggaagagtcgtgaatccatcactaactatgactacgatggtttcctctaacactatgtcaggaccaataataatttttacgtgagtgtgtcatagatcattataataactttattaatgatagactgtggccatgcaaaaatatttccatcaaaagaaaaataatgttgacgaataagaccatcagggactgattttaacgaacaaattagtttcatagtagaagtttacactcaatgttgatgattttgggaggttttgggtggagattttgataaaagagtataaaagtataaaaattcaaattctagatataaaaaaatgatatacaaaaagtaattggacatttcaatgtcaatcagtgtagagtaataagcatgaggtgatatgttcaaatatcagtgagaccattataaaaaaaatcatacctatacaaataatttgctaagtatatattaatttgatgcatagtgcaattaatttatcagtatttcaataattaatttggggtgagaaagggatatgtcacgcataaaacctatggcgtagctggctcatattaggtctaggttattatatgaatttatttgtaagtcaaattgagatatttttaaaggtttttctattcaaattaatcatgctaacacatttaagaattttttgaagtctatcatgcatattaaaataaatcaa

SEQ ID NO: 4820 - DNA, 1214 bp, Glycine max
  Soy_ogl_3274 Gm10:196887..198100 Cluster 20
ggccgataataacaagtcaacaattaagtccctttattaaggccctcctgtaagaccagtaaagagctgaaatagggatgccaatttgctaacagcaagaaaagtgtctattctttttgctcctggctttattatggtttgttgttgatgtcttctcaatcattgaaattcgaatgtgacattttctgttgtgaaaccaacagtaagaagagtgatgactattattgcgtatttgaatgagcacttaaaaacttaattttatatgactttgaatttacaacttttaattaaaattgaatttgaagtgaaactagttacgtatagaaacttttatctaagaaataatttttttatgaaacttaatataaaattctaactcaagtcaaaattacatattcatgcttttagtcaaatatacctttaggcggtgtttgattaaaaagagagaaaagaaataaaaaagatattgtgtggatcacacccaaatctcacgtattcaatattctgttttaattataaaaaaaatcatcttctattcttatacttttaaccaaacataacatgaggaaaaagttattatattcgtaaattcgaacaatcaaacattatttttttctctcactagatcacgttccctgcatccaaacttgattttcaagtcctccaccatttacaaattacaaacatatcatgttcgacaactctaatgacagcattacagatagaaaacacaggactttggagcaacatatacaactagcatgtctacaacatgctagctatatgtttcaaaagtcaaaacacagtaacgaacattcattcagcaagttcctgtgttcctttcaaattaatttggagtggggttatgcaaacgtgtagtgttatatatacgtggagttttggaccctatagtacctgttgcatgtcattagtatgtagttatcgtttagctaccgttctaaagggtgtacgtacgtagttctatttgacaaatcaaattatcaaagaatgttagaacaatagatacttctagtaaaaattcaaatcttgattcttcatattgtaagtgattagtctattatgctaaattcaacctctttcagtaaatataaatcatttaattatacgatcaagattaaaatttaattttattcacatattcatgtcacattttattatttataaatcataaaattatataacaatatttcttt

SEQ ID NO: 4821 - DNA, 1800 bp, Glycine max
  Soy_ogl_3816 Gm11:10073601..10075400 Cluster 20
aacaacaacactaaagaacctgcttgtcgaaaatcctaaagctcaaacaaagtgaaccctacagttgtgttgtgcaataagcttcgataatgcacgactccgcatgtatgagatgacgacatctatttgacgggtgttctcccatttaatcgtttttgcctttttcaagagtgatgtaaatgttgccttttgctagattcagaaaaaaggtccaaaaaccattatatatactggttgcaaataataattttgatttcggccacattttactcagcattttggaaaaccaatagtaaagtcttttttctcctatcaaaaatgcaaaataataatatttttatatcaaacaagtgaagtgtaaatgatcaaagtgctatagtaattttataaaatgtcaaattattttataatatgaaccaatcaataagtattttaggtatgaattttatacaacacgatgagtaaaaaatgatttatacaacacttttttcaatttctttctttgttttttcaaattttttttcttaaaaatgaagtcattattcaacctatagtatttacattttcttttttattctaaataatgtaaacttgttattatgtagattattgaaattaattagacttaagtatatgatgatatatttgatttgaactttcgtgggtgtattttaaatattcagaacccacaaagttatatattatttttagataaaacaaagtaagcaaatttatggatcggaagaaccttttatattttggaatcaagtattattgaatagcttctactagtatatttgaaggaatcgctatcattatgtgtatgttttactagtatgaaacaattgagtgcatttctttctctattttccccttcgagatgaaatccacaaaacgaagtcgtacttaatttctacaagaactcaaaagagagcaagcagcgtggacatgcataaaaatataccagtagttgcattgaagaccatcatattatacatgcattgcatattcctcttcaatgggtgaccagttctgagaagctcgcatatatagcattgatgactaaaaaaattaataatttcttattatgtacaagtattttatattctaaaacaatgatgattaaaatcacgactctgcacttaattcattcccgcatttaaaaaaaaaaaaaacaagttcctataaaatcatctctaactactctgtattccgaatcccaggaacacacatacatgcagaagcggtgcttgcttatatgcagagaattttactttatttaattttcttgtctccttcgttatcctcagtactggtgctttagaaacaaacctaaacctaggtacagcaagctatgagggttagggttaaaattaagatcatattgaggaggggctcacaccaaacataacacatcaaccttttcgagtgtttcatttcgaggcgacacgagcactttcccggcatttcctcccatctcttggaaattctcaaaattttctctggatcctcgtgagctccgttgtccacaaatgccctccaacccttcatgcaattaccctcgtgtcctcctttaaaccatcaaaacttattactgtggtttttctcccctcacaaatgaattagtctaattcaacttgattagatagagtctactaaatacaatatataagagtataactttataaacaaataaatttttttactatatgtattattggtgataagatgatggcataaaaatattttgtgacatacacatatatatatatattgaacagcatataattatgactttta

SEQ ID NO: 4822 - DNA, 1200 bp, Glycine max
  Soy_ogl_3016 Gm09:5601001..5602200 Cluster 20
caactatctaattttaagcaacttaaaatctatgtcacatgctaaaataatattttttttataaacaacccatccagcaacttccattgtagatgttgcaagacttagaagaaataaaatataatgataaatgataatattacaagttaattatcctatcttatttccttttccgctcatcaactaagcaaaaaagaaaattatgatcacaagctttttttggtggtggaaggataacccttttctgggtatgatcgcctctctttttggaacataaaaaattgaatgccacttttctaaatttccgtctttctttgaccgttattacatatatcctttaatctgcttctgatattcatagttttgcttcgctttactacaaatgctaaattaattagtaaaacataatggaaaaacgtacgagttttgagagccactagtgctactacacctttatgaaaggaagaatgctgcatttcaagcacgaggatatctcaagcatagaagcaccaaatataatcgcaatgttattagccattattaaattcatggctttaaagaataacaaatattttctgttaaaaaaagttatagtacttaaaaagcataggtcacattaaattaatagtattacttttctagaataattctacttaattatttaaccattatcttaatcatgcataatggttgttaaaatgacctatgctagaattgtgatattataataagtggaggttttagaaaccacattctccgaggagaagaatgatatgtgagtgagtacgtaaatcagagtggagaagtgtaattggaaaagcaaaagagtgaatgagagagggagagagagtgcatctcatacagaatagtgtgtgtttctggggacattttattgtataaagtagcacgctaggtcttcttttcacctccccgaaaatctttctctctatacattccaactttttgagtgaggtgtgactgggaaattggtgagttattggtgagttgttgttgtgtggagaatagagatgtgagtgaatatgatcgagaatagaatcaaaggctctttgcaaaactcttgtgggttccattgcccgtgggacccatccgacattccctcttgtttcttttttctttttaattttttttctcacattcccactattcagaaaggtggaggtcatgttataacttatgaat

SEQ ID NO: 4823 - DNA, 1900 bp, Glycine max
  Soy_ogl_2037 Gm06:38802201..38804100 Cluster 20
cactgaaaatttaggaaaatacttgggtgttcccgtatttcataaaaggaccacaaaacaggattttgatttcctcttggagaaggtaaacaagcagttaagtggcaggaaatgtaatatgttgtttattgagggtcgtgccactctcaccaaatctgtgttgcaaacgattctcagttatattatgcaatcagttatcctgcctagctttgtttgtgatgagatagacaaaaacaatagagcctttggagtgagctatgcaccttgaagaaagcaagggggtctgggttaaggtctactcgagctacgaataaagcatttatgatgaaggcagggtcaaggccgagcacccgtaaggattcctggtgggctcaagtggctcgccataaatataaatgtggtatgaacaatcccctagttatctctcagaagaagaattcctcgaacttctagaagggtgttaccaaaagttaggataaggtggaggccaattcggtgtggtgtattggtaatgacatttttgttaaattttggtaggatgcgtggatcccagattatcaacttcaaaaagaagttgccttatgttccttgtccaattaggagttgcaagctaaagtggcagattgcatcaatattaatgggcattgggatatggatagattaagaagggtcctcccaaatgatgcatgcgaaaaaatttgagctataatccccctaggctcacagggagtaaggatgttaaagcatagaagggaaacctaaagggggaatttaccctctcctctatgtataattgcatttctagtggccttgtaattagtgacccctttttcaccgccatttggaagtggaaggttcgtaatgagctagacttcacctttggaaggtccccaatgtgcaaacaatagtgaaattgttattcatctctgtagggattgccccgtcgcttagagtgtatgggtcaaagcatcaagtaactctctcctggattcattcttccagtctgacttaaggactttctttgctgttgggaaacttggttgataatttggttatgagttatagccattggcccctagcttttggtatcacttttactacttgtggaaattccgcaatgaagctgtaattaatattaagcatcacacttatgacaatatttcaattgttatttttgtgttaacccaccaatctcgttcaggaatgcgtgatgaaatgtcccttactagtagagctaagggggggtgactgagggcgagtttgatttcgtggacgcctccaaggctaatagctaaaaactgaattatgatggagtagttgctagcagtagctagcagtggtttagcgtcttgcggtgatgttttaagaaaccatttgggagttgtttgtctatcattttcgtacaatttgggtatctgttctatcgtgcaggccaaattatgggcgatcctccttggaatcatgattgttgggtcaaggggttttagaagtcttcaggtgaaatctaattctattatcgtcgtcaacttaattagaggtgtttgtcctaaaacacattttccccagcctttagtggaagctatacgggagctggtgggaatggatggggtgatcttatggtcttacatctataaagaagcaaaccaagttgcagatgcacttgctaagcatgaactgtccattcatgaagaaggctatatttgtaatgttttactgtcttttttgcattgccttgttatggcaaatttgtctagtattttatttcctcgtggttattaatgaaactatcttccttcgaggatttttttacccaattataccttttgatactgttatcattcaccgtgtgaattcgggcctctcaaccccaaattcatatctttttttgttttactttttg

SEQ ID NO: 4824 - DNA, 1300 bp, Glycine max
  Soy_ogl_2043 Gm06:40857801..40859100 Cluster 20
tagttttatgttatgttattgtaggaactcgatttatggagcttacatgcttcttattaattcatagtacatttcacttatgtgtaatgtgaatttgggttttatcgtataacctagttgtctgacaaatttcacttgtcattgtgttccaaattactcttttttttccaaatccaagccagtgactaggtcagatacgttgtcggtggagaaggaagattgatgtcaagtgcatcttctgcacgtgccaacacacatgggatctccaatccgccttctgcctcaaacgtggctttggagagtatcatctatgtaggttctttaaaaaatttataagatacaggccaatccttagaatttaatttttaatttccccttgttaagtagtaattttctcccattgatttgaagacactttgtgaatccattctgaaattacagttttctccaacatattgaagaacactcagattcacttacttgctgatttatgaataggaaattgtcccacaagttcaagtggttatttatgtgtacactttactgcatacttttttccttcctgtttggactactttgccgtaaccactttataatttttgaactgcataaaatttttttccttcctgtttggcctactgtatacttatctgagaattcattttaaaaaagataagaaaaattcagatcatttgatagtgtcacaaaaatattataatttctgatgaaataatttctaatggaacatggaaggatatttgcatagtttgcatattcactttcttattttatgatttgaattatgtattctgattcttctcttattttatcgactcctaaactttccctttgaaataacccatggaaaaatagtagcaaattttgttcaattgttttaggagtctagcaagcctgtgctgagcagtcctttcatatttttagattctagcatgctaacataataaaaatttgccaataattaatgtcaagaagagcaagctttggctaggacttatactgtgtgctcgagagttttcattcttgagtcttaagtccttgatttggatgcttgagtatgttatcacaactcaatttaacccctctgcatcaccttaaccacatcattgttggtatagcatgataaaatgggacaatttttttccttttaacatatattttaccatagttttaactaattcctacatgaaatatagttgaatgttattttttcgtcaattaaaaacttgattatatgtagtaatagtctgattataaggaacaatctataatgccttttggt

SEQ ID NO: 4825 - DNA, 1500 bp, Glycine max
  Soy_ogl_2347 Gm07:15628101..15629600 Cluster 20
tgacaagtgacaaccaaccatttccgtgaaaaacttcaagttgtctccaatcccccttggatatgtaatattagtaataaaaataattttaacttaattttgcatctctatattttagatactttatgttatgttgttttaattgattctaaaattaaatagaaatataccattcttattaatgaattttaaaacacaaccacaattcataaaattctttttttactgcacaaatcataaagttctagactttttaaatctcatttttgcttgttctttttcttaattacacatgatccatttttattatttttattcttaaactaagcactcgttctttatcagtattttatttcttctcccatatttctctgtcttttactaaaaactcgattaattgatgtgtatccattcttttatgcaaagttatgtctgctgtgcgctctttccgttcttatagtaaagatctagagataaaacttcaagaacctgtaaataaaaggaactactttaacgccatcttaaaatgtttgtgatccctattaactctttggtgctgctaactatactaaggcgtactctttgttgttaaatagtggatgaataattctattaatttttacttactctcctacttatccaataataagaagaattaaatacttaacatatatttttaggatattaacatatttactttttatccaatgttttcttatattacattaaaattattagtaagagaatatactggatacatcatagtgaattgaggcaaattgaaacctacattatggtgtttggacttttgcagatcaacaagtgcaaattgtctttcatatcatggatagagaggtccacaagattttgctctcatatcagcagatagctatggagacaaaatctaatacgggggattaattaatgcatctttggcttaatagcgaatcaaacaagggtggagtccaatttttgacttaaagggaagccaaatgctaagaacaaaaaaatgatttaatattaaaaaaaaaaatttcacattcataacatatgtaagaattttaatatataatcatagtattttctcttataaataaattaaatatataactatatgctgactacaaggggtagcatatgaatacgatgtgagaagggaaatattaaataaatacaattttaatttttaatagcatgagggaactgtaaaatatctttatatattgcataataatttaaataaacctaaaaagtttaggggtgaccataacatcactcagtcaaacctctgattccgcaaataaagaacatatttagactagtcacaagcacaccacgtgcattgtgcatggtgaatctcagtatttgtcgagaccaaccttctaaatgcacctttcaatgcttgttttgactacgcaaatctcgtgagaactatggaattgttaaatacattctgttttttctgttcctgcatttatgatcacttccctagcctccact

SEQ ID NO: 4826 - DNA, 1442 bp, Glycine max
  Soy_ogl_2359 Gm07:17621001..17622442 Cluster 20
cgttatatgaattctcctatgctctgcccaaaaaaccacaatggctttggagattgtggcttgtggggtggctccaccgtcgccaccaccggttcaatttgccttttggatacacctacttgtcatacaattaatatatatcttctcaatttgcaaataacgagattccttggttgtataattttattatatcttctctttaaaactaggtgtttttaatcaaagggggggggggggggggctagtttgaaacttcagtgcatataaccatttcatcaataagctcgtatttttatgtattatgaaattaatattttagagcagtgttatatataattttagaatgagttttttttttatcagcatagaatgagtttgtattaatacgagtgtgtaaatcaattaatacgaattgaaattattttaaaataataaataatcttaaatttaaattatagaaaggttaggttaaatatgaaaaacctttctacccataatagttgctgtcttttttttttttcttaaaacaaaatcatttaaaattaaggagccgtcatttaaaattgagaggttacaacaaaaccttaaccttctcatatcttgaatgatcaccactcaccaggcaaattgatgagtaatctcatgccctcataaggaataaaaggtgtgatttcaacaatataaagaggacaaattgtattgctagtgtgtaaaagtttttaccctatcaaccactcaataataatattaatctatatctttagtataattaagagaaatagttataattttctgaataaaatatggtaatataattaacacaaaccttaaagaatgccggtttaagtgtccctgtaaaaaattctaaaagcaaagcacgaaattatagcaaatctaagtaactcttgaaagtatatgtgataccttaataatcatcactgaaaacgtctttcctaatctcaactctactgtcaaaatgcaaagactccttccaatgcccaaacttccatgattggaagtttagacaaggttttgaagatgcaacatactatttataatcaatcatatacctacaggctacatatacctaaatagttggttaatgttaattttagaagttaagacttaagaggcggaggcgcggcgcccagttcaattctggtgttgatatagcgagggtatttctattaaaaaataaataaactaacatctaacctaacctcgataaccaaattttactagtttctgaaattgtctaatttttagtgtgtttgcataacactgagaaacaattccactccttaaaatcatggttgtgccattaaaaagtagaaataattatttattgttttaccttcattatgaaataataattgattatttttcaccgtgaaccttatgtcttccatatcaattacaagtttgatttattttttaacagt

SEQ ID NO: 4827 - DNA, 1529 bp, Glycine max
  Soy_ogl_4752 Gm14:34215872..34217400 Cluster 20
gggccacttctatatcagttgtggctttgtatctattgatattgccatcagaattaataatgatcaagcaaaaaagagaaaagatgttatttcataaacattgacgtaaagattgatctactaacccgtgtgcttaaggaccatatacactacattggttaaaagcaaatgttgcatagtggttaaaacttgcttcttgtagcctaaaccagtttagcatcttgttctcaaattactggtttcataactatgctactggcttgtgtagcatagtggttaaaacttgcttcttatagcctaaaccagtttaagcatcctattttaaaattactggtttcaattttctacacaagctatatacaaaaattcttaggatcacttcacaaacataaatatgcataaaaagaaatcattggaactatcttaacttttagaccaaaatactgacattgtgttggattaaaagaacgggctgataaaagaatcctaactaaactgggaaagaagagcataagaaaacaaatgaaacggcactcaaaccaaataatgataaagttatcattaaaaaatacgcacaaagggagagaggggtaaggaagtgagattctagtaagacaatttgcctctacaccaaagcaaaccaagtaggcaagtatcataatttacatatcaataccatagaactaacataatagtctccagtaaaaaatgtttaaccatttagggtaacaatggtctgtgaaagagatagaacgaccaatattaatataaactccaataataggcgtgaactcttaaattttataagtccaagcagcacttaaatatgagggactgaattaataatcatcaagcaaaaaagaaaaaataaatgagaaaaaagagagcgtgagggagaaaaatacaaaaaaggcaactaagtcatcaagtggaatcaaataaaacaacatggtgcaaggaagttgccctgaagcacaaattaccagtctaagttgccctgaagcacaagcataacgcatgtgctgccctgttagatcctttgtctgcagcaccacatatggattcattttgtcgtggacccattcttcaattactggttgctaagattaacaaaatcagtgatatagaagtggaatctagccctatgaagccagaaagatcgcggaaatcaaatttcagtgaaggaagcagcagcttcaagggcttgtcggccatgggctcattttgaaggattgtcggccgcaattcagggaaaattacaaatgaaaagcaatgataacaagaagcatgacatgaggacatttagtcaatgactttgcaatttctttaggatgttttatcaaggaatctatggaaactgaagattttctcattagtgtcaaagtagtaagacaatgtatgttcaagtttgttttcaatcgtgtgatccatacccaaaatatgaaacactaagttggatcatcatttgtgagaaagtgtggaatgcaaatatgaaacacaatagcaagtacatagaaaacactaagaga

SEQ ID NO: 4828 - DNA, 1182 bp, Glycine max
  Soy_ogl_5669 Gm17:13219419..13220600 Cluster 20
cacacacactatactttcaattttcttttttctcaaacagatagatatggcaatggattcaattcatgggtgactcaaagtttatgcagagttctattctatatgcttgcacagaaactagaattttaaattgtggttcaattcgtaattgtaattacaaaaatgctaattggtacggagtgttgctttcataaaagacatacgaacgaggttgattggttatttttcaaatttactttgctttatattccgtctaatacaactatttacatgctattggttttaaaaaatagacgggaagtgtattgtttcgtacaattagtacaaggaagacttcatagttgtattacacggaatatatagttgtttatacgaaataatagtcgtttttagtttttatagttatactttttttgtgtgtgcaatactcataatactatgattttaggattctcctgattacacaattacaattacaactcaatcaaatcatatataattttcttacaatattatcatttagaaaaatccataactgggagtacaatcgcaatttaaaactgagtgcagtaaaaaatcatcatcgattaaaagaagttaattattttttttaaagaaattacatgtataattaaaaagaaaaaatcgcccaggaacacgtaactttgtccctgagaacataaaaaaggctagtcatccccaactacccataatcattccaatattccacaaacaaactgatagtggttagagtagaaattatatatgttccatagttgagattaaaccaactaagggtatgtttgattttcaggttggaggataaaaaaatatgtttgataggaaaattaatttgagattatatttgatttttttttttaaatatatttgagagtaaaattttatcatcaaaagacttatgatatttttacaagcctaatttacaaacttaaatctgtaaactttaatctaaacatatgttaacgagttctgattaaagccaggattttaattagtttgcccttttttgctccttggctgataagtatgcaagatattccactaaatattgtccaacattttgcttgagcaaacagtgttaaatggcccccactaaaaagagttgagagggagtttggttaaagcatttacatagttacatgtgaattgagaaaaaaaaga

SEQ ID NO: 4829 - DNA, 1900 bp, Glycine max
  Soy_ogl_6009 Gm18:9462901..9464800 Cluster 20
tgaataaggagagaaactaactccgtataacttctttgccttttataatgtttccttcctcattttaattttaataaaatttcctctgcttgtggtttctcttgtaggcttccattcattctatgcaccaaaatcatggtaacaaaattaaataaaacaaaggatcaatttatagatatgatttccaattccaggatcttgatcattttattcttttattttctgtggttatactcaagttatgaaatgtatattgatcttcaatctttgcctatcccttaatgactaattctgcaaatgcttttactctattatgcccaattaccatttactataacgttaccattttcttccattattttaaacaaaaaggacccgttcaattttcaaacttaattttgtttaattcggaaccacttattttggtggggaaaaaatagaacgaatgctgaccctttttgtgtaaaattcacattgaattaaacatgtaaattgtcagtggaattaaaatttccacagaaggtgaaaagtgattctggaaaaaaaaaaagataaaaagaaacttgaaattaaagcattattagtaactttacttaccaggaaaatagtacggtaaagaacaagaatgcaatgatacaacaaatttacatttttagtatgagtacaaacatacaaaagaattgcagttccacgaaccaattaagtgttggatgatcactgcatgaaaaattgaacaaaaaaaaaataaccagatcactgcatgaatttaatatacaatgaatttctagaaatactaactttttataaagtgaatatggggatgtcttttgatctaagtagaacctgaggccacacaaattgttggcagtttgatcttatgtgaagtgaagtctctgatgtcaaattgatcaactgctaatcatactaacaacagctgaattaattatgctcctgatatgttgctccaaactctcctctccacgctcgattaagtgatcatcatcccaaataaataaattttacgttgctatagatgttttcagctaaatacgatgcattgaatagggaacctctttatgagatagaattgtacctctgcaacagctgcttcaagctcagcttctgttagtttaacaagtagttttttcctgaattctgaacagcttcagctgtatctcaaagttgaatctcaagctctagttctcccttttccataattttgattccccttttctttcaaccctcaacacagaaagctcagcagaaagagatttggcaacgcaggcatgatcttttttgaggcttttgctgttgccttcttcacctcttttcactatagcatcatgcttagcaaccaagtcatcatatttttctagtagatcagtgtagtgttctacaattctagaatgtcccacaactgctctctagatctttagtgcatcattcatctctattgtgcatttcttctataacttagttccatctccaacctctctatctctttggactaactcttcagggacttctttaatttcacaatcttcctctataatacatcatacatggtaaataaccatttcaggaaattcccctcagaatcaaaacatacatttggaatttatccatcactccattaggatttcctgctttttcagttgtttcaaaccaggatttcaagctatcttggacctcagtggaatcatgagtagatattttggtcaggcaagatgcacaatggacttcatcactggaaggtttctgttgtattgttttatttttctcatcagattcagcattttcaatatctcgacatggtgtcaaagttaagcgagcgaaggggaaggaagttgaagatatgttcaatgctgagttctgctggtgatagtcaagaatctgcaat

SEQ ID NO: 4830 - DNA, 1608 bp, Glycine max
  Soy_ogl_6721 Gm20:31629893..31631500 Cluster 20
ggaagatttagaactatttccaccgatacacagactttaacaaaggtaaaggacaggtagctgaaattttgaaggaataaggatgcaactcgatatagggagttatgggtatcccatctcgtgaccctctttttacttctctttatatcaacaaagaggtggatttgaattggagttaccttctcttttgggatgctcacctatacttgaaatttccaacccaaaaacatggaaatgtagatgtgaaagagttttaatttgattttgctcaattggatcaggaatcaacactatcataaaagtcagaaactaggaaattttaggaactacttaaatatatgtcttacgaggaaatgatgagaaaatttcgatagggttaagcttgtggttcacggacataacagctttgacttttgtgccaaatttgaaattattgaacgagtcatactctgatattagcaatttgtaaagtgaatatgaaatactagtatataggtatagaccaattagttgtctttcatctttttgaggaagttacgtaaatactaataatttgtatattaacactttctaagtattttgtgtataatttttcccctaaaagcaagatatctcataattaaaaatcataagattaatctggggacataaagatcacaaaatgaattttatttattttaataaaatcttctctatatctacattcagaaaatcaaatcattgtcagcatgtttaaataatccaacaatttgttattggttgttttatgcgtataattttaagcatgaaaatttaatgcaatactagtagagcttccccaaaatcccaggaataggaacggataaggaacttggaaaaagtaggttgacaatataaatcattagggtcaaaaaggaagaaattaggacacccactatggaaaatttgacttcactctcctccatgcattagtgctgccttcttgatccttccaatcctactaaacaaacaaaccattgacgttggattggatccgacgcgacttttggtccaaataatgcacgtcaatttggggatgatgacggagatttgggaaacgaacttcattgtaatttgtatgtagttggtcatacatttattaataagcagaagacttgtactgagattttttttagatgagtaataattttagtgtttgggactatgtttaatgattaattcattattatgaattatgctaaatttataatttgcacttcataaatttgtaaattcttatgaactatttatgcagaaaaatatgaattcataaactgacaaaaggttagtgtagaaaaaaattgtgtctattttttaaaaaatgacgttccagaacaagttaattaaatatttgggtatttctattctccatcaaagcgataatggcttttgattggagtattcgtttggtccatactttttagagaaggcaacgaagttgctgacttttcggcaaaatagggggtcatgcaagatgaagctatgagcattttggagggtgttggttcatctaatcgttttggtccttataaacttttgttttccttcaaaatagtagttgtagaatttatttttttggtttgatctttg

SEQ ID NO: 4831 - DNA, 1144 bp, Glycine max
  Soy_ogl_298 Gm01:52765857..52767000 Cluster 20
tctaaaattcataatttctgaaatttcatattttttatgtatgaaaaaatattttcctattaaacatcccataaggtcataaatggagttgtcactcgtcatccctaaacacatcattttaaaaatgttgtgtcaagctttgtccatttttttattgtcttcaattattatctgtcttgtgtcttgtgttagaggagtgaatacctacacaaagacattatgatattaagtcaaataacacccaatataataaaaatgaaagaacaattattttacgttgagagtcttatcctttatatacattgaaccttaagctgaatgccttatcttattagtaattcttcattatctgacaataatattaccttaatataagattatgcttttaatgatgtgactatcaaccgtggtagagacctaacagttctcaattgtgcgagtactgttagcttatatagtttcttgaggttttaggccgggggaagtaaatagtaaatatataaagtataaatagtgccaaatgtatcataggcaacatggattaaaaagcgtaggtagtgagctaacaaaaaaaatcttccaacaaaagaaattcactttctcgggaaaagttaaatacttagattgtcctaaccgcgttagttactgacatatttacaaacttttaactgctccttacagaacgatatacatattaaagatatagcataaaattattcatgtatttgtacttaataatttaagatcttcagatatatagttaatttatgacatataaaagcctctgattaaatagtctaaaattttgagctttctgtattatccatcctttaaaccccaaatcacaagctacgcaatataagctatcttgggaagatagataaagcacgatcgagctaacatcaaacccacatccacaatccactatggaacgtgagcacaatataaacaattgccgtttggtaaacttccatcatagatgatatatatgctgaaaaacaagtgaatgtgtgatcaattgatcactacatttgcaagattacaactgagaaaaagccttctgcaattgtcatcattttggacttggtggagaaaagaataaaacaaaaagcacttatgaaagcttaagttgcggtcgacattt

SEQ ID NO: 4832 - DNA, 1600 bp, Glycine max
  Soy_ogl_542 Gm02:14216201..14217800 Cluster 20
tgacctcaactctatcatcttaggaagtctgtgagtaaatatggggactgtaacaagtcctaaactatttctcaaaattcttattttacatgattcatttgttattgtacctctttatgtcacaaagtgaatgatttttttttagagaagacaaagtgaatgtttatgaagctatttacttgaaatatattttttaagggacatgataatatgttttgttataaatacaaaagcataatctgttacggtatggtgatttagaaaattgaggttattaaattatggattttggaaactctatggtttggatattattgcttcattgttaaatcattagtttgatttgagatgggaaaatgatagagaagttagtggggatgtttttctatgaaaacaaattgtgaatttaaattttgaatgttttgggaaaatagtttctgagaatactacagctaacaagattaggtgttaattttggtgcactatgacttatctttagtcaaggagcctatcattggttttttacttacaagcggggagcttgacgttgatgttgttattactagtcgggggatcctatatttaagatatattttcaggtagggagcctgacatttgacatttatattattagtcgaggagccaatcttagagatatatttaaaggcagggagcttattatagttctatttgaaccattatacttcgatttcatataacaagtgttgtgaatttgatgagattttttacatttaagattgtcttatgtgtagtgttgtcatatcctgcttgttaccttcttaactatctattcagtgagtgatgactcatattgtctctcttaatctatttcagataatccttaggtttgtgtagaacccaacacctcttactagtgactcatattttgggtgagccgtttttgtattgaagggccaattgggtcattcaaagtatgttgtaagttgtcattttttggactatacaatgataccttgtagttactctattacattgtcattcaaacttaaagtagtgatatatatgtaaatctgtttagcctataaggtcatgtgttagttgatattgtattgcggtaattatacaggttttagggatgtctatttttaggaaaaattctcccgaaatttcaataggaatccattatgtagggtttataaattagtattaaattactattttagttggagctgatgatagttaaggtttgttggactagatcgagtagtagtctgtgcgctagtcaccattggagttggatcatgataaaaaccaacagtacatatgttataaaatgtcaaaacaaacatttataattacagaacttttcagagccacaagccgtttagttggctgcttgtgcaaaaattgctatctctagctcgtcttgctacaaacctaggtggcaactcttttcttcctttgctttatttcattcttctcctcaacaccctcactctattttatcctgcaatgttctcaccaacgacgatttccatcaagtacagcatgcaactctatgtgacaagtatcaattttttgatagggttgttacatgaagatctcatgattggtctct

SEQ ID NO: 4833 - DNA, 1428 bp, Glycine max
  Soy_ogl_1888 Gm06:10216801..10218228 Cluster 20
tggctagaatataatcttgacattcttgaaagagcatgagtgacacacgattaccttgcctcctaataaaacacaccacaacagttttgagattcatggagattctcttgacagtttttcataatttcaccctgctgtgatatttggagagatacacataaagccattaccactccgttgcaatcaattaagctcgacaattacatgctgcatatttaaatgatgaaaccaagaagtgcttcagatattttgctagcaagagttgtccagtatcatctctaatgcacataccatcatatccgaacaggcactgatcaggaaatattgctacgtctacattgcatttgagaatgtcaacgtgtggtttagtccatcataatttaaacataaaataagggattgtttaacttactccattacatgacacaagaatttaaatcattatttaacataaattatatattaattagcttagtttacgttaattatttaaaatatgagatgagagattgaaataattgtacgaggatctagattaatttgattatcatcgccatcattaagaaaaaaactgtttagacaaaaaaatttgtcaataatttctttgttagtgcttggcatccattacaaaaagttgtgtttggattgtcagtaataccatttgtttgcgcccaacctcactttagaggaagcttcatcttccttgcttctgcctcgaatagcatgcttcagcaaatccactggagatccaaacacgtgcttagacggttaagaagtgacattcaagttttgaggagcctaggttaattgaacgttattcgaggttgactcaacagggagcagggagctatgggtctactctccgtgaagaaaatcaaacaacaggtgtagaacatttcatgttattcaatactagtactaatgaaaaaaaaaagcgagaaaaatgataagggttcatggaatatttgtaaaatactgctagtctagtaattatgtatcattattcttattttaaagtcacatataattgattctaattttaaattaataaataacatatataatttaatctcaattataaattttatattaaatcacatgcaatcgtataaacactcagacactcaatataaagagaattttttttaatgagaatcatatgaaaaaacatttaaaaatcatacaaaaaagcatttttatgcattctaatattttcccctttttttcttaacacgagggaactagttaagcatataaaagaaaattaaccattaactcatataaatgtagatccatgtttcttataattagaagggaaaaaaaaaactgtaccgtttcttatacaaaagattggaggaagtaattatcttgttaacaactaagaaaaaccgtgggagagagaaagagaaaagagtttaaataaaaaaa

SEQ ID NO: 4834 - DNA, 1400 bp, Glycine max
  Soy_ogl_3902 Gm11:35466301..35467700 Cluster 20
aatctgcaggtagagtgggttatatatataggctggctattatatatgtaaaataaagaaaaagatgtttagaatctgagcctaaatttctattctatatatgtgtgtagtgtgtgttcaaacatgccataggtcacatagcctataagactcccgagaagttatcttctctgggaggtttgttaaatattaaacagagttgtcaaagtctggatagaagaattcataccaggcataacttgaagcagttgttgttgtgaatcatgactgaaattaagggtaccacggccaagcgttggaattggaaattaacctagttagaatcagaaaacttcacatatatagatattcttgcacctgatcatgtatatgaatcagccatctcagctatattaattatcattgaccagtcctcgtgagacgtatatatatacctttccaacagaattgtttagctagaaattaataaacaacaggcaaattaatcaagattccagcaaattaatcatcacctcgctcgcaagcaacaaaatggttgactattattacccgaaagctagcaatagcacaaaaccaaataatgaatacataatccatcgacccttttcactcaatcgatctcatcggtgactacatgtggcaacaagccaattccatatagaggtttgctgctgtaggtttatgcaccttgtctatatctaccctcttgtgtgaaacagctgctactttcctagctaccatcttagttccaacgagggatccttcatctcagctatatatatctagtgttgatctatgcatgcaccttgtatgtaatagcatgttcctctagctaggatgaattatatatgatattcattactccgctgtgacatatatatatatagagagagagagaggtaaacatattataactactatttaattcatatgtaaaatctatgattatattatatatctaaaatttcatgtcttcattagaacaatattatagggttgcatttttcaaatttactttggttaaaagatattggagctgtcatcatataagaaaatttgatgtctactctcttttttaaaggacagagtaatttatgtttttcattcaactaattaagttatatctatataatatgagattcggttatctatcaattatatataattagaagaaaaaaatttgttagaaattatttcatttgacttgttttaatttttgaaatccaacttataaacactttttttattggaaatattagttattaatttatattgtttatacacttagttcttttttgttactttaaacacacatcttcatgcatctttattttattgctgttgtaaaatgtcgcaaccagactttagttacaaaaaggaaatacaaaggagaggagatt

SEQ ID NO: 4835 - DNA, 1407 bp, Glycine max
  Soy_ogl_4232 Gm13:23740801..23742207 Cluster 20
ccacaattttattgattttttcttctgctagattctgatagtgaaattattaaacgaaagaaagaaaatacatttatcatttttctattcgataacaaaaagagagacaaaataaaataataatttacaaatataaaaaattaattagtaaatctgaaacatatataaaagaacaaaaagagagacaaaataaaagaacaatttatcatttttatcaatttgcatggtattgtcatctttctatcccttcactcatgtgtgttcagtgtcaccgaaagttataatacatggattaaataacatgaatctcaacaaaaagaattatttaaaaaacattcgaatttgttaagaggaagattttagtatctgcaaaagaattgaataaaagaggactagtggagaatgaaacaacaacatattataaaaagacacagcatacaatagagttgggaagaaggataaaaaagaagagaaaaaagaagtataaagttgggtgagatagagcatatggtatgaatttttgtttgcaatctaaatttagaagaaaaatgaagaaagagtacaaaaagaaaccattacactagaatttaattgttttaattatgaaatcgatttaattgatattgatatacttataagttaatttaattgtgacattgattttagcaaaaatattctaaattatttgaaaaaagaagacaattattaaaaatttgattggtatcaatcaattataaatatcaatagaaatattatcatttcaaaaccaaattattataatttaaaaaccaaattaatgacaggtcaattactataattttatatatttatttacctgattttaggaaggttgtgcaagagtgttggcaacaaacctatgtggaggggtggaggattttctctttcaaggagaaaatcaaatgccttaagataaagtagaaagcatggagtaaggaggggtttggggaagctgtctctctgattgatagggtggtggttgagaagggaaaaattgatgagaaattttgtgaggagagttacataattctgaaaaaagagaacaacagtcagaggaattctggaatcttattaggaataaggaaagctatcttctgcaaaaatcaagggctcggtggctgaaagtgggagactcaaattctaaatattttcatgcttgtatgcgacataaatatagaagaaaccagttggtagcttcgggttgggtggaggaggtcgaggaagtgaaggcagaggttaagaatcacttcgaaaacatttttgctgggtctgacatggtacaccctacccttgaggggtgcagttccagcatctttctacggtagataaggaatctcttacaactcccttttcatatgtgttttttctagtcgggcttcagcccctatt

SEQ ID NO: 4836 - DNA, 1200 bp, Glycine max
  Soy_ogl_4385 Gm13:31319301..31320500 Cluster 20
taaaatggcatccattgtcgaacaatttttttttctcaaaaaccccctataatctaaaatggagggactaagctttatgaagaggacaaatagtttggagcagagggaacatgatgacctccacgctgacttgtatccatgccaacatgcctcaatctctctctgacattatcaattgcttcaaaggcacctctttgctctgtccttgagacagatatgaaatctaatatctgtgactacaatttatttttatattaataataactgttttttatttaacaatttcatgtggcctttagctatatcataaatctattttatttatcagcaattcagcatggagtccatgtattatatgatgtggtatttttcttcttttcttaatatttttcgtaaaagtaagatttaatttcgtatacttgtgttcattgttaaagaatttattacttgaattgtttaacaatgaactatgagcatcataatggttaaaggggccaaattctttttttttttttactttaaaaaaaggctattgtaacaattctataggttaaaggggccaaattcaagtaataaattgacaatggacataagtataagaatttgctatataagagattaaatgcagtagcttattgtaaccggtacatatattatatatgtcattatgcaaagtcaaaggaatctaactatttgtttcaacattatgtatgaattattataatctttttttacattattttttatttttacgaataaaaaaaatatcattatgttgaaatatatttggccactcactcgatatgagcttttcctcttcagctatacgcagtttgatgcagttatatgtttcatcttgccaccgagccagcatcatcatggttgagcagggcagccatttagatgaattttcaatttgagagtttatactcaaatagtttttgttttttgctgttaggttctaggattgctcacttccatttttgcttccttttttatttttattttaataatgtttaccacttttttcattcaaatttattatagcaatttaagaaagaaaaaaacacttatataacagtactatctcccaccttcttttcctagcttctcactgtccctagagcgtggagcaaaaaaccaacattcaaattagggtgaaccgtgaaacaacaagtgcaattcaactgttcgaattac

SEQ ID NO: 4837 - DNA, 1031 bp, Glycine max
  Soy_ogl_1359 Gm04:43043201..43044231 Cluster 20
tataggtaatctatttaaattttcaaaacagtggtaatgcttttctttcagatataagtttatgagttattcaacaactgtctatctttcctgattgtgtgataactaaggaaacattatttggtgtaaaacacaattaattttcttcttaatttccatgctatttgctaaaatcttatgacacaaacctaatcggatttaacacagaagcattgaacatccttccctcaaaaatgtaattccttttgggctcctggcttgaatttcccctgaaagtagaaccaatcaaacctaaaactatatctctcaggtttcaggtgccaggttctattcttccctaagcctgataaagagacctttaacttaatacttttctatccttgttttttgctactaaccatccctcaaaccttaaatcacctttgaaaacctaacttccagcctgctaaattctaattccatttgtgctacaacaaacacattcaactaatctagtcaatcttaacgctagacgcaatccaattaggattatactatagtatggtgaagctgaaatattggtaaaaatcattaaaaaaaaacatatacgaagcaatcagtgaaagctgagaactgacacagacaatgagtacaaaaatctattagataaagtgtctgacaataacccattaggccattagccaaatctaaataactttcactcacttgacatctacacatgaccattgtccattggttataaaatttagaggactctgttctatctagtataaaaaaattacaaaatcaattatattgggcacatatacgagggttaatataaatttgagttcttactgaataactgatgtaccagcagctttatccaaaactacatagagattccgccacatctatgatccttgatctccaatcaatatatagctcctaaaaaggctttaaaatgtaaaaaaaaaaatgtaataaaaaagctacacaatggtggattatcacgagtcttcttgaagagaaagggcacttacatttcagtg

SEQ ID NO: 4838 - DNA, 1600 bp, Glycine max
  Soy_ogl_1987 Gm06:16560101..16561700 Cluster 20
cacgagggaaactaacacccgtcgcatcactaacaatcagacccttcaagaatgaaggttgttgctcaaaaatcacatattcaccccccaaagaacaaccataatcagccagtaataatctttctctctatgactatgatgatgaatccgaatgtggttaaaggaaggcaacaagatgcgaatagttcgaactagccttctacccgaaacacagccccacctgttcccctttatagcagtaacaacggctttagaatcaatctgcaacaccatattctgcatctgtaaatgaaacaccaacttcaaacccagcaaaactccccataactcagctacaaacacagaagctcttcctatgtatttagcaaacccacccttctattggccattgttgtttctgattagaccactacaacctgcaatgccaccattccctttcaccacttcatccgtatttaggcagaaccaacctttattctcttgactatatcatgaggcaagaacatattcaagagagggaggttccaatctccattgttatccactaagtcagcaacacaacaattatgaatatgagcagggaaaacaatagcttgatcaaataacattgttcgctcatccaaccacctatcatgccaagcattgacagtaggaccattatgaatggcccatatctccatctcttggaaagtaccccattgatcagcatgagctttccaaatgtaggaatcagaagtggatccattcctaccatatttaccaaccaggacttgagcccataaaatttgatccccgtttctaatggcctatcccattggcagggagaatcaccttggcgaaattagttatccaatctttgccaatttacacaatgttaagcttgcctgtgcctaagaatgtcattgaagatattcagaagttgcagagagccttcatatggggtgatactgccaatggaatggatttgcacgagttatacatgttactaatccaacactagattttgatcaggtccacatttggatcctaaacttctatactcaaataaattcgatccttatcaatatttaagataagatcaagttaactttgaagtacaagagaaacaaattaaagtgataaagtgatcatcattcaattatgtctaaaaattaaaattgaaaaattaactattcttgttattttaccatatatcttaacccaaatatgacacaaataatactaatttgccaacataatctgcattctaatttgaacattttacattaactagtattgtattttagtatatgcaatccacaagatcaataactaatttccaatctccgtcacagagagtgattgttagatccctcacttttatgacaaaatttgtccctcacaaatttgtgaggaatatggaatacatcacatataacaaaggaaatatataaaaaaatgtttcatttattatcagcatgtagagaccgaatttgtgtatttgtgactggtatatttcgttacagtttgtgacagattacaaaatcctcgataaacttctgcgatgccagtttttgtgacaaaagacgtgttcttcacaacatccgtcacaaactatgtt

SEQ ID NO: 4839 - DNA, 2064 bp, Glycine max
  Soy_ogl_3890 Gm11:30095337..30097400 Cluster 20
gtgtgtgtatccttctataacatttcgatttcatttcttgcagtttctgcgactcaaccctccgatttctcgaatcgcttttggtctccaaggacgtgaaatcgttgatcgaagttcgatccagcttgacgcaactcctcagatctgaagtccgttattctctccgtctccgcaaaaaccgtccacgacaagcttctcgttctcgatttcttcgtccgcgttttcgctctcgtcggagatcaacaggtacttgtacttgtaccgcctctcagcttcacaatcttcttctcggaaaaaaagaaaaacgttgtctcgttccatttgtcgtgcattttactagctcaacaactttcctattgaaatctcaaaatatcaaacaatatatacatacttagcagcgacgtgtatgtgctgatttgataattagttgctaagaaacgccgttgtgctatttttttttctctttctcttttgcgttttcgaattccttttttgcaagagttgtttggcgttgaaatacgagactttagtaatgagagaacataaatccgctagttgtcaatggctgctagtttcgcctgcagtatggttaagttttgtggagaacgctgtgcacaacggctttcacgcgttgccgaaaaggtacgatatatagcgcaaattgtaatctgcgttatgaaacctagcaaattttgtttagaagaacagacttagaagagttttaaattcatgatataaaactgtctctgtataaattctatactaggactttaagttacaagagaagagaataagaaggtaaaataattaaattaaacttctataaaaagttaaaatcaacttattcgatcactttaactcttttaactctctgatttaacttctctaaacactgtggtgcataagtttatcaaagaaacttgatttattttactttttattttcttcttctagtagtatgtatggagaggtttatttaaacataatgttagtagagtttagttgtgtctgtatgcttaatttctgcttggccatcaggcgtctgaaattgccttgtcgtgccttgggaataatgatgatctcaagcctggaagagacacagtttctgaaaacttgaaggctattatcattgagattacaaggttcaggaactgtgcaatggcatctgttgcttaacgatctggtatctcttcactcatccattaattgcattgaagattcatgcgattaatgttcttctgaatatgtcaatctttaaagcagatttgagttacgaatcattttcagattgtgattcagagtgatagcagcaaaattgtttggtcctattgctgcgtccatctctcattttcaactctgcctctttggcagagtttatcatgatttgactaaaaattgtgtagaagtgtgcagcttatgctgttctttgctgttgtatttggttagagaaaaatgcctaggcatctttttgcccgagattcgatttgtgataggaatgtgtatttaggttctctcttgtacattacatataactgtccctagagtgtttccatcgtgtgtaggatatggtgtgtaggatatgttttattctttttcccaaatttctccacttttctcgttcatgatttaacttaatttttggtttctctgttgttatttacctgtttgtagtctgttgataattagaaattggtgcttctatcttttattcttcctcttctatgtataaagttatacacttctatggatgggcatatgggggatattttacttgtcattcattctccctcagtggctagtcgcacggacattgatatttaaactagattttatatacttttaagaaactaatgtatttttgtgctttacggagttgtgattagttactgctaatgctgtttcctcatatcagttcaggtgcagacggcagagtacctaaaaaggaaaattacagagcggcaaaaaccgaacttaatctacacagaaaaacgatgtctagcaagcacttctttcagaaatggaattaagagacagaacatgcgaaagttacgtgaacaccaaagt

SEQ ID NO: 4840 - DNA, 1351 bp, Glycine max
  Soy_ogl_4326 Gm13:28466250..28467600 Cluster 20
tctaaaatattgaagagcctccatctccagtgctgccttctcctcctgtaaccttgtaataatagacattgcttcatttgtagcaacagcagaagcgtttctttcttcctccacttccttctgtaaagaatcattgcatttcttgtaatactcaattcgtctccttagtctatcatcattagactctcgttgaatttcagaaatattgctttcatccagagaatcaagaccagattccactgaggatgactttcgaaatatctgaactttgtttaaactagaagcctcagcatctaccttaggtgagtgaacatgatttacgggaatacttgatgatgtattagacccattaggagaagatttgtctcatgttgattgctcctgttcttccttgacattattaacttcctcagtggttggcttctctttgataaaaccagtttcttctctttccttagtggttacagaggacatattgatgttacttgaattctcttctttaggatttataggagcagaatcacataccaccggatgagtgtttgttgatgttgtttcctctgtaccaatcttctgtaaaacttcccccatccttttcagataccattccagtatctcttggttgtgcaacatttgcagcttatgtacagaaaataccttgtttgtgtcttctttgggtactactctaataatagtcaactttctgttttattaaaaaaaatgtggattctttattagaccccaagagtgttattcaatgatttgagataatgtgaaaaataagtatataagcaccagtgtgcaagtatgatgaccataaatcattaacaaaaaaaaatagtaaaatggatgcctcgagattatgcaagagtacactcctttttgcattcaaattattttacacactacactcctttttatctctttaatttttccttacacatatttttttcttttctttttttatcttgttcttaatttctaccagggctgtacacactctttggagtgtcaaacaattatttattatataaggtcttattttgggctgtatatactctagtataaagtgtatgcttaagggataatagatgtggtgctaaaaatattaatataatttagtgttaagtcactcttcacactttaattattgaagcaaatttcctgttttgagcagtgtccactataaacctttataaatattttcttttctcttggatttcagcaaaatttcagatctagttttgaagtgtactggcctaaaattctgagttacaaaaaatgaaagttatacattgacatgagttctacctttgtaaaaaaacctttatactagattctattctaccta

SEQ ID NO: 4841 - DNA, 1000 bp, Glycine max
  Soy_ogl_5038 Gm15:13334301..13335300 Cluster 20
tcacagagaaaaaatcataagccattatacagtgtaagaattccaagtatcaacaaaatacaaatgctacaacatatacacatatttgtaaagtatttaacaaattcagagatcactaaaattgttgatattgtatatgaggttaaatattacaaacttaggattgcctggattatgcacatggtccattcaaaatcacatatttttattatctttactattctactgaatggcatcatcaagacataaacagtgttatgagcttagggtggtgtttgtctctatacatagctctgcctcggtttcaaggctggtcatatgaccaaagccaccttcatttgtatctatccagaacagtagaattcatggtctgttcctcatcccctctatttctttattgtggattttcagtggagaagacacatatataattgcaaatgctggaactatgtatgcttgcttttattttttaaatccatcgagatgctgaaatgggtaatattgtatttattgaatgactcaaaacacccaattgtagtcttgctgtctactaattttgggaggtgtgtctaattttcaatttccaaattcatcttaatgctgctgacatttgtaaaattgcatatggcagagtttcaggtggagaacattcgctaaactattgcgagtgtcatacttatattaagcaaaaaataagtttctagttaggtttcgtaatcttgattaacaagggtcacagaagaataatgtgacaaaaaagtgaatggcaagaatccaatgctgactagaaaatttcccatttgcattctaaaactttgacggtgagttttgaaagtatttatttattaaaaaatattaataacattatcactaacactttttttaaatattttttattaattaaaatttattaaaaattatcaaattttgatagttccacttctagattaaaagtcaagaaaatcattaaatgaaaagtgagatctcaaaattaatactt

SEQ ID NO: 4842 - DNA, 1400 bp, Glycine max
  Soy_ogl_6682 Gm20:1744401..1745800 Cluster 20
ttgatttagccatgtaaaaaggctttgtaaactaaaaatgttcacacaatcatcaatccgtcataactttaatttttcattgtttcattattctttaattttcagcctttacattcatcctttatgactatgtttatagtttttttttgcctcattcatatagtttttcttcaacgttgatttttattcagtgttattatctattttaaatgtaaaagtacacaccaatataaaccaggcacctttttcattagattaaggaaccaaagctgaggcagagagtatccccaatgtgagaaacaaatgcgatagacaagcaatcacagaaaccctgtcttttgttttggagatatatttgctattttctcatcaacaaaaaatttagaaaatggaaagtgtctcagtctatggttcaaagtacatttacagaaaatttacatttatgatttatcttacctcccctttggagatatatctagcattccaaattcggagcaaaggaaagatgtgagacgtggctattattatctaaaaacaaaaacaaattctataggattcacctgagattgggaaccaatagtagcagaagttatggctctattttggattgctgcctctagctctgggcataggttactatgactcagttagaaatttgacaactcaaaaattatctcagcattttctccctcaacacttgatgcgatggattatgtagcagtataatgtcatattagacaccttgcccgtcagcatttcagtatcttaaattctcatgaatggtgggaagatgtacatcgtgagttcattaattgtgtgcatcaaaattcaaaatctacatgtatgttttttctttttctccttttaaattgttcaggcttttttgattgaatgccgcgaatgtaattaaaccggatcagccgaagaacttagtatgtttgtttccggtccaacttattgtgtacgaattttgagatcaaatctaatggttcaccacaaactgaacgcaaaatgaagggtgtgaattttttgcaaaattcattttgccacctgcctgtttgcagggatatccaaccatgttctggattgggctgtgattcaggtttgagtctcaaccccgtgtatcagttgtctaaatgaccaaatttgaaaaaggtctaaacatgttattaagggagtctttttttttgacagaattattaagggagtcttagtatggtgtttcttcatcaaacaaaaaatagtgtgtagataaggaactagggaactaagctaagtcactaacagtgctgtttgtgatgatagtgagttcataattatgttaacataacattttttcctttgctttgtagggaaaaaaaattcagttctcctcaaatttatacttttttcattaaaat

SEQ ID NO: 4843 - DNA, 1353 bp, Glycine max
  Soy_ogl_3458 Gm10:39697548..39698900 Cluster 20
aatacataagactcctcataaaatcactaactcacccaattaaattaatcaaacctacttaagttcccttttctccctattaggccaaaacatacacaatccaaggtcataggttttttctttatttcaatcaataccacggtaacatctattcatactttagcattcaaaagcagtgatatatacattgtatacactagccagaaatggttccaaacaggatgaactcctatttgcgttttcatcatcggttgatcacatattcatacacatatataattgacatatacattgtatacacaagccagaaattggtagtttacctcatttatttagctagcttttgtgtttttatcttcttctttttgtggaattgtgttttatctattagttaccaaaaaaaaatagttctatccaattcaaatagaattaagtaaaaaaaatcaacaatccaaaaaggaatttggcttaattacgttgagaaatcattaataaggaatctttctgcctacatgtacgttgatgggagttgagaacgaaaagatttgcttattgcatatgttgatgggagtatttggtacgaattgaaggaatattgattaaattccccatgttcatgccaaatttccaaattattttccaccactgtatatcaaccctaattttgctttaaattttaaattgattcaataaaaaacaaatgtaagataattaagcataaataaattttcaacgaacaatgaaatatgattggaatgatgccttaattaatttaaggtagaatattaaggatcacatgtacatgcatacatgcatgatgcatcttatctgtaatttttatattacttttatttcatttttatccatcttaattttattttgaattaagagtcaatttgatctatgaaaaatattgaagttcacatatatataaattcttcgaagtaatatcatatcctcttattaaatcttcttacgtacgcatcttcattcaacttttaataataaatatttaataaaaaacaaatacatttaatgtcttaaaaatataaaacatatttattaaataccataaaaggatagtacacttctaaaacgacgttcacaacaatgttagaggaaaatgcttctaagataattgacgaaccatcctcctaagtctaagcacattcaacaataacaacaacagttaaaaatcgtgttcaaaaatataaaagaacaatcataaaatcagctctttctagtagtggtagaaaggatggtgcaggagaatataggcatacagtacctggatagttatttattatttatattagatttgataattgcagcaggtcaacgttgggtgatcga

SEQ ID NO: 4844 - DNA, 1600 bp, Glycine max
  Soy_ogl_1613 Gm05:25752101..25753700 Cluster 20
aatcttaaaataacatcattcaatacaaattggaaggaatgcccatttcaaattttctagcctttcctggaaccataggctcactgccacaagccacccccacactaccaattgacatgctactaacaccattgttgatatatcaacagaaaaatacctcttatatattttgagggggacaaaatattataagaatgatagacaaaagaaaaataccttatacgccgcattaaggaactcaatcattgtagaaattttaatgttgaatcagtttacttatcattgcagaaatttcactagtactccatgtttttgagtctctgggattaaaagaaaatcaaggaataacgtgagctaaagttaaagtccttatcagaacaagacccacaacttcatagtcttaccctccccaacccacccaaagaaatgaatatctatatatatgagtataatctatgagtatactacttgtgtagtatacccactaaactcttgcccaagagtcaaaggtgttgcatcttgagtatgagtgcgtccaatcttaataaaatctttaaattcaagtgactgttattttttaaaaaggaaaaggaaaaaaagtgaaatgaagactgattaaaaaaagcaatgataaaaaaaccatttgaagaaaatcaattacaaagccaaatgcctcccgtttctaaaatttcatctaagaggcacaaattttgtcaaggttaatttcctaacatgtgtcataattactcattatatatttttttttttttgcaaatgcaacatgcatacttgatagagcaaaaggaaaattgagataaagagctagagaaaaaacacaatcttgaagcccagaactacaatataagcatataaaaactaaagaacataccaattcaccagaactcttacatttatagttcacatttataatattgcaaataactcaaaataacatgacaggaggggcactgtaatttatccaagatactatggctagtctaaatattggtaggtctgtatagaaataaaatttataatcataaaaaatgcaatccataatacgttattagagaataataacaatgtaacatatctcaagtggtactcctgaagaaattacgaaacttagaggataattatgctccttagtaataaacatataaagctaacctatttaacaatatatcatcaaaaagcatacttaaggggacctctagacagaacaagaagtcaaacttgagataaattgaacctcccattagtagaaatattggataattggttaggatacaaataaaatatacttaagtcaataatatctaccaagctgcaacattgttagtacatctttcaggatattgttagtactcaatgaatgatggaaaaacatatatgtatttaaaggattggcgatctcattttaaagaagaacattcctgcaattaatccagtttgtgcatagtcaagtacaatgtacgtacagctgagcaatgctccttgcaatgtctaagatatgaatcatgtgattaaaatggagcataaacagaacaggtggtactagtctgataggagaatcatcaatctccaataacagttacct

SEQ ID NO: 4845 - DNA, 1000 bp, Glycine max
  Soy_ogl_1267 Gm04:7052101..7053100 Cluster 20
tgaaacgtgcaaattttcgtttataggatttcaaacgaaaattcaaacacatgctacatcgttgggtttgggcactttacttgaaggcctgtgaaaacgttaagcttaaggcagcacataaggagttacagaaatctggtaccattaagaaacacatttgtttgtgtttgtgcgatgcagagtgttaatggatttaaggattgctgacatgaaagaagattgagtggccaacatgcggacccagattggacaaccatgcaggtcaacctataaactaaaaatatttctgtactaaatcgcaagtggcacaatgagcgtttcccactttccaaaaggggtatgaactatgtaacgaattaacatcgatcatgtacattaaataataactcaaataatgaaaaagtgataatgtgtatcatacttcattctttcagaacatcattatttgctctcctattgaaatgccccaacgactgctgcacctcttaagttatttcacctccactttggacggcaatatatatattacgtttcccagttcatcatcatcgatgttgctgccacaatttgcttcgtctttgtttttctcgtttttaatttgatttcatattttggtttgaataacactagtcaaattatatttgtataattaattcaaaatgaggttaagggaattttttttttttttttgtatatagtgaccaaattgtagccaattctatccatcacattagcaagatggaaaaatattttgtacaaattaattaacttctctaagagaaccactactgattcataatgtttttgagataaaatgcagtggtcagctagaccaaatggaatttactatgaatatacacataactaggtgtcattgtttcatatgttttgcaggaattaaatgaaaatcagtaggaaaattgaaagaaaccataattaagttaattttgcagtgctccgtgttgaggtcaaagtaattaaagtttcaaagatgtcaaat

SEQ ID NO: 4846 - DNA, 1500 bp, Glycine max
  Soy_ogl_2380 Gm07:35698601..35700100 Cluster 20
tcttcacccatgcatatcgggctcattaccattctctcaatctggcgtataatcttagtttcttcataaacttatggttgattactaaatataaaataaagaagacacataaaaggaatttaataaagttgtggaaggaaaaggcacgacgcatcattgtgcctcgctcatctttctttgatacaaaactttctctttttcttgttttggctaatcaatgacaatctatatctatcttctagtacaagtttttcttcccacctgaaaagggttctttcttttcaccaaagaaaaaaagaaggttattccttctttgttggtactttgaatctgatcttgcaagctctttaagcaccaaactacctcctcctctgggctttggaagaacgttgatgtagcaacattatatttttctttaagcgatttttcttccttccgttctcccttcactctttcccaactaaactttatatctctagcaacattatacttttcgtgatttgggtggcaaccctccattttagtaatattaatatttgaatgttaggaaagctaggaaatgacaaaaaaatgcaagaatttattaaaaaaaaaaaagattgaatgacaaataatgatggctaagtaatactatttttattctttttaagttttgaggtttaaaacctcccaaagacttaaaggaagtaaggaactatgaagtgtcccttctctttcgttctcttccattcacacatatgtacttttttttgggtacgtaacaaatatacctttcagtgctgtcaagttgctagttgatgagatgtttacatttgtaaaggagacaaaaaggattttactattttaagggcgaaagacgtacagatactgacttagcataataatgctagttgacattggttattccaaagttacaataataggaagaataaacgcagtatattgatgtgattccatcccaaacttgtcgctgaaacgaaagagagcactaatgttgagctagtttgtctatactctaaattgaagtaacatattggatagcaacaaaattaaaatttttactaaaagggatgaccagatttaataatcgactaagtctcaagtaagattatcttttaaggaggttaccttaagaaagaaaaaaagttacatagggttagggttgatatcactaaagaaagtttgaacttcactgtgtaacacataagagaattggaggcttcaaattacttcggtttgacttaccctgatgttcagcatgtgttcaaagtttactgttaaaaaaagtttacacacaaagcatctagttatgattaagagtgagtttatttaaacttttaaaaaaaattaaaataagtgttttttatacaaatgaattttaagaagtagataagatttgcttcttaaaattaataaaaaaaattagttttttaaaacaaaagcagtttagacaaatatattaaaaaatagaaaattatttattttattaaaataaatgtt

SEQ ID NO: 4847 - DNA, 1137 bp, Glycine max
  Soy_ogl_5044 Gm15:13465864..13467000 Cluster 20
ctttatacgttagttaagtacagatcgcagatgtagacatacgtatattgatattcaactgagatgaagataaagattaagatttctgtctacacaaatatatatgaagctggatatgaaattttttcaaaaatataaatacaaagataaatactataaaaccctactcaaattctatcattttcattttgaagaattactcagaagttgttaacgtgctgtgttagtatatgaattcaaactttcgatccaaatataatattgggttctacaatctctgatccttattacgtaagaaactttaaattcctactttatttctcagatatagactgcaactctgcaagtgctaaatctcttcatgcatgttggttcagtactttagactctgaagagattaatatatttttcaacaaaaagttgttttgaaattttcaacataaagagaactatattaaacttatggtagtaaaaactcaatgaaaacttattcacatgaattgataccatatactactcagatagattaaaattaatttactagaaactaacagagttgatctaggcataaaatgtgtatgagatcataaatttaaatctcaatatgattattgtaccaaaaataatactggaattaatttctaagaaattaaataatagccatatgtacaaagatattggaagaaaataaagtataaatttctttgacttaaactatgatcaaagtcctctcaaatattacgattttttatttatttagtataccatttttaaatttttgtaatttaattgaactattctaattggtatcgaaaaagggatcatcttttacactaacaccttcctcctcaatcgcaccatcatatcgaaagccgacaccaaatgcaactatgtctccgcgacccccatggccatgaactatttgagaaaatgccccaatgttgtcacattgttgttactttctataatgctcttgttgcttgttctagggtgtcttcgagatcgaggaggggacgtagattcatgctgttttgaactcgcttatgaacatgcataacttggacttttttaagcttagttccacatatttggtttcttggacttccattgtgttagatatgcaatgagtgggggaaa

SEQ ID NO: 4848 - DNA, 1200 bp, Glycine max
  Soy_ogl_2496 Gm08:3882401..3883600 Cluster 20
atcaattatttgagaaaggacaattaaaacttggagatgtctgcataatttgaacccttatccaggatttagatcttttagaacacgaactttagttaagaaaatataatttatatatgactcttgacagtttctttgtcaccgtcaacatgtactaccgcatgatcttgctagaagtacacgaatgaaccagtcaatatccaatttcaatgcaaataatttatgtctgctgggctacaatactaatgcaaagtactgcagtttagtagacacattagagacccacagcatgaagtgtccttagtccttgtatgtacctttttcctttttattttctctcacaaaatgaccacaccattcatcgtccttaattatgctgttctccttttttaaataaacacaaaatggacagtgcatagtgagattgatattgaatgcgtaactacttccagtgtcaaagtaatgagcacatatgaacatacaagagagctattgtattgattatatgatctatgcacggtcaagtcatcaagcgaatagtgtcgttcaaatagtgatactaaagtagagtattatttttcttagaacttaaaattgtgtcaaattcaacccaaaaattaggtaaagattaataattccaaatcttgagcgtgagatttataattcaacatctacgaaagtctgataacatgtggtttagtaaacctaataacaaactgatgaaatagacaataattctagaaatcacttgaatgttattgtaagaagattttcgttgaggggtgaaaacctaaatcctcaaaatattgttgaaagccacttatgaacgccaaagcattagtgtgtagctgggaaggcgcgccacgtcgagatcttgaaacaatgttacccatattaaggatcaatttttgtttaaatttaatatttttaaattttttaaatgattacaatcctattgttataccaatttttctttattcaaaacttatatattttttatctaaaaaatttcaaaaaaagatgcaaaaacaaatttaatgaaacttaataaatcatgacaagtcttgcaggaagtatttacgtactctcttaaaacataatcataactaatatatacgagtctcccaatccaataatcttaataataaaagatttaaaactacaattaaaaacttaaattatatcaatattttgatctgt

SEQ ID NO: 4849 - DNA, 1475 bp, Glycine max
  Soy_ogl_6161 Gm18:53778526..53780000 Cluster 20
cagaaactcttgattagttgtgtacacttcaaaaaaaaaaaattgtctgtaaatcttgttgccaccctaattttggagcacttcgtgggatatatgagtaattcattgtgtataggccgagtgatcaagtggtgtgtggtcctgttatttatgacttgtgacaagctgtttgggttaaaaactcaggccccgcacccaactaaagcttttttcatttcttgttcccatctcccattcccacctttaaaaacactctcaattccctcttttgttatacatgagtaagcttgaagcaccaaagttgcagtcgggggagtcacagattaaattcaccgcttctttaacctttgtgtttctctttctcataccattttttctttccctatagctcctttaattttcttgtgagagtcagaaaagtatcactatatcaagtgacatgatcatcagaattgaattaggtgcatgttgtgcaagatggagaagcagggcacgtgcaatactaactcatgaacactacacggggcgtgaactcggagaatcatattctcttctgcttcatttcaccaacaagagagatcctattagttagttcttcatgtgcccctcttccccatcatgacaacagcaccttatatatattgcatttggaaatgttgaaggatgaggtttgcttggcttctgctcaaaattcagcaccgagttttaatggtttatgctccatattgaaggtgagtagttgtttatcattaacatattcttcatctttcccccctttattcaacactagcatgtcttccactccacgcatgatgagattgacaacactattaattagtatttgaaatcagtgtaaaggatatataataagtgtgcatagatttggtgacgtttaagattagaaaaataataattatatatgttattttaagttttcttagaaatattgggaaagaaaaagaacataatttctatataaatattatggtggataaacattgaagtgaactattttaattgtgtttagtcaaagaacatgacatattaagcatgtatattaatcaaaatgatgaagggtgttagtgtgagtcacattctaattcgtaggtttccctttctttcttccccccaatcactcaacgcacaaaagaattttctttgatgtggaaactaaacccaaatcttgcataaagatcaccatgcaagactatatatcatgatgtaaaaaacttatttggcttcagtttcatcttactttgtgtcaactgaaaaggtcattctcaatgaagcactagctaatgttaatgaccttgcctcgacctcaatttcttatgcttttattgtagaaattgaccaaagtggtatatgagtcggtgcccggtttatccttccgcaaaagaaaaagctcatttgttgggcgcacttaggaagtattgacatagtggcatgctttttcatgggttaatgaattttag

SEQ ID NO: 4850 - DNA, 1398 bp, Glycine max
  Soy_ogl_1654 Gm05:32102601..32103998 Cluster 20
gagaggcatttcctttaaaaaaaaatggtgtattaattctctcccaccttcaaagtgttggaaaagtgaaggtggatgatgtaactagcataatatatatgttctattttggtttgaaatactttgtcgactggttggtgtaccccctgataattcacattaataatattttcttttcaacagaagaaataaaagtacatctgaactttggggttaagaatgaccagccgaaggaacacacaagaccagaatatagtggttttctaaactgttgtggacactttgtgctgaattaagaaattgtaaatgttgtgtacgtgaagcattattatatagcaaagccaaacatattagctagacattgcagtttgtacccagctagctattttcgatggcatcagttgttatttccactcccattttttacttgcacactcccctatgctttttttccctaactaccctctcaaaaacactccccctctgcttgtacaagaaccttcggataaggtgtgagggcgggttctccgattgtaggaaatacatattcacaccaatcctgtagtggtatttccttatgcatgcttggtagagataaatttgatcctatattcatattaattttttaagttcggctaatattcctttcaatgaatataaaatagaatgtcacgttgtgtagtatatcacataataatatgatatataaatttgacattctgtatctctttgacaagcggataaagaaaactcaagatgtgattagatttaacccgcaaggaggcgaagatacaagtctgtctcacaggagtcaaaaacactgaaacagacttgtgaaaaacttgatatacaccaaatacaaacaaaaggtacgtgcttagtcctcgtttatcctatatccatccaaaacctggatatctaatcgcgtagtcatggtttaggagtaataattttaaacaccttccgtcacacctgattccaaggttctttctcaagcagagggggagtgcattgttttttgtggcaaggagggggaggtacaagtaaaaaatggacgtggaaatactaacttacttttcgatccaatctgaagtccagcccaataattctggaaaggactcttagagaaaaaacgggcttggcccatgtatatccagtccagaaaaaaggccacatgattaacatatggctaagttttgttcattatctttttcatatattttatcatattacttctctactccattatggcattatttataatgtaaaagaaaacaaaatggaaagtggatgctgcattttttagggaagtgtgggcactactggaaggtgaagcatatgggctcatgatatggctttgcagttcgttaacagtttggagttgcaaaaatattcatt

SEQ ID NO: 4851 - DNA, 1392 bp, Glycine max
  Soy_ogl_520 Gm02:12778609..12780000 Cluster 20
ccttttaatgggcaacaattacatagtcaaacgtataattcatgtgaaacaatgatttattacttgactacattgtacacttgtgattttcatgtatcactacaacatgaaacaaacaactatatgaaacatacttagacacttgaccctccaacctaactaatagttcccttctacacttagcagagggcaactatcacaactacacttgggatcattcacatcatgatctaagggagcatgatgggtctcttttcaatatcactactacctttactactaccttgctcagaaccactaaggcttagaaagaggaaagagtttgagacctaactagtggatttccctatcatctaacatggaatggagactacattctaccttcgagacttggtgcatatcattactacatatggccctaatccaaaaactaaaccctgccattgtaagcactccttaaagttagtattgtcctattgcactccatgctatgtccattccccgagttcgtccaaggtgatttagatatgttatctctcatccatctattgtttgacactgagcagagcaacaaagaaaaaagacagaaggaagagtgaggtttgtagttatacaacaaataagcaggagagttaaccacacatactacactgggaaaaacacacatcatatataacacattgaaccagacattcaaatccatactaaaggaaagtttataagcagcttatgcatatacagcttacacatacgacaaccatggtgaagcaatatatatactcacatatctcacgcataaaccctccttaacatacttacaagcacatagaaaactgctataaatgttgatttgcgatattttttccaaaattcacaacacactaatcaacttgtgtgttgttgtttcaatttgtatactatcacctcattacgaatgtcatatatagtaagttagttaactttgagaataattaactatcttaaaacttaaaagttatatatacttattataatttttaattagttaacattataaaagtttttaccgtaataatacatcagtgtatacaaattaaatccgtatgcctaaaatttcataagttaatttgttaatatatagtctaaaattgaagtgagttatttacaactttactaaacatagtttaaaataagtagaagttattcgcttttcttatgttataaaattaaaatcttcacttaacagtacgtaaaaattcttttttaatatgtaagtattatattcaactatttttgcaatcaaaataaaccaatttaacacgtattaatatataaatagcaagttaaaagcttgaaataaataaaatacggatcgaacttaatataatttgtataacgctcagcaaaaatatt

SEQ ID NO: 4852 - DNA, 1000 bp, Glycine max
  Soy_ogl_4312 Gm13:27739601..27740600 Cluster 20
gcaggatttggtgggggcatgtttttttgtgtgattttaaaacagattttttaaggatgatttattgcgttgcatattcgagagctatttctgaatttgtacgttaatctcaacgctgaaaatgtttgtctaaagtctaaacttcatagtgagcgatattgctcattcaaatcagaaacaaatatttttctgctgtttgaatttaatgatctgcataacttgtagcattcgcaccaaaaagaagtttgtttatgcaactagtagcataacttttgaaaatagtactatggtaattcctgtgcatttttttgtttatttaacaaatatgtagatttgaggtattccaacgcagatacaatgtatgtacctttttatcgtagtttttctttttgggtacatatataaaggaaaatactatttgatacaatccaaattcgtatatgtacgaaaacttttgttaccacaaccgccctttatttcctcaaagattatatttttgaattaacgatttgttaattttttttaatttaatattcaaccaataatacattgactgatatttttgtatgtttgacaacccattgaaagcacgaaacggaggttgttggccaaagcatctctgttctttcttttgccttcatccgttaaatctttcttgaaacacgggcggcaggtgacagcatgctcaccggcaaaacaaacatacttagagtctttgtactgtatagcattgctgatatataaatcaaacctactcaccaaatttaatctaggttataaaattggaaacattttccatttaggataggtaataaatttaatcctataataaaggataaatagtactgaatagttaaactttttccatgacctaaattaaaactattttcaaccaacaactgaaaatgacacaattcactcaatcaaggtagtattcataattgaaatcaaagtaaaaagttaacaactccaaatataaaacatataaatttaaccatct

SEQ ID NO: 4853 - DNA, 1000 bp, Glycine max
  Soy_ogl_5997 Gm18:8683701..8684700 Cluster 20
tgctacaaacaatgtttttaacattataactttgttagttccattttgttatataatatctgtttttttttttgcttgatcttcaaatcagttatatgtgctagtaattcattttttaacttatattaatttttttcacatttacttgctttcaaatttagtaaataacaatattgtataataatatatctgtatagttcacacctgtattattatttgtatttttcagcttacctgtgcgggttactgactagtttccttataaatgatcaaatagcagacaaattagaaaaaaatgatttcaaagaataaagatccaaaaatagaactttcatataaactaattaagaaaaaaatctattttggagaccttggatataagagacacatatgtgtttgagattccagaggagattatgaagcttaaaaagctacgtcatcttctggcttattctagttgttcaattcaatggaattggaggcatgacatccctaccagagatacctccagtgattatagatgatgatggagtggtcattggagaggttggaaagctaaagcagttaagggaactgttggtgctagattttaggggaaaacacgaagagactttgtgttccgtaataaatgagatgccactctttgagaaactacgtattcgtacagctgatgagagtgaagtaattgacttgtacattacgtcagctatgtctacacttaggaagcttgtcctaagtgggatgttaactgtgtttgcgccgctccaggttgactaatgatgcattgaaatcactaaaaaatatgccaaggttgttgttcctcgagttaagtgacaatgcttatgaaggtgaaactttgcattttcaaagtggagggtttcagaaactaaagcgactgttcctcggaagtttgcatcaattgaagtgcatccttatcgacagaggagcactgtgttctgtggaagaaattgttttaaaaggcctctcccaactcaaaaca

SEQ ID NO: 4854 - DNA, 1435 bp, Glycine max
  Soy_ogl_1853 Gm06:8320066..8321500 Cluster 20
atgtgtaaaataatttagaactataattataatcaaataaaggggtaaacatataatttattttttgggttataatttaaatctattactgctagtataataaaacatggttatggctctcctaaaaaaaaatggtcatggctagctgcacatgtgtcaacatttaatatatatttttactttttctgcttaaaatacattattacctttctttgggaaattcttttgcagggatttctcataagctttcttccacacggatctaatggtacgtacgatcgaaagataacgcaatccatgcaagtattaatttggggtcaatgtattcgtccagagagaaagtaaatacgtactcattccaagttcaaagtatgatactaactttaacagagacgtaataacacatgatccatgtgaaaggaaaagctagttagcagaaatcgagcataaaacatagtaaaaaataaagtactattagcggcagaatcaagtctgtctgatagaattgttattctcatttgtgtattaaaagaaattcatttcatttgacgttgttgattaggaattacctcgagaaggatgtcatacaccgagtgattgatcatttttacaattttttttattaatatatgttgtttctaaaacaaattattggcatgaatttactttgatcaaattagggtaaaattgacaatttgaagacctaacaatccagaaatataataaaatattttgaattacggctttatcatgttaaaataaagtagtaatttgaaattgtttatttgttacgtgagtatttaataatttgaaatgattgattcgttgatataactatttacaatagctgatatatgtgtagctcgagtccacaataaaaaatcgtaaaatgtatgaatcaacaccagttcaagtacacgttaaaacaatattatgtttagcattgaaacaacaatttgtattatgtgaattctttgtttaactaattatatatatgttggttttttctcttataatttttccttccataaccctttttttgcctatataattcatatgcccgggcccacgtaatctagctgttattgctcaaaatggagttaagcatattattgtttcaatattaaacataatgttgtttttaagtgtacttgaattagtgttgattcatatattctataaatttttattacagactaactatacacatacaaactagagttgcagtagttatataaacagtttcaaaatttttgaacattgacgtgataaattaataattttaaattgttattttgttttaacgtaataaaataataatttgaaattaatgatgtgtaatatcacgttcagtagtttaaaattactaattcatctttattgttgactgtgaaatcttcaaattgtcaatttgcctcttgattttgacacatat

SEQ ID NO: 4855 - DNA, 2112 bp, Glycine max
  Soy_ogl_1224 Gm04:5201789..5203900 Cluster 20
ttctaaaaacaagaatcgaacgcatagaataacgaaattagtggcattgggccccgttcaatttcaataaaaattacgacagtagttctccgagagaatcagtggttgcagtaattcagcacgaatttatggcaaaaattgggaaaaggcattttacaaaaaacgaggactagcatttagcaagacaaaaagacatggtccgagttaggtatattaacatgacaccgtccagtgggattctggaaatttgatttgtttcaaaaagtggcaatgggtttctgcggtccagctattatatacgtgcacagagagttaaccatactatactattaatcttctaacatatagcattttagttaaaatttaaaattaggaaatatattcattaaataaaaaataagatccataaaaatatgtagtttttaataaattataaagaaaatattaaagaatattttgctggcatatctcatgtaatttgataaagctgaagagtcgtgcacatatttgtctttgctcctttgtcttttcgttttaataaatataatataatatgtaatgcttaatggcattgtagtctagtgcattttcccattgtcacttggaatattgatgtgcaaggtggagagttcatccttttgcatttcattccgacttttcacctaggttctagtaaaactctcttagggtgttaggtattttcggtagagaaaaaagaaatagaaaaaaaatgtattgagatgaattattttttttaaaaaaaaatacgttttatatcattttacagttcttttttttttctttttccgcaaacaaacgcgccttaacttatataaagagttgacaatatgtaaatgcagtgtctttcactaaagacaatgaacccataatattgaatatttatatttttacggaaaaatcccttatttgttttccttttttctcccttgagaattcatatatttttcttaattataataaaaatgaaaagaaagttttttaatcttaaatcaattaaataatgtgacaaaaaaatcatttaaaaatgccacttgtacaacattccttcatttaagaacttaaaacatatcatggttttgaaattagctcttttatagaatgatttacttttttacatggtaattttttttccacaagtgtcctccttcaataatatactactacatatttagggtttgaggtttatagtcggatactaaatatatggatattaaatgtaaaatgtcgtatgtcttatttgatttgatgaaaaatagttaaatagttaaatatgtaatgtaatagtatttgaatatgaataattataggaaaaaaataacatattcattattttttttatacaatagaccattaattaggccgcactactcgtatccaaccattggattcgttaatgagttagcagcataaaccttttgttctttgttttggtgaatgaccattagaattacatcatctcatcttttattagcttcccgattctgggtggagaatgtgggagtcagtgggacacgatatggaacaagttcacggttgtcccttttccttttttttgtagggaactcaaagtcaaaaatcatcttttacttttaaccctatatgcacgaccaacaaaaataattagaaaccgaaccaaagaccccatcaatatcttcaatgcaagatcctctcccatttgttcctacgtatcaacatcttctattcttcatcttcaattgcaccttcaatctcttatgacattatctgacaagcttgtgcttcctttccatttgcctatcaaggctcaaccactctggtcagtatccacatcaactcctcaaaatcatcattcccttgctcttttccccatgcaagcaggcccattgaatgaaaaaaagggaaagtaacataaaaggaaaagaaaaagcctcttcaagtaatcctaaatcctatatgtatagtttttttttttcgaaaggctagctctaaggctcctctttttatgaccaactaatgattttggttgttaatgggatatacttaggaattgtgccttaagagataacttaggagcattattttgcttcttttcttcatttcttttagttcata

SEQ ID NO: 4856 - DNA, 1790 bp, Glycine max
  Soy_ogl_1832 Gm06:39901..7491690 Cluster 20
ggagagcaaaagtccaaccctcttcagtttaatcttttaaagatccgaacgttgattttcgtttggtttaaattgggacatgatcaattttgaaataattggtagcttgagcataggtagctatgtagttgtatgagctcagctatgaactagatcaatgttaacataatagtcacctaatgatattataaattcacacaaggttgagttagaaatatatatcttcaccatttaactctggacttaggttaattaaagtcattttatatgtgttgttagtctaaattctgagaacgtatcaaattaaccctttaaaagaattagtttttaataactcccaactaagagatatcatgagcttttttttttttttatagaaaaatctaacttcttagagctttacacgagtagtatgcagtatttggtttaatgtttctaattataaaagttaattttaagttcaaattaaaattgttttataatttttaaattaaatttttggatggtgtattaaaatttagaataaataagagaaatagaagatcttaaaattaagcttatgtttagatgatcatttgcaccttgtcaaaattacttttaacttaaacgtaacaaagaattttcttctattaacatattttaagaacaaattacaattacagtaacttttcctaatgtaatttgttgtatttttaattcaattctcaaaaatgattactcaaacaatctataaatcattgaaaagtttttcaagtattttcttcataattttttttttttttgtagaattatgttttgttcaactttctctcttaaaaaaaagaagtttaaaatagtttaaattaaatgctattttaagttagatgtgtagaaaaataattttataaaaggtaaaacaaaatactgtagcatatataatataaaagcaagataaaaaataatattcttgaccaaaaagagaagtaacatgaataaccaaaatcaatattagaagttagagtatcaatttcaattgtgaccccatatgcaagataactagagaaggcaaagagaatcatttagcatttgaaatgatttagagaagtcgaaggtgattttgaacatctctcacaaagagacacttgatcgtcaacaaaagctggagaaagctccacatcgatctctcacttcctaaaattacaaataaaagcaaccaacagattctcatcccacgtttcagagtgttgataaagccaaacacaaacagatgcacgtcactgtgtgtcatttgtccacactcactttgttgcattgcacttcagccactatcgctaaaaaaataattattggacctttccatttacgatgctaactttatgttatgccaactttattttaattataaaaaacatataatacctctgtttctatttaattggaaacatactttgttgcttgtgtttccccactttgtgtagagttttctccataaccagttaaccacacgtagttctgtcccaattaaatatgaaggtggggatccttagttaattaatttaagagtaatgttgtttatatattaattttttataacaaattatgtactaagaatggaataaatagaaagaagtgtgtaagctttcaaaaaataagtgtatgattaaataagtaatgtaacaataaagcaaagagaaaaatgtatataaagagttttatagtttttttatatgaataacattactttaaatttaatttgttggtattatacgattttcctcaactccttttcttacatcttcattttacaaatc

SEQ ID NO: 4857 - DNA, 1700 bp, Glycine max
  Soy_ogl_2288 Gm07:8291501..8293200 Cluster 20
aatttttattcattttgtacaagaaggcaaaacactggaagtttatgaccaaacgctttaagctccgtacagttgagatggagtcaatagctgaagaccccaatgctaagggtccgttcagtactgcaaaaataaatgaaaagaaaataaattaagatgagatttttggattagattagagtataaaagtgtgaatctcgttttattttattttttatttcatctctttttaattctttttttatatgcaagcgaacacaccctaaattctctctctctccatcttatttctcttctctttgaatttcttcatgttttgctagggttgataaatttctaccgtacccttacttacttagggaattcaacaaaacatgagttttatttaataacgaaatatgatcaaataactgaaatatatgagttttgttcatacagtttacaagcaattactagtgttcccattcaacttaaaattataaggaattctctttgggattttcacttaaaataatgtaataaatgaaaatcgtcatgtcatgcgtgagtgaaattgaatattccataaagcaaaaaaaaataattggtcacttatggccctgtccacacaacagagataaaaaaaaagaagacaaaagaggcggcaaattattataaatggatggttatgtctgtacaacatattaacatatgagattctcaacaaaaaagaaaatgatttgtcaccctgtaatgacttttgtggggtgcctactttttaaagtaaaacaagttaattggattgcaccggcagcacacacacttgaccaatcacatgcacatatataccagcttagagcaccacattattattattattattaacaaaattaagagtacaccatacaacatccacaccccacttaggattacgcacatctatctcatccatcatgtccccaattttcaccgacattttcaggtatttatggcctgtgatcaatccttgacgaccctgagttaggtataaaacacatttcacccacatagaaaaaaatattaaaaaaataaaaaatataagattaattagatgattaagaaagaagaaaaagataatcggttccatctgatcttttttataaacaattaactttcgattaaaaaaatattgagaaaggtaggaaaacttcatttcaaataggaaagaatctaaaaattcacactatacctagctggttaatttatatataattttttttatcagcaaaagagaatactatatttctgtttaaggcacgaaagatgcccaagtccatgcacaaagaatcaaccgttccatgggagaaaaaaaaaagaataaagaaaacaggccaaggttacaagacattagcatgaaggcatgacaatatagagtaaccttccctgaacataaagcatcatgataaacatcatatgcccaccaaaaactaagggtgatacagatagggagacctcgcctaaagtattatgtgtcttagtaagaacaattggccatgattgaatttggaatcactctaacttcaaatgtattttagtggaatgaaatttgagatttgtcttgatgatggtataatttgttgatacatcctgaagctgcaaaagaatcttacatagattagtaattaaagttagagatagtttataagcatcacatcttcctttaacctacataagtatttttt

SEQ ID NO: 4858 - DNA, 2271 bp, Glycine max
  Soy_ogl_5822 Gm17:40481230..40483500 Cluster 20
tattaaggtttaataaacacttgcatagctacggagttcccgcagttttaaacacacatattaccatgttctctttgtgttttataattctggcttaatcgaccaaattgtgttagtagaaaccaaaagtattatagtgacagcaaatttaaatttgattttataaaactccaaaatttgtcaatatagaggacgtttttcttaattatgtaggataaaaaataacaacaaaggcacattttagaacataagattaaaattacttacttattgtaaatatgattagatgtactgtaattatttctataaaacaaatattttgtttcgagagaagtcaaatttttaggtattcaaagtttttaatggaacaaaaatttaatagagcaattgaatggtgtgaccactatgatacttaatcacactatcataaaatggatcaaaattttttacaaaacaaaatatcagtgcagcacacaagaatttatagaagaattctaataaattattattacactaaagaataacctttttatatataaaatcattaaaatttggattatattatagttaaagaaactacattaagacattttacacgagttacaaagtttgctatattaattgtaggcaattagttgaaccagacaaaccatcacgtgaagtgatgcatttgttttataaaggaaatttcaccttttatcaaaatgttatgcaagcacataatcaaatagaaaaagtgaagcattttgtcttcctcatatgttgtgtgacattccttggtgtacgagagagctagttttatttggatgggacaacgccatgttgatatcacttatcggtagggactatgcttggaccctgaaacagtgaaacccatgtgagactctatcgagtactctataagatgatccttattttctccttccttcagtaagatggaattactaaaaacccaaaagttggatgttggtgaagggaactacgatagactcttttttttaaaaagaagaagaattcttttggaaacaatttttttaagatcatctcttatatagtacatcatccactttgattcttcactcaattttggcgagtcttattatttcacatcagattaacaactttttactctgatggtagtgaaactactgaaaccacttaaaaattaatttataatagattatcaacattttattttaattttaatgttaagaattagttcttatataagaaccattcttacactatgactttcaacttaacttcctagctccaactgagatgtaaacctcatatgaactcgttcttgtgattattaagagttaataaacaattgttggagattatctagaggaaactgattttcttgatattatccaatgcatatctaatacattatccatctatattctataatattttttataatattttctatttccctcttttattttaaccaccaacaagaccttgctaagtgttatttaatgactaaatttaaagcaataagtcttgatcattaattaacttttcctatattgtttgtggctattgttgaatactattttacactatgtaccttaaaattcagcaaataataattaatgacgaccgtgaggccagagcttaattgttgcatcctaagggaatggttagattttattggaaatggcaggataaacaagaatcaaaatgtagctggttaaatatagaaatgacacagccctcggcaagtaaaggtttctactttcttatctcatttagcaaaagaaaagaaaagtaactttctccccactccattgtggttgtcttaaaatagttttaaaaggataaagtaattaagtaaaagaagaaaaaaaatgcaatcatgcaactctattttggacactctatgctgatgaatagagcataacctatagacaagtataattgacacacctgtgttgtaactaaaacagaaacatcgttttgtcatctgtcttcatacattgtattacacatttagaggtttcgtttttcaattttcatagaatttctcaaaaataaacacatatttccacagcccacaccttatcaaaaaccagcagcgacatttgttttctctggtggagaccctttgcttatgccacacgtagcacctgatggaatcagcttctttgtctttcctctgatggcatcgatgctcgacatattgaaattctgacacgtggaaaacctggactgtagggacacgcgttacaatggaatgtgtgccccccaaggccccaacta

SEQ ID NO: 4859 - DNA, 1600 bp, Glycine max
  Soy_ogl_1252 Gm04:6288901..6290500 Cluster 20
ttgacaagtagatagaatattaattcctactaaataatcaacaatgtattatatccatacaaaatagttattaaactatttaacaaattttttaattatatatatttttgaaatgattgatatctaatatgaattatagattttttattgtttgaaatataatttttattgcattttctttatttttatctttggaatataactaattttatatttttatatataaaatgtgtaaatattttttttataaagtcattttttgctaaacattagaagtttaaataattataaaagaaataaaaaaattgccctgtctctccctcaatagtttttgttttgggtccatacgtttgcagaagctctcaaagaagcccctttgtcacagtttgttcaaaacaattacttaaaaaatataaaaagttatatatctaatttaaaataattttattattttttattgaggagggatcaatttactttaagaaaactattcttcatccaagtgattcattttcttgaaatataatggttaatattcattacaataattaaatttcaaatgaaagacaaaaataaaaattattcttaaaataaattgatatatatttttttcattatataatagttcggtttccgcatgccatagaatctttttccggggagaataaagtgtgatatctgtcccggtttgaaagttggaacctactttcattatttttcttccactcccgtcttcatagaaaataaatttctgaatttgggatctcaaatggtatacccacgaaaaaatcctgaaatggtggggaaaatgggtcatcttaaaagactgggttggtggacataagatgtgatgatgtgcgaattggcgattggtagattaattaaaatcatgactgtgtattttattatatatttttgcatttattttaaatttgactacatatacatcaaggatttattctcataatattttaagtttacttgtattgattaacttttagttttacttctacagtagccattgatattatatttgttaaaatctcaagttgatccagatcataattgaagcctgatgacagaaaaaaaaaaaagaagcaacagcccacagataacaacgtacggtacatggctttaatatgaaatttgcaggtgttaatgtccctactagttggtaactatcccattattaaatgaattttcttttatggaaatgagtgtggaggcggagaagtagagaaagagataaacatagttaggtgttggatttaattaagcagtcaagacctagaaacagagtggtacaaggccacattgaacaacaaaaggaaaaaaatacctattaatatcacacagtttgattttggtggactttggcttattggcagacagatattccaaaataagggaattttataatgaaaaaaaagttagaaatactgcgatgagattaatatgataggaggaaattgggtcagtgtgaggagcgagagcgactcttgcagacctaccttatctctttgaatagagtaatttaatcaatcatgcacttgatccagttggcatgcctcatcccatccaataaacttcttgcttaaat

SEQ ID NO: 4860 - DNA, 2400 bp, Glycine max
  Soy_ogl_6260 Gm18:58834601..58837000 Cluster 20
ttcaatctttcttaatactattagtcgattattatttattattgaccaattcagcattagaagaaaacaaaagatgtataatatatgaattcagctcctgtggcatcactatgcatgccataattcatatggtgtgacttcaataataaataaatttgaacttaaaatatatgatggaatcatcatcataataaataaataatgtttcaaacaaactaaactcaaactaaactctaggagtttaagggtcactctatctaaccttacaaggttagtgacaataataatatctatctgctcatctttaaaaaataatactgtattatttctctgaggccaaatcgtccgtacaagatgtacattttttttttttgtatttcatatgttctttagatgattacatcctaacaacgtgattaataaacaacttatcacaaccagtcaacgacctcacatatatcaatacacatttgccatattaaatttcataaaattacaagcccatgaatcagttagcatattatttacaatcagtcttattttgtaatcacatgtagctttgatatatatcttataatcttatgtaactctacccatttttttttacaaaaataaaccgacgagataagttttttttaataaagaaaaatggacagggagaggggcggcagtgatttcttctgcataaatatattctattgcctatttactacataagaaaacaatactcaattcaaataatactgattaaaattaggagtcaatttgtacaaatatataactccaaccaatataactatagtcaactgtatttccaatccgattcggtctgacaagctaaaacttactatgtaagaaaacattactcaatttgaaatgatattttgattgattaaaatttattgaataaatttatgaaaatatacaaataatattgttatgaaaatatgttttctagtccaattgagcctaatggatcaaaatatgatacgatcccagcttacttaacctaattaattttaatatggatcactgatttgttgattttgtttagtccgttgagaaggatcaaattaacctatttttctcttctattaatatatattagactatttttaacagttttaccaaccaacatattagctttaaaataaagcagtccattcatgtattaaattaaagttataaaaaattcactcataatatatatacatttcaacaaaatcgatgctaaatatattttggctttcaattggaataaatgaccaaatttgtgtccatttcttagaagttaactctacgtaatgtcaactgatgctaacaaaaatacccaatgtagtgtcgacaaatgacactacccttaaattagtgtcaatctgactgacacaatgtattttaatatttgaaaaatgaaacaaaatggcatttaaaaagttttacttagtgttagctaagttgatgctagtaatgtcaacgtgaggtcgacacaatttcgactttaaaactagtgtgtttttaattaattttttttatttattattctgtcacgaatcttatgaaattgtccactagtcacttataatgtgtttgaataactcataagaatcaattctacccacaaaatcgtagtatatctcaaagaagttgaaataattatttgttgtttaatctttttcatgaaaaaaataattatttatttatcaccaggaaactatttcatttcaagcatacaatcaatatgcttaaaatagtcatgggctgattacttttaatgtcaaataatcaaaataaattttacttctcttgacagattatatttttttatatatatggtagggaattaaatccctgaaaacatattgaagaatccaaatatctataaactatgaaggatcatattgatttataactattggacacatacaagaaaataaacagctagagacatgttcattactggcataagcataccggttgccgttggaaatgataaaaaacatgcaaattctatcctaagagctgacatattgtggcaaaactaagtaacaaaatagttgccggaaatcagcgaaattgtattcaatttcaaagttcaaacacttgatttgccaaactagatggttaaaaggaagcatattgatcactgtcgcagttcaagagcatattgatcacatggatgatggaacttatgtatattagtctgcacttacaaaaagctaaccgatatatcgtcattttgacaatttatttgaaaggttgggagaaatttctttttgtttattaccacatggccatatcatcattttcactcattttccttattttcttttaggatcggtgaaatagaaaaggattatgagtttcaaaggaaaaatagcttaaattaattaaaataaaata

SEQ ID NO: 4861 - DNA, 2163 bp, Glycine max
  Soy_ogl_4157 Gm12:38671050..38673212 Cluster 20
ccaaccttagtttgtacaactagcatttaaaatatggaaggtttgctaatgcgttgggataagaagtcaaggatccgaaataatctcattttaagcaattgggagtaaaactttgtaacttaaacttgtagagttattctctaagtagacattcactaacagtatcatcaacatgtccttggcatcatgtttggtagtgttgaagatgcttccttaatctctttttttctccaaaaatatattgaatgtttaatctcctacttactaaacgagttatcttctagctagccttaattaagtggttacatatatgttgtagataaatgtaaccgtttatcagtttagtagtgcttatttgattaataaatggtaaaatcgtgtgaatgtatgttaacgagggacgcataatttatgacaatttatgagaaagtgattcgtgcatttagtatgactaactaaaaaacaagttacaataaatccatgacaataatctaattcctaattgtttcaaaatatagaatttatgttatagctacgcccataagatcattctccctatacgggaaacgttctctaaatgcatgatataagccaatctgaatatcagtatcgtcttaaatttggaggttctttgtcacatcaaccgttaaaattagatttagaaacaaaacaaacataattattattcttttaaaattaatacatggatatatcatcacgtctcttaccattaataatatttggatttggatagctcatagctcttgctgctaaattcagcaatatgtcaatttcaatgatttatatttgattacttagattgcaattttgtgtcaaacttccaaattaatcagttactaaaagtttaaaactgcaaaaacagagattagacctagaaaattgagactgagaactcaatattttaaaaaagaatcacaagaaattagaattttatacttttatttttgttagaagcaaaatatccccatattctcgtagagatcatggaaatagatattgtttcttcccatttctatataaaatcatagattattatcaattttcatttaaatgcaaggaaaagatatgaaaaatatcccatagattatgtgtgaattcatgaaggaaaaaaaatccagcatataaattcaaaaataaatgtaactatacaaaagtatgtgcagtcttcttttctcaagagtttattatctcttttgttaataaactttttcaaaattctagtttgaatccttaatctaaattttgatgaacggtgaaagttcatgagctttttctctattatcactttgtctctattgtataatattgacctgttagacctatcacatcattaaaaaatctagtagaacaattagatgtatttttaaaaaaaaattatatttttaattcctcatttatttattacaagtgttgatgttatactaatcgataagaaattaaagacaatttatctaaagaaaatacacatgattatatgtcatcaaattccttaataatgtgttaggcaattaaattgttaacattattgttgtgtcatcaaaatattattatttgataacaaaactaaaataataaaaaaaattgaagatctttgataggtcaaacaaaatcaatgtattttgattggatgtcccattggccaaaagggttgacaggtctacaatatgaagactcgtgagttttatgtgtctaaggacgtaatattttatgagcatatattgccttatgttcaagaaaaggatggtgcaaacctttttcttgacaatttgcagaatgacatttttccttgatggtttgcgacggcattaatttgtgggatcaaatgacagcatgaatgcagtctaatatactaaatttggaagaagaaacacaaccagcagcaattgaagagaacacacaccaacctattgtcacggtaaattcaataataaattaatgataatataaaattaattttataaaaaagtaattttactcattatttatttttgttttatggaaaataatttagggtaataatgatttaaaaactgtagaataatagtatattatataattatatggaagaagaaggaagggcggcagtacatgatgatatttttggatgcctaagcgtgtctcccgcaagggatccaaggcacc

SEQ ID NO: 4862 - DNA, 1290 bp, Glycine max
  Soy_ogl_39 Gm01:1894401..1895690 Cluster 20
ttcatctgaaatgaggccgttaatttcgaaatgaataatgacatataaatattttattattttaaatatttcatcaaaatttatcaatatttttatttttttttattatattttaaattctattaaatctatatatttttttctctccctacctgttgaataggtgataagagtgttcatgtaacattatttttcttcataaatcttgataatatctgagagttttgttaatttcgttaatccattatgtaaacaactagtttttaagtataatactctcttgcagtaaaacaaagtatgttactcttttttgtttaaaattggttgtcatttttagattttctttattactgatatttttaaatatttatcattttaaaaacaaaaaatatttattattttgtgatatttccattttaaaatttctcatttgaataccttaccaatttcaaataaaattcttagtaaaaaagttatttttattaaaatatccattttaattcaataaataaatcgtttaaaatagaagatgtaatgactaaaacattctacactgactattgcaaccatcttattgtattgcacaaccatcataattcataaaggcataataaaaatgtgattacgagtattgagcccataggcctagacatgaaggtttcataccattttctcaaatgtgattaaggcacgatagatatcaccttccccctcacacacgaaaatgacacaaaatacactatcctcctaaaaatgcaagaattgttacaagtaagtttgagagcatactccacaaataattgatagttttattttttttgggtaatttgatctttaataattttgtcacgccaatgattagccagaaaaccagcccttattcatcgtgttttaattattgtgtttagttaatgaatgcataggtattgatagggttgagaaggaaatggtgggcatggattcatgagaatgacaagggataaggttatggatggggatagcattagattagattagtgaatgaaatgccagaaaagaaaaacgtaatactaacaaaatactacattgatttatggaacctaaataaaaataattggagaattaataattggacattattagacatattaatattccaagaaaggaaataaaaattgaaaagatttgctttcattaggagccacaggttttgcggggatgtggtacgacacagggtcccaatgccggaaggactccgcttttgtcgctaccccatttcgtattagtatgttttttttaagggttaatcag

SEQ ID NO: 4863 - DNA, 1540 bp, Glycine max
  Soy_ogl_820 Gm03:3250792..3252331 Cluster 20
cttttgtcgaatgtatctttactcgttaatacctactaatactcaaaaactcttgacattataaaataaaaacccaaatagtattataagaatttgtttggcaataacagttaaatacactcttatactctgattaagtttctaacgtatgtacgtaactcaaaaagttacttattaaggaagtaagaactactatattgtaagaagaaaaaaaagggtgagaactatttaaaatagtttattaaaatttaattaaattgtatagatttgcgttaaataagacaactaattaaataatatcacgcttataaaaagtttgaatgatgccatattttagttgtttagttaatgtcgtgttgctaattgctatccctttgtgtacggagatgtacactccatggtgagtactcaacttcatgtaattggccttatgtgaaggttattgacaaaatttgcagacaagtaacaagttccatgacagcaaagtaacgaaaagaccaagtgatcgatatctgagactgataaattagcattattagggaggatataatattagattatagaaaatttgtttggaaaatataaaaaacattatcaactgctacgtcgacctaacagtggagaattaaataatatgtatgagaatttaagtgtatttcttccttatcatcattgtactaaagaaaaaaaaaatacggcaatacatttactttatgatgattaattgaaagaaaaaattgttgttctaagtatttttttataaatattagtttattagaatattaattttgttagcagaatatggaatttcttcatgttagtctccatctaagtatgtggatcttcaattcatattaaagatatctatgagatatattattaatgttttacatagatttcattatcttggaaaactactttttagttattcattgaaaatatatactctagattgaaaaaaaaatacatttattccttaattttagtaaattaagattataatatcttatattaaattggaatgttttttttaatggtattacattgaaatgttaaagctagataagtcaattaaaaaaagtcaaacaagacacccttatggcttatctgtgtcgggcagcccttatctttagataatacaaatgcaaattggcctagaattttcgtaatggacaaatcagacagatcttccatgtttagggatagttagctcatgtaggaactcgtggtttatttatttatatggataatcatggcctcaaagcagggatattgtataacacatacatcatgtgacaaattcagctccaaatatataaatgctccaatataatgttccatttttctaagatatgatacataaatgctctatgacgtgaactatggtctttttatttaaagatattttaagtatatatattgaacaaagctattatgtatggtgatataagtaactaagagtatactcgcaatacaatacgtaatacaagtgactaatactttggatcattcaaacatataaagagattcaattcctaat

SEQ ID NO: 4864 - DNA, 1100 bp, Glycine max
  Soy_ogl_1856 Gm06:8356801..8357900 Cluster 20
tctaatttttttttgtttcaattcggttcctttgctcttaatttaaaaaattttactttgattttttaaaatgtttttcttagactaaattagtcttttggttagtttctcacccaaagatcatgtttagaaatcaggtaaaaaaattacttatgagacaaaaatatttttagaaaaggatcatgatcattgtttttgctttcattttattttattcactattttgtattgaaacacatattataataattttaaaggtaaattaaacatacactaattacgttaacttaaaagacacatgacaaatcatgaaagatattataccatatatttgatacgtcagtcaaaattaatatcataagcataaaaaatatataaaatggttgatttgttctaacaaggatactttcagaaactaaagtaaaactttttcaaatttaagaaaataaattgaaaaaattagataagagactaaagttatactttaacctaaattaaataacttctacttttgtttttttttttaatcaagacaatcgaccgaaaagaataattaaatgagacgtggacattttaacttaaaccaatagaagaaagaaaatgaattaaagaatcttcatgtccgaagagtagcaagaccaagaccataacccctatgtcacaaaggacattttgaagcgcattggattctacctttgacccaaagaggttcatgcattatagcatctcttgtataaaaatcaaaagacactatggcctacggattctacccttcgtttgcaaggttggcagccaaaaagggagtgaattaaaagttgtatcagaaactatatatgactaataagttaagacatatatattggaatccaagagacattggaacttgtaaatattgcaaatgtaatcaagtattgctacctcacaatttatcttttgtattaaattgagggaaacacgagatgattgataggtttgttgagtttatattttgctagaatttaaattgatgttaaaaaaatggattaatgttgtttgagaatagaactttaaaaatgaatttgataaaattagcaaaaaaaagttagttaacgacgaactag

SEQ ID NO: 4865 - DNA, 1566 bp, Glycine max
  Soy_ogl_5282 Gm16:4129001..4130566 Cluster 20
gtgccatattgctgcgcagttcccccatatgtcaagtttggcattttctctagtaccccatacaagctgattaaaggctttgtcctttcaattataattttctcattataatttccagctccaatataatgtacaaaattacacgcttggtgttcccactacgtatgttgttaatggcatcagtgatggtcttgaatttcccacttccatcttgcattaccttcacaaccttaacaccttcttcagcagccaccaatgcggggtccacagttcttttttctttgatctaaaggccctatattagtactaaaccatgtgcccaattgttacttgtcagcacgaattgacacaatgtcatcaaagaaaacaacttgggttgttagaaaagctactatgagagtcacctgaatggtagtgcatatagtttttgaggccatatttccaactttttctttttggacttgtcttataggtgataacaattgtaatttacaagaaatatatgaatggagagattcctaaatttgagactttgttcattttgagaggagttagtttgaatcaacagtcttttgttaggaagctaaaattaaacaagggatttaaagttgattggtgttttaatttctaatcatacaaatgtgtacctcgaaattgaatacaattttacataatgaatgtaggtcatgaattaataagaaaatattgattggtaatttagcatggatcagtaggttgtcgtgatttagaatatttttattttaattaggattcatttgtttgtattttagcattaaaagataaaatttactttcatttacaatagtagggttgggggatagagtatatttactttcatttgcaattttgagctttgaaattttgattatagttttaacatacaataagaaacataactctactatgattgatgattataatttttcaaagagttgaaaatatatatttttccaactttttttattattgatcaaaatgtattaaattgttaagttatctagggattgaaaggaacttaagatctcttctcctatgaaattagagtttgagtgatttttcattattaatgtcaacatggaagtgcaaaatatgtttttaaatgtgttttgagggaaatttaatgaagtctaactgcaacaatgatcatcatattcacaagatcctaatttttttcgcatcacttattaaaaataaaataaaaaataaccttttgcaacctaaataaagaaacgagaaaagcaaaaaatcaaccttttataatgtagttaattcaatattaattgaccaatagactaagagcagctaatctcttcattatcaagctcattctttaattacaaggtgattaattttttatttatatcttttttaagattacatgcataaatttataaacatatatttatatatttgtaggtattataatcataaataaataactaaagattgtaattgagtttctccacatcaagatatggaactcactcatgaaagagttaaattttttaaaaaatgttctttcttaatttggatgtaaagagcaat

SEQ ID NO: 4866 - DNA, 2187 bp, Glycine max
  Soy_ogl_4290 Gm13:26910214..26912400 Cluster 20
taaaacaatcgagtttaaaagtactcaagtgctcgtgcatgtaacccaccactaggccacagttacatgcatcaagtaacggtataaagatatatataaggttacactgtctatcgacacttatcaaagagttatattatcatttatactaactttttataatactctgctctatttcttttaatataatttacatttattttgtctctcttttagttgtaaaaataattataaaaaagaattgtcagtataaatatttcatttatttattatgaatacaatggctaataattaaataaataacactatttaagttgaatagaaatattttgcaatagtagagaactagagatgtcatctcagtacttctttatacatgacttttattattataataattttgcatcatgcatgtagccttcttttgaaatgttaggtccacaattatataatattgtctcttcttttgcaaacttttttcccaattggatgtggaagttcagtattaatttgttttaatttctgaattcggattacctaacgtatatatacccagttatgcaagttgaagttgaagtagtgcatcattgagatgcagtactagttttgaattttgattctctgttagcccctggcgttgcctttttgagacagtttagccaacacctgtcatatatatacttcacgggccaatatgctaatcgtaataagaaaataaataaatatgttttattcgcgtcacttttatttcatactccttttctttttcctgaattttattttgtactccttttcattctatataaaatgttgaatcactttataagaaagaaaaaagaaaaaaaagttatatttaagtgaaagtagaaaaaaataacgtaagaaagtaaaaactccaaaaatagaatatcatgagtaaattcataaatacgccactaattaagtaaaaataatcacaatcataaaacaagtgactacacagtaaaagaggcagatcgagtaagttaaattttattgtgataattactttaaaaatatatattaattgacatattgattatatatataataagattattaatatttataatagttattttaaaaaaaatatttaaaattatttctaattaatttataatgaaaaagctttacactaactatatattacaattaaactcaacttattacagatcacataataatatggtatgtagaaactaaagtcgatgttctatttgtaatctccttattctttagactactagactgtagtcatgcattcagcattctttggatatccttttgggtttattattaacatgcttaattataacctttttttagataaatatttaaattaaaaattgaacaatcgtattagaaggaaaaatataaaatgtgaattccatttgtttgaatcgacatccatgtattataaccttgcacagttgcccttcaaaatacatttcaaccaatgagggaaaaaactaatattattagtaaattacacccctttttcaataggtggtttattcaaatggtacatatttgatccatgttatgaatgttctgtacttatatggcacaaacaaaaattacacctctttcttacaaaaaataatttacacgttatcatttcgaatagcaagggttagtttcagggaaagttctcaaaattaaatttcaatgagacaatggtaaaagattggcaggaagctagaatagactgattcatcaaaggcaatgaaaatgatcaaattgataagtgatgagaagatgagcacgtctactcaaagaagagtcagaggagaccggatacattgtagtctattgtattgtatgtcgtgaattttctgtcaaagcctcaccttttgaatggaaaatattttttttaattttttaatgttttcttaaagaatgctcgcgtgaaccaaaatatttcaaaacccagtattgataaattctggaagaaacaaaatatccaactactgtattgaaaaaaaaagccatgcatgcattatacacagttttgtaccaaagttgtatggcaatgttcgttgtatttgcacctatgggcgtatattattgactgaattgaatttgcagacttaaattcgaaaattaatccaaacagaaaatgactttattacattatattcatcaaattgattcacaacttatgagtca

SEQ ID NO: 4867 - DNA, 2000 bp, Glycine max
  Soy_ogl_4313 Gm13:27761101..27763100 Cluster 20
gatagacaaagtagcagaatgcgagtaaagttaatggtggatccaacccatttgagtttgttccaaaccacacacattattgtcatcttacacttcaagtccacctagctttccctcatgccaccatctcccacttttcttagtgtcacaatgctttctctttccaaaccgtgtgaaaagggagtactttgcagccactttggggaaaaatattttcccactgtggaagtggctttttcaacttttagtacaaaccctctagtttcctactgctgtgaatgattagtggaagcagatttggggaagatccctgtgcatgttcattattttaatctgaatagtttaatataaaaatgtttgtagagctcattcttttttacatgaaccaattataaaatgagatatagttagctgtatagtgtagatattccaagcatgacctttcaccaaatgttttagtaaatgattaatcatgattcatatgcatattctaggaactaccacccttcttcttctggggcctaaagagaaaggctatgccaaaataaacacacacacaccaactcttatataattactttagtttctcttttttttttttcatgattatttcacatattatgcaccaaccaattagggttgttttgacaagtgtggaattaagcaagaagtttctcagttaatcacagacagaatctctctacgcgtttgaggtttttttatgtcaccgctgaagtgagagtttagtgattcaattgattagccagctaatttttgtgcatggattattattattgttttcactttcatgagaaaaccaaagaccattgtcatttttaacaatcattatgaaatcaagtctggccaagacggttatggtcttgatgctattttgatgtattatcgtcaagaaaatgatgggtcggggaccatgaattgtttcatcattgaattgcctacctcgtgtcaacttctgcgtcaagaaaatgttggattatatatatatatcacaaattggcaaggaaaataaagttcttctcggtgccttaattaggtggtagcattggcatagcgtatgatttttttatttattttttatgtttaattagtgatttgattcctataactccacaatctttatgttttggtttttatacttcaaaattatttgttttaaactatatatactttttagttgattttaatccatacagataaattttgttaatacgttttagttcctccgattttggatggctgagactaaaatgaattaaaatataatatatgtataataactataatgagtagtttctaaatatagagattagaatgtaaatattttatacaaatataagaataaaataactgattaagttcttttaaaaatgagtataattaagtcgtaattttacgtcttaaaatacatttttgatttttataatttagtgttttttttgtattcctgtaaaaaaaaacttcattttaatctttataagatgtatttattttatttttcattcttaaaatattttagataacattttaaacattaaaaaaaatactttaaacagggaaaaaatgttctatataacaccttaaagatgaaaaaaaacacattttagaaggaataaaatgaaaaaaaaaagatgtttacaggaaaaaaatgaaaaaaaaaactaaattataaggataaaaaatataattaaatctaattttactttgtggctcagaatatcggatttgacgtaaatgatgagcattttctaatcccatcacccgatgtgtcccaatatgggactcttccatgtgttatgtgactcattaataaaagtgataaaaaaaaaattgtgctaatgatgtcatcagggaattagtgtcccacacacaatgttgccccaaccacttggcatttggaaagttaaagagtctatgctacatacatcccaagttaccattcaagatcatagactacaaaatcaacttttttataaaatata

SEQ ID NO: 4868 - DNA, 1600 bp, Glycine max
  Soy_ogl_4983 Gm15:11082001..11083600 Cluster 20
gcgttgtgctcaattacaatttttgtattttttaaataattaaaaataaagaaaatgtaaacaaaatctaaagaaaaagaaagaaaaaattattcatttgatctctataattgaaaaagttttatcttttagtttctacacttaaaaactcttcattttaatttctatacaggcacttttagatcttttttagtttttataattacataaattttaccttttaatccttgtcattttataaccccaggaccaaaagagatccgagagatatcaatttaatttctcaattgtgatttgtacatatatagaaggatattttgtttgtcacttttcatgattaagggactaaataaatgttatctatctctcatcgataaaaatgatataatttaaaattttgtaataacaataaatattactctatttattagtccaatcaatacaattatccagtttttttttctgaaattgcttggatttgttattatcagtgtaaagacgagtaatccaaattagtatagtaaaattgttgaaaaataatgtgtaacttcctcacaccacaggttagtatagtaaaacaaatcaatttcatttgagagaggtcaaggtgcgcgttttatagcattagaatatctaattatagtttacgacaagacatcacataaaatgatattcttgatacacaacagcattcataagtaagtaaatagtatgttatgttaataaaatgaattaattcaatgctcgtggcacatttttctactcattttctatacctaacatataagtatacttagttcttcttaagagggaagaaaatacacgctttgcctttcaaagaggtcaaaagattggggagacgaaaaagggtcacagttaacaaaccaatgtagacaatttgagtcaaagacgcttttcgacgtaacaatacagagggcaaagattgatagtataaaattttcatcatcttataagttatatatacatacgagatagatatttttcaatttgaaatgtacacatacatatgtatagtgactagttagtattcggattagatgtgatgaggaggataccgtccaaaaagggaaatgtcaacgcaatgaatcctgaaaacccggctatcttttgacaagaagaccaagaaactatggatggtgtcactctcattgaacccgaaatattctatgtgacatggatcccaataacgcataacattatgaaattaataattttgcaaattgcggtaattattacttaactagaataccccattgaaagagttgggattggcatagatgccttctcatggtataatccatatggtcaagaatgctgttatgtgaagaaatttttctcactttgcttgagaagctcttgtttcttcatctttataagttgccacttactaaaagtgcatgtttcttgcgcaactagtgctaagtggcttagtacaagttagttatataatatgcattatcttatatcttatgaggcatcgcttgttaatgataaaattaacgtgggttaggcgtgtttctctgacattttggaaggagaaaataatcaagtttaattacaaaaacaaaacttaacaatt

SEQ ID NO: 4869 - DNA, 1463 bp, Glycine max
  Soy_ogl_5961 Gm18:6277638..6279100 Cluster 20
gttataataggaaagctttttttttaagcatacactaaacactaaaaaaagggagaaagagcatgatgtaagcagacactaaaaagggagaaagagcaagacgtaagcagagactagctaaaagggaaagaataaacatgaaaaagaatcgaagctagctagctagccaagtgcggctatgatactactagctatgatactcttactcctatttaatcaacgttcgtaatatcaaacgacccccaactaccaatactacctgattttgttaattcccatcaacacacaaatgaagcataaagcttacactattctcatggccttgatgttaaccgcagttggtattaagtatgaaggctcaaataacaaccccttccaacattcaagcccaagtacatgtggttttcctcacagcaatgtgtagccacgtggttgcatccacagctgaaatgagcttgccaaccactattttcatattccacgtttctggaatagttgcatgtcaaacacttatgtgggttcttgtatctgaaattttatggtggtacatcatcaacgtgcttgttttactcgtggcatcattctgcttcaactacaaggatatcactgagctcatccgtggtacacgccacccgccaaattaatttcgaagcctaggaagctcgcgtggataccgtgttatgtagcatccatgttctcgtggatcgctgaaatcttcttattttggtttagtatgatgttctgtttttatagattagaagaatcgatctaatgcttagggacttaatttatatgaaaaatgtttggtaggttacaaagtctcatgttaattagaagatgacatcggtgataatttataaatattctttttctttaatatatcgaaacattttttttagtaagaacaaaattttaatgagtcatcgaataacaaaataaataatgagtgaccctaaccgtgtacgagaatttatgtttgaaacagaaaataaatgccttccaatgcgcctcttgttgccttttttgactaaataatagatatactaggtttataagataatgaatttttcaacatcacgaattcacgaggccaaaattcctatgacattttatacagacttccaccgctaatatattgattagttggacaaaattctagctgaatttagtattggatacaaggccttgttatttaaaaaatgtgagttaaatttgataaaaaaaaaggttgatatatcaatagacaatctatttaattaaaattaacagataattaattttaaatttgatgaaaatttatatattaatagacaatatatttagccaaagttaatgaccaaatgaccgactacatgtcataaccaaaatttgtatgcatatgaccaaatatacataagaaaccaacacttgaaccaaaacaagtaaaatttatattaattagtaaattaatataactctccaga

SEQ ID NO: 4870 - DNA, 1649 bp, Glycine max
  Soy_ogl_4283 Gm13:26532001..26533649 Cluster 20
aacattgttctaaaagaaatctaaaatatatgcatgttttttttatatgtataaatggtataacttagagaatctgttaataataacattcggggtattcgtaatcgtagccctaggattaagggttttttgtgcagaaattaagatggccttgtccgggtctaaattttaactaaaatcttattattcaattcaaaaaatctaatgacgtttgtgtatttaattaagatcgagttttaagtaaaattacaccttacttaagagatatttagaccttacttaagaattcggatactcatatgagattagagcgagatacagtgatgataataactcacatattaagagctcgcgttttattgttttttcattttcctttccaaatttcctttattacttaaagaataaaaagtgctctctcactcacacacacacaaaaaaaaccttgagaataaactaataacagacaattatttaacttttttttattattctgagacaattaaggcattttataaatttacaataagtaatccacaataaaattgatatttgatactgcaaaatcgctacaatgcacaataacgtacacctactatcatccacatgagaggataattaaaattatctgtcattttaaagtatgtttaggagcgtgattttgaagaaaccattgaaagttaaaatttttatttttcatgaagagaaatgtatattatttataaaaaataaaatcattacataaattttgtaattaaagaaaatgataagataagcagcctaatgtgccctgtaattgtatttgatatttccataggaacttggttttatttttcttctgaaacctaatatctgtagataaaaaaccaaacaatttaagcccaatattaatgcaaaacctgtgattagttaagctcaacgagcagcgaatccattctcacgcggctcattattatgaaagccgaaaaataaataaaaattaaattcttcactaaaattgacgatgaaaaactaaactaaaattgatgaaaaatatttttattcgaattccctttccttaatttttctttgtcatgtaaaaatttaattagaactttaactttagaatagagtagcattactatttatgttttctttcgtcaaacaccaaaaaaaagagaatagactagcacactcaccaaaaaaagattagattaacaccttatactattttttaatcataaaattttatgaatgataatgttattaatttttttaataattattttaaaaactatatataacgtagacttttataatatttttctaattttttttcattgtcaagacaagcaattttttctatagatttaaagtatatacgggggcacgtacttgaattttttgagaaaaaaccatttcaaaaaattagttgttatatcactattcatatatgcctgtcatttttgtagaaattcaatttgggttggataaccgttttagaaaaaaaaaaaaatacatattcaacaaattcttattagtgaatttttactattttaaagatatatcaattaatcaataagtcaaaaaattatcaatttaaatatttttttatttgggcagatatacatttatcataggatgtagaggcgtaataagttgatactgat

SEQ ID NO: 4871 - DNA, 1474 bp, Glycine max
  Soy_ogl_2204 Gm07:5125402..5126875 Cluster 20
aatgaagtatgagtatgttttttagataatttaaaaaactgaggattatttaactgttgatttagaatttacacctcctttgttgacgtataatgagatatttaatactttacgagttttttaaaaatattttttagttgtttgatatttaatctaacatgtgttgtctattaaaaaaatgaataactgattcaattcaattcaaccacgaaaggatcaagagtgcatttgaaacaaattatttataatttattcagattgatcttttgacataaacacttgtataagtatttaggagagtgtatataaaaataacttatggcatgttcataagttatatttagcttgtttcaataagttgattacgataaagattatataatgaattatcaaatgaccatttgactgcttatttgaacaggttaccttggctcataatataacctagctaatgaagaattgtagggataagactgccacaacctcacagtttcgtagccatgcatgtttgtaactgcaagtgtcctcgctatgctatttccctctattgtatatcatttgttttttgtaacttacaattttatatagaagaaaaaacatattttacccttctttttttaaaatattttgcaatgaaagaaaaaaagaagtaaagaaccttcataatatgtttttctcctacaatctactgacgaaggtgttaacccatccatgagacctcttccacaaataatatggaccacgaatggggaccgtttccaaaatcacaatcaaccataaaaataacctatttattaaaaggagggaccataggaaatcaagcaaccattacaaattccttttgcatatatatcttctaggatgaaaaaatgcttcaatcttatgatgaaatgttttgtggacgaaatgcaacagtgtctgctctcctatatatcaaacaaaatagtacgacattattaggagatgtcatgcgatgcttcaatttttcaagcatgatgtattatcgagagaagaaagatcaaatacatacacacgagataaaagaaaaggttgagtcttacacatgttttaatatgccaaattaatatatacttgtatgttaggttttatccaaatcgatattaaattgtttagaagataaaatacaataactcaacacacacaggctaaatccaaattaatatatacttatatgttaggttttatctttcacaaaaagaatatttcaaaaatatcatttaaccaatgatttcaaaataacaatggaagacagttataaaggtaaagaatcttgaagattagctgtcaaatttaaatctcttacagattttcagagaaaagtttcagttgcaaaagtaggaatcttgattccaattccacttccttttattttaaagatctagcgagacaactgacttttagtggcggagtagtttctggcccttcttagatcctatgcataataaggacaaag

SEQ ID NO: 4872 - DNA, 1755 bp, Glycine max
  Soy_ogl_2643 Gm08:12853401..12855155 Cluster 20
aatagtcttgtgtcatttggtttatatgctcgaagatatatcaatttaatatattaaaaatataatattaatgcaatagtatgatatttttgtagaactaattaaaatggatatattatgtttttcacaataagatgaaatccttcatccgagctatgagatattttatttttatcttttctatgcatgtaattacgtgcttttctaagcaaagcatgtacaaaatagtatttccttttttaatataaaaataaaataaattgtaatcttacatctcgaaagccatacataattttattgtgatgaggatattttaaaattaggtcaatttagttttatttttaaaaagtgaaacgcaagactacttttgtgcgcaataataaagctaaaccaagatttagctaaactattttgagtatgaatttcttgaggctagagcaagccattattatttcaaatcttgttagttaatcctgtctacttttagttgtttatgttgctaattgctggtcttgatctaacattcattgattggatacgcgatcgatgatgatgactagtcttctaaacagtatgattagatcatagaaacaatattagatggatccacctttgtccgacatccacttagattataatcagcgcgtatgccaccgcgctataataaagtaaagccaaaatacaatattatctagtcgtatattatactaatagcatgtaggcattgttaaaataagtgaaagaatatagcaataacagccttggaaataaattattagcaatgctgcagcatgtcacttcttgcaacatgctgaagatactttactctgccgctttaattttctgtacatgatcgtaatttaatacatctgctttacttacactcatgatttagagacggttaatgtacttttccttataaggtccatatttatttattatttcttgtagtcagaaacccaagctctatcaaactcatctctgtctctctcaaagatacacacacaacacaaagagagtaaatcacaaattttcaattaagtaatgttcttttaagtcttaacattattttttttcatctattgatgtgggttacataatgagaggctaccctggcctctgctttaaattctgcattctttcgtaaaggcaaactgtaaccaaagtctcttaattataagttatattaatgcaaaaacaaatactaattaatatcgtattaggacatgtgtttaattcatgaacggatattcgagttcgcaggggtccaattaaacttccattgagccatttatgtatttacatttagacgtgggactcaggacttacaagatcagcatgcctagtattattttaagggttttacttatatcaataaccttaacatattggttaagaaattaaaaaaaattattgtaaaaatcataagagaatataacaaaataataaacaaaatatttttatgtatttcaataattttttttttctttttaatttcttagtcaatgtcttaggaacattgattattatttatctatttttaaatatatagatgtgggactcatttagaactaacatgacttgtgtgctaaataggtttcagcggattgaattgaaattagtttcaaaagtgaaaagccatttgatttaatgatttcgagtttttataattatcatctaattaattatatattagtttgaattttaaatccaatccaatctaaaacgatttgaattgaattgattttctatttc

SEQ ID NO: 4873 - DNA, 1225 bp, Glycine max
  Soy_ogl_793 Gm03:1638459..1639683 Cluster 20
tttattactaaagtatgttcataaaacaaatttttgggcaataataatattatataatgaaattttcaaagtgtaattaaatgaatcttcttctcttttttttacattgacaataaaaaaaatttaacctaaaacgtcatacatattacaaaactattcctaatgagttacaaaactaagggtgatcttgaaaggatatgcacaatgttgcagcaaaggaagttggaagctaggaggcaaaaaataatcatccacgttaactcctataagataagatattgttcttagagctcaaacgtttataaaattatatagattcagtgactaacaatgtgtcatcatcgcatattataataatgaaaccacatacacaatttactgtacgtccaccttgaatatgttaaaattaaaccccaattaactctgatgcccttctcatgatcattaattccgctacaagaagaaaaagaaagggggcaagaaaatctccttgcatgagtcccctatgcatagcaatttcttcggatataccatcaccattaattaataaggatttgatgtatatatgtaagtgatcccactagctagaaaatgcttttttattgttgttgtggatctgattacaatgttgtcccatgtaattggaagtttctaacattattcattaatttgagagacagcatgtcagcatcgatcgatcccaattcaaatgaatccaaagaagaatcagcctttggtttcatgttgtgaatattcatgtccataaagatgtatcaacagtgcatctatttattttcttgccccactgctgcgctccaacaatggcagctttatatatatatagactttataatggattccgcaatctgcatcctttaatttaattaaacggggcttaattttattagatactaaaataaaaatcaaattaatttgttattttatttatttatttttgagaactcaaaatccacagttactatctacttactatatatactactttagtctttatactttttttttgcatatataatactttatactttgtgcttcgttttcacgtggtgaataggatttagaagcccataccatacccatgtcattctttattctcttctctaagttgttgagtcttgtattaaccattgacttgttttcaatgaagttttgtttttgcaacttatgttaaaattttcttttcctgcttttcttatgaaaaatc

SEQ ID NO: 4874 - DNA, 1400 bp, Glycine max
  Soy_ogl_3132 Gm09:36586301..36587700 Cluster 20
aagatatataatatgtttcgaaaaccgttcgttggtgctaaacatgggttgttggaagtaacaaaggtttgctttttttttcaaacacgtaattttagaggttgttcattggctttccgaacatgcacatattcttctccaagactccaagtatgcatatgcataatttatatcttctcttatatggcaaaatattatgttaggtttgaagcatacgcgcgtataccttgcattggctcattttaattttgttctaaaattcaaatttcatttttaaaaaaggatatataatgaggaccaaatcctattcactaaatcacaaaaggaattgatgattaatattctcaaaagtttaaattgttaggtaggaatgaatttcttagttattacatgtccaatagaaagtaagacatgcactattaaattaaaggagaaagaaaagagaaaagaaagatgtgccctaaaaaccactagttaaagcctaaaatggtgtatgctgtgaaacttgagcatgtcacatgaatgggatgggtccaacatccacgtgagtggtatctgagtttttctctcaaatatatagctctcattgaaatttctgtaagcaaattattttatcttgcttaatttttttttggatgatttttatcttgcttaattaaagagcattcataagtagtttactattgctgatgagatggcttatggaacagttggcaaatagccaaaagtaccacagaagcaaaggaaattcaatattttgaccttgctattgataagttaaattttaaattcatttttaactgctgatttggaccggaaaggagcaatgaagtctaataaaatatttttgctataggtagttgttgaatgttgatctccactcccgtgcacaatacataattgaaatgtgctttaaacaagagtgatctaacttcattcgaaggaaaatcatgtttttagaatgctagttgaattaagcaaagtaataaacgatggtttcatcatgacaattgagtgaaataacttattttctggacttcggagtcgtggtgttgagataagcaacatgtcactcttctgataattaaaaatatttccatatatgcatcaaattaaatatcatttggaatttaacttttgaatatctaattgtattaaatattttaattttttttatcactcatgctaattgacatcatttgatttgaactatagaaagattttacattagaaattagtctaaatataattttgtgcataattattataaaattatcttacgtttgaatttatatttagataaaaagtcaaaaacctacccatggacaatgtatcttgattaaattcatagcaaacatgcattattgtatttaagtgtcaaattagtttgcaaaaaaaag

SEQ ID NO: 4875 - DNA, 1700 bp, Glycine max
  Soy_ogl_5454 Gm17:1944101..1945800 Cluster 21
gtgatgatattatgatatataaatactataatttttatatagaatatacttgaaaggaaaaataagtttaacgtgctattaaattatagattatagattggcacttatgataagttttttttttgttacattgctatttatgacaagatggtgactttgatgatgattattttaaaagttatatttataaataaattcttaattagttgacaatctaaaatttagtgcataaaaaataaaatattattaaagttggtaaataaaaaaaaatattctactaatatattatttctttgccactagcgatatttacaaattagatttactttaaaatcttaaagcgaatgcaatacaactatgcatccttgggaatatgttttccttttgtttttggaaactcttccatttgatattgctaattcaatttgtaatttatcggataagtaaaaacagaagaaatagattattggaacaaattaggtatagttgtgaccatgatattgcataagcataagcatcaaccatatactactttttagagccgtaaagggcgtggattctatacatcatttgaagtcaaactgcagatgacagctccatccatcgctaacgcggttctatacatccaaaacaaggcactagctatacattactatagcccaatgttgtaacttgtaagcctatttacttttaactttattaaaattaatcttttaagttattcaatatttaatttactttttacgtgtgttataataacgaaatcagttataaatatttattattaaatgaactcttgtattatctttaaaacaagatttatttgtctcttgcgtatattttctcttacggtgttttctacataaatctacgatattacattattcctctcttctatttttcacactaactgcataaaagaagtaaattttactaatccttgtatgtttaaccatactgttttattcaaaataagttttctaaaataaacaggatttagaatctgttaatttgtcacctatcatttttttagatcggaaaaaattatattagttgtaatggtaccagcagtacctatcataacctcataatttcagctctttcttatttatacccttaatattatgataatttttttccttgatcccattttaatttagaataaactctcacccaattgatctttaaaaaaatgaaaaaaattcaaaatcaagtaaaaacttcaaacaataattaatcacctaaaattttattcttgtcttcggaataatatatatataagcatataaaaaattcataatgtcttgtatttattatatattttaataactattttattgaatatttataattgaataagttaacaatttttagctaaaaaaattaacttgtaactatccaacaactgtatagctaggcctaaaaaataccccttaaaaatttgtatgtgaataacattgatcaactgctttttatcaaatatgtctccggaaagccatagcccttaaatatttttgggtgaataatattttcattgaacaataacctcgcaccaactaaccatttttttaatcgttaaatcaaagtgcgcgtttagtttaggtgtggaatagacatttaaaaagaaaagattaactgaggaaaaagttattttcagcaatcgatacatttataattatttattgttacaattaattgta

SEQ ID NO: 4876 - DNA, 1800 bp, Glycine max
  Soy_ogl_4809 Gm14:47716901..47718700 Cluster 21
ggcaactcaatgtttaacacaaacatatatatacttagtcctcagtaaaattataacaagaattctttcagtgagtgattaagattacaattaatcaacttagtgttatcaaaattatttactaatcctttaaaagaacagttattaataaccaaggatcaaaataaattttataggcatgagtagtacgtagaacaaaaggcacctccaatattatacatgatgccattgaatgttgagactacttgtagatatttacatacaagattactacacagacttaaatataaacgatttcacccaattacaactcaatacgacgaaaaaattatttatttaaagagagagaacctaacttaacaatttttttctaaagaataaaaccaaatatcgaaatgtttataagtattataaactaatttaagcgccaattaaattttagagaacatgtaatatcatatttgaattcaggttggacactaagtaacaataagattttgttaaatctaccatatataatgtaaaaattctacggttttaatcaacttcattgatactactatattatttttatttatcttattataccattgttgttatttttaacatagaattccaatttcttctttattagctaggctacataaaatattgcatagagaagtttggaaaaagaaactcgatcgtggtcgtggggtttggttcattaaggcatatttgctatataaagaatacccacccaacccagcacaaatgagtatgagtacgtgatacctatctatctatctatatatattgaaagcaaagaaaaagaaagagccatcctggctcgtgtgattttgggttgaaacatgcacgcaaataccatataagttaacatcgcattcaattcctttttttgacatgaatattattatataatcttggtggagccacccttccaacatgatccaactccactaattctcactcactaattaaccccaccatatatagttccatgtcttcgcatcaatcttcagttgcgtttcataaagattcacagatagtttgattctccagttttggtaatggtgtggttgctcccaaataaaatgtcacccatcttatctatccttttaatgcgcgcgcacacacacagtaccagctcttcttcaatcaaatatatggtttttgatatgcatgaaattgggattgctgtttataattataatttgaactttcccagaattagaatcggcttagaatcataatttgtatgtttaggttgtgacaaaaaaaatagtgttttgaacctttaattacaatttttttaatttccgtgggaatggaactttatatcaaagaatttataacaatttatataagtaaactaatgtttggtttgagtaaaaaaaatatatattccataggtaatggtgcatcaatcgaacaaattgaagcagtggtaaaggtagtgatacttaaatgataacaaatgatgataagagtagccataataaagatcattaaggggatcacaatactatacatataagattgattcaataattaaagatggaaaaaagaaaaaaatagatgatgagtttgaatttttcaccaataaaatttaataaattaataattaatattaaccgataaaaaaaattattaacatgaaatatgagtttaagtgtaagggtgaattcaaccctcaaaaatttaaatttgaaatgatgtcgatcatatatagtagattttctttgataaagaataatcatcggatatataggtatatgctaatttaaatttaaatgtcac

SEQ ID NO: 4877 - DNA, 1320 bp, Glycine max
  Soy_ogl_5438 Gm17:1220833..1222152 Cluster 21
tatatgtaattaccttatctatataaaataataaaacatagttaattgaattatgcacttaaaaataatctaattatttaaatttaaaatattttttaatactttaattatgttatttaacatttccctttgtggtttcagttatataatctaaatactaattatgccaattaaagcgaacataattcattatttcgtacttgtttctagtctacctggtcatctgaaaaataaagtttgtttttcttctcaaggaaactcacgcaattgagtcatttatgttttttcttaaatatatttatgttctctaataaattattgaattttattttgaattcttgataattttattagtttttgaattttttatatattaaaacttttattttgagtcattttagtttataagatgacatgtcatcacttaattgataaaaaaatttaaaacaaaatttttaatatatcagaattttaaaataaaaaaaaattattaagtacctaaaataaaattttgatcatttataatccacattcaatatattcaaatttttttcttataaatgttagtaacattctcctttaagactttcttcccaatactttatatgttattggttaaatttattgatatataatctttaaatttgatgaattatatatcgaaattaagagaagaaaattattaaagaatgaaccaaactcacctaaattaataattttcaattttagttaatcacacaaagaatataaaaaaaagtattaggaacaatattaataacatttttttttccaaaacataatactggctatcaatatgacttcagttaaaaaaattatggttactttccacagtttatgagatcaagtgcaagttcttttttgaaacagtaaataagtcgattaaaaaattaaaatgatcctctattttttaaaacaaattattgttctcatttttaaattaaaattcatggcctacaatgcaagcattattatatttaatgcaacagaaacctacgagtaacatattgggtccaccagctaccccccccccccccccacacacacatatatatatatattgattgctaaagaggcgtaagaaaatattggatgaaatgaaatagtataataacgttggtttgaatcaatatttagttatttgcctcctcaactggggatgattgaaaattacatttccattaatttctttagagataatacatttccattaaaaataagtaaaaagaagttaatatttaaatatagggttgattaagtgttcctttagtttgatatcaattctccaaatcatagtatatg

SEQ ID NO: 4878 - DNA, 1122 bp, Glycine max
  Soy_ogl_3285 Gm10:710801..711922 Cluster 21
ggagattatgacagtttacatgttcaatcaatttaataaaaaaaaatcaggaataataagtctgtttacttttataataattttttattgaacaataattatcttaaaagctatatttgatatatataatttttaattggttgattgtggatgtaaaatatttatagtaacaatgtttataaattaaactcatttaatattataaatgtatttatcataaaattatttattattagatgatatttatgttggactttttaaatgttagacaaaaatatttgaagtttccttagtatttttgtatattcgatctatacttagatggttggaagaaaatttaaaattttttcacttcctagtgtagcagttaatttttttttctacttgaattcaaatttcttttgacatataggggagagagataaaaaatgatatttttgtttatttttccatgaaataggtataaaagaaatggcataaaaattcaagtgcaagaatagcgttgtttgatgttgaaaaaattgggcacaaaagcgtttggcacgtgatggtgaagggagcttggctcttctgctccacgttgaaaagtagagcgtccattgtatttggatggtcaaggaggtggctcttgcacgtttggatactcttttactcttatgactttaatcctctttttccccttttgttgtttctgaattccatatacagttatgaactcacaaagaaataacgtaatttttgcccctggaaaaaggaaatgaaaaggaaaagagaaaaaatcatttttttttgtgaaaatgtcaaacacgtggtgatctataggagcattgccttaatggtataggtcattatgtttttaaagaataaaaagatgagttgagttgaaactcatgacttatcaatgtcatagtatatcttaagactcactaaatgttgaaaggaatatttatagatcacttatcaataaaattctcacaccaggaacggattcaaatccacgtttttataaaataagttcattttttttatcaatctttattgatctactaataaaaaagtagttttatatttattttaagaaacaagtcctaattgttttttaagaaaaatattttttaaaaa

SEQ ID NO: 4879 - DNA, 1900 bp, Glycine max
  Soy_ogl_3669 Gm11:624301..626200 Cluster 21
aaaatttaaattaaaaaaataagagttaaagatacaattgaacctatttttcattacatcaattattttatcatattttttttccttctctcactttttgttgcatacttatatgtaattttctcatataaaacttacgtacagatacaatatctccatgcatagatcactttcatcatcgtatctatgctttttaaattctcagcaatatacctgttatatatgcacaaacagaaggtttgatgatcccattctttttatttctttactatttcagctgcatatatttgtcgtgagcgatgttcataatattcaactaatttaattgcattattcgatcatggatattactggtcccctccacctttaattttcaaaaaagaaaagtgagtggggttcgaatcaatgcgatgatttgcagtaatctatctttgttacgatccccccttttctcataatttcataaacaaaaatctaaactgattgcgtttgtttctatatatccgaagtttttaactgctactaatgtatatatatgaacaatcttagaattctatccgtatcttaaaccactaaggaaaatctttggaaattaagttctcattgacttcaacctatatatcaacattaaggtagcgtcatataaacacttctatatgaataaaatttctcgaaataaaaatatgatcgcataaaaatcttttatcaaacaacagtaatgtttaacaaagtttcatttattaaatttatttgtgaatatatatactcattttaatttttttgttaatataatggctatcaattattgatcaagagtagtacttagtgtttatgatatttaatttgcacaactgacttgttgggtatatataaatgatatgcaggtagactagtaaaaaaatgacacgcaggtagaaaatactcatccaaaatatcaggctgttgttgtttccagatatatataatttttttgtactcatattggtgcgttggtgatatatagtagcgttttaacttttatttaaaccacttcacatgcatgcatgtttagttattttagcagttcttaatttcatgtatatcattaattttgtgccccactttttatcagaaaattgatgaggcatatttaaaagagtaagcaagcaaggctgtattttaattatcaactcagttacgtctgtctttcattttttggcgctctttttcagtaacacaatgaatcgggaaaaccttatagttgttatgattaacctctctgctatatggatatggatggatgttctttcagtacgtaactcaatcattcttattacgtacactgagctgagatctccaagtacagaacaatagcttgatcacttgatagtttcttactgatcatacattaatttattgacaaatttaattaactttaatttgaatcatatgtgtaattgttgccttgggtcttcgtgaccaaactcacagaaattctcaataaaataatatatagtcaaatcggtagcaacagaaagaaacggggtaaaagatatatatatatatatacactgtgatacaataatatcaaattttaaatataaaaaatataaaatcaataaaatgataaggactgtgaggtaagaagatgattgagtgaagaagttgatcttatatatattgcaattaagaagatgattgagtgaagaagttgatcttatatatattgcggtaagaaaacaaattaatatacgatcgagtattttgggtaaagcgaagttatttcttacttttcttttaaaatctagaaaatgtggcagaaatatttatcgatctgagcacttgggagttgggaccagttgcaaaagaaaagaaaggttggtggagacaacatgcaagtaaactatttatgtggtctcag

SEQ ID NO: 4880 - DNA, 1197 bp, Glycine max
  Soy_ogl_5510 Gm17:4604101..4605297 Cluster 21
atcaaaattaagtggatatcgggctctttgtttaattttttttaataaattgatcggcagatctttatacttttattaaaattgcaattaggtttcttaacttttttttaattgggtccctaatttttttaattggattctcctgtttgattgtcttattcaataactatatatataacggtaattgaatattgtggtgtatatatttttatcttcattttattccaacagtataattacatccatgatcattattttatctctataaaactactactttcataaaccaaccattaacttttattatcttttatgtaaaaaaaacttctattattttttattttaaaaaatgaaaaaaagttaggcacatagggctatagattaaccgtaaaacttatttagggtacagacaacgtggattggtgctttaatttgggccttttgtaattttgagagtcttattttcataattttaatctcttgtagaatcaaataattgtaaaaggttcatgaaacaatagttgaattgaattaatatgtagatgttaaaactttacaaaaacatttcataaataatttaattgttcttacaccacactctggattcactaatctattatctacacttctaattaggtatttgtaatttttttatgacgataattagataggagaatccaatttaaaaaatagggacccaattaaaaaaaagttcatgggcctaattgaaaattttgttaaaaaacatataggaaaaaaatataacattcactttgatccgatgatttttacatcttgataataatgggaaatatcaataacatccaatataaaaaggaaaatcaggtgtatgtaaaaggtgaaaatatatattaacttgaagtgagaaaaagattgaggatgataacatcttttttacctaaaattattgaattggaactatttaaaaaaaaaactttttagagtgtaactagttgaattatatgattatttgactgttaaaagaaatgatgaaaaattttgtttaaaaataaaaatgagaaaaaatattttaaataaaactatctttaaataaaatttgaagttataaacagttttcttcttcttcttcttggcttgtatgcttgagtgtattttgaattttttagatatgtgaaaaatcaattctttcttttccgcccctagaccaaaataata

SEQ ID NO: 4881 - DNA, 1180 bp, Glycine max
  Soy_ogl_2105 Gm07:860621..861800 Cluster 21
aagtatctaatactagttttttaactgacattttaagaccttcctttaagtattatttagaatttctaatctaataatctaacttggtaatggtggagtttctcccctaatagtataagttttgatatgcccgcaaaaaggtttattctttttcgtttcattcacgtgaagatgatcgaatagaatattaaactcgttaaattgaaactgaaagtcattatatatgtttaataaaaatattaatataaatattgtaaatttacaccacaactcattatattactgtattaacaacatatattaattcttataaaaaattaagatgatttactcttaagtacgtaagtgttaagaatgaagtaaaaaaaaagataaaacctgatgtgtataacatttgatgagaaatgagatttttgatggtaagagttgttaaagtgatagtaacatctaaataattcattacttataaataatgtattattaataaataatttgttgctaataaataagtagatatatataacttgataagggaataacaatattatagttagaattaacatatttatattttatcgacctaataatcttaagttcgtgtagacgaaaagaattgaggtgtatattttaatatcatctcacctatcatgtcaatttatgaacccaagatgtatgatagtacagtaataataagattattattaatataatgtactattaaacggtcaatataagcctaatagttaacaaaccgtttgtaaaagaaagaaagaagggttaacatgtactgtaacaattttttgaagtgaaattttatagggtatagacagtgactcaacgacgtcgtcttagtatattcgattgtgacgccacgtatcccgtagcttccaaacctacgaagcatttttttatttgcaagatctgattaaaaagtcataatctcttcggcttaaacgaggccagacactagacaactcaattaatatttttttttatttctatgataattaaaaatgttcgtaaaaattaattattatttttcaatataatacgggatttttattaataattttcaaaagatatcaataaaagaatcaataataaaaaataggaaaaacatgttaggagtatattgtaaattgaatttatttaaaatacatttatagtacaatttttttat

SEQ ID NO: 4882 - DNA, 1067 bp, Glycine max
  Soy_ogl_1198 Gm04:3586001..3587067 Cluster 21
gagaaatgcataaagaggaaattttatggtatatttcgtttaagaaagaaagtgaaaaaaaaatagtaaggaaggaaaaggagtagaaaatagaaaatgtgatgattttttaagattgtttttataagaaagaaaatgaaagaaaggaaaaatatttttccttttatttgattgtgcagaaagtgagaagaaaataaaaaaatatataaaataacaaaaatacttcaaatgaaggatgaaatataatataactagggatatttttgttattgtattaaaataaaacactcttccttccattccttgcaacaatctcttcttcttttgaatctttcaaccaaacaaataaaggactaaagttttgagagtttttcttccttccttccttagtccatccttcgtgttcatgcataccaaacaaagcttccgtttcataaataaaaataaatcccgctctaaaaatgcgaacaaatctttttgttaaaaaagttttaaattattgctctcgttgtgtgttaaaatgcaagttataattcaatatacacaaatgctaactagtgcgagttaagaaagtataagaaaaaatgtgtttattggaacgaaaaaaagtatatttgttaatgacttttaaatgtgattccatatggtttctaaaataatctttcaaattttataattctttaatctatattctaaaaggattagttagcaaaatatataattcttccgtcccaaaataattatacttttaatctttaaaaaaaatcttaaattaaattatattttcaatttttaacaaggtattcaaacatttattcctgatttatcctctagtaaatatagttgtgttaaaagacttaatatatatttattgaaattgaaaaagaaaatcaggatattttagtccaattgtcccccaaataaatgttattttcttggaatacttttttttaaaaatctatgtaaaacaactttaaatataaatcattttgaaataaagggaataacatattttgctcaaaaaaaaattacatatttcattggtctcataataatcatagtataag

SEQ ID NO: 4883 - DNA, 1300 bp, Glycine max
  Soy_ogl_6882 Gm20:40063201..40064500 Cluster 21
aactaaaaaaattaaaaaacataaccaaacattattactgttagtatgagaacaaagaggacatgagcccatgttctgcacgtagaaaaaaacataaatacctgtccaagtccaatcattaatttctcttagtataggattataggaacaccggtcgaactataaatgcctgtgttttttttaaagaaataaatgcctgtgttttgaaagaagaatagtacaacaagaaaaaaataacacaattcagaaaaaaaaaatggggatcactaagctagataaaatttatttatttaataaaataaagtatttattattggaattgagataattttgtattacatttttaacaggacatgtatcttcacagtcgtcattgatttaagtattttaaaatttgcaaattgtcagttacttttattttccttatgttatatttatctaatctaatttgcttgtattgtatgaaaacaattcaattgtttacgttaaaagataaattttgaaaatttgaggaaccaaatacaatgaaattatttttggaggattaaaataaatgagtgaatatttggagaaccaaaatcatattttactctaaaaataagtatttgattataattaattttaaaagaaatgtcgtatcattgtattattttttaatataatacaaaattaaaaaacaatatattaaaaaaacttgagcgttttatttgataaaaaacatattgtcattaaaataattttataagaagatttatcattattttatctttggttgtagtcttagtttccaagcaggattgatgcacaagcacacaaaaatcacaaggacatgacacaactctaaattctaaaatgttcaagtgcccaacttgcggctttgttgataaatattctccctctttttttttttttcaatagaagttaaacatgctattcctatattacaagattgagacatgggcctctttatatacaagattataagtgtttttgagagtttatttatttatttattattatatattttcaataaagaatctcttaaagtcacttttgacttatccaatacaacatctataaagcttcttatgaataatttctcatttttattggtatgtcctttgttttagggttattttaaagtttaaaaatatataaataatttttatccgacatatgcaatttgtagtcttaggtgaatctaaggtacctaattcatattcgagtgcagatattttttctgacaaattattttttcaaagacaattaactaatcaagactaagcatgacagatgaata

SEQ ID NO: 4884 - DNA, 1164 bp, Glycine max
  Soy_ogl_1008 Gm03:40826437..40827600 Cluster 21
gttgaataacattttatagacaacgtttttaactttcaatgaaaagattataatttttttaattttttttttcatatttccctttctcttttatgccattcacctcctttttcttttagtttataaatgacaaaatgagaatgagtatcagcctcataacaaaagaagaaaaataacagtttaatgttcaacaaccacaactttttgttcaacggaaaacatttttgcgtcacaggatttagaaagacagtgattaatcattattatgattgcgattgccacttaaagaggaaacaaaaaaaaaacacgtagtaatttgaagtaacggacgaacagaggtcagatgacgtggaattgtgagtgaggttcatatatatttttacactctattttttatatatttatagttatctttgcatctatttctttcatttttttaattaaacacctttcattttattttatttttcacctaattcttgtcacctttaaagaaatttgagctattagaaggtaagcgcttatctcgtattaattttagcaaaaaatatacatatttttagattaaatatttttttgtccataaacaatttcagaatttgacttttaggtcttgtcaagaaaattctacattaattatctatttattttatgtcagcaattttaatttttgacattaaatcataatcactaagtattaatttatttgatgtaattttatatcaatagatacttgatatgtattgtgacactgtgaaataattttttcaaacataacttatgtgttattatgtggtttcacacgaaagacatcatgtgaaagtatcacactcttataatattacatgacatcgtgttttttatattatttttcttttttaaccaattttttacgtcagtttttcattcataaaaaattttgaaatttgaatgtttaattcctataaaattgccattgataatgccgttgaatttagagcttgatcttttaataaatattttatgtccattcaaattgacattaaacattttgtaacacatgtttatgtacataataaacttgaaaaatcattgattaaatgtctattttgctaacaaaaaaatattaaactttctaaaattgattacaagagtaacatttgtgagataaaaaaaaacttctta

SEQ ID NO: 4885 - DNA, 1258 bp, Glycine max
  Soy_ogl_12 Gm08:43521101..43522358 Cluster 21
actcacgtggatataaaagtctaggtttttttattccctacccctcagtggatgctatagtagtgttttttttggtggattaagtcttttaagctcgaaccggacccgtgttttttacaaacgaattgcatttatgattcaattttttgcatttgcattaaatttgatatatagaagggaaaatctcaagctataaaaagtgttgtgcaacaattatataattaggcttaattttagagttgggccaacatgtttgctttattggtttatttgggcctaagtggccataaagagtctagaataaattacgtaagagtcagatgaatgaagtcatcattgtcttcttgaaaccataaacaaacttcttcggttcttctttcatggaaaaaattcaaaagaagtttcaaacatataaaagaaaatgatatttcttttgagtaattggagaatatgttttacataaaacaagagtatcataaaaaaaaggatcataaacaaatttatatgcacgagaaagttcatgtgattaagaaacatgcacacaatgacaacaagaataagataaggaaaaaatgtttcgttaatttgtgggaaattaggttattatgcattttattttttattttctttaatcattttacatatattttttctatatgaatctatatacaagttaatgtcatattcattgcattcttattcattattatataaaatttgaagaggagaaatttaattttaacaattgagaaaatataaaggttagatacaagtaattaaaatgaatcaaattcgtaagtaaactaaattatgagaataaaagtataattaagatttttttttcctattatatagtaatgtaatgtcacgacagcacttcattataaacaaataattaagtagttgaaaggtttctataatattaaagatttaattaataatgcagtaagctacctagatagacaaaaactcaatatatccagaatctgacccaaggcaatccaattttaacacgtacacatggacacgataacaaaaatgctccgagtctctgatcagtgaccaccatcaccatgcaattaatgagtttggtaaaagtgtactttattgtatttcatttgatacggtaagttatttattagcttgtataaataaataattaatcaatatttttatcatactgattataattttatgttatatttagcgtggtaaagtaaattttaatcaaatttagtataataaagaagataatgat

SEQ ID NO: 4886 - DNA, 2090 bp, Glycine max
  Soy_ogl_1192 Gm04:2652501..2654590 Cluster 21
taatttttaaaaatatcaaaactaaaatcgaaaaatcatcccaaacaaaaatgctaaaaagactaatgttagaaaatcaagacagagagattagcaaaagatccttctattttataattttctgaacataaaatgattttttatttttatattataaaaacatttattcaatttaaaaatgagcaaaaaagttacaattttttttcattattttcacagtaagttaggagggaattgtttttatatgtcggtcctataaaaatcattttgttaaatttttttttcaaacaaatagtacaaattttctgttttcatcagatctcactctccattctctatattgggtggacttgtctcaaattcttaaaaaaaaaaaaaaaggtccagaatgatgttctttgactatatttgcttaactatatttattgctgtctactactttttgtaagcattgatgtaattattatcaaaatattatagaagcatatataacacaatcttttgttaagaagcttgcagtttaattaccattcatttatatgctcctgtgttcgggtttttaatgtaataaaaataatagcatactttttttttttgtatagaatgttctgtcctttggattgtaatgatatttcgttttctaaacttcatttcaaaagaaaaataataataatagaatattaaaatttgtgaagtattctttctctctatggctcgtgacaaaatatagttgccctaaaaggtgagaaagatccaaatcaacatccgatgaaagaggcaagctaagcaaaaattggcagcatggaactagggaaggatatagggacaccagataaaaaaacacatgaattatgattttatttggtggaactaccttaacggtgccgtttcaaccttgtggctgagtgctggtaccagcgagcatgttacatcctttaaaataatattcatcccccattcatcacactcatcatcccggagtcaaaatcagaggatttttgaatcaaaacggaccccacagaccatgcatttctttgaaccttgcaaatatatataacaaatcaaaacttttattattataagagagtgaaaatagtttgtcttggttatgggataaaatcataaagaataaagactaaatcacaaaattatgtaactttttgagtgattatgtgaatattaaataatttttatgattatggggtctgaatttatccatctcacactcttatacaaacactcctctcctacactcaataataagatcatttgatatccagtgtaaaactttttgcacttacactgcttactaattctatgtagagtacaaaattattaattcaacggctgaattaaagttttttttataaagttgataaaatctcatgtaaattacaaaaaaaaaaacttcatcgcacaacttcattttaacaaataatatgttattcaagttttttttttgactgaatgttattcaagttctaaataattgttttttaaaaaaattatgaataattattataaataaataaatgtcattcaccaaaaaaaaatgttgattactaaataacgtgcaaatactaaatttatatttgattgaaaataaaattaaagtctatcaaacttgtatcctctacggacaatggtcaacgtgtataatgtctaaggtcattaattgcttccttcggttatggtagggtcatctcccataacaagaatagtcaaattacgacaacaaagttttccaacaaattattacacgacccacttttcctttttctttctttgataaaaaaaaaaaatacttacttcagttatcataaatacgctttgctcaattgatgcatccaaccgatgcttacagtatatcatctatgatatgctcccattctcaaaacctaaaatcaccgttaagcataaaacaaaaatatcactatataattctaattgaattctgtaaaagaaatcctaattaaatagaaaaaaatgttaaatagtaatatttattttaattagaaaaactatatacaatcgtggtgctaagccagcttaaccaattggactttaaataatatatatatgtatattac

SEQ ID NO: 4887 - DNA, 1232 bp, Glycine max
  Soy_ogl_2220 Gm07:5581265..5582496 Cluster 21
aaaaatgataaaaacttacataaaaattatgttttaccattaaaataaatgaaaatttaaatttaacaaattaatccaacttactgctatgtaaatgtaataaaaaaattactgatatttttttccaataaaaataatttagtgacattttaatctactaaaatatactaacatttcaatccaaaacatattattaatatttttattcataaaaaatattggcatttttattttaaaaaaattactaatatgtacataaagttaatatatttgttggatattggaaacgagaccgtcgtgttggccaaaggagacacaacgtggtgtcatccacttgccagaagagtttcgtgtggagttattctattatttcagtgtaaaaatattcacatttcagtgtaaaaatatttttacgaaggtttattccttgttatatcaattgccatcttatcttcattgcatcattaatatatgtgattatctgtatatttttcgataaaacttatctatatattccgatgaactacaaataacatttttataaaatatatagggattaaataaaaaaattggatttaaaaataatttaattagtttttagagaaacatatttaatttctatatttaaaatcaaattatttaattaattattagtatcattttattgacgacaaaaaataatcttataaaatagttagaatataatttttcttacttgtataatgaagtatgcataagtgcttattctatatattggacaatgagttctgtaactatgaaactcaaatatgaaacacgttgccacctacctcatttattgttaccttatcttcgcattattaatcgattggagtaaaaaaaaaaaaaacaaattagattataatagaggttgcctcttccagcggaagcacgaaatagttttcttgtaagggtacactagtacggcacccgtgtgaatgtacggagttttgtaattttttcttttttttaataattgtatccattatttataattttatagatttagaaatagataatataattaaaattaaattttatcttttttgtataatcacctatacatataatggaattatcaaatgtagtatttaaattaactaaatgtactaataataatattcaaaggatacaacaaattaataattttaaaaataattaaataattatttttattattgaatgtgtaaagcacatgtaaatttattcccaag

SEQ ID NO: 4888 - DNA, 1379 bp, Glycine max
  Soy_ogl_6838 Gm20:38263922..38265300 Cluster 22
tatggattttttattaaaaaattaataaattaattattaatatttgttgataaaaaaaatctcaccatatcaagaaaaaaaaaatattgaaaaaggggaaaataagaaattgggtggtcaagctctctcctctaaaacataccatatgccaaataccattgttggatgattatttttcgaaaatttaagtacagagagcaaatgatatttgtttcaaagatatacgttcttccctaattaaagattatctcttgccccaattgaacggccatttgaaacggttgtttcatctctgaaaagaaaaagacaaggaacaagagtttggaaaaatggatttacctcctttaaagaaggggaacgcatttaaaaaatatataaagtatacttataaatttattaaaatatttgaacaattatatgattagttatatatgtaattaagtatatggtttaattgtaattgctgattttctaatcaacacttataattttactttaattatcttttaaattactctatcttaaaagtaaaaagaaaaaaaaaacaagaagaagatgcggctaggagaagaaacttaactgtgaatcaaccatcataaattcatagactttttgattgaaacacttctgtcaacattttgatttgggaattgacaaaacgaaggaagatacaaattaaaagaacgaataaaatatttcaagagaaattaaagaagttttacattttaatactgatattagttttgaattcatggatacatcttttctatcatggttaaatttattacattataaattaaaatattgaagagtaaaacttcattttctcaattagatattttcaatgctttttatcattaattatacactcattcactgtttttttttaatccaataaggatttaagatgaaaaatatgggtagcctaagattatatgcacattcctaaaaaatattatatgcaaaataaatagaaattaaatatatattacgtaaattaatgactcgcacacacaaattttaaatgatttttttaaaaatcacatcaataaggtttgaatgaaaggaaattttgacaaattaagtaaaaggttaatttaaagactaatttcaggtagaccacattgataggttgtccatgatgaatcataatcttcaaccattagatcaatctttttatcacatatttgatcacaccaaaccctcatcgcaatttctttggtcatcatccacagttgctagaagcgatttctaacaatgacaacattataagatttgtcattaacattgtatgaatataaattatatattttcttttgtgaaatgacaaggtttgtccttgaaaggacctagaacggcacatttcacttgattaaagt

SEQ ID NO: 4889 - DNA, 1700 bp, Glycine max
  Soy_ogl_5849 Gm17:41640401..41642100 Cluster 22
atcaatttacatgtaaattttaaagtttcatcactaaaattttactgacgctcatattagtgagtgtatatttgtcattaaatttagtcactaatcaattattttcttatatgccaaagatttcattactaatagcagtgtttaggttgagcataagatgtgtcaaactcaaaacacacaatacaaaagtagcagtcaaagtagcttagttctgctggatcaaaatacatgctaattttaattagccaacttcccttctgacagtgaccatctattagaaattaaaaaatgacctaccatcaaatataactaaccgtacattaccataagaaaaagaacctatgagaaaggcacaactcttttaagcagagaaacaatcaggtcaagtgtgaggcaaccacaaagtcaaagtgaatactactttgtggttactgattcaactactccaactaaatcattgaaatgaaactcaattgagccagaacagaaaatctatgtaaccaggaattaaagttactgttatccccttttgaattgcataaagatccccaaaatcaatttgctgtgggtcatgaagaactcccactgacacccccatccactttccagtaaaacacttgcttcacatccttttgcaaactttctacaacatttatcacgaatactctcccagccagagagatgataataaaattcacacttaattttattccactcccaaaaatagaacttaatctattttactatttctttgatgtctcttttactcatcaagaaaatcagtgggccaatcaaattatcattaggaaaatcacacacagaacaccatttcaacaagtgaacattgatgtgtaaaattattacgtatgatatatatcggtggaaagcttccgttgccaaactattaaggtagcgtctacttaattattggggcctaggctcgacagaaaattcaatcctttccacacgcgtctgcttctaatttggtttgaattttttaatatttgatggttacagatacaactgacacctaactcaatttagtagatccatcattttatttatttgatgattctacactagtcactagaactactctcacatgaaaacgatgtgtaataataaaatttaggcttagacgtaattttttctcactcatctttcatattgtgaattttatcatcaaattatgaattttttgttgccatttaacttctaaaattttacttattttaccacctaatttttaaaacaaaagtgtttaattaaaattttgaaaaattgagtaaaaaaaagtttaatgataaaatgtgtaaaatttctaaaattaagtgacaaaatatacaaatttcatatttcgatagcagaaatcgtgaaaacgtcaaagataaacagaaaaagtgcatgtctaaaatttaattttaggctgtagcttataacatttatgattagatttgggtgaaatatatgaagtgtgaaaacagaggatttataataaaaatgtaaggtgactttgggtttataactgaaatgttttaattattgattaaattacttcatttcatttaaaataggatagaggttacaatatgatcaaacacatgggtataaacataagacaacgatgctcttggtaatgaatgaacattgttggcttgagtcttacaaaactcaccaatgagtttggaataagttgtaac

SEQ ID NO: 4890 - DNA, 1061 bp, Glycine max
  Soy_ogl_3684 Gm11:2247401..2248461 Cluster 22
attttaagaagaaaaaacattgaacatttttaacgattatgtacttctttttttataaaatgtagacgtccccttttgttacttgtgattataaatttgtgttttttctttctaaaaattactaattttgtcatacactatatagttttgtttaaaatggtataaatttgtatataatataatttttatgaatatatagaaaagacccgacatatatgtgatagcaattttcctgtttgcatttgcagaataattgtctcacacatgaaactggtaatgtaggctatgcagcgtacatgggagacaaggaaatatcagtaccgtggtctgggttgatgttgtgatcatcgggtattcgcgtgtgtttggacgagcatggtaaatttcattttaaataaaattgattttaaagaatttgaatgtttagattaatattttttattatagaatcaagtataatttaaaaaaaaaactaaaagtataaagaattttcaatctcaaaagattttaaaatctatactaaatacatttatgttaggaataaaattcaatataaattttatgttccaacataaaatttatccaaagttctttcaatttataatcaattttagatccataaatcataatcaattttaaaatattttacaacataaaactaaacacataaaattcaatctaaaattaattattgagtcagaatcatctctttagcagcaaatcagacatagtttcatatctttacacaccacacaagtcaaataagaagttttttaagtttttatttttattttagggagtgtttggaacttggattgatagaagagatgcaatggggagaagtgaagtgaaaaggagaaaatattttattatttagtttctaaaattaagaattgaacataatgaaagaaaataaatcatgatctattttattactgaagttcaattctcttttcctgaatttaggatgtacgtaattgaaggaacacaattttatattataaaataaatattttatttttgtaaaatttatctaatcattagcctcttaagaataatgg

SEQ ID NO: 4891 - DNA, 1086 bp, Glycine max
  Soy_ogl_274 Gm01:51866101..51867186 Cluster 22
agtatcttgttgtatataatattatctctggtattttttttataagaaataagtgttattttattttatactataatttatttattgtataaaagagcagaaagtactagtaataatgagtaagactaagaatataaattttactaatattgtataacaagactcatataaatgtatcgtatcttgttttattaaggaataagcatacgttaatttctctttatatttcctattcactctgctagtatttttaattcaccaaaaaaaactctactagtattttttttttccttttttcatcacactctttattacatttgttactttagtaacggtaaaagaaaaattaattagcgctaagattactttaaaacgattttaattataaaacaagtagcgaagtaactgtattgaattaaatatttaataattttaattattaaaattcaatacaaaaataaatttatttattttagaaaaaaaattgttaactgattatttcttaaaattcgtaaaccagctacagtaaagaagttaatgtctacagaagtgttgtgctgacgggacacacaaataactacataaaaaaaattgtttggttttgtttctaatattattaatttttaattgtttgtgtgggggtgaagtaaaggtaacgcatgaaaggaatggtgagggagtgaattagcgagtgattgccacgtggccaatggaaagagaactctaaatgtggccttaggctctcacgggaatgcactaaactgatgaatgtgaacgccaagtggcattatcctttctttcatttcattttcattttcattttcatcatatctttttcttgccacccccattcatatcttttttggctagtgggtatgccattcattttgttaagacatgactactacctagttggatagagatagctataaactgtacctgtatttatggaaaaaggataacatagtaattttataagtcaaaggaagaactcgatcaaaaggatagatggagttgactacatacctagcatacctacttgctctgtggaataagataaatgctaacaaattttttagtctatcg

SEQ ID NO: 4892 - DNA, 1521 bp, Glycine max
  Soy_ogl_6536 Gm19:43751301..43752821 Cluster 22
cccaaacaataatgtaggagaagaaagaaaccatacgagccataaagaaccaacccttgccagatgaaaaaaagggtaaatgatcacccagcacttgaggagaactctaaccttgccaatgagctaaagaaaacttatgctcatataaataaaaaagccaatcactggcctaattaatactaaaaagtctaatagtagataagtaaacctaatactaagtaggggttgagaatgttctgatcctatactggcgtccatgcaaatgtggagcataagatttcacacataaactaataaaacaaacaaccaatatcatgtgattcactagctacatgtaacatgagtaagaacatataaatagttcatagaagcatcaagtatactctccaactttatatcttcgtaacttccacctataaataatgaattaagtgttaaagttcttgtaagtacaccattgaagtttggcttgtgcagctcaaaagagattttgcttgaatatttcatccctttgatgttgaacttcttagcagagataataatatattttcacctgccgtggttgaaaaaaggatgatcccaattggtagccttactactcccatgagaagtaatattttttgaaaggaagagaagagaagtaagtgattgatttgattaatgatattgtgccataggaagagagaaataaaaataaaagagagttgttcattgaatgttgaaatttgttgttgtcaaaatataatcacttttttgacttatcatgatagaaaagaaaaatatttcttaaatactcaatacactactttaaaccaagagagagaaagaaataatataaaaaataatagacttaataagtatttgatgtaataagaagaaagataaaagacaacggatgatctaactgtcactactcaatagaaaatgatttaaaaagtaataattagatgttagaatacttggatgtctaactatcattactcatcagaaaaaatttgcttagtgttgattaattaattgtttagtatatgtttttacttttgaatttttttttgccaattacatgttgatcttaaaggtaaaattagtatgtttatcatctaaatttaagattggtttagattttttttttacttattattatttcaatttaatcatgtaattttaaatttagagcataaaatactaatttaaactatttaaaatataagttattctgtttattttttcatgaaggtatctcctaaccaataattaaagacttaaccaattatccgacaccaattttctttcaaaatgataaccaataattgcagaacaatttctttcaaagtgaaagttcacgaaagtaatccaaataattgcatgtttctcaataaattttatttaataataaataatgcatttgaaaactgttgaaaagcttgctattagcaatcgtttcaagctataaattcaagttcattctaatacacacctagtagcacgaattgaatgtttatttcagatttttttggactg

SEQ ID NO: 4893 - DNA, 1259 bp, Glycine max
  Soy_ogl_32 Gm01:1715501..1716759 Cluster 22
tattacgagtagtattctgatcctggaatttgcttacaaagtttacggttgtgactgtcattaagaatctgacttaattctgtatatgtgggaatggtagaggaagtgttttttggtatattgtttgttattgtagcgatatatcgtttcattgccttatgggaatatgaactctgcagggttggtggtgaaggaaaagaagtggatagaaacaatacatgataaatgggggcttctatttaatctttgtatatgggagtttctacttgatctttgtattaactttgtaatgactttaggtacttctggtacctagtaatgttaattctttttggttgaacaaaaaaaaggtttgtctaactagtctaacatatttagtaaataatttctattaatagtttataacttgtaagatataattttttttcaaactgcttattctttctttcacataatatttttaatgttatctttgctaattattataataatttaagtagttaatattttctttaaaaaaatatacattacttaattcaaagattaaaaaatattagacgagaaataaatgtccaagaaagattggtaattggccggcggtttacacagtcaatttctaataactaacagttttcttatattttttagaactccggattaaatttcaaagtttttcttttgttttgattctggcttaaatttcaaagttatactcactgatggtttcactttcatgaaatcaaccattaatttaaaaattcattttaaccgagtcttatgaattatatttgctttcgtattttttcccaccttaaacatcattattttcaaccttttcaaaagtatcaatttattttataagtcatctccaataggatcttagagagagattttaagttaaagatctattcttccaagatttaattattataaactccctcaagatttttatgttggaggtttgattcttgtagaagaatcatgaagatttacacttttaaaaaaaaatattttttagtgtctctctcttaaattctaacttattattgctggaaagaagaaaaataacaagaagaacagaataccaaaaacagaccacaatccagtacaatagcataacaatataattttaaacaaataataaaaaaataaaataattaaaaaagagggacggaggctagatcggcaatgaccggcgacagtcgtggtggctagatcggaggctagcgaaggaggtagggtgggtggtgggggaagag

SEQ ID NO: 4894 - DNA, 1497 bp, Glycine max
  Soy_ogl_1039 Gm03:42218901..42220397 Cluster 22
attgataaattataaatcaattgtcaataatcaattattatattagaattgccaaataattagcataaacagtggtattctatctatcgggttttttttatttcacatgcacacaccattcagtttttcaattactacttttagcagtgatttacaattatttatcaaaggaattaataatttataatgtaaaattaaaaaagtaaggccccccattgctacacatccctccgtgcacatgaacagaaacagtttgaataagactttctttttattaaccggacatgcaccctcgctcatttatgtacgttaaactatacatatttggggatctggctgtgactatacacacaaatgaaatgggtttccgcactcatctgaaatgcttaattaagtaatatgggagtcaatgcaaatgtcattgcatcatgcacatatgcgtgcacatgtatagttgtatatacttaacgtgagtggaagatcattataattagagaattatgttttcttgactgtgaaagtcaacttcatgaagagacgaggaatactgaggcttcagcatatatatgcagtacaccagagtttagataaatgagattaaagagaaaaagagaggatagacaaatataagttcaatggatattgtaagtttgagctgtggcaaagtgtaaaaaagtaaagagaattttttttttacaagaagtaaagagaaaatttaaaagataaaaatgtggaatatattttatagaataagaagagttataacaattagtatatgacctacatatacaaaagaaaatgtagctaatagtataccaatcatctaactgatatgataacaaccaaatgaatttcaaatttatttcttttagcattctcagctagttgagatgcatatatataagcaaatatcacctgagattaacatatacaatgcaaattttattaagtaacaacataaaaactaaaatgaaaaaaataaagctataattacatcaactaagtaagaaagctaaaatacaatgataagggcaatggacgaagtacatagctccaagatatttttttaccttccttatccctttcaaacatttattagcatggctttacatgtacatcccttcaaatacataatatataataccaataattccaaatgcaagaggaattaatggttgatatcatttgagacaaaagcttaagctttcaagcaaaatttataatctatgcttaattactttgtaaaaataaacaataagttaaatttaagcacaagctacattttatcctttagtttgattgacatttttttaagtacaatctagtatgaaccaattgtttgtaaaatgctatttttacattatttggcatcctttatttatgttttcaaccaattacattcatttgtactatttttatgataaatcattcctactaaacaacatttccctttttttaaatacatcatttttattctttaagtattttttattcttt

SEQ ID NO: 4895 - DNA, 1768 bp, Glycine max
  Soy_ogl_3706 Gm11:3675201..15968 Cluster 22
cccttaaaccggtgaatgtacgggatctttataataagtaataagagtagacaattatgggaaggtccaggaagatttgtcgtgaagcaattcaggctaacaaggttgaaacgttgatatagtacgtgactaagtgaggaaattattctttaaagagtgaaaggcacatgaattcccgacaagtgaagaaggctaggcctcttgcccctcaaatttagttgggttggagaccgtggtctgtcgctttctactgaggtagggatctttgtcttttcgatctccagctctcaccaaatttacataaccacgcttaacccttacaaaatcatctattttaattggttgcgtttttattgtaatgttttgtaaaataaactaaaaaagttacttttataatccttttataacttattccaataaattaaaaaaaagttgcaagaaaattataaattatttaacgaatatatttaaggcttaacaaaattttacacttccaatttttatttttatttctgtgaattttactcccagcaaatcaatttcgtatattttattttaacttttaagaaatttataaaatttatcctttgtcattttacttataaaataattatatttttttaattatttttagcaactttgcacctaatttttttattttttttatgaattttaccctcaactttttatgtttgttaataaataagtgacagatgaaaaaattgaaaattatggataaaatatgtcaaatagtcccaccccactcaagtcattaaccagatttaattatcacgctctctcgatcacacgactacaaagagcaaaggggaaccaaggttgtttctcctatcttttagtacattctcattactttctattcattccttttatcttttgccattgttatacctttgcaattcttttcttgtgctttagcttcaatagaagtcaaccaagaggaaatttgccttcggtcatcatcacacttccctgaccaaccataaacttttattttttgtaacatttttctcttctaaaaaacatgtgatagggaattgtggagattgagctattcaattttttattattttattttagaaaaaaaaactgaaagttcgaggttagatatggtaagctaagggaaaaggtgttaaaatcttggtagttaattatagattaaaaaaatatgtttttgaattagtaatactctagttatattcatagaaaaaaaatactctacattaaaattactatagtttttttttaagcaaaattactttagttataaagggagagaatatgatttttctctagccgtaaaatatatttatatattaattataattattttgtaattaattgatttatttgttcattactacgtttgtaattaattgatcttattataatatggtggattgtatgaaaataattcatgatgagaaaaatattaaaagtatataaaattatgataaaaaggcctgggagctttacccagcatttggaaaaactaaattgcaaaaaatttaacatgtaagcgtcaagatgtaaatggcaaaatgactaaattacagaaatataaaagacaagggattaaattgaaaataagggaacttttttgggcctctgttccggcctgtgcctcggcccattggatgggcaaggaaaaaatagaaaggacttgctatttacgctatgttatctaattagtacacccccattctcctttttatattttaattgccattataccctttttccttaaaga

SEQ ID NO: 4896 - DNA, 1500 bp, Glycine max
  Soy_ogl_4478 Gm13:36210701..36212200 Cluster 22
actttcggaagaattaatgatgactattgactattggaccataaacttgaatatatccaaataccactaatgtgaaaacatattttattgattattaaaatacaaccaaattattaatgacgacggtaatcttcaaaccttttgttaggacaatttccttctcgtcaaaactcattaatccaaatttatagcgacggtaatcacacttaaaaaataattaattattaatgttcttttttaaaaacaaatgtattagtggagttgggttaattcagggaataaatgtcaaggaattgccttctaagtatttttttaatataaaatggtaaaagtgaaaatagattacttcaatattaacataattgattcgagtgatactcacttaaatttttataaataaaaaaatataattaaaaaaattcacatcataaaatagtcaagtagattttttaacaaaaattagttattattaaaataagtagatattttataccaaccaataacaatgtaaaaataaaatagaataaataagatctctataaaaaaatgataattgcctagcaatattcatctaagagatattccaacccatgcacatgagaaatgtataattgtatccaaatgttttaactgattggcatctcctttgtaatttctattaataaaattaatatttacaaatatgcacgagagaacaagcgcacatggagttaattcagggcttgtacatgtgcagaagcctcattaccttaaatggttaactaatagaactttgaaacaccaagctactctgcctttttatgaaaattgcttaaagtggggaagcacaaactgggatgcttatattggtatttaacctaacagaagatgcttctcacatgccatgtccaaggcaattataggactttgatccataatttcaaaatttgtagcaaaggaaggtaaacatctaaacctaacaaaatcattattcttaaacacccccctaattaacttgctataaaattttgtgagatattagattcattcattgaaacaaatatacaagtttcatacggaaatgcacctacacaggagatggaaatggtacaaaaaatgcaaaatgcagatagaaaagaaaagaaatcaaggggggaggaacagagaagaatatgagaaatatatttaaagtattttcattcgaaatatttcactttcccacacttcaactactctactccacacaaacagtagatatatcaaatttaatacataacaatatttttttcttgaagttgagtagaataaaaagcttaactgatgtcgtatttaagttatgagagttgagactctcccacataatattggactggtctttttgggttgaactttcttcctatatttaaaacactgtatttttgttgagacttgagttaccgaaatgactatttattatctgaattatggcacaatgtattgaatactgataaatgactacctattatctgaatcaaggtacaa

SEQ ID NO: 4897 - DNA, 1100 bp, Glycine max
  Soy_ogl_4921 Gm15:8616801..8617900 Cluster 22
atgaaatttattcttgtaactagatcatgtagaagacctagaagcattaaagtgaatgtggttaatttgtttatttttaagttaagagacaaactatataattttaatcgtatctagtcggatctcgatattccaaggactatttctcctatctgatctcatagtttatcctaagatccttaaatgtgtctcatgagtggttgcacaagagtcatgcaacatagtatgaataaaatgtctaggttcaataagcatccgagcaagtatccataggatgattaaaagatcggttaacccacaaataatgatatacatagcccctcaatcttaagtgcatgaatgagaagagactaaatttcaaaaattggttggcctatcatcggtgggttacaaaataaaataaaaatgcattatttgtgaaagagatcatgttgtcaacaactttttcaaaaaaattataaaataaacaattataggtttagtttttaaaaatttaaaagccaaaaataaaacctctctaaatgagatacaagggaatgaaagttctttcctaccaaagatttgctagctagcttaattatggatatcaagaatatgctctcctatagtcttctatataggtaggtagtaagcttaaagtatatacatttatgtttggtatggtagagagagaataagaaaacaaagaaaagctagtatgaaattttaagtaaataagaaatatttatctcaattaatcattatcttttttttcgtaatgaatcagaacattaataacaaaataaattccagctattatcacaaaggaaactattaagacgaggtaacctacccaaccgttttattctccaaaccacgtaaatgtaaatggtaattagaacgaggatatatgagggaaatattagtttaataatatccgtacagagactactttttcttccttccatgcattaacaaatttcaatatgttgcgacgttgttctttaactttggtctctttcaaattgcctttaatacttcttttgaaaaaatagctcaagtttgaggggaaaaggcaattcttgatgttaccaaacaaagaaaaaagagctcacacgatc

SEQ ID NO: 4898 - DNA, 1100 bp, Glycine max
  Soy_ogl_5878 Gm18:1907501..1908600 Cluster 22
aaaccaaacatcttgataatttcttagtggaagggattcaaactcattacttccctcccttaaacccttatatctctatgctaagtcaaatatataaaaaatgtaaataaccaaaacactaaaatttattatgtgtttacaaacacgttcatatttgattttttcttttatactaagcaaattcaatatattttctcttttatgttttatgaattgaaacatgtccaaaaattgttatattgtcgagaatcatcactatatcaatcaaggaggtctaatttaaagtgtgtaagttattttaaacttttgacttcgtcttaaatttatatggataaaaaaaattatgatcttaataatcaataatcacgtgacatatgaattataaagatgatttgctaaaattaatgtgatttgcacgatttcggttaaatggaataactttattttttcaatttcagattttcttttatccattattacttattagtgatcaatcaatttctaaaaataatcgctgattgtttacacaaaagttccacaacgccggaaacatatcgccttctgccattgctgtgatgttaatgaaaatatagtcaaatcatggtttcacatatattagtcaaatcgtttactaacatgaaacacacagcaaaacttctgccattgttaatcttgtgctagtctcatttcaaatcatggttgaaagttaagatcttgtataatagtaaaatcgtttatgggcatgaagcacaccacaaatctgttctaccatggacatggttaatcttgtgctaatcttctgctatagctgcaatggttgatgagaatatagtcaaattattgctgataagataaatcatattcttttttggtattatataaaccatattcttgaatagaagaccctgaactcaagtcatgcagcaatggcagagggtgttctttctggccttgtgaccagattttcgtaaatgatcagcgattatttttggaaattaattgtttatgatttgattaaatgtaatttgcattatttgccgttaaattgtttaacttattttttaaaatttcaaatttttctttgtcctttgttagtgagt

SEQ ID NO: 4899 - DNA, 1854 bp, Glycine max
  Soy_ogl_6914 Gm20:41828147..41830000 Cluster 22
gttttggaggaatttttttttgacaaggtgacatgtgtcccaatcaaacattcttctaatataactagtaaataataatagaatagatgtcgattattataaccaagtatgttttctgcattctgggttcggtttatttctcaagtctcttttgaaccttattgtattacctaaactcgagttgcttcgagacatgaatcaagacattattgtagaataaattattatctttcttctcgcatgtttaggtccattgttcttgcagcaattgtgttaactttaggcaatttcttcctgcacctccataattgcttcttgcatttaatctatgtaaaattattttctggaagttaaaaacttacattctagaaagattaattcgaaatggaaacttacactgtggattaaccttatcagaaacttaagaaagtgcaagaagcaaacctaaaggtgcaggaattaattgcctgatgactatgtctgggagatgtatgacttggtgtcggcccgaaaattcctttgcatatgaaaattgggctcaatcttatctctagaatagactgaaagttggcctactccatccacctatacatagcaatgttatttttttctttgttaacgtgtatatttatgttttcaccttttcatcttatttatgcaattttctaattattatattgaaataatttgactctttagaatgaaaaaaatattaattaaaatgagactcattacaaatcatattaaaattgtgagaactcataaatagtaagattctaattccaatcctgtatataagaaaaaaaatatccaatttatgaagatttgtaaaagtagttaaagtatttaaatttaattcccccttttctgctggcttcgaataggaagactttgaatttgaaaactaacaaccaaaccatcaaatctcccaagaaattggcttatttaattttaattaatggtatcataaatttaaattttattccatatgcacataagattaaatgattcactcataaaaaaagattaaataatttaagtggtgattatatttaatgatattactcataattcaaagaatattttttcaaccaatgattttgacttatattgttaataactcaaatacaagcattcgctttcatggcaaataacagaatatatcattgataggtttggcaataaattaagggtataaagaacaattagcaattaatatatttgaaagtggtaaaattatctttattttgaagacaaaaaattaaaatgtgctaaaaaagacaaaaattaaaataagaactttaaaagtaaagaagttgtatgacaacaagggtttttggcaactacccaattacacagcaagggtttttttttaacagaattacaacaaggattttactaactgaatatatatccccttaattcatatgcataaaggagaaaagtcggttatttattcttttccctggtgtaactagctaggccatcctggacaaccataaacttcatatctgaagtaaatcatttagaattttagatactaaaagagaaaaatagtgtgatgagaaatcaatttttattttacatacgtgatttattattgaaagcaattttgttcaagtcaaatttgcgttttggtggtctcgtattcgggtttgaactgtttttcataatttgagtaatcgagttggtttcaattcgagagattttcaatgtgaaccaactacaattccttcgccataggataatcagttctctctttttctcttttaatctttctttataattcccttacttgatttgtaaacaatcagttgcttaacattgaagcagtaacaactagcaactgctcat

SEQ ID NO: 4900 - DNA, 1300 bp, Glycine max
  Soy_ogl_980 Gm03:39752201..39753500 Cluster 22
agaacccattcttaagaaagaattgaagtcaacaaaactttaaaaaagtaaaatagagatagagggagggaaagtcaagtcagttgcacactgggtaaatcacccaaaatttgtggccagaaatttctctgctgaaccaagctgaaaattaacagcaggtctttaatttcaacggtcagactagcaatttgtggcttatgtatagcatgagttattttatctaaacactagctctcaaattgtaagtcttaatcaatgcatctagtttaattggttaaatatgataaatataatagctattatagaaatctcttgttgtcttaaatttctaaagtattaaaacaattaataaaaatgatgtgataaagtattattattgattgtctgtgtaaaaatctactatgcataaatatttttctattaaaattttaacatttcttgctaattttaaaaatattcagtattttatttattgctccttacaaatttttgtaattgggcaattatgtaaatacactgcattcattccagaactatttgcgatgttgaacgttgagaaaggaaagtcatgaccataatcacgactttaattatggcaagtcattgtagagtataaaataatatacaataaatttatctcaacccatttaacaaaacgacttactagtaaaattaatactccttatggttcataaatgtacaattttagggagtactgctacttacatttaaataaaaatatagaattttaatgaaaaatgtcaataaataaataaaattattacaaagtcgtcattatggttcatattactactgtaggttacatcatttatagtacgaaatataaaattacattgaattgatagtattgcaatataattgtaaaaatgtcgttaaaaattaaagccgccattagtccatgaaagactgcacgatgcaatgcaccagcaggttccacttgtcttgtcttcaaccataaatttttaagcaataacaacgaaaatagtaatcagaaaaggggaacggtaaccaataacaaatagtgattccatgtatatatgctctatgtcctgtaactgaaatgatacccctggtaccgtgttgagggggcattccatgagccacatcaatatttaactaatgcaaattaacatcaggaacaaaaggaaaaaaatatcatataacaaagaccattttcatattgggaagaactagctgaattcatttattgtaatctctatgtcctgtaactgaaatggtaaccttggtaccgtgttaataaaatttatcttttcatcca

SEQ ID NO: 4901 - DNA, 1400 bp, Glycine max
  Soy_ogl_6791 Gm20:36545501..36546900 Cluster 22
ttttcttttcttcgttctcatcacggtgaagagagaatctacatatgcatgcttaatttaccttattacagaaaaataatcatctatttttattatgtttctaataatttttttgaataaaatttaccttatttttattgcctttctataataaaacttttgaaaaataaacaagtatttctaagaaattaatctttcctagatatatgcactaacttagatcttcaacacacacaaacacaaaatcctgagaaactataaaagaaaagtcaagtatctgcaagttaattgatatgcttgaatttgcatcatatatttttcataatatttgtatattaattatcataaaacagaatttgcatctcacaggaaacagaactttataggcttagaaaaaataggaaatcacatgagagaaaaatcctaaagatttaagttgaatggagaacaaattaaatagtaaagtaaaaagatacttctacttgtacggatggccatcatcattgtgaattgtgatatgcacttgaaaaagatcgacaagataaaaattgtcacaacctgccattgttagctacaacggaggttgtgacggccccaagattataatttagggtatttgtttttctttctttctattattatttggacctcctttggaaactaattatttaagggtttttggaattttttttaagaagctagggagacaacacttttggctatcaatatttgtttctagatttcttctctgtgctttcatgtaagttccgatcgagtaactaatttttttccttataatttaaggataattgaggtttggtaacttcaagagctgagaaatctaattgttctctattgctctttcataattttatatataaattgagcatattcatttttgtattattttgttcattggtgcaaaagggtcatttgttcaactgacaaaatattatacaatgaatcggtacaattaatccataatcgttaattttttcttctaataattagtagtgaaataacgaagttcaatccaagtttattgattatggaaattgtttcaatctttgttgtgtttcaatttgacaccgagctcgaaatctttgaatacttttccgaagtgcttccaaatgtcaattatattttgggactttagaatcaaagaattagttgtgaattatttttcatcaaaccagtagagtttatctttcaattgaatggcatgcatagttgaatcaaaatttcaattcaatagttcgataaagaccttgatgcatagtggttttttggtaacagcaaaccgaaaaatgcagcctttaaaagcgtaagagttatacccaaacaagacccctgatcaacatacaaaagagtgaaagaggtcttataatgctatacacact

SEQ ID NO: 4902 - DNA, 1900 bp, Glycine max
  Soy_ogl_1142 Gm04:563701..565600 Cluster 22
caacatctgagtgagctggtctttctgcaccaaaagtttcaaatggcaacttaccataatgaaaaacaaaacacttctttataatgaaaaagtaattgcaatttcctataaccatgtattgtaattaagcaattttctttttaacatgcatgctctatttatggtttgggtacagatcaaattagtttttgctgaaaaataatttttgttcttatttaattatggttaaaggattctaatgggttataatttgggtactttaaccaagtgcagatttttacattgcagcttagaccactttgagaaaattttcctgcttgactactggagatactaccatggtgacatacaacaacaaaaattattaatagatattatagaaacgaagccggctaatgcaataagcatcatcgagacagactgtgaggtggactttactcctcccttggattacaaggaacttaaaaagcctactactgcaagcaaaacactagaaaaaggttttaattcctgttcttatctggttctttttgtatattatctaagccattttccttgaggatgtatcaatagcatggaaatctgacttgacttttagtgttggatcagatttttttggtacaaaagaaactgcagggaacgtaattctgctgcctctcctcaataccctcttcagtctgccccttctcttagacagtgctataattagctgctgccaactaataattgtaggaaaagaatgagtcaatccgaagcaaccggaaattcagcctttcattggtaagaagtattccctaactctgagggtttgatttatataagatcaaattattagatagtaatgtactaagttggcccctatatgaatcatataatacaacaaaactacgtattgtggttttcttcggcaactactaaaagttttaaggaaagaggagatcggtcctttcataaattaggtgcataccacatagcacatacattggccaaaaattaatctaattgaactatattgcagtattttaatttagttctacaggaaagataattgaacacaggcacattaattactagtcttcacttatacggttatgcttgttcttttatcagtttttctcaacaagaattaaatatgctacgttcacaaatcttgatctccagccttagcatcgtcttatacaacgttcacaaatcacatgttactatcgcatatgttcctatagcagattttataataaaaacaaatagtttaaataaatagaataatttaaaaatgaaaattaaaaaacccaattactttaatcctttcaccacctttcactttcacttgctctgacacgtatattcccatgtgatgtccaattcaatttttgtggtcgtgtatgatgtgcatttgctctaggtgattcaaattgttcattcacaaataaaaggtggtcttgctagggataacaatgatactcaattcaatttggttgaatctttattgaataaagggcaaggctttaaattggcatacagcaaagcaataacagaataacaaaaggataagaggaggataattcaatcactggacgtgcgtgaattttgttatgaacaagcatagtagttggcacttggcaatgctcttttattacgaatgccactatagttagttgcttgattggtttggtatgctttgctgcagatatttggaacattttcaaagttttggggtggacaacttttctaaaatatttatgaaagaagaaattaagaaaatataatggattgagtttttctggaatattaaaatcaatttttttataataaattaaaatcaacttatacgtttaccttttattggatatctattatttaacctttcaaaaaattaaaatgtataaattaattttaacat

SEQ ID NO: 4903 - DNA, 1300 bp, Glycine max
  Soy_ogl_5267 Gm16:3185301..3186600 Cluster 22
taatgactcttcaaccaagtatttctcctcaatgttttttgttttttttgttggagagaaggacgacaagttttaaactaacattgatactttatcataaggtttgtttgataatcccactcctaaatattgtatggtcagaatattttgacttgtgtgttttatgtgccgataattcatacttgtaatatgtcaggtaaggaaaagaatatatgaatactattgtcatcttcagacttgttgaaacttttgttgttattgtgtgtgctttcgtgaaaataatgatgaacttatatacttcattattaggacaatggttgaattttttttaacatgatatatatattatatgttaacatgtattatgtgttttaattgtgcgtaatatttgataatattgcattaaataatgtcggttaacactttttttcttactaaatagttttttttattacctcctatctttctaaacatttcatctgtttaggtatgagtacatttgagtatcttataaaagagattcaaactgcatttcgtgaatgcatctctgagatatattctttacatctaagaacgtgtgtcaccgcaagccaaacacaaatccaaacatgtggtacagtagaacaatttttgctcttccttttcttactttcttcattattttctttttttttttattgggagaacataaccgttgtccctttatcattgccttcgactattttggtaggaaagcagacaatttcattttagtttagtgaacaaggttttttttacatgttattgcttaagattaggacaagctaataagggttttgacttttgaacccctttaagcgtgtactatagttaacattcacttatcaagttgtcatcttaatcacacctctgtttttcttatacctttatgacatttgaacaattttgtactaacaatcaagtatgtaaatgcttgatataaaaaagatgtgagatatattagaaaagcagtaagcataataaaaaatgggggacaaaagtttgcaaagttcatttgcttctgtgaacatcattaagaattgaatgcaaaatcatatggacgataaataggttgaacgaatatttagttacttatatgagtagaattttttttatagtgttgaaaataaaataaaaaaatgttcaatgtttccaaaatatataaactccaaaataataatgatgtatatttatacttttaatagtagtttattatattttcaatgctatagatttgtatgtcaatgtctccctaactgattaaaatttctggatgaaaaca

SEQ ID NO: 4904 - DNA, 1500 bp, Glycine max
  Soy_ogl_1874 Gm06:8856001..8857500 Cluster 22
atgaatgaagaattctaatctttgttttatctatcctctcttagttttgtagctttaccataacaatagtcgatagtctgatagtatcctatcaatggtgcttttattaagagtagaagatgcagtagagactatgcaagcaccattgatcatcaactaagactatataaatatatttatttttatttattatcatcaatgaatgaaatatcttaattttatcttttttttaaaaatctctttatgactttaatagtagtcttttagggtatctcagtaaatagcttgcggctgtttatccattgcttataataattttatacgattctatcaaaattatatttttataaaaaatatacacctgtaatcttaaatagagaaagatgaataatttaaaaatgtgaaatgattaattggttacaataaggaggtacaggaacacgttttaatgcagatgagaaccaagtccgtacgttttgttttgtttgttattttcttttttctttttcgtttggcatcgcagtgagtgtgggggcaataacattgctgattgctgaagctgcgtacgttcttctgaacacataaaggaagggccatcaagttgaacagtctcctcaatttttgtgttgattgcagattttgctttgtacccgatatcacctacgtaatttgccactcaaaaagtgtacatgatgtacctttttcacaaacaaaactctttctcgtctcatgtcacgtgaataatgcatcaaaatttatgatgatattttataaaaaaatatttttgatactttaatgttacgttaatagcataaattaatatttttttattaggagaaagggaagggatggcatattaatggagcattcaactttccatatcaatataatcacgaaaatattaaagatttgaggctatgcacactcagttacgagttttggttacaaattatttaatggagtactatagttagcataaaactttttatggatgggttgtttttccttttcccgcaatagacaaaggattaatttaattatatggatgaaaatgtacacaaacacagggtcgcatatttaaaatcttaaccggttatttttggagaaaaaaaaatacttgtaaccagtgaagcaattaactcattaaaattagaacactggtaacattttttttttttaaatcaatggaataaaggtaacgttttcttaggatagaataatggtagcattggtaagtactatataagtttttttttttttatataataaaccagtaatataagaaattaaagtatttttttaatgtatgaggtcgtttgtaaaaaaaaaaaaattggtaacctaaaacaattaaactattcagttttcattgtttagggagcaaggtcaacaaaataaataacaataaatatccataaattctttaaaaacctggggagaggaggctaaggagtaagacgctttcaagttagaggcgcagcctttgggaataataatcta

SEQ ID NO: 4905 - DNA, 1000 bp, Glycine max
  Soy_ogl_50 Gm01:2345101..2346100 Cluster 22
aggaaaactgacgagactacatttcacaagagcaaaataaatataatttctcacactatacagaaaagaaactctcaaattctcatttaacttaaacttggagagtatttggtaagaaaaaaattcatactctgagaatcatgtttatgaaaaaaaattggttgattgatgataaatatttctgaaaatatttatataagtattctctaaatatataagagggatcaaatcactcagaagtaattcttttacattcatatcctttattttcttaaaattaatgattataataaataattaatcttaataattatatatatatataatgaaaaagtgctgaaagccactatgtacaaacttttctgaggaaaactattacagcaaaatcagtctaaacaagattataaacccgtgcatatatactccaaagacaaaggaagtggatcctctcctgcaccaaggtgtttccaaccctctcttgtattatttaaaccgttagatctatataaatggatcggattatattcaagccatattcaaaagataactatccaattattactatagcaatatgggattatttttatgaatggatcggattatattcaagtcacattcaaaagacaactattcaattattactgtagcaaggtggaattttttttatggcggtgtttagggtccaccatgaagatttttaatagctattacattaatttaagacatacatttttattatatactttccacaccatagctctttccttgtatatattttaattttatttcatccattgcttgcctcgtttcagtattttgtgcgttgaaaaataaagggaggtcaagatctttccccatgcataaacaataatgatatcagtattactattatacttaaaatgcacgtacacgttacatcaataacgaagttatatgaatatccatatccacaattgtcaacgtagtgaattaattgtgtacaatgtttttaagttaattg

SEQ ID NO: 4906 - DNA, 1062 bp, Glycine max
  Soy_ogl_3582 Gm10:46505539..462600 Cluster 22
aggattaaaattgattttaaaataatgtggttatgtttgaatattttattataaaattaagttaagggtagaatttggtacaaaattttgaattcaatgttaaaattactaaaaattacttcaactcaatatcaattataaacccataattaattctaatttttttaacttgaaattaaacatgtgtggaaatgtattcaaattaattatggactcaatcaatttctcaacattaaaacaaacgcactcttaaaatggattcaattaaaattattttttgcaggttttacaaaagccgatcgataatcataataacataacaaatacattagcatttcaccacgtacttcttattgtaaatattttccatctatatacactttttagttaattttgtgtttcacaaattcatagcttttatctattgtcaagtttattgagtataagagtgttaaaagttatggacagtgatacttaatttgggacgctgagagtaatttataagcttaattaggttagataaaaaaaagttgattaggtttaatatttgatttttaaaaaggaaaaaaacttttcgttttggttttattgttgaagagttatattatatgactaacgaacttgtctaggaacttgaacccttaatgaaccatgttgcagcaacatgctgagaaaagtagaagagggcttaaataatctatctctctgcatcattaactacaatgttcagacttgggtttttcatttttcataaattattaattgtgtatgttagattgctggtaaagtcagagggagggggaaggatacgtaaccatccatcatcattttcaaagtaatttgtttgttgtttctgtttctgaaaaaagagaaaatatgtaagtttgtcttgagtgtcagtgggacccacatgatggagtcacgccggccgaccgtactattctgacggcggaataccggcggatatggtgccggcagaatctccttctgaaacactgctctactgagtctactgctctgcctctgaagatgttattcatagttgatgatagattaggcctg

SEQ ID NO: 4907 - DNA, 1849 bp, Glycine max
  Soy_ogl_22 Gm15:3084152..3086000 Cluster 22
ataaatatacatttttatgcaatttattaaaaacaactgaaatgaaagggaagtgatagtgggataaaagaaaaggaaacaagacagaggaatatatggtaatgattcaattttagcaaggattcataggaatatttacttcataataccattaaaattcattgtactttttttaaaataaaaaattgggtaatgcggggctaagcgaacaaaaaggaagttacgcatataaaaatgaatatattttctaaaaaatgttctacaaattaatttagatataagttttttttatttgtaagaactcttggagaggatttacaataatttatgcatgttagttaattaattgaattagacctttgtgaataagttaattttttttatgaaaaagtacataaattaatttgaggttaggaagaagtttattttattttatttataaatctttttgaagaaacttacgcaaacaagttaaaaaaaaaaagttcaaatctagggatgctttttatttgagatttatgggtactatgtattgcaatgcaagtagctgtaatattccaatcttccaacacagcggctctatcatgcagatgaatttatgagtagcagataaatacgtagctggagatttcaacaacacttgatcaagtctggcttgatgattgaccttaattaagcatatcttgggagaaggcaatttcattagcaaattacttggctaaacatttggcatctgatctatagatccctgtattcatgcaattctgtcctttgcttccatttgtttcctttctaatcgcgcgcatgttctgattataacaagtgttaattaaatcgtagatttgttgtctttagcaccatttattcacaaaacacaaaagggtacctgctgaaaagattgacaaaataattatgacatcgagatatgcattgataattgcaagattcgatttccatatatactaataactatatgttccccatcctaaatattaaatttatcattaattcaaaattattattcacaattgtgcaattgatgagtaatcaatgcccttgcaaaatacgagtaataaatatataatcaattatatttatattagattctattgttgtggaaaaaattataaataaagtaacttatttttttagatttactatttacattaggaaaatatataagaataattactgtttaaaagacttaattttttaagatgaccgtgaataaaataaaggaaagtacattacataataggtaaaataaaagctgaagcatgaaatatataacttggttataacgtttttaatgattgtatgatagatttatcaaattttcttctgacattatctaagctagttaaattatttattaagcaaataattttttaccaaatttattttgttcacgattattcgtataataagcatgaagaacttctcgtgaaaaaaattaattgaaaaataattttaattaaaataaggcttatttaaggccacgactatatttatgcaaacaacattttatccttcattcataatataaatcatcagtatactgcaagaaatcaaagccccacatgatagaaacacaacaaaaagtcacaaaattagtaatgcaaaaaaaaaaaaaaagtaacatcaatacatagtatcttaaaccaacataggaaaataatctttatttgacatatcaactgctaaataattttttgatgtcaagtttaactgtgacttgatataatgggttaaatatgtttggttagttaactctttgtgatcggatcttgtttatcttaaaattaatcatataaatcgttagaaaaaaaaaaaagaattgatacgtcta

SEQ ID NO: 4908 - DNA, 1539 bp, Glycine max
  Soy_ogl_1541 Gm05:2086262..2087800 Cluster 22
atatggtgagtagtggtattttcgacccacacaacaactcggaccaatcaggcagatactcattactcattattataggggagaagatcatggaggcaataaccctagtcacgataataagggagaatatcaggaaagtaatcatattcggtagtcatcccaccaataacttgagcatatacactcactaacttgaggatcgaagtggatcactaacttgtagttaccacccatcatgctgaggaactcagcatactgagtaggactcagatcatcgctagtggagatcgagagcacttcaggatttcataagaacaatatgtgtctgaaatggcacgctacatggacttcctgtcccataataataatccacgtgtataaaatttagctcataaggacaagtgctcatggcagtgtcatttttcttttaattttttttatagagaaatgttagtaactgttgtcatgagaaattttaataattaatcaaaacgagttccgttataactgtttcaacataattttaaaatttgagtgattgaatcaagtgattcagttgttaagaaggaaaatttatctcttaatattttgtaggctcttaagttactaaataaagcatttgatttgggatgaatcttaactagaatgttaacagactaaaagaaaaactaaattcgaaataaaacaataaaatcggcaaagataatttaaaaaataagtgcattgattgtttttttgttgaaggtccttataaacgtttatgcaacaactatttacacggtaaaatctaaattaacttaatctaaatcatatttatcaacgtttgtacataattccttcatttttaattgattcaactagtttattcctgttttagttaattaagcaaccatggggcaaacatttcaagttccaattttttcatgtaccatttcttagatcataggatgtttacattcacaactaattttacccagaatcaaaatttcattattttaacctcgatttaaactctaatgcacttatcttttgagcatcttctaaattttcaaaaattatttgagttgtcttttataatgattaaatcctcccttataaatgcttgacgaaagtttaacatcaaccccttacataaaaaatgtcaagtcctaccctcattcacacggaggcactaaatttatgtgctgtacccaattaccctagtgatcattgataaacatacacataaagtgggctacagtacggaaaacatttcccgtcactattcaatatccattttgttccaagtcaagtgtcccataaattccacctttccaataagaatgcccatcagacagtatataatgtgtttaccattaatgttgtactgatacagctccatcctcatcttaattaacttttgaccctgtatcagcctagaaactcgtacataacactggttgcattatagaaagctataaaccttttcaaacataacattggttcccttgaccattcaataaaattaagaaattaaatgaaagacctttcgtgttagca

SEQ ID NO: 4909 - DNA, 1440 bp, Glycine max
  Soy_ogl_2497 Gm08:4439501..4440940 Cluster 22
aattttatcatttacatacaatttacatttccaagcatagaacaaaataatttttctcattctcttagtgtacattgttgcgaaattgggtaaaatgaacatatgcataacggaaggaattttatttttggtgtaaaacaaaagttttttttatatccaaaactctgcaatcacataatatgtttcaactttgcaatgaattcataattcgaagtaaaataatataggaaagaacaagcagactttatttttgttggagaacaacggcgttaattttttttttttatcaagattcaaaataagcccagtacgatttgggccttcttcaccatggtcaagctacagcttacaattcacatatttcgacaaacgaactttctgttagcataaacctaccgatgtggattattactgtgcgtctttttagtttttacactaatcatgaagaaaggcacaagatttgattaaataaagttagatttattacgaagatgtccctaaaaaaatagaagaaagataccactataatttattaaatgaagttacaagatttttacaaagttatacattccatgtttaaaattattataactcaaagagtatttatatgttttggttaaacacataatttagtctttatacaagtcctttgagtataaggaccaagatgagaatgtgttaggtacatgcatgtatgtatgaagagatcaaattaagaataaattatgaatatgtaagggattattggattaatagtcaatttgggatcattagacagaacattatgacattagagaccaaaccgataatatttatatgtttggggactaatttaatatttttttatgtatagatactaaattgagaattcctgacatataaaagaactaacttatgtgtttaatctaaattttgtaattattttcttatgtattattggtatcaacttagaaaatttttaaatgttagaaaatgcacttgggttgtccatttcgatcgactggaagttaaatgctactgtcttattagaacacaacgtaaaatttgattataaatatctcagtacccttgtttagaatcaaacatattgaaaaagacattaaaacttcaagttgaagtgtaatttgaaaccacgtaaaatcttcaagcaaatttcacaatcaacaagtatataatttgtgtttgaaatcttttaattcaacttattcaatagatcgatctaaaattatctaaaaagcaactttgtacattagttctgaaattaatataaaaaatacccacttattatatcttgtatccactgattttacatctttgaaactgatttacaaaaaaaaaagaatattaaaaatatggaagataatacacctagattgataaagaatgaaactaatatctttatttatattaaaactagtcatagtttcttaatatggcttg

SEQ ID NO: 4910 - DNA, 1026 bp, Glycine max
  Soy_ogl_3570 Gm10:206275..207300 Cluster 22
tattgtaattagtactttaaatttcgtatctaaaatggattttaattggttgactattttatatagttttaataaaaacaagtcttaacttgtttgatttcaacgaaaattaaatgttcaagatagttcttatttcttaaaaaaaaatatttaagtgcaattcaaacattcatttaaaaggatgaataattaagtttcattcacaatagttgaatgtaaataactaacaatgtcaaattatattgcagaaaatagcagtgtggccccgcctccctccctctcccttcttttaatgttttcagaagaatcttatttttatgtatgatcaagacttttgaaagaattatagtttcattccggattacgtaaaggctattcttttcaacaagtattatttcagttgagtttttagggtcttttcttcttttttataggaaaattcatttttcactttacctattttgttttcatatgcgcagaaggtcttacctgttgaactttgctgaagagaaatggaaaagttggaaggtgagatcgagtcaagagcaattgtctctctatcaccaatttttccatacaaagaattgccaagaagcagcgtttgaatgtgtattgagtttttttttttctttctatttttaattattatggtcaagataaatattaaggaatccatcagaacttatacagtgtttaataaaatggaaggtattctttttaatattcatttgttaacaatgataatattttgaaaaagaacaatattgaagaccaaatgggggtaatcctttacaacaatatctacagacactatattaattaatatatggcgtaggattgatattcgataattaagaaacccaaaatttagaacattcaattttgattactaatttgaaaggcaacgacagacttcacttggttggtaagtcatctgtcgcaggtagctagcgaagttctcttacaatcaattttgtggcacgtccagtgtacaatgagtagtttcaactttcaggtttcccaact

SEQ ID NO: 4911 - DNA, 1440 bp, Glycine max
  Soy_ogl_3736 Gm11:4926661..4928100 Cluster 22
tttttaaaaggtagcgtgtgaggctcgtgtgtatgtgtaggtatgcgcgtctctcgatctgtatatatattaccttagggattaaggttgtaagggacacggtggagataaagaagcttgaggattacaaaagaggagaggtgggggtgtatgaggaatagagattctagtttatatatcatgggtcatataaagaggtccattcacacccacttccattccaaaaggggggggggggggggggtctaaagggtgtttttgaagaagtggaggatgtgatttttcattaggggaataatattagagaaggatcttctatcttctctatggtacaattgcacacccaatgccttacaacaggggatccatgaggatatgttgttgctttgagaagtataaaatgcgaccctcgattcaaattttcttcttttttcccccactatgacagctattcattttctcattttcagcatgtgagattcctccacatttttatacaatatacgtggtcttcttttgtgtctctggcatgctcgtcctcttgatacttactagttgatgtgagacattatggcacaggtttgtggtctgaggtgaaagtccgaaatattaatttgtgcttctggtgttgtttagagccacttcaatgcatgacgttaccaactcaaacggctcattttaaaaaggaatttttgtcgtccgatcacaaacagatgagtttcactggagataagacaggcctggacaatgatttttttttctttcaagagagaaaaatatatctctattataatattaataataataattaaaattcaaaatgggtgtcccgaggagataaatacttattttttcttccatgcatagagtccatgtttaatatacacatgcacgttgaaaaaagaattttttgtctttacaagtatgtttggttggacagaaaataaaaagaaaaaaaaacacataattaaatgatgaagtattttttccatttagttagagagaaaggaaaaggaaaagaaaggaaatatttacagttttagaaacaaaattttattttttttttcaaatcaaatttcaaactttagtatcgatataaaatccactagttatgcaaagctgacactaataaatactttagtattagtgaagtggcgatctcaagatcattttttatattttttatttgtttcttattaaaataaaattatgtcgaaatcaaagaatgcaatattttttatcataataaaatggttatgatgttttctattttattcttttctattgttacttcacaataaatacatacctgtaaattaattaaaaattaggtagaaagtataatataattaaaaaggaataattaatattatcttaaactttaaaaataacaaataaatataaacaaaaatcttcttaaaaaataacaattaagaagaa

SEQ ID NO: 4912 - DNA, 1400 bp, Glycine max
  Soy_ogl_4547 Gm13:38470301..38471700 Cluster 22
ttttaatcaattagaagtgagatgtatttgatgttaaattttaccttttatttaataaaaatcgaggaggaaagaaagcaatatgtatatacaatataggaaacgccaaatgagttgaatcagcaacagaaaataaatttgggtgaagcagagaataggatgttcccaaaccaaaccagacgcaaagattaatgatttatgaagccttcccaattttggtccttaaaaacataacattatgatttataaatgctggccatgggacatgggacttaaattggaaatcatcataaaagattgttttgttaaatgaaagtgactccttggcctaattattaaagtggttgaggaataacttctaattagcagaaagactcgtagactcataaagcagtctccttcatttaaacttcaaattaaaggctgaaattggagtgtccactgggcatacagatatttttatttttttattacgtaaactgcttctagaataggttttgttaaaagggtggttacgtattattgcaaaatctttttcaaacttacactggattatggatggcgattaattacctgccatcaccatctggaaagccacacggagaaggtgtgtgcatatatttgctaaatgttgaaatgaagttgctacatctttttattgcctccaccaccaccccacttctaaactcatcttttggttacgaaactggattccataaatcattaagaactaaaggatggagtttaattacctaaccgtgaccattttcaaatttaactttctttccaataatcatttggtttgagtacttaattatattccttaaacaagtcatcagaggtttgtaatttgattcttgcgtatgaaaaaaatttaatggaaggaacaactctgttatagttaaaaatgaggagacttcctctaattattattatttttggtttttaaaacacttgttttttgaaaataattttctaaatcttataaattttagatgaaaaattaattattgaatattggaaaattatttttaaaaacagtctttaaaagtgagaagaaaatcaattaagcccgaattattcatgatctcgtttaatttgagttgagctgtgtaaattcatttaagaaaacaaagatctttcaacgcttattttaccaaacccaaatccaatttcttgctcgagaaggactactactttaaactgatgaagccaaaattttaggccccaaatacttatattatttgtagttaattaaatttactaatgcttaataaaatacaatttgcttggaaaaatagagttcacaagagaaagaggtactatagagctagtcttagctagcatagattaatggaataatggctacaagctaactattaaaatcctcctatccagcc

SEQ ID NO: 4913 - DNA, 1302 bp, Glycine max
  Soy_ogl_5871 Gm18:1677701..1679002 Cluster 22
aatgtgaaggaaagaaataaaaaactggtgagtattactcaaaattatctttatactgatgaaaggaaaactgataaagaaagtaaacactaaaaaaagagaccaacttacaactaacatttacttcgagcatagttaattaagtgtttgggacataatattgtttctataactaagtcttacgtagattaaggtttacgagacctatcctaaaaacatgaattgaaactagtatcacctgtcttctgggctcaatcctggggattcataaagacatttcttgaacaatcaaaggggttatatgaatggtttaacgatcattaatgtgatattgattgacaaccgatcaatgctagatatataggcttaaaatcctgtatcagtctacagacgactaatatgatgtaaaattccttagttttaagtgcttttgaacatcaagagacttaaagttccgtgttggttgacaaacaaatggtatgatatataatccttcaacgtaaacacgaaaaaaaaacttataatctcgtgccaatcatcgatacagtacaaataataaattaaaatgcaatttttttcttgttcttattttttcttatttctcttaaactagatactatcgaatccattctatttcttatctgtttccattattctacttctcacttattttcattactttattcctttcttttatgtttctatccactttatttatcacctatttctttctttcttaccgaatactaaacaagccttgtgatccgaaagcccgaaacaatcattttttatgaaacagcttacactctggtggtgtgttgtgtatagttaaataagcttttaaaaatatggtaaattataaggtgagggaccaaaatgtgagattgaaaataaccgtttcatatattattcaaataaataaatggctaaaattgaatcattctccgcatataatgaccacccatttattttattaatatatctaacaattatttttaactccatataggcatttttgaccctcatcttaaaactcacctcaagaaatatatagttattttaattaaattagtactcaacttcaaattaattattagacaagtgttgttttttaaccatttatcaaattaggaactttatgtcacgttatcctaaaatcgttacataaatttttaatgtcacgatacaattttttagaagaaaaatttgtctgaaacccatatgacatgggatgcattagtcaaagtaacacttcctaaatcatcaacttagttagtggcatgcaacatggcgttaacctat

SEQ ID NO: 4914 - DNA, 1175 bp, Glycine max
  Soy_ogl_5904 Gm18:2556001..2557175 Cluster 22
attttttttttatcaatatatatagcagcccaaagaggtccaactagcatgtccagggtttcataaagaacacgtaactggttctagaagtcccaaaaatacatcattacttacaatcaaaaatggaagaaatattcgaataaatctcaaattgaaatactacaaagatcaaaataatttctaccactaacaactgtacggcctgatcagattaaattaatttgatttctctacgtgaacagatcgaagattatagttgcttgaggtctttgacatttgaaaatcgtccttaatcatttgaaaattatttctctagagctgcgttcgacattgggaaaatgatccttagaacacaacaggaaaaaaagttgcaaaggttttattccaagatttgttgaacaaattgtggatgaaggtgaagatattaaatatactctgtcgttgatgcttttctttcattccccggcactatgtattcacagaaatatgtcttcatccgctggaatttggaatcttgtgtcttatgtgtagagtttgtcgtcttacttggcttgatgtttttttcttttaggcttaattaaaatcatcttgacatatttttctggggaaaaaaaaccttcttgacatatgaaacaactagatagtggcaattctcttatttagaatatttgttagaatgactttacattaatacgaatattaggtagtgttgaccgtaaattttgtattttattttttgtcaactaacataattctataatgatggtgttaacatgtaaatgaatagtttctattaatttaaacgtatctaacaaccattattaaatctcaatttacaaattacattttatatagttgaattttgtcgaatagttatgactgtgaacatagatgtatattatatgattccatatatttcaaatgaaaagtcatattttaactgatgcctagaaattggttgactttctaaacctaaataaatttatgactaacttataactgcatgtgccgctgaagcaaacattatggaaaaatatttgtaaaacctagggaatgagttataatattgtggtgaagtcgcgtcttaacttaagtcaataaataacacagtacgtactagtaaaatgaaaaataaaaggaattcaagggtttgagacaaaaatcacacttggtac

SEQ ID NO: 4915 - DNA, 1000 bp, Glycine max
  Soy_ogl_6584 Gm19:44984001..44985000 Cluster 22
gtgtggagtaattagttcttataaaataaattcttatatgaattgagtttttaacattaaaaaattattttatttatcaatcaactgaaaattataaagatgtgggaaggattggaaacatattttatgtatttgagaattttactattgaaatgaaaaatttgtgagaatttttaaattttatatgacggcgtataagtcactaaaaaaaaaaaaagaacctatgaatagattctccatcacatcacagatgttcttaaaaactgcacttcatcatgcaatacaataaacaaaaaagaaattataaattacacccagcagcagttcagcaccttatattaaataatttcattaactctccttgtgaaccaactttttgtaatttttttcattggtttttcggttctttaagtatgttttctccgaatcaattttgttatgtattagaattagacacatgattagttgacccatttttcagtttgattagtaagtccggttcagttttttttttttacattatttcttaaacataatatatatcttttaactaagaatgactatgtaattggtagataaatttgtttgaattattataaattttttagtttaatttctacgactataaataataatatttttattggttaatttttttttttgcatgatgtactttttatttaataaattttaattataatttttaacttttaattaataactaataacgtgtcaaagattatattagtaaccgtattttcatttaacaaaagggaatcacaagacattgatggacattgggttctttgccacttgtcgcaatacttcagtggatctggtaatgccctctaactgcagtgctattgaggccgcaacacgaattcattttgcaattactatcctgacttctgaatctgtagatttggtgattggtaagcaatcatatgcgtcacaatccagtcatcaacttaggcttcaattctctttggctttcttgctt

SEQ ID NO: 4916 - DNA, 1200 bp, Glycine max
  Soy_ogl_280 Gm01:52113501..52114700 Cluster 22
aggatcaaatgcaacgccaaaagagacttagaaagtaaaaacggcttgcgtgagtggcgtaacaaatttaaattgcgcgtcttttgggactttaacacttaataaaccatgttctattatagtaatactagtatatcttcagatcaatgcaacgatttaaatattgaccctaaactgtgaaatggaagagggggattgggagaagggattgttacttttggaacaaatttcgtgtcaaaataaattaatgtctttgacgttttgactcaacggaaaataaggaaggtgctgcgatgcatatccaacatttttttattaggataaattccaccactattattttctttcactttttattatagccagatgtttagtagcatattagtaaaatttcttaatatactctcaatgatttttaaaatatatttttatcataatttttaataaaaaaatattatttattcttcaataaaacagtgattaaaaaaacctttgatcgtatcttcaatatcaattaatcaattctaattctaatttttatttggatcaattcccaatccgcaatctctcaaggagggtgcaaaacaaacaaatctagctatcatccccacttcaaaggtgcagggtacacgcttcttgtaggtattaccaacaggcatttcccaatggatacttaaatataattaacaaaatgttcccacaagtagagttcgatttttcaatgaggtgctatatattatgattaaagatctgtgttgtaaattaaaaagatatttgttttagtataagttttttctttagttgaataagacctattccggcattcaagcgataaaatataatttattttttttaggttatatcattagacttttatcttttgtatttctttcatttcacaatcacaatcttaacattcaagtctcatgtgattattatatcactccaaagattgtctatattaagtgaagagtaaagaattgatcatcgattgactcacaaaaatctataaaatttcaagagattgattgacgatgatcaatataatacataatttcttaatctcgagtgtgcaattaaaaaaaattaaaatcaaacaagaatgaattgcggtaacatatgacccagacggtacaatctcaaatacataaaaaaagaagtctaagtgattaaattttattaataactgaatgaaatttt

SEQ ID NO: 4917 - DNA, 1359 bp, Glycine max
  Soy_ogl_4 Gm03:41909342..41910700 Cluster 22
tatgaattatatgtattttttactaaatattttgaacttaaattcaacatcactaattaagttaaaataatcacaaatcatttgatccacgtatataaaaattgttctatggttgtcatatatcgaccaaacatgtacagtttttatgtaattatccttttcttaattttattctcgttttttcttctctgatcttttacttagtttaatcatatgttgttgtttttctgagggaaaacatatgttgttatacgtaataagattgttcatttttcaaataactacttttttataagttatgttatgttaattttcgttcttaaaaactaaagttttttttttattttgttgttgctgaaaatctagctaaatgaaggctctttgccatcccttgcgtggatatttgatttttttaaacaggagggactgatcatgtcatccatatatcaaccactatatgaagtaaactcctaaaatattttgaggatgagatcatggcacgtcagaaatgagtatgataatgtagaatgaaaacgtgatatatatagattgagaatattaaattaagtcaactatgttaaagacctgcatgtggacatgctagctgggtcaagtcaattaatttggcacatatagatatagtcctaactcctaccaatcccatcaaggtcaaggtacacgcacaaggcacaacacaacgcatcttcgttactgcatagatttatcaagatctgcatgcggcggcttaaaatatcagtttggacttctgaagttcggagttggactttcaaaacacaacggttttcttcgttgcgatacgttgattaaacttgattatttagcaatctgtacgtcggcatcgacttttgtcttaataacttttagctttcccgtccttaaatttatttatgttagattgagtcgaaatccacaaagtacaattgcatcatttgcctctagttgttcttcttttacttttatctttgacaaaggtttataggattaggaggtaaaattaatattaggaatttaagattgatattgtctgatttttctttttaattaaataactttctctgtctgaaattaatattactaaataatgtgctttctgtatgggaccccataaaaacattcacttcttaaaatgtgctgatatgtaaggtaccaagggcatactaaaactcaaactattgcttgaaatactacttattaaggtgtcgttgcagtagaggcaacggaaatgaatggagatatttggtgtggagcaaatagagcttaaatccaagaagcaatacaatgggatcatgcatgccaatatctgaagtcatggctacaccagctaactagctagtgtgt

SEQ ID NO: 4918 - DNA, 1100 bp, Glycine max
  Soy_ogl_1703 Gm05:37349501..373200 Cluster 22
gctttattatgaatttaggatatgaaatagttttataaatttagatttaaaaaatttagtgagaatttagtaatgtttaaatgatattatacggcataaaattaggatttgaagaacgaaaattgtgagatttttttttgggtgagatttaatgattttattagtgaactttgagtagaataattataaggtttaaaacaaagtaattgatttaacttatgaaaactttaagtaaaacataaaaaatttgaagattctatgtggaagaaaaaaggacagagaaaccaaatttgtctaattttaaaaacatagaactgaattaactaaaaagatttaagaaaccaaaattacacacggtataattgaaagaaatgtttcattttatgcatcgcttcttgaaacgattaatgttgctctctaatccactttcccctcttagccacttatacatagtactcttccttaaccatgtacacctaaccccactactagtctatctcttaactatattaacaccaatttcacacttctctcaactactcataaacaaatattgaacacttggaaattaatccccaggaagtcttaaaaattccatgaatcaaagttaaaccatccttaattcttgtttttactattttgtaagaaacaaacacacttaatttgatttcatctttgattttgatgtggagatctcaaattataatgttgttggttgcaaagatgtcatagatagcaaggttacgacctgcaaaatcagaaagaagtagaagaaaatttagaattgtggatttgcacgtatatctgatggtaagaggtaatcgtatgatcttgcactatatattgtcagtgaggtgtgtgtatttttaactcagcaaaaggtaaaactatatatcattgagtacaatgggtgcccaaaaccatttacaaaaatggttgtgtgtatcatattaggagacaatgaagggtgtgagtggatgagaggagtgttattaattagtcaaatcttcaattccaataagataccaattaagttactcggtcattcgtttcataactatatataatgagtcactgatggaactaattgaacagtataa

SEQ ID NO: 4919 - DNA, 1100 bp, Glycine max
  Soy_ogl_2197 Gm07:4896301..4897400 Cluster 22
gcataacatggttgcagaatgcagtgaaccaacaaggtgtaacaccccatgacaccaatcatatcatgtctctctacgagtcaccttcaatattgtggacagtaattcccatctgacccaaaaccaaggataattttagtggaagactaatattatgatgatgtaccatatgaaacatccaaagtccaaagccccaactcctcatacaattctcaattttatcaatcaaatcaatgcaacactgcctctcgtaagaattgaatatttgaaccaaaaaagaacttaaacaaattaaggagtactttgtttaacaaaactttttttattttcatttttaattacaaaacgttaattttagttccaccttgtgtcttattttcaaaactttgcataggaactagtgaaacaactttatattgctttatgtttgaaaaagtttatttaaaaaacagtaaatggatgagtttattaccaaaaaaaaaatagcaagaaaacatgtaattacggttcctttcgtatttgattcctggtgtttggtgctaaaaacacttaacccttgttggcattttttttttcatataactattaatcatatgaaataaatttttctctttttgtcttcttatattctccagctttgctttgaatgttttaaccttcaaagttagttataagaaatcttaatgtttggatcaataaaaagaaaagaaatgtaatggaatgaaaatattacttataattgtgttttatcttttaaacattgaattgaaattaaaattgataatatttttttcctcaaaaattggaagtacgtgccaacaaaatggtccaatggcccgcaatccactcgggccgagtttcataactattccgtacaataaatttttagcctaatttatcttcacctgcaaatgagttaggtaatcaaattaacatagtaattactactgaagttatggagtaaaacaaaatctaattccacatcttgtttagttgtggatgttttaattatggattcaatatcagggaaaaataaataaattactagttgaaccacatgataaaaaaaatagaaccttataaggaacttgcatccaagt

SEQ ID NO: 4920 - DNA, 1300 bp, Glycine max
  Soy_ogl_2930 Gm09:1334101..1335400 Cluster 22
actatattggactcataggcccaacactccttctggcaccaagcttaaaaggtggggatgtttggttggttggtgatgtataatgtccatagccccgcaaatgtcaagtttaaaaggtgtaactacttgctcaattgagtaatttataattgatcaatatataacccctaaagcatcaagcctaaatggtgcaagcacttgttcgatcaaaagattcataatctgttggcctacaaccacccaagtgtcaagcctgataggtgcaagcatttgtttggtcaaacaatccattattggttagtttatagcccctcaagtgataagcctttaggcatagaccctggcttagtcgagtgatccatatttaggcttgttaattatcccatgactcttctctttatgtttagagattaattgttcgactttcactatgagtcttttttaatgcttagatttggttgattgaatcttgtctcaagccttatcttcatgtctagggagtggattggttcactctctcacaagtctttcttgatggaggttggttggttaactctttctcgtaagtcttttgttagtatatagggttaggagttaattggtcaatgatttttattttttttttgtatttggtaagatggttggttgactttctcataaagtatttaaaatcggttatatattactacaataaactcaatatcaatcaaatgacattaattatttttttaaagtattatgaagcttatataatttgagggtttaaaaaatttacttatttactattaaatttattgcggtaggccataaagttcatatcttttctttactttggtgaaaaaccttcaacaattgttttttttttttttcgaaaggaaacctttaacaagttgattatataattgatgttcgttaaagtgtaaattgatatgacaactaggcaatttgagtttgaatccaatggttatttccatgggcaggatctataaatcccattaaagattcacgttagtaaatgacaaatggtttccactttccaggtggatttttctttgggttgtaaagtttacttttccaccgtataaaaggaaaattatctctaattggtaactattgctttaaaaatatactgtaaaagcattcattcactattcgttaatataattataaagtgaatacgaaatactttatatgcatgatctcaatataataatatgttattttcacttttttttacatttttttatttaaaattacctaagaatactcattcctttgatataattaataattaaaaata

SEQ ID NO: 4921 - DNA, 1400 bp, Glycine max
  Soy_ogl_4098 Gm12:35676701..35678100 Cluster 22
aagtgaacggcaatagtagagaagataccaaaagaaaatgaaccatacacaagggtcgcaacagatagagatggtaagcactcttatgttgtattatgcaacctcgtcatccgcgtgctttcactctctttcatctcattttgggatgagagttttaagccatgggttccacattcttttcaaaaaatgtagttgcaatatatttccactgaacattccttctcacaaatttcattccaaagcaattaaaatcaattgcactcaacattcatccccttgaaccaaacactatttgataattatgggtatttttgttcaaatagcatgctgtattacttgacaattaagcgataaaaaaaaaagcaacaagaaataagactctctttgacactatatttggtagaagagaaacaaccaggaaggagcaggagaggaaggagaaattgtaaaatcatgttctcttccttccttatgaaagaataaaaaataagtgatcatcaacccgacttcaagaataaagtaactaaagtttaagttttagacttattagtaaaaattattttctattatattttgtataaaaaaattacatatattgaaaaaaaattaatatataactatctcgtttaaagtaaaaaaatgtttttttttttaattttctttttaaaccttactcataattaggtcggggaaaactcaccaaatattataaagaaatatctgaataaataaattaagtattcctaaattattattataaaccggtttatttaaactcttttcaaatgaaattctcccattgaaagatatatttaagcatttacagtaattatatattttatatataaaaaaactccaaaaaattaatactttataaaatttgaaaataacaacctttaaaaaattctaaaaaatctgtatcacagaattaccattgtttattatttattaaagcctaaataaacgggtctcgtatcatttgtccaagtcatgaactcacaacagtcggagcttattcaacaaatatgtaaaataatgttttttgtcttatctaaatttcatgtaggtaaagaacattattcttttctcttgttacttgcatcactcacttttttttataaaaaaaatagtctttactactttcataatttggaggacaaggaatgttattcatgtatttttgttcctgctgctgatattctctgtgattgtatatgaaaatggctggcaactaacaacctctgcataaacttaacaactttttaggaatattatgagaacaatattcaatctaacttatcacgtatctctctggacggcgaaaggggagcttaagcttcgggatttggaccacatgtcctcttttgggtttgcttatttcttcattgcatatgtcacaa

SEQ ID NO: 4922 - DNA, 1249 bp, Glycine max
  Soy_ogl_4539 Gm13:38161125..38162373 Cluster 22
taaaaagatattattagagtcaacctgttgagttaattaatatttataaaaaatattttttatctttaatattgacatagttgacgctagtttttcattttgagggccgagaagtgaggatgcagtggaagagaagggtaatggagcggagctgcttcaacagcagcaacctatttttatttttattttttttgtgcatgtgtgtattgtgtttgtttttacagaggtcattgtttagccggcgctaaaatagtcattaactttagttttttgataattagggctggctttaatctgatgatgctacctaatttatttatttttttagtgttttttcctgtcaaagtcaggttgagatggaacaaagtactgagtttgaattcggatttaagtaatagcaatcaaacataaacaccacacatgtaatgacatctaaatgtcatgaaacttaagaatataatctagagataaactgatgatctgatgatggaaaaaaaaaaagaccggtttccttcacattgttgtttgtgcatgtttgtctatcggtttatttttatatttcttaaaaaatcttctttttttatcatgtggagtctttgatattaatattttaaaaaaaatagaaaggaaataaactaatattcaaggttacgttgaaataacagcatattttatctcaatctcttaatggcataataattgatattgacaaccactcttctattgaaccatttagctttttttattgtgacattttagaattgattattggttctctctaagtctgaccctttttacccagctaaaaggaaaagtgaacaaaagttgagaactatcaaatattgcaaagcactgtagtctatggatagtgtttgtaatcaatcaaataaatttcatgaaatgatagtatatatctatggaattaattggaagtcgtcggaatggttaaaaacagtaaaacatcgtggcgtgtgaagctgcaaaatactaatcagcataaatttgctcttaacaattcgccatacttgaatgcgtatacaaagagcatgtgtcatgaaactgaaaagccgaaatcgtaaaacatgcattgcatccatcatatattgtaaacacagtactctcttattgtagccaacacatttgagacaacatatagtggcatgagttgttttgcttttactgtaactttgttgttccttttcttatatctgtgataagaaagaaaatgacgaaactttgctatgtacgt

SEQ ID NO: 4923 - DNA, 1171 bp, Glycine max
  Soy_ogl_5208 Gm16:587730..588900 Cluster 22
ttttttgttggcatataggatgtgcctgtgtgtactaaatgtcacaaattaaatactatcagctatgaggtcagaattttaccctccatttcacccaatacgtcgctaccaaagtaattttctaaaccgatgattgctgtcatggatcagctttgtaacaatctacgtgaaagcaaatttatccaaaagagagaagatagttttaatgctctatggttattaattaaaaaattgtccctaccactggctatgaaattaattagtgcttttgttctgtaatgccatacgagggtttactttccaatccatcaattctacgtgccttcggaattcaattccatttgcataaaaatctcacacaataaggaaacatttcagtctctcgtagttactctttcaccaaccaattgtaagttgaatagagacctttaggctggagtatttaatattaatccatatttttaagaacccattagtttgtaaaagtaatctataaaaagtttaatcaccatgtatagttagtgtaaaacttaaacatctttgtgttatatcatatcatggagcccccttgctctgcacaggctgcatcaggtttcttttgttaatcgaacggtttgaacccccatcaagtttaatgtaacagaaatataaggttggttgaatgattaaaaaaaagtaaaataaaaaaagatggtggattcaacgtattctattaaaaaaaaacaaataaattaataaataatatttatcaataaaaaaagtattttgatatttctatacattttatttgggggatttgttgtggagatggtgagtttgttgaaattagtatttggtttgggctttcatgaactaggctagctatttatgagttgcactgctgcgggcctaaacatttagacatttagtaaacagaaaaagtattgcaaatgttgaaaataaaagagaaaagaaaataacaagatgtaaataggaatactatgaaccggaaacatgaagggttaaaatatatataaaaatatggaaacaacaatggaagaatatcgtaacttatttgaattttatatttttacttttgctttattttgaaaaagaggtttaatccaaatatatatgacgcattgttaattttgtatttggttacctttgttattcctaataaccattttat

SEQ ID NO: 4924 - DNA, 1100 bp, Glycine max
  Soy_ogl_6265 Gm18:59024301..59025400 Cluster 22
aaaacgggtagggtaaatgtcataattgatttttgtagatggtccccttatgctttcttgctttatgctgaataatgattatgatagccatatatatatatattcattggtcccttaacacttagccgcagccacatacatgcacatatcctcctttttgtagtttgtctttctgttactactgttgtggtgaatgctgggtccatacatagttatggtggtcctagtcatcgatcatcattagtcatattttcagagaggttaaacgtagtcatcacagtttcttgactcttttgcttactgctaaatccctgacgaatgtattttttataatcgcaatctttttttttatatgtatttatagtcacaatctatgctagtgagtaactcattaaattaatccccgtcattttaattctgataatttgtaaactctaaaattataaaaaaatttacaatttcaaaaaaaataatgttcgaattaattaataactgtgaatgatttcaattattagaatatcaataactttaatttgttatatctgcaagattttttttaacattaacggctgttatatatatattttatgatggactggatatagtattttagttttattgtagttttttagggtatgagcttactctaaaatcaaatggcaaccaaggatgtttagcttacataattaaatcttttgatacatataaaggcatctcttatgggaggagcttacatgcctttcaattcttattgatttttggtagtcccaaataaataagaggtctgacatgtgcagaacatttttctcttctttgcaatgaatgatgcttgtaggtgtaaataaattaatttttaattcttaagcaattatttctcatataagataggtgcttaattttaagatactcagtttgccatctggaccacctccaacggaggaaaaaaaaaaagaaaccatttcttgggtttaagcaactcttacgacactactactggaaatagaaaataaataaaattcaatttttatataaatatctaaaactaaattaagaaattaaaataaattattgacaaattaattacaaattctagattcact

SEQ ID NO: 4925 - DNA, 1068 bp, Glycine max
  Soy_ogl_981 Gm03:39763601..39764668 Cluster 22
cttaagtgattttaaaaattttgcattgataatttataaatgactgaaactttaagaaattaacaacaactttttaatatatgtcatgtgcttttaaaattaattttgataaatattttaaatgtctttgtaataatttattaatgatggatacagaaaacgttaattgaaaataaatacatattttttttgttgctacaatacatagtttaacatagattttataactaaatataaattgaatacaaatgttaattatatttaattatttaaggttttttatcaatataattttccttattttttttatatacaaccataagtatcttttatcaaggcatttttatttgagcaacactattatagaatgcaaagatctctctttaaagtatttattgtagcttcatgcctgcatacctatactcaaaattgaaattactttagaacaatgtgtaccaaatattaatccacacacgttagtagtttatccaatattaaaataaacgaaacctaatttgtgtcattcaaacacaatattctaatgtattctagctccaagtatatatggtattcaacaatggcttctaggttattcctcttgactttgaattttgaaaagaagtccaggcgatctgatagaccaactgatttttgtcttgaaccaaatacaaataacgaagatgttaaatcagtgctgatcatgaaaagaaagtgtcaaatatatgtttctatttgggacaggtaacagagatacatgtatcttcttatgtcgtaaaaaagcacgaggcgtccaggcctaagcctataaataattgcatatatttaatttaagtagcttagcttgtagtactaactttattacaagttgatagtagttaatgcccacccataaaagtttcaatctttctttcaaagctttattgtcttcattctctttatcatatttaatcatcataacggtatcccaccaacgatgtatgaaattgaacttatcagatgctactaataattataacaagactttttaacgatttatcaagacaaaacttatgatactatataaaagac

SEQ ID NO: 4926 - DNA, 1469 bp, Glycine max
  Soy_ogl_2112 Gm07:1316632..1318100 Cluster 22
gccttctagtggttcttatagatggtggtataaatgcatatgctaatgagtttaaactctagttttaatattattttttaaaaaattttaaatcttatttttgagcgttacgttacgatactagcatgtccaatgcatatcacaattttattttatgggcttgcttaacatcaaataaatatatgttaaacaattttattacatcttattggtgatttgagttaagtaattaaaattacataaattaaaattaagattaatcaagtttttagttagttgattttttttaaatttagtttttaattcctacatttgaccgaacaagatccttcaattttttttattaagaattttaattcttaaacttttgtttaagtgatggagattcttaaacttttagaaattttaattttttattttctaaataaaattttgaatctattatttttatttatttaatgagattttcaagaataaaaactgaattttttaaaagtttagggattaaaatcttaattaatcaatcttgatgagtcaaaattttatctaaaaactaaaaattgaattttgaaaaagttgaaggactttcactaataaatttttatttaagaactaaaaattaaattttaaaaaactttagaaactaaaaacataattaacccctaaaattatattattggtaaactatgagaactaaaaatatttatcttatttttttcacaaattttaaatcacgagaaaaatttgcaattgcataaaacgttcaaacttacaatcatatgtcatcagattatttaggaaaaaataaataaatagaggctccataaacaagacttatcccattttatgtacattaatttggtaaatttaaaaccaaattacacaaatttggtgagtaaataaccttcagaaggacaactaatcccgttgtcccttctgattatttttaaattttttcttacttgaatgttttagtttaaagtaattggtgtttctttgtttggagtctcctctagaacatcaaatcatcattattcattacgctagcctgttaacataattaacattttgtgttgaacttgaacctagctaaacgaattaagtttcaattaatgcaagcaaaatttgagcacccagaagaacataatcaaatcagctttaacaaaggtgcgtagatgtataaagcatggctgcgttaagcttttaagaagtaaagcgggtgcttcgttttccgtcatgtggaatataattttattcacggtcaattaacttcataaactttaatgtcatcccatgctttttcggtagttctaataaagggagtaatcacgtttgaaacagaacaaccaagtcaagcgacccctaaatatatagagatgaataagactatgcatatgctatggttaattaatcattttcattaggttcttaacaaactagtgacgaatttcactttgattttttagttt

SEQ ID NO: 4927 - DNA, 1542 bp, Glycine max
  Soy_ogl_2492 Gm08:3531201..3532742 Cluster 22
cttatacacatgtcacatgtcgaatatgaatgctgttgactatatttgcttgtttaatcaaactcagtccattgagaacatataatattggacaaatggcatttcaaatactattaattattttatttaattaaatttcaatggctaaagataactttcaactttttttttttttttgtaaaagctttaagaaattgccctaatatatctaacacattaagaagaaaaacagcagaacttttcgtctttggttatattttaagaaaaataaaaattataatttatatcctttctaagcaaataagtggatgtacaccttatgaagcaaaaaaaaaaaaaaagtggatgtacacctatttactttttaaaaatatattttagcataatgcattttaaatgtacattaagaaaatcaaagttataatttattaatatatttatttatactaaaacaaactaggtataatataatgtaacaaaaaaactaggtatacattaacaaatccacgacagtgttcaaatcaattgtataacacgtatacacacagattaaatcaaagttcttgcagcagtttgagcttgcctgttcttttatttatatttataatttaaagatagtttgacagtgatttttcatagttggagctctagtaagcgccactttatttaatatttttgtcctctagcatttcatttcaatcccatgttttttgaccaagactgagatgtcccttgcatcttcgcatcatgaatcattcatctccgcaaaatccaactttctaacacttttaacgatgagaaacaaggaacaataaacaaatagtaggatattcaaatatcattcatttaatcaaaaagatggaatctaatggaataaattagtcttttataatatgatgaacaaaaattaaaatttttgctgaaaaaaatattcataatgttcgatcatattttgaatatgattgctttcagaataacgtgaaaaaaaaatatcatccattttgtttttgttttttattatctaacagcgcgcttacgtttcgtcattgaattggccactgctaatgtatgatcgatttattttatccttgcgaaatttttattttcataaatgatacataaagtatttagatgttattgtaacacgtgaatttatttaagccacactattattttcgccattcttttataccaaaattcgatactgttttctccttgagctcaaaatattattcagtcatcttaattttatctgtgtaatagcgttagattttattattttgagtgtgtttaggattcagggtataaaatatatttgaaaaataaaactgtacattattgttgagtgcagcgacggtgaaagatgatttaaaataaatatacattattcaagccttttaagttttaccatcaatttacttccaatgtttcaatacacgtacatattagtttttcttcttttcttttgtgaatgaatgattgaattaaaagaaatttatattagtttgatacggccttcatgttgataagcgtcagcttttc

SEQ ID NO: 4928 - DNA, 1100 bp, Glycine max
  Soy_ogl_3335 Gm10:3016801..3017900 Cluster 22
aataatatattaggaggatcaaaatcaccaatttataagattaggggaccaaatgttataattaaaatttaaagagaccaaaatcataaatttgagaaattaggatgaaaaaaattataatttaatatttatacttttaattctttaacttccacaaatcaccaagagtcgtctaagacacccattaactattttttaaaaaacttatttaacttttaactatatatgcaataatttttgcaatgagatttactttttaagagagaagagtcattagtctattgtttttaaactataacttttactaaatgtttttaaatattgttacaaaacattttttttaaaaaaatgttgtatatatactgtattcttttatgaatacacatcctttaattatttcttacagaattattctcagctagctcaaaaatatgagcagattaattggttctgtttacaacttccgtacgtgatcattaatcaaactttcatagaatatgtagaatgaagatgcaaaagaacaaattagagaaaagaaattaatgaagtttgaagaaaagaaaagggaacaaatacattgcatatgtaatctaaatttgaaaatttgagagcaggccatggacggatctctctctccgcttgacttagacttcaacgttccttagtttcttgtttttaattgattgtcatactcggtttggtcatgctcatgcacatgcgtcgtttcttatatgctttcatgccccgcaattctcaatctagctaccgtttctatatctttatgatatcttttcattaatcatttgcctcagcgagcaagttgatgtttataacttgtaacaatacaaacaaatgcaattttctttgaaagaacaaaaacaaatgctactatctcgttttccgttttttgcttacaagaatattgtgatcatggaataagagaattaggaaattaaatttataagcaggtactagctcacggaggcgtacatgcatgcatgcatgcataaacatcatgaaataaataagttattatcccaacaatgagttggatatagagtggtaacgggtaatcaattacggttcaaggaaaaacttga

SEQ ID NO: 4929 - DNA, 1200 bp, Glycine max
  Soy_ogl_289 Gm01:52279901..52281100 Cluster 22
gtgttatatcaggtgctttcatcgcaattacttgcatagtttccttgccagcataaagaggaactttttttaattaaaaaacaaacaaaaatgaattctaaacacacgatgagcagttagtgtttatttttacttcttgagtatttgtccttaatcttcttttgtatttgatgctgcctatgtaaattttctgtgtttttttttttatatacagttttctgttgattttgaatataaactgtctatatgtatgatcaacttatgtaaagctcacttcgctatatttactcattaaaaatatataactaaatatacaagttttgaatgatgcaccagcaattttttctttgacctgctattggttgtaagttaatgtttatcaaatattttatccctttcatgaactaggacttgatccattaaagagtataattgttaaaaactccaaatgcaagctgctaaataagaatcttaggagagagagcttgggcaattactcagtcaaaacaaaaaattgaaaaggaaaaaaatgcagaagacgacacaaaattgccaattcgccatgttttctgatattctacgcatagtgctctccctgtctttcaatctaaatcccaaaagttatacgggacagaataatatatagagcagtactgtagcagaagatacaatcagaaagaatacaacacataaaacgggggaaatagaaattggtaatggtcggaagagaaatgctatcaatgcaattttttaaatacattctctattattagctacatttattaaaattcacaatatttgataagtttcggttcctatttaatgagtcttatttcataacttcatactaaaagatttattgaaaaaattattacaaacactcgccattgtataatgaaaaataaaaaaaaaattacagttattcaatcacatctcattatatattagtgattttttaaaaataattattttgcattagttattattaagccgttatatatttatatgaacaataaacctgtgcaaagtccccacgctgtttggttttgagttttgatagatagatttttcagtaaagttgtttgtcgttttgggactgattagcctctcccgtctttcaattttcatcttttttccttcattgttgaatttggtacgcaaataatttgaacttcaaagccgcattgaggggctttttct

SEQ ID NO: 4930 - DNA, 1063 bp, Glycine max
  Soy_ogl_5213 Gm16:766138..767200 Cluster 22
aaataggaacgggccagaacagaacattagtcagataaaaaaaaaaaaaaaaaactccaaatcatctttgtaatgtcaatgatttctattttgcttctcacctacaaggtaaaaatagaaagatatggttgatatttaattaggagagcatgcatgctttgcaattcctataaacacctcagcagcatgtttgtttcttgtttccgaatctacatgttcttagggcagacaatactgtggggagtctcataggcatggtccctactccctagaatccagagtttgatagagtagtagtacctgacaccttgtcaattttcctatgtcactgctcaactccaataagattttgttctttcactttactatatcgtatcagcaattcatgtaacagtttatagattattggaaacaaattaatagtagtagtgtatttggatccacttttctcataatcaatttcactttcaaaataataagcagttgtttccactttttcaattttttatcatgattatgggagttaatcagttttgatactatccaaaaaaaactaggaaacaataatgcaaaaacatcttgagagataaatcaatctctgacatgatcaagaatactcaagctcatcaaaaaagagaaacaataataagttgttcaacaaaataagtattctttttattgatttgtattttaatgctatatgaaatgttttttttttttactattctagagctagattatgaagttcattattttttgtctggatattctttgatttagagtcaagaaataatctttcaacattaatattgtttaagagatttacatctcaatggatattttttcatataccgtacaacacttaaggatcatctaattatatgctaaaaaacaataatatctatcaactatgtcatatcgtgttgatagattatagagttcatttaagcaacattttagtattgttggtataaaagaaaataaattatttgactatttaaagtaataaaagtgatattatattattaaaaaaagtataaaatattatattacaactttaatg

SEQ ID NO: 4931 - DNA, 1700 bp, Glycine max
  Soy_ogl_2945 Gm09:2184701..2186400 Cluster 22
tgattttttcattgcaattagactcaaattataatgcaaaactcttcttcaatagctggatttgctactttaatctcatgattcactttggcactacttcaccatgtgtgactttgaaaatttagttacattatgactactgctttgtgacagcaacattgcagacagacagagaatttttattttattttgtttaaaattaaagctaccgagagagaagctacaaagtgaaaaataaataataaaaaaaattaatgtaaaacacgtgacaaaatcaaagtcctttatatgatctaacatgcaaaactctctcaactacaccttcaggtgtcaagtatgggagaggattcggatttcaaaattttgatcatgtgatcaacttgttatcttgagtaggattacattttacatttaaagatctttcatgtagtgtatttcttctcatttcctcaattcttagaactaattatataattttcactattttctatcgagctttgttgcccacttaattaatcaaatttctttcttcgttatctcaaacttgaacagatttctactaacttaagaggaaaggtctactgaagggcaagattcttgatttcttgcactggaaaaagaacgagtggaaatagttatttttttattttttattttttattatagcaacaagtggtggaaatagtagtaaagaaaggaagagatccaacaactacagcaaaatagaagcatgacattctacaaatgatgtgaatatcgtttttcttagccggagataaaacaacgacatttaaaaaaaaaaatcaaatggaaataaatttatgacatacaagtggaatgcgtatgattgcattacaaatgacaacgatatatcagttcccctgttgaatggaaaaccaaatggtacactaagttttgaaatattcaacaacttgcacgtttatatttaatcaatactttttaaaaaataaaaaaataaactctatctgtttagggctccaggatgatattttttctcttcgtcccactaatatacataaatgagcaaatccccacatgttagtccttaagattatagttattgagagatttatttgatggttaaatctttacaaaattcacatttaaatgactaacttaatataaaaaacttaaaaaattaataatataatgattcattaatgtttagagaacatgatcgaggatgaaatcttatttgaaaaatctccaagaaagtacatgcattagctgcttaatatacgcgcttacaaaagtagcaaaaaagaaaaatacgtacgcgtttgtaagtaagccatttacaagtataaccttatatccgaatataatataatattcctttcccacagttaccgtccacatggcacatgctgacttttttcgtttatgcggcattgttagtctccgttttttaatagtgacagaaaaaggaaatagcatgcgcataatatgattagaagtatttttaagaataaataaataaaataaaattgaaatgagtttctttataaattacaattaacttggttataacctaatttctaaaaacccttccattacatttttaaaaataaatttattatataataaatgaatgcaccgttttaaacacttataattataaactattatttttattttgacttaagttattttcaaagttgaaaaaaaaaacagtaaaa

SEQ ID NO: 4932 - DNA, 1322 bp, Glycine max
  Soy_ogl_3218 Gm09:40167479..40168800 Cluster 22
gagattaaaaattgattaagaccattaatatatgatggtgttgatctacctaataactatatcccattgaaaaagatgaagcaagtgggacacatctctctctttactagtgattttgagaattttggcattgaaacacagggagtaatatgtagtactaaataatagataaataaataaaagctggttgggtgagaaaaataaaattttgtctttgtggggatactgcagctgaaaagcaacttttgaaatagtagagggatgagcacttgaacagtgattttcctgggaaagtaatgtagatgccaaaactgaatgtattgtccgacgtgtgagaccgccccttttgacgtatatccatttatccaattgtgactgatgagagggaaccatttgattcatacattgacatgattgccattttagctttaaatcgtggccacgcattaatcgaactagcgtagagtagataaatgataaacctcccaactgtaggaattttcttttagatcatggttatgatagtctgagtttgtattatatgatatatgatgattcatttctcttgagggtctaaattcttaaaaattatatttatttagcaaaattccttctagtaaacataacacgtgaagagcactaagccccacgataagaaagggtaaagaaagcgacttggacccttttgagatcatccaattggatacaagttgccaacttgatactaaagaaaggcgaaaacttggagatagagagcgacaaggaggaatagaagctacaaagactagcttttttagaggagggaaatgctcaattgctggtgtgtctgaagaatctttttagtccaaattgaagcatttccttttccttttcattttgctagttcattattggctcttctgtgagtaaaaagtagtggccacaatcacaagtaaaggcctcctaaaaccaatgaaatgaaaatgtagggccaaaaatataaaatgaagtccaatcatatttctttgctgtttgaaaatgctcctgttagaaattcggaaaagattttatgtataaaaaaatggatcaatagaggttgtctctttttattttttaagtattttttatatgtgcatatataaaagaaggtaacataaaataaaagataaagatgattatatataatattatatacatgttcaatgataaaagttaaaaaaaatattacccaataagtgtaactaacaatatactaagtttgtgaaagaaaatctgaatttatagaacatatctttaatgaagaatgaagagttttatgtttaagcctcaaatgaatgattaat

SEQ ID NO: 4933 - DNA, 1089 bp, Glycine max
  Soy_ogl_5896 Gm18:2378212..2379300 Cluster 22
gttaatcaattaagtttcttcacttttcgttacaaaatggaagctgattaattggcgtcactttaggatttaaataaaagtaaagatagtgaaaatatcaatcaactgtattaaaaaaaatttacagtatattaaagacaaaatgatatatgctttctttagcttttacgagtatttcaagaaaagttaaaaaaaaattttgttacgagggaagaaaacaaacaaactactgaataaaaacttttcctgcggcatatcacttcgtaatgcatttatttatcattctttaacacttataattcatacacagatactgtaatttaaaatattttttctaatttataataatagtttatttactaaaataaataaaatgtaattaatatttttattatgaatgattaataattaaaaaacgagacttaagggcatatttacagaatgaataaatagaaatttttttattatgaatcatgaaaaagtatataagttttcaataaaaaagtttcttactttttatttcttaaccaatgacgtgtttttgctatagagacacaaaagtaataatatgaaaagttagtttgtgctggccaaccttgagggagagagatagctcctccatcagataccttcaccacgacacttgtccttctatcatcgcctgaatcattattatttgatgaagcaaacgcaaacgttggaaccctttggatcctccaactacgaaccagtgatgctaaacccactttctttcttgcatacgacagtttttgttgttgtttccccctacctgaaattaattaacccaccaacacacatcaattcctcaaatcacatgacacaatcgaactatatatctctctgatcatgtgattttgcttgcttcctacttcctaggagaatacatgtgaagtgagaaacaaaataggaaaagagaatagtggatggtgaatttgataacataagagtaagtagtacatgccagtaataggtataacagttgctggagcaataagcgcaatttgagccattgaagaagcaactacactaatctagccagctaactgagacataggagggagagaagag

SEQ ID NO: 4934 - DNA, 1000 bp, Glycine max
  Soy_ogl_54 Gm01:2459501..2460500 Cluster 22
tcatgcatatggcgagtgatcgaaaatgatgagggagtggaaactgagtagaatgctgatatttcagtattcgcaagatgcttcataaagaaagactagaaaaggtaagatacaattaatttcatcttcttactttgaacaagtgaaaacacaatactgaacaaatatcctctccatacttccatatctaagccaaaggtgaacaaaaagacaaacacattcctcttattttcaacctacctacattttcactcttgttttaaccttaattgagtgtttttttatgagggaaaaacttgtcatggatggcatccagtcagaaaaattggttcatttctaccaatttatactcttattttcaactctatgccataagcaaaacaaaaaaggagtttaatttataatatttgaaactatctgcataattttaaatatgacttagaagtcagaatttgatagattgtgtaaaatattataacagaggcaaatattccagctgttagttcatatacatccttcatgcatgatgagtcgtttatttaggacttatttagtaatttataattctcaaagagtcaaagacaagcaatcggagaacttgattctcaaattctcaatcttgtccaacacacgctcctagcctaagatttataaatcatttggaattctcaatcaacaaatctaaaatacttgtatcatgcatcagtgaatatttgtacacaactcacgaatatttttaatgtcagaaactactttcatatatgagcaaatacatggaaggtctataacacggcaaggaaatcaatatagggaacaatacggatggatttttcagtgaaattgaccagttctgttcagttttcataacaatacttatttttcatttcctatcattccgtacaaataattcttaagtagaaagttaaatcacattcacatgttaaaggacttgaatcacctccattcagcctaacgcaaatcgtaacacattttagtatac

SEQ ID NO: 4935 - DNA, 1114 bp, Glycine max
  Soy_ogl_3259 Gm09:43109501..43110614 Cluster 22
tttgaattctttaattatatcttatagacaataattaacaaaactgtcaatataatcgtgttagccaatttaggacttaggagcaattgcaccatcattcgttccatcattcacaatatgccacgttattcccattagtgtatttttttttttatcagcaacatatgtttacccatttttcgtgtactgggatgtgacaactcatgactcgtgagcaatatagaaatagtgcctaacttttgaaacgttttatgagccaattcgtggagaagagacaatgcaatcaatcattttcagagtgcctcgctgggcctttaaatggttgggttctgtgagtgtgtggcccagtgctgatatccttgtactatattttatagaataaatatcatcttcaaagagtatagtattccaccattttattatttttcttctctctttttttcttcttcttatctccttgtactaaaaaaaataaaattttaaataaatttctgaaagtgaaatctgttaattacattagtttaaatttaaaaagaaaaatatacgacataagtgataatattaatatatatttagggagaaaaatgataataaataattaagtttaagaatgtaaataaaataattgaaaattttcctaatttttaagactaatataacaataaggattaaaatgatggtttattctttctttttaattgtactttagctaggtcttttttttctttttcttcatataacacgatgaaaaactgaaagtggaaatgggaaaaagatgggacaaaataaataggagagaagagatggaaacattccattgaggttaataacataacatacggacaaaacaagttggaaacttcagtatcccatagttatacacgaaagcaaacagagaaaaatgttaaaataaaaaaggcatgtgggaacaagtataaacaacggaatactgtagtggagaagaatagcatacggaggaataaataataaattaaaaaatacaaaacaaaacagatctgtagattttgtttgtaatgttttgatctatatacttctacttcctgtcacttagacttagactttaccaagagtagtgttcagtttatcttcgaca

SEQ ID NO: 4936 - DNA, 1083 bp, Glycine max
  Soy_ogl_4125 Gm12:37549418..37550500 Cluster 22
gagatgaaaacgttttacaactcaattagatatgttacctgctgatcgagaagctattggctgctatgcccatctcttttatcatattattatatatacgtgcatagtttagcaccttgaccttaaatttcttcttcttcccccacactcatctctgaacataaacaaaatacttttttttgggatctttctctgtaggaataaattttaaaataatgtttggtgaacattaaaatcaagtaaatcaccttgcatacgtgtgagtgtcaaaatcaaagtacatgtataaacgaagtaaaactaacatataaccgaacataaaaaaaaatgaaagaataaatacaaatatttacagtaacattaatttatattataagtttttgcccagaatcaaatatcgttaattttaacttttatgccataattatgaatagagtttttattcaaatgcatcattgtcctatttttcaagtgtatcattgtcatatatttccctgaaactaacaccaattgaactttcaattcttttaaatatcaatctcgatgcgaggtcaaagtgctgaaatttggttcgtatatataatatcgtgtttggttggccattccacatccttgaaagggcacctcaatcaaatccatgagtaatataacatatcttttgctcaacaagaagaaagatttttcatttttgggccccaaaatatgtatagattttcaggcagacaccaacaactagtcgacggaatgttgcaaatgtttttggtgctgtacacgtttcattggacaaatcatatattattgcctattggtaccgaaaatgaaataaatagtccttaataatactaaagtgccatattttgtgagagcaaataagtcattttgccaggaaaagccaaagcaataaacttttccctcgcaatttgtcttctactttttacaaccctaatgttgccaatgatatacaccttaactgaacagtactgtaaatagtatatttgtatttaatttaatacaattaggacgagaatctcaaggtgttttttatagaagaataaaacattagtatgattttataattagatt

SEQ ID NO: 4937 - DNA, 1000 bp, Glycine max
  Soy_ogl_6904 Gm20:40902801..40903800 Cluster 22
gctagactaatttgcaagattcagacagagtgtaaagattagttaattcaaatttgtctgcaagtgcaaggaattcagcattaagccattagcgctattgcactttaatttatttggggagttgttaatataattttgttcctttgtgaattcttaaataccttattgttcaacggatcaaaacacatcagaccaagaaggatagtgataaataaaaatactttttttaatcatcgtatttaggatattttaattttcggtaagactatgagatattactaggttaattataacgtgtcacttttattgaattgtatcatatggcaacgatgtgaaaggaattaaggtttgattgcagatcagctatagcaggctactcgatcgcatcctataaaacaattaaggattgcattcataaaataatctcccttctatgtctaggcatgacccatgttgtttcaagacttcacactaggttaattataacatgtcacttttattaatttggtctagtttaaaattaattttgatgactttgaattttaaaatttaaatttcacacattttaaaaatgagtttgagttatgtactttcagaccttagttaatgcgatttgctcttttggttaatattacgagagagtcttattcctaccaataaattaaagttacattttcatgcaacagcggacaaataaaactactaaactatatatatcataatatatttgtgggaaagtacacaacaaaataaaaatttgtgggaaacgtacttctattcctaatagatggacgatgcctttcatatctcattatgatttgaaagcacagataactgaaacatagatatgtaataacaaaccagaaaattaaacgttgacaggatgatctacttttatatttatattgaaacaaaagcaacaggtaaatccaaagtagattaggttcaatcttcaacttcacatggcacgcataacgatgaatacaataattaattaagc

SEQ ID NO: 4938 - DNA, 1098 bp, Glycine max
  Soy_ogl_1852 Gm06:8311903..8313000 Cluster 22
gtaagctcaaaaaaccaagagcattacctactttgccttttcaaattatactatcattttcatgcacagtggctgaatattatttgaagaacccaaaaaacggtttcatctgctaaatacttcctctcgtatgttatttggtgtgggtggagaagaaagtattcattgtcaaaattaaaaatccccacttggcgtggtgaatgaatgcttaataattaacttttagcattgtatatgaggggatgattgagttaatatactaattaaatttattattatatgttaaattggagaattaacttcatagtgattaaataatgtttagatacttactagctaatcaatcaatattttatatgtacattagaaatgaaggtttctttgattttctcactttcttgttcactctcattcatctgaatttacattcatgtaatattttaacatctaaaaaaaactcaattaatatagttgaacttaaggaagatttgtcgattaaaatactatattcagttattattatgttgtaactgttttaggttaacaataactacacttccaaaagtttaatgaaactataactaatatttatctctctttattttgacttttcttgatccctctctatacaattaggagatgtttgtatcaatgagaagagtatatggtgttacattatcatataaatcaagggtggtttatgtgagttagaaaaagggagagagatcgagtaaaaaattattaaatattgagaaaaacaaatgttgtcctattttttataccattattcgagttcaaattatatttattgaatttataaaaaaattatgttattttgtaggtttacttgctctacggtcttgccgatatctgaacttttattaaatttttaattaggtttctactttttttagttttaatttagttcttgaatttgtatttattttttaattaagtccatatgttagtgataggtccaacaaagacctaattaaaaaataaatacaagttcaaagatgtaattgaatccaaaattagttagagacctatttaaaaatgacaaatagttcaaatatctaattaaaaaaatatcaacct

SEQ ID NO: 4939 - DNA, 1200 bp, Glycine max
  Soy_ogl_3289 Gm10:833901..835100 Cluster 22
tattatatatatagaccaccatattagtactgacaatatgtattacattgtcaccttatcctctaaaattaacaaattttcaaataagtcccaacccttcactcatattaataaataaaaaactgtgatttgggattaaaatataataagtagttaaatctaataacttagatcaagcaactattaaatttaggaatttatttgaaatttcttaatttcaagactaatatgacaagatgttacgttttttttttttggagacttaaaaatagttatttacttaaaaaagaaaaaatacactgtcaatttattccaattaaactctttttttcataagcatagctgctacatgtccttttttttattaaaaaaaaaaaaaaactactacatgattcagcaagatgtatatataaattattgcaatttgcgtgctgtcatcccatgtggcattagctagaaacccaatttgtcacttgccattgtacaaaattagtttaaaacatagaccaagaacaagctttagtctatagcgagatatatacaataatggtacgactaattattatttaaattctttgactctgcaattataatagagttaatatgatgttactaacaactacttaaattattacaatactgcgtaggctagaagtcataaggtttattggtataaaagaagaaagagaagaaaaaatagtgtttcatttctcttgctaataaaatattaattattaattactaatatttattgattaaaaaatattatatatgttaatcatctttagaaatttaacaaatacataaatattttgtgacatcctgcttggttgaatcaagccgtcagagttgttgttccgtacctatcagtctaaaaattatcttatattttcttacaacttattttctttttaaattgaaaaattgtttcatactcgtgttaagttaaaaaaaataaaaatcaatcgctaatggttgcatacgtcaatgacattttgaagagataagagaacatatgttagtatatagattgcagtaaaaagatgttagtatatagatattgaatttttaatattcttacaaagagaatatattgataaaatctacgtttatagaccattgatttgtcgacaaagctcttgataatttgattccaactttcacccatttatcattacattagattgtttttcttaacaa

SEQ ID NO: 4940 - DNA, 1100 bp, Glycine max
  Soy_ogl_25 Gm01:1572301..1573400 Cluster 22
caaagcaagatgttgcacattctctgcgagaaaattgcacatggcaattaatgttgattggcatactgtttcaccaaggaattttattcttatctccccttagcttgagaaaagagtcatggtttcttctctgtttaacaaggattgttctaagactttgagatctagtgaggccttgaggagtgacaaaaaatggttagttaagcaaaacttaattaagtacgaatattgataaaatgttgctatcattatattataagattattattgttttcataaatctatagaaatatattggcatccgcattgaagaatctaactatcaaaaactataagcttatcggctccacatacacatttcattgtgtttattattgattgaagaattaaatttgagcaatgatttaaaagagattaagaaaataaaaaacgtcctttgataaaaaaaaactagttaaaaattattaatttgatttgatacaaatgtttataaaacttatatgaaacaaataaatatgtgacttaattagttaaaaaataaaagtagatacagagaggttattttttttagaaaaatacaaaggttattattaagttattattcaaggtttatttattctacatctttaaaaatctcttaaattataaatactttaaaatgatatatttttattattaagttgttgatattttaaaaaaatattataaaaatcttgcattatcacaaaatataatcaatttttaagtgaaatgcctaacatcataaatatttttcttaatgttgaacctaggatcctcaagggaaatgaaaggaaagaggaaaaataaaagtaaaaatataagttttgtaattaacaaaaacttccttaatagtgttaaacctaaggaatacatttttttatgatgaatggtatgaaacttcttttatatcacatttacttaaattaaaaggaaacaaatccggaataattaactaacccgagggtttaaactattttttgggcatttttaattattttttagcttgactgaaaataaagtacgaattgtctgtctttactctgtacatatgccacgtatttctcgtgagacatttttaa

SEQ ID NO: 4941 - DNA, 1217 bp, Glycine max
  Soy_ogl_1525 Gm05:1672001..1673217 Cluster 22
gtccaacaaagctcatacctggatgaaaataacccttccctcgaaactttggacttgagtcaaagcaatcaatagtaataacaattcccaattgacatcacatacgccattaatctgaaatatttgtgtggaagcggaaccagttagtcccactttccaatttgagcattcatatttaaaattattggctgacatctagagacatgtttaagtttatatggaaagcactgcagaacttgttttttttttattgaaaaagtaaatatatttaattttaaaatttaaatttaagtaatactaaatcatcttattatatgttatggtaagtattgaataaaaagtaaaaaaaaaaaattgtcttagaagtataaaacatatttgaaacttatcataaaaggtagaaggaaggtttataagaagatataattgtatgattaaaaattattctaatcttaatgtgttacacttgcattcatccactaatttttgttcgtgcatgcatgtgtgtatagtattctttttcttaattataatgtttttatggtacgagaagattaataaaactattaaaatactcgaataaattattataactattttgagtatgagtgcattaggtaattgtgctcatcatcacctaacttatattgttttaaaaagtcactttttcaagatgttcataattacagtacaaattaccattgttttcaattagagattacatggagatcgagtcctgttagattagatacgtttcctatttttaaaatcatagttgatagaggaactttattttttcccctgctgatagaggaacctttatggcttggaatttaggccgaagaggggaattgaatcccgtatcttcatatttgatgggattggagaacaacggaatcaaatatattttctcatttttttgaagactttagtttgtaatttttaagcatggatattgtaaattattagtcaattataaatcatgatagatatcacttttaaggaattaatgaatcctctacaattacccgtggatgaaatcttagcccttcaataagttctattaatataatatatttctattacaaaatagatgtttaaaagaattaatggtgagatatagacatttcagaatctcaagttaaacttttgctagtggagatgatttttttttttttacttttaaataattattataaaaattaataaatttattt

SEQ ID NO: 4942 - DNA, 1101 bp, Glycine max
  Soy_ogl_3229 Gm09:40404726..40405826 Cluster 22
agtgaatttttattaaatgcttgtatattttttttacattaatagcatatataaattaaatttatgatgtaataaaaaaaatagagtagtttaactcttatattatttatccaggctatcaaatgagttctagtattataattgagacaatatatatagaataatcgtttatccttactagaacaatttcactttaattttatgtgtttaatgatatttttaatttaagctatgttacatatacacttttttttatcatttttacaaaaaaaaaaaacatgtaattactaaaaactcacaagagaaatatgtcagcatatactattttaaatacattctttgataaaaatttattaaatatcacaattttataactctcacttttttatttcaatcttgattttacaatttttaataaatcttaacccatcgtgtattatgaactgagtgaaaatttaattacctacataaaaaattaatgtacaacttatgtttttttttcttcaaaatgtgttaaagttgagtgaaaactcatggttttgccttaatgtaaggattgtgatccgaaaaatctgattaatggatcctgacttgttatatcatttcgggttgtgtcactgctttggatgcttaacacttgattataggcatctccattctccaccatggcaccatcatttccttttaattaaatgtctctaacctatacaaatgctattgttaggtgtagatgattaccagattcatcctcactataacaaacaccgcagggttgtagatgagcatgtttaacgacaaccatgaaatttgagattttacgtacctaaatatggatattaactgaattcaagtatattgttaaaaaaaaaaaggataataaataaaacaacaattaccacaaccatgaagcgttaagctctgatatcaccacaaaaacctcacctatccatccatttcggattgatcactaaacacttgtcatcactcttataagccaaagttcataatcaagcacgtggcattctgcaacacaattactacaaagcatagtaagaattaagtccattgtatcacccacacattgccggttaggaagaagat

SEQ ID NO: 4943 - DNA, 1200 bp, Glycine max
  Soy_ogl_1047 Gm03:42612101..42613300 Cluster 22
tgaaaatatatacacgttgattttaatgtatattaataagtattaaataaatttatcttaaatcttcaaaagaaatttatcttaatataattaagacttttgtatatataatctttatagtgtaatgtaatctttatagaagatattttaattcaacaatagattttgaaataaaattatctaataaaaaaatcttgaatattgtaagatttggtaaaagttatagtatatataatttgatggttcctcataaaattgtttaacatataataaatgttttataaataaatttgttagcaagtacttcagcattattaattaagatacgttaaattttatctattaaatattcttagttaataaataattatttattatataacttcataatcaatatataacaaatggattatattcgattcaagatcaatatatatattctacctttgctaagcaaattatattttgaaagtcaaactataataagtccttcttctagttctttatttgaattgattgtgaaatagagaagaaaaaataattaataacaaatgacagagaaattaattaataagatagataaaggatataatagaaatcagataacaacttttaaaaaatgaaaaaaaaataattattatatttttaattcccatctcaaaatctttaacattactttaaaaaatgaaatagtaaaaaaaacttcacaaagttaatgtacgtatatgaacattactggaattcagaaaaattgagggtaaaattttgatattttttatttattgaattctactaaaaaattactatttaaaatacttgaaatcaaaattaaagacttaattaacatttttgttttgggtcacaaagagttttatgcagcaaatgataagttatgtgcgtgactaaacagttgtgaaaggaatctagctagctagtgtaatttggcataagactcgacacttcatgtgaaaaatccaatagaatacgagacaattactcttgaactatggtacttgcttaattaactacaaacactttcgtgatctacagtgttactttaaggtgtgaagttcattattagaccattgaaacatcataaaaaaatcttatatgcttttctttttttagaaaaaaaaaatcttatatgctttgtaaataaagtgtaaagtgaaagatgcttggattgaaagcaaatcaaga

SEQ ID NO: 4944 - DNA, 1322 bp, Glycine max
  Soy_ogl_4148 Gm12:38361801..38363122 Cluster 22
tcaagcattaacatttttaaggccctcttaaacgactattaattgatatttaccctatgtaaacggtcacgtagttttccctctgccaccgtatttatctttatgaggaaaaaaaccaacaataacaatggttggtagggaggaagtggaatcaaatattttagaattttaattttaattcatctttgagtattaaataaatacctattttatatatgtccatggtctccaacaaagattaatagacaaaaactactttgtctcagtaaatatatagattactttttttaacggagccttactgaatccgaaattattaatccaaattaagagtgaaatgataggttagagattgttgagtggatataaatccaacacctcgtcttcctttatgcaataacacctcatttttacacaacaaataaaagaaaaaaatatcatttattagatttaattttatttcttctgataaggatatgatatatttaacttcctttcataaggatttcattttaagaagacgtgctaaatttttttcaatctcttgtttttttacagcttcaatcttttgttatgtatctcttgtttatgtaaacaaaatattacataatactttttttacatctctctactatctttgtaatgagtaaaatttaggggagatggcacctcagtctaaagatctctctactatctttatatattttgtttttcttttggttacaatatctgttgtcttttattttcataacacttataacatatttaaaattatttgagattactacaatcatggtatagcgtcttatttaagctcaaatcaatttcgaaacttgataaagcttgatttaacttatatgagtggatgacatggagtgaacaaatgatatagaaacttcaaacttgggaacgtttccttcgatgttttttgacttattgtttagtaactagtaagagaacaaaaggtctggccggcaatttttgtaggtgccatccatattaatgaaatcgacatattgttgagtgtatatatatatataaggacgtgctcttgttcaaccccacaaagacttggaacaagtcatcgcttacaaaactgattttagtcaagatcaaaatacacgtcaaatagttatttatttaatttaattcaaacattaatctcacatattttgcaagtgttgttgtttcaggaactcattcacttaaacttatattttataaaaaaaaaatatcaggctcccatcaggctgctttaacgtgttttttaattaatatatttaaaatattatagtacagatttttaaatggttaaattaaat

SEQ ID NO: 4945 - DNA, 1199 bp, Glycine max
  Soy_ogl_5226 Gm16:1287801..1288999 Cluster 22
aataaaaatcatgttttatgaatgtaattataaaagcgattttgacacaaacaacttatttttattttaaatttattttttacagattttatatcaattttataaagataaattattttacttcaaattaattttaatcaaaataaattttacataattaacatcttatgaaattaagtttcaattcattcaactaaatacacttaagcgtccctaatctctacttgcaattgtcctataaaaaaatttcaagccagaaaaaacaactttcattttttttttgtttacttttgttcaaacaactccattaagctttataactctcttctcactttttagttttacggcagagtgcgtctttgaaaacactttcgtaacgcttatataagtgttttctcacgttcaaactgtacgattgatgcaaaagttagtaatatttgcatcaagtgaacgcttgtcgctcccttcaaatatctaagcaaacacatgagaattgtcttatacattgtatttatagtttaaatgtaataaaagagaaggggaaaaaactttttctttagatcgatattaagaaatttgaaaatgaagaaattttttagactagatttcactacattatcctttactaaaaacttgaatttaatgactttatgtatttattctaagagtgttaatagtttaaaaggaaaaattgatgtaaaatgatctgagatttaaacttatcacagtatgcatacagtctcactccactactaagtcgattgtagtgctttaattttatttttttttaaaaatgctaatttgtatgaatttgtaattgcacaaaaattattacctcatgtctttgttttctgccaaagagttgggaattagatgcaggtaatgtattatcttgttgcattcttattatgttattattatgattactctatttggattgaaattttattttataattttctattatcgaacccaaagtactcattcatcctcctcttagttcttccaaaaataattcgattatcaactttttttgtgttattttcccttaacctgccctaaattttataatgatagggagttttttgtgggcaagtgtctcttttatttggatctgttgagtaattcagccttttaaaatggttttggttctttgaacccatttaataagacatattgacaaagtcaggaatcatttt

SEQ ID NO: 4946 - DNA, 1000 bp, Glycine max
  Soy_ogl_1501 Gm04:48832401..48833400 Cluster 22
gttaatgagtttttaatatttttactgattttattttgacaattattaactacaagaaattcatactttaaaatataaaatataaaatcaaattttagtgattcaaagttgtctaaaattgtgaatcttttattttctatttgactcacatggtgcagaagacctaaaaagaaaatttggtaaattttcaaggactaaaaaataactcaaatttaaaggattaaaaacatatttaaatttatttttaattatatgatttaactgtacatatataacactaaagacctgcagggaaaaaaaacatcaaaattaagagtgtaagttgagacactattaatattataaaaatttagaaatttttataaagatgattttgaaataattattataaattaaatccaaaaattatatcaaacatgataaattattattagatgaacttataagaatcctttaaataatattgtgttagtgtgttttaattaaattaactaaattcttaaaattaatattgggaaggattttgacccattttgtggatgttttaggtaataaagacgatcccaataaacaacaataattttttgagaagttaaatctgcaagcaactgcacaaatattttgaccatcatgtaagtgagtataaaaggtgaataatgtgacttagacgtgtatctatatgcataaaatgccttatttcttttatttaatggaagtaaaaaaaaatattataaaaatcttctctttgttttcactttccttcttctcatctattagaagctaaagatgcgtgtttcatttctataaaatcttgtaatcgtacgttgggattggaattggaattgccaagctttagcagtgacagagaatattcacctcgtgccttcttgctgcaacacttattaacgcatgttaatatattgtattaaactttacaggtttcattgcatatacatatataaacttgtgagaggcatgactttccagagagttttgagtt

SEQ ID NO: 4947 - DNA, 1079 bp, Glycine max
  Soy_ogl_3633 Gm10:48867772..48868850 Cluster 22
taaaataaagtgaatttctgttcgactttcctatggtaaatgttgacgaatcttttctatgaaaaactggcaatgatttaattctgacatatcatatatatgaaatcgactctttcaaatgaattaaatgacttacttcctcctcattttgggctcaggtatgttctcatctgtagcataattaaatctgtccaattaacattatctacttttcctgtattttttctgaccaaaaggttatttttaacactggaattaggttttgatttatacaggtactcttcctccgcacagagcattgctggcgtctccctcgttgagaattgaaaccattttaattgatatcataatgctttatggcaagttattttatgtgtaacagagcgctaaaatgaatataattattcattttttttgtctgatgaaattaaaacacgtctcaggttctaacttttccaatggcacgttttagaatgtggtttatgggtataattcaacattataaaatcagtctgtaacgtgaaatttgcacctcatccctcactcccaaagtttgtaagacataagcgactcgtttgatatgatatctgtctgataacggcggccctatcaataaattctctaaaacttgcttgtaagttaaggttggtaattcacttatatattactttctttgtttctaagattattttttaaaaaaattatttctttttataggatattttttcaatttttagatatattaattatttttttctatataatttaaatatttaatgagaaataagttaatacatagagaagatactaaaaggataattttgggataataatcaataaatttaatgtgataagtattcttctaataagacgtaacttttgtgattatgatttcattattattgatataatcttagttgtgtaattgcaacatttgaaattaaatatctttttgttaactaccaaataaattccatcacattcacaactttaaacaacaacaatatattataaacacttatttaacaactttcatatcccacatacatgtaaaagagagctcaaattatatcattata

SEQ ID NO: 4948 - DNA, 1643 bp, Glycine max
  Soy_ogl_3286 Gm10:712058..713700 Cluster 22
acttgagtcttcttccttatgatatgtttgatgtttgactaggtaaccctgatctcttcttcaatactgtatttctaattataggtgttttcctttgaccaattctttcgccacctttactcacgctcaagttttctcataaaattttactagttgtgttttcatgttgtaatactactatgttcttagttgttttatcttttgtgtccaattgtagcaaaagttgctgacctatatataagactcactaaatgttgaaaggaatacttatagatcacttatcaataaaattctcacaccaggaacggattcaaatccacgtttttataaaataagttcattttttatcaatctttattgatctactaataaaaaaatagtttatatttattttaagaagcaagtcctaatttttttttaagaaaaatattttttaaaaacattattttaaaattattttttaagtttaaaaaatcattcaaaatcaatataaaggatgctcataaatccatttgattgaaaatgtaatcattgtctttaaaatagtaataacaaattataaaaaaaactattaaaaagaaaaataaatgatactcaaacattttatgtaaaaaacaaacattgtaataaaatctacaatgaagattataaaataaaaaataaaatatttatctaaacagaaaataatatattattatcatcaaagcaaagactaatcatttctgagagacttaaacaactaccattgttcctcatttattatatttttttttcttaaaaggatagtagagcatgaataggattgaatcaaataattatttataaagtctctattaaacactcaatatgttcaaagttaagctttacattgtaattttataaagacctcaaaaacaccatttaactctcatttttgtatttttgcacattaatttttatcttttcaaactacttattcgtcgcagttagcttgatttgttttcaatcttcagagtatagttaggagttaaggtaggaggattgtgtgtctgaattgcttcttgagtttccttaaagtgaaagtactagtttaagcaaattatactaatgctccgtgtgattttttttttcaaattcacacgatatttctgactgtgtaactttatatgttccttgaataatacggggtgttagtgtcatgtatttcaaaagttaggcgaaccttgtgccattggatagatgataaaagggatagaaattgtcaaaatgttgagaagtatccccatagatttggttaaaagtaattagtcagagtgtattgatatatggcttgtgtatatacttcgtatgtgcaattattgttttttggaacttatgattgaatctcggttgattttccttttctgcatattaattatgacattttttgtgtttaacaaaaaaataaaatcaggataatgtatttgcaaaatggccattgaagacagctatgataacgtgatttggctttattggccgagtagactaaaagtgtgtttgaaaatacatccaaaccaagttcaatagagaagttttgtgttccaatgcaaaaattctaaagtgtctgataaagaggcacataattattaatcaaaagcatgaaaaccttattttgtcgtatcgtg

SEQ ID NO: 4949 - DNA, 1200 bp, Glycine max
  Soy_ogl_4847 Gm15:1020401..1021600 Cluster 22
caataagtggttgttttgaatcttcatttggactatatataatacattcatacccttgtcaatctttttttcaataatatatataaaaaaataacaaacattttcttataaacaaaatatcagctttaatttgtaaccaccaaccttgttttataattgatcgagctcccaattaagacgggaagtgatacataaaattaattggagaaatgttaataacaatctctatttctgatatattctttcaaatatttttttattaattgaaatttattagaaattataaattttaatagattttactatacatttaactagtttcttttatgtagttatcaataaattttaacaaatagtaaataatgttatagaaagtttgtgtccctacttgctagtattcttcttttagttgttaccttcaacaaattacttttcaattgcttacccaatttgatatatgcctcgtttaaaattttaatacaagtattaaaaaatataactaatattttgaatttcataaataaaatagtatgtaacttctcttaatatatgttttatctctttaattaaatacgagaattaaaaagaatattattaatattggttaacagtactctatagagaaaaaaatgtgttattagttttttaaaataaccattatttagaacatttttttacactaaaccttcatataaaatgtaacggaggaagagagaatacacatttttgtattgaacgatcaattatatgcctacagaatcataataacacgtcttcagataaagtagctaggattcgttattaaacaaattattgtgtaatgctttgttaactgtaccaggcatgatttaaattttttttttttttttacacaaacatgatgatgatttaaattctattcacgacaaatcctttatttttatttttttggattgcagtgatcatcatatatcttgaatttcggaggacagtagggcactataatattaacattatttcaatcaattccggtaaggatgatagatgttggacggatccacattctctacaagcactaaataaagatcacacgacttataattaatacgctagctacggtatatatgaatcttaactaaccgcaattaaatagtattgtgattaatgttttgctgaaattatataaacatgtgtcagaatcaaagaaagttaaactagcca

SEQ ID NO: 4950 - DNA, 1100 bp, Glycine max
  Soy_ogl_1420 Gm04:45757401..45758500 Cluster 22
aaataaatgctataataggttgttttacatacatcaaggagaacttataaatgaatgatttttttttacaaaattaactttattaaataaatgaaagaaagtaatattaatattagattgaaaactaaatgatatttattaaggatatcgatgaaaaaaattcatgattattatattaaaaagttaaatacaaaacttattttaaaatgaaagaaataatataaataaatcaattttcactctgttgtatggaccaatcataacaaattaaccaattaatagaaatagtttcatgtaatgcatgcccggcctaattaatgggaaaaaataggaatagaattactaaaattaaagctttaagtccattataaaaaatatttttataaagcaaaaacatcacaaatgttagcaaaaaaaaaaaagtctaacgtattactcttttgtttaaaattaaagaatttttctcaagctttaaacctcacttaacattgaacggatcctaaaataaataattaactgtttaccaccatggatgtttataaacacttgacggcaatattacaaaagcatgcagacagctgagattttatcattatcttcggatgtcttcttttcccctgtttggttaaagcatgaaggtcattaacattcttaagcgacgtcttttccccaatttaggattaagaaaagttccatgtgcataatcaaagacatttttgtttccaatttcttgtatagtgttaaaagtcagtactgaaaaaaacaaaaacagaaagctgtgaagaaaatgaaaaattatttggcttcagttttcacctctgcacattctttgaattctgataagtcattgtttctttgccttttgcccacaaaacactgtagagactcaaaaccagtagaatccctctcagaactctgaattgaaaagcagaacgtccaaaattcagaggattatggcaacggagtataaaaatagtttacatgtcatttttttctttttctttttctgactttggatcaccatgcatgtacgcattctttttgttgattaaataagtgatgatttgcatgaactcttttaattaggacgaatgtgagtt

SEQ ID NO: 4951 - DNA, 1063 bp, Glycine max
  Soy_ogl_1478 Gm04:47899201..47900263 Cluster 22
gattaattggataataagcaaatcaaaacattcagtggttttaattatataaaacaaacgaattattttttaataatatataagctaaaataatagcaataattgatatattatcaagctcaaagcacttggtgtctaagatgtttaaatgatgtttaaaagctcacttgcgttaacttaataatgaaaatattaggtagtttacatgagattctaaattttttttatcagcaaaaatatcattttattagtgtcaacagctttaacccaagctgtgttaaaacatcagaatacaagaatccgattctgcattagattctaacttaaatctcattattgttatagtacgtcaaaagataaagtttaagaattagttttttatgtattacgtactaaatcttcaggaaagaaaaaaggtaagccaaccacacaaccccatggaggcaggacccaactacgaactaccattttcaatgttaactcacttaaaatgtgtggaactgaatccgtttattaataagttaccaataatcataggtataaataatatctatttatgttctttcattaagtagtttaatatttgaatcttgatggttgaatatgaaataaattatgttaaaaaaaataattttatcttatgtatagttatgatttctaacaaaaattaatcatatcaataccatgataaaattcattttttcttatccctaacaaaatcattgttaactaatttaaattgcacgtaaaattttaattaaattaagttgaattaaaaaatgtgacatgataaaatatttttgtataatgatgccaaaaaattgtatattattattataaaacatttttagttcctttaaatatagctaaatttagttttatttgtttaaaaaatagctttcatcatcataacttattttttaaaaaatagtatttttttatcaccaatttataataatatagtatacatgtagacattccatgtcacttgtcaccctagtatggttgttgatgtaacatgactaaatgcatgttactttactaatgtaaataatgacaacag

SEQ ID NO: 4952 - DNA, 1100 bp, Glycine max
  Soy_ogl_2950 Gm09:2436208..2437307 Cluster 22
tttaaaaaatatcacttcaagtaaaatgtcaaaaactactaaaaattactgaaaaactattaaaaaaaaatttcccaaataattaaataagtttatctattaataaaaaaaattaaaaatgaagtgaaatattttataacatagctttaaagtctctgctgtcaccaattatcacgaaatgattgcatagaaaaatatgtacgaacactgaaagaatattatccactagtcattcttaattaacactattaagctccgtgccctgcacaatatatactaaatttcaacacttctacgttatttatacactttaaaatatacgccttgctaattaatcatgctcgtagaaatttattgtgagtaatttactttgataatcttcaagttttgacagaaattaatttttgaccgttggttaggaaatattattgattttcttcattagccaaataatttttttatgtactcaaaaaataaatttatgcctaactactgaccaatatttaaagaactaataattaatacattcatgcatatggttaatgaacgaacaacctataaaatgttaactacgtcacaaacaataagagaaccaaagtttaactcatcggaatcaaaggaagcttaggtaacctagcataaataaaacatttccaattaatcttaatataagaaaaagatccatgacagcaaaaattaatcaattcgttatgacatgcatatgcagcagtactgaagaagctcgtaattagaaaatcttaaaattttagctgtgtaaaattattaacaaaacaatgtgtattatatatgatctgctatatatcatgtatatatatttatagacttatagttcagattctagatttcacaaatagtatctctgtttttattaacactcccaaaggttttagagaaacctaaaatatatatatttaactctaatatcgtatcaagaaaagaaaatgattagtgttatttctagatatataaccatatataccgataactaaaagataatttcattttttttctctatatcatcttgtttttgtgtttgattttttctttcattattttcaggtaaattaaactatccagta

SEQ ID NO: 4953 - DNA, 1063 bp, Glycine max
  Soy_ogl_5216 Gm16:820301..821363 Cluster 22
tcttttgaatacttttcatgtgagatataagattgttccatgattttctaaataacaaaaatttgagtttttgttcctaaagatcaaatcattagatcaaatcatttgagcatattatcatatatcaaaggcaccctaaagatcaaatcattcaatcatattttaattaaaacccaatttacatgctatgaataatgttatttgttgttgtacctattcatacggctgctgctttctaaagagtctctttctcttatattcgaaataaaatcagaaagtcttcccaacctactgaacctagttgcagatatatttcacaaatttaatacaaggacattaaaaatttagtttacagattttaatacaaaaaatactcacttaaatagattttcatcatttataatttgatattttaaaacctgaattcatgtttgcaaaatagtaacaagagtcctaaattcgatgtcagccacctagcttggctgggatgattggcaatatggattaaggtcaagtcaagtgaagtcatttagtaaatttatgtgctatccttgtgaagaacaaaataccaaattacagagtgaacacgactttggccgtctaaaaaatactagataattattttaatttagtcctggaataataattcaacaaaatattttttaaagtcaatttttttatatcagaattttattttaatatcatttttgtgcattaaaaatgttctttaaaagggcatattttatataaaattactgtcaaaatatcactctatactattttattattttttagaataaaaaatatattgataacaattatattataaagcatcttcgacggaaaatatattgtttctatattaaaagtttaaaattcatctggacataaataaaactagaatattctcaattgctaataaactaaagcatctcaacacccaaattaaagtaagaaagtgtattatcatttgtggaatggacaaaagtcatcaatttggttttaatttgttgaagagaggaaatacaaaataacatttttaatacactttttattagcgttt

SEQ ID NO: 4954 - DNA, 1100 bp, Glycine max
  Soy_ogl_6790 Gm20:36534201..36535300 Cluster 22
atgactaaggtgaaaaaatacatattgttcaagtcacaacctggtcaatttacaagtaaggttagtctctacaaaatgcaacttaaatagaagtgaatcttttttaactaaattcatttagtccaaccagctaaataagtccatccgatgagtaatataaaaaataaaataaaacatataattatcttatagacataacatgttttttaaaaaaatcttacatataacatattgacattaacaaataattataaaggtgtgagtatatttctaatttcttccgttcaaaaactaatttggtatatatacacagtcattaaggatgagcataggattaaacccctcataagggtctatgacctaatctaaatgagattcaagttagtcagacttttcaaaaattggtcaagcttaaacttttagaaaagtctatttgattaaaaagattagattttaaattatttacaaagtttttaaggcctaacaggccaacctatttgaacaaatataaattataataatttgtttagtattactattacattaaaaatgttataatgtatcaaaatcatgcatttatttaccttttaaaaatatttcgaatgctgactacaataaaaatcaaacatataaacttaataagggataaatttatgtagtacttagagagccggttacaaaataaactttttaactaattatctcaaaggtgatagatttatatcatactaacatattaaacttgattcttataaaatttagttagcctatttttacctttgtcttatatgttggctaacaacaatttttgatttttctactgattataatttgatttatataaaatttttctcaatgacttatgttcaatgtaaaggaaagttagacttatataaataatttaacataaaataagtcattaagtaggttaagaaattaaattaggctttaacaaacaatagttccgactttagacttgaatttttaaaaagattaaacctatttaacaaaaacattcttaggcctaacattttctcatccctaaccgtcatacatatatgcattacacattctgaatcagttttagtctttatccagtt

SEQ ID NO: 4955 - DNA, 1025 bp, Glycine max
  Soy_ogl_6942 Gm20:43013376..43014400 Cluster 22
cagatatcagatgcttaaatatgattttgagattgagattgaatactgtgaatgaaaaaaaaatataatgttaaaagcgaaaatttcattttaggtggtattggtgagttaaaaatgttggtatataattcacaccaatataatggtcactaaaaaaataatatatatattgaaggaaaaaaaaaactcagaaataataatttctagggagacttttgttcaataaattaaaactggtatcattaccagcaatcattcgaaaaaacaaaataatacctgcaacgaccacgtacaacaactgtaaattaagtttgatctttgccatgatgatatgccatttgttattaaaaatttataataaacgattggataaaaaaaaattgaaactctaaggagacttttgatcaataataacttataacatgattacccacaacccgtagaaaaatcataagaggtacgtacgtgtacaatgataataggctcgttgaaacaatacgtacgtgtacaatgataaaccctaaatcaagacaacaaggctaaccacaaaaaaaaaaaaaaaagacagcaaggctaaacgcctaacagtcacaatctgaaaagtcaaaactctaacttaatttttgaataattttaaattttccgcttatattctcctattaattaatgctctaactttttatgacaaatattgaatatattttatatttaaaaatttctttataaggtacagaaaaattataaaagatataatattttttttctctttagagaaaaaaattcctttaggataaattacttttgtgtgcctgaatgtataaattagtgataatttactccttaagagaataattttttttatttaatccttaaatatataaaaagtatgataattatgttttgttattagttttgtttgaccattttatcattaagggtatttataggatataaagtacacatttaaagattaaaatatatatatttttattttataaactaaattatcaccgatttatatattt

SEQ ID NO: 4956 - DNA, 1300 bp, Glycine max
  Soy_ogl_337 Gm02:3044501..3045800 Cluster 22
aatttctaacaaactaaatttattaaaaaaagaattaaaaaagtatatagtcaactatgaaattgaaaaaacagattaaaatcacaagtttttttaaaagtaggtgatgaaatttttaactaaaaaatagggaattaaaaatgtgaatttttaaaaaaataaaagacaaaatattttaattaaaaaatatgatgactaaaattatggattaaaaaaataaacaaaaattacattttaatctaaatatttttaatttttattataaaataacatttataatataataagttttcctttgtcattaatatacttttgattctttgagcattcttcatagataaagagcttccaaaaggcctggaaacgggttcagctgcaaagaataacagcagcaaggtcccactttttgttttcaagttaagattaaccaaacattcaacgactcacaacaagggaagaatcatggcaattaacggtgaaattggaattgggctagcaccaacaccaaggctctgactgagataacttggcttttggctgctgaccaattattaatactgcttaatatgtaacttttattcttataaatcacatgtatcttcgatgattctggcacagtaaactttttttttcttaagtatttaaagcatttgtgcatttaaaacttaagcttgaaatttctgattaaactaaaataatttcatgttatatgttatatgccctcaactcctcaagcatgtcttcatcataaatatcatcaacaatgcacattgagtaccaccattcatcaaagtggaaaactggaaagaatcattttgattagctaccaagcctgtgcttattccctgcagagaggaaaacaagacactgatctgatgagtccaatccagcttatgagttttgcatgaataatatgataaatagaggaagacaacaaggaggaaacaaaaaaacattacttgtggattgacttcaactgtaggtgattaatcaaaaattgtttggcttggcaagagccaaaatcaagacctaaactgatggtgccaccacccccaaagcggaatatcttgtgttaaaatttcataatactaacatttatcacgtgaaaatttgtcttgttctttttttttttttagaagtactcataaattttgatagaccgtaccccaacaacatatacaataaaggagatagacaacaattttagtatttaaatccatcagttgcctgcctccatgttacatattcttggattatttggacagttatagtctgtcaattatattgatattatcaatct

SEQ ID NO: 4957 - DNA, 1146 bp, Glycine max
  Soy_ogl_4492 Gm13:36710555..36711700 Cluster 22
aatttcgaatgtcttatgaattagagatattaagatatgaatcgagaaaagggatttacagtttggggcctttaccactcggtcatgccaccgaatagatttagatgggaaaatacctaaaaaatgaaaaaaaaaatcagaagaaaaataacacttatttttattagtagaaaaagaaaatgaaatttacaataattcattcctcctgtttaattaattaaactaaattcccttaacaaacaacacttattaaatattaatttcggaattattcttgataatttaagtctagaatggttgtctttttaatgagataagaaaataaaatgaatacataactaatcaattgttgcacagtcacgttagacatctacgttgtaacattcttttgtactgtcacattaatatttttattaaatattaaatgtcaaattaatgaataaattaaaactgcacaattaaaaatagtaaggaaatttaatttagaaaaacgaagggagataaaaaaatataattaagctatttataatatgaatacgtaagaatttaatgttaagatttatttttgttaggtgagtagcgagtgttttgataatcattgtttccacttttttttacgggaattatttccttttttttttgtgaaagaattatttccaattaatatggtccttgtggtgcaatcattctcaatatgaataggaaagtctttccatcctcttccattaaaaaacattcatggataacttcatgtggatggcatttaaatctaaaggggtgtgcttaaaaccaacggtggagattctcttgaagtaagaatttggggtttctctatagatacatgaattgtatttatatttttattataatatatactttgccaacattttcatgccaattttgcaaaataatttgcctttattatattgggcttggcttcatgactcttgccattcatattctcccatatgcctttgttttgtagtctatcatcacatataacacttaattgagttgcattcttccgtggtaattaaaaataaataaataatatttattgataaaaattatatatatttaatttccaagtgaaatatccccaaggcttttctggctcactgcaacataacttctagggcacccaaa

SEQ ID NO: 4958 - DNA, 1042 bp, Glycine max
  Soy_ogl_6264 Gm18:59022359..59023400 Cluster 22
aattgtacttcttaaacgtgttactcaccaccattagccgccatctgcttgatgcaccacggtcaacactcaagtatcattataccattttgtttttttttaataatgtatcactataccaaatactagttgcatatttccttgtcaattatttgtccttggtttgacaatgcaatgttttcacctatccatggttatctttcttttggtgagaacaatccatggcttttacgtaaccaaatggtccaaattgttgcccacgtgttgagcctcttaacttcaaacgacaacagtaaatttgtattaatctatttagtattgtttatattaaaatgattttatgattttaagtatatgccgctttattttttaaaatatatttatatattagactatacacaaattatcataggaaacatttaaaaagatatctttaaaatcacaaacaaagtaaaaataatatgacatttttttgtaattattcttaaaaataaaaagcaatctctaacaaaacatgtcttaaattatttattttataaaaaatataggtaaaaaaattgagatgtaggattggaattgcatcttgtgcttaaaaaataatttgtgttttgtttaaatagagaaaaaaatgaaaggaaaaaatgaagagaagagaagatagtacaattatttttctctttatttgtttagatgaagagaaaaataataacaattttcccttttcttgtttatgtaggaagaaaagtgagtggaaagaaaatatgcttatattaaataattttaatgaaatagtactgggtaaattttttattttgtcttttcaatattctatctacttgatttttttttctcgttttttcttcttcttttctcattgccaaataataaaacatgtaacttttctgtctaatttccccttctttttttgccacttttcaccctaacaaaacccaaaaaacatttttttaataaatgatcaaatacattcttcctctatcacaccatcaagaggtgttcatgaatggttttaaagaaataaaac

SEQ ID NO: 4959 - DNA, 1353 bp, Glycine max
  Soy_ogl_4886 Gm15:3033320..3034672 Cluster 22
gtgtctattatttttagagatcacacatcctccacgcatgttaagctgaaacaaccctatgttgattaattcacacatttgatggttaatgtgtttttaatatattataaatattgaagtattaaggtttattataatttttttttattaatatattttatatagagattcaaaagaaaagttgtgcattgaataaatttatatttgttttattatatttaaaaaatataatatttaatagtatttaaagaaaaactatttataaagaatttgataacatatgcttgtttttaaattgaagtatgtaattaggttataactaaatattgtattaaaatatatgacgtagcttattaacatactctaattaaaaaaaagtgtatataagttaacaaatatttatttttaattagaatatattgaaaaataataattagatattatcttaaattacattaataatataacttgctaacatacttcaactaaaaagttgatgtatgtttacaaaacccttatataaatactacattaactattaaatactgctttttaaaaaaagtattaagaaatgcataaataatttttttcttttcattcagaaaatttaatatcgagaccttacttacttatgggataagttttagaacaacgatttgttagtacattaacagatatattcatagttttagatatttttagttattaaaaagctaagctcagtcagcaagctaatttataaaggagactttttttatgagtggttgcgtgttttaatcaaccaactcaagattggagaataagcatttaaaaaaattggttggataaaggaatatctagtgtgcatgatgtaagccgaatcagtaccagcttccttagtctcagattttttatttaaaaaaatctctctataccctttaatttatgtctcgtctccaattttataaaaaatgaaaaataaaaaggctatcagattacaagttgcaaatagaattataagcgaattcatcagtacgtgtcttgttaaagcaactttatcaccaaacagtcaattgtgtgcgacttgttcaacgaagctgcataagtacataatattgaccccaaaatattgtcacgaattcaattcatcgtgtcacaatcctctctatagtaccggggaaatggtgaacgaagactatacatattttttgttgtgtaaaagagaataatgaaaacgatgcagatataagtcagcaaacatgaacatccaaattaatataataatcagtgggagcaaactgagcctttaagaaatgggaattggtaatttggctcacacaaaagattacattcatgttgtccaaaaggacagct

SEQ ID NO: 4960 - DNA, 1444 bp, Glycine max
  Soy_ogl_5265 Gm16:3171957..3173400 Cluster 22
agtatatttgacatttttttattctaaaataattgaaaaatcatatacaatgtatgcatattgaagaatactaaagagacaagagggtatgtgtgatgagagaaaagaaaatctgataaaaaaaaaatagtctagcaaaatttcaagggtttgggtgagattgtttgatgatattttataataaaaagtctaaagaaatttttttaaaaataatccatcaaaatttgtatattttttaataacaaaagattttttaaaagttataaaaaatcctaattaaataccaccggattttgttatcctcattaaaagattcttaaaaatcttaattaaataccacaaaacttatttatatcattttaaaattataattgaataccacaagatatttttattaaaaaaagtattttaaaatcctttgaaattataatctaatacccatccttaattggtgcgtacttacttaccttagcttacaagtatttaaaaaggaaggaatatctttcggcatatgattttccaaaaggacttaactatacttgcaattgtggtgaattaaatggactttatttttgggtccgtatcaagcccatggataatagaacagtctgtgggccaaaattgaaatgtgaaaaagaaaacttaaaaaaaaaaacacaaaatccgtaacaatctaaaatattaaatataccaattagaagaaatttctaaaacgcacaacatgactcaaatttccctatgatcatatggatattttttaaaataggttccttatccacctcattcctgactttaacagactactccgcagatccggatccatatacaaacctctactttaatcgcaaatttacaaactttagccgcttatgtaattattgcagtttgaatgccacctaaattgagtagattcttctttttctagtatacttgtgttttgaagaggaaattgtatcttgttccatttttgtaacattcttgtactgcaagtgactcatataataggaaagtgttagattgtctacaagtaaattaagtgtcaaaaatgctattgtttagataaatttatagcatgtttagaaccgattttttccacaaattcaatgtgtcctacaaaatatatacgttttcaattgatattattatattaataaatttataattttctatactctgaatggaccaccagtaatctgggttctacatatgacgtagtttaaaagaaagtgataaatgccgttcgtgtgaccatttttgtggataataatggaaaaagtaaaacggtaggaccatttttggggataagaatggtaaaagtaaaacggtaggcagtcagtggagttggcccagaagaaaccaaaatgaatgcgtaaagaagttgttcaaagtataacataaaagcaataaactagtgaaggtattgcacaatttgtggatagtacaa

SEQ ID NO: 4961 - DNA, 1319 bp, Glycine max
  Soy_ogl_3538 Gm10:44989501..44990819 Cluster 22
ttatcattaagatttatagtgatgatcaattaagattttattatgtattcgttaatacttatgtttttttttttacagcaagttaatactaatgttatgctttcgaaaaaatatacatactcataatcaaactctagactagctaatgacaatagctaataaaaacacatgcaactttgactcccctttatattccatactaaaactagacaatccacacagcttttgtgattataaataaaaaatcttagctgttcctcttcccagcatgaaactcatctatcatagatattatttgtcccccacccatgcacgatagaacaagcatcaggatccaagttgagttgtaaaactagaacaggagataatggagcatgccttcataaacatcaagctacatcctccacaacttaattaaaatcaccctaaatatttcttacttgagtttttgtgacatcaatgtagattcctaaacacgtaacctaattcatgaaccacagaaaaatacatggtattaattggatccttttgatgtctgccacctatatatgcacactttaaacggacttgtttttagtacaaagggaaccaaaccatcatccaccacgtctttatatacctagctcgtcactcttcagcaaaccttcaactgagaaaagtaatgccatattccaaaggtcaagagggatctctttttgaagaagactttcgtcacttttttctatcttgcatgtcccttcacaaaccaaatttagaatacaatttatgtatgacttgattttgagaggtcttacctaataatatttctgctcattttattcggtttagttctttattcaaaagggaaaaaatcgtgtcctatattcttcatctgttttgtatttgtgctttggtccatttgaataataatgtgttaaaattccatttcctaattcattttttattttattgtaattaaaaagagatcgatcgaacgtcatcaatattaatgaacgtacaggtaatccgtcatatcaaagcattaagattagagtaaagcaataacttttaatttatggcctcaaatacgtatatgactatctatttaagtaaaaaaaaaaaaaacgatattgttaacttgaaattgtaatgggtgattttttttttaaagtgaagtcatgaacaaaaagaataacttctgaagttgtgattcgagccttaaaacttttatactattttttttctttactttattttttggctaaatcttatatcatgaataattgaaatataactcaatattaattaaaaataataatcagaagtttatgtcaagccca

SEQ ID NO: 4962 - DNA, 1300 bp, Glycine max
  Soy_ogl_6491 Gm19:41634301..41635600 Cluster 22
cttgatttgataaacaagagaattatatagggacatgaatgatctgtcggtattccatggcacagaagtgttacagaaaaagataccaaagcgtaattttccggatgagaatttaattccaacaaaaggtacattttggttgacactagataggtactttttagttaaaatatattttttggactactttaacttgtttacagcttgaagttgaaagagaaagaaagaaataaaaaataagtaattaatttgattgataatataatgtgataagacacagaaaaagagttattaaatgattgaaattattgtttttcaaaatatagtcactctttttttaagtaatagttgtctatggtgacggatccagaattgtaatgttgtgagagtaatactcatatataatattattaaaaaaattaaaagttagttatccaccgagtggatcggtccctctctctatatatgtatataattattcatgggattggctatttatgtaaaaggttttggatacccttgtaccctatattacatatagtttctttggcttatcatttaaaaaaaaaaaatcttgccagtgatgcagtgctgtggtgagataatagtccttttataaaccaagctatggcgaggtacatttaaagtttgtattaggcattaaaagtacattatttataaataaactatacgcatcttacaatatttttgttttatttgtccgaaaatgtataaatatagtattttattgtttttatttttatgcaaatctttcaaaataaagaaaatgaaaataatacttttataattataatgaaaataaaaaactaacaaaatattttctcaaaactaaatatgtcctaaactacaaatgtgtgggacgtccgagattttcgaagacattgcgaatctagcaattctaggtggaatgagattttcaaagtcattattgaataatgcattttccaagaaaagccatttggttttagacttacgataattccattatttgaatatcaaaaaattaaatcataaagaacaatgtactcggttatttttctctgttaattgttttttatctttttatatacacatatatcttaaaagtatatcctaaaaattaaaggggtgacattttataatcttattttattttatgcccaaaagacttttttttgaacaaacctaccttattatttgactagactgtagttgtagcaaagtatccttaaaatttaactaaaaaataaaaataaagaaatgattaccagaggagatggatattaacggattcagatcc

SEQ ID NO: 4963 - DNA, 1580 bp, Glycine max
  Soy_ogl_1236 Gm04:5507801..5509380 Cluster 22
aggactcattttgattctttttgtccatgtaagcaaacaatgacgtgctgaaaagaatattgtctttttaagtaaacttgagtcagtattgtctatcaaaaactcccatcaatcatgtactttaggaggggaaaaatttaacaaaactttttagctggaccattgtattatatcttattgatgtctaaaaattcaattgcatgttacatatcccggtgcaccgcatgtgcatgtttctgctaattatatgttccttggtgtgcataacttaagagagttccattgattgaacagatggattaaaaaatacgcagacagtgagaatctgttctttgaagatttcaaaaatgcgtatgtcaagctggtgaattctggtgtgggtggaatagcttataaattcaggagttgaatgttccaacttccactgaaggggcaacttgcatttttattgactttctaacagtgtttatgcacagttgccatgaagttttgggtgttttattaaaatgtttgaacatcaagatctactaccccttaaaaaatcaacctacgaagtatgtgcattcagggccaataaactccatgcgaaagtcgtttaaatttgaagtgtgaaggcttgagtgacacatggaacaatttttgtatgagcaaagttcttttaagttttaaacacaaccgaacgcatttgtattatttatttataaagaattcctttcataactcatggccatgttcaattacaaaaggaatattattgactagggattatcacttaagaaacatataaaaattgtttttgtctttttataagatctttttttaatttttagatgcattaattttttttccatatatacttacttaattatcctctctctaaatattaatgaaaaataattaaatggatagagagataaaaaaaagataatttcataatgttagtataaataattgacaattttaatgtgattaattaaattaactattttttcttaaggtgaattatttgaaatggttttataactagaaacggaggaattaatactaattatgaataattttctgttagggatctgttaattaagtaaaggtatataattacaaaaatgccaagtattttgttacctagtccttgaaccacttatcccttaccaatttttatattttaaattaagatcatgtgcttactagaactttaagataagttcagttacgaatttaataaaaagcacttgatgatattttggacttaattataagctttttaaaaaataaggacctaattctaagatagtttaagaacttgcagattcatttaactaaataaaagaataccatgcaaatttaattgtagttaaacttgagtgatatttagttgatacggggctgccttcggcccgtagtatttgtgtgtggtttttgaacgtagccccactcggtatattttttttttttaaaaggaaaacaattacccagcttttttttttttggtggaataacaattacccaattcaatgacatgttgaacataacgtatcatgtagttgtctctaaaaaaaaattaccatgtagtcagttac

SEQ ID NO: 4964 - DNA, 1252 bp, Glycine max
  Soy_ogl_1419 Gm04:45677149..45678400 Cluster 22
cctctaaatcacgtatattttcaaaagtattagcttttgcttggaaaacggtgttggatagaatacaaataaaaggaaattaatctaagaaaaacaattaattatagagtttgataacagagattcaacttgccttttatgcagcctggaagaggaagctagaagtcatttcatgttctcatgcttcttttcatcatcaatatggaaaatatactatgattgcttggggttcaagtggtattgcctattatgtcataaaaattattaggaatattttattgtcataaaacatagtaggagtttttttattgtgttgtcataagtatatgatataaaagtattaaatcttattaaatttatttaaaatatttaatgtttatacactatatctatatgagcacaccacagaaaaccctataaaacttatcaggaatgttctattattttttataggaaaatatatttttattaaagataaaacaatcttaccatttacgccaaaaaaaaaaacttaccataaggtatgctaggaggagttaaatacccacccaattgaacagtcagactcacgtagacggcatttttcatttgtcttgttaattcgtttacgatttaaaccactgtgcatatagtttattttgtttctcaaaactgaagatgaatagaatggggtagagatagccattatataattctaatgtacgctggtttgtttcatttaaactgcttggtaggtatatatatatagttctctttttcatgctgaaatgaagcattatatatggacacacacaaattaatattcgatatccttacttgaattccaaatttccaataacttgaagagatttaaatgtatattttctagtttgatgtttctgcattctgcttctctgctgaaggggggacttcattattgtatctatcctatggacataacgtatttgcaattgcgagaaacctaattcctttgaagaattcagattttaatttatagaaactttaatttgaagagtttcttcctgatcaattgcgagaaactttaataaaattaaaattttccatttaaaaaaaaccacaacgcatatcctttttttcatgtctttttataaaatgtctaagtgtgtggctaagaagctaaaaaaaatccaaagtaacttcgtataagaaggggaggaggggtaacatgggtacagtaggtaaagtatgttgcccaaaggagagaagggctaggtattaaaacattgaaaat

SEQ ID NO: 4965 - DNA, 1434 bp, Glycine max
  Soy_ogl_3297 Gm10:1075167..1076600 Cluster 22
tggatgtatgcccgcaaaaaaagcaaggttctttcgtccagttctaaatttcattaccttgaatggtccctactccattccctaatccctattcatatctataattaccgtataaaatgatttattgaattcaagatgtcagtgacagcagaaaaaaggacatggggacgtgtaaggaaccatacatgatgttagcttaatggaaatgtaataagttatatagaaattaagaggtatttgatttagaagagagaaataaaaaaagaagaataaaagaaaaatctttgaattaaagttaaatgtaagagaggtatgagtcttataaaataaaatataaattttttcttgtatatttcaaaacaaacacacctaagcgattattgtgaatgaaaattcgaaagctacattaatgttaaatataatagatagagatatacaagaatctttaatataaaaaaaataaaggggaagggggatattttcctttccgatcttgtcatatcctaagtttctctttacaaaatttatgtcactaatactaaaaaaaaagtctctttctttattctacattgtattgtacaccaaacaaattgtcttttttttttaaagtaattctaccactctatttgaaaacacttctctataaataagataagaaaaaataaattaagcttggcttataaactaaatttagtttaagtataatttaaaattattttttaaagaagctaagttaagaaagtttttacaaattaattaatgcatacgttaatttaagcttatagaagaagttaaatcatttttctttgttattttttcacctaaaattgcttattgaaaaatttatccatataaaaactataatttatgtgagtcttcttgttgattttattttattttttgtcgacagagtcttcttgttgatatagcatagttatactctttcacctaaatccttcctacattaggaaagtattcagaatagataacttttgaagagggatattcaaattgattttcttagataaaaaaaaacttggagaggttggacaaaagttgtctctctacaaccttattatctctctgtaaccttttttttcatttcatttcttcattctctctccttttttttttttggagacacagacatggtatattttggtagttctttcataaatacattaattgttctagtcacaaatttaccgcccttttcaacatgatataaaacaacttaatttcgaaaatataaatataccacccacgtgattaattaatgtacgtacgtagggcacaaattttgactgcctaaaatagattaaaaagtgtcatgacttaaaacatcaaatccataaactgatgcacatcattaagaaataaaaaaccataagctcgtggattaagtaagattccattaatcatatattattttta

SEQ ID NO: 4966 - DNA, 1200 bp, Glycine max
  Soy_ogl_4850 Gm15:1229001..1230200 Cluster 22
aaataaatattgaataagttacaaaaaatgaacgtagtattattaacatgaattcaactattccctattgttgattaaagagacacggaaacgatactgttcttttttaatttgtaaaagtcgccttttcatactatacaacgacacgcatgaaaaataattgttttttttttaaatttaaacacgtgttttattcttgtttttctaaacttaatcaaacgacgaatgcattgactttatttttttaaaaaacaaagattctagacaagtgtgtttgtgtacagtaatactagtgttaactgataagtgatttatccacggaggaaaacatgattacacaagtcacttatatatcaattgttgattattttttcaaaattcaataaatttcttttacattcaacatattttaaaaaatttaaattttatcttttattatttcttttttttattttcttttataattgttaattcgtatgagtatacacattattccatccttaatttatattaataatatgaatttatcaatgcgtgtgaatttatattaattgatcttatatatttttaattggtagattattcggaaaaaaatatgaaaaagtaaaaaaagataaaattaatttttttttaatttgtttgatataaaaaaaaactgttgaatataagaataataaccctcaattgtttgacgtgagttgctatcaaagaaacgtttgtagatccactatcttcctatctaagtatttaagtcatgttaataaagtcctttgctatttttagatagtgggagtttaacataagatatgtatgacaagatgtctttttgatatatcatattacttatagatattttaaatgtttgaacattattggattgcatatttctcttaataaatattgcactcatatattccttttctacgtagaaatgcgagtatttagcacgtatgatatatattcctatgggatattattttctgcaatgttaaaaacttacttttcttggatattgattgactgacatttcttggataattttctacaatgttattccatgttttaataatttcgtaaaaagtgggttgaatcactctcaaatcatattttctcttataagaaagattcaaataaaataaagaatgaactcaagtaatcaattacatattattaaattaacatgctacagtctatatctac

SEQ ID NO: 4967 - DNA, 1812 bp, Glycine max
  Soy_ogl_5479 Gm17:3469389..3471200 Cluster 22
ttacaattttttaaaaacaatatatatgaaaaaaaagtggaagtcataatttatgacttctaaaaaaacaaaaaaaccattttaaagtggtaaaaaaaaagtcttatcgttaataaatttaaaaaatcaattggtctttgtaaaaataaaaatcaaaagatgactgccaaaagttatattccctttgtgatccatgtcaatcatcattatttgtaaccgtttatccaactcgtaactacttaacaagagatttaacaaaaaaaatgcattactgtaatactgtgaaagagaggttctgacgggtccaagtccaacattggaggagtcatcttcattctgaataacctttcatttgattttgccggggtaatgcaatgttctttcttctctctttcttatacacattaattacaagaaacaccaatacaagtaaaatgtgaaatacaatagtaaatagcaatgtatacattatttttttaaaaaaagaagcaatgtatacattatactttcaatagggttgttcaatttgggatgatttggataacataaatttaatttccaaataaaaaagcaatgaaacggttgaaaagggattaccaacttatcattgacaacagaaattaatgtagcatttacgggcacaaaaatctatataggatgttttattaactttgagaaagatgttcaaatgttcatttatattttatagtaattaagaagaatgtcattacagtaagtcaagaatgagagtacttatcttataattgcactgtgcccaatcttgcctatcgccttaaaaaggttgctgcaacttatatcttggtcagtgaagcaaattgccttattcttgttctttacctgatctttgattgatttgtttgtagttaaaaagttgtcttctgtactttgaaaggaatgcaatacgacgagtttattaattgtttaaacattctcactaacataatcattgaaaggaatgcattctttaataacatatcagagttgtcttcggtactttaacatgtcagtaatcctattccaaccccaatttctctgttaaagcattcgagtttctggctaaccacaatattttactgcttaattgctatgttagtatccaagtccctgatattaaggagacaccatctgttttttatgtaaatgtaagagactaagaaatcgatgtttttacgatgcaattgtgcttttgtctttcattttactttgattgatcgcatggtattattaaattttcatttggagttttgatagagagctataatgtagttacctttattaacatttggggtttctgaaacaattgtttcttgtgaactaagtgtctgtagttaaaacaagtcctccttgatctaaaatttaaagggacatgatttctccgcaatgtctcaaactaacttatcgaatttgtcttataaggcaagtcagttaggaatacgaagctcttttactgtcttgaattgcctttttttttttttttttttaagttagttattgtggttatgtttccagccactggaacaaatcttatcaagcagactcaatgctgctagctttatacgtgccatctatgtcaattttggaccaatgggttcctatgagctcaactacgtaagtagtttttgcatttgaagttcaactacgaaagtagtttttgcattttctccattttcatctgcctagtctttttaggtacacgaatgaaaagccttggttgctatggacaatttgatcagttctcacaagattttaccccctgttaaggcttttacaaattcttttgcaggtgaatta

SEQ ID NO: 4968 - DNA, 1108 bp, Glycine max
  Soy_ogl_1024 Gm03:41722401..417214 Cluster 22
cagacctgcaaaagtttctttaggtcagatgcagattgagcttcgagtgcaacgatacaagagaactttgatcgcaagagccacttagagcaacaaaaattagtcttaataatctaaaagggtgtcgagtgggagtgggagcctgcaatttaattaataaataaagttactataggaataacaaattaatctcccttacaactagttcatgttgtgagaaagtctaacacttcagtgttgactcttaaggttgtctactatttagtaaacttaaaaaaataaaattcataattaagaatattttttaaaaacaaaaatattaatacaataatcaatataaattgattcttataaaaatgattataaggtacacctttaatttgagttttataaaaaggaaagaaagtagtactttatatttaaaaaaaatagaaaaattaattgtgaaagagaaattttttgcaggtataattaatttcgaaagacaatgtcatctgatctcaactataggcacgttatagaagtggtgagttgcaattatgttgatgcattgtggtagggacgtaggacacatacaagatgaatgaataaagttatcgacgcagttgcaaccaataaccaattatggcgtattttggtcggcatttcccccaaccaaacgcaccttcatatcctcaaacttccttttcctcttattttattaggagattcaaaattaaatgattagttgcttgtccatttaatttctttgtgaatttacgttgtcttactctttattactttctttatttgagggtaaatagaaaataaagaaataaaatgaataaaataagatagaaatactattttttttaagataaaacaataaaaatgaattagttttttttagattccacatataaaaatatttctcctaagttgccttgaaataggaaaaaatggttgttatattttttgttttactttatttaaaaattaaataaatattttaatataataaaataataaataaaactatatttaaaaaaatatataacatttttcagtaaaaatatgtagcatttttttaaataaaacgagttaagttatttttaattaatataaaaac

SEQ ID NO: 4969 - DNA, 1222 bp, Glycine max
  Soy_ogl_6289 Gm18:60062601..60063822 Cluster 22
cagtgaaataatttttttcgtttatgtaattttatattcatttgcattattgaatttgtttctttgccacgcctaaaaaatattttgtctgcagattagaccaccaaggcacgggcatacaatgtgaaaaagaaaacaagtgtcagtagggacgtagccaatacaatgattggacgtagaattaacgttttgcagaacttagataagcgaatagtatactgatttttattttttttacgatatgtttagatattaaaaacaacaaaaaaagataatattaaaaggagtgaagaaaagggggaacgagagaaataaaaaaacaaaagtttagattgtttaaaaattaaattgaaaaaaagtaagaatcgccacatttaagatattagtggcaatttttcctttaaacgattataattaagataattttgtgatgttttttaattaattgtagcattttttatattggaacaaaatttgcaatgttttctaagttgaagtgcaaaatttgtgatatggtaaatgattagggacaaataatataattaagcttgtccgttactaacaaaacaagggagttagcaaatttaataagaaataatatgatttggatttgcaaattatccaaagttaataatgcaagtcaatttaaggagatggtggacttgatagtaaataaaaaggaaaaaaatgaatgatcttaaatttaaattttttactaataaaaactaataagttaataactaatatttattcataaaaaataatataatgcgagtcaatttagagttctattgcccactaggtcaattagatttgagcccttgtggaaagaacatgtatacctcttccaatgaatcataatggaggaaaaggacactagctagtagtcacagacttacacctaattctcgatggcctgatagcaaagttggccaaatcgggtcctgaaattattagtttttcgttttaatttttatttaattaaataagtgaagaaaaatatttaacttttttatttagtggcaatttttctatgtggaaacaaaattcacaatattttgtaaactcgaggcaaaaattatggaaaaaggggaataaaattcacaatattgtaaaactttggaaaaaaaatccaattaacccttatagataattagctttcttttacacaattaattatggtatatttcatattacttcttttgtgcatcaagtattgtat

SEQ ID NO: 4970 - DNA, 1206 bp, Glycine max
  Soy_ogl_2522 Gm08:5275072..5276277 Cluster 22
ctctagtttttcctcatccttgtgttatctatagctctagcttcatacgtctaagtaacatcattcatacatgctttagccgcgcttattgtgttcggcactacttaataattttgacagttgagacaattgttttaaacatgtcggggaaagttgtaaaaagttacgggaaatgctagttttacaattaattttcctacaataaattagtacaaaggagcgagaaaaaaggaaaaatatataatcaaatagatatgtgacagagaaaagtgaaaaaaatggagtaaaattgtcttgtaaattgctacaagtataatttatattttgtccctacaaattatttttcattcctgtaatttttagacatttgcttttgtttgctttgtgatcagagtaagttataaaaaagatgaaatattacagatatttacattataaaatttgaatttttataatatagaaattagtttttgtctttatatattatgaaaactagtttctgtaaggtaaatttttacattatggaaattagttttcataatgtaaaaatttaaataacgaaaattaatttcagtaatttatatagcaaaattacattaaaaaaactaatttttgtaatgaataagacttcctatattacgaaaactattttccataagataggggaaaagtaggggtgtgacaatgagagagaagaatattttgaaaatataaaaaacaaaaaaaggggtgtgaagaataaaaagggtgtgaaaggcatgggccatatatatataaatacattgggtcacttggacttgttttaaagtaccaatcttcagtacaattataacaacaaacataactacagaataaatcaaaataattaaaaattatcaaaagtcttcttgttcttggtcctattcctctgcagcaaccatcatatcccacccaattgtcatcagtatatgtattatcctattttatatttaaaatggactaaaaatgtcagggcatatataatttgtgtgataatatcactatttttatcataattatgcaatatttttaaaaaaaacatcttatacaaaagtcatatctcattattgtatgatggtcactaaactgtcctttttcttgttaggatatatgaattcttttattatgtttctagttgttgcctctattattttagttctatatatagaaattatttttccattttaa

SEQ ID NO: 4971 - DNA, 1300 bp, Glycine max
  Soy_ogl_1827 Gm06:7352401..7353700 Cluster 22
gtctttgtttttcatttatttatttttactaatagtcacttgttatctggagtaggggggatgggggtggaattaaataagagtaaggaaaattataatttatttattctactttgacaaaacacagattcgatatttttggcgttttcgaaattccaaacttattatcaaatatacgaataagcaatatgagtggatattaaaattttaaaaactttaaattaatacatcaattttggtggtaattatttaaagaataaatgggaatcgggaaagaagaaaagatacaattaaaaataaataattaaaaataataaagtgctaaagcatgatccgtaaagagaaaatagattaaaaaaaatatataaaaattgttggaaaactaaactgaaatttaagtgatggttgcatacttgcatgagactagctcgtttaatcctttgatgagtaacaaatgtgtcgggatttgtacaagtttgtagggcagaagtttcaaccctaatacatttacagattaatatttatagataataattattaattaactactagtaaattcaagattgttatttataggtaacaattattttcttgtgtgtcaaaatatttgtaagtaaccaccacttttcataaactgtttatgtttgtatagacattaccattccaatttctctcaatttatttatgaatcggcattcctaattcaactccaataaatattttttaatatattatattaaaatattattaattattattagttcaaagataattagttcaataaattgaaatgtaactaaaggatggaagcttctagagatactcaccgtcccattaaagagccaaaaactcttgttattgtaattttaaaaaaatatcgcttcatcaattcattgacagatccttctacaattctatggttaaaaatggtgcgtgaaaaaagaagtatgtaccaaattagcatattaataattatcgacaaatatagtgaatattgcagcatccacgccaataatataataaaagaattaacatattaatgctgctccggtttaagaatattttaatttaagaaggaactattgaaaatcgttaaatgtcctttaagatctgtacaaatgtcagaataattcatgaataaatgtcggcatttagaaaaaaaaaattaaggaaattaaagagtgtgttaaaggataagataaaacattataagatcgttttctatatagctacctaaacaagaccaattgacacgagacacacaaaaaccatgttggaaatgtatagcccaaagacaaag

SEQ ID NO: 4972 - DNA, 1556 bp, Glycine max
  Soy_ogl_4827 Gm14:48665401..48666956 Cluster 22
taaaagcccaaaaacaaactaaaccaaaacagctctagcctttgcaatcagctaacagtaacagagaaacatgcattaggaggaggagaagcaaggaagacagtgccacaagaaagcttatacgctgctttagccattcaagaatccgcaacagaattagggtgtgagaacttgattgtccaagtattgataacttgaatgatgatcaagctggatgtgatgaatcattatctcataatagtgtcatgaattttttattttttttataggaaagtgtcatgaaaatttaatgctattaaaatagtaaattttaatccagcaataggagggaaaaaaataaagacttgcatgtttttatcgtgtattacaagtattttaccgtcacatagatactcgtttaagggattgtcaagagattgtagtaaattagagtaaaaactagagaagtttggataaggataccaaaattcagaagctaattttattgtctaagttttccttgaggaagatgacggaaaactattccttgttgatagaaaatattccttggtacagtgatgctgattaaaaataaaataaaaaaacactggtacagtgttgtttttgattgtaaaacgttctctggtattcctggtaccaagattaatatatcattttttccgattaataaaaaaactaaggtctatatattaaacttaaccaagattactattacttacatgtgaacataaaatattagagaaacagaaacatgaaaaaacatcatacttgttctactaatttattggtctcaaatatcatttgaattgtgatggaatatgtaataatggtggcgttgtatatgttgggatccgtcatccgtggtatatagaaaatatagctggaaagaaagtgacacattaaggtggggatatatggattcgggtacatggctagtgttatttgtgtaggagtgtaggagtgcaagtctggtacaaatggaacacttgggaaatattagtgttttggatatccgattatggttatactatgtaatggggtataggatagattgagtgctttcaagttgtttggcttatatgtgtaagggcggataccccttttacactgtattatcttccttaatacatattcttttcactgattaaaaacaaaatctgcttgaacacttccataatgaggtcatgatagtaagcaagaagattgtcctaaatcctaatcctttgatgtcctgatgttttgcacaatcattcccaccatgaagaacctaacacgtaatgtgcaaatttgaagtttccacctttaccatatacaaacataatggtatcctggtgggtgatcttgaatgacatttcacctaataagcggtgagaatcgaagagggacccgattcaatatgacatttctctatctttaatagattttttttctttttaaatgtatttaaatgaaatgttactaatacttctataagtaattatctaataagagtataactataatggaattatttttactttttttttattaataaatgtttaaatggaaggtactat

SEQ ID NO: 4973 - DNA, 1100 bp, Glycine max
  Soy_ogl_5421 Gm16:36604201..36605300 Cluster 22
aatacaactaaataaatatgtttaataatattttttaatcaaaattaacgattcattttaatcaatttagctgtcaaaataaagtaaaaaatattgtgacaaaatattttttttaattaaaaacaactccaacagcattatactaataactaagatttttcattgtcacacgtctcaatgtagttccattcaatctcaaattccacaaagaaacttttgttgccttcaattccaagacggtgataatgaggtcgccataataaatacattttttttttggataagtagcaaaactatttttaattagagtgtcacaaaatatttgttttcatagaaccataataaaatatttcgtggtcaatgtttcttttggtttttttagagatgtttcttttgagttaaacattgttataaatgtatcttattatttaggatgaaaattgtcataattttttttaaatgttagttatttgtttttgttagaatattagtgagagatttgaataattgaaccatgacccctttcctttttcctccaaccattaaacaaattttgtaactcttaaatattattataaatatgtctcgcagattccacagtcaggaattcaggatgaaaatgacattcttttttcccaattgagagataaaagtgtatattttaatttatcggatcaaagaaaatttgatacatgaaggaaattgattataaattttttgttaattaatatttttttcaatgtgaccacatgcaacaaaacaaaattaagttaaagaaataaattaatttcaaatcatgacgtgttaagatgcaagacatgcttgaccatataaacaccagattattagagacaaaagtgtaatccatgtttacagctcttacaaacactacgaaaatagtgagatagaaaaacaaaacaagtcaatatcatgttagaacagtaacgattccttatttaattattagttgcttaagatcaaatcttacccatcacatcttatattttctaatatgcattattggttctcaacttatttgtttattccataaagaaattatttgtttatagattccttgatttcatttctattaattagaa

SEQ ID NO: 4974 - DNA, 1100 bp, Glycine max
  Soy_ogl_5034 Gm15:13148401..13149500 Cluster 22
taaaataactagacaagtgggatatctatctaaattgaacttttacatgaacacttcaatatttttgacgcggacaaaatagaacaaagcattatgttctagtccgttgtctttgattcccatctttttagtagaaccaaaatgtgtaccacttttagtattgtgttatgttatgttctattttaaaaatacatcaaagatagaatagagcccatatattatgtttgatattgttctaatacggctaccaatagctaaaaaagagcccatatatacatatatatttttaagaaacttgttgcgtaccctacctaactaaaaaaaggttttgtttttttaaaaaaaatgtttggattactctttctatctttatatattatcaatccaaaaaatacttaacacatgtgtttgatttggtgtcgtaggattactgttggtgcatatgcatgctacaagttgtagcttccacgtccattgacaattagttatttagacgcggaagctagcatgcctttacacaacgtgtttcaatggcactcatttaaaggtgacaaactttcatgtaccatctaatggtgaaaacccgacaatttaggcacccatgaccaaatagcatagctagcaaatatataacatcaacagaatggcattttctagcacacaaaaatcaaatgggtttccaaaatcaggaatttgaaaattctgaattgagccagaacaaataatcaagctattagttcttaagcagaaaaacaggtgaattgtacctgtcttgattgttacagataaaaaagtaaaaaaaaaaaagagcatattaaatataatttttaagtatcaagagacgtgatgtgtaatttattttaaaatttgtatcttaattcttaaatttgttaacctttttatttatttgattttttttatttaatttaatttaattttacatcaaaagaactaaataaagcaaagtatttaagtgatcaatccttaataatttaaagatactttatgcttacaaagaactggcgtgggtcttatttcttattcaataaatttcatttgtaatttcatacatttgaaaaaatcaccacataatagagaat

SEQ ID NO: 4975 - DNA, 1000 bp, Glycine max
  Soy_ogl_3193 Gm09:39453801..39454800 Cluster 22
aatgttaactaattgagggaaactattatggaaccctttccatgttgccatttgggtcatggcctataaacacaactgcttcacaaactactacgtattatataaagcatttcatggctatagttatagatcgaagttcattttacacgtattacatatatattctttgactttcacatcagattatgcttttaactagaggtcactgccacttgtcagaatcttcgccggacttccctccgcatccatcatgttctgaaatattaccgaacaatcataaatcaaacaagaccatttacagttgaaattgattttgagtgccccatcataattatcgatttctcaaaatctaaaacaaatttgaaataagtcattaattgtggagaaaaaaaattccatttatttaagaaaattcatcatcatatgcttaatttataaactgagtctgtgtggttcaaaagagaacaccatctgttgcagtacaatccaacgaccagtaatatttagaccattatttttcattcagttttgaaataatctccttaattcattaaagaatatattttatttatatctctttgtcaactttgttttgtaatatttaaacctcatttttcattcaatttctaaaaagctcttaaactaataaagattataagttttcttatatccctttctactttctaatacactttgaatttaattgctcatgaaaactaaccaataaaaatggaacacaaaggattctgtatatttatataaaagaaatggatttaagttttctcaagtgagaaattaattaaaagtaaaaatatatccaccttaatttaaagtaaattaaatttaccaaatattttaatctaaattcagaaaagacgcatcattacactttttttatgcttatctcgttctaaaggagacaaaattaaaattaaagttactcattaaatacagtagtgaaaaccttaggttattatacagtgcctcttgtgaaagctat

SEQ ID NO: 4976 - DNA, 1127 bp, Glycine max
  Soy_ogl_6952 Gm20:43454101..43455227 Cluster 22
attttaatactatttggtataggttgaaagtagagaaacacaatgattaaggtaatggtttaagtctttaagagaaggtctaattgtaatgaggtaaaggttaggcttcgacttgacatcaatgggccggtgagaatgtcattcatataaaaagcaacaaagcaaaaatttcttttggtctcaatccacatgaaaagacgaagtattcctaaaaacattttcatatatgaacagaataacttccgtctttcaaattcttatcatggttttagtttacttttaaccttgattccatttattaaagttcgattaattttattcataattaatctttatcaaaggatttgctatctttaatataaaaaaattccaatcatattttttatattcacaaggtttcaatatgagactttatttaagaaatttaagtttaatttatctattcaaatcaatgatattttggtattcatccttagcatatgtcatgctagattataattagtatttcttcaggcataaccttttcaaggtagaagagtagttaagtatagtattaacttctccaaattaaaacgatagaatttattttcacaaatctcctttttgcatagacttgaaatgatgtacacgttgaggtttagaacgctagcactcaagaagtggaattgtttgtgattatatacgctctcaaactaaaataaataaaataataagcatattagaggatcaagcagcttagcagaggatattctaacaagattctcaaccatttttaaggttaaggcaatatgttagttgcacagtgctaaattcttgtaactttttgctcaaaagacttaaaggttaattgtctacaagtgagaattgaaagattgtaatattcttctgacttctgagtgagaattgcaagtcaagtgcccttggaagtttcctctggtaaaatctttacagagttaatcttctatttatttttgaagaatatacaaataaaaaatcaataattaagacttgaatcaatatatagaacgaagagagctccagaggttacaccttcctatatatgtcaacaacgaagaaggaaaaattaaaagacaaagatgttgtaacttatacattaattgggtatt

SEQ ID NO: 4977 - DNA, 1278 bp, Glycine max
  Soy_ogl_1235 Gm04:5482923..5484200 Cluster 22
actggaatttaaaactatgacaacctaaaaaatatttttgttctcaatgaaaaaattacattgcatgaatatatattttatgtatcttttaattttattttatttttactgaaatgtcacttttaactattagtgttgtgtttgggaatcaattacgttgaacgtaattggcgttctttcaaaaataacaaaggagtcaattctgtttttgttgtcttcaaatgcacaaatagccgtttagatgcattggaatttgtgcaaccaaggttttaacgggaaaaaaatatgtactagatagtccacaagtaatttaattaaatacttatatttcaaaaagttagtttaataaattttagttaaatatattttttcatcttttagttaatttatcaattattttttttgaaacataatcttgataactttaattgaaactctttactagattaataaaatttcaatctagagaagggattaatacccataaaatgattagatgacgtttatatttagcatatgatcatgattaggttaaatttctccgtgagaatacctaaaactaatacaactctcatgtaaaataattaactttaagattttatggttaaaaaataaaattatttgttaatcgtattatattatatttgttaatttatgcattattttcatatagtttaaagagtttgatgattatatattaattgtataaaatatttttattttgttagttaatcttaaaataattattttaaaagtcaataaatttaaaatatgataagttgtgatcagattgtaaagtataccgtggtctgcgcatgacattttttctttagtttaaatgcggcggttattcgctttcgtaaaatcaagggttaatcaaacccagaaaaaaaacaagaagcaaggcttaaaaggaacgttctggacttaaatactgtgaaattgtcgatgaaacggaattgagtttaagcgggtaggtagtgattgtttaatgtgtgttcatacttggcacagtgatgcgacatggatggataatttgcaaagcaaagactcggttggtgaagagccagacacgtcaaccctttaccttttcaaattaaaatctgacacaaattcacccacttcttctatcgtgcttgtcagaactaacacttcagcctcacctttcaagagaaacattaaattggctcccttaataactttttttctccttttctaatggaagtataaaaaatttatgattttttcatactaattataagagtaatgtgaaaatga

SEQ ID NO: 4978 - DNA, 1100 bp, Glycine max
  Soy_ogl_1829 Gm06:7375401..7376500 Cluster 22
tattgaaagttaaaatcgtatcatattttttaaaaaaatatattttataaatcatattttaacatatgattgcgttagaagaaaaaaaaaactaaaatggtattttaacataagaatttagtacttagaggaaaaaagttgatatgattttttcattatgaaaacgtttattaaagtatgatttatttattttcgtaatttttttttaaaattctacccatttccgtaattaacccaatagttgaaagtaattccctcgttggaccaagagcaatccccactgctaaaaccaacggataaatgcagatgatatgtgtcacaaaagaaaaacgcacaagatagtaaatatttataagatactactgttaattaagaaattaagagtagaaattttttattaaaaatattattaatatattttaatcataatttttacatatctcaacgcatttgtttattattaattctttaaacagtgtctttaaggcattaattaattaataaaattaaaacaaataaaccagctgaataaatttttgtgtgagtgatgttagaggttttcaaacgtcttggctgatggaagggtttcattttcgaaatatgttgcatctaataaggctgataggttcccaaacaaccgagaaccaaacaggaaaaagtaattaatcacccaataaggctgataaataagtaacaagttgttactagaagtaacaagagtgatgttagattgtgtcatcgtgattttaaaaaaaataaaaattgtgccattgaggtgtaattttcttaggtctaattatacattttattttttaatttataaaatttcacgtattttgtttatttgtagcaattagagataagtctgtaccgcaaaacttaccgtgcataaaactcgccctacaaagcccacaatttaaatgactttgcttttatcgaacttgcaactgcatcttcacgtgctaaatggatcgattcccttttgcaaaaaaaaaaaaatgataaaataaaaaatcaaatgttataaaactgaaatttaacccattttttaaacccttttaaaaaaaattacctaaaaaaataaaattaaaaaccatttt

SEQ ID NO: 4979 - DNA, 1105 bp, Glycine max
  Soy_ogl_1750 Gm06:729696..730800 Cluster 22
ataacgagagttcaaatctattacttaaacgaaaaaaataaataatacacaaaataagatataaatttataaaaacttagaaaatgataagtcataataattattataaattttttccaccaaaataattatatgacaatacaaaatattgtaattatttgaagaaatcatcattcaattgaaaaacatatgtctattttttttattaggataaatcatatggcaatacaaaatatattattttattcatagatatacatatacagcaatacaaataatcattggatggtttggaccttaatcagcccactatagaaccaaatcactacattcgtttaattataaaaaaaatcacattttcgaatatttgatgatactatatatttttcttttttttttaaatgtcactggatttctgtaccaatgcatcggaattctccgccgtcgtgtatgcacacacaccactactatatcacaagtattggaatagttatgtttttttttaccaaaggaataattatgttattaagttattttttgttttttagagagctttgcgctcaattttaactaaagtactcaactagtattttcttcatataaccaaattctcattgttaccttttagatttatcgtcatctttatatttatgactctttagatataatacactatacagtgcttatgtttttttttttttaactaagtagatatgaataaccaattttttttccaccaaaaaaaatacagtgcttatgttgaaggattggagactgggctactttacttgagtaaccgggatagttgatgcattctaaagttgatttgaattttgatgtaatcttcagaatttaagatcatcgattcaattcattcatgtttccatacaaagctgacagacagttcccgcgtctttggagtaataatgtttgttaccgatggatccccgtcaagcacaagttacaaaaactagcttttgcgtttctcaaatctgatgtgaaaaaatttgagacttgcattagatatcacatccaaacacagttcaccagctgccaattattcatgtagacttttgttttttacataattcatgtttgtgtatta

SEQ ID NO: 4980 - DNA, 1100 bp, Glycine max
  Soy_ogl_4664 Gm14:4981601..4982700 Cluster 22
ttgatttataattttgataggctgaattttgttataaaatatttcggattttgttaaatttttagaaaactgcaaaccatacagctcttgaattaaatgaatgtcagcatctcggattttagtgtctaattattggtcgggaatatcctgagataaagaagataatattgtcattgaatagtttttcattcggttattatctgatgtgatataaaatattagaattaaatttgttattggatatacatattaatacaaattgtaaataaaaaattactaatacaaatgaccattataggccacggttttaagatccaccagatatttactttgttggattttcaaaataaaagcggatgagaatatactataaatgatattgactcaaatgcaaaactgaggtttattatttcattggctcattgccaaagttttgttttatttttatttctaaatgaatttttttttatttctaaatgatttaaatgaattttatttgtaaaagtagagggaaaatgtcaggataaaatacatgtgtctttactctctctttttattactcaattgttaattttttttggaatgataataagattcaaactcataatttttttttaaaattcttacaatatcaaacacagaagatttttggtcatattgacgccggttaaaggacaacaacataaaatttaccctctgtttagaggacattttaatggctgctccctttaccctttgcacagttgtgcccctcttatagctaatatcatgcagatatgtgctgaggaaggacaggttcagtggctctatacactcccatagggaaatcaaggcgcagatatagtattgtcgttaatgcaagaatttttcagtttcctgatttccctcgtggtttttgaggtgatgtaaatcctttttctaagaaaaaaaaacttaattaaacttttgttgaatataatagaagggacttaaatccttcacaatgttaaaaattatggtcgaatttgtgtttgaaagaaatacttaattttagtttataataatttcttaaatataattatttttgaagaaggatatttttaaaaaaaaatagaaaaagt

SEQ ID NO: 4981 - DNA, 1891 bp, Glycine max
  Soy_ogl_1075 Gm03:43837101..43838991 Cluster 22
ttttataaatcataattttaaataaagataagctcctccaatcactctattaatgatagaaaattacctttattcttttaaggtttcagaaaagccctgtcaattgtgggatacatgattgctatatgttccttgtggaaacgtgaaaggacacaaatcgccctttgcttttaattagtattttttaaaaattttaaacaattagaatgaactaaagataaaagtataaaagtattcattagtatgcaatgctgagataataatgacttctaaattggtggttattagtcggtatttgttttccactgttctttctacttcacgaatagtttataataattgtaggttgaacatttcaggtaagaaaaaaaaatagagagtcgaaaggacaacatagagataatgctgcaagaaaaaaaaaagttacatgaattgggacgggatatgtcggacaatttatcagaaagaaaaacatcaagatccttagataaaatctatgtgaattcgaaacacgtatacttgttttggttaactaattagtgtacttttttttttatcttgcattaatattaataggggctaaccacatgattataattttcgtaagatatatattacttctacttctccagtaacatggaatgaaccttttattttctctgtacaatttttgttaaaaaaatattagaatttcttaattaaagtgttaggctaaaaattgaaatataaatttaaaaatcattattaatgaacataactagttgatctttcgaacaactatattatacttattttttttaaatactttttatggaaaggaatcattaaataaagaaatattctttactcttcgggcagggcagtagtcagtagaaaactggaaatttctttgccagccgagtatttttccttaggcataaaaaacaaactaagcaaagtgagtcttaaatgcaataatgacctagttggtgcttgttaaagagctcgagacactgacagttcaaccaaatcaacagtaacatagaaagtactaaaacattttgattgagagataaacatctatcaagaagggatgattataaaatgggtttagtttagtcttaattcttttcgaattttttttaggataatgtcttgattcaatcaaaatttgataaactgtggaacaaaatcgaattaacctaaaatattaatttagcacaggtcttacaagttagaagaatgcagacagatttgatggtgtaaatgttttgtactacagcaattagagttgaaagggagcaatcaagctaagtatattcagattttggcaacatatcatggaataaaagatagtactcatctctcgtagcctatggtctatgggttgcaatataatgcggaattgtgattgtgtagcagaagaatcagatatgccttttgtgattaatggttttgtttattatagccttagtgttaggcctagtacataatggcattatgatgtttatacgtttaggaagggccagcattgtgcttcattgtttatggtcaatgctgttaatagctattagagaggtcttgagttgggaatcgtaaacaagctgtggcttgcaatctattactcttatactgatcttggctcacatcctgtggcttaaccattgcttctttgttttaataatgacctttttgtttatttttttttaaatgtaataaaaaacacttttatggaacaaatgaatttacttttaaaaaaagtcagaaaactaatttttttaagcaaaagcagtttaaataaacaaaaacttaataaaaaaatgtattttatttataaaaaaacaagtaagtttccaatatcttttgcttttttaaaaaaaaaaaataatttgatataatataaattttaata

SEQ ID NO: 4982 - DNA, 1100 bp, Glycine max
  Soy_ogl_4546 Gm13:38436901..38438000 Cluster 22
aaatttacgataaattttaatattatctttaatttgagcataattcaatttaaaagttaacttgtgagaaaagaattgttcaaatcttcaaagtttccaaacccgtattttttctttaatcgtatctgttttttctttatccatatatgtaattaatgtgaaatctcaatacatgaagagactaaagaatgattttattcgataacaacagcatcatatctacatacaaggttgagagaattaatctcataaatctagggactagaatcaaggattagaataatctatctacagaaacaagaaaacaaaattttcttaaatggacaatgtttccctattatactaaatatctcaacaatatttcaatagtcaactatgagcactttggagttgcatctagatcaatcattaagacattttcaatgttgatgtggacttacattttttcccctcatttctggacaaatgggaacatacgcagatgatgttctattttgtccacaagatatttacattttgtagtgaggttgtgatctctgcgggatgcttcctcacctgcaaatgtcaaacttgcatattatttgttactccgcttctgtcagctcatatcctttcttgaaaaaccttttgttggcttatgaagagacccaatccaataaaaaaatttcggttttcggttcttttcatagatttttcagttttcgctggattgcatcgagttatgaactctatacgtttcagtaatttataattctttctacctagtcacaatgaatgaagtattttaatagtgtctagctccatctcgggtcttgtctctgtctcatcaataatgcatgtaatcttatgttaattccatgctgatcagctaaacgctatgggcaatttgactatagacataatacctaccgattaaatgtgtgcccatatgccatcatccgtggtcaattgtatctagttaatccaagtagttttactacctgacattctttgtcatattagtgtgaaatatgtaatatgttaaagaaaaggacattatagttcaattttaaatgtgctatttacagttatacatgcgccataagaaagtatcatttgtt

SEQ ID NO: 4983 - DNA, 1128 bp, Glycine max
  Soy_ogl_4897 Gm15:3876773..3877900 Cluster 22
agaaactaaaccgaattgcagcataataaaccatttactcagacaactatccatagaaataatcatagcatcataattttatagcagctaaacgcatctctagtcactctttcttcttccaaaatggtggtaagatttaaaatgtacatgttccaaaaaaatttacatttgatgatcaatgatgccctgcaagcatgtatatttattgtggtaaaatttatacattacaataatatctcttattatatatattgatgtatgtattatgaacatgtatattagttttagttttacagtaacattttttaatatatgtttacctattccatcagataaaatatatgtttatttataagtattttttaaattatcgagagagatgagattgagtagaaatagaaaaggaattaaagcagcaaaaattattatcgatcaaccaccactttccgatagtgtcttaacatcaaagtaactaaagcttttgtgggtgtcatttaaaatcaaacaaaaaaatagaaaacatataaaagtcaagttaatttttttttttttttgtataattatatgactagaagcatatggttgaggacccgtttagtttgagaaaacaaaatgaaaaaagcgtagccttctttctttctattttctatatcttttgaaattttgtatttaaattttggttaaattataattttccagatagggcagtaaaaaaggcttaaattataaagaaaaacattaattgacagtaagaataattaaagaggtcggacaaagaggataattaaagattaacataaatagaaaattaacaataattagttacttgcaaatgtgatagtgttaaaaatgattggaacaacaataatattaaaagcaagattgaaaactaataaaaaaaaagaagaagaaaagaagcaagattgagatttgtgagggtcatatgaagctagaaaccagttcagttaaagtgtggttacaattaccgtatatatgccaatttcaatttttgaacgtttctacaaacataatttgaaaaatgaaaattgaatgcatattataatttggaaagtaactaacatggtgatatacctcaaaagcagttgtgtaggccactaaagaaaatga

SEQ ID NO: 4984 - DNA, 1135 bp, Glycine max
  Soy_ogl_6588 Gm19:45234966..45236100 Cluster 22
gctgagtgtatagaataagttcttatgactcttaaaaatatttttattcaagaaaaatgcgagtagagtaatagaactaaagctaaatgattcagatctatatttccaattgaaaaaaagtcacgcgctctcaaccactgagctaagacggctacttgtaatttatgcaaattgtttataaatttgacttaatacttttctacccttttttgctacatcaaaactatcatagaatcaattacctcaccatcatcgaaaatgacagagtatttaatttggtcatataataaaataatctatattaaaaaaataaggtaacattttatttttttaatgttttacgttttttaaatcattaccatttgttaaaattcattaatctatttttgatacatttaaatataactaatccaatgattttgtactttattttcctctatggatacatgaatcttcttagagaaataatgttattctaattaaacatgtgcaatataataagattaattcttctagtgagaatttgttgcctaacacgtactttgactaaataaaagtaataatgtcaaatgtaagattaaaagcatcaaaagtgaattctaaggtacaccatcattctctctgcctcctggataagtattcgtatatcattttattatacaaaaggaataatgtaaacgtaaacagtgattatatattaacactttattactctaaacattttattaatactcataatttttgtctatctttatctccctattatatcttatatacatttatctttctcttctctctttatttgtctactagaattatttgatcagtgtgtaccttttttttatatataaaaaaaggcaaactatattaataaacaaatagagtacaagatgtatcctactaagaaaatacagcattctctgtccaaaaaaaaaataaaaaaatacagcattcaacaaaaacaccctgaatcaacttctatactattactacccaacaagcggcactgctgcttagagattagagaaaccgcatgccaattaatagcacctaaattcacctaaatttgagtatgtgcctaacattttggaaaatcaaaagtgagtttttaaggtacattacgtacaagtacaac

SEQ ID NO: 4985 - DNA, 1114 bp, Glycine max
  Soy_ogl_1028 Gm03:41856785..41857898 Cluster 22
ccttagtgcactcgtcagtattcttatctataagcaacaagaacgttttacgtgttgtagaagtccatatatgaattttaaagaatcaaaaagtgtttttttatataaaaaatgtagcatttagtcttacaaatatttcaataattttctaataaaaagcttccatttattgatttactatctaatgcctttaaaatactcatttgcaagactcaattttttaggcttgtttgttatgaactcaaatccaaccaatgttggcaggtttaaaagaatgaaactaaatcaaatcagaaaaattgtgagaagaactaaatttaccaaataatattttttagagaactcaacaaatcaaaccatgttggattgaattatttatatttaatctttgcgaatccttttttttttttttaatttatatgtgatttcatattttagtttgccttattctaattaagtttatttatatttagtttttatagtttctaaattgttaaaattaatgggaatgtaacaatgatgtgacatcatattaatttgtacatattaacagaaaaatgtataaaacatttaaataataatgatgaagattaagaaaacaattaaacctgtatttttttaatctgtgtcttttgttaatcaaataaaaaatatgctaacgaatattttaaaaattgaggaaaaaaagactatattcaaaagttgaacaattatgaaatacaacaaacaaaagtgttatataatacatcacattaatccactaggatcgatataatgatcaaggattgaggtagtatacataaattatacattttaattttagtgcgattattatacactgaaatggcacacatcacattctttagcttgtatatacttgatgatactaaaaaaatagtgaatttgtaagatggaatttggggaataattcttttaaacgtttttccaatattttaatattcttaaaatataataattttgtggccagaaattccgtgtattaattgaagtggtgcaaaaagctcagaacttgtcacgtatagtttggttgggatcttatttattcggagaatgttgtccctgtctttttttttttttttttacaagagtggtc

SEQ ID NO: 4986 - DNA, 1300 bp, Glycine max
  Soy_ogl_2130 Gm07:2373301..2374600 Cluster 22
ataaatacacatttagaaattcttaacaaacacacacaacatacatatttagaaattcttgtacaatatgaatatataaatatttatcctatacatgaaaaaattgttagtttgttcattattttctttcatttcactggttgtcctctctctctctctggggggcttaaaaattaagtcaaagaaaaacaatttggacttgttcatgcgatcgggcttttttttttggggtggtgggttggggggactaccagatctctagcaggcctattaagtggtgaattcgattggctaggctatatcatgagaattacttttacaactgcctaaagcttaattatatttttaattcttcaactaaaaatttatatttgttagtctctttaccaatttaagagactaaaaaaaaattatttgagggggagagactagctcttaaaattaatataatagaacaaaataaattattaggacagtaaatttataagtatttaaaaattcaaaattagtgtcattattattactgatcaataaaaatatatataaaagtaaaaaagcaaagagaagggaaaaatgtgtatttaaaaattcatttataccaattatataatttatttcataatttaaaatattccacacaaaaatttattctaaaatccaatagaaaaaacaaaatatttcttttctctgacctcgggtaaaaaaaattaacagccaagctttcttccgattattttagtttttttagaggatgaatcggcagatactattaagtagtagttaattaaacaataagaacttttataaagaaatataatctaatataaataaatcgagttatgcatttgttcactagaatttagtctctttaggacttaatgctattaatattaatctaaacccaaagaacttgtttagagttttttttagtaaaagaattcatcagtaaatttatgttgatatcgagaaacgccctagtaattaaaagattaacatttttagtataaaaaatgtccttacgtacactttacaataatttttgtttactccatatatatgggtgagttttgccctactataaagcatacatagtgaaaaaagaaaatatttacatagtgaataatacaacagagtaatgtgttttctatgtcaatttcacacacagttcgttttatgagctaaattgcaatatatattatatgttatcaattgttggttttggaatgtggctggtactggaagttctccgatgcatcaaaaagagggagggtaggtattattaaaaagtaagaataacagt

SEQ ID NO: 4987 - DNA, 1002 bp, Glycine max
  Soy_ogl_5882 Gm18:2010001..2011002 Cluster 22
ttagatgaaaaggaaagctttttgtcttggagcttcacatatattattgcacacacttaaaataattaaagaaaaattatatttttctacatcaaatttatatgattttttgtgcaacaaaaaaaaaaggcttatcagaaggtttctggtctgattaacccggacaaacttgaacttactttcacccaaaatcaatgtatccatggatatatactaatcttgatctaaagctgaatgaaatatgttaaaaacttaaaataaacctggccaaaataaatttaactattttagcattcttaatttcacccgatgatgctgctatcttacaggcattatcccacgccattgtggttttatttcttccttttttttttctttcccttttttacttgcaaactatataaacctattcctacagacataattccagtggtaagagtttgtatcatgatctaaacttctactgtacaaatcttccgcacgatcgagtttccaacagtttaaaaattttccttgtttcagatttcccaaaatgcgtgtgcccaaaatccatatgggcaatgttattgttcatatttcagaccatataagttttgtgtaagaaattcattttgttaaataatgataatgaatatgcataattgcatatgggcatatggcttttctaattaagtgtctcctattacctggctatacctacattttgtttcattaataaaatctctgcttttttagtgaaaaagttatactatactattatttaagtcagaacaattacggaagttaaaaataagtaacttatctatgcaaacctataacttacggatcgaaatagttagaaacacctactatcattaattgcatacaaagtatatatttaaatttgcaacagatctatcggctgtctacatcttttgttgtttataactcgaataccatatatatttgcatattctaccaaagcgcgcgttattggaaaaattactgtatattatttccaag

SEQ ID NO: 4988 - DNA, 1139 bp, Glycine max
  Soy_ogl_5902 Gm18:22501..2507639 Cluster 22
cccgagaacagtgttgaactttatgcttctgcttaaactttatgtttatctctaggaaattaatcaacaacttgaaacaaggttgagctgatgaaatgcctaatgcctcgggatgaataatgagtaactcgatcattttagtaatttaaataattaatctcaacattgatgaaaaaattacttcttcacattgcacaattataaatatattaaatattaattgttgaaaaattaagaattaaaattatttacttcactctaataaacaattttctgattttttgtgtgtttgtctgcttgttttttttttttttaaattctatttatttttagaaacaaaccatatctatttcttaaaggagattttatatcaaaaacatttattttaaaattatattttcttaacgcaaattaaatacattacaagcaatgcactatctcatgaatgggtagctcctctttgaacttgtcctcatagtttgcaaagctgtaacctccaccttcatttggagattattcattaatcatatatcataatatatacataaacagttggcacatgaaaaggtgagatagatagcctttacattaaaaaattcactaagaggagtatgtagatgggcttggggttttcgaacgccatcccaaatccgaggaaatcatatcatgataagaactaatgatgaagaaatacaagaaaccacaataaagaaaaaaaaaaaaaactcaaattttatgggaattgaatcacaccttctgaatatcttctcttgaaaaaaccatctcttaatttaatttcagaatacatattctggaaatgtataaaagtgatctaaaggataaatggaaaaatgaaaaaataaaaacaattgaatgtaacgtcacatagtatgtgatcaaattttgtgttcaaataacaaatgaacagctccactaaaatgctaattaaactgatgttaactggggtttgagtgaattctcatctgtatacagcaaccacaattctttgaagcatatcctaggtactggtatatgatgctgtcaagacactgtcccaggcttaataagtaaactgtttctatgaccttaaatctgttgtcctagatttagcaccagcatgtgcaatagcgcaaagacca

SEQ ID NO: 4989 - DNA, 1581 bp, Glycine max
  Soy_ogl_2472 Gm08:2731994..2733574 Cluster 22
gtatgatacattgataatataaattattttatatactaagtatgatgtatcatactgtaaatttagatttatgaaatttatattaaattataattttattaaattaaaattacactaattaacgaagaataatttagtattcaatcattaatgtatgacttttttagtaaatcaaatgtaatacaactaataaaaaataaaataaaaatatatattgtcgggcaatggcgaattaagaacgagaaaggaaaatattttctaaacaaataatttcctgaaaaataaaattccttttcgctcaccgtgttatgcttgcattgaatcttttgatggaaaagtttttttttttccttttgtgtttgcgtgtgtgtgtcattcagtattcaactttccttacactgttacagagtgggaaagtaaggtagtgttttatttatttatttattcaatagagtaatattttattattagaagatgaagaaattatcgagagtttccttagcctcgtcctcttccgagcggacacctttgactttgaatttctttacactcaaatttgctacagttcactttataaaataataataaatagagagaaaaacaagaaaattcctaatggataactcataattcactttttcaatactttacagaatttaagtcattattctaatttaaacactcgcatgttggattcactcttagaataatttaaaatctttttttttcaacagaggagtgttaccaataaattttaattaatattaattatgtattgataatataattttttatatatatcgcatttagttggatacgagtggaaggttattttgtatttatgcacatctttagtataaatactctttaaccttttaagttatgtgtctgcgaaactacgttgtgcatttgtattcggtaacttttcagtttatataaatatagatgtatcgaattgcatataaaatatctaaaacgttaattgcaattatcaaaatgttacatatattgaccaccagtatcataagggcagggcaaacaaaacctcctttttttaaaaataaaaaatcaagattataaatattgatcattagtttcacatactatatagaactttcatgaatttataataatatctatattaatcctaaatttttaagataatgttctattatttattttttaaaatctattaaatcagagtggcatgccagattataatagccgaggacgatggacctaataccagtgggatcaaataatctgtgcagtatgtcacctagaagtggaatccaccatgcatttattctttgagtgcaggaggacacatgatttatggaacaaatgctatacgtggtggggtgatcaactagtactacctgcaaatagtcaacaatacttttggcaacttaagaggacctaaccagaaattagcttggtggtttatgtggatgagtctaatttggacaatatggttgaatagaaagcttggtgttggtgcagagcaaaggtacaagagtttaattattcactttatgcgtgggtaaaccatggggcgcaaatgaattatggaacatatga

SEQ ID NO: 4990 - DNA, 1179 bp, Glycine max
  Soy_ogl_5473 Gm17:3316801..3317979 Cluster 22
gtatccaaattgatccttgaaaacaataacacgagggacacttcaatccctcaaaaaagtgaaccgtgcaatcccttgagattaaaaacttagtattagacactctaatccttaatatttgagttaacttttttccatgaatcaatcaggttactaataatttttttaaaagcttaagtcggttcacaatttatttttctatgaattagcttatcgtgattagaaacagagaaaaatgatttaatggtcaaagtttgcggtatttgaaatagacaaaccaaatgttttcattttctagggatcaaagtgtccctatttttttagtgattgatttgaaccttcatatttaattgagtcaatcttttacattgcatcttacatgtcacgggtcttattttatgcctaccatgtttatttagaatgcaatatatatatagtgtaaaaagtcgaaatatataaaagtaacactttttttataggaaaaattaaattaatcatgctgaatgtaggtcactagaaaatataaggagagttcaaattgcgttttacaaactttcgaaaaattatatcttaaaaacgttttaaaaggattggatcatcttagtgatataaaaaaaaaatcttaaaaaccaagttcgcaaacatcaaatgatgtgtatacagttaattttttaggttagttaaaataaataacaagataagggaaatgatattctttaggtttaaatattagaattcagtaaaaataaaaagggtttaaatattagaattaataataaaaaattctaaaaaataatttattaatgacattgatcgaaagtgataaaaaaaataaatcaaaatgtcgttgagagacataatcataatcattcattatcatgaaaaagtttgtttatataaaaactttttaaaaatataaatatattttgacatttcttgaaaaaagaatgtaacttatttacccaatattatcttttgttttactcttgaatggttagtgcatgtcagcatcttttttactaaacgtattgaaaccgtgtaattggaaggaaacctttggctgcctgtagcgaaagaaaacaacattaattcatgagccagacccatactactttgtctaattacgagggaaaaggacaagcgcgggtcgcttgcataggaaacgataacatttttttt

SEQ ID NO: 4991 - DNA, 1400 bp, Glycine max
  Soy_ogl_725 Gm02:47765901..47767300 Cluster 22
aggataaaaagaaatggaaggataacatcagcactcaaaccatcgaaaagatttctaaatattttgtgtttctaatgttcctgctttgttttttgatatagaaaaatactgtatagcctgaaatttttcaacagaatggctttgaaatttttccttcttattgatcctttcgggacagatccccaaacttaatatacgggggcgaaatatttttagtaataagtattaaataaacattgaattataataattaaatatatcatattgctatctaagttatagatgacatttttttatcatcaaatttatctatagtaaaatatgcatcaaattcaattaattatatatatatatataatttaaagagtattctaattaaatactactctttagtttcaaatataaataaaaaaattcattatatcttggtcccaaatataaataaatcttaattatttttaaaatatctttcatttaataagagatttatgtttgacatcaaattctaatgaatattaattttaaaaaaatatattttttagttgacattcatacaatttaataaacataactagttttcttaatatgagtgaaattattattttttgcttatatatatgtgatcgaagaaaatatgtattttatagtaattcttataagcattaattatctcttcatagttcatattatgattcataattaaatgactttttttttgtatttttaatatattgtgataacatattgtagtttaattatagaataattatagaatttaatgttatgatactaatgaataaaataattttatattattattcaattataaattatcatttgaattattttaaaagttaataaatttatgagttgtgattcaatgactaataaaaaatatatattttgcttcccccctccatccgtcttgcttgcctgggctactttaatggtgtgatactgtgattgaacatatctactttgacatgcatggcttatggctagatcttgaggtgaagataaggattgaaaaacacagggaaaaagtgctccgttgtgataacctgttattaaaaaaaaaaaaaaacagtttgttaagtcagtgcctcctactgtcaagaagagatctagaatttttatatttatattagcagaaaaattaaacccatcatttttttttaaccatccaaccatacaacctttatatctccagaaactaaactataggtggtctctaactcttaaggtcggttataagttgtacattactgcagaaaggatgaattagtacgtagtacgagagttgcaaatgtttgaacagtatgctcagctgcaatcatatatggactacatgggttagttacttatttttctcttttcattccaaattaaacattattttg

SEQ ID NO: 4992 - DNA, 1799 bp, Glycine max
  Soy_ogl_757 Gm02:50249617..50251415 Cluster 22
cactctatatcttgggtggatgggatatgagatatcaagccctaattcctcgaagttttcttttatataaatagatagagagataatagagacatggaatttcttacaaaaaatgagcaatagataaaaattaaaaataaacgtgtaacactatataacttctcatattcttattatatatttataaaattacacgaatatgatgtaatattaattatagagaaatgtccaaccatatttaacaagtgttagtgggaatggtaaaacaaaattatccaatgagtgaaaatactcaagtactcaacccatttattttagtggttgagttgcaatgttaagccttacttaatgtcttatgagaaattaaatttctatcaatctattttttactttttttaagcttaattcataaatttacatagtaattttaatataattcacgctggagcatgcatattgaatttagccccattatatgtctcaacttttgtgtttgtcaacacaccaaaatggcaaaatcctatatctcaacttgagtcgattactaattagcctcatatttcaatcttgactcattcaaaaagtatccctcatgcacgagtcttgtagtagtatgtaaacgatacttaatgttatgtggatcacctcttagcctcccttcccattggtaagagtaaaatagagaggaggggaaagaggaatagatggtttcaataatgtgaatttcacaccgtccatactctattttaatttaaatatatattttatttatttttatcttttctattttcatcttctctatcaaacaaagcattagactcctatatataaatcagtgtccctcttttttaggtatgcatgttttctccgacctaactagtcattagtttgtttgctcctcacccttacatcggaatctttaattgcatgtaagcatcacctccgttgcattgcttcaattaagcaacaataatatgttatcgactctcatcgagcctcgatctattagagccacataatattactaggcatgcactagagcaaaacacatcaaaacaaatatataatagcttaaaatagtaagcgtttgtgaaaataaaatctatataaatatatctgttcattaaataaatttagaatgtcatcagttagtggcataaaatacaagtgaaaattcactcacaaaattgtctcctattttatttccctggtgtgatgtggatttgaatgaatggtgtgggggactagggaggggataataacagaagaaggcagagaaagaacgtgcaagattccgcatctatgaagggatcattcttatttcttaagactagaaacactcttttttgtctgctcccagactcagagagaccaagacaatgacagccacatgctctctgcttggaagctgaacgaccccacttttcttaacctgcaattattataagctaaggtacacttcggcttgagaaatccaactttggaattgtgtattcaaactatatatagttgttacattcgaatttaatcatcttattatctggtggatacattgatataatgatatgactttaaatttcatatactgtcaatgcaaaataacactaaaaatattaattacaactttttagttatttgacctattttatttaaacttttattatttcactaaataaaataatttagcctccattaaatgttaaacataagaagctaaaattaaaattttgccatggttgcttgtacaattctaaatacactgttatgacattttccaatagtcatgattattaatagac

SEQ ID NO: 4993 - DNA, 1055 bp, Glycine max
  Soy_ogl_797 Gm03:1727501..1728555 Cluster 22
caaaaggccaactaattcaaaattcccaagctttgtccaattttcagtgtaaggtagcaaaactaatgttcttctttgtcgatgaaatcaacaaattaatgtactgcctgctcgtagtaattaactaattataataaagttgacttgatcatatttcttgaagttggagttttgattgtttaaaaacttcagttcataaaaataagatcttgaagaattttgattgatgaaaagattctcaaagacataccatgtgtttgattaagcatttaaaccacgttcaatggaaaaatacatgcttcaaaaaagcacaaaagttaaagtaataatgtgatgatggtttgctaaaaccgaaggcacgaataaactagtggcacttcttcatggtcaaacacttactactaatctactttcttgattatcagtaaaggtacaacatgtgcatgagttagagattagggagcataacatacatatgcattttgtgtaatgtaatgtgtgaatcatgttgtatagcaactaggtacaacacttgttttatatcagattattagtgtgagatattatgaaattgtctaggttataagtatttgattgcattatgtgtgtgtatgcatgatagagaacagggtgtatgtctagaaattaggcaaaaggtgtttcgttagaaactaagaatgtttcatgtcaccttagaggtttaagacggattatactttagaatcagtcgcggattcgggaaataatcgaaagggggctagatttttttttacttaaattatttaaatatctaattctaacaaataaatatttaataaataataatttttataaaattatttattagttttacacgtaaaattaaaattattttttgtttcaaataataaaagaaagaaatatgtatttataacttgtacacgtctttttcacgttttgaaatattttctagtctcacaggcacaataacaatcaaacacgattcatttaataatgtcacaaaaaaaactcatcaaatataataatacctgaacgtcatcaaaatttataataat

SEQ ID NO: 4994 - DNA, 1030 bp, Glycine max
  Soy_ogl_1713 Gm05:37646701..37647730 Cluster 22
attaagtgttcacacttcacactcggtctcgcatgcacgttctctaaatttaattacttttaataaattacataaaatatatctttagtgtttaaaactatacatcacttttgataaatagaggaattaaatatgcatttaattcctctattttaataacgatgtttattgttgcagaagaaaaacaatgtgtattgtttgattaacggtgtgtggttttctaagaaaaggaagtttagttcaccaataaacaaataaatgctactacataagtaagtttttgatgggcaggggtaaaaatgaaaaggtcaaaggagtttcgacaggggaatggatggaagctggccaaattgaaaaaagaaaaaaaaagaagcaagaggatagcaacttgattgaccaaaggggaagcaaaaaggtttgaatttgacaaaatcagaatcccaagggccaaaacatgagatatgattcctaacctcaaccaattaataggttgtatgggaagggacttgtcgacgggtctagatcaatccattacgaggtaacatccaggtagcttccacattagaacaacgtccttatccacgttcgcccaggatcaccaacccgaactaggtttcacattccttttactgtttctgaatccattttccaatcccctacgtaagaatgttggcgcaaaataaactatgcatattagtagtatataccaaatgcatgcaactttgaataatatatccaatgtactcccttcccacttatatccttccaactcattcacttctctcaagaaaaataattaattatattaaatttattaattatttatgatattattttaaaattatatttctttatcttcatattcacttaattattttttattaatagttggagagaataattaaataaaaatatgtaaaaaataattattattatatctaaattttttttaaaatcttataaaaatagataaataaatttttggggaaaaaatcttataattaaaaatggaaatggtatatatttgacc

SEQ ID NO: 4995 - DNA, 1300 bp, Glycine max
  Soy_ogl_1828 Gm06:7353801..7355100 Cluster 22
ttacccatgaattttcaactccagcaacctttctcaaaacttttctttgattttatggcaagcgttattcagtcaaatactttcagctaggggtgatccggctttggaggaaaataaactccaaatcaatcaaaacttattgatttaatttggtttaagtttacaaaattttatatagttttttcctaacatataaaataatatatatatatttaccataaatttatgataaaaaaatcactataagtatacaaagtcttcatcaaataaataaagtatttttttttcatttgtacgtagaatgaaccttgatatcttaactaattaacagaaaatgcttatgaagaataaaacatattatatatattagcaaaagtaactggattctaaaacaaatataatcacacacatccatagacataagatttaatgaggttggacaaatatatctatattttcaagaatataacaattatttttattatttattatagaaataagattacatcaatttatatagaattaaacttacgatacaaatttacaatattactactgcacagtactgcgggaggcagacttggccctccgctcccctaacatatgtcgtaatccgataatgagtaattcaagtccaaaagataaatgatgttgttttgcttccacatctgtccacctatagaatatgattcatctcaagtgatcggctgcataaatacccaaatcaattgagattgaggttcactaattttgtttagattgaatcataacatgaagaaaaaaaaaatcaaactaataattcagtttctcgacagattaatctagtaaaatcaaatcaataccaacctacatttactttataataatgtttaaataatatattaatattagttatatcaattgtagatggcgaatcatacaagagactctcgttcaaatcataactacaagctctaataatcatcttaaaaagtgtgggatctcccaaatcgtcgccaccacggtaccatatcaaatattttcaacccttttttgggggaataataccactaaaccaaacgattcatgttcatattttgtgttgactatgttgcttctatgtcggctaatgatgttcacgaagaatttgttacacaagattggtccatttggttagtttctacatcttttgctgttttgcatttccatttatgtgtccacacgtagtaaatgatttataattttgtagatttgaaaaatgtttagattattattttaaccactacctagcttgtaaagaaactaaatagaccttatggtc

SEQ ID NO: 4996 - DNA, 1025 bp, Glycine max
  Soy_ogl_3310 Gm10:1940876..1941900 Cluster 22
agacaacttttgtatttccaacaaccatggttcgtttttattaattggtttgattaaaggatatgaagagtgataatcgttcagggttataacttttttgtctttttttaagaaatatatctttacatttggaagtcataaaattaacctttgaaataaagtgattaatgaaataagttttattttttccaacaaaattttcttaatacacatgattaaaaaatcaaactcccatcaacatactaaaaaaaacatattcatttatcaacgtagttaattttttttatatacttattcctctcacattggttaccaaaactatttgtcatagctatttggatcctatgcaacatgtcttcttttgacggcacggaggacctgtctggtactgaaattatgcgtctttttcatgccattcacttccacgacaccacaaagaattgagttgagaaacattattttacttgtctatctgaacccaccatcatgcaaagtcaaatgtgtggagtttggtaagccactattgtagtagtgttttaaacttttagttaattaaaaaaaagacacaatttgttgacgtgtcttcaaaaaatatgaaaataaaatataaagttgatgaaaattttgtatttgttttcaatgtaattaatcaaccatttcatatataatcaattgtttcaagacttttttgaagcgcaaagagtcaggtgattgctgatgctgcaccaagaaatggtcccaatgtccgagatattaaacaatttatagagccttcaaaatgcaagttgcgaatgtttgatttctcttgcaattgtaaactgtttttcattcggataccataatttcaacaaaaaaaaacatgtttattatttttaattataagatgtttataatttttgtagtcaaagtaaaaagaaagaggaaataaaactaaaaactggttgcaatgaaaaaaaatataggaatctaaagagaaaagggctaaccccaagattgatggcctaagcttgtggaataagttgttg

SEQ ID NO: 4997 - DNA, 1100 bp, Glycine max
  Soy_ogl_4860 Gm15:1829301..1830400 Cluster 22
tgcaacatgacaccaaatttgtaaatatttctgcttttctaatttaaattttcaaccgttgaaatggttgattttttttctccgttactattttaaactttatatttaaattaactaatgatataataatattatttaataatttatcacatcaaaaaaagtataacgagaaagtcacataactgtaaatcatgtttttgaatctttcattgattaatgtaaataaataatatattaaaaacttagttttactaaaaaaagactacacgtctatttactggctgttaaacttctgaataatataacaaattattagattgttaatgttatttttgcatcaccctattatttaaatgtagaaattaaaagtgacgataaaaaaattcaaaattttaacaaatcaaaatttagattaaaattaaaagtaaaaaattaaaaaaaaaaaagagatcgaaaacataataattaaaccctaaaaactaacgagtagcagtgcattatattaaatataaagatgaagtagtacattagtatatatgataaggacatagaaattggtagttagaaagaaagtggggaagcatgaagttgatgcccatgcacgattcacaaactgatgatgaccccaatgagtcgtggcacaccaagctcaggcttatgcagaacatcatgatctcaattaattctcatgcatgctctatcgctcttgcgcaccctaatgtaattctaactacttttaggttatataattcgggaaattttggtacaacattttccctttctcgtgtattgttgtacttttttagttatcttctattctccttaatactttgataaaaaaatatatgtttaatatttaatactgtattttgaaaacttaaaaatattgaatacttatttttatttttatcttacatgataaaaaaatagcacgaaaaatattgcttagaattgttatatgccttttcattggaattcttctcttgacaagatttcccgtccaattattctggtctcaattggcatatgatatgatataacttctggagcatgctaactgtcccgttcgcataaattgaatattaaaaccattgaaaatt

SEQ ID NO: 4998 - DNA, 1093 bp, Glycine max
  Soy_ogl_1774 Gm06:3140707..3141799 Cluster 22
gagtgtaactagttaataattatatatatgacctcttaaaaaaagtcatgtattttttcttttaatcgttaccattcaaatatgattcgattaattaacatctttattattactttgtctctatatagagacacaaaaagagagatagaaaaattaacatatataataaatttcaaaattgaaatatttcatttgaattgttcaattatgaatgtttaataagttaattataggttcttttcttcattgaaataatagggaggatcgttatgctcattattaaacatgttgaagagatattaaaaaagaaaaactcgttgaaaagataaaatagaactagaggtcgaatatatcataaaaaagaattagatcaagaataaagtttcgattatatgcatgtcaaacctttctttctcttcaccgagatgtagatcaaaaagaatttattctaatgcaaattaagagattcacaagacatgttatcctattttgatattcagcaccgtaagtattgaattatcttttaaaaagacaaggaaggttaaaatggcagcaagtgtctgttattgaattcatccaacccgaaagtataatatccatgttaataatgtttggtatcaaagtcatggaatgggaaatttgacaatctagaaaacaaattatgtaatgtactttatcaactggtttatgagtgagtatttttctaattttttttatcatatcaatctatcttggtgtgaattttgtttaagcatatactcaagtaaatgtattcgttagatagaaaaaatcatcaaaatttcatgattttttttaaattaatcatcatatcttaactcaaatctccacagtttttagcttgcaaattttgaatgcaatggtctattgtgatatagatgaataactggtttgatgggagtgaatatataaatgaaaatatttcttattgaataaatgttcgattgtgattaaaatactccactcaatataaaaattcagcctgcttaataaaaatgaaaacaatttttttaattagaagaatcaggtaaaaccaaatttagacccaaataagttcaaattttagattcgaagt

SEQ ID NO: 4999 - DNA, 1229 bp, Glycine max
  Soy_ogl_2103 Gm07:567272..568500 Cluster 22
taatgaaaataaaactaatgaattagttggattatcgattgtttttaagaattatgagcaccattcaacattatttataattcattgattcaaatagtttaatgttcattgattgagtataagtcttttaggatgaattctaaactctacaacatttcagtatacataaaaaaactaaactttattttataattttttaagtgaaatgtaatatacatcaaatgaagtgagaaaacatccatctaaaaaatggttaatgaatggatagaatatttttatttattaaactgatcataactagttttttctaaagaaactaattttttattatattaatttttaacaattcacaaatgaattaataattatttaacctatttattgtagtttaattcaaaattatctaattcatccgcttcacactttatttaatattaaatgaccactatatagaatatataatataatatcaacccccctcttaaaagacacacacatatatataatctcatccatcttattaaagtgttttttgtcattcctaggctagcgtattgtttaaggataaaggaagagtaagagatgtgaactagttataatcaaatccaaactttgagatctaaaagcataaaggaggcgaacccacttttgtctgccaatacgaaaggataaaagaagagtgatatgaaatgatcgatgtatcattgtatatttgtactccaccaccgtttgttaacgagagaaaattagaataggaattatgatggagacttaaatatcaatggcattaaactttttgaaaaaagttggttagcttgtgggtatgaatttagataatagtaacaagagtaaagctaatgatacatttttttaatatacttttgtattattatacaaattttatatggaatgataaaaaaaatacgaattttatgtgggttttattaaaattaataagttcgttgttatgagattacattaaatttttttagtaacaaaaaacatatcaactaatctgttattatttcttttcatggaatctataataattatcgcattagtatcaataaattaaatgatagtatataatctcatttttcactaagacacttattcattacactggaaaggttttacattacacacaatgtttttttttatgcctacactaactctttaattatttaaaaaatactattgcactgaaatgttttatatattacactaac

SEQ ID NO: 5000 - DNA, 1036 bp, Glycine max
  Soy_ogl_5901 Gm18:2485401..2486436 Cluster 22
ataaacggattaaagggatgtcttttgcatacatgtttggattttcgttcaattagtgatgtatgtgttcttagacacgttcgatagacaaacatataagacatcgttttgatccctttaggaaatgtcatttaaagtttaactaccgaatactcaaacataccttacgttttgtcaattggatttgcatgtggctgcattttggacaaaaattcaaatatacacacacatggtgagatttagggacaaatttagggggagggggaaggggttgggacaatatggccttggccaccctccctcaagattgtttgtatacatgagaagcaaaataaattaatatcaatagaaaaaatttaataagaaaaatagaatattgatttaatgtttgtttaatagtagattttacttcttttacacataaaattaatattttttttgaaatttttttatttgtcaaataattatttattagaaattaaataattaaacaatggtgtaaaaaagatttggatccccctttgaagtatttcaggatccgaggtgtgagatgtgcactgaaaattctcagaacttgagatggctagataatccacactctactgtattccgtgaagcaaaaagcggaaagtaaatttaaaaaggttcacaaaaaaatgagttttgaaaaaagtagcggccatggacttaaaaaagtcaagaactaacggtgcctctgctttaataaacggatataataacagtttcctttttcactttactttaacaaatccattgtcaaaaacaacgtgcaaccgttgtaggcattttggcctttagcttctgatcccttcgttgctttgtaagttggatttcaacggaaaaagttagataaatttgaattgaagtttgtatgaaagtcatctccgtgcattgtgacagaaaaaaaaaggaagaagaatatatagaggaaaacgttaatggaattatgttagcgttctttatacagaatgacaaatcaattaatttttaaagaaatttagttagaatgtacttc

SEQ ID NO: 5001 - DNA, 1100 bp, Glycine max
  Soy_ogl_6287 Gm18:59867101..59868200 Cluster 22
tagttttaaaaaaaattagtttataaaataaaatttgtaataaaaataatataaaaattcttatatttatattaatgtgagaagttgttgattttattaaaatatattatcagctacacattggtattactttgaattaatgtagtgacacaaaatgtataatgtttttcttcctccaaattactaattttgattatataacaattaatattgaaaaaattcaacttatcctccttttttccaaatcattagttttgctaacatcagggtgtgaaactcgacttttatatagtataaatatatagatacttttatgttagaggtagaatcacatagcagttgttgatctaaccttcgaactctatccctccgagtaagtataatataacgcaaaaattagagatacaatcatatataccacttatgttatcaaaggtttaataaaagatttagagggttagaacacaataatatatactgtgttctatgtatgtgtttagttatagtgagggtgtctagaagaggaagagcaaaaattatagactgaagtgattttaatatcagtgtactattattactggttttttagcatccagtttcctgcattcttttcaaatttacactagtacaatattcttacaatgacagcttttggaaaaatcaaatgctagaaacaaggatctcaacaaaagctaccaatatctcaattaaattaaacatgatcaccccaaaatgcttactgtgactgttttgagtcaaaatactatactttcttaagcatctctgtcttctgtattgtattactgtatcattcccaagggaataatggttttggacaataaggtataatgagcattagtgtttgtgatatctgcttgttccttcaacaaaagagcatgctcaagttgcacctctacttcacccattgttgatctcttatctggtttattcttcacccatctttcaatgatatccataaagacttgccaacacactggtgcaatcttacctttgatgttcgcatcaatattctagtagaaccacaccaaatgagtaaacatcacatttatctgtgacgacatgccccttataatactctg

SEQ ID NO: 5002 - DNA, 1090 bp, Glycine max
  Soy_ogl_6928 Gm20:42273111..42274200 Cluster 22
tattcatcatatcaaatatcaattaaagaaatgacatttatttcaattaagtggttatattttggctcaatatgtttaggtggtatatgcacaatatctgcaaccctaaaatgtggatctagcacacagtcattcaaaatttagggtagataaaacaatacaaagaaaaaagtggtattactttttatgcatggttaattgattatattctgttacatctaattactaagaaaatatagcaacataggattagttttgaagctgtaaccttagatttgctgtagcaatcaaaaactaaattgaccatatatctgcaatgtgattttctgaactttttgtccagtaatataaactggacttctatgaactatttcttattggcatatatggatagggttgaatggttttgggtttctagaatataagttgcattgtggcaaatattttgttaacccaaatcatcttgaatgaattctaatggattacatatatgaaattaaacgcattaaggtctaattgatataagaaaactatccagaaaagcagagaaactaagcatagaagaaactttttctaaaatgggttattttgtcaaatacttattttcaatggtttgtacagaaaacagtgaaaacatcaaaaatcctatttttataaatattttggaaacaggaagcaaaatgaaaataagtttttggtaattatctatgaaaacaagaaatgaaaatagaaaatgtttggaccggactattgataacttaattcaaattcaataacaactgtgaatataagtcactgggaacatttgatgttgcaggtttcagaattctacaatgattatttctcaattttgcagaaccatcacacatttgagaagtctgtaaaaatatacaactaggaaaggtctgtatcatctcaattgatcagaatataataccttatggcagtgacacttgcagtgttatgaaggtgatcacagaagtgtagagtagagatactgtcaatcttctcaagaggaatgtctcaattttatagatttatagcttacgggataagtatatagccttcatctgtcttttttggtggttaa

SEQ ID NO: 5003 - DNA, 1500 bp, Glycine max
  Soy_ogl_1130 Gm04:164001..165500 Cluster 22
tataacttaatatcaaattaattatttaattaactttacaacctaaaaaattataaatataatatcaaattagtctttatacattacttaagataaaaaagtttatgaaaatttagcagttatcgtaacacaattattacactttttatagattaataaactaaatcagaatttgtttctttcatatattaaattatcaccacttaacacttttagggatgaaagccattatttatcctaaatgttttcaatatttttgtttttaactatatatttatagacacaccatacagccagcttctaatccttctatatatttcagtggccttgaaaagtaaaaacctgtgcatgatgtacaaaaccattatcaagaataacattatttctatatctttgtaattgcaaacaaactaaaccaaatgccttttaaagaaaaagaataatctaccgcttaagggaagcagaatccatatgcttcaatgcaactaaaaattaatattcattgaaactagaatcgcataatccaaaaaaaggtcttataatagggtttttattttttattcaagatatttttttaattatttattcaagatacttaaattgtaatagggttgttatactcttaaaatacaagattagttttcattcaagatacttgatttatcctttgtaataattatgaattgagtaaaaaaaagtaataattataaaatgcaaataaaggtattaaaaaaaaagatcttgctaacttgcccaacaattggttaaaaaattaattttttattattaaaaatcatatgaaaatccattttaaatataaagagaagcacatttttttacatttcaataaaaatatttttcttttaatttccttaacaaatgtcacgggaacattaattaatatttgttaaaaaaagatatagtgatgatttaatatgttgtccaattttattagcatgcgaggtattttattagcatggtcaatataactctgtttgaaaataatttgtggtagatttgaaatgatcaaatttcactacagaaaacattttaattatttaagatacaatatatatccagcatgctatacaataattacattgcttgcatccaaagtactctagcatgatttatgaagtactccaacattcatcacaacatattctcatgtctactaaggcaataagtagcagtagaaaaactctttctacattttcatggtcgatcatgggcatggcaatattctaaacacaaattcaatatatatttgatatttcttccgacctgagtacgaggatggcacgcagcatattaaacacacgccaatacataatgtatttgacgggttttcttaccacaaaatatctttgaattttattcacagattaattaagtggcttgatattcaagacacaacagattgtgtggttgagctcagctcacgaaccaccaaatatttatggtccaacattgtattgcacgtgctactgtttattgcct

SEQ ID NO: 5004 - DNA, 1266 bp, Glycine max
  Soy_ogl_668 Gm02:45167335..45168600 Cluster 22
atttctaattggttaacgatataaaaatattttacattactaccatgtatactatgttttctcagcaaaaaatattatttcaaaacataccctacatatatacaacaataattaattgatgatcttttttgttaatatgattgatcgagttggcaagaaatcaaattgctctcaattcacaaattggaaatgtttttaatttatgataagaaaaagacttaaaacatatttttaaactcttaaatttttggagcagtacttttggttttaattaggttttcaattaaaagttacttatgtgagttttttccttttcaacaaagttttttttatatataaatatgatcagaaatcgaactagctatgccaatatctttcataaaagaaatttatttatctacctactatataatatagtagtaccttcttagtatccactttcagacattatgtattaaatctcaactcatagcactgttaactatcacaaattaaattgcatcagctataattttccagtctataattctcatatgcagtatgattggacaaggttaattaagcagtttttgtaataccaaagaggaccattgataacaccctagcatttttttcatgtgctccatggagatgagggtgaagctaacccaatgagaatagaaaacagaagtgagttgatggtgaggggcaacaactaatctttggtcatgatggcctcgccactcacgctaaaaataaggagaaaatcaagccattttctcatactttttgtgatccaacaaatcaaattctttgctcaattactagactttgactggtgtcgttaatttgaattttaaagtacctttgactacccgactttaacgcatgtttccttcagtcagcgaaagttcttcgaccaatattccaatcacttccaaattccaatccaataagtcaataactcgccaaacacgtatttgcattatcgagtagagatgttttcttgactttcccatctcataatgttattccaccgaaatttgaaagctatagcttctagaaagtgggtattgtgatttttttagtgtctctctagttttatttataatttaaggtaatgtacacgtattaaaatatatttatttatattatttcttctggtgtttagtgtaagaccctttcatcaatcaaacagatcgaccaataaaataattaatttcattgattttattgttttttaaaatattactaatgtaccaattttgtcattattaataatcatta

SEQ ID NO: 5005 - DNA, 1014 bp, Glycine max
  Soy_ogl_1183 Gm04:2273587..2274600 Cluster 22
cgcatccttttaaacgtaattttattgttatattgttattgagtgtgaagtatctcattctttaattttaatcatatttttttctcacaagctacaacataactacataagacatatttccttctacaattactttgtcccagctaacaataatttaattctttaaagttaatttaaacttaatttaaagcactaattagattttcccattaattatataatttatcctccttcctaatcagaaagaaatacgaacttcattcatttatatgatctatcccttccaactttatatgtaaaatttaattacttgatatatacttataaaagtataacacttcccctttgataatatttgtgtcgatcgacgaatctaaaggctacttaattgggtaaaaaaatgctttttaaaatttaataagtaaacaataaaaaatagttatatgatgatttcgtatatgcatattgatcttgtacaaagatgaatctttatagaaatgttaaagtaagaaaaaaagtaacgctaattttttctcccgaggaaaaggtaacaacaccaaacataacaacacatacggttgcataaataatagtatatctataacggtacatggacatagtgataatatgtgtaggatctataatgaattttacaaataaatgtctacacaaggattcttcttaggcacttggaactgagctgtaaagttatgaaagcataaaacaatgatttctaattgtgctttctctttatattttggttgcattgagagatttctttttcaaaactttccaaagcctatatgtggccagatctcgagtcacgattcaccgagactttagaaaaagcatgcctaagttaataaacaaataaaaagtaaaatgtaaaaagtggaagaacctaactcagtaaggaataataatttgcattgataagggaagaaaaaaaaaggtgattcttctttgtactttggacgcacgttaataggttgttgcatgggcatggcattaaaa

SEQ ID NO: 5006 - DNA, 1087 bp, Glycine max
  Soy_ogl_4868 Gm15:2302314..2303400 Cluster 22
tagcaagtatataaatgtgtgaaattgattttctttgaagggcatgatcgattatgccttcggcatatataattgataatgcgttttttttaacagaatataagtgttaaatttaaaaaaaaaaaagtttttgtacccaggtttttttttatataaatgggtaaattttaattctaaaaaaactattttttctacctattaaatcattttaatttaaatattttatttcttctcttctatgttcttttttatttctaccaaacaatatcatttttcactttctttcatgtctttttattcatctttatttttcacactttcattctttttcattcataccaatcaaacacaatattagtccttctaacgcaaagttttgggttattcttactgtggatagggaataattataaccatccaagtagaatcctccaatgcgagttataagttttttaattttcatatattttatgagtatataagtttaatcctaacttcacttatcttgcttggtagacaatctctttaggaatatattgtgaatatgtgatgacacttagagaatgggacatcatgtatcttgattgagattgatttcattcatccagtgttcatgccgtggatgctaaaacttgttactttacctttaattaattttcagagtaactaataatcacaattatcttcatatgattcattattttactaataaatagtaatacatgaatcactcataattatacatatttcaccaaataattgctaatatcagctttctattatgtggatcaatttggtcgcctcagagtaattaggtaatcaatcacactaactcaaccaataagccaatgttttcaactaaatactcctggtgtgtattacgatcaaacaaaagaaaacaaaactaattaacgcttctaagtaacgttccttgtcaatttttctcagcaaatttaattgttgaaacactttttttaacattaattttaaaaagaacagcggacacgctagaaaacaaatccgaaccttctatgagcgaactaacttaattgtcttgtagttattattcaaaaactctcccataaaa

SEQ ID NO: 5007 - DNA, 1302 bp, Glycine max
  Soy_ogl_5515 Gm17:4863199..4864500 Cluster 22
gttatattaaaatttgatttgacatttgatttttcatcataagtgtcattacctcatttttcatattcagccatgcttgataatcattggagtaacagtttaatcaagaaaccacctaatacaattatgaggtcctaccattttgggtcacatcatatataatatttgtttagatttttttaaccgaaatggaatagttaatttccttttaaaattacttaattagtatagtttttgaataactaatcaatatgagataaattgtattattagtatgcactaccatcatctctactaacaagtaataaggtggaatataattggtaaataatattattctttaaacacgtggtcataattttaatttttatccgtgtgtatgaaaaatatttgtcgaaaaaaatcaatcttttaaataaatttcagtatgtgaagatttgatccttaacttttaagattgcattaatcctaaaaaaaataaacaaaaacaaaatcatcaatcctaaaaatataagtaaatgttgactataagattccataatcacaaatgtttaatttgtcttaaatttgatatatatatatatatgattcgttgagttaatattaacagttggaaataaaatttaatctgtataaaagattattaaagggaattattttacagaaaattactcttaaaagttataacttgatatctcttgtatatattattttaatttgtaattaaaatgatattttttaagttttccgtacccgggaagagatcatttgcgtatatgtacgcgtatgcagagagtctgaagctagcccgtatcatcttaatatatcctgcatcaaatgaaagaagaagaaaaaacatatatatatagttgagagatgaattcataagatgagtctcccattacgaaagctagttagctattaagtaagtacatacatatgtgcctcatctcatattacaggaagagagcaaaatgcagccaaagattacttgccgggttaactcaattttcacgatcaaagcatttagcctcatcatcacatggaatatgactccggcaagtcatccttggcttcattccatcctcaacctaaccctcagctagttaacaaaaaaaacatgcagcattatttgatgtactgcgggagcttaattagtttgcttctagttgctgtattaggtgattgttatatagagttagaacagtagaaatacaattatattactatttcgtatgaattcttagccaggacaattaataatcattcaaattgtaggtgactactgactaggtggcatct

SEQ ID NO: 5008 - DNA, 1000 bp, Glycine max
  Soy_ogl_1528 Gm05:1830801..1831800 Cluster 22
attttaaataacgaaaaatagacaaattattatattaaaatataaaattttaataaatatttttttcagcagaatatttttaattttagttgtttaaaaatgattttcaggaatgatgttatattgtttaaaagatatatttaaagaacaaacaaaaaaaaaatatagcacttatcccaattaagtcataccacacagccacacactcaaattccatgggcattagaacttcacaatatacgtttctttcatatggccaatcattatcaaccaattttggtgtcggacgacacaaaattagaaattgtaaacagaaaagagtaatgcataagcaacagacaaaggaggaaagattaacgtgcagaagccagatgctgatggctgagtgaaattggatgtgtaatattttccaattccatagccagactatctagcttaaagtctatatataagtattccaataaagccggagtacaagattaaatgatcgagaaagtataagattagggttaatagtatatggtgaatcatatacgtgtgtctgcaggaagcatgtagttattgacttattgatttcaagaacatggtttggtttaaatctttcgcttattaattattctagggcattctgatcattttaggaactcattcaaaccatacaatctaaagccaaaattaatacagtacaaatatatacaatcaacccatacatcctcaccattatgccttcatctaacggttagtgttgcttgaggctgctaagtcattcaattgtgttggactagattgccttttgttgatttgtttggggtttagtagccagggaataatcagatttgaaaggaaaaaaaataaaagtctttcagattagcttttgctatgtacacctatctattttttaaatacacttctttttttctcattttcatacgtcaatttacttaaatattctttccctttcaaacatttccctctctctcccacactcctcatttcatag

SEQ ID NO: 5009 - DNA, 1448 bp, Glycine max
  Soy_ogl_1786 Gm06:3475901..3477348 Cluster 22
cgtcaaaagcttgaaatgtatgcatttgcaccctctctctatatatttaatcccttgattgtgcgtttattatttttgggtatagatttagtgttagcaaaatattttgtatttaactaatgaaccagtactctagctagccgctttgattatagctagccaattcatgagaagtaatatatgatcaagttaattaactaacatttatgtgtcatggtgaaaaattaaacaagtggtagagagagatggatgttataggaatcgtgcatgcaatgcaatgcagcgaactggatcgatccaggaattaaaattgttacccagaggttggaggaataatttattgatgagaaactaccagggagaaaggtccatgcattcccataataccgaactttgtgaaatgtcatggctaagtttgtgtccccgtgagtggggcttagttccacttaactacaaaacttaattatgaaagtcttccccctctgcgcaaaacgtactgcgctctgctcatgctatgtaatgttgctatccctcttcgtctctttcccagctcttactgtaaaaacgatattatcaacatccacatgcattttgttcccagcccgcaagcagtgcaaagaaaacgataaattcaaagtatgcctttttatttcaattttttttcgacacagctagctaagatggttgggtacccattgatgttatgttatatgataagctttttccgcagttaatgacaataaagtctttctgcaatgtttaacgtgccctcacttttctttgttcttttttcaaatacacagctggaaactaaatacgtctaaaatggagacatatcataatcatacatatgtgcaaaattaaatggttttacattcagctagcctcccaaccacaatagatagtgcatgccaactcaagtcttaccatttgaaaaaaagaaacgcgaaaactaaatctttctagctttttctaactagacgtggattcatcaataaccaaatacttgttagcagactgaagttcatcacttcataacagtgatgaatccagaattattatttagtggaagcaaaatataatctaatattttttcagacaaaagatattataaagtctattaaaagagtattggaaaaatttaaaataagaaaaaattataggataaattgaataaaattaatatcaatttattttttccggtgtctttttcaattttttacatttatctttttaaaataattttctaatggaaataacacctattttttatatggataaaaaatatttatttgatatattaagtaaaaaaatttacttagaggggacaattgtcccattactttctacatagatctgtccatgcttcataagaggagtcttcaaatcaaagtggacccgtgagagtgagagtatttttttaaaaggcagggagagtgaagaaacaa

SEQ ID NO: 5010 - DNA, 1084 bp, Glycine max
  Soy_ogl_2259 Gm07:7845517..7846600 Cluster 22
cgattgaattaaggtgtttgtttgtatcactaactacatctgtttaatattataagaataagtaaaaattagaatgataaagtgatcaattagtatcaacttattctcttttttatatcttaattataactttttaccttcatctaaaaaccttttactaaagtgtctacggcaacaacacttattttttattggggaaaaatctttttttatcatatatgtataagtaaaaaaatgtatcttgtgtgggtaattgctcccatagtgttgaacttgcacccccgcaagcacaaccttaatttatctgtttgaacatattatgctgtcatggagtaggaacgttaatgtatgtgttgacattgttgtctttgtaaaaaagcctttttaagccgagatcgcaagttaattgacccttctacggtgtataacactttccacttctcgaacaatgatccatcatcccacttgttgttacttgcacatgtgcttaagtcgacggtagcagattttccttgctgcagatggcatggaagttaaaaagtgacagtgaaataaaccaacattgtttcccatcttttactgtatttctttaaattgtgattgtgatgggttgtagtgagtcaaaaaaacctttgtattatgggcaattgcgagaaaatgcagctgcaatttaaaactatatgttatatagatgcagcacagaacaactcaacaaattggaatggatcggttcagttgagggtggccacttgaagaaggtacgtattatacatacgggaatgaaagtgcatgtgcagttactgaaagaataatgggtgattaggttttacctagtgagcatggttgggatgttcacatgccaaaattataaatacacacattacagaatcattttttcattctcgttgcaaggaaagcgttattcttccgcagattaattttatcatgtatgtagcatctaattctctttcatatttttcaaacctcttttctctatctagggccgttgcctttgattcttgattcttttacttgttctattctgttatatctagtgtgcattggaggtgttagtttgctctct

SEQ ID NO: 5011 - DNA, 1032 bp, Glycine max
  Soy_ogl_2471 Gm08:2658233..2659264 Cluster 22
gttttttttttctaaaagagaagaattaaatatttttattttaatgtggaaatcaaaatcatgaatcgaagaaaataggagaaaaaaaatatttttaattattagcaggtaatgagatttttctagcgatggcaatcagacttgggtgatatcactacttgaatttgagacaaatatttacatacaacattttttagaataaacctactaatgcttaatatttcatttcaaatgtcttattgattagatgacacctggatttgaataggggaaaaaggatttgcagtcccccgccttaccactcgatcatgctaccaaataaatatagagatataaatatatgtagtatatgagaatatccctttttcctactgaaaaaaaaaatatcgagacaatttgcaacggttaactattaatttatgaattattctttaagatttgaaagcccttttctttttctatttttctatttcggatccaaaccattttgctgtaaatgaagacagatttttgtatatattaattgatatctatattgatatgcacttttgtgagatcaacacatattatgtttgttattgacaaatcgattgaaaacgtgttcactaaaaaaaaaagtttttgtaattggtacatgttttattaaaccgctcataagaatcatatttagacttttaactggagaatatctaacaagagcttccattgaatgaataatagatccagatcttaaaaataacaatgcttttgaataagcatgagtaatcaaatgaaataaagtggttcgataagatcggagctaacatcacataattgagacagtagaaaataagccaaatttttcttaatatcttgttgaacaatagctaaggtagctcctaatactaccattattatacctataaaagctatttcgttcgttacctagttttttacaaaacttatatgcctgcacctaaaagttatatactcctaataagagataagatgattagagaaagaggtggaaaaatgtgaaaatgatgtaacatg

SEQ ID NO: 5012 - DNA, 1217 bp, Glycine max
  Soy_ogl_3603 Gm10:47340801..47342017 Cluster 22
aaatttaatttaatagtatcccatcgaccaacgatttctgcattctgcacatttaattcagcatgaaggagaagctgctgcaagctagcaaagcaggccaaccatattaatttttaaccttgctagctattaattctttccatcattgatccttgcagcaggtacgtacgattgatgcattcttttatttctatgcatgatatgtttattatctatcttgcactcccttaaaaggtgtgagtgaaataagtagaggaattaaggaaagagatatacagaaagataaaggaaaaagagagaatatggaagatgctaattaaatacaaatacaattgatgagtgtaacgaaaaagaatgtttcagaaaattaaaactgtttttcttttcctttctcctctagttagtgccataaaatattacgcgcgaaactttcttcttccacgagtaattaatacagctaactactaagattggagccggggctgcatgcccttcgttaatcatgatgaccatcgtcaagttgatttgttttggtggctgtggtacaatgaaaatctgatatcattgcaaattgtgcagagatataaaaggggtcgaatcgaacacgtacctagcttgtggtgcaaatagcccgtacccctataacactgatcatgaaaatcaatagtgtatatatatagcagaggcgctgttcccttaaattaaggacgacctcacctcagtatcccaacaagatacaatgacatggaacgtattgaaacttacacaaagtatattacattcattatatttcatccagtaaacttatatttcttttactatatttgggattatgaaatataattaaaaactaactgttcactaatatatataaagatatatatatatattaatctcataattattctcatgcatcctttttatgagctaatcatatttgagaaaatgttggagaataatattatactaaatgtaaatatatatttctttcgatcaaaattcaaattttagtttattaggttgtaagagattaatttcttctattatataatcattattcaatcaacgtagatttatgatctttcggaagtactcaatgtaatattcacataactctgaattatatgatacagaaagaaatgggtaaggttaaaattgatctggttaagtatattttgcaaaataatgatctcattagccatttagactcgactttt

SEQ ID NO: 5013 - DNA, 1300 bp, Glycine max
  Soy_ogl_3608 Gm10:47590701..47592000 Cluster 22
ataaattacgaaattacttttacataattaaatatatattcattaatttcaaatagaaataattttaaaatagtatttgtttatacataaaattaaaccacaaaataaaatatttcatgtagatagcttaaatcattcaaaacataatataattcatataaccatgagtcaagcaacaagaaatggaaacattgacataaaacttcatataagttttgatgctgtcatttcaatatatacatatatgtgtgtgtgataatactggacaaagatcttgccaaatttcttccaaagattttcccctcttctaatgtattacctgtaccatccaaacgacaaatcaaagtatatttgatactctcatgtgcataattttgggtactgctagtacctaaaaaaagagtacgtagggacttggccttagcccttaattataccataacttttactaacttattcgctgacaaaggttcatcaatgaatatatgattaatgattttctccaatgtgtttgacaatacaaaaacagattagtggtgaaggtccatgcttttttgctcagagggtacataagtacgtagcagaaattcacttctctcctgtttattttttggttgtttctgtgttgtgttatttatgtagttgtattaatatttaattttgttaatatttaactttataatttaattttaaaactgtgtaatttttaaggagtaatacaaaaacaattaaaaaaaaaataggagagaaatcatatccgtacttaactaacacttttggaatgcaggtttgcatggttgtctcgtgagtcacgccccagacatcatgcgtattgcacctttaccgaagtggttcctacttagggaatagttttttggttggatcgttgaaagattgtgggtggtagctaggtggggtttgatcattgcgtctccttttttgttagctctaaatctttatttccttggtcaaataattgtctgtattatttcaatttttatctgcattaatttatcaagttcttgatttttgtatttccaaaaccatcaaaatggttcctagtttgaacaatatatatattttccttcttaatcgagtctatattagatatcctagagtatctgttttgaagctcactgccaacgttttgtcgatcattaatgttcttttcaaagaaacaagtatgtactagcaatgtttttagattgaacttaaaatatgctatgtataaaactatttgggataatttattttagtttatgtagaccagtatttatggtaagaagcacatctacaaagc

SEQ ID NO: 5014 - DNA, 1229 bp, Glycine max
  Soy_ogl_3616 Gm10:48116901..48118129 Cluster 22
tggattgtataatggcacataaaacatcggagatttattaataatttttttaaccacaacatatttggaaattttatttggttcctagctaatctactcccaactgagtcggtttattttgagagtaaagtgactcaatttttaagtcaatcccaaccgtagttttttttccccccacagaatcataatttttatttaagagacacaaattaatattggactactcttgccaaatgacttttgatagtaattaataatttggaaacaaagtaacacaggtcgatcctaagtctacatgctgcatagtaatagttccctcatttgtttgaaaagaaaattaaaattacagaacagttcaaactttcatatttctgacaggtgcttatgtggaaatttttagaaaatgagtatgattatgatgatataagataataaaatatgtaaatattgatagttaagctattcaatgaagatgcataaataattttataatatattttgaacaaatatagtatggtacgtgaataagtatagtaacataatcgatttatccatttggaaaaatgggtcgaatatagggttgggcctgttaagaaaacggtgttgaatgtttgttccggctgtgatccgacccggtcagaatgtaacaacacttattcatgacccgacccgaatgtagcattatcgatttatatacgactcgtatataatttagatacccattattatttggtaaagttttgtccgtaaaggtggaaaaaataatatgctgacttatgcgataaaacaacgtaaaaaacagaggagattacaatcattctagcaaatgtggctgagacgagacaagttatatttagatgtgatattttaaaagtgaataaaaaaataactatttaattaacaaagtaaaattactttttttatatggaggggttaacttaagcccctaaacattctctctaatacgtcaagaggaagaaatggacattaagtcctgcaacaaataagttataatttgtgaattttaagctcgcaatattttgttaaataaaatagttataatttaacacacaaaaatatttttttctttaaagacaatgcatagagtaaattatactcttcattattaaaatacaaaatttagtcatctatttaacttaactcattccataagagatgaatgtatgcattgcaatattccaacccaactaaatagtggttgaattaag

SEQ ID NO: 5015 - DNA, 1100 bp, Glycine max
  Soy_ogl_3711 Gm11:3895901..3897000 Cluster 22
gaaattaaattttgtgcagttgaaaaatcaactggatccaaatcggtctccctaatttacaaattttgccgttgggtcacgaataggtgcttttctcatgagactttctttgggggtttgatttcatgggggttgaacttaggggttatcactcaaatacgggccaagcccaagtcaaaatagacattaggatatagaacaattactaagggcatctctactcgcacttccaaattgctattaaaacccctcagcttttaagaaaaatattttttaacaaagacactcctgatatttgacacttctaaaaaaacattggaaatgtatttcttggtgtatattttactaagtttaattaaaaatacataataaaaactaaaaacttgtttaattaacaaagatactgccttgcacgaccacaaacatacttttcattttcatactccccttccgatttacagtttacttttttttttttactaaattttcattttggcggttcagatctcctccactcctctttctgtttgctcttgtttttttagtggaatttctatttcccgtgactatatgtagttttagtttttttttaggtagattatttgagtttctttattatctagtcagatatataaatactggctaacttttactctaatatagaactaaaaaagtctaaaatttaactcaagctcttaactctttttagtaggttctatttgtttttttctgcacaaaaatcctcattttaactgaatttttcttctagtttctgaataatcttggtgaaatttatttatataagcgacttatataagcttcaaaaaaattcatttactcttaaaagtattatttgcaagttgcttaattttagataagtctattacattcttatctcggtagtttttttaaaaggattttggatcctctcctttctacttttaaaagaagaggtcctgataaatcccaacaatttattatgtaaagaggtgctttactacacaatttgttgcatcgacggaaatttagaaacttcgattgagttgtgacatctttttggcttcaaaacgtgttacaatactcaagtttcatattactaa

SEQ ID NO: 5016 - DNA, 1400 bp, Glycine max
  Soy_ogl_4555 Gm13:38610901..38612300 Cluster 22
gtatttgagtattagtttatatatcgacatattattgtgtttgttgctaacgtacgacgtttctaatgcatattgtcggccattctgctcaacctgtttggacccctctctgaatcaacctgtttgtaaggagaagaaaatatccgtagctctctaaatggttttacatatgtgattcatggtcttaatttgctcacttccaatgcattatacgtggaatctatgctctgctgccaggatacgtgggagcctattcttcatatgttttaattagttaggcagcaacgcaatagggatccaaaagttgtaatgccaagcccaaattgcgtattggttttaagtgtgccaataaagtgacgtgtagttggtcatttggaaattttgtgttcaatgtgtattgcaaggacaagttattgtctggtccgagatcattacggtcaataaatgtatgacacatgtgtttcggataaaaaaaaaattaggttagcattcttatcttttgtaagtttgcagggtgtcacaaggagtttataattttgttttcttggggttgtgcttgttgtaagtaggctctaggttagcattcttatcttttgtacgtttgaactaagttgacattcctttctctttaacttaaagcaagaaataaagacagatgctagagaaagagcattacaccagttcacaacaaattaataacacaacaatagaacagacacatacacttagtcatttggctactcatacagtaaccgtgaaaaaccttgctatagtcttagacatttatacattcttttttataattcctttcggattgacacttgtttagcatcgatctaaaaaaacacaatgaatctaagtagaacaatgttgtgtaacagaaacaaatttgaccatatatagcatttgagtatgaggatattatataagttttgtatgagtgttgtaaatctgatattgtgtttaatttttatggataaaaaaatataagttttgtgtttaatgtttatgctaatttaatatttattattatttattttatctaatttcaacgaaaggttataagttctatttcaaaagttaaaatattacatatgcattttctaatttaatgattaacatgcagtaaagaaaattattatatagttaaattgtggaacatgaattgtgagtgtatagattcgatcctccatgatgttctctatctttttaaaggtaaaacaccattttaattcttagaagtgtaaagtgagtcacattaatcatattaaataattcagtgacacaagttcaaataacacaaaacaaatatttttggtagaattacatattttaattttggcgaatattttttacataaattaataatgcataaaaaatcaattaaagattaatacgac

SEQ ID NO: 5017 - DNA, 1117 bp, Glycine max
  Soy_ogl_6765 Gm20:35117984..35119100 Cluster 22
taccctgcatgcactatatagttctaacattttcttattattatttattcattttctatccgtaaataaacattaaaaaggatacaccacattttaatccataataatttaattttaaatacttttgtcctctagctttcttctatttgtgttatttgtttgtcatccacattaaaatggatgttagcacagctagcctttcttgagtttcttcggcagtttctgaagctgttgtggtccatagagtatggataaaatcaaccgttttgttataaagttttttgcaggaactatataaaccccttaaagggaatctcttttattcgctatccaacaaacagcacccggtagctttattaaagttcatcacatatgatgatttgataatattcctttttattctttcgaggtcgagactaatttatactttgctcaagagcctatatgttaatcttgaaggattttacgaagtgcattgatatgtttgatactggttgtgttcaggtttgaaaacaggtaaggctggaccaatagagaatatgctgctaaggtgctattgctgttaggatctttgagacacgtcacatgtaaaataaaattaggaaaacaatacttcgacatccaaaatgtttattgatacctagtgagaaagaaataaaagagaacaaaatagaggtattatagattccataatgtgataagaaaagattaagagataaaaaaaatgatgtgttaaataatgtttgaaaaaattagatattcatgttctaaaaattatagtatcattatgttacatgtataacacttgtgcttttttttcaccaaatataatacttatggtactcaataaagaacagcctcatgtttgacattagaacttagaagtactttattcttaaaaaatgctattttatacacacagtaaacagggcaccggatcgaaaagggagcagtgtaaattaagtattgctaccactgtaatcatctaaaatacaaaaaaaaaaaaagaccttatgctatagaaaaatagagagagattaggtttataccaatttccggtacaaaaagtattgtttaaatttttattttttattataaatattaagttagtaatact

SEQ ID NO: 5018 - DNA, 1300 bp, Glycine max
  Soy_ogl_73 Gm01:3149101..3150400 Cluster 22
tatttgtagaactttgcatggctaatggatttatttcatctaatgaaatattagatgttggaaatgctggtgcctggtggtgtgtggaatgaattatattggagatcattttttcaagatattgagactcacacgtttggcaaaattacacgtttcaaaatgcatgatcttattcatgatcttgcacaatttgttgtgaaggagagggttgttgttgcatttcgaatgacaatggtgtaactattttgcctgaaaaaaaaatccaccatctctcaaattataagtggaattgtcatgggacaggaatgaagagtgagaattacaagaacatgttgaggagatttttgaagtgtttcagcctactacctaacaactttaggatttgagtgtgaatggatataaaggtgctcatttcccacaatggatgtcagtcctactctcaattatttaacttatttaaagttgtgagattgcgaaaactgttaacaacttccagcgttggggaaactactttctcaaaaggagctacggataaataacatgattaatgtaaaatacacatacaaagagtgctatgatggtggagtagttttcatgactctagagatctgtcactctgcaatatgtcaaacctagtaaggttatcaagggaggatgggaaaaacatgttcctgcacctttctacacttctaattaatgaatgtcctaaatttttgcaggggaagtattggtgcaagggttgcactctcacaaggaattagtaattgaggggtgtggtaagttcaatatgttggcaggttttcaatgcctaacttgtcttgaggaattcctattccttcctatatgttggtaggttttaatcatttgcaaaccgtatgaatgtgtatccagcctaattagacgaagaggaaattatatagaattttaaaaattaaaagaataaatttgttattgacaccaaattttagaattttaaattttcaaacaagaaaacacaattttacgatttctcctctctttcaccctatagtataaattgcctctagtaatcaaaacttaataatcaccttgtatgtttcaatttaagaatttaaaatattttttctaaaattaaaatttttccattttttgttaaacataatcacttcaattgacgccgttaaggagagggatttcattctatgcaaatttcataattttatcttattttgttgtactgcacaacgggttctattttgaaactgaaaactacattgttcttgtagtcataaatcttgccactttgaaatccaaaatttca

SEQ ID NO: 5019 - DNA, 1200 bp, Glycine max
  Soy_ogl_287 Gm01:52237901..52239100 Cluster 22
attcctcaagcctaatgaagcaaacccaaacaaagttatactaaataagattaaaaataaagttatattaaagaagattaaaaataataataagttatacgaaacagaatataaaattactataaagatatagtttttaaaagaatataaaatttattggtgttaacacataatttattatgtgtcaggttattggtggaattgtcatagtcataatgttacctctggtagcaatagctacaaaatctgcttcatttgtattcacacactcagaattagcccctaaatcagcaggagtatcaagcaaaccaaatgcagtcattctaacatttcttggcagccagtattctctctatggctatgatgttgcagtacatttaactgaagaaaccaaaggtgcagacaagaacggacctattgtcattagaataggaaaattcaacttctttgaatactaaattatgtgattgaattctatgcagttttttgtcattagaataggaatttcctctacctcagtcatttcgcactcctccctcataactaaaaaaaaaaaaaaaagaagcctggcaaaacagagcaaatgtctattgccattacactcttatttaattaaattttatatacattttttaaattactagtttcattaacaaaggggagtgacaatggacacaagggaatggcaacactcattcccattaacagaatatcaaccacaacatatattttatcttttacccctaatcaacaacaggctttgtactctatgttcgattgtttcaaataataataatgaataccagagcacgtttgtagcctttgcaaaatgaaattgaaccaaactggaaaacggttctcccttaatttaactaaactagaatttgcaaaaactgaacagaatcgtttctttcattcagtacactgttaaaaatggtccagtttttaaactcccaattcagtttagttcataatttgatcagcttattgaattccaactcctgccccaagcagaaaccagattaattacttgactaatttgtttaataattagtaccaaaagggtaggaaatttctatacacaagtggactgttgagaacagattttcaactttcaatgtttagagtcagaaaactttcccatgaaaaggtttttgctagaaaaagaaaaaaaaaatgtaaagttaatacaaagaacct

SEQ ID NO: 5020 - DNA, 1200 bp, Glycine max
  Soy_ogl_6954 Gm20:43467401..43468600 Cluster 22
atattgaaatgatatttttcccctcctttgatattttgtttgttataaattctgtctattcattaagcacacaattaattaaagtcttcatatgttaccatcaaacgatttctactttcgattctttaccaattattttcaaccattaattagtaattcatcgagattttaaaattattattttatttacatttttctttggctgtttcttagcctgtgtattgtctgcgaaacgttctttacgactagtctacgactgtaagagaacttggttaactttgagaatattgataattaaatttaaataattgacttccactggtccatttgggatattctttgtggttaattttaaacatgggaaactgtctgatttttgtttgctagctgtggaaacttaatcgtgatgacgagtattatgcttgtggactaaagttaggacacgaattaaagaaaagtttacggggaaatgcttttgattcttgactcaaaacatagaaagttggttcaaacgtgtgttacaagtgtgatggaaattatattttattgttatattattatgttatcagcctaaaatattgattcaattttgagaatttatcttgttggatatggaccgtcatctcgttaaaagaatttaagttcaattttattcgtcccaacaaaatatttgggatgaaaattcattataagcattcatcaatttaattatggagtcggaccacaagaaacatgagcatgcaagttcaagacatgaagagtgacagaaaaaaaatgtaccagtataggaaaaaattactctatagaagttgattggagtgagagagaagaaaaatatgcttataaaaatgtctttttgttcaaaagtttataggagaaaaaaaggaaaatgaagggatttaaattttcttttccccacccttcatctcctttcttacattaggaaattcagaagagatgaaaaatagcttaaaactattatgaatactaaattgttaatattcttttttttttcattaggaaatttagagcagatgaaaaatagtttaaattgttctcaacatagtaaattgttaatatgttgatagagtctaaacaaatgtatcatggattgagcaatcattaatacaaatataccatggactgttcaatccttaattatatagaagttgtgcggatgaatggtggttcagtgtgaca

SEQ ID NO: 5021 - DNA, 1034 bp, Glycine max
  Soy_ogl_1048 Gm03:426127..42616100 Cluster 22
tatacttcttaaaaataataaaaatatttttattttcttaatcaggcatgctataaatacaacggtagtttgcaaaattgaaaaaaaaaattggtaaagacttagagtctgttactaaatcctaaaaaacatctgttaaattattcttgttttttataataaaaaaattattttctttttcttaagtattcctctcacgttagtatttcttccgtcccataataattattcgtaagaaaaaattatcattttaaaatttcaattttctatataatattaattatataatgattattttaaaatacacacgaaagatattttattagtaaatttattcaattttataatagttgttttaaaagacacacaagatatatatatttttaattgattgacaaattaaaacacatgcgtgaaattaaacttaacagatcaacaaatgttagtccaattagtaggtatcaaacccttatttgtaggttcaaaattaaacttaaaataccaacagaaaaaatatttcaatatttcataagaaatgtaagttcaaattcttctaataatgtaagaatctattttataaaagatatgtaagtataaatatttctataagtatttaataagcgttcatcaactacttcaacatttttataaaaaaaaaataaacttaaaagaagaatttctagtttggtacttctattatcaatggacaattcaagaaggcttttgggcatatttttgtcattgtccacgacgctttttgtctaggggaatgcaaagtttggttttgcagttgggcagcaaagcatgacctagttctacattgtgtggctccttgctttatttcgatatgtaactatcttcatgattcatgaaaaaaagaatttaaatattttatttgttcacgttggatttcaaggactcaaacagaaatatatatcacttcactttcaactgactattccattactttctcactcccaaagtcataaaagcttcaccatttggccacacgtaaggcacattttctccaacat

SEQ ID NO: 5022 - DNA, 1049 bp, Glycine max
  Soy_ogl_2466 Gm08:2402452..2403500 Cluster 22
ttaaatgcatgaatctgttctattttaatacttcaaataatgtttaaattttttaaattgtattttttttcttcatatttcatgtatatttccaaatacctctaatgtatgagatatatcattttctaggttttggtaataataaatatgtacattttttttatatagaagctatacaaaacttttaacaagtgttgaaattatttttaatagctattttacataaaattgtaaaattttaccatgcaaaatgttaccagataatgaaatggttgttagttgtccaaattgattagaaatcaataatttagttggaagtttgttagatgaatagatgtacttatagtgtagtttttttttttttttacgtaacttatagtgtagttagttagctgtaatttacttgtgtatataattaatagctcactaacacttctatataagcgatgactctcatgttgtgttatatttagttgaatgaaattattattttctcattctaccactaattttaatgttccccttaaaaattctattgataccacttaacatggtattagaatacttctttaataggctttgtcacactttacaatcatttctttgcaactttatagatttcctataatattgctaccgtacattttctctcttgcacctaaacataaacaagtgctattattgtttttatctctttcactagggagaactatcatttttttatgtctcaagcaacgcgcatgttgctattagcgctcaagttgttgttcaccaatgaaaccttagcaaagcgagacactaaggatttttcttttgtatacgtatatataggatcaatacaacatcttttctttaagttataaatttatagctaacttacatctgcacttgcatataagtgatatatgtctctcaaatattttgcgttataaattactcaataactagttgaatgcaatattcctttcattctaccaccactttggagtgattcctttcatgatttctatctgtttcagtaccatttaatgcaaaatttatttatcttc

SEQ ID NO: 5023 - DNA, 1000 bp, Glycine max
  Soy_ogl_4805 Gm14:47490401..47491400 Cluster 22
acatatctagaaccaaataaccacgaagaaagtcaccatagtgttttcttaccaaaaaaatcgaatgtttaatcaccactaaaatataacctttttcattaaagacattccaattcattaaaaataaacaaaacagaaaaatagaaaaacttgaggattaaatgtctcaaatttaatatttatataacttaatattttgaatgtttagtcaacacattatttggatggatagatcgaaattattaattttataaaatagaaagactaaatgccttaattttaaaataaaaaaatcaaaattgaggattgaaaaaaaaattacattttagccttttttttattattataatacatatgtacttttcattattagaaagttttcctaatttattatgctaaagagattagtgcaatgtaaaaaaaaatatagttcaattaaaccttaaaatgtaaatgtatatttacatttgagttttgaaatatagttagtgcaaaacatatagttaaatttccaaaaataattctaaaatcattacaagcatagatatagttataatttgtttatttgatatccaaaagatcaaaactttaaaaacttgaaaatcagaagctatatattgagagtaacttttgtcttgaacttttttttatatagacaaaatgatttttattataagatagaatagaccaatagcataagatatgctagaacccaaaatataacatttgccttgaaacatgctaatatattagaattacaatttatccttttccacgcgtaactaacgtggcggaataatgcgctgttatgaaaatgttttctatagactataatgtttgttggtaaaagtgacttagaaaaataaaatgttgatggatggctacagatgtttttttaaaaggactttggtacaagggtatgaactaaattgaaagtttatattaaacgcaggatcataaacaaggttttcctctcacgaatgttctaatttaacctaat

SEQ ID NO: 5024 - DNA, 1578 bp, Glycine max
  Soy_ogl_4877 Gm15:2679923..2681500 Cluster 22
ttttattcataaattatcctttaatatatataattattttttatttttttcataaaccttaaaaatgtaactactgtaacttttttttaaaaaaactactactactattttctttaactgccttttctttttattttttaaaaataaagatagaggcacaaagtgcctctttttcatctagtttcctcataagaaataattcttttatgtttctatactgtagatgcttttatacctcatatatgagtaactttattagattttcataacttttttataaatcgaacttggtggtagggaaggtcccgcagaaaatagcttagcgttaaaagatcatagaacaagtaaatataattttcagattgtctcatcaattttattataaaaaaaaattataaagaaacgaaacacgagtaagaaaggaaagtagagatcacttaataaataaaatagctagtaaaggctttgttttttttagttatttgagaatgatctaatttgagttatggagttatagatttactttacagatatatttcaacgaagtatttaagagtattagtatctaatatcaaatatatatagactgatgttttatactcttcactcttcaattcttatatagttataataattttggcgtgtgtatgtgtcacaggtaaaagggtgtgtgtctgtttgttacacatacaaaaagtatatatgcacggtatgatttaggaagaacgacaattttggccaacccctcatttttaattacttctgaactctattatatataactttattttgaagaatatatgtaggttatattcctttacataaagtaacacgttttttccacgcatgaaaagcaaaaccgagtaggataattacaaagtagtgtaactaaagttgacgtaccgactaaaatcgttacattctgaactgtacaggaatcacagagtgaatctaagtatgtaactttaccagcaaaaagttcaccaaaaagaaaggggagaaattatgacaataagtcaataagagccattttcaaatttaaaaggccaaatattgatttcagcggcgaattacggtttggaggattgatatctcttaaatatccatttaaggaaaaaaaatgtaactagctagacctaggaatgaatcgttcaatttttttttccttaaagaatatttgtttgcttttctacttttttttcaagtttatatgtggaactctcttttattcgatggttaactttaatttacccccgtggttccttggctttaacaagttcggccctctctctctctctctctgaattcatcattgtttgtaggttttgatcttgtgtttttctagagtgagtaaaggatatagtactaatgtggtaattgatctgatgatcgctgcagcacatactttgatggctaccaatacagtatagataaccagtccaagattaggaactagctaggtacaagaggctcaaaattattgacatatacataagcaaataattacccttaaaactaggggaacaatacttgcttcttaggctatagcatatagccattaaattcattctattattt

SEQ ID NO: 5025 - DNA, 1018 bp, Glycine max
  Soy_ogl_4883 Gm15:2930083..2931100 Cluster 22
gataaaagttggaaagggagaaaataaagagaaaatgaataaattttacatattattttggttagtttgaaaatagagaaaagtaaaaaatatttttttctatacttatttatttagataaaaaataattataaatccattttacaaataactagtgttaatataaaagaaaagtaacaattaagaaattttataaattttaataaaaaattattttctctttagttttccttgttggggtgaaataaaagttttttaagttggttatcgtgacttcttttctttctttgccttttctaaattgcaaccaaaagattgatttttttttattcttttctctacaaaattaaatacagtgttaagagttttaaaattaatgtttggatagagtgaccttagcaccaaaaacatcctaaattaaaaaatgtagttatactgttataggcatggtgcacggtagttctattcgttgagtaacgtacgtatgcgagttttataaattctttatttcttaagttcaattcctataaatatatacatatatataatattagtggtattatatttattttcaaagcgaagtatttttcctatgattgaatgattcctttcttacagtaatatattctactaaagggtagtcataatataatttggaggaacatgttgtgagcctttaataagatccctgtctaaactaaagctgttaatggaatatacagtactgtattatactcctatattcagtcccacctgaatgtttgtatcaatcaaatgtggctatattccatttatcctcatacggaaggatgataattttcattatgcttataccgaatgtaccctaatcgggtcatataacgtgtcttatgaagtatatgtcattatcaatatcggaaaggaatctaagtcctgatatgtgttttacaagttactttggtccttaaaaatgtgagtgtaatatttaattgggaaaaagaaagcgatatatctcaatataattaactattttaaaagt

SEQ ID NO: 5026 - DNA, 1058 bp, Glycine max
  Soy_ogl_6848 Gm20:38574784..38575841 Cluster 22
ttactttaacatagtaaagagtttaattaattcgaagtcgtatcctttctagactttggtacttgttttaattttttccttttttatatgtaatttaattattcccttttaatttcatttaatacttttatcggtaatttatttcctttttttagtaatatctccaacaaagatataaataatctttgtttaacaagattaatttataataaataatatatttttcaaacattgtaggactcgtacgattaatttgaacactcacttttaataattttaatattagagtgaaattttgtatagaggatttaaatttatgtaaaatataacacccaccaaattaagctgaataactcatttaaacagttatgtattgtagatgtcgtaaattattactaactgaataatttaatgattcaaataagccaagcattttcaaacggctcaatattttataggaataaaaacgatacccttagctaaagaaaaagtaattgatgccattattacggatgatactctttataaaaagcagtcatcaagaagattttgagtatggaaattcaaagatccggggaccattgatgaaataataatttcttaaaattcgaatactccttttattaggaacaatattattatgtttaattgtaaaaatatgatagcctttttttttttcgggaggaaattagatgcatttcttacgattgatatcatactgacaaagaacatacagatcctacaacattttgcatcaattgactaggttgttaatagagcagaccatgctaaccaaccagcccaagtgactttttccatttcaatggaaaaccaaccacactgattgatttgtcattcgcaatgaatcaccctcgaattatgttgctttctcaaaaccaccagctatctgcatatgcagccatcgaggttgtgattcttgagcatataccctggccggttgtgatccaaatggctgagtgccaacttcttttgaaggaaaacattcaatagtagggctcatgctcaacctcaattaattgtctccagtttgttttttt

SEQ ID NO: 5027 - DNA, 1000 bp, Glycine max
  Soy_ogl_294 Gm01:52433401..52434400 Cluster 22
caatatctttctttttttgggatttttttagaaaaatatatttttcaaactaagaggagatatattatgtatggaggggcttataaagtttacaagaccggtcgattttttaaaaactaaaaatggaattcataaaaagttccaaatatatatttaattttcttaaatttcattttttacagccaaatgattaaatataaataattaatatactaaagttaaaattaaagaataatacccaaatgggaggattaagaccataaatttcatttttggcaaaaagacatgctactaaattaatgaatgaaatcatgaaagacatagacagtgtacgtatgctctttatctttctttttttttttcaaaaaaaagaagaagaagaaaacagtgtaatatatgcagcaggatcattggacagacttattaagtataacttgacatcccagcttccaattatttggcgaacttcatgaagacaagctctttgagatgatttttttttattggctaattaatgttaatgtgttaatgggggatttgaatcacgacctttccctcctcatttctccctttactctctcccttcaccaccaacctaataagtccgagatgttttttttttactctctcccttgctaagcttctgctagagttagataatgtgaaggatttttctggaaaagaagtcaacggtgatagagaatgcattatatgtggaaaggatgaagtttcagtcatgttcttgccatgcgcacaccaagttatgtgtgctggttgcggtaacgagtatgggaaaaaaggtaaagctgtttctccatgctgccggtttccaattgaagagagaaatcctatatttggggcaagttcgtagtcttgcatcggtaagctatgaatattttgcaaaataacaatgctctgccgtagattttcttttttattaccttgaaaataagataggtaaattctaacatgtgctttgaaggcactagtcaaagaatta

SEQ ID NO: 5028 - DNA, 1229 bp, Glycine max
  Soy_ogl_2161 Gm07:3379901..3381129 Cluster 22
ggtgtgcatctcatagaaagatcaaattggaaaagaaagacaagtcggtgaaacaagatgaggatttacgtaaaagtattacgaggtatcatcgactcatcgttaatcaaagtaaatactttaaatgaataattgaaaaaaccctctttactcatgcgcatcttctagatcaacatagtgtacaagtgaattctttttagtttaagctatcattacaaatttcactttctttcaagtgttattgttcaattgtaaatggttccagaggtgtatccgttcaaaatatatttaagacgtaaggtaccaatttaacagatgatttataatacgcgtttataaataatgcaccaagttttttttatcagcaaataaaaaaatattataaagaaagagaaaaagggtacacagggatatccaacccttacaaagcttaggacatcaaaatatccctaagaaaagtaaactgtgctatcctctttcctccctatattgaaatataccttcaaatcggttttttgtgggcttaacaaagtattcccatttctacaacttttacccttaaaaacattacaccaatcttatgcaccaattaagtttagttgcaattgtaaacaagactagtgcaattagatggttgcaattgtaaacaagactagtgcaattaagtttggttaggacatgctgctggtcgtgtgctccctacatgttccaaagcttcaaaaacgctcattccgtgagtcttcatcatatatgccacaattactgtcaccctggaaggtgtaacattattagaaccaattcttccaaattcattgtatgaaaagggaaataaccaaaagaacaataaaaataccaagattttgtttacaagttcagatatgcacattaaaaaggtagaaaatgctggcatgtgtttcatgaaaacttacgggaacaaagtataggagataattcataagtcttcaaattcaagctacgtaatagtttgaaacaaacttagcttagcttagtaatagtttgaaatattgtatagcatttcacaaatggaagccagaaaaataataatttgattcaactcatgctatatatggagttttgaacttctttttcactgggaagataggcaataaccttgaagcttacacttttattattctttcaaattttctatccatgaaactggaaagatccacacaaaagcagattccagaaagaataatgaagcagag

SEQ ID NO: 5029 - DNA, 1204 bp, Glycine max
  Soy_ogl_2885 Gm08:44286985..44288188 Cluster 22
gtgcacacttatcatttatcaatatataggaataaaaatgataatacgtatttacattcaatccgaatgtagaaaaaccaaaacctagttagtacttatttaccaactatcatcattaaggttttatcttgatttggacaaaactcgtgtccgttaatgtttttttgttcgttcgatcaatcaaacatggataatttttttcaaacaacaaatattaaaatcaactttaatcaatagacaaatttataaataaatgaattaatattatcacactttagacgtaatttctttaaaaaaacctacattattttacaatcaaaattacagttttatctcattatcctttaatacaaaagcttttactatagaaattactaaaatgaaactctcattctaaatagaaaataaaacacacaacaaaaaagaaaaaaaaacacttaaaatcttctaaattttgaggaaacaaccaagcaagtgtatgaagagaatttctaatgttatttatctctaatgattcatccacatactctagtggagactggagatcgaaatatatagccttattacccaaataggagagataaaacatgaccatgcacattcattcatgaagtaggataagtccattaaaaaactaaaaaaatcgaaaaaaaaacataaagggttgttgatggctaagatgaatgggaaccaattcctattgatagtgtgtatgtcacttgaccatatacattaaaaaatgtttactttaaattaataggaatgcatgaaaggttccctctcccatttccttctagcatacgcctcttttcgggtttttatttttttagttttattttatcaacttaccatatgttccccaatcaattgtccttctttcttataagctaataagctaatgaaaatgaattttggacttttcacgaaagagaaaacaaattgaatctcaagattccatatttctctatcaacgtcaacaccatactttgccttgtcctatatttaatggaacgttgattaaagaattaaatttacttccattttgtatgtagagtaatcatgctgaaatgcatcaacttggatataatggaaagcaaagttaaaagttgtgtgacttaattaatcatcaccattaaggaaaatataaaataatcaaattatgaaattttcatgaatgataagtgtgttatccaagcaatgaata

SEQ ID NO: 5030 - DNA, 1083 bp, Glycine max
  Soy_ogl_2957 Gm09:2901201..2902283 Cluster 22
gatgcctttccatagtattactgtccatcacttggccaaaacaattcaaactcgtctggaatatggagtataagactttttttttccatgccattccttttttggcacctaataatctattaatatgtttatgaaacaacttttatatctgctaaacttgttagaacacttagttttttaaacaagaagaactaatgctaataatgcatcacatatttttaaatatatagtaattgttaagtaaaatttatcaaataataaaaataaatataaaatgtgtcattatttatctcttaatttaaccaagatttttggatactaattaatgacttatatcaaatattgctgccgacaatttttaatctgaaagtgggatgaaatttagtggctctttatccattcttgactttcatccattacctttcatttaatttaatttgtttttaccaaataaagtaccaattgaactcaaaatgacagcaaatatagacgtaaaaaaaatttcaaacgaaaatgatcacttcaaattaaatttactattttcattcaattttttggtaatttgttcaagctcaactaagatctattgtatcagttaactaaaaaataaggataattaatggcgattaattcacaagtttagtgcactttttcataatctggcccgttaaatatgtactatctacagcacaaaatgtagtttcaaaatgagagcaataatcatactgtttttctttgaataaatgaacaatcatacttataattgtataaatttgacggaattatagagtaagatggacctactactcaaaatagttgagggtcagtttgacacagcctcttgcatgaattacacaccggccaaaaaaattatatgataaattcttaactaaccatagaataagaaaaaaatattgtcatatgcactgtaaacatacgtgcatatacatgattttattaatgtgaataaatggttcaaggtttaacaagaacataatatttaatatttcattataaatattgtaaaatattaacaattaaaatgagaccttttttttgttaaaacatccaagtgagacaggg

SEQ ID NO: 5031 - DNA, 1080 bp, Glycine max
  Soy_ogl_1505 Gm04:48963321..48964400 Cluster 22
aatcagtcttttcgctttattttttttcttattcatgtcggaaattatatttcaccagtaagcacctgtgttgaagaaaataagtaatctaattttctaagtaaaagctatacgctcttatgaattaggagtattatggtacttaactcgagcttgttagggggagggggaacgaaatgcgaagagaaactgaagtagaaaaatgtatttgatttttcttggtttattatcatggagggtaatatgtatataaactgtgtgcctgtttaatatttttttaataaaaattagtacaccttagtattactagatagagtactaataacatgttggacttacaataaagcttactcaaaagattattgcatagacctaataaattatcacttgtgaatgaatagttttctggagaaggatttcttaacaagtgaaattttagcggtctaaagagaaattgaaatccgtgttcatttaaaaaacgagagttaacttaattatgtatttttaattattgtgtcaaccagcgcattaacttatatttactattttgatttggatatgattttgtgtaaacattaaacagtgaagctattctatatagttattacattttttctaatttatgcgtaaatagtaaatatgttatatgtgagttgaagacgtcatttcaaaaacaaatagttacagtaaaacttttatgttattaattaaatacaatgaagttaacgcaagatttttaattgtttgtgtgaactaacgttagcttatattatctctttttacttttatgttatagtcatttattttttctccaaacaattgatgtttttgaattttttacattaaaattaaaaatgtttttacatgtatgacacgagtcatttccttttttatcattatacatatttgaatattaagcataaatcaccgcatattgctaaaaccctcaaagctacttgagctttttcatttatgaagatgaatttgccacttgcaaattctcatgcgtaagtaacgttgtgcattcaaatcaacaaaatcatccctaagaatgtccaaaacatgtctgcaagaaatccg

SEQ ID NO: 5032 - DNA, 1400 bp, Glycine max
  Soy_ogl_3958 Gm12:368001..369400 Cluster 22
ggcccaatgattttacttttaaaaaccaaaatttttttctagtctttcacatttgggcccatctgtcatgttctctacaaaatttacaactgcgtgtactcttttactaataaaaagtataataatatttaacaattacaatccaggtttcaggaacttcagaatatttgtcaaaagggtaccacaatgatatttttgttttttgtttgttgcggttaaagttaggataacaaattctttttccaaaaacaaaatgcacgaaagtcggttaaagtcttgtatgtctatagtttttaacaattttggaataatctatttaaattttatgatggaatttctcaagctaattctctcatggatcattaattataatccatttacagcaaccaataacctaatataccttctaaaataatattatttgattatcgatgctcccttgttgagtagtatttttaatatttaataatgtcgtaacaaaagtaatggcgtttttatatgtatacaaaagcaatgacttattgcttttaaaagtataacatattaaaagatcacgacaaacgtcgcaaaaagataaagataaaactaaataatctgaaaatcgatacaagcaacattaagaaatccaaaacggagaagaaaaacaaaatactttcatatttaggagtctgttcatagtcgtatctccatttcaaatttaggttttataaatcaattagtgattacttctgggaaactaaggccaagctagcattcactttttcatcaaaaaggaaaattcacacttacagagtgtgggaaacactttgtaacttttttttttaaaggggatgaaactgtttacaattaacgtttaatttattgtttgctttttatttaattattctaatatttcattttatatatttgtgtttgtgtgaaatacttgtatctctagtttactttattacttttcttctccggtgtctaacataaaaaacacgtgaccgatcttctaataaaatctcacccaaatgatgatatacacaacaattttttttataggcaatgatatacacaacatacccaattgaaaattaaactaatttattttcatatatacagataaaaataaagactattacgcatgtgcatggaattaatttcaaaaggtaaaatggttttatggctaaaaacgagagagagaaaaagtggttgtgaaaaaccagtgtccaaatgcaaaggactggggtttcaaacattgctagccgttgatcaaacatgtgaactctgagaacgggacggaattatttccagttgttgtgacggggaatgaattccgtaataaagtccaccacctgtgacagtgagacgtgcaactgtatatacatagcatcaattatgaccctcgatagtgtgat

SEQ ID NO: 5033 - DNA, 1200 bp, Glycine max
  Soy_ogl_4100 Gm12:35728201..35729400 Cluster 22
tggaaaaaaaaatcaaaaaccaatcaatctaaggtttattggattagatctataatttaaaagttattagcctattagatattggtatcaactatcaattataaaccaacctcttctcctttacaaatggacttcttttgcaattattgttgcttgtccatctttattatcctgaatgcaaaatagtaacgacaacagcgctaagaaacaatgctctgtatgattttcaaggttggaaagtagcaacgaaaacagaatgtagacaagctacataacagagaagtacaacaaaagatgttgaatccaataacgacaaataaatgtgaaattaataacaacgcaaacaccaaatgagtagcttgaactatattttgcacctacgatgttaagtaattgttactgtaatattaatattctgcacctaatgagagacatcttaacaacattatctaagctatttacagtggtatgaaaaagcctcatgttcaaccatctaagcaagcacaaaaggagaacttcaacccatcgaagggctaggagatcttgtaaacacacatggcattggaagccacatggataaaaggaattatcattttcattttcatgctaaaacagaaacatgaataataaatatacaagaccaaagaaattactctaataataatctttggcatcaaatgaagtcaagtaattaagtaataaactcaaaccaaattcatagtagataaaatgaagttagttttacccccacataccccatctcttttgaaagccttggcattaggacaacaggaatggttcaagcagctttgcaaaggaaaaatatgtagttcctaaattaaaattcaataactaaatagatttatcactcaatagttaaaatctataacaatagataaagaaaatatctgatagtggtaatcacttcttgatcgctctttttgcaagacgattattcccttaataaataaaaacaactatacaaatttaaaaaattcttttatttttttccactgttttttttttttgggggaaccttttctttcacttttactcactctcttactaacgggaatatcagcttttggtgtacaaatggatagtgtatattatatatcatctttataatttgtatttttttagaatcttttgtaatctgtctttacaactatattattaagtgatttttttaataaatta

SEQ ID NO: 5034 - DNA, 1000 bp, Glycine max
  Soy_ogl_4532 Gm13:37999501..38000500 Cluster 22
ctataaacttactcatttaacaagcaacttgtattagaatttcatcaagatgggccaggaacttttgctggacatggcccccatagcccaactaaacttcattttcttgaacaagagagattccacatactcttgtcaactttaagccaataggtttcttcaaaaaaaaaaaaaaaaaactttaagccaataggttcaaaagagagacgaaaaatgcaatcagttagttatttgtttggattattatttgcaaattaacaactcttgaaaattagtttggatggtatatatgctactttgctcgaaagaaaatgactaccgctaaaggaaaaggacctacaagaaggtggtggatgcatgtagtggcggcctaaagctagagactgtgacaaggatgttcatcctatcgcatggcttagtttaagttttctttgaaagattgcaagtggataataaaagaatatcaaattttacaaactctattggcgatacttgtggataatgatttaaaaacctgtatgttttacaacaaatatatacatatcacgttttaattatattcaatggttgaaaattaatttatttcactttaaataagatttcaatctttcgtttttgtattaattttttagattagttatatgtacgtatgtattatttttgctttcaaatttgcatcttaattgacatgctcattaaatttttctttctttttttaagttataccgttatatgggttatatgtgatataggcgtatgaatacagaagattgaagaatgaagaaacttgtgacacatgtatggagcctaatttgggctccaagaaatgttgtgagtcaattctcgtgttgaaagagcctccgtgatagcgattatacgtcaaagttaaaacaagaagtcagaagaaactcgttagcttattgcatatatatcattaaactcaagtgatgttttcgcatgccctacaccgcgctgccttaatataacccttccattgaat

SEQ ID NO: 5035 - DNA, 1000 bp, Glycine max
  Soy_ogl_4596 Gm14:898301..899300 Cluster 22
tttaaggaccaaatatttaaaaaaaagtttaaaaatcaaaaattgaaaacctccgtttgaggactaaaaaattaattaatgctagaatatatttgaacttctttttcaaaattcaagttaatgatcaacgaattacaacaattggtccactacaaaactgactacaataattatattgatttatctattttcattttttatataatagaaatataatttattctccccttttccatatatttttaataagatttttgaaagttctatcatattgtgtcccttaggtaggatcatgaggtgatgcttaagaaccagttaagctcttggagataacaaaagaaatcagaaataacttcaacggaaagtttctgcataatacatcaaataatactatgacaggacttaaggttttgttctaaaaggaacttggtgggtctatgcaggccatgggatgtacatacatatacatgcgtgatattaagttcttgacacacatgttgcttgttataaaattccatttaaaaattccgtagatgttattttgactcctcactcctatcccatgtgtttcttgtgctgtgctccttcgattcaggataatgcttaattatttaacctcacgtagcacttacaaaacatatcatatttataacatgtataaattataacatatatcctacttatataattataatttttatattatattgtttttaaatgaaaacatgtttaaatattctatttacataatccctaatttttgtaggattgtagcgtatatttttaacccgcacaacacatggataaatatcaagtttaaattcaatttagctattatgcaaaaacaaaatcaatttaatccttatttgtaattatgtcctcactgattgctacatttatatcatcatttattggaattacaacaaagtccaatgtagtaactaatttagttacaacaaacctaatcatttaaatttgtaaatttttttttgactaaaat

SEQ ID NO: 5036 - DNA, 1100 bp, Glycine max
  Soy_ogl_4616 Gm14:3528201..3529300 Cluster 22
atgcaaagatatcccggatatcttcttgatgatgtgaaagtcaagtgattagtgatgtgttttgttagtggtaattaacaatggttagaagtacaaatagtgttaatactcatacatgaatactaaaaatcaaactatggcagggagtatactaagatttgtgcagtggaagcacgattcacaggacatgagagctagtaataattaactcaaacaattcttaaaaacactcttccttaagaataattcataaaaacacattctcattcaaaatatcattcaaacttgcattaagaataaattttattgaaatatatagaaatcaatttcgtaatggttaaaaagttaggaactaagttcaaatttttaacaactaaaaataatgagacgttaagtaattaactaatataaaagtaaattgttattgaaaaagtatttttatatattttaatcacattaaaatataaaaaagtaatttcaatcacattaatgacatgagagagaaaaaatgatgcattaaatatagcaataattatattaatgataaaattaataataagacaaatattataaagataaaattatttaatctcttttattttgagtgaattagacaaattcgaataaacaaatcacatctattatctatataaatataaattaagagggaactaccactttggtcttgtgggatgctgtgatagtagtccttgaattttttttaaaaaaccaataaatatctgaaattgaattatatcaataaagttagtctctattgttagtcattcattatccaaagagagtcacagaatttgggagtcagacacactagcctacagagtttcggattgacaaaaaaacacaccctactataaaaattgaaattgtcacaaaataaatgggctataaaactaagttgggcaccaccgacacatattcattgtagtatatattttatttttggtaattaatcattccataattttatgtctacaatctccacgcacacaaacacgtgcacacagactgcagcagaattaagttgcgcattactggcactgtcaactttacaacttctctctctatcatcaacgttactc

SEQ ID NO: 5037 - DNA, 1000 bp, Glycine max
  Soy_ogl_4801 Gm14:47227001..47228000 Cluster 22
aattttgtaactcaaacggttcttaacttcaaaattctattcaatcctccacaatgacactaagcagaataacatacagtagtatttatagtacaagactatattagtgataatcaaatttttttcaacctcaaaaaaaaaaagataatcaaatttttccctataattagcactaatttaggatagattgattgttagaaatggaagaatggaagggaaaaaagtttgtatgtttggttggtctactaataaaaattaatactctcttggaactcacatataaataaaataataataatattataccatagacttacatttaagtaaatctaactaattttatcatatttaatattatcattactaaaatattttttatttaattctaattttatttttaatgattcatttttattcataatagcaagttttaatgaaaaatttctaaaataaccttattttttacttgagattaagaaaattaaatgatgtcaactaactttttaattagtaaaaaattagttatttttatttttatataaaaggaataattaacctttattgataaaaataagtaataattaggaatatttattttcctaatttcctgttatttttttttattagttgccaatatagacaattgagtattgcctgttatatatcatggttttgaagattgaactggttgaaccggaaatcagtgaaccgacttggtcaccgatccggaatactcatataaccggcttgcattagaaccaataagaaaccgttaaaccggtcaaaaaccgaccggcctagggtttaaacgtagaaaacccgttttaccagtaccctttgtctttgcaaagctttgttgcagatagagattcaatggaaaaattactgcacaagctttttctctctggtctccctctccttcgttaccagcacatgagctctttttctcgcattctcgtccccactctactctgaatacttaggtcaaaaagcttgttga

SEQ ID NO: 5038 - DNA, 1000 bp, Glycine max
  Soy_ogl_6262 Gm18:58942401..58943400 Cluster 22
ctagaaactaacttatatcaataaaaagttaataactacttacaaaagaataaaaatttactattaaattatttatgtacaatgccacagggtccaatttttttagtgcaataataatagggcccaacttaatcctttgaagtatgaccctttcccctccttcttcatccatcccagtgctagtggggcatcattgactttatttttgcaacctgctataaagttcagcaatttattaatgttatttttactcaaagaattataatatttttatactttattttctcttctcttttattatattatttacttcatatatttttatctcttttattataaaaatattaagttaaaataacatcagtgatcattcacaaataactgaaatcattacaggatataatctttaatcctattagcatatgttgtatcagcatatgtttaattgaaaaagatgcatgaagtattataaataatgcatcatacgttgaattaaataagatgcgttgtaaatcaggtattataaatcttatgatattattttcaattactatggataaacaaaatacaacccttaacccgattagcatctgaaacttcccggagtgtgacccttcaactaccccagtgccccccacgttattggatgaacagcatttcaataaataaaattgtgttacagctacaacaccccaccagccaacaagaaaaagaaaaaaaagacttaaaattttcctcgtgaataaattcatccagcaatttcccccccaaaaaaagatttacaactatttttttagatttctatgatattttgattatttttaaatgatttttttgtcgtattattgacttttgggtttaacttttcaatattaattcaaaggaattcgtaaaatggagacagaatacaacgtgcatgtctaaattgaagcaactaagatttgtcaattcaattgaatttaatttaaatttggggggtatcttatcataagtcctggcg

SEQ ID NO: 5039 - DNA, 1000 bp, Glycine max
  Soy_ogl_6639 Gm19:50064601..50065600 Cluster 22
aaaaaatgaatacaatttaaattcataaaagaatctataagtttagatcattttcttgagtaggttatcctaactggtaatttcgtgaaactaaccatctggcatgaatcatgtacttacgtttgaatataatttttttgcaaaccattcattagaaagtttcaattattcaagtaatatgcgtatgcgtgaccagtggcacccataatttgatgactaccaagccaaccgaccttgatggaaatgcgacaattcattttaagtgtaaacaaatactagttgtttgcttcccatccaagccgttctaatttgacttgatttcgtatgcatcttgctgacttgatttcgtatgcatcttgcatatattccacaccctttcttttcaacttaccctatttctgaccttccatttgcatatatccctttcccaaacgatacgtcaaactttaaccccattttatttttttaaaatattttgttgagttatgacgtgctacattatgatgatactattcacagagtttacagtaccaatccttatgcattaaaaaaaaaagtgtcaatccttatttatttaatcataatcataaataaataaggaatacaatcatacgatattaaaaaatatgaaattttcgaaaataaataaaatcttaataaataatcacacattctatcaaaatacttcttttaatttatccttgtcatttaaaataataacttaatcaaaaaaattcttcaaatggttattcaattattctttttcaattttgaaaggacaacaaagaaaataagtgacccagttcatctggtggaaactttcaaaagagaacaaaatttaaatcttaaatgacaaattaaaatcgaaccatagtataaaaaactaaaatactttattgcacctctaattctgtgtgtgcgtgtgtatggaatttgacaaaacaaaagcaaaattttgtgaacgtcgccgacaattatctctgctatgacctgactccga

SEQ ID NO: 5040 - DNA, 1569 bp, Glycine max
  Soy_ogl_2487 Gm08:3274701..3276269 Cluster 22
gaaatttataagaactgctaaacagctttattattagctcagtacatgaatcgaattcaacatgcatatataatatttttatctacaaatcattaaaaatttatcaaacctactaaataactttattaattagctcagtacatgaaccggacatgcgtaatatttttatctacaaattaattattataagaaaaaaattaagtataatattttagatatttttatattgttttttaattaaaactgaaatttcacttcagtaattgatagtattaatctttattattaaatttattaaggtataattttaattttagttttaatgaaaaactaattaaagatacaacaacaaataaggttttgttattataatttgcatatggtaaaatgtatctttaaaaaaaagattttttttcccgtacattcgtcaggatggattttgcttggtctcataaatgctagttggttttagaacttttttggtattattacttatttttagatattattacttatttttttgtttttgaatatcaaattgattaaaattaagttgcagttgtttatataaataacaattgtttatgaataaaaaatattttcttatcatttaaggaaaataacttaagaatgacttaaaattatcattagaataaaatatatatgagttacttaagtataaggtaatattataagaactattaacataaaataaataacttaaaataagttgtttaagtttcactcattcgagatgttgttgatgagttagtgcacagcaaattacaatcacgacataattaattaattggtgaaactaaactaatttattttatttttattaatttgtaggaataaagagaggtacttaaggagtgatttggctggagtgagaaaattattgttcaagaataaatttttaaaatatataacatgatgtcacatctttttatttctattttaatttaaatatttttaattctttttcttttgcacaattaaacatattctgagtttacattattttatgcatattgtttaatcaactagttagattctttaatctaatataagttatttgcataaatgtatctcaaaataaaaaaatctttttcacatgtacgtcaacatggattttacattgtgtcataaatgctagttgatttgggattttttttttccagaaaattcagatcgaatcactggacggcaatcacagtataattaatggatggaaattcatttataatacaacactctgttcattcaaattttatttatttttagtttcggaataatttcagtgaacaagtggcgctcctctatatgttccttttaaagtaccatgctgtggacttgtggtgtgtattgagttcatagcagccattagtttattccacatttctatataattaattaaaaactaaacgttactatatgtactgatctataaatctctaaatcaataccccagaaacactaaaatactgagccttttatacctatattaaaaatacctcaatttaaagagaaatataaatattaatagatgaggatgtgtgctttgag

SEQ ID NO: 5041 - DNA, 1406 bp, Glycine max
  Soy_ogl_6288 Gm18:60061095..60062500 Cluster 22
gataatttttttaatgagttagatgataacatattaaaaaataatatattttttcttcttttattagattttagcctagaagattttttctagtgtaagattttaatcagagagattcttatataataaatatttaaggaaaagggttataagtaatctattgtctatatcttttataatctttcattgtttatatttatcttttataacttcttctagaattattatttttacctataaatagactatattgaaaagaatatacataattgtgattttgtatatactctttttttctctctactattcttattttattcaacagttttaatattttttatggaaaaaattattaacacaacctctttttaacttattttaagaagtttgtaattaaattttgaatatttatttaataagtgggctaatattgaatagtaataaaaagaacgttgattgcaatcacctaaatggattgatatagaccccgcatttttcttttatagtcactcgttagcaaacttgcgtccattattcctcagtaagccctatacacacttactagatttgttttttttttttactgcaactgtaactttttccccactttagtttcacaaagactcccttataaattataatcaatcacaatcaaagttgtgtaaaaaccactaataatccactaactgtataacaaaaaattgttttgtcatatacctttttctgtccattatattattttctcccacctgctccttaatcatcactcacataaaattcactgtttcactatcttacaactcacaattattagattgagtcattctccaaaaccaaaataaaataaaaccttttgttgttgcagtttgggagtaaaccagagtgaaagtttagttatttttttattactctcgatctttcaatctctcacaaatgacaataataatatatagaaagaaatagacaacttctttattatatatttgttgtataatcaggttcatttaaattgaaaccagtgagtacattatccaattcaattttaattggatacactaattaaaaaaacttaatatgtaaaaatgtaatttgtgtttgtaggttagacataatccgcttacatccctatttcttattatttataaataggaacattattattaatttcatttctatcttaaattatttacaaagagaataacttctatattttattcaatatatcgacaatgcttccatgtttttatattttgtatatatatatatgtatgtctcatgtggttatattgaaattttataaaaaaaatatatatatataggctcagatatttcatcaatacttatcaaacatatagacgtatccaaaaatatagatattgaatacctacttaatacggaaaagtaaa

SEQ ID NO: 5042 - DNA, 1424 bp, Glycine max
  Soy_ogl_4922 Gm15:8622077..8623500 Cluster 22
ataaaatatatttttaataatagcatatgaattatggattcatcttacgaaagaagaaataaaaaaaatattttttaaaatatgttggaggtaggaagaatagtcccaaagatttttaagttgaagcccattgatgcatgtccaagaccaaagaacggggtgtgccatatatatatatatactattttacaaatcccttgatttcttccatgtatggctgaatctgataaattaataggtgtgtgtttggttgaatttgaatatattttaaaagttttattaactttttaaaataaaaaattaattacttttagaaattaatcaattaccaaataaacgcaatgtcttttaccatttggttaaatgatactccaacaagagtgtaacttcattttcttttaaattataaccacatttaatttaagggttcaacttaaacctattacaattattattgactggactgcgtgtgcatgtttacctccaacaagatttagttatagttaattttaaataatacagggaacttgtctgtttcaattaagtcatcttcatcattttttgttagattaaattttaaattactagaatcggtttatgaaataaggttatgccgtttataaagagaagtcattatataaaagaattctagattaaatattattaatctttgattgtaaaataccattgatcttaagacttggaagttaaagaatactatattataatatggattaattctgaacatatgaaagaccttcacctttttgtggatggtcagataagaatcaaatgttttctgctttgtctagtcagattttcattaatggattaattggttttttagcgtttagtctcatgtttcgacaagatattttagtattaataacaattttatttttatgtagaaataaaaaaataaatatggagatataataactcacacttctatttcattactcaattgaactaaattctctcaatcattaaaaagcatctttgcagacaaatcaagacattataattcataccaatattatgatttatgaattcacgacaagatatcagactttactttctgctttcaaacccattcctgatctggcttgcgtggtattggtcaccggaagaagcttattcaaaactttcttgttttaatatttgcatgaaattgtccacatgcttgctcgttttaagtgcattttatttgagaaatttatttatttattttattaaagaaagtctgaagactgaaagtgaacagagaaatatatatcatggcagaacgagaagtttttgagggacgcatccggttaaatttatttcatatatataattgaaactctttttacaagtttagaaagtttggagtccagcacgataaagcagtgtttaatttggattttgtttagttaaaaaaatgg

SEQ ID NO: 5043 - DNA, 1300 bp, Glycine max
  Soy_ogl_5247 Gm16:2160701..2162000 Cluster 22
ttttagtgctaattacttgtagtaatatattacgtggaaaagttaaattataataatatttttaaacatttcaccactaagatccattcatgttgagacgatatatgatgtcactacaatacaatgactacatgtacatcataccaacattgttttcttttcaaaaaaataaaatcatttcccaaacattttggtttcaatcaaacatttgcttctgttgtctattaataatctagaattagtcaaaataatctttttattcaaacgagaaggcctgcaaacttgactcgaaagatatatagagacactaattgacgtataagcaacattttgaggaaaaatcatcatatgcattaccagaagaaaaaataatatagtgaaatatgctttcatttaaaaatgaaaaaaactcaaatttataatataagaattaataataacgttaagttgcggcaggagtgtatatgtaaaattgtaaaactaaaacttcaattaacataaaaatcggtttgagattatttgcagaaaaaaagttaaaatatttattagtattgcatcacttgagatgaaaataactttgttaactccctgtaaattaatttgtaaactcctgtgattttaatcaaaactctatgtaatttaaatattttaattaaatatttaaaaactaatgtggttaaatttttgctaaacattgataatgaccatgtaaatgcgtttagcattaattgtgaggagaccatcgtgaagggttttatacttttattgatttattgtcagatttaacggaccgacactgccatagcaggtaaacggtgctctggcaaacgggatgaatttcaatgcctttaagtaataatttttgaatttcaagaaactaaatccaaattctttattcaattaaatactgtaatattatttattctgtcttccctgatctagggaatcttcaatcttgcattactgatacacggtgctgctgctgcatggggatttataaagaaatttagaaaattgaggataaatgttaaaatgagacaaaatcttatgaaaaataattaaaaatacaaaaacttcgaaaacagttaaaagttgttatataaaaaatctacttcctcccccgggcaaactatggttacacataaaagaaatttaataaatagatgattttttttgcaaaattaaccttaatattaatattacttaaaaaaactaaaataatactaattaggaatattagtaaaaaaataattaatattacattaaaaaattaaatacaacacttattttgaaacaaatt

SEQ ID NO: 5044 - DNA, 1128 bp, Glycine max
  Soy_ogl_4981 Gm15:10957001..10958128 Cluster 22
caccaaaatcttaggaaatcaaatttatgatttttttttaaaagaacaaatttgagaaatgatgataatagtggaccaaaagatcaattaaatctttttttttttaaaaaaaaagtaaagtataaaatatttaaatgaaatgaaatctatacttgtatacctatacctaatcgtataatcatgatgttttgattgttttcctattcattttgcaaggtgacaccatttccattttgcattcatagaactaggtgcaaaacgagtgttacatgcataaaaatattaaattaatccataacatcaagttatacacaaaagaaaaatccaaaacatcaaggccaaattctaaacgacaagaatttgttctctagatccgatgagatacgcagtcatatgtacattgaattatcaaatgtaggcaatgtttctaaaacgcacgaaggatacctcttctaacatctatttgaatagttgttcgttattttgtggtaaactaatctctttcatatcgttatatataatttcttgtaagcacatcttttttttcgacacaccttgtaagctcctctaaatctaaggtgatatataatatctaattcatttgggacttgttaatttatgtggtttcttctttttatctagtaatacaaaggtagaattcacgtaatgttattcatatttttataattcttttaataattgagagagataattaataacaaaacacagaaaaaagataagaaaaaaaagagaaaaatatcaagtagaataaatgatgtaacaaaaagataaaagtattataaaaatagaatattttttttattgaaaaatgtatgagaagtataggttaaaattctgtattgttaatattttgatattattgtataatgtttttagtttcatcatttatacgtaaaatatttagagcgctgttaaatgatgtgaaataatttattacgaataaatggcgaacccaagtatttaaaattcattagttgattgaaaatttaaaataaaaatggaaagtagtttgcaaaaaccacgctaaactaatagtgtaacaaatttagtcgaatttccactcagtctaacttttttcaaaaaatttagcgcggcatgcgatactgg

SEQ ID NO: 5045 - DNA, 1615 bp, Glycine max
  Soy_ogl_1508 Gm05:1245592..1247206 Cluster 22
aaacgtggactatagtatgaattaagaaacttgggctaaaaaagaaaaaggtacaccaaccagcttatatgtcgtcaaaagcaaaaagaagaaaatcgtagaatgcttcttcttgggccacaaaatttgtttctggaccaaatacaatactattataccaatcctaaaaaatatataatcttgcagttctttttttttttttaataaacaaaagttaaaattcaattttggtttttctactttacccaattaataattttaatcttcaattttgtctctatttattttttatattttaattaattaaataactttttttggtaccttaaatgaacatgtcaggactaaggtttaatgggactaaaataaaaaataaaacttatataaaattaaagatttgaccaaaattaatgatttttaaaaaattaaaggactaaatgtctctattttaaaataaaaggacaaaaattactaattgaataaaataaaaggactaaaattatattttaatctaaaagaattaaaaaaatattaaagttgacagtgttagttggagtagaatagagctcgaatccgttaaacaaggtctcaagttcgagttgagtgaaagtaaaaaaattggttgaggaaaaagatgctactaacaatggttaactagattttttgatggatggtgacattgcttcttatacaaaatgggatacttttgcactaataccaaaaaaataagaggtaaaaacaaatttcatatacaaaaatagtgataatagaatggtcatttcaataatagagtgtaaataaagtcatcaattaattttttataaaataatattttttcttaattttaaatcattgatttttttaaaaatattttctaaattcatatctaataccaaattttaataaatctcatagagggatcaattccactaaccattctaattttaaggactaaattggtaattatatacatgaaaagaaagaaaaaaaacactttagacatttaaataaaactaatcaacctaatttaatacatactttctatcatgtgaattatttttttggtataatatatctttgtttgattgaagagtattttcaatttctatagtatgcatatacataaaatacattacactactagaatataagagaaccctgaaatgcatatctattttatatttgaactcaattacttagtataaatgaaatactttaattcaatagttcagaaattaaaaaacccaagtagaaaacaaaatggatactttgatcccttaactcaattttgaatatccctagagtccacttcttccctgtactaggagggaaagagaaaatgaaaaaattaccatcgaagcagccctaacaagacttattatgtccatgtaaattttgtctcctatctctaaaaatatgaaagaattatttaattattattcaaaaaaaattcttctaatattttcttttgtattattcactaaaaagactataataatagtggaattgctgttagtaaaaaaaaaagattatgggctaacaccattgaagaaaaacatgtgaatttagtacaacatgaaatacatacttactttttaaattcttttttttgtca

SEQ ID NO: 5046 - DNA, 1424 bp, Glycine max
  Soy_ogl_3586 Gm10:46666982..46668405 Cluster 22
ttttaatttatatataatgtattataataaattaatctaaatactttttgcattgtggggcagccgaatggcttttataatgcgaatataaaaaattaagtccatagaagcacttttgaaatgggacgtgctctcattactcaactaagaagtgatgttaatactaaaaggatgtcaaaaatttgtaagaaaataattaataactttatgatatttatttaaaaattgttcatttgtcacataaagaatattctcatatacttttatgcaaacgaaataatgacaattttataaaactagctggtacaagtataccaaaaccttaggcctctaagtctaaaataaaataagctttgaaaatgcaataaaatcttcatagataaaatgcataaaatattcctttaaaaaaaaaaaaggacctagcatgtccatgaattagcatagagacatagtgacggagatttggtccgtttggagacgtgtagaatcggcgaactaaagatgatggagtaggtggagattagctactcaaagttgtcaaaattaatatctaggcacacaatattattttattctataaattcatctaaaacagttttacatctattattttattatattaatattgcatcatgacacacacatagtcacggggttgctccgcctccaatatctcttgggattatatatatataattttcgataaaagaaaagtggaaattcagagtaatttatggattaaaaatatttaattaattttttaaaaaattaatatgtgagttttataactactcaatcattgacacttatttaatgtgtttcaattaacttatattatttgaattaatttcaatttttatgaaaatttattttaaggatttttttaaaaaataatcgccattaaactgtacttattctgaaaaaaaaaatcctttttactattgacttttatcttattttttaaagttcttctagaaatatgaaagaatttatcctcttgctgtctctttctcaaactaatattaaacacgcacacaaaattaagccttggtttggttgtgtgaaaaaatttattattcatgaataatttttcaaaaaataatgtgaatttcatatttttttaattttaattcaaatatattttttttcaatttcctttcatttttttctcttacaccaccaaactcacctccaatatctactgttgatcaaaaggagtctatattataatcagaattggataagtagtcttctattttatgtttccttgggtaggtttcttgcagaataagtggtgaaacttctagcttagctggatttaaaagaaactaacgatttcaaacttttcatgaggtgtatattatatagagtagtgatatatgtatgaatcactcataatattatatatctcactaatatatatt

SEQ ID NO: 5047 - DNA, 1334 bp, Glycine max
  Soy_ogl_1460 Gm04:47262667..47264000 Cluster 22
gatagaatctattagtagaagaaaattaatttaatattaactcaaaaatctatttttttattcatttttcttcattaatgttttttttttcacatatacaccagggattttgagttgtctccctttgaatcggtcacttccatggagggagaggatcccttgggagggggaggaaagcgttgtatggctagagggaaagctccaaatgttgatattaaataagaaaaatattaacatgtaatttgtgtgagtggaattagacaatcctccttatgcatcattttaagtttgagtcttataaatgaaaaaatataattaaaaaagagactttacaattaaattttgttaatcatagtattaatacaaagtaatttcatcataagtattactaatttttgttgatgatcatgaacacacataattatgaatattctgtttttaacaataatttatttcatactcaaaatctggaatcttagatcatttaattaaataacaaaagtttctacaatttgtgttaactgttattattattttggatgtattatctactgattatccaaacaaaaagttttgggaagttttacacttgtttatgattgggaggcgtaactttaattaggaagaaagatagtttttttaataaagttaagagaaatatatagtagcatttataaaaataaataaaatattagcatactgcgattatgttgatttattattatttaaaaaaaattaaatttttttcattagaaataaaaattattttccttatttatttaagaaaatttgactctcaaaactgataaaaaaaattaactctggaaactgataaaaataaataagtctcaaacatattttcagagagtgtaactaccctgctttgagataggaaggatatgatacgaattacgagctactatcaatcagtggtttgctaaatcagtttataaaacgaaaaccacgtagaccaggggagtacgacttatgtacacatttaatttaataatgggaattcctttcactcttaagattaatgaataatgatgggtgatccaaataatggaaaaagggagtaaaaaagtttataggaggagccgaataagacaaacattaaattataattaaaatatgaaacccaaaacttaattcaatcaagttttcataacaagatttagaatgatatcaggtagactttagataaggatacaaccggcatgaaacgttgaatatcagtgctaaaaacagtaaggaaaataaattatgtatatttaagtgtttgactgcaaagtactgtgccaaaaccattttgtaagaaatcttttcgtgaagca

SEQ ID NO: 5048 - DNA, 1200 bp, Glycine max
  Soy_ogl_1471 Gm04:47575401..47576600 Cluster 22
cccctcgtcccccttatttccattgctcgtaggattaatggaaggccatctcaagttttcccatataatactactacacaatgtttcacctttttaaaattcgggtcttgctaccagttaaagaatttaaaaatatttcttgtacaaattataaatagtaaaaaaaatcataaataacatcattttacgtatttaaataaaaaaaaatatacttttaggttttcaattaaggatactggttggtattaatgtgtttgttagtaatttcacaagagaattaatgacatttttttttttacaaggagaaggacatattgatctaactaatgaaaagatctatactttcaattctcgcttattccaaatattttaaaaatccattcatttaatatgttttattttcattttctttatactgatttttcatttccatctaaataaaggatgaggtgataaaccggaccgaaggcttttagaaggaagtacctgcaacttagcccaattcataagggcctgagctcggtagtaaatcgaaagtttggaacaataatatcatcatcataaagattttttttatttaaaaaaaatgtaacaaaagaaagtagtaattagcatttatttttcctaaataattggaaatatgaaaaacatgttatcttatttaattttaaaaaatagtatattaattgaaatatctaaataatttatgctatattttcttccgaagaacatccacattcgaaacttatactattagacattggactcattcaaattaacttgagtagtattgctaataggcaataattcttcatttaaattttcaatataattatattttgggacttttttttagtatttttaatttgaaaagaaataaaaagaaactcctaaccatttaataaacttattttaacatcgccttataaataattcttacaaaaattttaatcaaatatatgaataattttatttagtataaattacacttacactcccggaatttcatgagattctataaaactttttttctagcctcatggtaactcttttaattgttcaaatagtattgcacttagaccaattgattcataaaaattacagtattagacaaaacaagaaaaacaatacaggacaaaagcacaagttacataataattttttagcatatacattgtttgatgaataatagaccacaca

SEQ ID NO: 5049 - DNA, 1300 bp, Glycine max
  Soy_ogl_4961 Gm15:9747301..93600 Cluster 22
aaataaaataaaatcttttttctttattattgaggtggaccaaacaagaaggaaattgttcatgtttggtctgataatattcttttggtgttgattctcgtaattctttctagatatttttcaattactatattataagtaaaagaatttactgtttttactgttgagtaatttttgttgaaaattttgactaattatattgtcagtattttcttttagtctcatttttccgtttattatatttacacccaaaatactacttaatgaattcaaactcgtttcaatcggcaagtaatgttagttctttttaaaataaaatgtattgaaaaaaatgataaatatttaaattatttttaaaaatataattgcacaggacataaattttattttcgatatcatattggtttgtcaatatttaaaacagacatcaattaagtcacttgtatgttagaattatatatgagagatggagataaggaaaagaagaatacgtgaatgaaaataagtgaaaaataaaatgaacttacaaatatttaatttgagaaatagaaattgagcaatcttgaatagccggataattaatgaggttgatgagtaggcgtgttcacaggaaatgagagtgattgaataaaaaaagagataaataaattatgagttcattcaatggtactacctgtaaaccaaatataggtatcaagaggtagtacaatgttgtgtaatattgattatgccgtcatttaaaattgactataaataaaattatagtacatttctttaccatttttgcataaaataaatccgagtaagattgatcacctttttttttttatttctatcatattttgtatatacccaacatactcactttttctcattcctcctccatttctttgctatctttttgccaccaaacataacgttagtatttttgcttatgaaatcacaatataattttaaacatcaatttgcattcgaaactaatatctatattatattataaacagccaattttatatttcatgcacacttgagtatcttttaatgtcacactcaacaaatttatttaaatgtagaaataataaagcaaagaaaaatatcataagttaatataagcaaactacaaaagtttttatattaactttaaccccagtgtcttcgcaagcattatttgtaaaatcctttaaaaaattattgcatgtaggaagtcttttttagagttaacttttctacgtgcttgaactataaaaatatttctattcataagcgtgttttttctctttatttttctgtggattcaatt

SEQ ID NO: 5050 - DNA, 1400 bp, Glycine max
  Soy_ogl_2894 Gm08:44713701..44715100 Cluster 22
aataattataactatgactaattttgaaaaaataaatataaaactataattaattttatagttataggtgtttcaaataatttatttttatttaaaaattagttatgattataaaactataactagttttataaaaaatgggtaggtatttcaaataacttatttttgtttacccataattagttatataattggttttagacataatttgttataaaattggttatataattagtctattcataattagttatttatttatattttaaaaacttgttatagtaataatactcacttataatctaattatttattaggtatggttataattatggaaatattcaaaatatgagcaaccctactaaaagttaaggttttatggccaaacaaaagaaaaaaaaaaaaaggaaaccaaggcatatcttgatgtaaacaatgagctgtgttgtcattgcatgtaaatcttttatattttctttaggctaatctttgtttgtatcttttggcagctatattgcacggtgagtgaggtatggatctgattccgccggtatgagcaagttagttttactgtattctatataaatagaatttcagaataataaaataaaaataatgacatgtttaaaattaaaattaaaaaaatattttctaaaagtaaacaaactaatatttccttctaacaaatcaagagcgtgtctcttacactaattttatacattaaaaaaaaaactcgatctgttgaatatcagcccaaagtttatcaaacccaatatttcaaggcaataatctggatcattttgttatgatatattttcttccttcacccatgacattgtaagaagcaactttctcaatgagatggaatggaaaagtgggtaacaaagtgatgagcatgcataggttgagaaatatgaaaagaggcacgcagataccaaatgtttagcaataaaatagcacattgactttatcattatttttttaaaaatctaatggttaaaattaattatttattataattattagatcttaaaaaaacaaaaaaaaactctaaaagagttatttattccctccatgtatatatgaatgcatcccagtgtggaattgcaatggtaatggaccccaatcaatcatgagcgacaacaatttctatttcactcatgcgtatcaaaggaaataaagaatgtcatactttttattttctctcaacaaatgatttggggttgtttatttgcaactacagaactctttggcagtttggcattacatgagactgtgtgctttatttcagtccaccttttctccactcatcaagctcaattcataaacgcacttcaactaatataattgatcctttttttttacttggcacaactaattctataaataccatacctaat

SEQ ID NO: 5051 - DNA, 1200 bp, Glycine max
  Soy_ogl_3307 Gm10:1824801..1826000 Cluster 22
atgttactattaattataaataatcattgttttcataaaatcataatagcccattaaactatttgttatatccatactgatattattttgaacctttttgtcagtatttgttttaagtataatactgataatagtctttttcaaagccgcttattaaaaagcattataaggtaaagtatataatagcttacgttttaaggtatacacatttgaattgatcgcaatcatacaatgtgcaaatccatgtcgatggattctgttagcggatatgagtacttagtcttcacgtgaagatcgacttttaggctagtaattatgacaatggtgattggtgaatctgcatatgtcatcaatctcttcacggttttgattggcccatttgttttcattattattggtttcatattacgctatactggtcgtattacacacactgacaagtacagaatgtgcctcattcaattccagcttattcgtaataaatcagtttatattttttaccaataataaatcagtttatatatatataaagcttcctgcactttctaaaaatcaaacaatactccctttctattttggtaagctcaatcctcaatccacattctgtacttctaaaagaaaaaatattaattttgatttttatgggatgtaaaaagaaacatcctaattaaaaaaattgttaaatgggtaattaagtccgataggatatatatgtgttgtaataatttttttagacttgctctagtaattaattaacaactttggagctaccgtaggaaaaaacaattgaagctaaattacattatttagtaaaaaaaaccataataaagtcgtcattaatcaataaatttatactaagaaattcagaccatccttgatattttatgagtctgagacaaaatgagataaggttccttatatataagtattaaaaaatttgtacatattgcataaaaaataaaaattaataattttattattaaaatgatatatttgttgcattaagtgaataatataattttaacaaactataaaaagatgtatttttcactcattttttttagaagcaaaagttgatattcaatttatattattgtttatcattttgtcttcccataaaaaagtacacacacaaatatctataaataaggatactccctaaaagaaaaagcatatacactcaatatgtatatattattt

SEQ ID NO: 5052 - DNA, 1011 bp, Glycine max
  Soy_ogl_1535 Gm05:1961583..1962593 Cluster 22
ttttagggataatcttattttttatctgagagatcataaaattaaattgttttaactaactttcttaatgtgtgtgaaaatatttatttttacttatatatgatgactccatggggaataaaattaaagacaatgatctgagacattaatgataaaaaaagtaagattaaatgcatgaaaagtgatgaatatgctgtctaacatatcatggttgataattatttctctacacaattttaatgaaaattcatcatctgaataaacgaggattagagacaatgataaaacttaatttatcattccatatatactcaatacaaatgagatattttatttatgagttacttaattttttagtccttctaattttttaaatcccaaattttagtccttcaaaagttttttttttaaaatttaatcctccatttattttccatcaacatttttagtccttcattcatttttattgctcaagatttgtcattgttagtctctcatttttatatattttgaactaattttgagtaataaaaacaaatgagagactaaaaatagacaaaattttgagggactaaaaatgctagcaaaaaaattaatcaaagactataaacttaactaaaaatgctagcataaattttgagggactaaaaattaaaattcaaaaaaattgagaggttgtaaacttaattaatcctttatttatatttacagacataaatctacaactcaaaaaactcgcccaatgtattggccaataaaaaagtcattttatagttcatttttttggttaaattttcacaagcaaacccaacccctctcacaatagttgaaattttttgaactaatttcaacataagtccaacccagcacataaaaatttaggacaatttttttttatatcagtgttagtttttgttaatagagaacttcaaatccaagacttctccctcctcttttcaccaccaaaccaactttatctctttaatctctggacatattaatagactgaaa

SEQ ID NO: 5053 - DNA, 1038 bp, Glycine max
  Soy_ogl_1189 Gm04:2487463..2488500 Cluster 22
attcaggcattaaacttcaagatatttatacattgtttattttaaccattcctctatttctattatttttaacattatacttcaagataatttaacattataccattatatataccattaaatttgattagaaatactttaaaatgtattatttgaaagtaaaaagaaaagaaaataacataattgatctacaaacaaaaaattacaagaatttgaaaactaaaatcataaacacccaaaatatgcttttatcaataaaataaaaatactatataagcatttctttttcactcattttatatttattaattactttaacaaataattttattaaataattataatttaataagttaacttcacaatttttaactatattagccaccaactttcagttgtcaattattttctcagcttttaattaactttttggttattttgtcatacataaccttgatataaaagacaaatatcaaccataggcaaattaaagaaataaaagtaaaaaaaatgtttatatattacaagtataataattatttaacatttacgtttagcaataattaaaactgtttaataaaacgtacttaatgtttgttaaacatgttctcttttttttcgaagcgttgtcgaacatgttcttatagcattgctttaacaagttctttaaacaatatatttaagttgaattacaaatcaaattttactcatggaatacattgaagattatataattgaatttattttatataaataaataattattatatattgctactagaataatttaaatgactaaataataaagataacaatgagaaaatttgaacttttgaaacgtacgtaaattaaataaaaaattattaaaacctaaacaaattatacacgattaaataaaataaattccaattttataattttgttgcataaaataatttgtttataaatcaaatcatttaattccagaagaaaagtgaaaacgtcaggaaccaaatttaataatctccgacaaaaagaaaataagcagaaaagcgtata

SEQ ID NO: 5054 - DNA, 1730 bp, Glycine max
  Soy_ogl_3283 Gm10:698801..700530 Cluster 22
atgatcaagattcactccccttgaacttgtcccaatgtcaccaaaactaagattttggctaatcttttaatagtcctccgaatagtatggatactttatttgatggatctttcaacatcaaacattagcccatcaatcaatagacatctttgaaatttaagactttcacatatgcatgcagctattgagaaagcccattttgagattactgttctacaatcttagtttcactaaaattattaacaaatcaattgataataaactagactactggagtatttactcttaaaaataatataacttccttatttgtcagagaaaaaataaatttctctacatatttttttttatcattaagattgtgtttgatttgacaagacataattaaatgactgatgataaacagtttgattggaacgaataataagagagtcaaattgtaagtgatggcccatagcttgaaatttttatctttccgtttgtagtaaaattgatttttattggattaaaaaatgattttcttcagacaaaaaatatatttttgtgaaaaataaagaaaaattgattttctttcagacaaaaaatattatttttgtgtaaaagtaaagaaaatttgattttctttgcttcttacacacaaaaccaatttaaaggggtttatttgtgagttattttaaacttcttgtataacgtacactgtgattttggttttggttagattgtttatgattattgtttagctatcttttgcatatttaaatgttttaattttgaataagttaaactaattagacacttcattctttttacttttttcattttttaaatatattatatattaattaatgaattgacccgactagaaacaacttgaataaagttggattaatttggattaaatttcttaacaaataccaacaaattaacccaattatccaactagaatcaactagaatcaacttggacaaaatataaccttaatatatttttttattaacacatatttcatgctaaacctaaatcttaaaattttaaattataagtttttaaatgaactatacgtatcttttttatgaataattttaaatatatcatcttttaataattttattttattaaatatttatataatatcacaaaaaaataattatgtatttaataaatagtaattaaaaattgtatcatcgtccaatacttgactagtttttgtagtttaatttctttcaaatttaggttatcacggcactagcttttcttttttttggcaagatcgatcatggtactggctaatatttttatttccaggctcagctctcaactttactttgttatatattcattttcttaattaatggccatatatttcttcaagccagtgatggcttatatggtaatatcaagtaaagacaaattaaagggttttcatggccaacaatgtgaaggaaaatggaagggagatgcctttcctcttgcatgggtacaagggtgcaggtccctttttcattacaatttccaaatgactaactgaagatcttgacaatttgaatccttcatttctgggtgtggtttggttctatgggtaaagtaatggctgttgattgatgccaaaaacacatttttggcactttgagtttgaggttctttatttgtcgtatttggagaaatgtatgatatgtgctacttacgtatattattttttggctaatgattttttttttctcaatgcaacg

SEQ ID NO: 5055 - DNA, 1672 bp, Glycine max
  Soy_ogl_6621 Gm19:49293001..49294672 Cluster 22
ttaaaaggatggattaaataaaagaaactcgtgatatttaaattaattaaaatatatatttaaataaattatttagtacatgcttttttaaatgaaggtcttactgatgggtgttttaaagataatgattaagaaatacaagtaaatatgtcatattaaatgttttaaattattttaaaagtaaatgttagtatatgacttttgcatttctgcagatacaataaatattcatttttgttaaaaaaaggtcatacttttatttcattaattagtgtccttaaaatacttattaacttttatcttttgatgattaataatatttaattaaataataagaataaggaaaacgttactgtaacaaacattctttaaatattgattaaacaataaaaatataaaaaaaaatatttaacacatttcactgtaactttcagtaaaatgtttttattaatcttttactactacccttaaaacactgttgacaaaattcaatttcttctctactaaacaaagcattaacgtggtgcaaactctttctttgacttttttctaatttttaaactatttttttttctcatcctatacatatcttaatgtaaaatctgttgttaaatatgatcaacactcaaacttaaagaaaactaaatttaaacaaaggatcaccagttgatatgattgtttgagttttgcaattgtgatctaagttcaatgttttgggaattgggatatatatgcacaaatttttagttcattaattaatttgaaggcgtaatgatcaaagtaaagaagagtctttctctcttttatatattttttttcacaccaaagtcaacctttgtatgatgatttgacctagctgcaatatgcccaaagagatacggagacaaattattctaagaaaatcttgcagtgaccattgagcgctatatatatatgaaacccacttcctttcactttcataagtttggcatgccatgccatgccgacacatattcttaatatcttaaacgtgaatagaatatattgggtgccgttggaaaatttggtactacataaatttagatagtagtatttttgcaacctgtaattcaattcacgtgggattgaaataattcatttgtgtttttatttcttacttttattttttaattaaaaattgttaccttattttcagcatcgatccaatttatctttaaatctaaaacaatttttgaggtgagatcttagggtaatataatatattttttacgatagtaaattcaaaattaaaaagaatagaaatctaagggtaaaagttgagaaatttcaaaaaatataggacaagtattaatcagtgataaaaagataattttgtattaaagaatgacgagtaatatatatataaaatataagagtttatttattactttaataagatttttttattttaagaaatcatttttttaaacgttttttttcttgaaaaagccactttcctaccttttcaagagggatcacgggcgagatatatcttcttgatgttcataggatgtctcacaaagcgagaagaagaatatgaagaaaggggatgaatgaaaaaaacaacataaagtgcattacattacatggattcaaagcccgtactcttcatgaatgtatagtgtcttgatttcttcgtagtacagtaaacttc

SEQ ID NO: 5056 - DNA, 1100 bp, Glycine max
  Soy_ogl_4572 Gm13:39456801..39457900 Cluster 22
aatacgtttataaagtcattttcttcataaagtcattatatccacatcaagatttaagactgattcgagacatgtaatgaataattctaggaaggcacgacaaaaaaggaacattaataattgacaatatactatttagagaaaaagaaaattgaatagtttttattttccataagtcacaatttacctatacatcttaatttttagatgccttcgcatataatttttcccaaaattgactttgataaattaattttgatttatgtaacaaattctattcaatttaatttatctctttattctcttctgtatttactgataatttgatctacatgacctcaaatctaaaataactaaaatgtaattgcgaataaacataattaaagttgttgataatcaaaaatagttaatataagtagtaatactttatgttttataattaagtgattaagagtttaaatcttgattaactcttaaagactactttataattgtactttatatcaattatgataaaaaatcattgttgataagtccctaaatcttaaggggtcaaaataaaaatataataatcgtttgtgcatataagttttcctatcatattttctaaacgactaagtcaatccaaatcaatatgatatatgtttagttggaaatatgttcctaaagtcattttcttggtaactaaagtcattattatggatcaacacccatttgagatatccaatgaataacttaggaaggaaaggagaaaaaaattaattaattaagtttgaccatacttataaatgttattgacaatcctgtttagatttatattttatgtactaatattacaatctttcagtcttttaatgatatattattgaataataaattttgatcatttggtaatgaaaaaaattaagtttaaccatcatatatattaacaaaatttctctttttaatggtgtattaataatcattacatgataatatagaacatttcgtaacagtgatgtaatgaaatttaaataaaaaattgatttacttgttttttaatagattatttatttgaatattttaaaagaattattcatactatttatgcttaaaataat

SEQ ID NO: 5057 - DNA, 1140 bp, Glycine max
  Soy_ogl_975 Gm03:39606461..39607600 Cluster 22
ctctaataaaggataattgtgatctaaacaaaagaaaaaaaaacttatcctgtttctttcctgttgaagtatacactgtaaattcttcaaaagtttttatgcaaaatatgttcactagctagtactactgctggtcactgtttggtttattttattacagttctataaatgggccttggccacttacgggcgcacgatagctgggccacagctgattgggacaggccgactataatcatgttgaatgtggctaacaaaggttaaaggcaccctttattgctaagtatgtcccttactatagtttagttcttttttgacaaaaatatccttcacaaaaacacgtttatgttgttcacgacaaaatatggaagcatgtttccattttgtaatggaatgtgcattcccaatacaaaacggaaactaatttccatttgtaatgtatcatgacaatgtatacaaacgaaaaaaatgttttcatcttgtaatggggtgaaatttcagtatataaaaaatggaaactagcgagtttgtcaagtttttagcaccttgctaatttcataatgagacaaagtgatattacttctagatgcacaattgcaagaatttttataaatcatgtcaagagttcattttcaacttcaagataattcatttttttttttgcaaggcattcacttgtgcgtcaaattcaacatgctattttgaacattggtgattctagccaattttttagtaattacataatttataaatgcatgcacttgtttaatgaatgcatcttgtaattgatcatatatgatgggcttttaaaatcaaaattacataatctattgttgtccccaacgccattttaaaaggaacttgtcttattttgcaagttaaatatttgataacgtattatacaaatattagttgatgagtttggattgtttggggaagaaaaaaatcatttaaccaaattctttcattttattcattatactatctaatcaatttaattcattttttattttgtttcattataagaataagtcatatttatataatacatattaagtggtaaatattctattttaagaatgtgaaaattataaatttgagtcatacatgtatggtcaaaatttaaacttatttaatagt

SEQ ID NO: 5058 - DNA, 1430 bp, Glycine max
  Soy_ogl_6993 Gm20:44638801..44640230 Cluster 22
attgcattgtacaccgatagatcacttaaaaacttatctaccctaggcagaccccggtcacttggggaaaaagattctctttttagtgagaagttgatttgggattttggttaaacaacaattttttcgattccaaaattaaatataaggtaaaatattaattttattcctttatcaagtatggttattttaatttctgaaattaaataaattaaaaaaagtttttagatttgtaattcatcgatcaaattagtccaattgttacatacaatatgtgacttgaattgctctcattctgttagcattgttcttttcacttttattgtttgtttttgtgttcacagcttctggtgctctctaagtttatgttacattggtagtcaacgttttttttttggtaaaaaacaaactaagtgaattgagcattgagggctcaccagggtcaaaatatgctttaagagttttgttttctttttggtataaaatatgttgagcatcttaaaaaatgagtgagatcacataaaggagcatgcggagagaaaattaattaggaagaatgtcaaagtatgagacttgtatctatatttgtaatcagtaattttttaacttagatttatttattttattgtaatctacccacaatatatttcaatttataaaatactaagaagccccaaaaacttattcagtatgtacgtaaaaagtcatgaaaggcttttaagatcaatttcgccagcagttacatctctgtgattctcttgaagagtgtccttttcgtaataaggatacttaggatgtttttatccacaattggaaagactcaaagtttttagctagttaattttactttttaattcattttaatcataaatgcaatgatttcatattttattttattgatttttttttcactaggaaaaaataatgaaagcaacgaaaactcaagcaaagattgtataccttcacaaattgtacgtctcatgaggattacaaattattcgaacaagaaattactatacaactaattattttttgagttttttttttaatttcttcttttttatcacgggaaaagaaaattcatatgtaagcaaaaagaaaactgtttaaaaaataattaagaaaaattgaacacattcttaatatcaataatagatttgattttacttgttgtgattttagaaatattttatttttgttaaaacttaaaacaaaagcatatggaactaatgtttctaaaatcaaatgttttattaccgtgactattttttatttttatttttgtgtgaactaatgtttaagcggtctgtactctatagacccgatatctatttttcattggcaaagtgtcacggtaaattagaggaaaaataattatttcccacgaaagcagtaaataagtcatttgacaattttttaaaattctcaga

SEQ ID NO: 5059 - DNA, 1200 bp, Glycine max
  Soy_ogl_318 Gm02:1886401..1887600 Cluster 22
tctaaaattccccatagtttgctaattatactttgaattataggaaaatatatatttttatgttattcatgattgaaaatgtattaattggtaaataatattaaaattactatatatttaaaaatattataatttaactaattatttaccaaaaactaatataacttattttgaaaatattaaataaattatttaattctctaaacatttaattattacaaaaatattaaataaatgattacttgcagataatataatttttaagatttcttatattaaataagtttttaattttaaagactaaagtaatatcacataaattaaattattttcaagtgaatctatagaaaaactaaatttatttgtcagtcttagaaaaaactaaatgatttaaatatgtttgagatatttctaaatataatattttttatttaaatttgtaattttctttttagttttttattcattcaatgatcattattatgacgttatatatttcggttcctatcatgaatcgttattagtaataacatgttttacatttttgcaaacataataactttttattttcttataaaatatagggattttttttttaatttcagtaaatataacattttatttttacatgtagctttgggttgtccagagcgggctgcactggtatcttgagaaatcatacagtagtttcttaggctgtttcacagccaacttgggtcttaaaaattaagtttttgctgaattaatgggtgtcatcctagctattgaaaaaattatgacaagggttggagaaaattttcactggaaagtgactccattttgatagtgcaggccttttctaatgataatttcgttccttggtctgttagaaacaaatggttaaactatatagagttaacaaaaaatatgccttttgtagtaggtcaaatcaatagagaggataatatttgtgcagacgtacaaaatagcccgtttggcttcttctctcaaatctcaattatttttgttggtggaattctgctcctattttcattgctgcagaattgaataggaatagaatagttttgtctaattctcttgatttccctccaataggtttggttcatgtcctcatggtcttttgtattttcttcatcttttaaaatgaatttcttggttagtgtttgggatgtcagcctagttggaattgcaaactctaaa

SEQ ID NO: 5060 - DNA, 1109 bp, Glycine max
  Soy_ogl_5535 Gm17:5587001..5588109 Cluster 22
ccctttatcaactaagactaaagttaaactcaatcatgcagcattgcagtgcaaagataatcatcattggtccttcgataagcctaaacatgcatcacaattgaaagggataggcaagtttatactcattaagaagttgcctcactttttttagatttaaaatactagtataaatttatccttataagttacttttgatttggattactgaattttaaaacttcaatatttaagttcaataattaaaaaaaaaattatcccttgtactatgaagatgccaaaacgtatgttgtacaagttattttgatcccttgtactgggattataattttttgggatgaatgtcgatatattgaaaggactgaagctaaaataaattaaaatagcataaaactataaagccaaggaaaaattcaaatttaaagtatgaagatcaaaatcagaattaaagtaaattataagaaaaaaaaatgtagaggcaagaatgggagatctaatttgtgtcacaaagctatttaatttgttttcttcatgcattagattagttcttaaaaattttaaaaaaggtaaatttcatattatattttaataattgtcaattattttagtatatgagattaatatcatggggcaatcaattaagttattattaatttaatcgttaaatttaacaattattaatcaatttaaaaactaagattatatttggttttccattcagttaccttgaacgtgcatttgtgttacgttaaactcacttttgtaattttccatttctataggtgtgtttgtattcatgtttgcttccgttgagcataaatacttgcaaccgatttcctttaaatgtggattcaaaattagaaaattcatatttcgcttcaaaccaagtttcaaataaaagtgatatcagaccatcagagtagcttttaaaatttaaatttctaaattgttgttcattcaaacttatgtcagttaatttaatccagatatatattctaaaactgtatctgcttcattattccaattgtttttcctaaaaaaatgtttttatttctttaagatgacgcaattcataatacatgtatcacatagtctagtggaattgctta

SEQ ID NO: 5061 - DNA, 1200 bp, Glycine max
  Soy_ogl_6971 Gm20:44019501..44020700 Cluster 22
tcaagaaattaagaagagagaagacaaaaagtatgtgtaatttttaggtttgattcgccccaaatgaaccctatatatagaaattggatgcaatatataatatgttggcgaatcctctttaagatataatggagttctttgatatggattgcacacccacaattaagcatatcatcaatgacaatttacaaaataataagaaaggaaatgatttttttaggagtaagaaaggaaatgatatgaaagaatctcgtgaattttgtggccatggttttgttgtttttttgtatgtagacttgttctatttacagacaacctcatttcttttggtgaaagaatttgatatttcaaaacttgttccattgacagaccacctcatttctaggtatttaaatttttttaattggatttttaattttattttttaattgaatctttttcatcaaattctgattatgaaaaaataactacaaacataaattagaagtgcaaacagtgaattgatatttttaaaatatgtgataagtataactaagtccattataagtatttttaacagagtttaagactttttcacgtcaatacccaaatattctttcacaatttagtttttaataaaaaattatttaataaaccacaagtttgttgagacatctacacatttttttttataaaaattcaaattaattatgtaaccaagaagtaaacgttagtgttgattatgtttgccaacacaattagtttttaattttttttttactagttgaaatacttataagcatttcacagtttgataaacagatttttttagtttagaatagtatattttaaaatactatagttttttctcttttatttttaatatatttatcaaattttttttactatcatttttaaaataaatcagagttttattaaatttttttcttcactcattcatatgtttgaagtatgcctgtttatcactctattttttttccaacgagtccactctctttttttttcaggtaatttttaatcaaataatttttattcttgatcaattgtaattatttttttgcaattgatgatcaaactttcgtattctttttctagtggtgtggcggtttatttgtcgacagtcttcgaaacttttcgcaactgataattttctctcgcaattcataatgagcgtatatttttttacatattgggtgtgta

SEQ ID NO: 5062 - DNA, 1177 bp, Glycine max
  Soy_ogl_1248 Gm04:6040478..6041654 Cluster 22
aaccgatgcaagctaaaaaaattaagaaaaagtatattaaaaattaataataacacttgttagtgtcggataatcgttgactagactagctgatactaataccaatttttgttgtagtgatgagtgtcaaatagatttttgacatgaaactttgtcaattatctcgtttatttgtagatgagtgccaactttgcatcattttcaactttaatttatattttatgatatcgataccaactccacttcagttccatgggcagtgattctgcatattaagaaagaaaatacgagtttttatttaaaccgtttgtgccttaaaaaacattattggcatggacaggtaaatcaaactgctgttacaaaattatgttatatattaataaaacaataaaatatatacaacgaaacatttactagaaaaattggtaacaagtgtgcctgatgtcgatgatcttgcggatgagtgtactcattataatagcaaaaaataaattgccctctcgtgaactttttaattgaaataagattgtcccaataagttattggaaatttgtattcaatggacttcatagactaaatatgaattatatatatataatatttaacaaaactaatattatgatacttaaaaattaactagctagctgacaatagccaacttgtttacaaaattaaactaatagatacaaaaagcaaaaaaaaaaaatttaaaccaatactaaaataaataaaaaattgttcgcattactatcttcaacatgttgaatttaaaagtaaatcgcaatctcatttttaattgacatttatactttacttttcttcccttttactttaaaatatatactctcattttgaataggagtcatgctttaactctttcccatataaatgaacgttttaatagtagtggataattacaaatgtatcttctggtcatatttttttttttacaactttcagtgtatcactagtaattaattttaaacatcctattattcattttaaaattttagaacgtaaatggagtttcaaatgcttcttctattacgggttttgaaattttatcaactttacaaaaatgatataaagttcaaaattagtttctaatcatgtcgagcactgttgcaaaaagaaaatctaaaaactcattaaataaaaatagtattaaatgtaatat

SEQ ID NO: 5063 - DNA, 1400 bp, Glycine max
  Soy_ogl_4779 Gm14:45446301..45447700 Cluster 23
atgctttaaagagatgatgaacttgttccataaaaaaaaatgaggaatttgtttgacctggtatgatcaaacttgatgggttgtatcttcattttatggcaattttattctattagtaatgatcaaataatcaaattttaaaattgctttgttaatgaaattgaggtttcgaagttattaaacgtaaaacaattcttaaggaattggttcttttttatggccttgagtaaatttgtaaatgtaaaagacaaaaaatataagggagcattgtttcattaaaaaaccaattgaaaaaaatattgtaataagccactaaaaggaaataaaaattattaataagtcaccaaaaagttacctgcaagtcagagaagatggctttttttaacctttttttaaatttttattataaaaatacatttttgttccttcattcatttagtaatatttgttttgctcatttatttattaaaatattcattttgacctttttgttctcaaattgaagttaatgttgtccttctaaaataattatcatttttttcatatttttatgatattagattcatttatgaaatagttaatattctaactaaaactgaccatatataaacatgtgaaaagtatgtttaagagaaaattaaaaaagaatatgatataagacatattattgccagagttgtgccgacaaatagtaaaattaacacctagttataagttacctgcttgttttgaatccatacttggtgtctacatgcaaaacccaataatgcaaaaagtatttaaaacaaggttatttaccggtggatcacctacttaactggttcaccgtagaaattaccttaaaatatagacataaaagatatcaacgaaaatcaatatggggtacattgcttttaataatttttcaatttcattaaccatcgagatattgtttagccttaaaaaaacaaaaaataatagcattgactgttccgaaactgaccaaaaaaaatattgttacataggatgagactaaaaaatatagacgtaaaagatatcactgaaaatcaatatatggtacattgcttttaataatttttcaatttcattaaccatcaagatattgtttagccttaaaaataaaaaataatgctattgactgttccgaaactgacaaaaaaaatattgttacagtaggatgaaactaaaaaatatcaacaaaatcaatatgtggtacattgcttttaataatttttcaatttcattaaccatcaagatattggccagtcttaaaaaaacaaaaaataatactgctgattgttctgaaactgacaaaaaaaatactattgcgttaggatgaaactaaaaagtagcttagtgcttgacacttgtcacaaaagaaaacttgaaatattatattt

SEQ ID NO: 5064 - DNA, 1400 bp, Glycine max
  Soy_ogl_864 Gm03:5705701..5707100 Cluster 23
aaatgtttaatcaagataaatggcaaaattgtattttcatgtatatagtttgaaagaatttcacgggtccattcatgtattgcgtttattatatttgacatcttttctttttttttttttttactttgttggagaaaatattagttttattaatgtgcatcacttgcaaaatatataataagaaattaatcttatgaccgtgctataagctagctttacagactgtgcctgtccactaacctgcatttgtcgtgtgtttgccggaacattttaccccacagtccacataaatgggatgatatgaatgtgtcaattaatttagttgatggaggatatatcactttcaattgattggctctatacactgttgatgtatccactatacatattcaaagtgaattcccatgctgtggctttgtaatttgtgttatcaaatgtcaatttccctgcctaaaagtatacacatcctatagcatacaagcattttgtgttatatatatatatacactaacatatctaccaattttttatgaggttaataagttataataattatcttaaaaaatactgaaggtgtagtttaataacatagtccttctaaaaacacatatcaatatatcaatgaacgttaacaaatgtgtattaaactaagatataacttgccaatttatttcttttaaaaaatatgtaggtgtatgttaacaaacaaaaattcttttaattatgaaaaacaaaatttataaatattgactatcaaaattaaaaataaattatatggttatattttttaaaagggttaatgttagttattagtttgttagcccaaaaaattcaaacacacaatattttcttttatttcttctctctaatatcttaactttataattcctaattacatcatcaattaaaaagttatatatgtctttcttttaatttatccatttaaatattatctaatgatttaaatttacaatttatttttcaagagaaaagttctcgtgtaatgtgttatttatctatctatgtgtgtgttttttatataatattttatttttcttttaaaatttgagtaattttaagatgtttaactaatttgaattgaaattaaatgaaaagtttattcatgcctttagggaaacaaaattctttcaaaattctatcgtttatatttataaataataaataataaataattgaggtactcccctcatcaccacagcatgctccatccttcctaaagaggaaatcaattatttaccatttcttacaattactactactgaatcattcatggactattttgctgggccttccaaaagttctaaggccacgagtttgaacaaagaagctacaaagcctacgaggagagttgttattttatttattttgggcacatcacg

SEQ ID NO: 5065 - DNA, 1000 bp, Glycine max
  Soy_ogl_5718 Gm17:33726801..33727800 Cluster 23
gattattcatatcattctatcagacttttcagaaccttatctcattttctttgttatccatccgagtttatcatgggaagatggaaaggttcctgtaaccattctactaccatttcttcgggagagatttgaagaagtggtcgtattacccaaatccgtcattctgtaagtgacaaagatggtggaagtgttgaggatcctatagaacatgatgaatttcaccttttgttcatacaaatgatattatccagcctttggaagacacgcctattgaagacgatgtactatattcttcttttcttttctgaacaacttgatcctcctgctgatccagttattacaaatgaggttgggatcaattttttttatttttcgaaggtaatatttttttctttttaaattatttataaagaaaatcaattgaatgttctttttttttgttgattttacatttttttaaattttatatgcataagatcttcttttgttttttaataaaagtgaaaaaaaaatgtcatggtaatttttattaaattgtgatactatattttgaatatattaacttcataggtggatatcatttccaaaataggacatgtagctgagtaatagaatcgatctgttgaagcaattaagtgatacaatattatatcttttgttatgaatttgtttatttactttagttgatacataagtatatgaatacttttttattattagactatttagctctcttatattttttttttatagttgttatggtgaatttcgtatgaatgttttgtccttataattataataatacttcttttaaaaatatgcttcatcaactctcagctatttttttatacatatatctaataaaaaaaattaatcattcatttaacaatttaattatatagcaatgcaactctttttattattcttaaacaaaatcttcagttcaagcctttatgaataaaaaaagatggttaagaaacaagccacttaggtttttccc

SEQ ID NO: 5066 - DNA, 1155 bp, Glycine max
  Soy_ogl_6162 Gm18:53821801..53822955 Cluster 23
attaaactgtcaaacaagctttttaattaataaaaaaagatagaagttaacttgaaatattttgttaaaaaaatcatagtattttgattggggtgaacctattgatttatataaggaaaagatgctccctttgtttcaaaataattttgtcacaaataaataaatcaggttacatagcaagataaatgtgtttgtcaatcgcacatccttagatccttcaaaaagactcatcttttcctgcaaaacctgaaactcaagcgagagtacaaaatgtcaaaacctttaatatcgtatcaaacaaatcctaagatttctataatgtcctatgaaagaataaaaaaaatattaattaaaaattaaaatagattggcaatgagaagcatcggacaaatatgaagaaaaaaatgtaagcagtcaactaagaaaaagatcccaacaatttcattgtttcttcttctgttcaattatgataacaaaattattaaaagaaagaaataaattagatctatcgtttttctattagataacaaaaagagagacaaaataaaagaacaatttgcaaatataaaaaatcaattagtaaatctgaaacatctatgtctttatcatccattgatcttgtatgacgataaaggcttcttagacaaatctagttttttgtttctctccaatgcataatgtttccatctttctctccctttactcatgtgcacaacataatgctaataggttaaataagtgaatctcaacggaaaaattattaaaaaaacatcaaattagttgaaaggaatatgttagtgttaccaaaagagtcgaataggagaggatcaaaagagaatgaaatgacatcatatcataaaaaaatgaaagcataccatagagttgggaagaagaagaggaataagaggtgtgaaaatgggagaggaagagtgtatggtatgaactttcatttgcaatttgaatttaaaagaaaaataatgaaagtgtacataagtcattgcaccaaaatttaatttttttaattgtgacatcaatttaattaatattgatatacttataaattgatttaattatgacatcgattttagtaaaagtgttctaaattatttttaaaaaaattattaaaaatttgattgctatcaatcaattttaaca

SEQ ID NO: 5067 - DNA, 1085 bp, Glycine max
  Soy_ogl_2022 Gm06:20553702..20554786 Cluster 23
aatagtgaagctttgcaaaataacaaaagaaaataatttataacttatataaaaatgatttaatcatattttgtcttcggctataaaatcattttaattaaacatataacaagaacttattcaataaatatttaattaagttatttatgcaaatacaccttaatcatataagaaaatcacatgaacatagatatatagacttagaaagatattttgattaaggaatctatagtactgaatacaaatcgatgcaagtttttttgtgaagtacttagaaaatcgagttttaatgtacattgtcattgacatgaacaatttaattttaagtgatatatttattaggtcagctaaattatgtttactgccggggaagaacctaaattcctactaaaataaacgtactggaatgaagttacgatttaaaaacgaaaaattaatgtaatgtgatcagcgacatgtcaagataggtcaccaaagtttctaagatcatcattatgtttttcacgtgtcgagatcccagcaactgtgagtgtaatgggaaagcacaagtggttgagtcaaagtaggtggtgtccttgtctagacacattgcggttcatgttggaatttttttccccagttcgattatttatttgttattattattaggtttaattgtaatttttataatcaattttttattattttatgaattttattacttaagttttattttcacaaactttatcatttaattctcataatttcatgaattttatcattaaaatttctttttcacaaattttacctttcaaattttttatttttatatattttatcatcacattaatgataaaacaatataaaaaattaattttctaaattattatatattagttatagatataactgatctaaaaattgatttttttatattgactgtagttaggacggatgtaaaaatttactttttacatggatgataattacaaatgatattcaaagtcaaaattatttatcttaggttaacaatacataaaaattgaaaatttttgtgataaaatttgtaaaaataaaatttgagtggtaaaatttataattaaacc

SEQ ID NO: 5068 - DNA, 1100 bp, Glycine max
  Soy_ogl_4746 Gm14:28922201..28923300 Cluster 23
aattcccttgaagtgtcaataggataattaattgcatattaagatactttatcgctcaagtaaatgactaagataaaaaagaataataaaattagttaaagtctgatcaatctaatattagttaatatacatcatccaaatcagttacttatggaataaaaaatacataattaatttatgttttttatcaacaaatattaattgtattaaaaatattagttaaaaagattccaattcactacctcttcctatcttcttctccctttattttaaaattcatctttccagctattaaacctatcttatcttatctgtgcatcttttgcatatgaaatcccattaatttaatttttatgattttttaactgttcggtaagtaatgattttgttttttaatccacttgattcgggttgtgtacagagatgtatgtcaattattctcctgctcatttaactttttcatgtgctattttgttttttaattgatcttaaaataaataaaaccttacataacctgatctatattttatatataatctataactattataataaaaggctatagaagttttgatttctacaatttgtttttactaaattactgttaaactacatattctcattttatagaattaactgtcgaattttctatttaacttcttctgtctctcttattgtttgctttatttttagaaaaatgtaaacagccattgagcgcctctcctttctccggtatacttataagagttttttcctctaaataattaaatgtaagaaaaatatatttattattaattcgaataaaaatatattgtaatcttaatcaactttaacttttttgtgaattaattaactttaaatataaatagaaattattaccaagtgaagtgcatcaatcaattggcacattgttgttctaacttaattaactagtgttattgagttaaagttttagatatataattatattaaatatttaaaaacaaaaatttatcacttataataatcatattggagcatgattacacccatcgaaaacatatatgatatttaaaataaattaagtttgattaccatacatttacaatgtcaaataaatt

SEQ ID NO: 5069 - DNA, 1484 bp, Glycine max
  Soy_ogl_5346 Gm16:26440001..26441484 Cluster 23
tctttgtcaattggattaatctttgatggttaattaaggactttttgacccttaggaatgatgccatgtgactttaatttaaagtatgtgtggatcatcctcagacgtcacaggtcttgtgatagagaaaaatgatgcgtcttattatattagtttagacacgattcatggctgtatattagaaaaaataataagacattatacaatgctgcatcattttcattcaactgaaactcagaaaataaagcatatggggaagacagaaaatatagagcttttagctcatcaatcatcatcagttcaagaaaatatataagaacaagacactgaattaacgctctaataggatttattctgatacccatgaccgtcaagagtcaaggctcacttatcagccggccatgcaatatttaattcaaagggctagaaagggtcataccaagttcggggataaaaaaaaatgagaatatctatggtcatctaataatttggggattttaatatcgttaatttttcaatcaatcaaattatatttttttattgattattgttttccaaattagtctttcattattatttttaaaaaatttaaaattgtaacttttttagattagaaaatatgattatagataactttagaagtgtgaactctaaaatcttttgaattactttcaacactttttataaaacctatgcttaagaaacaataataagaaatttttaaaccataaatctcaaaagattttcttataaaaagtgttaaaaataactaaagacattttatagttcagacttttaaagttatctttaatcatattttttttaatttaaaaaagttgcaatgttaaaattttaaaaaaaatagtaatcaaggactactttgaaaaaaacaaaaaattaattaatgagaaaatcacatgtaatttgattgattaaaaaattaacattatcaaaatcctgcaaattattagaattaccatagaaactctcaattatcttttaaaaagccatctttgaaatcggaattacttttttatttttattatatatttattttattttattttaaattctcaaatatgtgatgtgtgatactaaaagaagatagggattgagagaaaaataaaataaaagagaggtaaaagaaactatacatgaatatagttgatgccatgtatatattgtttcacgaatggaccatatattctttgatactgttttaccaaatggtcatatatattaaacgagagtgtttcattttgcgctccataaaatttaaaggacaccatgttgcccttgaatggagataccatccgttcaagtgtttgtaagcaactggtgattcaaaactcaaaatacttcaaggacttaaagatcaataaatcatagttaaaattttaatggtgcccttaagctttacaaacttgtgaagattaatataaggaaaatttaaaattctacctcattttaagttgattgggacg

SEQ ID NO: 5070 - DNA, 1013 bp, Glycine max
  Soy_ogl_6031 Gm18:12371414..12372426 Cluster 23
gtcttattgctacaaagtcataagttctaagaaacaaatatttcaaaaataaatatcatgtgaagatcatatatttggaaaataatggttctaggaaaatcatatatttggaaaattcttgcaggatttttttccaggaaaatcatatatttctaacaataaaatccttctcctattttataaaaaagtatcagaaaatagatatatttaacgaggagggatgaaattattttaagaataatatttactctttatttcaaccattcatttttttaaattcaataatcttatagaatgatatggtataatagatttagaaacaaactacctaagttacccttgaacctagagaacccaaatattttcacttgttccgtgaataaaaattacgtaaactctttttcttgtacatttatttttagtagtaatttttattgttaccattgtttattgcttaacttgttaaacattctttaatttttattatttctattgttttctaatacaccagtacacccgtttctccttcacgaggattgaaaatattatttgtcttaaatattaatatagatttctgttttatgttaacaaaataaaagcaaacctcattatgtactgagttttaaagaatggggaaattaacaaaataaaagcaaacctcaagatcacaataactcggctaatgtcacagctgcgtcaatgcatacatatattaatcaattgtcatttataaatgcacatgatccaaataataccatcaagacatatgaattgccagctactatataatttagtagtagtattttttaaatcggaatatcatcacacttgcaagtaagatcaaagacaattggaaaagttatttatagtcaattgctatattatcttatttttttaaaaataataataaaaaatacaataaactctagtttagtcaatgtatatattgagaatagactatcaaaaggacctagcttgctctagatatatatattgacaatttggctgatata

SEQ ID NO: 5071 - DNA, 1202 bp, Glycine max
  Soy_ogl_5715 Gm17:32504599..32505800 Cluster 23
attagtacttttcacaaaattcaattatatatttaactgatatttaataattgatattgttatttactctcaatataattttattgatacatacttcttaataataatgatgctatcaacatcaaatcccctttaaataaccaatattagttgacacaaatgataataatttgtatcttttaatcaaatgatttaaaattcaaatgttaattttgaatatgaaataaattatattaagaaaagaatactcaccttatatatacactcacgatcttcgacggtcattagttactactggcaacaaatacttaccaattaccatggtaaaatacaaaaaccctttaaattactattgaaaactatactgcactagaattaattaattagattagcatattgtcaaattttcaaaggatttatatgcatcgtgtcctctccttaaatttttagatcttatttatgtgctatttttaagagaaaattatatattatactttttttttagaaagtaaattatcatttatctaacaattaagagaataatttcttttaagaaataaacattatattaaagtgattttatttctcttgataaagtctttaacatttcttaatttaatccatcttcaacattaaatactttaatttgctttttctatttatatatataattaataaaataaaaagttgaattttaaatttaatcattgtgttcaattttgacatattattaatgttaagatttacacagaaatctatcaattaaaaaaatcatgtaaatataactttttgaagtaattgttacaaaaataaacaactttgaataatttagttatccatgattcctcttttttcttagaagagttatccatgattcttataatcatgaaactaccaatagtaaaatccccctttaagtttacactgttagccaatagaacaccaaatgagtagtatattgtcaaattcaaccaaggatttagatgcatccagctggtaatgatattgattgaaagtgatgtcaatgaaagttccagaagccaaaatgtgtagagtccttactagttttaagggctgcgtattgaagcaaactagttagtttttcctatatgatcgatacatagttttcaagcttttacaatttgtggatttgaaaagaaacgagcatatgcaacattttagtggaggttacttttcccttt

SEQ ID NO: 5072 - DNA, 1176 bp, Glycine max
  Soy_ogl_6377 Gm19:28640925..28642100 Cluster 23
caaccagtatttcaaatgtaacttaattacattaataaataacaataattaaacataatataatattaaataaagtaaaatctatgtataagctgaaactataaaaatgattattataaataataactacatataatttgtgtactatatattatggttttagttaatttaattttatattcttaagtaaaaaaatgataactaatgattatcaataaaaataattatttaacggttgttcaaatgtaagttaattatattaataattaacaataaacataattatattctattaaattaagtaaaacctatgaataaagactaataaattatgttaagtattactaatgttattttaatgaaactaaacttattcatgaaaaaaaattattcatttaaagtaattatctacaacaaagtaataacactatatatataaattcatatataacaaaatttagataattacaacatggttcgaaaaaaaaatgcagtaagcagaagatgattaattaaataaagttatccaatttcaactcaatttcaattttgaagtcaaagttatcgaactttaagtcctaatttcgattcatgtaatgaacagaaacaaatatatacctcatatctgtcctatcaaacctcaaagtaccatcattaatctctcgccaaaaaaatgatgactcttccctcaaatttgagactttctctagcttgacatctttcaaagcatttacattactctgcattcaagcagttcagaagttgcatgaataaagtatttcgaacacaattaccaacacaaattataatcatttgttaagcataaactataaaggctcaagattggttttcaagtaacaacataagtccaatcccaggtatatcctatagccaagttgatatatatgaaattgatgactgaatcaaatattttgattctaactcccctaaattcatgtcatcaatattcatggaacattgatcataaaaaaatagcaatatatccagcaagcataaatttcttccagttgagttaatgtttctgttccactgaaaatttgatatatattgtgtttcagctccaaatttccaaaaaattcaggtttaattagcttcagtctaataataaatggctcctaagaatatcataatttaacgcattgacttgatgacttc

SEQ ID NO: 5073 - DNA, 1100 bp, Glycine max
  Soy_ogl_5350 Gm16:26712701..26713800 Cluster 23
agagaacatatcatccatatccatttcatatagatcaactttattatatgaaaagtttatttatatctctatctctaaatataaatatttttaactcaaatatatatataaatatttatatacaagataaactaaaaaaaaacttcacaaaataaagtcataaaaaattaatatgagaatattcatcttgatcgtgagatcggctgcttgctacttattttcttagtcatacaattatttttccctttaaactgcaaaatgctcttcataataagatttcacaagtcatgtaacaaaaaagtagacaaataatcgtttccgtattggtgcaaaattttcctatttaaacaacgcaaacaattcatttgtttagtataaaaaaaaataaagataagcgaggctaggggtctttagtctaaataataaacaatatatatcagaacttaaaaaattatttactactagtaaaaaatatatttgtttcatattaatttctttttaaaaagttacgtaaaaccaaaattgcgacgtatactaaagagaaaattttatcttactgcacacacgactaactcgttgagattgatcacaaccaactagatctaacaatttattgcgagacactgtaataagcaaagtaggtataataatcattaatccaatcgacatcctcttaaatgcaccaaataaagcgtccttcatcaatatcaaaaaggaaagaaagaaagacacatctcattaatgtgaagttggtcatggtcaaggacaccgttaccattagaaaaattaaagaaaaaggcctaataaaaatgataaatattaattgtcttctagatatttcattagttaaaaaatttaaagtaaaaatatttttattaaaaaataaaaaattatattgattataattatttttacattttcttatgatttaaataataaatatcttttcttttaattccttaattaatgttctagatactcttattacccatactcgtcaaaatatcaagcatttcataggcacggtccgttgttattaaaatgtacaactcggatgaactctagggttcacgagtctgaactaacctagggatgctgtc

SEQ ID NO: 5074 - DNA, 1453 bp, Glycine max
  Soy_ogl_2096 Gm06:46639150..46640602 Cluster 23
gatgggttttcctcccaatgttacccatgcaaatttgataaaatttaattaagataagaatgagttaaaaaataaataaatttggttattttgaacttaaacttatttcgtcttttgttgtgtcgggggacacgaagagttaaatttatcttcaatatgtctcgttatcatgtctatcttatatataaatatttatcttaggtaattattttgaatatgaattgaataatagatgaaaagataaaagtaaattgaataaaaaatatgatatatgtgtatataagattattaaagctatcctatttgtttattgtaatcaaacttattatttttaatgaaactatgtgtttatttttatataatataatttatattttaaatacttaaatataaaaagggttcatatttattgtttctgaatccataaaatttcaagatattgaccttgtttattgactatttaaataaaatttagtggtttccatttaattagatcaattctttttcactttctctctaccttccaatatgctccacataagtgtggaatggtatatatccttctggcttctacttgatttttcgtttctgttttgtttatggtcatgtgggactatggaaaaggaaggaaccacatggagaacgataactacacacatccctactatgtcgcccctagcttgaaaggtcaatacaagtgtataaaacctaatatatattgtcataaatatttgctttcatgcaatgaaattaatgacatttgaacctccaataatgctaaagtattatggaacaacaacaatgataatagctgtcttattttctcatagaaaatactagtgtttcattttaacgtattatactcgagtcagttaaaaatatattacgttacggtagcataacaaatatttccggctagcatttttttaataaaaaaagtttgagtgaattaaatttcgggagtttatgaaaatcaataaattactcacaactaaaaaaaaaaacacttacaaacgtacttataaatttttcactaataaatacattataaattaccaacaaacttctcatattaataacaaaattttcgaatatacatttttcagatatgaatctaattcttactgattagattaatctttcctgatcaactatttttttttctgtactgttactacgttagcgtttcatatatattaagatttaagaagggatttatgaaatgataatatttttaccatgtaatattattcaaaatttacaagattttggaaataaaatcgttgctggaattgtacttaatattaataatgtcaccggtacctatcacactcatgccatgtgcgatcgatatttatagtttttacaaattataataatgaaaatattgtataataatagctattaatgctaagagtagtagttgttattatcatataattaatgaagtgtg

SEQ ID NO: 5075 - DNA, 1522 bp, Glycine max
  Soy_ogl_6126 Gm18:51139179..51140700 Cluster 23
gaagtagtaagatagtttgggattttaaaaacaaaagaaaatgacaatatttaacgaatactaatttatttaagaaaatagtaaaatggtatgaaatcttaaatttaaaaagacattattctttctaaataacaataattagtttacatgttgatacttaaaagacttaaaaaaattgaatctcataacagtagttattttattgaatatagtcattaacaaatatgaatctcatattaattattttaaaaatttggtttatagttattgttagtttattaaaattcaaataaaagttggacaatataaaaaagccaataaaaaattggagtagtttgaattttaaaattaaaaaaaattgacagttttaaaaaaaatagtgatttctttaaaaaagctaagatgagaatagtgggatagagcatttcaaaatagacctaatgcattgttcactaattttttttatttcttcactgtcaaatgtacatggttataaaggattaatttttcttggaatgaatggtaattatagatttaaaaataattattagaatcaaatttagctttttgtgatattttttaaataaatctttaaaaacacatgaaaatatttaacaatgaactttttatgatctcactttcaagaacgattttcttaaaaaaaatgaagaaggtagaaatgaagataaacgaacaaaaagtacacgcgtaagaaaccaagttaaattgcattactatatttgcacaatatatagaagttcttatccactccaataacatgccccttaagagaaaaatacaatatgattacattgcatttggtcgttgtgcctgcagcttgagccatgtagaatgaaacgaaaagaggagaaagcaattggtaaaggaaatataagagtcacatttaagaaataagaaaaaaaagaaaagaaaaggttaattgatgaaataagcttgtcaagatttgcgcagcagcttttgaagattaagaacaacttttagtaaaataggaccggtagatgatagttcattgatagattaggaccagcacaataaaaaaaaaagatatatgtaaaaagcaaaataaaataaaaaggttaattcaagaagtatcacattaacaataccaaattttactaaactacctcctaagtaattcaacattgttatatttaaggatgaatatatatatatataatacattaaaaatagaaagcggaaaatggatctccagcaagagagctgcacccagtgcagttactaatttccccattcatgtaagtttttcttttgtttatatattaaaaatatcatatcaaatgttaaaagtaaagatatgtctgagaactcatgcagtttatccaaaactatagaggatcttaatccataggaaacatatttacaaaggtttgacgaaggtttttaagaaagtccacgactgtgatttctcggccataacatcaaggttttttgcattagctgcataatttacaatacaatataatgtgtcaactgtaattta

SEQ ID NO: 5076 - DNA, 1051 bp, Glycine max
  Soy_ogl_2539 Gm08:73291..7366251 Cluster 23
tgttattcttgtgcttttccttgatcctttccgggagaagtttattttgattggatgctatgctactgcctttgttctcacttaccacttcgatctccacctccacttttaatttccacgttaatctaaagttttatctagctttattaagttttatcttaattatatacactaaacacttcttaaaaaaacgttttttactttagaaatttatatcggatagtagaaagttgatgagatgagattttagtaacacgacattttagattgatttctatataatagatttaaaaatatttttaaagttaatcgtactaggagttattttatatcgattctttaataactaataatccagtattgactatttttacaacttctaattttttaataagattttttttaagttagtcgtattattacttagtcttttaaatcattattggaacaacttacgcttttaagttttgaaatttctaacaaaatattatagatcaattgtaccaaaaatcaatgtagaaaataccgtctctggtccttcatataattaacaaataacttatatgtcaggaccaacaaaaataattaagttagttaatttattttataatatcaaattataattttattagaaaaaaatccataagattaaatggtttaagtgatgttgatatttaatgactagtacttgtaatttaatgatttttttttactaatcagtgtgacttagtctattgttaacaagccaatgaatataattttcattatgttaaatgtatcctgtgaaaataattaatgtattatctaataaattaaaatgtcataaattaacgattaggcattgattttatcttcattggtacaacttttattataataaaaattaattggttaatatagatataacatgtttatttttaattagacattttcgttggtgtaaaaaatgaatctataatattacgtcgtatttttaaaataatatttctactagcagtttaattttgctaaatataaaatttatatattaatggaataatcctattaaaat

SEQ ID NO: 5077 - DNA, 1000 bp, Glycine max
  Soy_ogl_112 Gm01:36169101..36170100 Cluster 23
gatccaattaaaaaaaatagttcaaattcttaattaaaacttatcaaataattcaaaatttacggattaatttaaccaatattttttttcctttttccaattttatgaaccccaataatacaatttaagactttcagtgattttctttccatgaccttccatgacaaattaaatattgttatttaatttgagattgtaattagtgactcagctcaggaggaattaatgctagtaatattttcaaacacttttttatgattaactaaaatttattaaaaattaatcctggtattttcttgttagttacatcttacttcttaataaagagagaattaaatgagaaataaaaatccaccaaaattaataatttttaataaaatttaacaaatcagtggtattccttgttatggaaaaaaagcttcccactttttctcaaagtttaaaaaggaagcagaatttttttatttatgcctattatattaatatatcatttatgtaattagaaaataacaaaaatatgataattatgtataaaaaaattaacacaaatttttaaattacattttattatttatgaaaacattattttattataatttaattttctactttattttgtcttgaaatttgtctataattttgttttagaacaaattacatgtatatgacaatcattataaactttttagagtttatgtacattgcaattattatgcacatgcataacaaaaattaatttatataaatatatctcattaaataaaataataaataaattttttttgttattattaatttctatataaaaaatagatttttttatgtatgtgacaaacattatcaaattttttttatgtatgttgcaaccattatccactttatcaaatattatttattttgtctaaatatatctcataaaaataaaataaaataattcactattagcatacattgttgaataaatgaaaaggtattaaattttttatattttatgtttcaa

SEQ ID NO: 5078 - DNA, 1406 bp, Glycine max
  Soy_ogl_2375 Gm07:29399995..29401400 Cluster 23
cttcttgcctttttatttaatttttcaaaaaccgagtcctatttcgggtttgatattttactacaatactaaaaagcaaaagaaaaaaaaagagaaaataatgaatttatttattgcaaaaatttgttatcaattatctactttaaccctttactttaagtattcaaaagaatatgatgatgaaaataaaagagagaaaaaatgatgggatgaacgagaaaaatattttttttcctatgaagtttataaaataggcagccaacctacgcccccatatatatatatataaaagaatgtttgattctatgggataatttcatttgataattatatagttattcatttcaaaaatattaaatgatattatttaattcaattaataactaaaataaatattattctatcaggtaaatcatgtaaatagattgtattttatttttcaatctattagagctaatttattattctattaaacacaaacaattttatttttaagaatttttattcttaatcaattatttcattcatcttttagcatttttaataataattgtaatattgtttaataacatactacgaaaaatgattaattagtttatttcattcctttgtagtactttttagttaagaatataaatttttagatgatatgtattaagctatattagttttatagaacacgggtacattcatgtaattaaaaattataagaatggaatataaaaaatattaaattcatgaatcatatatatttaaatattaagtgataaaaatatgttcaaatgtaaaataatatttgaagtttcaacaataaaaaaatgatcccttaaaattaacggtctagaataaaatttataatatatttatctacgcatttttagtgatgatttttgtggtaggctatgtcattattttttcttgtagtagtgatagaaatattagattttataataataatagtaataaatgctatttttttttccaatttgtagttagcaattaattattatcgccgaaaataactcaagctagctcccctgctttctattttaataataaatttatctcttattaatttactattatattaaaaagatagactttatatttgcaaaaatgacttgtgtatcattaggataactttatctaattatcctttttataaccttgaaaatacattccagaacttaacatataaatcattaaaatattggcttaaaaaattgttagcatcggtgactttaattgagctttcacactttctattttcattaggcattcatcatggcatgcacagacttttacgtatagaattgaaccaataaaattcaataactaaatatatatgagattttttttatgggcctaaggcaggcctatgcagtaaacacgtacggcctcatatc

SEQ ID NO: 5079 - DNA, 1186 bp, Glycine max
  Soy_ogl_4029 Gm12:9437615..9438800 Cluster 23
cagataactccttttattcttaaatttaattatttgaggctaatgagataaaattcatgcgaaatagctaaaatctccttaaaaatgaaagcaaaaattagatagtccaagaaattatcagagaccattttaaaagaattctaaaatttgtaagtatcaaaactaagaaaaatattattattcttactgttctctaaaattgttttgaaattagttctcatcatcatgttctctaatcaaacaaagacacgtgagtatttatttaaagttctacaacatgtatttaaatgaaagttgtttaattactactaaaaaaattgtagaaaaaaattactactaaaaacatatgtgtatatataatcgattgaataaaaaatttgattaaaaaaaatattgtcttttattcagccttttttcaatttttctcatataagcatgggatgtacttttttaaaaacaaaatgttttgtttgctcttttgggtcattattttttagttttctttctcctttccttctttttcatttctcccattcttcttcctcgtgaaaattttcttttttatttttttaatgaaagttattcagtaataaaaaatactcacatgtaaccattatcagtagaaaaaattaatgataaaaaaaatgagaaatttgataaaaattttgtcctgtattgtacgcctttcgcatcttttatttttctttttttcagataaagatgggtatagttattttattttacttttagttttgtttgctttaattacttcttggtactatattttaatttttcttctccttttcttcttttctcattttccttattccctatataaaacatttcttaaacaaatggttactaaattactccataatcttgtaagttttaaatggattaataaactcaatggtacacaattatggcatattcataacatataaaactattatctagagtttagaaagtatgtgtaccccgaagagaaatccaaatctatgtcttttaccaaatagttttccattcatattttgttataaaaaaataaattcttccaaactattttaataaatagtttttaataataaaaagactaaaacacaaccaaatactcttatatttatttaaacaatcacatatgaatatttatttaaattctacaacatgtatttagtgaaagttattt

SEQ ID NO: 5080 - DNA, 1652 bp, Glycine max
  Soy_ogl_149 Gm01:43458401..43460052 Cluster 23
gtattcatttggacttaaatataagtgaaataatgttaagtttggtggactaaaatatatgcgaaggcttctcactacaaatataaatgttgaattagtgtgctgattggttggtaaggcaaggatcttccacaacatcttcaatgacattttcgatacttgtccggcttagatgaagcatctttcgttgttctattgtaatgtttagagtgattaatgtaaaattatgtagaactagatgtgtgtttgttgttgttattactattattatgataaaaattaaagttattatggtttaatataaaaattagtttcaattttatgtgtaaaaattagtttcaagattaaaagttatacatttaaataattataagaaaattttgaacccctttataagatttctggatccatttgagtacatcctctggtaagttgtaatcttggttttttttttcgttgtgttttaattttacacaaataaaagaagaagcaaatttcaactaatttaattttatttaatgtcattgttacaaaaatatccttttgtttatttaaatgtgatcattatgattaaggatagtttaggaaatgtaattctttttcatgtgaaataaaaaaaatgaacttaattattttttaattagtataaaattatattttttttcttatatttgcgtatgatgggaatatattttttttaactttgtgtcttgttttgttctctttccaaaatttactccctccatattcaaatataagaaaaatatatgcgggcatatttaggaaaaaaaaaaactgaagggagtattgttttagaaaaaaaattctccctcatattttctagcttttggacacatattggaacaaaatcgaacgtaatatttttaaccttgtatcttgttttgttctcttttcaaatatggaatttgaagtcacaaatattagtgttttagataatttagtcataacttgagacttgcttttattcccaccctaagatagacagaagaagaacaaatgcggccatattaaaactatagaacataccacatcgactcttgaaagtctgaaacaaaattatttgttgtttctacttttttttttacccaatatatgttggcacaagagattcacaaactcataaataagaaaaatgctctcaaaaaagaagtggaagtccgatattcattcatgcagtagttgaaatgattggtgtccaatacatatattctcataaaacagaacaatagttacttagctcatctacccatcataaatacaaagcttaaaacacactccagcaagagtcaacacacttactgaacacacacttactacgctgcataaagcataaaaataaatacacataagaaaattcagcaactaaatcagaaatttcagtgcattaacaatagatgatgtttctactattctatgatcaacccaatcttactattactgatgttttgtaaagacttaaattaacaaggattaagcttggtttataagctttatgctaagatatgatcagtttgttcacgtttataccatttgcacagaagcaacactaaagatccattcttcatataaatcaattcaataattattcatagaaaacatgtcacaaaatcaaaaacccatctttggtagaa

SEQ ID NO: 5081 - DNA, 1092 bp, Glycine max
  Soy_ogl_1596 Gm05:4941209..4942300 Cluster 23
ggaaattgatcgagatcatgaattaagtgatggttcaagttcacttaataatttttcataaaagaaaaagaaaaaaatcaaaagaaattttagacaaaattattaagataatgtgtgattctagggattgtatatataattgttttttccttgtatttagagatgtattttcttttcctcaaataaaaaaaaacatcattatccgtagtttttccttatttttttagggttttcactattaaatattatgtgttaatcctcatttctttcaactcgatctattcgtttgttgtgtgagaacattctataactgatctggttcacaatagtgtattagagccattaattggtgttggccattattcccactcattgtgcacaattgctattcgagtgtggttcaatacttttgtagtgattatatattaacgtatatcgaatccattctagtatgtggtaatccatgacttctacgatccaagaagtgttgatgtcacactttcactattcaaaaaaaaatattcatttttttttcatatgtgatttgttcatgaatttatttgctggactcttctattgagatatccaaattttgcttcaagagttttttgaaccaaaattatattacttattgaagttcttttaagaaattgaagttgctatatttattatttgattattgtacatacaatatccatcaattttggtgtaagatatagctcataattaaggttgttacattgacttttttatgttattagtgttaatttaatgcaatttcaattataaggatatgatgatattcattcataagaaacgtatgagacatttatattgaatatgttgatctttaactttttttggaaattaataaacatgctattgcaaatagaaatatcctttgcatgtatcattatactttattttgttaattattcgtattaatttaatgtcatcttaattattaatgtattttgttattcatttgaaaagtggatgttatataaaataatatataaggttaatttgcttgcattaagtaaaaacaatataagttaactatgaatattataagtgtcttaaactttttct

SEQ ID NO: 5082 - DNA, 1111 bp, Glycine max
  Soy_ogl_1331 Gm04:40998201..40999311 Cluster 23
ttgacattttattctggcaatagaatagaagatgagattctttggtattttgctgttgagaatctttattatcaattcctaaatgaatgagtgaatttcgcgtttgaatctatatcaagtaatggagctatatgttttgaggtcatgttgataaagatgagattttcaagttaaggatctaaatatatatataggggaactattaggcagattgaaaattttgggggcaagaactaaaattttcaaatcattctcatattaaaatttggtggtaagcaaattttcatttaaaaaagtgagagccaatttaattttcattttagtgattgagtaagcttcaatctcgctttatttaagtttattgtccaaatttagtgaaatttattggaagtacatttattattagtgaacatttattatgaaaatctgttacacttaatgggtgtactatgaagtagtatgagtaaatgaatagttattagagagataaaaaaaatatattacgaagttatataatattttctatgaaattcaaaaaattaattatattttttaatacttgtggtataaccttaaacattatgtaaactgaaacggagggagtagtatataatggttgtttcttttcttaaagtttcgctcacttttcaggcaggtttgcataattaatcatgtgataggacgatatatcttttatattataaaatgggtaataaatctgcatggtaaaggatatctaaatctaaaagccgtttcttagtcgcaaagaaaaggacacaccattgatatcaaccttttattgatgacagaaaataaacatgtaaaacatgaatgtatatgcaattacatgccgtctaacgacagcagtgacatggaaatgttgctaaataaaattattcgaattagattgcggcattcacactgaatcaggttgcatatatttatatatatgactgaaaaaaaaaagattgcatatatgattagtttaaattatattatatatataatatcttctttatagatactttaaggtccttttataaaacttgtttaaaagtattttttaactaaaattatatttttttaaaataataatttagtaaggcttaca

SEQ ID NO: 5083 - DNA, 1400 bp, Glycine max
  Soy_ogl_4066 Gm12:334131..33431100 Cluster 23
attatggtgtagggtcatatatgtctgtgcatgagtggtgagaaataagattatatttaaaaatgagatagatacttgtatatcgatgtgtcaaaaaagtattaataagctactacatactatctcacatatatatatactaaatctggactcggaagatgcacatggttgtatataagataatcaaaagttcaaaagaatgggtaaattaacttcaaaagcctcttttaaacatataattataaataattaatcagaacgatcacaaattacaaattaattttaaaatacatcaatctaaaatttttagaataaatttaaaacacaacaacattgacatcttttttaaaaagaaacaatattaaaatttcattgtgtcttctttatcataattaaacttaattactgctaaaaaatatattcttataacattatcttgtataaatattttatatctcaacttcatttctggaagtgaaaatgtttttaactatttttttttcatttttaaatatttattttatacaataattatatatgtaaaaagtatcgacttaaattgaaatagttttatcatctatttatacacatgtgttcactataattttaatcatcattttaaattaataattatttatattttattatttaactactattcacaccttcaaagatatagattatttttctcctcttcagtaatatgagataaacaaataatgtgaatatatagcaaataggatcgtaggacagtacacgtcgaagcaacaattttttttaaaacaaacttgtggattttgttttcacatatataaataatattttttataaccaacacaatgatgaacttagttataatcagaataacccattcaaaataagatcaaattgatacattgaccattaagaaccttaattccaaaaaatgagatttagacagtagaattttaataaacacattgcataatatagattttagtacaaattcaaattcatatacaatagcacacaaacataaaggaaattacatgcactcttaagctctatgctctgccatgttgcctccaaagatagactctaatttgaggcactccgcacttgtcaaactgatattaattaattgaataacaattgaacccgcataaatatcaacttgcacaaactaaaaatgtgatttgctgcctttatgaatactatgccttgatttaaattaattgtccgagaacaaatatatggccctgtgcccacctcctatatccaataaaaactaatcactttctaaaatttgttggttccttctaaactcaactcaaacgccacttgctcatgagataggaatacaaacttacgtcctccagagttcacaacatgtttaatcctgatatcttcatatcagaatt

SEQ ID NO: 5084 - DNA, 1137 bp, Glycine max
  Soy_ogl_6243 Gm18:58133948..581144 Cluster 23
attccaaaaaatatattttaactaattatgattataattttaataactcatttttattcttaatatcaagttctaataaaaacactttaggaaaaagattgtttttaattaaatgccattagaataattaaattatatcaaccagctttcttaattccatataaaaattagttaaatttatttatatttagatctagatgtatttcttataatagcattgagtgagcaatctcttaaatatgtaaaaaaaaaaaaaaaattgttttgcactttgaacatctccaatgttattacttataagagttgctttaagttaaataagattgtttaatatcattggagtatgacattgttaatataaatatcaagcaacattgtttaatcaattttaaacattaaatatattttatgagcatatttaaacaacacatttaatatttatcgttagagaaaaaataataaaagctctcaagcatgaagttgagtgtaggattgttaaccgagattgactagtaaactaaatccgacaagtaataattttattggtatcatccatgccccttaagctttcaacttcttgacacatgaccttctcttatacacaactcacgctcaatggcttctcaactcgctaagtgagttatccaatttgcgaaatctccatttccttcttggtgcattaacaccctacaaaaaccattcaaagattaataaaattggtaaaaaaaaaaaaacttcaagagtctaaaaactacagacacactaaaacctaccttattggaatcaaactaagcaccaaataagaagaaataagataagtattgtgaaaaaatgtgcaaaatctaagtatgcacaacaattattaaggatgcaccagaaaaactcttagagtgtgtttggatggagaattaaaaatgatgaaaaattttaaattttaagaatttcaaatatttcaattgaaattcttttattttcaaaattttgtgtttggataaaaaaaattaaaattatgaggatgaaaaaaatgaatgaaaaaaagagaaaatatcgttggtatgttagttatatgtgttcctctatgctcacacccgatcgatattttaggagttcaggcgatgtttcttgaagaagattgga

SEQ ID NO: 5085 - DNA, 1100 bp, Glycine max
  Soy_ogl_3894 Gm11:32895601..32896700 Cluster 23
taacgcataaaaaaagttataaacaagataatctccaaagtacacgaatattatgaaagtttaaagagaattaaattaatgtatgacacaaaggttagctgcatatgcgcgatgtccctactctttctagtttagatccttaattaggaattattgatgtatggattgaacttttataattacgaattgtcatgctttaatgcatattttatgatgtaaaaatcatcaacttttgatcttatctactttagcaatgatcgactttttgctataaaactgttacttaagtaatgctcgatcttaaaaaaggactgaagttgtctttatggcatggggaaatatttgtaatttttaagttacatttcgagtgcattttaagtaattttattataataactaaccaacttactcctaattatataaaaaataagtaggtgtaatttagcaaatctcatgcagttactgatatgcattcactttttttttttaaaataagtatgttaacaaattatacctttaaatatattttaaataattatagttttattttgttatattacttctcttaaaaaaacaagtaaatataaattagaaaattcgcacacattcaaaaataatcttggtcgagacattcaacgcctctcttgagaaagttttcaactttaattcattataactaactttttccatcaaccttgttatattaatacaaataaatatcatttgatatgataataattaaagttcacgtgtcaaaaaataaaacatatataaaaaatataatacacgtagaggttaaaccttttttttaaaaataaaataaagacttaggtttatatttacaaagtttaaacaatctaaccatttaggcattgactttattgttcacttggcacttaaataaatttatttggacaaagtatgtctctattaattaaagataacattttctattaatatatattagtgttaataatttaagacaatcaattcatacagtagcattaattttagtaaaaaatttacgtatttttattggaatctctttttttaataacttttttgttgtgttttttttggagtattttaaaagtttcaag

SEQ ID NO: 5086 - DNA, 1200 bp, Glycine max
  Soy_ogl_464 Gm02:9982701..9983900 Cluster 23
attcgtttaaacttctgatatctttcattacctctgtttcatttatttccttcctatcattttaagcaatacgcaatgtacatcctaagaaatgcgaaaaacaatatattttacaagttcggttgaataaccattttttctccaatgaagtgagatggaaagtaaaaaaacagaaaaatacatttattttatttggagctatattatataaatttagtatattttaagtcaagaacaaatacatcgttatatttttatcttacctacttttttgctttgaggaaaacaaattcagacatgcgtatttctcatgtagtttcatggtggagcactaccacttggatcacacatttcacaaaatttatttgtttatattttgatatttaatctaattaaattgtcaactgtaataaaataatatagtacatgtaaggttgtcaaaattaaattaacaacgtttttttttgtaaaatatttacctataaaataaggagttttgtgggtagatatgggaagaagtagataatgtcaataagattgtacattcctccgtttgagattgactcaaatatttaagaatttgactagatattatatataagagtttttttttgtttttttacaaaagatattataagagtttgttggaaaagcaaggacggttataaagtagttgtgatataaaggaaattaaaatgaccgacaaatattattctgtaattttattttgatagcgaattgtttctctttggtactagtttttgtgttcttttcctttttatttatgcatctattcttcttcttgattgtccttttgttgggtaggacgcaaagaaagttatgtgacacatctcagctataatgaactccttctcttatgactattattattcaatatcttaaacaattgattttacaaaataaaggatgggcccataaaaaaataaaggatggttttacaacgactgaatagttggctgtttaaaaaatgacttaataattattgttgatctacttctttcactgaatgaagtttatttttatgactgtgtggactaaatgaatttatataaagatgaattggaggcaattttaatgaaaatataatataaatactttttgaacatttttggaacaaaataatatttttaaaaaaggtaggagaaaaattatattaataccaaaataggaagaagaaga

SEQ ID NO: 5087 - DNA, 1000 bp, Glycine max
  Soy_ogl_470 Gm02:10284901..10285900 Cluster 23
ttgttttataagtgacacttagggtgcatttgactatttggtttaaagggtaaaaataatttatttattttttaattaaagctaactgtaaaatatgtaggtcctatatgaaaagtaatttttctacttccactctaaatcaaacacaatcttaactttttactcatttatttgatttagaagttgtatgatgtgatgaattaacttcatatgaactaaagttttattggttggttacaaaagggttcttaagagccgtagagctttcccaaccactatgaacatactggaccctttttgggtttgagatgtcagcccaattacgaagggcatcaagtccactctcaacttcttaatacttccataaaagataacgggtagtgttattttcactataaaaaaatacatgttttgacaattccttattttttttttctctttttccattatatcacacatcttatctcatatttttttctcttttcttacttatctctctcctcattgtaaaacatgttgtgataaggtaatattaaaatgacatatataggattgtaaatatgcatacaagtacactgtacaaggatcattctatttaggagttacaataatccattctttaacatacctcttctatcacataatttcttacggtattggtcaaaattattagaaacttcaaaattacgagcacgggatatatgttaaattttgtaatttttaaaaattcagtcaataataaaaaagagtttattcaaaatagtgtattattataccatttctcttctgttctttttaagtaggaaataaaatcctccaagatcatggtatatatattttgacaattatcaaaaacagtatcagatcttatcatacaatattatataattacatccatcttgtgatataaaggagatacaggaccgcatgacatgcgtatagatgcaaggcatctttcatactaagaagtataaatatcccgttattcttcaacaccatg

SEQ ID NO: 5088 - DNA, 1144 bp, Glycine max
  Soy_ogl_3385 Gm10:6272357..6273500 Cluster 23
ttagtgtttaatttttatgtatctaatacaaaatatccccaattatgttttatttttaactatttaaaatatgtttgatacaaaatacttttccaaataattaatgtccattttagtaatttacacatttaaaattgattttgagaacaaatttccaaataatattgaatgtgaaaatcaattttcagatacaattattcaaataaaaatcacatttctttaaaatcaattttatagaatcaagttgatttagaatcaattttacaaatgcataacgcatattcaaacacgcacatagtagtgaatggaaatattcaagacattgacaactcaacaaatgcaacgtgggtcgaaggctagttgtatcactttcaataacctgttttttttacaattctgccaaacaaggaaggtggaccaagtagaaaggctggtgaaggggatgtttccccccactatggagacctataacacttaaattaatggttatggtcacatgcaccattttgccaagtgtttccatgtttggttgggtaatgtggcatcctcttcttctacatgtatttacatacataaatattgacaactaaagaaaacattatacacaacaaacttttaacccgcttcacgaatgtgaagaaattaaatactttgaccatatcacaaacaatgcaactttgaacaagaaagctacagaatctcctaacacaaccttttgcaaataaagatagtgtctttggacacactttgagacaaataaaaccgggttcattttttaaaagtgttttgagaaagatatgtgttttatatgatttgatgctggaccaaacatattgtaaatcatctatcacaatttaagttacaactttgtcggacaaagttgtcaattgacagcttttgaagataaagttgcaaatgttggaattttgtagattaattttgtttaattattagattaatttctacattattaagtaatagaaaatatcataatagatattatgttattttaattaaatggagaatactaattatttttgcttttgaaatattgaagctattttttttataaaattaactggaaaactaactgaaaatttaaaaattagcttataaatgaaaacttgtagttcatagttaaaag

SEQ ID NO: 5089 - DNA, 1107 bp, Glycine max
  Soy_ogl_1300 Gm04:37898401..37899507 Cluster 23
ggaaattatcagaaaattaagtgctgatgcaattattgaatatatttatttaaaaatatagttacatgcatttgttgatatataaattattttcatattaattacatttgttgatatataaaaaatctattatacttaatattgattgaaaaaacttaaatgtttgaataaaaagagtagaagtatcctttatttgaataataaattaagatagattaatgttaattttttttatttaatgtgaaaatgcacgatacggttgattgcatgcattcaataagatgagagacacatgacatatgtattttagatttttatttaatgtattatataaatttactgatttttttataaatcaacctttttttattctaattaattattgttttatcatttagacttattatatgtaggttgctttttcttaccaatttctattttgatacggaaatggcgatttgtacgtgattcgccacaaaaagattttttttgtcagttatatgaagaaaaaaaaatttcccatctgttgttttcattgttgttattgttttgcatcttacaatctcattcttctgatagaattatttttaacgcattttatatctgtattcacatataagattggtatcattttttataattcattaatatgaaaagattatttattttcctcttaactatttttaagagtaattggagtatcaaattcgtgtaataaaactaaatttcttattaatctaaatctgagactgagaccgagacagtctactagagtatatgaataagcaaatttgaaatctttttgttttttttttttttgggaaagcgatgtgtcttttcattgttattcaaattatgtaactctttgttataatattgttttgcattaggctataaaatatggactccaacattacccaggttgaggcaaatgtcaagaatgtttctttgtaagatgatatcaaacatcaaaataagaagaacaaatttgtaccattaactttttattcaaagaagttacttatgagatttttatacgtgggataattataaaaagcacccaatattgcttattatttattataagaatataattattctaatttc

SEQ ID NO: 5090 - DNA, 1322 bp, Glycine max
  Soy_ogl_5126 Gm15:44931201..44932522 Cluster 23
ttataaactataaataaaataaaatgtcatttcaagaaattgttagaccttagtagccagttcctagaagttgcgggtccaattcgataatattctactcccaggacataataatttagaaaatgaaaaagaaaacgagaatagataccttatcttgcaactatttttaataaattagatacactttgaaaaatttatagatatgaatcactactattacattcaataatccaaaaaaataaaaatcaaataataatgtaaaaaaaaaattgcacagcctggaaatctcgaaatcaataaattttgtagggtaaacatataatatagtctctaaacaagtagcagatttttattttgtttcttatacgtaaaaacttattaatttgattcataaacctgtaaatatcgttaatgtcatatctgttatcatattgattgttaactttttcttatgcattcttgatttggtctctatatagtctttgtacgtataatatattcttaatttggtatttttatatgtaaatcgataatatgtaaatgtacagagatccatttttttttgttagaaacatattaagtatactgatgacgatatcaatttgggaacttacgaagtcataggtgacatccctagctaagccactcgggctacatatatagtggatggtggggtgtcaaagaattactagtactacaatataataatatattgttgccatggactctttttagtcatgctccattaattacctttattataatatattaatatagcacctaactttcaatatcagtggcaccaaatgctcgcactacttttacacgatgttgtcataatgaatatgattaagaatttgatgcagtttttttcttctttttattacaaaataaaaataaaatcaagtcttcccagcacccacaatcaataggattaatcctaatcccaaacataaacagacattttagagtaaaaatcctttcaaaaaaaaaattacatgtacgtacagttaattaatttcaaacagtaaattcatttaaaagcaaatatttctctgctttatctttttattcttttattctccattcaacttttttggaaaaaaatatttaaaattaataattaattttttagtttgatttgctagttaaacagaattattaaatatagcaaaaattccaaccaaaattagttaatttacacactagtttagtgtgatttagtttaatattcatattcaatacacattaaaaagattaattttgatacattgctaatacaatttattttacgctattaaccaaataaaaagtattcagag

SEQ ID NO: 5091 - DNA, 1050 bp, Glycine max
  Soy_ogl_521 Gm02:12825951..12827000 Cluster 23
ctgttacattaacaaaataaaatatacgtttaataaataagtattaaaagtatcatcttagtaaatttaaggcttgacacttttctattccatatgtttatcatccaacttgtgtctataataggagtcatgcacggttgcattttggattacgagaagtattgtaatatactctctaatattattataaaaggcgatatcattaaatatagagcgagaagaactatacaattttattagtttcgttagatttaaactttttagatacatttttatagatttcaactaattataaaaaatgtgtcaggaaaggtaatgctttttaacacaaataaagatttatttcctcacataagtagcgaggctaaatcagtcgacagccattactttctgattttgaatgattaaatgagaaattgaatggaattatgacataaaatagaaaaagtactaatttgattatttaatattgttataaaatgaaaagaaaggaagctagattcattttaaatacattaaagaaaaatatcaggtgaaaattaaaaaagaataatagaaggttgtttccttaatttttcaactacatttcacaatttttcaattgcacagccaaaaaagttaaataaattaaactctgcgactggttcagttcatgggatgcacaagttttttttttttttttcactatccttctatcgaagaaaatctaatacccatttgagatgagtgtaaattagagtaaggtacttggtgagcatgttgaaggtttaggtgttgagtatagaaaaaggtataggcttaggatgtgatttttttacttgaaaaaagttggaactaaatgggaatatttataattagtggcgggtataacgaaggggactaagatacatatttatggtaggtaagatattttatgaatattttgttttgtattttttataataaaatagtagtattttttttatgagaatctcattattaagaattgtttcaaattattttgttaattaatttcacattttacttaacagtaaaaatatttataaaata

SEQ ID NO: 5092 - DNA, 1235 bp, Glycine max
  Soy_ogl_522 Gm02:12875661..12876895 Cluster 23
tatttgaaggtttccaatcagtgttaataagctcttgatccaaaatcttaccataatttaaaggatttcacattgtcatagcatatttgatcttcacgggctgccaaacattgtcttcgataggacaagctggtccacatgcccacattcaaattccccctgacatcctcatcctatggtccacttgatgatctaatgtataattagtttctcattcaagcaaatctaggctttgcactatcaaaaccaataattatttttgcttcattggaaagatgtccttgagtcaacttttacattaaaacattatttaattatatatataataaatttattagtttttataatatttttcttaaaattcacatcaacgatcattttaaataagttgataatattataattttatactgataatatgtattcattaaactcttaaaataatgatttaattactcttttaattttatagttacaataacttttatttttagctcatataatattttaaaacatttcattttaattctaattcccgtgttgcaattacttaactcctttgttggtccccgttcaaagtaatgcaaatgcattcatatcttttaaatctgctacaaaattggaactagcgatataaaactgctaagaaattttggaggttagaaaccctcataaattaaaaaaacaagacttatatgtagtgtttgtgtttgtgtttgttttttttttaatcgttttacactggcaccgatttttggcgatttaaaagtatctaaatgtaattgtattaaatgacttctgttgagaattaaaatgattaaaaattgtaactataagtaccaacatgaggtgttttaaactattgttgtaactataaggagcaaattaaaagagtaattaaacgaaaaataatcccaaattcacttatagtatacatttttcttattaattaattaaaaaattataaaagaatattatatgactataattacataaatgtttcctttcattgtattataagaaattttatgtgatgctgaagtcttgtacatttaaaagaacaaaaaattcttttaattgttgttttaatgtataaatttgaataatcaacatacaacaaaaacaatattttataatcaaaataaaaagtccaaaattattttccacttttgaccactcatgactacgttctctgtgctgcaataatataaaaaacaagaatgagaaaataaaaa

SEQ ID NO: 5093 - DNA, 1073 bp, Glycine max
  Soy_ogl_4761 Gm14:42685479..42686551 Cluster 23
cagaaagtataaaaaagaaactactggttgttgtcacaatgcattattgttagattatattggtttataggtattgaaattcacaatgcatagcacagattaaaacatgtattcaaatttcttagtttatatgcttaattattaattaaaagaaaattctgcattattgttagattatattggttcaaattactgattgttgtcgaattaaaattctaatctaatgactcaaacattcaagtctcttcaacataaaattatataataaatggttttattttacactacattttcaaaataatcattatttaaaaaaattaatcataagtacaaacaaaaaattattttaaaaatataatttttaatattattaatatgtacgtgtaataattttaaataaccttatctttacaataatagttaaaaagataattatgaaaataattatgactttatgattatatttaaggtagcatttatatatgtatatataaaggtaatttttttcttattttatataataaatatatttgcataaaataattttttaaacattgatattaggtcatattgattaaaatcaaccgctattatggaatacacattttaagccatgattataataatttcaatcttgatttaattatttaaaaagttcaagtttctaataataatatatagacactatgcgattgtcatcctaatagagcaaaaataaaacccaaaaaataaattaaatcacatcctaataaaatcaatcacagatcctaattaggtttgtaaatgttaactccaaatcctagaaattattaaaaataataactgcaagtatgttcatatttatttgcaaataatagctccccaaataagaattttgggatgttttcaaagataaaattttattttcattgttaaatcaatggctcgtcatcactcatacaccgagcttgattgaaatcatatatcgagaagctttcaccatccacgtgtatcaacttcaagttctagggtcacctctcatttatagaaccaccacatataagtgttagattgaacccagagccatgctcata

SEQ ID NO: 5094 - DNA, 1033 bp, Glycine max
  Soy_ogl_3900 Gm11:34239668..34240700 Cluster 23
gaatgaatgatataaatttagagagaaaagggtaaattaaaacttttgtagttctgataaaaaaaataaaaataaaaaagttaattaaaacttaagagtacttttatgttgttgagaggaatgagtctaagaaatcaaagaaggttatatggtggactaggaaagtgtagtcaacaaacagaatttagtcggttttggaatgtacttccatctcatgtataactatattagatatgatatttctatgctgataaaaagaattatatttgtacataaaataattacaacatttttatatatgactttcttttcatgatagaaaaataaagaaaatatgtatcttgatcaataatattattttcaaaattgttatatgaacacatgatttacaggttctatatgaatctaaaaaaaaatatcttttgaagagcttctgtctctaaaatgaacacgtaatggcatattctatgatgaggaatcgacaagtgtatcatgagattattgaaaaaattaaaatgaattaagtttgatgagactattgtgccattagatgaacaaatatgatttatagagtttatatttgtgcaatttgacacatgatgagatggaggatcgagttcataaaaaaaagaaaaagatggaggatggttaatatataatgacaccctagtgcagatgggggactaggaaagtgtagtaaacaacatgtgacggattaggtgctttgaaaatttggcatttacttgaatatgtgatctggtagcaacccacctcttagagtggcacactcactaaaagaatatagacagttttgctccatctccatgattaagtatatctaatattagaaatgatatcttaaaatatctgaccgagtatccatatgaagttggtccgattttaacgggaaattaccacttagactaagtatatatggatacagatattatccaattatatccttattcaggtggagtaaagctgaatttatttcttgagtagtccaaaatgactgcatatattttttgaaagt

SEQ ID NO: 5095 - DNA, 1208 bp, Glycine max
  Soy_ogl_597 Gm02:41328601..41329808 Cluster 23
ttttgcaactttttcttctttctgaactatttcaaattacatttgttttatatttatcaaaaatagttgatattcttaattatttatccctttccatctagtttcttctatctctagctctaaactgaatttaaattattattttctaaattatcaaaaattaaaacaaatcaagtaaagcttaagcaaagtttaatttgacttcatttagttctatctctaccccctaaagttattacaatctccatttaaaaaaaatacaataaaaatccaaaaggaaattgttacaaaaaaaagggcctttgttagtagatcatcctcaaaagatctttatttaatgagtctcataatctcatttaattgcaaaaaatatataatttaaatttaggagaaaacaaaacatttaaagtcagaaaaaacaaattggttcaagaaaaaaaaagtgacttaaatctgagatgaaaaaataaaagtatctagagctgaaatttgaagaaaaactcaacataaaaagaaatttgaacaactaataattttaattttttaaaatataaaataaatgttaaatgatggtgaaataatgtttcataaaataaagtggagtataataagaaatattttcacgtttaaaaataaagattgaaatttattatataaatgttcagtgttcaatatatgtttaagaaataatttaaaccgaaattaatcaagctcactaaacgaaggaaaaagaattaatttgtaaagagtaataaaattaaatgttcggttgagatcacttaagaaataataaattattttgttaaattttttaaagaaaattaacaaaaataagtgattaattgattattcttttagtccatagcaattatttttctaaataataaaatagtggttttaatttatagtgagctgttgctccattcggccccaaatgtaagcccaatgggcaatggctttcataaagacaaaagaaaaacagaaaaggacggacagaaacagaatcagtggtatacaaaattggcaccgtttatatgggcatgtttaattaatgaatctttgacaaaaaaaaaatgatagaaatagactgctggtttgatacttcagcagaggaaatttagttttggaaagtgaaagcctcatccatagcataggtcaccatcagaggggcttgaaaatcactctaatctctatatttttcttacatt

SEQ ID NO: 5096 - DNA, 1100 bp, Glycine max
  Soy_ogl_879 Gm03:34787101..34788200 Cluster 23
cgagaacttaaccattctgcctcaacatttggagaaattacagatattatacttcatagatatcaatgccactttatttagtatttgattgctaggttacagtcaatgtttcacacttctaaaataaataaagggctccccagaacccacttttgttatctcccccaccctcacaaatgatttaaatgtttatgcgcgctgttaattaagaattatgttttcttacgtttttttaacggatcaagattttttttaccttcttggctggaaatgattagaatgttttttttagataacaatggttttttttaatcataaaagtattatatattgatattgagactacatagagtacctaaaatgatgccaatggtaatgaaatgggttatatacaatagggctacccacttttttttataaaaaaaaactacaatttgctaaccaaaaatatgatgcagaagttaattaatactaataactttttaagtagtgaggaatttcatttataacttttaaagttaataaaaagtaatttatttctaaattctaatatgttaattaataagtaaactaaataagaggtatatacattgttgtttacttattttgaaaagaaactcactataaatgttaaactctttatctttacattgatctaaatgaaattaaattcaaaccctttaaataaaatatcaaattttataaataaaaataacataattaaaagaggagaccttattaaaagttagtgaatgcttcctgtaccaacaattcattagtaaattgattattagatagtgaaagcttttagatttatgagattataaataaatatatgttaacctaattacattaatttctttttaaatttttaagagagctaatttaccataggatttgaccattctagctagaatgaataggagtaaagcaaataatttaaattgcccataaagaaaaaagaatttagcatcgatactacataaatatacataaaaagtgaattactcacgttaaaaaaaattcaactcgtgttacaaacctaaaaatctataactaagtgaagagttggatgtttgctttcctaggttgtgggtggg

SEQ ID NO: 5097 - DNA, 1164 bp, Glycine max
  Soy_ogl_1325 Gm04:39564101..39565264 Cluster 23
ataagaggactgaaattatgaatttaaaaaaataaaaggataaaaattagaatttaaccaaatcccaatataattatttcttctttaagttccttaatcaatactttaaagatactgattaacatttgcattataataaatttctataatgattctgagtttgatattaatattttacatttcataatcagcaaacccaagaaagaaaatgttaaagatcagttataaacgtcactaaaaaaaatcatatactaaagaaaaagaaaaagaaaagttgaaagaattgttatgttggatagtcttttaataagtgtttgtttgatgtataaaattaggcatgaaaggtttcgagttgaaattagactttaaaagttctaattaaaaaataataacattttcactctacgtgagtgtatatattctatatatggaatagaagtgagagataattaagaagagaaataaaagaaagtaaaaatttgtgatgaattaaacaatatgatagtaaaggaagaaaaatatgaagaaggatttgtgtacctaaaaatggaatataaagaaattaaatttgtttttaactatatgatgttaggagatcctaacattggaatcacattgccaagccttaattttatggatttctaatacaattaaacctaattattcccaattaaccttatcttgatctgaatcacaatttctaacatcatcttcatatttagcaattgctcaattttttttttgtctttgcaccatctcccacttgttcacattgccaccactacttagggtataaacatattgagtatttaaagttcaagtttggtatacaaaataaatatgtgatgttcaaatttgcctcatttatttaaaataaatttaaaattttgatttgacttgttaaaaaatatataatttaaattttccttatttaatttatctcctatataggttgattattattttttagctattgaatatattcttaagtgttttaagtttaataactaagaatttcatacatattttcatgttaaattaaaggatgagataaaagtaagagaaatatcttaaaagaatatttaaacataaaaatgatgtacggatatttttttaggataatattacaatttactatctatattatacatacttgtacacgct

SEQ ID NO: 5098 - DNA, 1000 bp, Glycine max
  Soy_ogl_2055 Gm06:42571301..42572300 Cluster 23
gctttgaattacacacacatccttctagaaataaagatatgtgaatctgttcttgtattaattattttttaaagcttaaatttttttacaaaaatatatagagagactatactggtattcagtaaacttgtaagggagcatatgaaaaatctagtataaatcttgactttttctgctggaaggctatatgtaaaatctagtaaaaattctcagtgagattaaatattcgtctcctttaaccttgtaagggagcatatctacccaaaattttctgaatataaaagagagaacatattttaatttaattgtaaaaatatatgttggatcaattttcttattgtttattatatttaaattcataatggattccagtaaaaaaaatcataaaggattctttttatagaagttaaattcaaatattttatgaaattatataaaaatcttgactgaattataatatacataattgttttttttttaaatttggtttctcattttgaaagggttgtgttttttttttcattcttatgtaatactcttgttaaatttcattttttgtatggagactctaagaaacgatagataaaataggaataaacttttaatattttaagaaattaaataaaaatgagtcatgatatttacaaagatttagtaataaattaaaatgaagtcatgatactagtagagaggcagcacgaaaaaaaaaactaaattatagtttttcaaaagaagagataaaataaaaatatgttcgagaaattgaaaccaaatgtgtgtggaaataattattcatacagaaagcaagtatacaaaattgtcattacaataatactaaaaagtaattagaaattaaatgtgccggtgtatcaaaataatattaaaggataaatagtataactaatatagtgaaatactaattttgggcacgaagctagacttgtcagaatgttcctttcaaatgatagtaaaagcaaaatcactgacatggttgtccgaa

SEQ ID NO: 5099 - DNA, 1358 bp, Glycine max
  Soy_ogl_6363 Gm19:5326201..5327558 Cluster 23
ttatgagtaattaaaaaaaaatgtaacgccattgataacaaatgcttgaaaccgaagatgcagatatatacaatctccaagtgatattttatttcattaatctcactaaaaaaatgaatcatttaaagttgttataagggtcagcatatgtcattttcgttttaaatttataaagacgttattgtagaaagaagtggcaacgtggaactgttggcctctgcctgattggatagtgaacaatgccactagaaacttttctaaccctttctctctcctttaatcaaagcgtatcacgttcaaatttcatatatccttgaagcttcatgatataaattaattaaaaaaaagaaatttcggatttgataaagaaaagtgatgaaatattgactgtttaacaagagagttgcatgatttgtttatagataattcttaaaaagtagatttgaatttaagttaatgatataaactagctgttatattttgattatatcttttaaaaaataagatatgagatctccaataataatctataataaaatattatgttaattcatgtaataccaattgattgtttgatactaccttgagtctctaagatctaattaactaattcattaaaattaaaaaaaaaataattaatttaattatgagcaataaattcatctcaaattaatatttgttttcaaaactacttcatgaacaaaactaaaaacattaatgagctatattttttcattggtcacgtcattctaagactgactttaattaagagatatatttttatgaaaaaataattaataaaaaaatattttatattagaacttataaaaataacaagtcacacttttaattaatttagatttttttttggtgaatgattaatttagattttataataagtagcgaaggcaatattattatttacctgtatatatcttaagaaaaaaaaaggtagggacacattctttttacaaactcatttggattgtgaatgaaaatcatctaagtcctactgaattatttaggtcacacttttaaactagtaagactcacatgaattttgaaaaatgaaagaatatattaaaaagaaagtatacacataattaaggaacattaaataaatataaaattttgttatgattagacagagaaaaaaatataataattataataacaatctttgattaacatgagagtgctttgtattattcattttcaattcttccagatcataaaagaaagactgaaaaaaaaaaatataataacagttgtttataagtgaaaaaataattaatggtactttcaatttgtaaaatattgatatttaaaaaagaaatagaaaatactaaaacaccaaa

SEQ ID NO: 5100 - DNA, 1281 bp, Glycine max
  Soy_ogl_3527 Gm10:43857901..43859181 Cluster 23
actaatgttaattatattatcacaaaagtagtgtatgtaagtgagacaactttcattttatgaactgatttttagcatttagttatatttaaatagtaaattataagattatataccttttcttcaaatgaaaagtatggatgaatcatcaaattttatcctaattattattagagttatcggactacctattattaagtcattattgaaccaccactggtccgatgttgtggagagatatagctgagatctcatattgagtaaagctcattcacaaagtttttcattatggtctctgagggagaattcaattagttgaaaaactgatcagaaaaaatagtgttaaatgttgcttacacccgagaacgtcttttacgcaatgttaaatatctaatctttttaattgtcactaattcaagtttctaaattttatctgacagttaagattctcttctctcattttaacattaaaaaaaaaaaaaccacaaactttgttgtttagggttaaatatgaaattaattctcgattttaaatttaattatacttaaagttcttcactttttaaaaaaatatattataatcaaattcaaattgttttatataatgatgcgttgctaattaaactattctcatttgataattttttacttaatatgccctgcataaaacatgcatcgcgcttataatgcttctttgctatattttcaatcgttaagctttatatgaggtggttccgtggttggttgtcttatatccttcgaagatgcacgtaatctagtcagattatgttaaattcatagttttatttctttcaaaaagggcctgactaattttgatgggtcatgttgataaaaaacattctgccaacttaatttatcctacaggaaaacaattatggagaaggaacatgttctagttttttttcaaaaatgtttttttacaatattttaaaaattttagaaaatacctactaatctaaaacacaatttcggctaaacatacatacatacacttaatacttgtaaaatgtagcagtaaaatacatatacttgtaaaacttagtgatactcttgtatgattaagggttcatttcttacagcagcatctctggtaccaaaaaattatattgtttttttttataaaaataatatattttttttagtttttaaagtttttgttttagcttcctaaaataaaagaatttaaaaccagaaactattttgaactagggatgttcggctgttatgggattaaattggattggttttgaaaaaaaaatc

SEQ ID NO: 5101 - DNA, 1243 bp, Glycine max
  Soy_ogl_3525 Gm10:43827443..43828685 Cluster 23
gccaataaattttggtcatgcactggtggatcatatataatgctagtctactgtagaatctaccaaaaaactcataattaaaaagttgttcataaactcttttaattctttcaagggccaccatttctcatcctttaacctttaacctttaatctcaattattattaaattaattcaatgatcccaaaacaactggaaaagaggttatcgaaagacttattggaaaaaatctagaagcatcatggtacatatttgttaatgattttttttatagatatttgctaatgatttttttgttaaaattattttatactatccatacatacattaaactcttggtctaaactctcaaaatgcaaaatgcaacctctaaagtctaaagaggagttaataagatattcaagtccacggcatatgcatgataagagtagtggtttttttttttttgggtacatataataagactagtggagtatcttagaaacattacaaatgaatatcacgtagtacatttcatcagaattatttttttattctccttttggctcttccatatgtgcataagatggtgtgatgtgaggagttatccctgttaatgaaataaagtgaaagtgaacgtcgattggagtaggtggagggaggccacatactgatgagtgatggaaggaagttctcccagactacacgaaatgctttgttattattattttattttttaaaaatctgttttaacaaaaacttattagtagtaaaatttgtattataaacaggaatacaaataaaataaaaataaaatttattataaaataggagaaattgaatcaatcaaagataaacatataagtataacaaaaaataaagataaatatacgattattttatattaaatagaatatgcgtagtaatttttacttgaaaattatttattcataaataatttaagttactcaatctgtgattaactgaatgcaggatagatttatccaacttccaatcactggagtctggaatgtaaacatattgcagaaaataaatcaatttatctttaaattcggtatgtgtttgtattagcattcttgatataagtttaataaaattttcaagtcaacatgtaccaacagcaattaaaggtgtcatgtaagttttatatttctcttattactccctttcatcatcgcaattttttttatagttttcatgaaacttatctagtaaagtatagataaaaaattattttgtaaag

SEQ ID NO: 5102 - DNA, 1800 bp, Glycine max
  Soy_ogl_5689 Gm17:15291601..15293400 Cluster 23
ctttttatttgtcttctaattgtacaggatactaagacaattaggtgccatcaaaatttgattattcttttctcctttatctaaatcgataccatatacaggagtaaagttattctagtttaattcaaagtcttgaatttgaattttggataatattaaatgtttggaggttcagctcatcatcccatagcagtttttgattcaagcaagattatttccggaaaaagaaaatatttgtaatttataaaaaaaaagagtaaaaaataaacccagatggtacacttctaaacaaacccaaaccatcacagtactgtagagcgtgcgtgcatcgtagaaaaaaggcaaaggtatcgttttcgcagttgctatcagaattgaaaacattgatttgagcctcacaaagttgatataaaaggcacgttcattgaatagagatgtaaatgccagaactttggtccaatttatctcccaattgccaaagtctgcaggagcaaccaaaaggaaatgatttttactttgacgtacgctagctactacttaatatatatcttgttggtttaatttcaggcatagcaagacgttgttattgatctatagaaattaacgatggaaagataaaaaggcagatgaattaattatggaaaaaatttcgaaagtgacgtgaaactttttaaaaattaatcctatcctcgtggaagacaatcaaagaaaatttattggcattacagttttacacaaattgaatcacattttaccattcttggaccactttggctaagatcaaggacattttccaaactgtggaatgcttgagtttttttagtattatctatcctttatcccgaattcgattctaatgccttgtttaagccaagacattggactgtcaagatcagattaaagggtaaccttataaaacaagtgaaattaaattagaacaataatggccatcgttttttgacaaaaataatctcacgctagacgtcataatgattagatattagtggaaagaaaaattatttcatattgacaaccattaccaaattgctttgaaattcaaagatgttgagtatgcaatgatatatacgaaatccttgccagctacaacaatctatttgtagatgatgatcgacataaaccgtcaccaatatcataatatatttacactaacataaactctaaaagcttcacataagttttgaaaagttcaatttatacttccccgcatatattcaacggatggactagataagagatccatgaatagctaaaattcatttcacaaaaaagtctttggtcgacaattaactaaaaattaaaagagcaattaatctatcaacccccaagtttccagaagggaaaatttcatgttgccaaatgctagaacatagatgtgactaaaaacaaatatataaagccaaaacattggatcaagccttaagatcatggttgactacgatatcaaccctctatatccagtttgaatacgttacttgattatattggattgactattcttctacgcggccattcaatgataaggttatatgcctctcacttaatttgattcattttgtcaaccgttgtagttatgttcactagtatattgtacttgcaaattaacccatgtggatgtattcacacttgattgatgccacaccgtccattccatagttcagtctttcataatttaggaagtgtacaagatgttgaaaagagaagaagtatgtgggtattggaattactgtgttaaatgcgaaattaggcagatcaattcaataacggatttactttctaaga

SEQ ID NO: 5103 - DNA, 1000 bp, Glycine max
  Soy_ogl_131 Gm01:40073201..40074200 Cluster 23
tttctttaattatacaagttaaactattaaataaatattgtgagttaatgctaataatataatatattatactaattaataaattattccattaatataaaatattgatttatattatcaatatatcatatatgctattagtataaattttcaaaggttatattaataattttcgttacacaaaactatactaataaagataatcgtaattttgttataatatatctttattatattttctcccaataaaaaaaataagttaaaaagaatatatatatataaaggacagagaatatccttctttgttttgatcggctttgtggcttttaaggaacaaaatagttttttttttctagggactgtctttgatatgacttttattgtaaacaagattaaagtcgttcatggtcatgatttgtattaaaaggggaggaaatggttgcttttttttttcctcaaaatggtatgtgaatcttatatactgttaggcaagccttcatagccttgctgcttgcttctttataaatgcatatgggttttgtacttttatcaattaataattttgcttataaaatattcactaatttgttgatttttataataaataaattttactatttcgatggtgatatgatgtaataaaaaaaagtaaattttcctacacatgattaataagctaggatctatttatcactcatataattataatgtatggcaataaacttgtacagttatatttgggttattttttgtataaaaatggttcccaaaaagcttatttgttgtttggtaaagagacaacttcggttcaatgaataatttggacagcacattgtttttgtaaaaaccgggggttctataatcgcaatgttccaaaccgtttggtactgatataataaagtgctattctaatattaaagaaacaacgcaggaatttgactctattattactacaagaggaaaactagttaactcttttggaaagaattttacgtttgaa

SEQ ID NO: 5104 - DNA, 1354 bp, Glycine max
  Soy_ogl_3407 Gm10:7735464..7736817 Cluster 23
aaaactttaggactaaaatcgaaatcctaacaggagagtttaagtttaactcaaattcaaaaacttatatcatcatttagtttcgcttttttacggttaatccaaatcacatactaataaaataaagatatttatccttccatatcaatcagacgaatctcacgatgcaaaatccgtaccaaattaatgttattgcactatgctcatcgcatcatgctttatcatataagactttgataacagtcttcaataaacagagcaatcagtccaagctgttccatctgggtcctcacaatttggtttacattatatatctttccttttcaatttcctgtgagggacgagggatgggtatctgtactggttggatagagttttggtaaattcatcagtgcgattaatcaatcatcaatcattaatcacaacacaacttcgtcttcattgacgcgtcacatcctaatttccgcagtctctagttgtagcttgtatttttgtagaagcagttgctcgttcgtaccatggctaaacttcttagtcagtgaagtgaaagtgtactagtcctttcttcgcatgacaaaaattaacctctgtggtcgtaccagaattttgaaattttatccccctacacaactcaatgtcagagagcgagaggatcaacaactaaagaagatgacaaaagaattattttatttgaatttatatatataatacaattaaaatatatttttcttactgtaaaattgatcaaattcaaatttcattcttacaaagtttttcattctcatagaaatataacgtgtattttttttcttaaaataagtttgaatctagtattatgattttttatatttattatgtatataactaatgtaaatataatattttttcatatgtatataatcaatataataaagttacacacttagattcagatatttaaactttactttagatcaaaaaaagatacaatataattttatgaaaatgaaaaattaaaaataaattacaagcaaaattcaaattttattaaggatgaaaaatacttataagtgtgtggcagagaatatacatgtaatggtattttttgttttaatttgttagcaatggtcaatttttttcttttattgactagttttttttatattttcttttcttttcgattcattagatatctttatgctttatttatcttgatattttgttccattctatatacatttttatttatatgaatatgataattaatagttattattaattgttttttaaataaattattcctattatcttaaggtagcatcctttagtttttgttgaaaattcaaatgatcatttttaatgaattttttttaat

SEQ ID NO: 5105 - DNA, 1000 bp, Glycine max
  Soy_ogl_6043 Gm18:15442301..15443300 Cluster 23
ttgtgactaattagcaacttggatttaatgagagaacggttcttcactaataacgaggatttgtaagggactgttctctcactaatttgcatttttcttgtgtccctcagcaattaattcatgtgaatatgaaaagtaggaattaatttttgttgagaaccatgagcatatataaaatagatattttttaatataatttattttatactcaaagttagaatttaaatcctaaactacttaattaagaaatataagtcgtgaacacttacaccatttgtaaatattttttttcaagaggtacaatacaggaactttccaaatggtacttatgtatattatttactcacttgattttgtccatttatgtgtctttgattagaatccaaacacatactttgtgtgggatatgaaatcaaaatttataaaagaggaagagataaaatgagcgtacaaaaatatggcttttgtaaaaaggttattccaaataaacatttaaataagaaaattggaaaataaaataaacgagttttaggataaatttagcattagagggtattagctcaaattcaacattaaatttaatctccgaaaataattaatgaaaaaaatccaaaaattcattatttgttgtacattgggaaaaaaaaatccatgaaatttccgtgtatcatatccctctaaacacttgaaagcttgtaaaaccaaataacataaattacaccttttgaaatactctcatatggacagcacttttgagataaatttagtcggtagacacgtgttaaacaatgtaaaaaaaaaagtgactttgacatacacaaatataaatttatcatgtgggtgagatcgtaggagtgatggcaatatataatcttatatttttttaatcttaaacaaattaagaataattctatataaaatcatttttgactatttatataaaattaaattatatataagattaagttttctcgtgctcacatgagacttttgagatacc

SEQ ID NO: 5106 - DNA, 1100 bp, Glycine max
  Soy_ogl_6394 Gm19:34910101..34911200 Cluster 23
gtcaaatatttccatgcaatggtttccatacatataatactctattcatgctgatttagtgtaacatgctcacatattattttaattttggtcatttaacgcctcatatattattctattcatgcttatttaatgcaataaatttcatacaatcaagttttttttaaagacaaaatttcatggcaatgcgtttcatattctactaatttagtcaaatattctcacggtcaaacattttcatatattattttacttatggctatttaatgtgacatataatatataatttattcatgttcatttagtgcaacattttttatatattactttgaccttgatcattttatacaacatatattattctattcatgcttatatatttaatgcaacaaatttcatacgattaagttctattttttaaaagataaaaattacatgataatacgtttcatatgctttttttagagaatacgtttcatatactatttagtcgaatattctcgcggtccaataatttcatgctacagttttcatatattattttactcatgactatttaatgggacatataatatattttttattcatgtttatttagtgcaacaattttcatatattactttaaccttggtcatttaatgcgacgtatattattctattcatgcttatttaatgcaacaaaatttatacaattaagttctttttaagacaaaaattacatgataatacatttcatatactaaatgatcatggataaaaaaatatatattattttacgcatggctacttaatgtggcatataatattatattcatgttcatttagtgcagcaacttttacatattacttcaatactagtcatttaatgcaacgcgtattattctattaatgcttatttattgcaataaatttcttacaattaagttctcttttaaaaagacaaaactgacatggtaatgcatttcgtatactattcagtcaaatattctcggggtcaaatattcgatcaaatatttctatgctacaattttcatgtattattttactcatggctacacatacacttaaaaaagtaaaagaaattgtgttagaaaaaataa

SEQ ID NO: 5107 - DNA, 1564 bp, Glycine max
  Soy_ogl_6152 Gm18:53322737..53324300 Cluster 23
gttatcattttttataatttgaaaaaattaataaatcttgactaatgatatgtataaactaatatttataaagttaattaaacaaaacaagtattttagtaatttattatcttatttttaaataaaaagacgatgagtttaacttttatcaatatcttaatttaaaaataaaaataaaataaaattacaaattcaaaattataggaataacaaatttacattttaacttttaatgtactaacacacatgcgtgaaatatcagaactaatatatttttaatagtaaaagtgcatattggagtccagcaactttattcaaattaatatacttaacttttttatacaaaatcatgtaaaaatagtcaaaaccattaatcctttctttctctcctttttctcccaatgttttaacccatttaccaatatattttatgaaatgtgggaccatgctatccacttcagtataatatattccattaattttcaaagattattattatatatataattatacaattattttaatttatattttattaaatatattgtcaaataaataaagatattttagaagagacattttattgtggttgggcttgcatcaactcattcttgctactgcatgttgatctcagttataaagtcgttcgtcaatgatgatggtctattttcgtagaaccatgtctatcgtgaagtaaatcaggttgtgaatattttgtccacgtttaatttggtttcaccattgatgggttcctccagattttttttttctttcattcctccttttattctcaatgctattgtgtctgattcgccctctttatatttttcttgtcgatttatacttttctagattcttgacttaggaagaatcagttgttggatttgtgaaaatatatcctttgcaatgattaggaaagttttgtttatctctccctttttatgactaatggagttaattaagaatgccaaaaaagaatgattttgatgtaattaagtaaatgaattatttagtttaacttgtgataaaattggtttaaaaaataatattaaaaagaattatttttaaaaaagtatgttaaaaaattaatttatgtttagaaatgatattttaaaattaatcttaaaataattattttatttaaattgcataataaaactatttttgaagaattatttatgtataatagaactattttcgaagtattaatataggtatatgtttacaaatttggtaggttttgcacctaagaggagggaatatgaaaagaaacaagagatcatgtcaagattttttctaaaattttatctgaataaaaaataacaagtgcttgatgacaatgcatgatagcgtttatcatacagataaaataaataacaggatggaatacaaaaccaacaaatctctgtcagtgtaactatgacagaaacaagcttaattggagtttatccatagccaataatgtcttcatcatacagagatcagcttatcaaatttacaatatacagtattataaaccaaattaagatagttttaggagaaagtggaagactcaaaagaaaac

SEQ ID NO: 5108 - DNA, 1300 bp, Glycine max
  Soy_ogl_4357 Gm13:29954601..29955900 Cluster 23
aattgaaatgtgtgtaagttattgaatttttttaatatttgaatttgatttcttcttaattaggaataaaaaaaaaagatagaaacgaggtaaggatatctttgaaaacacttgtcccttgctttaaataaggttcatttctttaaagttttttttatttaaaatattatcctttcattaattttatttatttattttggtcttgatatttaatcatttgaatttcgatcctttgagtactaataatttaataaataaaaattaaaatgaccaaattttcagaaaaaaaacacaaattaataccttaaaaagtaaaagttcacgaagactataaatgaagactatgagtagtgatctagataagcttttgatctgttcaaaggccaattaaatttgctttaggttgacggggttgatgatggaaagttgaataattaacaaggaggtgaaggagagagtagctacaaagatactttaacgagtagctcaatatatatacaacaaataattgaatatatttttattcctaaaaaagtaggttgattatgattttggtcttttaaatttttatttcagtttttgtaaaatttaatatttttgtttcagtctttgttgttaagtaacatttatagtatgataacttatcatataattaagaagtttgagaggatagtcacatatcatttttgtatatataataaatttttttttttaaattcatcatcttctctgctttgaaaatagattttaaaagcacactttacttaaaaaaaaaacatatagctatcttgttagatcccataatgacatgatgtcattatcctgtcaacattgctattatttcatcaatagagactaaaaaaatatatcaaattatacaaaaactaaaaccaaaagaatttgttttaaaggaccaaagtcaaaataaccctatttttttagagacgaaaataatgtttaatcctatattaaagtaaagatttttagatagaaattctacctggtaatattactaacactttatgtatgttatcttattttttaaacaataaaattaatttaaagttagcaaagatttaaaaatgaaatagaactggtttgatagttttaacttaaaaactctttttataactactataattaattagctctttttttaaagctatgtctttcccttttcttttataaaaaataagcttcttattttttcttagagcttttatatgaatttatttgacccaacttcctttttcaaggtgaagaaaaaaaaaaactacttgatcaaacagtaccttacagc

SEQ ID NO: 5109 - DNA, 1489 bp, Glycine max
  Soy_ogl_752 Gm02:49911912..49913400 Cluster 23
aacgagaaattagaaattagtatttcaaaaaaaacaaaaacttaaaacataacttaattacaactattttatatttttttttaaataattaaaatgcgtacagtaataacataaacatattttacattatcatatataattaaaattttagaataaattttaaaggcttacgtcactgagccatccacttcatcaacttaaaacattgaaagttcaagatagtaaaagacacctatattaaagtccactacaagtgactcaattacaagacaagtttgatacaatttaaaataggagagcacacattagtcaaggatacatttctcttaaccaagaatgaaattaatgataataataaaaaactgtgcttctttacatgtaccattttacatattatttttttaaaaattatctcaaacaactattgtcctatttatatacgttactttcctagttgtttaacaatttcaatatatcctatatcctattatatttttttaaaattaaattttaatagttttttaaaagaacttatcaacagtttaaaataatctatataaggatggacaacttcaattttgagatacatgaaaaataatattttctttatcctcctcttatcatcttgaatcttttgagcatcatttatgagattctagcattttttattttttatttttgctttaaatacacaaatctgtatgcatcacaatgtaaattttgagaaagcaaactgatcaaggccaaaatttactttcaaaacaatactattgtcacatcacaattactgtcttattttttccaataattacataataaaataatgtttttaatatattttatcattaaatgataaatatatattattaataaaaaaatatttagtaaaaagcgatataaaacattgcaagagttagtgtagtttatgaaagtataatttaatctcttctcgtataaatttgatctccacctaattttattcattaaaaaaaaagagaagcatgagaaagaatgaataaactcatacatgaaagaaaaaatgatgctgctgtttataatttttctcactacaaatataagtaaaatctaaagcaaaaagaatgtaaaatttaaaaaatgagaagacaaaaaaaaaagagagagagaagaaaacctacttatatatatttttattttttatataagaacgaatgtagtattagttataggtaaaataaaagaaagtcaagtagttgaaaagttatagtgatcacttccattcatctgaggtgaatgtctacggattttataaatttcaactaggattacacttcaagtttcaaccttattgcattatgaaaaatgatatttataactgtttttgtcgacaactatagtcataactttgattctttttatttttaaatatttctttatagttatattcgttttcaaaaaatatatatttcaatacttaatagaaataattttaatattaatatatgcacgg

SEQ ID NO: 5110 - DNA, 1000 bp, Glycine max
  Soy_ogl_140 Gm01:41920201..41921200 Cluster 23
cttagtcccacaattagcaatttttttgtcttgattaatttgtcaaaccccacacttccaatttctctgcaagtgcctcggttagatttacaagactttgataaaagaatgtgacattttttttactgcttcaaatttataagacttcatattttatttgataattttttttactttattttgttataactgagcgagtatgtaatttttttttaatattagattattacatttataattttgtttagttatgacatatatttgaatgactcaacgttatgttttgttgtttttaatgttatgttgcgatgtatttaatgtcatatgaataatttaagagtgaattcttaatttacttatattaattttttaattaatacattttaatgatttattaattttatatataactaaaaatgtgggtaacatatgtgggtataggtatatagatacctagtagatacaagaataaattattttaaaattatttttttattgttgattttaaaattataaaaagtcatttttaaaaataggtttataattatgtggggtttccagagttttttctgcttttgtttttctaaatttattcaaaaatttatcataattttaaaaagaattcaatactttaatcttacattttctcttaaaaatatttttcatttaactaaaatagtgggttactcacttccacaattattcgtatgcagttttaaaatttatttaatttaaaaaaaggaaattttaaaacttgaaaattggataagatgaagaggtagtttttttatcttgattcagttttaaaatttaaatcataattttccctttttaaataaaaattaaaaatttaattattaaaagttgttttaaaatcatgttgcgttttaaacatttttttataaaaataaaatgtcaagtcaaagtaagtaatgagatactaattttgatattaattaaactaataatgaaagagtacattgacaaatctttatctttc

SEQ ID NO: 5111 - DNA, 1000 bp, Glycine max
  Soy_ogl_589 Gm02:40363901..40364900 Cluster 23
cgcgggacccacagtccaatcaagagcgagaggagaggcgtgtgaaaagaagggtcccacgtgcgacgcaaaggtcaagagaggaaccaatgggaaagagagatgggtctatgggtaactgccttttcttttttgattttttccttcgaataataaataaataaatgcgggtatatccacaaacttgtccctgtcagtttccatcattaaacacgtgtctgtcttctgctcctcgtgactaactgcccctggtttcttttctcttctagtattgcattgatgacggtctagcctgcattacattttccttttttatatcaaattatttttttcctcgtatgttttattttttaatagaaattacaatcaatatttttataatcgaacgggttgagatacaggaataatggattattgatctaatcaaagtattattaattgaactggtttgatgtaacaagcatatattaaaaatatatatatatatctaaataagtaacctaatttaaccatttaatattgtaaatttaaaataattgtcatataaaatatttaatatcccaaataacaaataacattcatattaatataagttcatataaataagttttaaatacaaataatcatctaatatcataaaaataatcataagttcataaagaataacataaaaaagtataatttttaatttcttaaaaaaaacgacactcaatttaagtaaagatccatccagttcaaccaaaaactcacctaattcaactcgagtcatatcaattttgaaaataattaagataaaaaatattttaatttgtacactcataagaaccaaactatatttttaatttataccttacgataaagattaaaaagagtatgatttaatatgttaaagaggtgttcacatgttttgataaccaaatcgacacaaataatttgatttgtattttttaatacataggttaaatttgactcaatctcatttaaacttgttagtgtagga

SEQ ID NO: 5112 - DNA, 1200 bp, Glycine max
  Soy_ogl_1632 Gm05:29653301..29654500 Cluster 23
gtatgtccataaattaatttcttcttcgtagttatatcatgtgaaattaatgtacatagcaacctcatgcatgtttttaaattttatgtgcgggattaatgaccggactcgtgttttttttttcttttcaatgcgttaattttgctttattattacgttgtttctgaaagacttcattcgcattttttaattatgtatctctaatttcattgttaaatatattaaaaaaaggaaaagaatattgacttatgttgtaccaaaataaaagccgatatccatggtttgagtatctgactgagagcaaaattagtagttgaagaagctaacaattcattcatgaataaaatatccagacaatcaaccttatccttgtcaaagtttgtctaatccttttggtcccttggtctcctggtgctacattcataatgtatataaagttcttttcttttcaactttgctcttaacttcatatatatactagcattgcagagaatcaaactcttgttcattgagccaaatggaattgaattttcaataagtaataattaaagaagaatatcttctaattagcacttagcaccctgtattatcgtacaatttctaaaaaacaataaatcaaaataactgtaactgaataactaatagggaaaattgatgcgacgacaatcaattaagaaggattttaatacaaaggaatgtaatttttttttgctgaattattaaaaattatactgttaaggagaactaaaaaaattatttagagaaagaggctattaattgtattttaattacttgatagatatccttattgaaaataataaataataatgatttaaaaatgctttcgtaattattttttatgattcttttgttactttaaaaacaagtgaaactataagtattgtttagaaaataatttctttttttcttttttctttttttataattaaataatcagtaagcattttgtttttccaacccaaacttaaaattcttgttcgtccttaagcaaactcacaaccctaaacttaagtctaggtcataataagtatattgtaagaatgaatctcttaattccattaaaaaggatagctctatttttcaattttggcttataatgagctaatcaaataacaaacggttaaggcttaaagggtttagcaaaagatacatgtaaagggtgactaatttttgtcctga

SEQ ID NO: 5113 - DNA, 1014 bp, Glycine max
  Soy_ogl_2825 Gm08:39215336..39216349 Cluster 23
gatgtcaaaaggtgtaaatatagattttttttcttcttgaaaatatgtaagttttgttttaatcctgtaaaaaaatgtagtttaattttttcttctatttttgtaatattcatcaatacttattttgattaccaccatatagagactaaatggagattattgtattttatagggataataactaaggactaaaaataaaaatatatataaacttatagggtctaatttaaagtaaatattgctatattttgtaaagatataaaaaaaatattatatttttttagaatgtagaacatgttgctaacaataaatttacagtgatcgaaaacagaaacttataacaagttgtatagaccaaaattcaaaaagcaaattacagaaactaaaattaaacactattatatttaaggtatatactaaaaatagaaattaatgtacattaattagaagccaaattatttaaaatatgcatgttcgtataattttgattgttgacaaatcagagagcaggataaaacaatatcatctagtagggttgactatttatggctgacatgacatttagggagattttaacattgaaaaataatgaaaaagcttttaaatgacattttttatcacgaaaaaactttaatgaactacttttaaataatgaaaaaacactaatactaaaagaaattttaaatggaattttatattctaaccttgattttgaatatctttcgtcattatggtataagtaaaaattacctattaattttgataagtacagaataaaattatttgtaaattatgttgtatgttagaaagaaaatctgattagttattattaatagaatctctcatctaaataatttttttttattcagattgtttgaattcaaaacttgaatttgaatgtaagtgaaggtaattattaattttttatcttgtttatgataatggtaattatattatatataaagagaaatattaacaaaatattcttaattcttctgaatacatttgattttg

SEQ ID NO: 5114 - DNA, 1860 bp, Glycine max
  Soy_ogl_5376 Gm16:30188341..30190200 Cluster 23
agggggtgcttgatgtcaagtactagtagtgtgtctctgtagatcaatggaagcccttttatacgaaattcaatatatcaaaaggacttcgacaaggtgagtctttgaacttattcatgtttaatattatcatagatggcttccgtgggatgatgatggaaggtatttctaagggctatttttctattcaccttatttgaagagacaaagtggaggtcaatcttgttcagtgttagaatatccttaaaattaattagaaaattaaagcttttaaatcaataaatcaatatcaatatattatataaaacaaagttattgattgtgtctgttacttaagacacatgacaaacgctgatgcagttaggcctcgcgtaattaaatattatttcccattgaagaaacaaaataaaattcaaaataagaaatcaatcaaacaccaagtaattctatcacacaataactttaaatttatttgttatattcataataacatgctattgtttaattatgtaaactgaaactgattgacgggaaaagaagaatgatagtttagataactcagaaccaacttaaataaacaattttaatgaccaagggcttaaaggatgaaaatatccaacatcttttaatattgtatgtacctttcagtagaatttttatattgatgaatgctaacaaaactcattttttaacttgattgaatccttactattagcgtaataccatgtgccttgcaagaataaagatgcgtctaagtaaacacatcatattcattctttattaaatgcatttttatttgttatattcataatagtagattattatatttaattataataattaagatatgtctaagtaaagtgtgtataataaatatatatcaatttaacctaatggcacgctcattaagatgattttgactagtactctattttgacaactaaatcatttagaagaaattattgtcattaacaaatcaatccattaaatcttaaaaatgatttttctatcataattatatttaaaaatgatttggagtttcggtaatataattttctgattaaactatagtaattatactaattataactacaattgaaaatgatttgtgattataaatgggattgtttttttaggtgggtaagccatgtcaaattttgttgttacggtgaagtacctttgtattcaaccatttgttttcatttgttcatattttgtgattttttgttgtcatcattcagcgaggttggaaaatctttatgtaacaacaaatttgtgattttttgtatagatttgtttatattttgtgatttttatgttacaataaataatctgttataatattttaaaataaaatattgaaattcgaaaattaattaaattgtagcatgaaacaaactatcttaatatttgtattattgtcttttgtaaataataaaagatttgggaatgagtaatatttgtaaaagaatttgatttgatttgcgtattatgggatgagtaattttaaaaacaaatctctatttccttaatcattgtagttatagaatttttattcttttcagggtataatacagagtacacaattttaggtgctaaagagtaaagagagatatttttaaacaagttaatgacgtgttggttcgtgctatttttttattttttatttttgctgaatttgttggttagtgctgatgtttatcagtcaacgagagataaatattgttttttagatttttttttatttactgaagttgtaattgtttgtttttttttgtacttgttgcaggtttaaaataattgtaaaattctggtacgatatcttttaaatattcacacacacaaagttgagttgtaatt

SEQ ID NO: 5115 - DNA, 1600 bp, Glycine max
  Soy_ogl_123 Gm01:38781601..38783200 Cluster 23
taacattttaaattaaaatggtcttaatttttctcatgtatttttattttattttcttgagcacttgacttaatcatatttgataacattttgataacattttagtaagttattgaggatatacttacatcctgatactatagaaatggaataagtttttattccaaaaatgcttttaacctcaaacacaatcactattccatagatcacattatatccatcataataactaattccataataccatgatatacctataatctcattaactttataatcaaaactgaaatattattagtttgatttcaagatcaaaactaacataccacttatgagcattttggttcaactgtagctgtctttagattaggtacagtgggcctcgctttaagtgaaatctttcattgttgtccatttattcattgcaattacaatagtagttaaaatatgatttgtgatctttttattttttctagtttataattttggtcctcttggtaaaaaaacggagatatccattacagtctctcagatctcaaaaacaaaaagttggtcctgccacctaatgtaatgttttgatcttcagaggtttttatgttgacctccagctaacacgtaccatttatcttacatgacatttaattattagcttttttagtggtcatgattttatttgtttacttttgtggtcatgatttttttttaaaataaacattagaaaaatctatttttttaaataactatttattaaactgaaatatctagtcaacaattaataaattttaaaaaaatataatttttatactaattaacattttatttaagacccaatgaaagtaaaatatcgtttaacatattttagccaataatataagatgatttttttttcattttcgattggaattcttttccagaaagtaatttttaaatagcttaattatattttattctctataaataaaatcggtgagttttcattttgattactgtaatgtttgtaattctgtatccttaaaaaaactgaaatcacgatttttagtttataaaattaatgaattttggtttcagtctttttgtaaaatattattctttaattttcactctaaaatctgaaatcacaatttttagtccctaacctttattttaataaaactaaattatattttaagaattcattttagaagtatcacattaaaaaaaacgcaaattagagtcagagtcattataagtcacgccaatgatgtagaaataaaaaatatatttaaatatttttctctcttttttattacgtcactcatcatatatgtcgccttttccttttactttttctcctctaacacattatgaaaaataccttattgcaaaaaaagaaaaatgttgtatagtcctgcatcttaaattggcacaggtagcagaagggggcacgagccagaggtgcatccagaattataggcgtagacatcaactcagacaaattcatcagaggtaattttctctctcatctatctctgattcctctgtgttctcttttattcttctatactcttttttggaaaatcataaagttaaaacttataaagctttacatgaactttgtttt

SEQ ID NO: 5116 - DNA, 1300 bp, Glycine max
  Soy_ogl_3884 Gm11:29636501..29637800 Cluster 23
aatgttattacttaaaatccaaggattaaaagtgatcacaataaaaaaaactcatgtattttcaccgatcaaaatttaggttaagaattaataagtttaacgatcttgtgatagtaaacctttcgaaccaatcgaatgttatgtgatatcacgaggattatatatgttaattttttattttttttataaattgaacaagtagtaacttaaacaaaggaccaaaattgtacgtatatttactattaacaaataaatattaatatattataaatataaatattaaatactttgtaccaataacaaaattataaaaaataaactaaatcttttttaaaaaaagaaagtgaaaaaaaacgtgcaagatatcaccaaaagtaaaggaattttgcattctcaggcaatgcacatttcattcatttttttaataatcaattgataaaatattttcccaaaattatcccaacctatcttttttatattccttaaatatcctcacccttcttcttttatatatataaaaatattctcctttgttgatacatgttaataaaaaaaataccttatactaatccccatacattataataagaaaaaccatatatcaaaagggaacattaactatatatgggcctatatgctactagaacatatgcaccacaagcaaaaaaggaatttctcaaattaaataaatgggtatattaattaatttaaatcaaattaactatgatactggaatctacatatattaattatatttttaaggacccgaatattacaaaagttattatatattttaattataattttatctgatgttttcttataaattgttaattatagtataattttttaaattaatttgtaagtatgataattattataaatcatcctaaataaattatacttaatttaattcaataacgacaataatttaatttatgtaaatttaaactatttgaagtaactttttaatggacaaatcactgttataaaaagacagataatgatttttgtaaaaaaaatatttaatgtaattttttatctgtaatattcattaaaaatcatattaatatatatatggtaatttttaatatgattgattagctattttaatacataattatttgaattattacaaatatttttttaaatattttgcgactactagacccaagttgacggagcaattatcagttaatgaactcaataaaaatgattttaatatattaacatgtaagttctttttaattaaaatgatttttttatcatatttttatataattcaatttttctattaaaa

SEQ ID NO: 5117 - DNA, 1500 bp, Glycine max
  Soy_ogl_2303 Gm07:9185001..9186500 Cluster 23
ttcattgcaaattttggattatttttcttttgcaatccttattatataatgattttttaaatttccattttccataatttatctttttaaataaaaaaacccaaattacaaatctaaacctgtggcgtcctccaataggagccctgaaaatcgtatcctgcacatgctcatattggcctgattacggaagaaaatattgaaaacaacttgtgcttatacataaaattaaaattgaaatcatgtcaacttgtgattattaaaatcaaaagcaactaaaatcgaaaacaacttatgattaaaataaagatgagtttgtttaaatttaaaaacaaatatttttaaaataaatattttttttacataactatgtccccaccctgacacttaaagttaattaagtttgacgagtttgatcagttttttttttttttttacataaaataaaaaacatggacgagtaattaaaaaaagtacttaaagttgaaaatctaaacatatatgtcatttatttattatataataatatgtactaaattttgaacctaattaatggaaattaacaaaattcttcaccattaaaccaactctaattattttaagtatttaattgatggatagtgtaacaaatattttgtattatttatccataaattatttcatcaaaacacatttgtgctatttaatatttttattatactaacaatcatatattaaataaataaaattacagtcaagtgatttgtattatattctttgttttagcggttggttcgtatatagtatattccctctcatgaggggccaaagacttcgtgagcctctgagaaatgtaacatatattatatatactatttccatttgtatgaaaccatgtcaactgtcaaatagtgtcatttgaaacatattgttgaatcatattcaattatatatttagtcacacatacaaatggaccacattactctattttatcactagccatctgtcccaaaagagaacaagtcatcgcctagaatacagatagaggaatcttttttattcagttttgtatttattcagaaatacagggatttggccgaaagaatccaattaacaatgagtaattatattttcactatgtttgcacaataatacttacatcaacgtacaataaagaaatgtagaataagatgaatgatacgataaacttaggcaaagaaaaaaattaatataaaaagaattgaataaaattaggaaagctcatttggtcgttgtgttgagactgagagtacatgtattggcctggctatataacaaaaataaagaaataattgaataaaattaaaaaaaagaaactaaaaaaataatatttctgataagctagacagagcataataatccaagtgttaaactaacaatataacaaagtataaacattaagcaagaaaattagctctgaaaattaagattttttacattgaaaatttagacttggaactgcaagtctaccgaataaacatata

SEQ ID NO: 5118 - DNA, 1008 bp, Glycine max
  Soy_ogl_2009 Gm06:82693..83700 Cluster 23
gatggttctgataattttgttaaataattgtctgatgtgattaatagatttaattattttttttaacttttcaagtatatttagaagacaccacaacctacctattttgttatttcatcttcccctaatctcactagaaaatgtgagaaaatcatcaagaagtgactaaaaattgcaattctttggagttttagccgttgtaaattgtttaatttattttgagtgattttaactgtcatatattatttaattcatttataatcaaattacacatgtaagtctcttaaccacatggccatctaagggagttactattgagaaccaacaaaaatatattttatttttacacagaccaaattaatataaatatttttataaggacaaaattaatatttttaaattttacagggatcttaaacatattttacccaagattaaattattatgagtcttttttgtttattccatctttccattttagatatttgtttggcccttaatttttttaaggtatgcataaaatataatgaataaggataaatacttcatcataaaattaaaagtttactaaaaatcatattaacatgtcaaaagaaattatattgtgttctaatttttaaaaaatttcaattaatttaatagaaaatttattataatgtagttttaatttccttaatttcttcttaattaactttcctttatataatcaaaattgaattctctttgaaataattattttatatttatttaataagactatggaaagtcaagtttaattaaagcatttttataatatttcacataacatttaaaattttaaaatctctaaaaatggaggcaaatcattatttattaattttcttaattttaaacgttaatgtctacatataaattgattaatatagaaaacgtggataaaataagatacgcaggactaaatattttgtaaaaaagcacactaacatatcaactaccgtataaataatttttaaatatatttttagttac

SEQ ID NO: 5119 - DNA, 1570 bp, Glycine max
  Soy_ogl_2747 Gm08:17573701..17575270 Cluster 23
atgttgattctttagcatagattgttgagagaggcatatttttaagagattgacttctgattattcaactaattaagagcttgcaccatgtatattgtagactgaacccgaagattatacgggagtaagtattcattattcaagaaattatccttgagcaagcgagaattcattgttttgcatgctttgtgtttaccatttggaagctcggttttcaagttttctgcacgtgaaggttgacggagccacttatgattaaaaaaaaaaaaaaagagtgaaaaaaagaaaggattaaaagttttttttctagacggcagtcacgataatcggcctcccctgcgctctttgccgatgtttttaggtcgattacattcatcttttttttatatatataacgataattatattaaaaagtataagaagtgcataagcaatatttacatcttcaaattgtcaacattacttaacctcccgacatcgtgaaccaaaataaggaaaaaaaatacaactaaatcaaatgaagagttgaatcttaacatatacaaattatagctgcatagagaaagatacaacacctctttcagcaatacaaactagtagttgtaataaatcatcctatataaattaatacattcaattagttatataaattgttttttacgtttttttcagaatatcctttcacttgaaaagtatgaggctgatctcttgaaataaattcagataattaacaaaatgaaaaaaattatgtttacaacagtattttttttttttttttagtttagactcacggaagaaggagaaataaatgagataagcaagtcctgcttgttaggtgagacttatcctatgtctctttttcttgtatttacattgaatggtgcaacttttgcgacagtcttgatataggtttttcaaagatttaattccttttaaataaaaggatgtactcatttaaaatataagatattttactaacttcatggatcaactaatcataacataagattattctaactcgatcaattaacaattttaagttcatgttatgaataaataatagtattaaatatttaaagaaaaaaaaatattgtatataatgatgttactcaagtaaaattgtatcccaccgaaaatacaacagccttttaaaaaaaatggtatagttgtaagattaaattttaatagatttataatttggtatacatatgcattatattataagtttgatattcataaaaaaatattgcaagtttaaagaatcaataattataattgtacttattttcactttaaaagacactttaattttcactttaaagaacactttaatatgaaggggattcaaaccccatgaacttgaattcatcggagtaattgattgtctcgcagtaaatattctctatccactaagtacaataagtaattactattaagtgacacactttattgcaatcaattataattgctaagatattttagttaattttttaatttttttattggttgaaaaatttatttaattattaatattgttttttaagtagttttttaatatattttagctttt

SEQ ID NO: 5120 - DNA, 1437 bp, Glycine max
  Soy_ogl_3384 Gm10:6269764..6271200 Cluster 23
cgttataaaaatgagaatgagaattaaacttaaaactttatgtatctacttcaatctttcactattaggtcaactttaggggttttattcatatttgttactccaacatgttattcaatattcattaaaactaatggtcatctcacgcattcatatgaattacttgacttaaaattaacataattcctcgcaaaataatcaagattaaatttttttttcttcaatttagtttagtttgttaagttgtgaaacatattatgaatgtgagtttaattactcgtaatatattccgtccttttcccatttacttagcaattctttcctcctccttataagatgggctataagcttttcctctgagtaaaaaaaaaaaaaaactcacaatattaagagagtgagaatttttatagcttgtttcgtcccactaaagctaattttgatgagtttaaaatttacaaattaggcatgatatgttttaaatacgaggtttgaactgcgatattttataaaatatatcttaattttagttatatatatttcttttattatttaattttatataatgttaaaaatgatatattatgacaataaatcatgcgaacttaattttttcacgtaagttattaaatcttaattaaataaaattatataaaggtaaataatttttattaaagtttcaacttaagtaaagaaaaaaaaaagataaatacatatctcatctcgtcatgtcaccaccgttagcagttagacgacaaaccactggtctgttattgcaataatggacgaggctgtgccagggaaatataaccatagcagttcaccggagttcataatcacattaattaatacgaggtctggaaaaaatacatttttagtgcaaattaattaaataaaaagtgttggttctagaggaactctccaaatttatgaggagtgacttaaatagtaaacatgtttaaatttagtggttgtataagttatgtgccgtgtactaataaaaagaaaattaatcaagaaacaatgaatggagcaatcactgtcattgtttacagtaattaactcattatataaaatgaaatgatccagtgccaaaatttagtggttgagctagagaattataagttgtgtccaatatttctttggacaaaaagataatcacatatgttgactgaaattaatatctgatttattggattgaaaaaaatctattgccttttatcctggacaaaaaacataaaataaaataaaatatacaaaatttatttaattaaatgaactagatgcttttggtattacaaagttgtggaatagagatttaattataatttattatttgcttaactcttagaaatggcataacaaatttctcaactccgtccaatcatagtatcacaagttattctattttaatacatttcatttgattcataacccatc

SEQ ID NO: 5121 - DNA, 1040 bp, Glycine max
  Soy_ogl_1804 Gm06:6582401..6583440 Cluster 23
aaattgttatatagtttaattttttatttttgttataattaacttaaaataatatttaaaatattttctaaagataattaaagaatctttatgctaatagtatatcaaaattaaatttataatttacatatttttagtttaagactacatttatcttttgtgaaatataattttaattaagttgataaattcattgtgcataataaagtaactctgactctcttttttaatatttaatttaattgtgtattgaaaatttgaattcaaaataatcaattaatttaatataatatcatattattttatttgcgcactcagtacaatatatgattcatatattcaaaccttagttcttaacatataaagtgaatttcatctagaaaaatatatttgaggaaaatgattatttattatcatactaataatattattgtcttattaaattcatataatttataggttattgtttaattttaaaaagtaatagtttgaatagaataaaaaaaaaacacccccttttaaaatttatagttttattttgacctgattttgaatattcaataataattgcgtaaaagaaaaaaaaaacatttaacaaaccattatagatttattagaatccagtcaagctaaaaaaattgtattttttattcatctcaatttttttatttctctctttgttacgcacaatttattatataagtgtcttttcttgtgagaactttttctttttaatttcaacttgctttctagggcagagccacaaaaaccaataaacaatatttttttgctttccatcatctctatgacagacgccaggggaacagttgaatgtgtctggctaatcattggagctgaaaatggttcgaatacggtcaaatttaataaagcagcttaacaataattgtctttgtaacaataattagggtttcacatacgtatacagatcttatacgataaacataacaggaacacttgtctcattatttctaacactttctttttaatattttctatttaattaaaatttattagaaatt

SEQ ID NO: 5122 - DNA, 1100 bp, Glycine max
  Soy_ogl_3333 Gm10:2950701..2951800 Cluster 24
tacagtattggattggttcaattaattaaacttggttacagattttcaaaacattcccgaccagccaagaaaaactatggtagaaatcaacagactagggacaggtcaattctcatcagttccatctgcctaaaaacagagaactcaataatctcaatctcttgttccctttatcattaattaatattgcgtctcttgcttcctaccacgaaacatacgtacctcatttatattaaaggtccactaatttattatgcaaaagaagaaaatagatagcatttaatatatttttgttttcaattactaaattacaaggagaacatgaccatggctttctcttacatgtgtggaagaccctcgtcatagttctgctgatcctcttcaccattttggctgcatctccattatttggagcagccttctggccattaattatcgttacaagcttagattaatttaaacatgcacatatctgaatcacatttaattactaattaaaatagaattttatcgaactttcaaacataccacatagtggctaacttaattcattcccttctatcctcatgtctctgaccacaaaaaaacaagaaactttaattattattgaggctttcaggtttggagttattagtaataaaatagatcaatccctatttttttacttaattaatttttatactcaccatatatcatttctattataatcttttccttcacaatattaactacagctattatgtttatttatttccacttggggtttatatatctcaagaaagtgtcaaatgatcacttttgacaattaacaggcatattcctatgagtaattgtgatatttaattaaacatcgagttttgcacagtatatttgagaatatttatcttttgatttttctcttttagtttctaattatttacatacatctaaacatatttcaaagtcaaaagaaccacaaatgtctcaaaatttttgtacaaaaaatattattctatcctctcgtggcctttttagatgcactattctattcagtaatctctttattcaccgatattaatctacgcactcatactattcatcgataactcgaatcgggaacg

SEQ ID NO: 5123 - DNA, 1913 bp, Glycine max
  Soy_ogl_6614 Gm19:47397701..47399613 Cluster 24
ataggaaccacacaaaaagatttggatttaaattgattgagaaaaaacaataactaaaattaaagaaataaataatttttttagaattttcttttatataaaagattccaagaacacaaaggagacaactcggatgcaagcaattaattaaagcattggggatcatgtttcattcaatttacctaatagaaagaaaaggcgttaaatgccaaagaagtttgaacagtaattatattgaacactaattatattggggatcatgtttcattctatatattcatgtcacatgttttcttaacatatataatcatgagcatatgttctaggagtttgattaataaagcaaaagttggatgtagacactcgtttatcgcgtgacaattctgtcaaagagaattagaaacaagatttcttgtattcaaatccactttgttgtgaggtgcagtaattatattttcttttttgtcaacagtaattatattgaacactatttcttttgttatttatctaattggggacctcacttattatttaattaagtctaggagaaaatccaaatctctaaaatttaaagtcacgtgaatcattcatgctgcatttggcattttaagttatttaaaaaggggaaaactggaaaagtgcactatataattatatataattaacaatacaaaataattgtttccaaaaattgaagggaggagagacggataataaacatcacgagacaaggtcgtgcatgttaccattgaagacaagaggactaaagattcaaaaattggttaggcaaacctccttgtgactgatttaattaatttcaaccctttcaagtttcaacaacgttaacggctttagcaaagcttaagtcatcagcagaaaattggtcaacttctaacgatctcaactttaggatttgtcacatttatcgtgaagacaatacttggttcttttgttgctcagaatctaggttatacttaatggaattcttttcctccttttatttttgagaagttctttaggtacagataaggactttccttctatagattcacatagttgagttcttgggtatggtttgaccctagctcccaagtgttttgtatcgttgcttctatcaatttattctgagatgagtcattagtggtgtaggaattgaggtgccaacatagttgggatgttaactcctattccttgccatttctcatttcctttttgaattattgcatatacgtacgatgttaaagcagaaatgcatataagaaaaagacagtaaagactaattaatctaatctaatctaatgatgaacacagttcaattcaaatgaaaccaaccctggtgctccagcaggggccagcacattcacaccccatctgttaaggcatacctatttcctaattaatgagtagaaggtgagcaactatgttagtgtacgtagaccattatctgaacaaaaatcattgtcaataagctgattccatgtatgtaataattacttatcttgaaagaaaaaaaaaaacttatagaaactgtaatttaaagcattaattattttgaagaaataattactactgcaattttttttgttaattaagagacatttttaaacaaataattatttctttaaatttagacgttatatatcaagcatgcatctaagtataaagtgtactttgattctttaatttcctgctacaatatttctggattagcttctacataagtgttgagaagtacaaacgcccaaatagaacaggcctacaccaagcaaccctagtcaacctaactcgtgaccactgctcgtccgtacacttcacaggccacaaggtaaaagttaataacaaaaatataattatataaaatttaaatgttatacaaagatcatcaaaacaaagattaattaaatggtcaatat

SEQ ID NO: 5124 - DNA, 1100 bp, Glycine max
  Soy_ogl_6959 Gm20:43616701..43617800 Cluster 24
ttctcactgctcacactaatacaattatttagcttaactatggacattggaggataagacgagcaataaattacagaaggaacatttgagaaatcaagtggtacctttctattcttttctagtcttttaaggttttgcataaaaattaaaaatataatatttttcttcataaaacaggtatgatgttttttttattcttccatttttactcaacaataaatacatattagctagtatttttttatttttactttcataataaatatgtaaattagttaaaaatttggtggaaaataagaatctaagtaacaaaaaaataattaatattatcttaaacaaaatttatccaaaaaaatagatacttaaaaggaatgaaagaaatatatactttgattagtgctaacataaagtggattataaaattccttcaagtgatatccttgtttttttgttgttgttgaaacatttgtacccatttatcattttttttcttttttatgaaagatacatctaacttttatcgccaaaataagatttttggttgttgatgagtttgatgccaacctatttggaattattctcctcaatttgtcgtagcataactttaaattttgattaaaaaaattgacccaacgaaattaaaagagcagcgaaatagaataaaaacaacaaatttctacacctataaaaatcaaacaaatactttagagcttggtgtatgatatattattgggcagaaactggttgggctagtgaagcgtaaataaactttttaaaataaaatggaccatggaagctggtgtttggatttgtcgtgttgccgtacgattggcactgggctatcttatatgttgggtttactatgaactatcatttgggaactactattaattcctacaaaattactctcggcccctatcagtcaagagaaaagatcaaaataccctttacaatatttgatacttccctttctcaccccaccattcttttctcttcccctttcttcgatcatttctattaccctttcctatgctcctctcttcactcacgcaggtctccgtcagtgaaggtattttttttcatgtttgtaaacataatag

SEQ ID NO: 5125 - DNA, 1200 bp, Glycine max
  Soy_ogl_411 Gm02:6032401..6033600 Cluster 24
gaggaaccaaaggagataaaccaactgaggtcacaatgaaaagatgaagtttttgccgatagatgctatatgagaacggaagcaccacaagaaattgcaattttcaattccagccaaccaattatttaaatggtataagatgttacaccaaaatgaagatcaaaggtataaattaacagatagatttttgtatatttaccattatggtataagatgttacagcatattgcgtgtttcattttcattctagaagtttaatttgctgccgaattaataaacaagatgtatggttttcgaagggtcatattttttttttttttttttatcaaccaactactgaactcaggtaatcacgtattatagttacaatcagcgttaaaataatttaaaataagtttgagtctctaagcttattttttcataaaagcatttattttaataaaacaagcagttttatatttacttatgtgtgtctaaattgtttttacttaaaataagtaattttctgtttatttcaagaagtaaactccatctgtttattatttttttttaaagtgtttattttttaatttttttaagaatgagtctgtttcaacttatttattaaaaaaatacttattttaatcaaataaatagtcttttattttcttaatatacttgtctaaactgttattacttaaaaaatatattttttttacttatatattttgagaaacaaatcctatatgtttattattatttttttaaaaatacttattttaaaattacctttttaagtttaaacaaatcagctcataatctttattaataaacgatttataattccattgaatgattttacttgaagtaattggtttgtttaggttaaaaatataggtagagtttctcaaataaattaaaagaaaaagtaggctcgtttttcgcgaccaataaaaaagtgataaaagattgcagcaacgcaactgttggtccaagaatctctttcttggcaaccaattgagaaaaaaagttatgcagcaaaattctctagtactgaaaaggctctttcacaattgctgttaatgtttgtcctaacaaaggatatatagtgtgacaaattgccaatgcattttggactggtatgctaatatggatgtaataggtgagtggtgctggaatttgttgcccactattatttttttagtggaggttatgaatcat

SEQ ID NO: 5126 - DNA, 1445 bp, Glycine max
  Soy_ogl_924 Gm03:37351201..37352645 Cluster 24
cacgtctatcaacatcgattggttgaagaccaaacttatgcctatctgctgcaaccttgtctagcctcttgctgatatctttgatttgttgagccatcttgtaacgaaaaacgagtggattagaagttgataagaagtgacttaccttgtctttggtggtaccatgagctttgacaacttgctttcgttgtctcttgcactcaaattcatccagcatatcttctgcataggagaagacacgtttgagccgcctcagacatttccgcagctcctggttctgctcctgcatctaacagcacaaccttgacaattgagagagaccgtataagatcttgtagatggtggtataaccctagcacccgagaagcttctacgaaagtcggagaagcaagctttgttatgagtaactttgcgatgttgaagagaaatgattcagccatggttatcaagattccaaacatcagaggttggaacgcaaaaacacttgttgcctggtcaacttccttgttcactggggcgaggttagaggtgttaatcatacgtacgctcctaagtcctaaagttcttgctttaaactataataataagaaacatttacgtaaccttttctctttttaattagtttataacatgaatttcgtactttagaacctaataatgttgcatgccaccgtatatctttgactttgtgccatgcgatttactccctccacctctaaaataaataaataacacattgttttggaagttacttatcctttttattataagattttcttaaaacattttttgcattgattatttttattaattattttagtccataaataataaatattatgaattttctatttatctttcatacgaacattggagaattgaagagtttaattttaaaatttaaaaccccactgttattattatacattaatcatttaggtgaaaagtaattaaattaattatttaggtgaaaagtagttaagtagaaaaaagtggtataattagttacaataattttaaggataattttaaaaaatattataattatagataaatttagtgcaattgactaaattaattaatttttttaatatgtgcaaattaattataattaatgtcttataattagagtatctccaatgagagtgtttacatgagttaatcactcaaattagcaaccttaacatttgagtgaatttcatgtaaagcatttaaatctatttgaaattataagatcccataaaattatgataagtatcttgtctaaataattgtgtattgtagatgctctaaggaacgaagggattacttcttgtttagtgaaacatttaatcccttgaggagtgtaaggaagatatgaaatattataaacttattactagtaactagtttttgactaatgcaatcccgtattaaagtttgtttgtttgtgtaattatttgatg

SEQ ID NO: 5127 - DNA, 1260 bp, Glycine max
  Soy_ogl_4436 Gm13:33695741..33697000 Cluster 24
attttttctgtataaaaaaatgttattccaaatatatatttttttatcttgatgattgattctcacacctcatttcttagtgcagcatatttatgtcattttaggtacatgtctattattttctttcaccttttaacaactaaataaggaaaaataaaagttacaaccatttttttcctttgtattttctctcgtatcaatcaacttaaaaatcctctcaccttttttttgtctctttccttcctttctcttcatttccttttactttcatgataaacaaaacaaatcattaataaataaacaaaacaaaataaagttgacccaaaagccagatcctgaaaaatatcatctggggtggttgataacaaaatctagcattatatttcataataaggagtcaaacgacaacaaatctgccattacatttcatacaaaagtgattttaccttgaatatcaataaaaaactatgatgaaattaatacatccaatgaatgttataagtttaagagaattttttattaataaatattaatggctaattgttaattttttattagtctagagaatcaaattcaaaatttcttacctcttttcttttcccttcacattaatggatcaaccctgtaactcatgagatcaaatcttagtatttatttttcttttgagtttttttttttgttttgtcgagaagaattttgtactaataaattgttttatttttaaaataatataaaattattaatttaattaagtgcacaatgcctcaatttcttttgtttgggaggtttgtcatccaggctcaggaggtcaaacttacacacactgctattattgtttcttgcagccttttctctgttggggaagaaaaaagtagcagtaatattttatcctctttgaccgtcactaatataaatcattttttttatatattgcacggtgatttgatattttgatttcctacccctcgtggccatgattttccgtgaccacactctggaattgacgttgcaaataactacaatatacttttgcatgtctcagtttgaatgacttgaggttgaaagtaatttttgaatattaaaaaattatggataaaagaataatatgtaatttttttataattaccgtgtcaattataagaaaagtagaggaagaggttatgttataaatatatgaaaatgtagaaccacagacacacacgttgcattattggaaagattgttaaaatagaaaacaatttaatgttaattttacagtag

SEQ ID NO: 5128 - DNA, 1000 bp, Glycine max
  Soy_ogl_4437 Gm13:33697501..33698500 Cluster 24
agatagttcactactggtcttatcaatcttccttaggcccattttattttatctgtatcctgtttattgtcttcacatcttttccagtttttttttttttctatcagaagtactagccacgtattattagttaaaattaattaaaaattacaaaagtacgaaagagtcctaacaaaaagtgagactaaaaaatatttataattttaaataaattttgatcaataataaaatatatacaaaagagtgtattattaatatttaacttagtatatatttggtagagtggaaataaaagagatgaaaattttaaattaaaatagagagtaaaaatatgaattttacaaaattttactatttatttaactaattttctaccttctcacgccaaaggaagtattagtgtactagcaacatatttgccccttttggtggctcggaagtttgggtttgcacttcttgtgctccaaattgctttttctttttttatctttatttttctttctaattgtttctggagtgcaaaaatacattctggaaactaatttttgaaatatgataaaaaaaaacatcaaactacaaagagagattaaaaaaaaaatcccctattttctccctccaaaaagtccaaacattccatagcccttcttctttgaggactgcggtgttgtgccaaagccatttcgtttgactatgaataaaaattgaatcaaatgtcaagcttatattaatatacgtgtttaattatcaaaactcgtaaaaagtcgaggggagccgtttgggattgatcatcgatagctgtcatcaagatcctaattaatccttcactcctttaattctaagtttgatttttcaacttcttttttattattattttaagtttgatttttcaacttcatcaaccttgtagcccatattaaatatttatagctattattattgtatccatcaataaatttaatacatatattccagattatgattggcgaaaggagtgatttag

SEQ ID NO: 5129 - DNA, 1400 bp, Glycine max
  Soy_ogl_4715 Gm14:6389601..6391000 Cluster 24
attactttttaactttcaactcagaaatacattagttcacacaaaaaaatatataaaattacaattgtacaagcctttgtttggggaattatctaggtacgccaaccttctcacggcgagtataaacttttagatttagaagttagattgtctgaatattcgctgatactttggattcaggattcatattcttttaaagttaccaaaagctgtagaaaaaagttaaaatatctagtagacattttcataattatccactattgttatgaattttctttatattttaaagtaataaactatatcttacattcatttctcaaggtaaggagtgcaacttattctcaatattattttctaaggtgcgtggggtgggcatttttaacggttcaacgaaactaggaattttatgctggcaaaacagaaagtgtctcttgcttatttgtacattgtgtatcccctcgtgtatgtaattgtggattggttttgctattgttgggtctaaatcgtccatagcaatcaacaattttaaggaaccaaagttaccaaaccatggatttagaagcttaaaaacaacttacataaaattaaatgattttgtcaaaatgatcgagtttatcgtttgagattgaagccatatttttccaaggacagcttaaaaaaaaggtaattttcggctaaaactaatatgcatttaccagtcattcagagcacttaaaacatatgcaaacccaagtttgacaaaatgatggattaattggaatatcttttttatatggaaaaagcatctgatcttaacagtttatatgtaccatataatctagtacaagcgttgaagtttcataaaaaagtgtaagcgatgaaggaaagaaaagtaactactacagaatggttccggtgactatagaaagaagatcgatacctaatttgcatacataagtttgtttctggggtagaaatctttctttatatattctaagaaaaacacacaaaaaatgttttctaaatcatttataagagcatctttattactaagttcttattgagttcttataagtaacaacttgcttttgttgaattcttccattagtgagaaatgacgtggctgccggcttgaagaattggttcttatataagaattctaaagatttttgtcatcataaaaataaaatttctcttactcaaatgtagtgtagagctcatattgattataccattagagtaaaatatggagttcttaaatcttaagtgacaataaaagtctcacaaaaagtgtgttaagaacccaaaatgggttctccaagtaaagttgttctaataatcttgtaccattgtacctataaaatggtattgagtaattttcttttttataatatgatatcttgtttatcatctcctttttc

SEQ ID NO: 5130 - DNA, 1000 bp, Glycine max
  Soy_ogl_5792 Gm17:39659401..39660400 Cluster 24
aactcctcaaaggagctttgatggctcaattttgtaacattagtccttctaagcatgataatgccactagtacaatgtgggtagcaccttaaaatttgcaccgataatataagaaaatctttcaacttcagttgcctttctcataaggctattgagaccttcaactacaatgaggggggaacaaagaatcgccctatttcagccatatgcataattgaaaatatgttactactactggttactacaattaggtatttattttttatatataaaaacggagatagtactgtaaaaatcaaactgttaatatactaaacccgacttaaggaacataaactaataacgtaaaaaaatgccaacattatggtggtgttgatgaatatctctttgactggaaaaaacgtgatactttttttttgtatttaggggtgtatagtggtcgccgcacctagtactgcttccaatattgtcgtaatcattatggctttgatcttaaaggggtcaaaagggtgaaaggtaatagattcaattcaagtgtccacaaactaaagagaaaaacaagcaacctattacttatgttctcctttatgcaatttccatacgagtctatcattgtctttcaactttttttactttttgtgttgaaaattgcactattgcagccttcagtatctacctcttaaaaatctagcatgttaggaaagcactccacctaaaggctaaagcgataatggtaacaagttttggattttttttttcaaaagaactattctttttcattttaaaggagattttcaaacctttattgaaaactctttaatacaaaataagacgcgcactattgaaacttttgtggaaaacaaatttgttcttgacccccaatttcaaattttgattcaagtgatatttatttaattctttatgaatatgatctgaaatttgagatttatacatgaaaacaaatattgccgatagctaaacaaatttcattatattgtta

SEQ ID NO: 5131 - DNA, 1100 bp, Glycine max
  Soy_ogl_5584 Gm17:8331301..8332400 Cluster 24
aaataaataaaagtaagcaataaattaaccaatacaacttcatgcgtgcggatgaataaaattattcatcagctttaataataatgttaaaatctccacaacaatttcatttttctcattttattacttccactctccctttaatgtataactatttgtagattaattaagtgatcattttactagtgattgctctctctctttttttttattattaaataaactgcctgtttttgtttcttttataaatatttgttcatagactattagttataatcataatcattgaattttgatttttaaaaataaaataactacaatatctcttttatcctatccctttttgaattttatttaattttcattctagatttatttaagttaaaaatacatatataatacaaatagtgcttctttatagtgcataactatttgaccaaataattatcatatggagaattgttatatcattgttcagaaaatttatcattatcattttacagagtcattttcacttttcagatgagacttgggactagctaaagtgctaaagtgaggaaggagttgtcttttagccgttggattttgagaccgcatatctgcttcattgcccgcacgcttcagtggtccacacacgtgactcgaccaccaaatataatggcacaggcgcgaacccaattatgtgccagttgagtggcgggagtcgtcgtaataacttgttttgatcggttatcaaccaagatgttattaatctaaaaaaatttaagctttaggctcattaataaaaaaaatatttattattaattttttaaaacaaaaaagatctcatgcacatatttcactaaaacatatttaactaaaagatctcacatgtgaaaagatctctctcaatttttactttccatctcactttttattggaccagatattaaaaaacttacattataaccataaaaccagtgttgtttaaaatttcaggcaaaacatgcaattacttataacttatcactatttttgtgattgaattttcctaaaattagtatagttattttttatagatcataaagactattatgaatgataaaaattttatttacaaa

SEQ ID NO: 5132 - DNA, 1363 bp, Glycine max
  Soy_ogl_612 Gm02:42628501..42629863 Cluster 24
caaaaggaaaagtgccaaaaccaaaagtattcacacgtcaaagataatttggaaggtgtgtgtatatatattcgatgcttttgatgaatcaataagagatggttcatgttgttatcgaatatctatcatgatcgtgccgggaattaatttagacatttaaagctaaatatggacctaaatctgactgtgtgctccgatccatttcatcgtttatagttgaaggcacgatagaaacaccttgaagcggataatacaaatagatgtgactgcatgataaaccaagcaagagtcttatggcgcaattttacctatcgtaaacttcatgataaaccaactctgtgaataaacccttgaactaattttcgagattgagttgcatgcaaatctaaattctacaaaaatattagactttttggggagtcaatgtggccatgcattattggctagatcatggcttaaatattatattggttctgcaagttagcctatttaaattggtcctgcaagttgatggcttaaattcttatttgttcaaagttgatggcttaaattcttatttgtttaaaataattgatgagaaatttaaaaatatattttattaaaaaattatatgtgattgtttgttagattattagtatcattgttatgttatcagttaatactataacttcatactaaaattaaaacaaaaaaatctttaaatgacaaaaaaacaccatgttttatatagggatcaaaatcttatttaagtctataaaatttataaatatatacttagatttagacaaataaaaacaggtgacatgaggactactacttgtattgatttcaccttattatcttcttttaaatcaatgttgtgaaaattattttggattaaccggccagaccgagtaccaatgataagattgttttaaattgattatcggattgattatacaattaactcaaatcaatttgatctgacttggattgagaattttttttataattccttaaacgatgtagctatttgaaaaaaatttgatggtaccatttgaaacctgcggaagaagtttgataattcaaatgttgaatgtttggtatacataatattccaacgaagctttttatatataaaacaaagaggtgaaatctctttttttgtattgttaatgggtcattgttgaataatagtatataataatataataatatgttccaataatagattaaattgttaatagctcattgttgaataatttgtaacaatatactcttataatattattttgatcttcataatagtatataataataataattattatcttgatcttgatataatttaatatttatgtttgttatatatctttatcagatt

SEQ ID NO: 5133 - DNA, 1647 bp, Glycine max
  Soy_ogl_386 Gm02:4990654..4992300 Cluster 24
aatactaacgaacttcataaatcacagggtcagcactcaactttcatgaacaatttcatcccaagttctaaactcaggtggtggctcatcatcattcaatagtcaatactataaattttaattgtcatttgaaaaataatatttttagaaattattctcattctcattcaatgacgtaactttcttaatcttttacatgagtattaattttattttgtattaattttttattctttccaaatattattatttttacaataatactgcaaatttaatttaccattcttgagtaagagtatttttagaaattatcctttgtaaattttcttatattgggtgtttaattttatttttgtcaattttcattcctttcaaactctatttttttttttttgtttacattttaaatctagttacattatatcaaattagtcacaaatatttatgaacaattcgaattgacggaactcgatttaaaatatggttgtggttggaagaggaccatcaaggtttcatttgtagagatgctcttcctaacaatgcattgagaatgcatcgccatttatctggcatagcttcgtgtctcacatcacttcgaggatactcttcactatttgcttgattgttcacacgctagagagatttggctccaaatgggtttccttgctcgggataattacctggtgactaatgcacttatttggatttaaagttagttgcgatataattgttgatcacgaatggtcatattagttacttaattgagatttgtttcctttttatctaattattattttcaagacataatgtttttaattctaacaacaaacatattttagtctcatttacactaactagcttgatcgaaatatgaaccaaatgtaattaaaaaatgcattgcctgttaacatgttacctcttgtaccaggttgatcgaaatatgaaccataatgtttcccacgaatggtcatattatattctcatactttgtctcattctccttcttttatttactacatgttcttcattctctctcattccactgtaatgtaatcgaagacaatattttgtgatgttgttttccaaatgtgagacaggaatgagcaatccattgcttatgttaccactgacttttttattcagtgaagaagagtcattttctggggaacgaaaatgcaaaacagaaaggtaagggaaaaaaatgttttttccgttgcttgaaaaaaactaaaatattcaataattataaacgaaaatatcgcaagtttcatatcaaccaatccgaacttgaataattcaatttattatttgcaacttaaaaaacctccaatcgatagttaatttttttcttcgtttgatctccttcatcaaattttcttctatggacaaaagtaaaaatagaaacagaatttaaataaagaaaaccacatgtagtaaaattcaaatccccccacagattatgtttctgtagaatctgaaacataaccaaattattttttataactaacttttcttaggattgtagttcaatagcccagcgtggctttgtcaaagcagaaattgggtgttcaagtcccataaatcctgatggatccatccctctagcacacctcaaaaagacataccccccaaaaaagccacaaacag

SEQ ID NO: 5134 - DNA, 1473 bp, Glycine max
  Soy_ogl_1255 Gm04:6529901..6531373 Cluster 24
ttatattcactttactagaaatagttttttgttttaatttttaggttttaaaccttgatcagcttcagaaaaaaacaaatttatacacaataatgatataccactatgccttatattgggagcaaagctgctaggaacttttaacaatattcttgcaaaaaatccattcgatcgaataactgaaatcttattagttatatatttcaggttaaaaatatgtccattcttcattccgacaacgttcaataagatacagtctatacttacacaagcattgattatgattattagcaaccaattatcacagtattaaatattcattttgctcccaaaataaacttcatgtactatacctgtttgcgctctgggaagcaccctcacaatcagtttatcttctggattagaatcctctatatgcttgattagaaatatgaatctttcacacgcaaagattaccaaggtgtcccatccagaacgtatagagaacaaaaatgattcagacacttgtaatctgaagacttcaagcgtataacgcaaaaactgtattgtgttgtgtttgataaataacaacgtgtttgtacaagtgaagttttcatttttgttagtgcttaataattcaatgctaaacctctgacgatcttttgagattacatgataactgacctaccgttgacgaaagttgtcaaattaagaggctgcaaaatataaatcagtacactgacaaatcaatctaaatctctcgtttgttttttcgcatataacacccatgttaattaaaggtgactcttgcgtacatgaggacatgcatcttgaaattcgattctgctatatagcgtttacttggacaagagggcaacaaatgtacttatgatcattacactccaatacaaatccagcattatatatatgtgcgtctgaatttataggttcatgactgcatggtgatttcagatttatatgtgacaattgcagaaagagtacaacaagaactaagattttgtatttgaatatcagcaagctaatcaataaactttcaactctgatagaacagatatattttacattcgtgtatatacacgtttccgaaacaagggaaaaaaggagtgagagaagaaggaaaaaataggtgggcaacactgagatatatgatgccttcaggtcctagaaaacattatctaattgttactgtctacatatatataaattaacagcgattttttctctctctaatcatataaaaatttacaagccttaataaaagattatgtataatgttatatgacaagtatacttgaagcgtacctgagtattcattttcagtgttaaatcattacttttgctatactacgtatatccactaaacataaccttttttattacatgattagttcttttataagcaagagaattattattacattgttttttttttttgcataaggttaaattattaactagtgtgtatgtatgtaa

SEQ ID NO: 5135 - DNA, 1286 bp, Glycine max
  Soy_ogl_1397 Gm04:443015..44658700 Cluster 24
tggcagaaaatggtcggtcatttgaatacagggcacacattccatactgaaggacatgcaattcatcgaaaagggcacgtatatatatatattgtgctaatcgctagagagaaaaaataatgctgattctcgacaaaagattcagaacacaagaatagcaaagctggaaagaggttatgggacggagatgaagatcagaattaagcttataatttgtctcaaaagtgtgcttgttggtacacagagtttggagctaatcaacggcactttcgcaacgatgctcactgctcagggagggatctagtttcgggagtgatatatatacttttgacggaaaattattaaagtactttcttgcagaattctggatccattttttttaagtgagttgtgaatccaattaaagttagaatttggtctttttttttctttcaaaagtataagttacttttatggaaattatttttgctttttttatttgatttatcggaaattttagtttttattttcatgaattaatttaattcttctatttgaacttgagagaatataaagattttagaataaccgaatttacttaatttaataaaaacttaagtgaataaaaaatactttaagagacctaaatggcacataatttaaattaaaagatcgaaaaataaagccgaccttagggtaaggggttaaagccttgctttaagctctaaaagatatttcttttttactaataatattcttaaaaaattaaagaaaaatcgtctctttaaattttacacctattatgttttttattactttcaattaatttatttctaacaactaattagcatatttttgttcacttaagttaaatttcactacatttagcatcggttaaattgtgccttttagtagaaccaacatagatctcgccgttgtaagttgaatttgaggaaactttttacatcaattattagtagaatcaaggtagaaagtgtcattaacatatttagcccactcccatcttccttcgaatagttgtttggtgtatctctccattagaacaaccaattcccaaaaaaaacatccacatatgagggaaaaaaaaaaatgaaaaccacatcatgcactaaaagaaaattacaaattagcgaatgaacattccattgctaatccctagaaaacctcaggcacttagcgtgggaatcttctcttgctaaatacaagtagctaattagcgaccaaacactgcctcgctaatccttgcaattcccttgccaaccctttacatggtatcccttgctaat

SEQ ID NO: 5136 - DNA, 1900 bp, Glycine max
  Soy_ogl_6533 Gm19:43524201..43526100 Cluster 24
gataagtctaactttaccaaatagtacgtacaggtttatacaactaatacaagtatacattttcctatttcgggccaacaagatgaaaaagagacaaagttgtgtttcattatgaatgcatggatgtttcatgtgagccttataagttaaagcccatacgctttttcaagttgtactatttttattaaaaccaataacatttttttacactttagttaattataaatccatatatcataagtttgatttttttttaaataattatttcaaaattcatatatacaaaaattataatttattaataatagtataaataatattttttattataatgggatctgttttaatgtaagcagagtaacttaatatagatatagagacaaattgaaaaacatcatagagcatgatatacagcatggtatatcactccacagagatatgcaactatgattggtcactgaaccactaacctagaattagttcgtcactgatccaagttgctttttcaaccatggtatcacaaattgcaaagtgaggttcgctttcatctgttgggctgacctgcttccattacgtggaacgcaaattgggctttttctaacaacttggttttcgtccataaagggaaaccctggtgcgaacctataaattctcgaaaacaaaaggtgaaaatggaccacatcaacaaatagaaacttgcactaacaaatgtaccctccaaagaaacttcactgcactgacattgaataatgctacggaaatttatcataagttctaattacgtcagcgaattaatttgagatcgaaattacgagacccctccacttggctcttaattggctttactatctaataaagtaagccaaagtggttcctggtgtacatatagattcaatgcataatatgttttgtgttgtgtcttaatcccatcccaaattatacagtaccttcgactttatgcattaaaatattaaatattagtgggatcttaacatatggacattgtccaattgtttggagtatcccacctcaacaactttatcatagtctttttttacccccttgatatgcaatatgtttcacacatttaaaaatgtcacacgcgccgcgcttatcaaatgattttatcagacgaaaggagataattgttgatatattcgtagataaatcttaagaaatatgttcagggtatttattctttatttatttgctttttacaggtgtaaaaaagcgatatcctcacattcaaaaaaagtgattatttttattttcattttcaatatagtattttttttattaaaaactcttattaatatcatttttattaaaataaaataagacataccctaatctatttatttgcggtggtgagggcgaaaagcagtaactaaaaccgcaagtaccgtaaaatatgtgcttccgtacttgaaagttgaaaccgccgttggtgtttagaaatattcgattcacattcataagaagttattattgttattcaacaaacttcattatcattattcccctctaactctagctattgatatttgataggattaaagtttggtatgttgtatatgataatgatcaacgacgtagcaccgtagtctaaagcaaaaacaaaaaactagcgacgaattagactatcatacgccaaatctgagacaaattaaattagacaacacatttaggagggccatcagattgcatctaaaagatcaggctgtctggtggaggcaaaataattatgcatccattctggcttcttattacatttttgtacggaaacagatatttattcagaataaataagattagagtaaaatttttatagattcataatgtagactaattttatattatcaatgacaaattataatttaatttaagttacattgaaata

SEQ ID NO: 5137 - DNA, 1389 bp, Glycine max
  Soy_ogl_225 Gm01:49409263..491851 Cluster 24
tatgattttgaacgtccaaaagcaaacgttgacatttttttaaaggatactacttactagcaccaaattttacctccattcggcaccccccccacacacacacatatatatatatatatataaaagtggtcaataaaacatgtgaaagtcagtgggttgatgtgtgcaaaccaccaaaaactgacgtggttaatttgaaaatgcgtggataatgattgagacaggagtagcctaacactactattagataatgaaaccatgacctagctagctatatgatgatttgtaattaagtataatacaccaccaacattgttaaagtacttgaccagaatgaaacttcttcggctagcatctaaagcagtatttgtgactgttgtccgattcaacatatataaaatcatgtttttgtttttcttttgtttgtggctggcaattaattaagtagctctataattttttttatatatcatgctatttttgcatactatttatagattttattattcttgctgagttttagtgaggtcagactgagttgtctgatcttctcattctcgatagaatctttaattttcggtgttgaattggggagagatacctgcaaaagaaatttctacgaacaaatcaatggaactttgaagtttttatgcgtctatgtctagaatgagtaaaatgtatttggagatttctcttatggtctatatatgatgtctgatgttgaggaggtaattatgtgacgttcggagctacattggtgaattgctcctctatgtatcgtggatgagtttgttgatgataattgaaattatcatgaatcgagtatttgttgagttcatttgttaataattaatttcaatttgagaatctgattgatcaattttaggaaaattcttccctcccaacctgacaattaattaagtagcactatattgaaaacataaataattgttttaatccaatcttagttataatgcggtccacattaattgggttaaaagtcatctgagaagtggaatatatcacgtgtgaacgattgaggttttagagtttattttacattgttaatgcttatatttatttaaaaactgatgattaaaataaatataataacaattatataaatacgataacttcgtaaagcttatcaagaaattaaatacaagacgacttcagtgctttttctcgcttcctatatatagttgaaaatatatatttaacttcgcaacttttatcaacgtattggttctttgattcgtttacatgcggtgtaaagtatggataaggtttctttcttcttttcaactttttcccttttgcatgcacccttcattctatgataaagatttgaatcagcatctgatcagcaagtttgatggggaaagtcat

SEQ ID NO: 5138 - DNA, 1068 bp, Glycine max
  Soy_ogl_330 Gm02:2707226..2708293 Cluster 24
acaataacaatcctataaaaacattaataatttttttatattaatatatttatttttaatactctttttttattatgatataggaatagattgcataattaatttcatttttttctaagtttaccttcaatctcctgaaaaaaaaaaagagagtatatcttgaatctcaaacaaataaacaaaccatcttttattgaggttcaattgctttattttttaggcaacgctatctcatcagttttagagtgtttgagtcttgttcaataccaacaaatggtaattatctttcgacactctttaatttgaagcacacgatatttctggtgtataatggaacaacgttatactttttataattttgcaaagaattagtgtgataattcataatttttgtagtacagaacaaatttgaaatttccctttttttttcttttctccaaaattaagccgcaatataaatagattgacagaaaataaaataaaaaaagtcggtgaaatcctgtaattgtcaagtggcaggtttcgatcgattctggcaacgtaaaccgattggacatcaaataaatgtggacactggacatcaccgtcacaccttatctctcttttatttctcttccctttacccacgtatgcatgattcgtattaaatagtaggtccaaaaaatattcctaaaaaagctattattattcatcacatgcacaaaagttgtttttaattacccttttcgtactttgtcatctgttctctcaaattgttgctgccacaaagtatcagaaaattatttttaagaaaatgatgtatcgacacttgcatgtgataataaattgtatagtgtgatagaaatagaataaagaataaaaaataatgagtaagtttgcatagtaaatactactgtacataaatctttatattactactctattctttacgtacaataacgtgggtctttatctaaaggtaacgtaaaataacttgggtccgctccttaaaatgcatattaagactttgttctaggagtcaaggaatcatctcatttaatttttagttttttttcttagttaaaaatt

SEQ ID NO: 5139 - DNA, 1019 bp, Glycine max
  Soy_ogl_368 Gm02:4068082..4069100 Cluster 24
tttttttcttttcatggtctcttatatagttgcagtgaaataccaattgacctcagaagatctcaggtttcgacatattgaaacacataagagtcaacactattcaagaattcaatgccaaatcactagtctgtatatcttagacaaatcaacaattcaccttagaagacacatcatccatatgatcatatccatttcatatagatcaactttattatattgggatggagaagccatactccaggcctatttactgtactaaagctgtgtgagatacctctcacaatttctgtaacacttgtagcacctctagtgcaattaatatattattcatattgctgaaaaaaaaagatcaactttattatatgaaaaatctatttatatctctatctctataaatatttatataaaagataaacatagaaaaatccacacaataaagtcatataaaaaattaatatgagaacattcatcttgatcgtgagatcgcgtgcttgctacttattttcttagtcatacaattatatttccctttaaactaaaaaattatcttcataataagatttgacaagtcatgtaacaaaaaagtagacaaataatcgttttcgcattgatgcaaattttccctatttaaacaacgcaaacaactctctttttttagtattgaaaaatttaagatgagggaggctaagggtctttagtctaaataaataagaatatatatcagaacttaaaaaattatatgcgtttcttattttaaaaaaaaaagttaagtaaaaccaaaattgccaaagagaaagttttatcttaatattctgataattaaaagataaaataactaaagcttttattttagacatagcaataaaaatatatttactattagaatttataaaagaatttttaggtcttactagtaagcatgctcagtgcaaatgactaattggttgaaattgacaaacaactcatctaccaatttattgcgagacactgtaataacaaaagtaggtataataatc

SEQ ID NO: 5140 - DNA, 1254 bp, Glycine max
  Soy_ogl_696 Gm02:46291516..46292769 Cluster 24
tttgagtaaaaaagttattctatactttaggatttcatttaggatttcacagagaagataattgtgtcgacttagtttctttattctttaataagaaaagaataatgatttatctataatttttagatcttaaatattatgcaaaaaaattgaaacaaattcttgaattaaattttggtgtatgtcatttaattatttaattaaacataagagaaaattaaaatttgattagataaaagaaaaatatccgttaaattagtttaagtcaagagatagtaagagaaaaataaatctatgtttaaatgattataacaataattaaaaagttctaaaactataatagaacatagtttcttccaattcaaatattaaggagatttaaaataaactgaaagtgggagccaggaaagtgatttgcttctccaactgtggagacttaggatccctccaaaggttagtggttttctatggagggtctgcattgatagagtagcaactagctagctaggaaaaattttaaaaaggagaaatatccaagtggataataacaattatttgtgtcctttatgtaaggttgatcagaagtatgtaaggttgtatggtgttcaatagtatggtgcatttggaactgcaggaacaacattgttttggagaagggagttatgtcaataggaagttgttggatgaggttattttaatggtgtggtttgggttgaaaaacagaatgcctatatatttttaactattcatgggtatctaatccgagagtatgcatctactccttggcatgactcatgggataagggtactatcggagatgagagatatgaatacgattcggtggcattttctgatatattaactcgtttttgtttctcttggctatactgatcgtctgaagatgtgtggcaataaagggtagtatatatactaacgttgccatatgatctcattttgctttttacaagggtatgtatatagttttggtcttttagttttttggcttttagttgctctgagttagttaggtaggtatagatggagaggcatacttgtgggttacttcattctgggttgttattgcaattgatgggtgagaggatatatttcttatgttatctagggagttacttgttggagcaagcatatctcgaattataacttattaaggggcgtatgggaacccttttatcctatatcttctgtctatagaagtttttctttgctgataaattttttaaaaatattttttta

SEQ ID NO: 5141 - DNA, 1348 bp, Glycine max
  Soy_ogl_722 Gm02:47724906..47726253 Cluster 24
tccaaagagaggcacaataccatatctcgatggtttaatatccgactcttgcctggtaaaattcttcacaatcaattacttatcttaaaaattgatttttttttctatttttcttaaactaaatactcttatttttactttatttctcaactgttttcatttattatatttctctcttctctattttcacctactctaattttcacatatttctttatttccggcaaattgtttgctgaaaaagatggcttttaagtttatgttgagggtactctttatagaagtggattagatgaaagaaaatgtatacttcaactaaaactttaaggagaaatatgataagaatcaataaattttggatgattaattagggaatgactttgttgcattttactcccttgtacccttttatattacggaattggaaatagaagacttccatgcgcatgcatgacctactgtgcctcttccaaattaaagaaaattgcatgctggccgcgaacagattgtcctttggaaaattaggaggagatttaattaggtttagaattattggtcactcttgaccatttcgttaggcgattgcttcctgtctttttatcattagaaattgaaagtggtgttattcattttggaatattttaagtttgacgaagtgtaacgaatctcctatatatatagcctgaccctgctattgattaagataatcaagcctttattataaccccatcactaaagcttaactaataccatttactaattaagaagattcgattgtcgattgctttgacataactacagtcgctgtttttctggtaacatttcctacacaatatttgtgccacgaggctagaaacttggtttaaatataattggtattatattagtacattgttagccttcaatataaaaatggatttaattaaccttgagatgttgattttatttttacctaatcgtctgctaaattaagatgcaaaggatctctacttttgattgggttcacattaatattgtttgaattgtcaaagtatatcgacaatgatccgctggatagggttggggagagaaaagaaagtcgtaaaaagatataattactcttgccctttacgcctttacatataaacggactaatttggaaattgattaaatatctctttcaccgctttcttttttatttatctttctctacattgatgatggattaattagaatattatctgactgagtcaagtagtagtatagatagatggttcccaacttataatgacctcactgactttatatttcgttaataataacaattaattaattttacacttacacagctggagatttaccagatcta

SEQ ID NO: 5142 - DNA, 1412 bp, Glycine max
  Soy_ogl_1237 Gm04:5543589..5545000 Cluster 24
gagaaattaaaaatgttcttacatggaaatggaggttaaggagtggaaaatgtagacgatggtacggtccttaatcataatgaagggctcttaatataatgcatttatatgcagagtattggagatgatgggtactgaaaaggaggatatgatacatattgtgtcttaattctcaagcaagagatatatactgtgtataaacataactttgaagaatagagatattcttttgcgatttctcaacttggaattagttcccgccttaacatccaaggaatgaaggaggcttaggtttccattggactatgatacactattctaatgggacctggatgggttggaaacttagaatgtctcaaacgttggatttggatggatgtgttggaaatatatattcctaagtcaaaaagtatttcaagcattgtagcaaaaagttgacaacagagcataacaggctgtgattttgccatgcgtctaacgtattgaaactcgaaaggagtcacagtcacgaaaagatcacacaaaatctaggcagtgtcctgcgtgagaatggggagcatctgcagcaaaacgatgttagtatttacaaatggcaactaatgtttgaatcatattaattgacttgtaattattttaacttaattagtagttttttatttaattatattaaatatttggagggaaaattttgttatttgtaatagtctcatgaacttggacatgattgctttccattaaaaaaaaaaaaaaaagaagaaccaccctgaattctcacggaaataataacttaccagtaattaaaaagtaagaaccaaaaaataagaaagctatgtgtaacttgtaagagcatgccatgtgagagcttttataatgaccttataatacttcacagttttatcatcttcatatttcttttttatttacgacattttgtttggtttgattgaatttgaacataaaatttaaaaataaaaatacaaataatttgttattggttaaaaatccaactaaaaccacgttgttaaaatcacaataatggaaatattttataatcggtaaatagttaatttataattataagtgcctttaagtttctagtatatacttttaatttatacagagtgaacaaaagacgagcatggcatagaaaaaattgatgctcaattttgtaatcaatcattaaagactttgataaattaattattagtttttaaatattttttttgtgaaaacaacttgttagtttttattttttaccaattcattgttgtcccaagaagtacgtatcgacaattctcaacatgatcgagtaagatgggcttaaaaaaggtaagtgcaagccctagaatattgaaactgtttctcagatcttagatgaggcccctccttcctgcacccaaaatcaaaccccc

SEQ ID NO: 5143 - DNA, 1100 bp, Glycine max
  Soy_ogl_1493 Gm04:48615901..48617000 Cluster 24
ctttgtctcaaatatccttttgagagaattatgtttcgaagtacgatcaaatatagtgagggatctaagatctgggattaataggaacaatctatttaaaagtataaaatataaaaatttaaaaatgtttaatatgagattaagatttgacatgtgactattaaaagactggtaacaatttctaaaaatgcttttatttaaaaaaatattcttagaaatactctcgttgaaaaaatatctcttataaacgctctcatgattcatgaatacaagagtacgttgctagattaataaatttatagatagcataaataagaacaatctccgatcgtttagtagcataaatagttgtgaatcataattatatttggatttggaagtgtcaaccatgatattgataacaaaaatatcttccacccttcgcaaatagtaaaaggtattgccaattataatatttaattagaatagaaaaattctattcttatcattttttagtattccttttataaataaattagatttctttggttctagttctacgctttctttctttggaagcccgacaattttattaaaaacattattcgacactaaatgtaaacacatatcttaataaagatttgaatattgatatgtgactcttgtgagggattcattcattccaccaaatacaatttctgatggtacataaaagaaagattgcaaagaaaagcaacaaatatatacaaaagaaatgatgtgataaaaacaaataaaaaaaattaattgtaaaagtttttataaaaaatgtatgtaaaattaaataattctttaaaataatattacgtatatactacacgcttactcgaacagcactctcacatactaattaagtgtaattagatctgcataaattataattaagtaccataagccttatcctatgatactatagtttaataatatcgagtgcggtttgaagtcttcaaggcatctacgcaaattttacacaatatataatatatgattgtatgcatactgactcacaaaccatttaaaaatgggcaatagctagaaatttttgaggaagaatcaccacctactcttaaatagctagctaa

SEQ ID NO: 5144 - DNA, 1400 bp, Glycine max
  Soy_ogl_1859 Gm06:8525101..8526500 Cluster 24
aacatgtctttttttttattatttttacagaattgatccaaacatgctataattaattaatgcttctttgctccgcctttgacttctttaactcgtctttctagaaataaagagatactataactagaatattttttaataagtaaaaagtgattttactcatttcataaattgatccaaacatgctttaatccctatttggtccaacatttgacttcttatgtagatctgtctagataacatctacatttttttaaataaaaagtggctttactcatttcataaattgattcaaacatgccataatgcttatttggtccacatctttctaacacaattgattggaatttcactaagaaaaggaatccagactaggaaaatcgtatatttaaaacacgcataaaaaagaatacaagaagcagaaggtttggtgttatgcgtacaagtggttggtgtttagtactgttgtacaaccttctcaagtaagacagcactacatgcagcacgagggtttactttagggcaaaagtatcagcaagttttggtttatgttctggcattgcacttgctgttgtttgtgattgccgaggaataaagctgtgtttcttgggactgactcaaattttcggaactggacttggatctggtttatgcataaggggtccatacgcggtggtctgatgtttttgtcaattggtgcaataatctgttggagtgtcttagggaactagtttgacagtatggattgtcattgtctcttgtattttgttatccgttggtgcaatattttgtataataatagtaccaattcaatccagggaacaaaatccataccctagttttatcaaattttgttgtcagagagaaaacctggctcccaaacttgcaccatgagataatgatcaaagatcatcatccacagtccttcatccgtcactttgagactatcaacttcattgtcaaatttgaccataaattaaataatcaaaactttgtcccgcatagtatgaaaaccaatattcttcccaagaagtttaacaagtgcatcttgccttggattgcaaaggccttgaaaaattgaatcagtaacttgccttggagtgcaaaggccttgaaaaactgaatcagtaacttgcaccattggctttagaggattaccatgcatcctcatttaattatgcaaacattctatttgaagaggtcatccttaatttgcttaatttacagactgacatatccttatttcccatcactatatctttgaaggaaattctagtttgtttctgcatgtcaacttgttgctactaccactgtctctagttgtttatttgctgagccatcatctttcataattaaaatccaattcaccaaaaaataatctctcataaaacccgcaggaa

SEQ ID NO: 5145 - DNA, 1567 bp, Glycine max
  Soy_ogl_2482 Gm08:3207901..3209467 Cluster 24
aatagaaaacccaaaaaactgatttctcatgctttaactcaatttaataaagaaaaatgataaaaactattgttgacacttcctgttcgtgtttgtgtacgtaattcaactattgacaaatgacaattgaaccttaagtctaaagcctataagctaaagattctcataatttctcttccatgggtttggttttacccctcatgatttttgtacttatattttcctcccttttggtataatatttctcggtttattgcttagaatcttgggcgttacgggtgtcaacttagttgagattattaggatttaagggaggctagcaaaccttggtttaaaaaaagaaaaaagagtcaaaagattaaaacttaataaaatcccaaacatatgtacaactaacataatacttttgtcacttgatttaccgtaattaacaccttaattacaaccgcaatatcacggttatagatactttcagaactacatcgcaattgcaataagctgcatgtgtatgtaatgtaatcgcaagtaacttgaccaacaacaatttatgaggcgatgaggctatttctgtgtctttttatcttgccatatgtgttccaatttcgttatgggtggtcactgttggtttttggtcctttttctcataattgttcgcgcttaattgagtgtttttgtgtatccattatctcaatctgcagttatatcttaattgcgacatcctgtgggtattaacttgccacgcacagcatttatttagaggcttgcatggaatggatgatcaatttagtcaaacctagtcattcttgacaaccatttatttagagtactctctttactattatgtaacaagtaacaaccattgtagtcaatattattactaccaaagatatgttaatcaataactgtaaaaccttacagaaaaagaaggggaaaaaaaaagatggctggaggaggctggtacagaaacggaattgtttcagaaccaatacagtatgaacggtaaaggaaaagtggattttgttaaagcaaaaaggtaactttgagaaccaaaaaaagtttaaagtcagctggataacaatacaaggattatccttttatttgaagaattggattctacttgaaataagataagctgggctcccagtaaagtaaacttggcttcttattccactttatgtatatgccacgtacaaagagaatactttgtttttggaaaaagcattacacatgtgacatgtcacattcttacttgaatcttctcatgtataaatctcttccatccaaaccatatatgtcttcctttttttatcttcccataattactcggctctttgatcgtgcattagtatttatgtctttatttttgtggtccattctccattgagacatccaaccgcattagttgtttttcttttcatagcatgaaaatgatttatctttttttgggaatggggaatccgaaagcaaaactattcctctttctccaaagtcatcccagagactgaagtatgtaaaactctagcttaacagcagaaaattataataacaaaatcgacatagtccaact

SEQ ID NO: 5146 - DNA, 1099 bp, Glycine max
  Soy_ogl_3759 Gm11:5840602..5841700 Cluster 24
cttctttagaaaattgatttattttagttctttattttcttgtgttgttagtgtttgttgaaaaaaaatgtaataaaaaaagtttttattgaaaaattaacttaaactagtgttacagttgaggttgaatttataaattatcaatttttattttattattttcacttttaaaattataaaattatttatagaatattatattcaaataattataacatttctcaattaataaaaaagactaattcatttaatacattttagaaattggatgtgattgaatcacagattctcagtgtacccgtcattaccaggatggacactttcccatcacacttatctactaaactttattgcatcagcttctatgccatgtttgttcatcaccctattaccttgtggtcacaaatataaaagtgcaacttgcaacgtgaaaaagaaaaaaaataaaatcattctcttgtttatcgattaacttgaacatgaaaatacgcaattttaagaaagctgcttttgctatcttgatgaaattgcactttcaaactttaacgctgatctgctgattaaaaagttagaaactaatggatagtaccacgggagacgcccttttgtgcggtaaagaaagtcaattacaattagtcattcctaatccatccaaatctctcattaacctttcacactaatgagtaatgatggattttgcaacaaatagtaattcagccaattcttctctcttcccaatttggaaactcccttcccagtaccaatggtttgctatagattcctttatctaaactgacttggtttgattggcctaataaataattgggttcatgaaatttctactcttaatctgtgccacttcaatcaacgggttagaaggataaaaaaattaattaataataaacacttggttgagtggactaaatatgtgagaatagtgattggaaaactaaattaagaatactaagttcaaaatctacataaataaaattattaacttaaggtagtgagaatactcaatacaacaaaaatatgataataataaattagggatcaaaatagattaattttagggacttaaaagaaatcttataaattt

SEQ ID NO: 5147 - DNA, 1300 bp, Glycine max
  Soy_ogl_4574 Gm13:39494401..39495700 Cluster 24
tccacagtgcaccagatactccaacaaaccaccgtaatctcattatccgtggccttttctcttctgttattgtcacattaaatgaactatcaattgatcattatacttttttttagaggatcaattgattattatatatgtacagcggtatatatatgactatgttatatacttaattttatttgcttctactttatgaattagtgagttaattaatttagactaaaatcttcaaatgaaaaaagcctcagtttgcattaattaaaagccagtttcatcctcttcatgaatattaaagcaaataaagaaaattaatttaaattttatgcattgacagtttgacaaacagtataaataaattgcattttttaattagttacaaattattttaaatataatttttaaaataattattgtaaaaaatattttatgcattgaaaattatatagagaacttttatattaaaatattttaattataagatgtcatatatgattagtttgttattgacttttataataatcatcttacaatatatttattatatttttcattgatcgatagtgtaaaataaaatttcttatattggccatatataaaattaaacttatatattattaaagctaacaatttaatttatcatgatgatttatggttcaacaaaagtgtaaaataatgattttcatacatactgttgtaaagtttcattttattaatattaagaaaatatcaaaataataactctggaattgagctatgggaagtcttcttgttttcatttaatagtgtccagctgttgagcacatgacaagattatagactactagttcattctatttgcacctgttgatatgaaagctaaatttcaatgtttgttgaaatactattaaataatagagtataacaatattatatgtacataagcatgattgggagcacaagaatatatatatatatattcttgaaagttaattgtaatggggagagggtttgggttttgaaagtgaggaagaagaagagggttgtccagtgggataaggttaaaagtacagaatctgaaacgtcaaatcaagataagttggtgggttaattggatgcatgtgtgtgtgtggcatggatcttgtctgaaagaaagatagctagatagatgggtgacttgactttatcttggcctagggttgctgaaaacaataaatgaatgtttctgactgtcatttcacttacgccgttgccaatttgccagtggccagtacccagtaggaccatcatccatggagcaagagattcctttctggaccaa

SEQ ID NO: 5148 - DNA, 1397 bp, Glycine max
  Soy_ogl_5016 Gm15:12517604..12519000 Cluster 24
tttctattatatattataatttgtcgtattacttctaacaaagaagtgtagcttagtggttagctctacttcgtttgagtagttgtgcataggattgaatcctcatggaagataatcttctaattttctttaatagaggccaacaacacgtctcccaagcttcaataatatcagtcggggttttaaaatattgtaatatatataaattgttaggttttttttggagtgggagtaattcaagtgacttatgaatttaagggttctaaatctttttgagttcatatcagcaagtcccctaggatttaacacgtttttcccaataataaattggggcaacataactcataagtgttttgtgagatcctagaaactcacaaagaggaatagaagaaaatatagaagagcggtctccattgtaactatttataataataataaggggtttcgaaaaattcctctaaaaaattcccactcgttctcattttttccttctcgtagttatttacaaaggtggaagaaaaattatagaaatcagaaacacaagaaacaaatttaaggagagtgcaattaacattgacaaaattatatgatttgaggtctcaatcttggaaaggaaaaggactctatttgtgccaaattcctttgcaactagactgtgctgaggattcttatgcggacatatcttttgtaacttcgatcttttacagcaatttataaacactgttttgattcagcatcactaccttgctgaaaatttcatatttttctagcattatacaaaagggctactatgccaaaccagaaacaaaactaaccatggaagactatggcaggagaatctgccaccaagggaataaacatgaaaaatcaaaattcctaataggtgaaccaagcagcaaatttgaaaaatacaataaactttgaatatccctggtgatgattacagacagtgtctttgtagcataagcattgtgcagcgatgtcgtcgcgacctaatcttttcgttaaaagggagtgaattttggggaaaattatttaaaggagagtagtttagtaaaagatggagcgaaaatagcaattccctaaaggaaaaattcaaacaaaaaagggcgaagattggcccaattgggtttggatcgtatgcaaaaaaaaaaaactaaaattaataaacagataaagataaaattgagtagtcacagttaataaagtattttttaaatttaattatttgtatttttgtacttctaaaatttaattcatgccattaatcttattatttgagtaaaatttgtaccaccatagggatagagatgccgcaactactactcttagtgataagaattacttttgcttttctaattcttttcctatatacatatatgttccttccagacaat

SEQ ID NO: 5149 - DNA, 1035 bp, Glycine max
  Soy_ogl_5490 Gm17:3632001..3633035 Cluster 24
gcgcgatggcttacgcaattttggaatcttttgttccatcagttccttacgttacttatgaacatgtgtagggaagctggcatgttacaggccaactgaagctttttgatttgactggaaacaaactaaagctgaacccccattttactcactcgttccactagcctttcttttcctgagttgtgaaatttcatgtggaatattggagttagtactgagttacttgaaggaaggcatgtaccatgcatgtttagatcaatttaatgacattcttcgttactaagtcttcattaaattaatattttcattgagcttcttcttcaatttgttgttaaatggcccactcaatagcacttgtttatcatgcacgttgcctagggcgtttcttgttggaagatatttaaagactagtttgcatgaaagctggtggaattggctatgagtctttttccgagctggcattttgtttgaactttgaagccacctcagtcctcatccattcaatgaagaaattaaactaccccctataattttggaccccacgacattacttaatttaaaccccattaaacgttaagaaacaaacatgtgtatgtattcgagaacagttatcatgtaaaaaatgaaaagaacagttcaacatttaaacataaaaaatattaaagcgtttttttttatcatatattaaagtgtgtgtaactatactaatggatagaataattaaaagttatttgaaagctaaatgacgataaattaaaattcaattagaagtccataataaattatcatcctttagttttgtagctgattagaaatgtgtttaacactttaactatagtaatggatagactaatgataaattaattgttaaactaaaagtgaggttagacttgacaaaataaatcaataagttatttgaaagctacaaaattggctaaaattgaaaaattaatctttagtgtaaaattattaaacttatttattgaattaaatatactttataaaattagatgttgaattagcaaataaaattaa

SEQ ID NO: 5150 - DNA, 1024 bp, Glycine max
  Soy_ogl_5774 Gm17:39204401..39205424 Cluster 24
attacaatttaatctaattacaattattatcgtgaaggtatgatagggaggaaggcagcactatgtttgatggcgataactcatcactttttcttggagacaaagctttctttcagaaaaaagaggctgattttgccaaaagactggtaagttttttttatttctcatcatatttaagctaaattttcctgtaattgtaagtgtatgggtgttgtctgtttggagcttcctgctgctaattaaagtgttaagtagataaaataaagatagttagtgtccataaggagatatgataaaaactgaaaaacttgcgagggaaaaagttctgcaccctatgttttgtattttgattctttaatctcattgtgcttacttggatctcatatagccaaagattgaagtttatgaaagttattatcatgtttgttgtgatttagttttggagcagttactttatcttcattcgcgtgcttggaagtggcgtgataagctagatagatatattttatgttgcaatctactaacttagttggcttttgtgtgaatggcacttgaactctggcatgtactttgattaaatggaccagaaaactaatacatggtaaatgctgcttatactgtatccatttccaatgcttatactgtatccattgccagattgatgcagacattgccgtagtgggaaaacaaggtgaaattgattttgaggaagctaagttttcacagcatttgaagaagggagaagctgtgagtgactttgctaagttaaaaatcatttcagagcaaaggaaatatctgccagaagagttattacaggttgatttttttttttttcattgttatatatgcataaagtaatgatatttgatagggctgctttttggcaaaatgcaaggaacttatgggaatccaatctctcgagttgatgtaattaacaatcacaaattcacaatcaatcactctaaatgctcaaaattaggacaatgatgtgtggattgttggcacattaatcataaacttcttg

SEQ ID NO: 5151 - DNA, 1300 bp, Glycine max
  Soy_ogl_6653 Gm20:255701..257000 Cluster 24
tattgtcaactttaattagaacaattaaacttttcggtggaaacaaaatagggtcttctgatctaaagatttaaccagatggaaatttacatgaagccaaggcaaaggattatatacggtatatatatgtatgtattctatattgaccgaatatctcactagcaaccagattttcataaaacttgcgccattttcttttttatattgttttacttttttgtttctgtctctgtctaattatatatttaagttcaaattaaatgagaagtttgaaactaagaagtttctataataatttaatttaatatgcatcagcataactaacgaatagaaaccgctctaatagtcgtctttccttgtcatacacacaaaacgaatgttcgaattaataggcatgcattttcttttataaatttatgttctgatctagctacagtaagttactacctcattttcttttacacaattctaaactctattcgtaattttcattacccacttcactttttttttagataaacacgtgaaaatgtatgtataattgtccaactaagctacgattataaatgcaaaattttaaatattatatataatgaaattagaccttgtttttcttcataatgaaaggaaatgtcaataacaacaatacgattgctatatatatctgaatgtcaataacatactacaacatttctgcaaaatacatcggacaattagcttcgatttatacatcaatgttaattaatcaacctaagcatattgctaaatgttggattcttgatcatgtgaatggtgaggagcttattgaaaaaagataaaattcacttgatttctatgttaaaaaataattaatctttaactattgatcgggaaatatcctttacacggaccaaaaaaaattatcactcaaactatttcaacttgactggtacatgctacttaattttttttaaatagccgacgctaataattaaaaatattaatttacaataagcttattcaagactaagatacactacaaaaacatgtttattatgcgttgaagagaaacaaaatataaaaatgatgataaaatggtaatttgctacttttttttttaaaaaaaaataacagtaaggagtaaaaagagcatcaaagagggtgagaatagcacccctatccttcgcaccccttccttccttttatttttttcaccactaaaaggagcttgacaaatagattttttagtcttagaaatacacgagggaaaaaaataatcttggataaacaataaacaataatcttacttttaattaatatt

SEQ ID NO: 5152 - DNA, 1396 bp, Glycine max
  Soy_ogl_7004 Gm20:45276805..45278200 Cluster 24
attctcatatttgatttgcaaggaaagaaaagaaaaaaaaaacacaaggttactccagtcaacaaagtacataaaaaaatatgtaagaagaaccttaattcctatcattcaaaactcttaacgtaaaattattttaacttaataaacatttcaaattcaaattttaaacatgtaagttccttaatattcgaacaaataattttatagtccatgttaacaacctacgctaaactaactttaggccaactttaagaaaaacaaagataataatttaatacaagatgaaatgcacacaactaattatcttatgtcttaaaaaaagtaatcatgttgtgtgctaataaatgataacgtcacatcattttctaactaaggatgtaatcaaattgcgttttatgaatgaaatatgttcgactgaattagaagactatatagatttagttagttttgattggtttacaattttcaagacaacactaagaaaattaatttgatcaaattcaagttagcctagatatagtcatgtatatttatatattgtatatagaaaaagattttgaaatgaagcacaattgtaataattgtgtttggatggatgatacgtggtgtgctagtattgaacctataacgagctaatcgagagaaaaacaagagatgcaccatgggattctaccataatgagaagaaatagttatcaatgtaatgaataattgaatatactaggtgggagccatcaaaaaaggaaaggatgatgacaatgacaacccaactcaatagaaacagaaaacgtggcaacaatatgataggatttgaatttgatttataatcactataccaaattagacttttaacagtcgtttcacatttctagccactactgttaaaaggggaaagaccaaacatagcattttagtaccaccatatttaccctaaaaaaacagcaactaattaacagcaaaattgttatattgctgttaaaaataaataatggtggaacacttaaaatcaaatagttgaacaattaaaactctattggtcaatcataaattaagctacaagacggtacttgcaggtgatgggtgctgatcttaaagagtctagatcatccataattggggtgctgatgacgtatagtttaaggtggggggttcctctggaatcttcctatatgcactgccaagttgtatatactaagattcttgaccatttataggggaagcaattaccatattatcaccatttcactaattattataagtctacacgattatgtaggaacaactcaaacccgaagggttaaaagatccacttggcctttcatcaccaaatgacattactttgccttttgattgatggcttcacccaatggttcacatcacatccacttcaattaatg

SEQ ID NO: 5153 - DNA, 1113 bp, Glycine max
  Soy_ogl_779 Gm03:836301..837413 Cluster 24
atggcttccaacctatctcttacaaaaacttgtagaatattcttgaagtggatgtttggagcatggtcaaccaagctttctgcacaagaacttttagggaaggacttttgaaacaccgatagttcccattcaaaaaatgacccttcttggccctcaaggacttcgacccatcaacctctacaatgtgttgtttaaagtcatttctaaagttctggttaatatactgggacctcatttggatacgatcattgggcccttacaaagtagttttattaccaagaaaggcacatctgacaatgcaatcattgcacaggaaattatccaccacatgcacaacaagaaaggaaaatctgacatcctactatttaaaattgagactctgattgcattcagcgagttcatgctatattttctcaatgaatgataattttaaaactacttttcttttaatttgattttaaaagtttatgtctttttaaatgcattggaaattacaaaaatgacccgtaaactttatgcggattttttttggaggggttggggaatttcccagttattctcgggaatgttatatgcttatattgtcatgtttcttacaagctttgaatgattattcccaagtattattgtttctttgaaatgttattactttcatttttatatattttgttaaacttttattaccataaaaagaaatgaaaatgtgatattttcatgaaaacaaagaggcttcctaaaataccattcactttctttttcaatttaagttattttaaattttaaaatatacccaacacattttcaaatatacctagaaataatatttataacgatataatattctttgggaatataatttctgaaatataacataattccttaaaacattcctagttataattatatataaatgataagtaaaaatatatttattactcactttgtttcataatgagcattgtgaaagaagaaaaaaattgtcccaaaatatttattattttattttttaatataatattaattattttttcatttgatttttttataatattaatgaaatgaatcataaaaactaaaaaaattaataatgataaattaaatactgtgaaatta

SEQ ID NO: 5154 - DNA, 1370 bp, Glycine max
  Soy_ogl_5818 Gm17:40425931..40427300 Cluster 24
gttttaaagtcataggaacatgagaatatataagaccaaaagaagagaacaaagcaagagcctatcgcctagacaaggtcacgcccataagtcacgtgagggaagccatgttgacgccgaggaatatggtattgccattccatttttcttttcactggatcgtgtcttcacgcgctgctctgattttttcctttttaactcactttttggcttaagattcaaagactaatatatgaagataccaaattttatttgagttgctgatctttcttaacatgtgttcatttgtacacatgaatatgaaaatcaaatttttaattatatacttaaaaaatattgttatctatcaatcatattacattttattgatcatgctgttctgattctcattgaaatagataaacgacaggtgaggttagttgcttaaggtaaacggcgtcttagacataagacatggaatatttgaacacggagagggaatattggagagcaggattatatgctacataattagacaaatgctagcgttgaaattcttaacgttaacgttggaagtagggtaggggatgcacttctttatacaattcctacttgcacttcagctaagcacttcttccctgctccattcacaaactcacttcctgctactttatagagttatattacaaataaacaagtcattcaaatgcagaatagtcaccatagatgttttattttttgcacaatattacctttaattttaattaaattatgtcaaaattgtatgcttttatgtgtaaagcatcatgcattataattcaaacatattacaatatgagttacactattggtcaaagaaataaaattgatttatattttttaataaattaataaaaaaagtaactatttaaacttcaatttcattcaaactatgatttgaaattcagaaacttcaaatacaacgtagctatagttctgccacgtatgctacttataaatggatatgaaatttaccctatttatgcacggagagggaaaaataaggagcgaaagaaaacatttaaaatttgtattgtttcatagaagaagaaaaaatatataaaggaaattaagaaaacaaaatttgaaatctcttttcatttttctccgttttaaattttatttttctatcggcctaacaaaataatttttctatctatcaggacactgattaatgaatccacaaataaaaaaatattaaaaactacagtaaaaatgtatttgcaacaataaaaagttaatgttttaaagtgggatgtttagtaaaaaagatttctaattttaatgttttttcttcctttttagtttttgattttctcatccaaacaaatttccctctcttatttaatttc

SEQ ID NO: 5155 - DNA, 1284 bp, Glycine max
  Soy_ogl_6845 Gm20:38455717..38457000 Cluster 24
gtactattagagtaaaatatactaattttagtttaaaatggttttaggctttatccatataatgggcctttaggcaattattaacaataaatattaactttgaacatcattactaactaaccatgcttacctgttaaaggattgagtctagtaattgttaggcaattattaacacatttttcaatgagtgatcaactttgttttgcgaccattgcgattcactttttctttgaagaatttcttcctggtcaaaggacaagacaacaatttagaccttcctccctcaccctttttgttttttccttttactcttcgtcttatctactccaacacgaacgtccaagacgttgtacttaagctttattttgaattacaaaaataataccttattttcaaaaatttatatggaaaaaggtaaatagtcaaaagtaaatattactatttttataatatgaaaaataacataaaaatataatgacattcttatgattaaaatataaaaaaatattttcttaaaataagtaatccatcgttttttcattgataaaaactattatcatattattttattctatttttgtcattttacctttcatacttctatctatgattactattatattagtcttggatgtgtgttttcaaaattaattttagattaatgtgattttaaagaattgattttaagtaaacgtgaatttaaaataacatgatttttgtttgcaagtattgaaaaattgattaatattaagaatgttgtttgaaaacttatcgtcaaaattgattttaagtatgtaattactaaaataagttttagctttgtgtgaacattttttgtacaataaataattataacctgtgagcaatagttcaacatagaattacggccaaaaattaaaaacaagacatttcataactaaattactaatttggcacttggcggtgaaaaggttaaattactaaaaagtaatttaaaaacaatatgactagtaattgtcgcaagtcctattttaaaggtaatcgtgcgctatcttcattcttcaccggcaacaactgcattttctgttatatttttctttaaaaaccgttcttatgaaggctgttgtaagtgaacgcaagagtgagggtagcagggttaaaaggaaagggtaaaagtgagaatatacacatcagcaagataaaattaattcttctgactaatgcagaagcaactcgtagtagaatcaagtggaagttgtgctctcttctttacacccaaatatctaaaaaatgataaaattgtta

SEQ ID NO: 5156 - DNA, 1377 bp, Glycine max
  Soy_ogl_86 Gm01:3375924..3377300 Cluster 24
attgctagcatacttttctttcttttttagttgaagtaggttagtaatctacaccaaaatatttgaaaaaaaaaaatccaattatctctttattattgtagttactttattttaaggataaataagtaatttagtactcagtttaaaaaaaaattatctttcctcctctaccgttgaatccatttctctcatatctcgattttctccttcatttatctttaaacatgttgatcctccatacctcctccacttaagggatgtagaagcaaaaaaagtcttcctcatatctcatattatcattcaaattaacatatataaatcataaaatcatatgaaaaataatgtagtggcaagaaataaatcaatgattcaataaagaggcatattgatgaaacttgagagtacggtggtttggagtctgaaacaacaacatccatgtcacctgaaacttaagaaatccaattgagacttcaaattcaacttcaacatttaaagagtcttccaaagttcctccaacaatgacgttacacactacactgctcaagcctcaaagatgaatgcgcgagaagcaaagagattaagagaggagagagaaggttttttttttttttttttcaaattaaggatcaaattactgttttatccttaaaataaagtaactcaaacaaagagatgatttaatttttttatccaaatattttgatataaattactaacatactctaattaaaaaaaataaaaaagaggtgagagtatgtcaacaatcatatatatatgtatatatgatattggatcagcaatgtagtgagaattggcttttaatgtaggatttttcaaagaatgagcaaatggtgaatattatttaggatagaaggattgttattttggtagacagttggagaaaggaagttttcccgttccaaaattaggatatacgactaatctcaatgaaaatttacatgacagcctataaatatcacctgtttatattggtgtactcgtagatctgacttgttaacaaaatattactaaaatatgaagtgaacccaagactttataagagttaaagacaaaattgaatgctagatcagtagaggaaataacagaaatgcgtgtaattagcattaatcaagttttcaaaaagagaaatataaaatataaagatgtgtttggcttgctttttgtttttagttaatatttttttatttataattatttgagtttaatacaaatcaatgtaaaaaattttaatctatcgaaatgcataaatcattcttattcttattatgattttaagataattattataaaaattaataaatttattagtagtttgttattgaatcacattatatgcattatttagacttaaattta

SEQ ID NO: 5157 - DNA, 1592 bp, Glycine max
  Soy_ogl_4890 Gm15:3558101..3559692 Cluster 24
taagttttaagatttcagtcagttcattaatttcctagctttatggaacatatctttcaccagacacatataaaatcaaatcaacaaaacccgcatcgcaatctgatttgcattcgataaagttgccgcttgaatagatagcaaatcgtcaataaatcacagcccacaagtttttcttaaattagaatgcaatttcacgttgctggcactggcggcatatgagtgcattttatgttagaaaatgatatagctagaacaaagtggaccataaaaaaatttgaatgatgcacatgcgtgtaagcatttctgtaatatctgtattctgtaagaatttcacttaatattccccaaaccttttcaaaaatcttatgaataaaatattgtgaaacggacaacatacgcacgcatgcttggcttacgatttttcaactgacgcaaacaaaatcccataaggccataagaaaataatgatgaaaacaacttgcaccgacacacatcaatgtccgttttcttaatactcgtcgcataaattgttaattcatgatatcaacaataatctattctaaattctctgttgaaaaatgaaaaatattggttcatgtaagtaaaattgttgaattcgtggcaatatcacgaccgcgtggatagggaaaacttgctggtgaagactatccccccaaccccatcccacctttcttttcccattgaaaacttttccatttgtcttctgtactttgcattatattattgcataatgaatttagggtggtttttccaagttaaaaatatattaatatattacacattttaaaaaaatatttattttttaagtattaaaacattttaaggtttgatgttttattgttatttgaggtttcagtaaatgagcaaattatttttttcttatcgataaatattaaccattagtattgtttgtttttttggttaaaaaattcaaactcataattttttttatcattagagtaattttatatctttaaacgaacaaattttttttaaaaagaaaaaaaagttacttggtgtcgtgtgacatgtcttgcatggctaacattttctttgttaatttaagtgtgcgtgcaccaaccagtagggcagtagccacgttgaaaaccagggataagtaaaggaaacgagtttggaggttgtaattggaagttagcaataatgatgaataagggagatgattataacactcctttgctttgcggatcatgtcaatactactatgagtattcaactattttttattcatcatttcatcacctaactcctcaaccatgacttgtactctcttgagtcttgatgcgtctattgcctgacctccatcattttgttcacgtggcaattatcataattcaccaaacattcctactcttttctgagttgataatactacgtggttttgtttcattggaagattaatatatagtttaagtttgtttaaacaaatataaagtgtaaataattattttaatgctgtatattgatataatttacttcctaaaggaaaatactaatttaatttctaaataaataaaaattaccataaattcatccttacgtttatcgac

SEQ ID NO: 5158 - DNA, 2000 bp, Glycine max
  Soy_ogl_5205 Gm16:486301..488300 Cluster 24
cacaaaccacttatgcgtaaaataaaggaatggtaagataagactttaccaacttatgtggctattaaaggtacatcaccaaccatgcttacatattctctatacaagcaagtggtttaattcatcactgtccaaacaaaagggcacaaatagggtcaaataaatttgcttcgctttgttccattgtcttttagaagatgctagattaacggattatttgtcatctctaactgtaagataatcttctcaataattagtagctactaatcagttgaaaaaaaataatttaaataactggttgtgacgagcttactcatttgtttgggctgtcaactttgtttttatgcacgctttcctttttaattttctactaccatattccttctaatcaacggcgacatgcattattatatatataggtgtgctacttttgcacgtacaaattatttaatcaagtgaagtgattgtgatcggacacaaataagtaatatattaaaattaaaattgaattattcgaatattatttaaatttgataattgatcgaaacaatttttagtaagaccaaaagtaagcacaaactgtttattaaaaacaaaaaaaaattatgtatagtgtaagttaattacatgtcggtttcatgatcatatatatttaaacaaattatttctcgaagcaataaatgcgaaaaatagtgctttgttgatcaaaatgaacaaaaaataataatcaagttctatatagttttttattccgtttgacgtcaacaagttaatatttcttgtttattgtttcattcaaataattaatattgcgtctatgctctgatatccaaaggtgcgggtattcaacggttatgggatgacaaaaaagttggatcgatcaggatttacaaatcaaatcttcctttttttttattaattaaaaaaaagaaagaaaagtattccctttttttattccgttccttctctacactaaaattatgatgagaagcacaaatcagcatatctttacaacctttttctttgttgataagaatatatttcatggaactcataatgagaagcgaagtttcctggatccgctcatctaagcatgcatgcatatatgtgtaaggtatgcatgcatgtaatataagaatatgttaccaacacaaaatatgtttgcaacccatatatggacatacacatgaatgcatgcgcgcaaaccatttttgtccaaaacagtttgccattcattattcactattgaaataattaaaattagatataaaatcatctatatatatatatactttttaaaaaatctatgagtgaaatttggtcaccaattcgttattttcttttttttcaaagggtttttagtactaccgatctaatcaattaattagttaagactaccaattaaactgtttcctataattttaatttttacacgctgttaatctttaaaaggtagaacaagttgaattagcttttttagtgaacgaactctctcccttggtcgtgtctctctaataatgttttcattgtttctttttcttgttttgttctggaatattgattgttcattggcttgtgcttgtccaatatcagtgtgtgggaaataagtgaagcatagcccgtggaactagggcgcacccaaagttaaaagatatttagaatatataggttgaatgtcgtcatttattcaaagttttgcgaagcctgcataccaattaccaaccatatataatttttatatatttggagaggataatttttttcttaattcataatttcacatatttagtgttgattaaattcacacttgcacacttaactagctaggtaggtatacgaaaaaatgagtcacatacaaattggattcagaagttgaaagacagctttagaccacaccacatagacattgtacccttgagcttcttttttgcttttcttccctttgcacccacacgtgatgaattggccccacatgtcccataactgtcgcgcatgcacac

SEQ ID NO: 5159 - DNA, 1400 bp, Glycine max
  Soy_ogl_1057 Gm03:42905601..42907000 Cluster 24
tcgagtatgagaatggctgataaagaaggttagacatcgatgtctgtgggaacattagatgggatatggttaatcagaaagtgtttttatgtttaacgtctggttgtattgtttggggatccagtaggttaactaatacattaacaggtatcatctttcttatgcttatgtcccaatgcaagtattgtatctttcttcgtaaagctgagaaccgcgacagttctggaagggctattgttgtgttaggcaagctgcacttgtatggaacttgacgaaccttgtatggattgaaaatccggctacagcttgattggacatgatgggttgatttagattaagactaacttgctttgcatgcatgaatgctaagatgaattttatatgaattatgaactcatacattcatgtatggcatagaaaggaaacttgaaaatgatattagcatgtcactttcagtgtgggtcagcatgtcataatcaagcattcatcaatcctcatgctccatgatgtgtgatagtgttcaatatctatagctgctggtccattgtatttgttttgatacaccccgaccacgtgatgacattagcttgagaatgtttcacggtctttcgctgttaagatagtaagatccttaacaatgcgtagccaagtgaatgatgaaaacacataatatacacaaaccggacggttccgcaccaatggttcctctgatgtgacatcttatacaggagaaattttttgacacattttatgaaatttatcgtgctagacttagtttagaacccaactcaaattcggcgtaaccatattttctgacaatcatttctgtttgaatgaggatgagtttgggaaatgtttcaaattctaggattgggtaattataaggtaaaaatataagtcctcaaaattgatcgtacaagttgcaaataatagtatccataaaaatttcgtgaggtggtgtgactgcatatatttccccttctttacttttgtttcattgcaatgtggataggattccataaatataatatgattcatgttcttccatacaggagttggaaaaaaaggaggtcccccacttttatttctgtcggaataatattataatctaatcaaaataaaagcataggccgaatcagggtcccagtgcattcattacacacacgattgtcaaggaaaatggtagtaatatcaacccatgttcattagcaatagtttaaccacgtcgaattggcatgccttggtcaaccgcatataaacaaacatactacacttaagctcctgaactggctatggaaaataatcaatttcaactattttgattgtgacggacctttggaggttttggagacacccaaaacacaattaaatgagacgatgaacaaaataatgaagagaag

SEQ ID NO: 5160 - DNA, 1300 bp, Glycine max
  Soy_ogl_1176 Gm04:2171201..2172500 Cluster 24
ttgtacattcccttatacaaattatgttataaatagtaaaaggactatttattccaaaagattatataataaaataaaatataagttgttttgtccaatcatatcctgccataacctgccataaaaagagtctttggtgtatatgtgaattatcaccgaaggggtcaatgctttagaaagtccatgccaatatgtaattcgtttagatttccttccattgattgaaatttcatattagagctttgaaacactccatcagcaaaatctttcactggcttttttgttgtaatggtgataactgagtctaaaaccttgcatatataatctaaatctaccaccactacactgaatatagtgatttcaaaccttcagttggttgcacctcgttggaaagttaaattggttaagtgtaacggtcaaaaccttcgactgagcctatcactactaggttttggatatccaaccccgtgatcatccatcattcgtttgctatcatttcttagcatatggttatggaccacaccatgagctatatgtattctacactgtcttcctactagacaccaaggcttttgggaattttcttctttctaattgctgactgtattcgaattctcttatgacgaaaggaatgttttttaaatcatatatttttaactcttatgagatcttcctaaccataattgctcacccaacgagattttatcgatgtcaagaattgaacccgtagccattatcctttgaaaagatgaaccctaactccataagattttcatttactatgtacttacatgttgtcatttgcgttcaaatccttgatcaaccacaagtcaaccattcacaaacacaatctgcaaataaatatgataacgaatagattaagcctaagacgtgtgttagacacattatcattaacgacttatttgcgtaatgtgcaaaccccccaaatttatcaggctcctccagaataatcgggatatcaggatatcagaatggactagtaaaacatgtgaatagataacccaaaaggagataagagaatggatgataccatctcacatggaggaaggagagaaagcatcttgttatagataaaaaaaagtcatataataataatgtataataaatataattaattaaaataatgaataattatatgtttaaatgaggtattaaaatcaatttaaaacaaaaattatggctaactaaaatggtaataagatatggcataaaatgtcattataccggaaaatattccaaattaaaataaaaaatagtaaccttttgaaatatacaaaat

SEQ ID NO: 5161 - DNA, 1000 bp, Glycine max
  Soy_ogl_3588 Gm10:46711001..46712000 Cluster 24
taagaatatagaagaaaattaataattaatatacttaaaatgatcatatgcttcttgtatttaaggtaaaaaaatatttttattttatttgttatatatataagattgaaagtagtatcatatactattacacaagcacaagtacacaaatttattaaaattttctttaccttatattaaatttatttttatatatctatcaacatatcattatatgtaatattttccttataaaaaaatagctggcacatatatacacacacaacacaaatgtacagcccaaggagtctgctttttcacgaggcgtggcagtgttgttgtttttagtttgtttttttcttctcttgcacttataatatgtcacagtgccgcagaaaaacatgtatttagcagtagttttatttgagagggggggtttgacaagacagattgacaatgagacggggaatggggtgatgaaggggttattactccatccaaatccaaagacctagtcaggaatgcccactacaccacacatgacagcaccccaccttcaacaaagtttggtgaggtctctgaaaaagagagatcagagaagtgatgtctgatttgacagtgttgttaggattgccttcaacactttggctcatgaaactcacatctttattcccatctttcactcaaacaagccctctcttctccttccattatcatcatcattcactcacaccaacttctgagttctgtgatgagattgagcatacatacatgcttgatgtttcatctgctcgtgttatttctaggaagtttcaatgtcaatgcagtggatgcacactatttatgtctcgtttgaaatagatatatagtgcttgcttgtgcctttttctttgctttaattgaagccgtgctagtcaatgcagaggttacagccttacaggacatagtatatagaaaaccattgccttccgacccacaaaagaataatcagacaacatgtgaagtgattggatttcgatcc

SEQ ID NO: 5162 - DNA, 1300 bp, Glycine max
  Soy_ogl_4112 Gm12:37015501..37016800 Cluster 24
agttgggaccctaacgttatgtttagagacaagaagtctcatcatcatggtatttttttttcccaaagaaattaactatgatacacacattagttgtccctagtgcaaaagctataaagattgagtggaatgtggcgggcaaagaagaaaaaggagagggagggccatatcaatatatatgcattaatgttctcatcatcgttattacgtatcagagagataaacagtgacatggcatcacaagcccaaaatttggtccaattatgatacataaaaaatatcaaagggtctatgtccttatgtggaatgtgggggatactattactgccttcaacgtcatcaaaaagggagaagggatttgtggggacgagtatattagaccatcttatgagcttggagcctaaataaattattctccaacagaacctattatagtgccaatggaagaaggtaatgaagaggggtgaagacgacttataattacggaccttcacacacacaacacatttcatgtttaataatgtatggattaaggacactttaaatgcttttaattacatttgtataatctttgtatttttatatttgaatttttatttatgttaatatcgattaccgtactattaggtattatttttgtattttattctgtttattgatttatggccatttttaaaactttaattcctttccatgatttattttttttatattatgttaactttatatattataaccatacggtatcttatatagtttttaaacttatcgtatttttatgtgttacactatctcttatgtttcctagaatttctttgttcaggagtcggttggtagaagaagctgacaaagtattaaaaccaaagagatactgtagattgtagaatatacagtgtaaaaaaaaagatagataaagtgaaaattacaaatcatgttcatgataaagagatggtttttcacttacgaatttgtaacaagaaaattatatatcactaatgtaacatatatgtgtatatattatgtaattaagcaaaaactacactaaaccacaatcatatataatattcttatgtgtgaaaaaaggggaatttaataagaatgtattgtctttgtaagtttttttttttatattattaactaagaaataattgttgataatttttttaaaataattattataaaaataaataaacttgtaatatatgaaaatttataattaagttacagtgttagagtcttttcgttattatattttcttatgggcgatgttgtttctgttggttaccctcgtggatattaa

SEQ ID NO: 5163 - DNA, 1000 bp, Glycine max
  Soy_ogl_32 Gm20:39167801..39168800 Cluster 24
atgagacctatggtaatatgaaacattaggattttgatagaaaatgaaacggtaaaatatttaaattcagaaaatgaaaattattgtaattaatttattttttaaaaaccaatggttcttaatttttattgtttagttttttaaaaataattcaatagactgttttcttgacaatgtgttaaatcactagtggagatacatggtttaaattatagaaaatcctaatattttaaaattacagactgaaaagtataatggataaacagcccgagcaactaataagtgaaaacactacatatatagaatagccggttgtggatgagggaaatcttgcatggatttgatatttatttattttttaggtcaacaatttagatctactgggtgcaacaggaaccaataattttaatggaagatctatggtacaaaacatatttatataaacctcaaatcacaaagtagatataattttagttcttttccgtggctagttctccacaaccaacaatcatgggaacatcgtccagacatatggttgctcacctaacatatcacaaaatttggtcatgttttgcttcagaaaaagcaaagaaagatgcattgaactttgcttatttacggattaaggaaaatagaaataaaagtaccaagttacttaattacttataaaaaaaaattaaaagcaagttgatttgttgtattaaatcccctaatctttcttaggtcgcgtttggtgaacacccttgtaatataaaattgaaactaggcctttcaagatctcatctcttgagtagtttggatttgttcactcaatgaatagctgaagtgactacttcttaattatgattatctctccttgattttgagataaaccattgtcatgaccatacccaaaaagcatggaacattgttggccattgcaatgaccattgatgatcacctattgtcgtttgtaaggtagctagatctaaaaggcttgcccaagtaacgtcctttccaa

SEQ ID NO: 5164 - DNA, 1400 bp, Glycine max
  Soy_ogl_435 Gm02:7225301..7226700 Cluster 24
tccattcctttgctgaaatcgcacatgtagatcttgccaaattgcagcagtactgacagagtaaataacactcgcgacaatctccttgctgactgaattcaagagccaagaagatacaatgctattgttgccaatccaggcacgatactaaggatgtccttcaacaggcttagggattgttttttccatcgagatgaatctaatttcctgattttatgaattgaaaaaaactattacactgtgttggttatataactaatcactcagttagttacatgacagctaagcaattactctaacaaactaacagctaattaagagttctaataaaaacgaatctgatttaaaaaaacatttgtttaaaaggataagtttgaacatggataattaatgcatgaaatgaataaggcttcaattaaaattttagagattcccttttgatttattacactgtctggctacgtaccatagacttttctggtgagtactatgctattgaagaccatttaatttgcttttgtactgtgtagaggtgatgaattttgactgcaagcaaattttccaagcaccttctattacacatgcagcatgatcacataagatcaccgtacgcgcatcgctgatgaatataatgcagatggcaggatcattagttagacgtaaattttttaatatgggtatttatgataatgtatgtttcgtacaaatgaaaatgaagaaaaatctgactatatatatggtgtacaatgtatatctaaatacaggctaacttgaatgcacataaaacctccttttagagattaattttctttcaagctcaccgaatttttgcttattttctccttcaattacgatatctaacaagttttaaagccatgaatagacccttacaaagcacactctaatacacaacttactaagcgctaggtaaagaatggaagattacttaattaattaatgtgtttaatttaatgttgggagaccccaaataatcgttgaataaaaaaaatctgaatttctatttctcataagacatacgtgaaaatgtatatcaacctaacattaaacataacacacccttttatagcgttattgattgtccaaacagaatcctttctttcttggttctcacaatgggtgagataattccaaacagacagttactatttagtatttacactctcccttgttgttaatatactcctcttttcatttttttcctaatctaccctcctctctttctccttctcaataaatattcttctagaagaattacactcccttctctaccagtgaaaaattttccaaaaaatattcttctagaaaaaatacactctatatgtgaaaaacacaatccttaaatttttttattgcaacctaagttccatccaacaacacct

SEQ ID NO: 5165 - DNA, 1100 bp, Glycine max
  Soy_ogl_1567 Gm05:3070101..3071200 Cluster 24
atgtgaatgcacgtacattaccggcttattggagctcatccgattataattccaccatatacatgcagacatggacacggacattgacacaagagtatctcattcaaaatcctgttggtcctaaaagtaaaagaggatatgtatgaagcattcaacgataaatgttgatcgttgatcctcgtctgaagtcgaaaaacattgaacgtattaacctaaaaacaggctacagaccaatccctttcggttattttgtgtgtgtgtgtatggaatggccctattgacgagtgggcaaattcaaaggcctaaacaaaaactagccttataaacggattcactcactatggcagacacaaaaacctactttgatatgagttgctggtgctagcaaatacattgcgtagcgtagcggccaaaaggtccactgaaaaaacaaggccctcttagattattatttattgttgtgagtcataggtatgggatgtttttcaattcactggattaaagattattattatttgggtatgtgattatttacaaaaataaataaacacatgtcctttttgttaaataaattattttttataagtgaacgtaacagttcaggattgcttaaagtcctcttgaattagcatcatattataaattcatattacaatatttcatattatttatcacgtatgttggcgtatttgtcgtatttcctctagtgactggccaaggtgaggtgacttgtaaattgagcaattgggcaaaatttaaaagaggtgcttagccatcatatcatgtgaaggtggataactaatccaaccaaaattttctttagcactaagctagccaatgaaatgccaattctggtacccaccatatctcgtttagagattctgtacagggacaaacaggcaacgaaagcaacttcattcaagcccaaactacagtttctaccctttccccattgcattggattctcagttgtatcaagggtatattagtcctttcataaaacatctccatgaggaaccatgatggtgtatctagttctaggtgtccacgttgaagcaatacacagttgtgggaaattatagcagtataataagactaaa

SEQ ID NO: 5166 - DNA, 1024 bp, Glycine max
  Soy_ogl_1824 Gm06:7210694..7211717 Cluster 24
tgaacctaaaacttgaattttaatcgactcgaacaatatattttatgctttataatattttaaattatgtcatataatttaatttgcttgtgtatatgaaatatattgtaaatttgacagatttaaattaaacgtaaatatatttttattttcttgctttatacactttattaaattcgaataactaataaatcatttttctatgatctttgagttcaactaactgataaacagttgaaggggttgtctagctgattcactccttttttgagttctaacttctaacaacattatttaattaattaaggcttaaatatatttttccggttgtattataatctattttgattttactacactacatcatcacttaatctaacatttggctaaactagaagaattgttagatgagcgaaacaacagctatttaggttggtacgcacgcatactcacccatcaccattttccattggacctttcacgtcatggttcatggttgggccttccgcttaaaaaatcacataaaacgaagttcaagattgacattagagaaccttagttattgataaacttttattttcctattttcttgcaaactttggtattcctttcagttttatgcggataaaacaattagtgaaaacttaatatatcacttcaatacaaatacatgtgtatcataaatgtaaaattttagcagaaatttattatatttcaataaaaattattgatattttagacagtactaggtccacagggaagagcccagtgcctcccggcccactaatcatgtaagcataacagcatcatacaaaccaagataatgttttccaccttgacccaaaaggagcaaatgcaaccaataaaaccaatcaaaaccaaatcgttttgcatttcatctttattattaactaaaaattgacaactaaaaagatccaggtgtacgaatatggggtaattgtctaaggatttaaactatgttgatttaaataccaaaagaactatattgattcaaaatttacat

SEQ ID NO: 5167 - DNA, 1300 bp, Glycine max
  Soy_ogl_3493 Gm10:41100601..41101900 Cluster 24
acaaaattatgatatatatcaaccagaccacaaaatttgggactcaaggatcttggataaggtagataatactcctagtatgcgtgaagagaacataaatggggtcctggattcagtatcacaatttattacttgtaataaagaccatgtagtgagagctttctccaagaacacaataattgcgggtcaggggtcctggattcaattccataatttattacttttaaagacgatgttgtaagaactttccccacctcacttcagttgcttaataaatttcttgaaagtggaatattctgagtagatactactccaaagtaaaaagcatgcataaccccatttagcttagggaaaataatgaaaggaaaaagggatgcatgcatggagggattccaagtagcaaacttttctctactaagatttcacatctggttttctttgaaacttttgtatgtttgattctgtttaatgaatcataattgtctgcaacttgcgggggatctaaccacagtccacagtaggatattccaaatcaatcccatttttttcttttacaaacattacactattatgacagcttgcagcaccttataagtactttggcttgtcttgcaatttcatatatcatttaaacatgaatggagttgcaggatagaagttttacttaagtgttggccaacaaatttttatacctaaagtaagttttgaaatgatttttttttaaaattaacatttccacacattttgttgtgtgagaatttccacacatgtgacatgaaataaatcgattaaaagaacttgaactaatttatgttaattataaaaaaatgtgaaaaaatagacaagtataaaatcaataatcaccggagaatttttgtttatttaaaacacatatatattttattagagaacttgaaactttttattaagttgaattaatctcatcagtagattcacgtgttttttggtaataagtttttatttatttaaataattttgtagctaggttctacataataattaacacaattgtcactacatagaacgattaacaactttttatttgtttaaataattttttaacaaggttctgcataataataaacccaaataagttttcttcacttaaaaaattataaaagaaagaaagtgtagggaatgtatgtgattgtgacacataagggactagaggagtaaacggaacaataagaatgtgagacatagagacagaacaataaaagacgtacgtgagacacataaacatagcaataagggacttgatacacagaggcatagtaat

SEQ ID NO: 5168 - DNA, 1800 bp, Glycine max
  Soy_ogl_3974 Gm12:2255701..2257500 Cluster 24
ggatccaatgtcattcccatctttgaggcccatcttaatgtgttaaggtaaaaattgctttagaatatttttttgactctcctggcccttgctaagcttcactaagattatattgtttttttccacttcaaggcaaagaggtgcaatagtggtagataatttggaaatagaaaatttaagcatcattctcaaccctctccaaagtggtgaaatgaggaccttattggcagacttcaagttgtctatcaacgattatctgcaggagctcgttttttctcctgtgagattactagctgagattattgaattcaacatcaatcaccctgatttagtaagtgtttatactatgatttttagatgaatagtagcatggaatagggtcattactttttctggcagtgtagctcgtcaccccacatttttaagctgatattgcttcaaattcatcccaactccaatactataaattaaagtatttatttttctattggaatgaaagtctcttaattaaggacaaaacaagttaggccaagattcatcagatcattaaatataaagtttgattaatagtatttattttcttggcataggccattttttatggcctaactgatttattaaaagtttatttaatacattttcgttgtagcatgagaactatatacaaaatctacagcaaaaagttatttgtacaggaagtgtatctttgaaaataaaagaaaactatccacgtggatagtttatataacactttggtagtgccaatagtaactttccaccaataaatggagtaacaaatttatgtagcactattgccattcaacggtagaagttgtagttactagactcttctttctctcattatctattatgctgtcaagaaataaggttacgcggtcctctacttatacgtgcctccaacaaatgaataaacaaaagaatataattacatcatgacactaaaagaaaattttaaattatgtgtttgtttctttgttaaaaattatctatcaatttttctgccttaactttccttttatattcaatacttcgaactttcatctaccgatttgttaaaaattatgtgtttgttgatgttatttttggaaataattattttttcaaaagctatcttttgaagctataaaaggataattatttctttgagataaattgaagcagataagttttttatggtacaagcgacacatgtttcaaaatgaatactttatattaaaggatgtctgatttaagagatatatcacatctttatcattgaaaccattgtctaattcataaggccaatctatcatatgtgttagaaaattatactgtgatgtgtaatttcttatgtttgaacatataagaagctatactttaggaattttagataatgtatttcccacatttatcattttttgtaaattccgtaagcaagtttagaaaacttaattgaatctataatgcagtgcagaaattgccatttgatattttctcaaatcttctttacgtatctcttctgttactccctttaatggcttgtcttatgaaaagtatctctgccctaaaagtttttctcggagagagatgtgtataggtgaggttcttttagaatgaaaaccaaccaaccaacctcccataacaccctttttcaaattcatcttttcatttgattgccaaaattgccctttaactaagtaagcaaagaggaaattgattttaataattgttaatcccaaaatgactttacaacattttaagcctaacaactatcatattaggcatttttttaatttaaaa

SEQ ID NO: 5169 - DNA, 1584 bp, Glycine max
  Soy_ogl_4810 Gm14:47752872..47754455 Cluster 24
gtaatgtttaaaaaactattaaaaatatttatttactaaatactcaaataaattttttaactattataaaaaaactaaaaattaactaaaatatcttatatttgtcattgaagctctaaacacaattcaattaaattcggtcggacaatattatgggactaaaatttgtcagcatctgtattaccaaatcagggaaggatactctgttcattattcaagtatcttcttatctacatcctgaagaagtgaatattcagaagaaagagtacttgaaagttgaaacagtgtgagagcatttaataatgctaaattactgtacacaaattgcaatctagtactataacatggtttcacttaaatcctacgtaagaccatagaatactaataattttagattaaaaaacaataatactaaaaatggagatagtggatggcggctacgtagtgtatagggtggtgggtcgtcatatttaggttttatttttcttttctcaacttcgtatctgttttggtcaccaaccgtggggcccaccaaatcaatcccattcaagtgttttcacgttttaacatctttaacccattgattttgggaattttttttctctattggttgattaattcgcgaaagaagatattaaataaacaaactcacatcatatatcttaggaattgtttgttatctattactattagtcatgatggtggcaccaagcaagagctagactcgagtcatgtcttagatatattgtatttaaggatttatttgtatagtgtgcaaatccttcaatatataagatacccatcctataatatgaacagagaacagaaactgagaagaaaaataaaagaaaaagaatccaaagagagaaaagaagatgaagatgttctctgttttttgtatatttgaaacatgtgtctaaagacggtatttatagagcgggagaagtaagaaaaaacgataagagaataaatgataattaatacatttaaataaaaataacaaaaaaaataattgaacgaaaatctgattgccatgataaaaacaaaaattccataatttttgtaatctcatcatgtcacaagacacaagttttgaaatactaaactactaatatatagtgcatagccattaaatttaaaatgaaaaagaaaaacaagaaaataaaagaaaactatgtggtgcaactcattattcaaaatatcagacccactacaaggctgaaatgctaaaagaaggtcctgcatcgacgtaaggaagctgagtgtatttaatgtgcaaggattagaagaatggtgtcactgtctgagattaaataggtacatataaataacatataacatgatcacatgtgaatcaaagtaaaaattgtaaatctcactttttgctaaaaatatattcaagaggtatgttaataattgtttcaaaaatatcggttaaagtacaaaattgaaaattattaaatagaataaatgttttttaagtattttctaaaaaaattgacaattaatttttagaaaataaaagtggaggaagaagatgaagcaatacaagaaaaaacatcaataatgaaaagtttgatgtag

SEQ ID NO: 5170 - DNA, 1900 bp, Glycine max
  Soy_ogl_6173 Gm18:54514701..54516600 Cluster 24
tcttttcttggccctacttcctcctttcatatacacacacattcatacttaaccattttaatatataaaatttctcttaaataaatcatataaaataaatacatgagttatgacttttttattttaggaaatgcttttgccataaatcttgcctctcccaagtggtgatactcccctacaattaagattgaagttgcattttaaattttcccgcaaagacaaaggaaaaagccttaatcacaatattgcatcatctaatactccattattataaatggttgaacaaacctctaagaagttagagacgtggaaatcatatgttcgacctcatttcttgaattgattccacttcactatattcagcgaaaccaattggatttcaatttttttttttttttatcaataatagggagttgaacaaagctaaacacgtgttggttggggtatgacactatgactgacatagtcacctagggtacacgtggcttgattcccttgatttttcatgattattaattaaggagttttatggagtaggagcgtagcctttttttttttcttatgaattttctcgttattgtacttcttctctttagtcttctacccagatgttctttcaatctctagtctaaatagcatataaactcttataccatctcacttacacaaggaaagaaggaagaggattataagaatccaaaacaaagtaattgaaataaaaagaaaatcagtggtgaatctagcagtcttaatatgatattgtcaacaatccctagaaatgacattaaaaatttgatgagaattttgttttaaccatgttaagtataccaatcatgcatattgagtaataaaagagtaagtagaatatccttttcagattgattaaagtatcaactactttctcaaaacaatactttcgagtaaataaaagataattagaaagattacgaattattaaaaaccaaacaaagaaaataaattaaaataggaactacagaattttttattttaatttgaattatactctagttctattaatttgaattttcatgaaaaaaagttccattgttattattttaatttctttttcagtttaacttttttcacctgtattcctttagatgcaattctatttaaggtatggtcagagtcagatactaatatgagcatttagtcctgtaatatttttcattttagttcttaattttcattttttttcaaaaaataaattatttattaactctttttatatattatttttactgtcgaataccattgccaacagtgtacttataaaaaaggttaaaatataatttagtctctttctcatattttaagttttagtttgattttttatgtttcaaaattttcactttggtctcttaaagttctctatcacattaatttgataattcttttttagtttatgataccaatttagtcaatttagtggtatatgataaaatgtaaaagatgtcgcgttatgtaaattggcatcattagtgtaaaaatctgattgaacgatgaatttggtgtaacagagacattacaagagagaaaaaaaatccattggtgtacttgacacgatgaaaaaaaaatgccattagttataccaatcaaggcgtactgatccaatatgacaattttttagtgtatggaccaaaagatcactcacgttttaacaataattaggggactatagtttaattgtcgactgtgtattctagcttgttaaaaaaaaaatatgttgggggtagcaagttttaaaattaaataataccagtatactatgacaataggttgaggcttcgaaaaaacattatgaggtctttaaatatttgggagagcctcctttctctggtatgcggcaattgaattctccgatccagttctcttattg

SEQ ID NO: 5171 - DNA, 2000 bp, Glycine max
  Soy_ogl_6735 Gm20:33947401..33949400 Cluster 24
atgaagtaaaatattgaataccttttctttaattttctaaattatcaaactattaacgaaccgttttcaaacccatacttccattccatgtacgagcattctagaggggggaaaataactctaatcacatttcctccttggatcctcatttggtattaggatttgatttcgtgtctctttcaattttttccttcattatgtttttaaactttttttctcgtgtatcgtggagccctttcaaaatgcaaaattttaattacacaacaattagaacttaacagtaacaactaatggttttacaataaaataccagacatatttaatatgtatttgaggaatcaacctcctgcttgattcttaattagacaaattaaagttgaagcctaattttttttccaaaaaaatccttactaaattctataaactattactgcaaaaattatcaaaagataaaacattcaaaaatatattttattattttcttatgaacccaaagtatctactacgaagtcgagaaattaagatgcatttaaagaattgatatctcctagaaatattattaagtatatattttttttatttaataaataaagtgatggattcaaaaaaacattagtcgccttgcatgcttaagtcgtaaatgattttgaacttattgattaagaaatattaattataatagtaatattataaatccaatttaaaagacatgagcaaacatgtagaaaaagacaatcttactatatagcctgggttaaaaacaatctcatattcaattattcaaatagctagtgtgagaatatttgtcacaaataataataaacattgttagtccagttagtcatatatgaaatgagtcgatttcatgcaagctttattccatatattgtatattgtgatcttactaaacctaatatttttatgtgaaaccgatcatgctgcttcgaattctccgagaatgaacatttataagtgacaagatgaacttgacacatttgttgatatatgatatatataatttcacatgttttataatattgaggtattccttcattcttatgcggtttgtttttacatttatccaaatatacattgtaattaaggtcaaatattcaatgattaggtttgtgttccgggtgaaacgatttccatcatactgatacgtaccagggaggcatgatgattggagctacgtgaattctgaatgtactgtagtttaaattttttggcttgttacaaccaaaagatgtgttagtgggaaaaaatggtatgcttgaataaagatgcagccaagatcgtgttaatttgtgattttactatacaaattacaacatgatatatgtacccaaaaatatatggaataccatgtaatcattttcaaaatattattttatgataaattcattctatactggctaggagaactattaatatataactgtacacacaatgcaggtatatggaagccaggcaaacgtattttttactcttcaataatggacttcaaatttgaagtcttttgtcgcatgtaattgtgtctaatggtcccttttttctttatctcatactttgtcaaaacaagtgggcaaagtatggggtcgaaataatttgtcttttgcctaattcctaaaccaaacagtctagacgcaccctttgattgattagccataattaattgttaaacaatgttttttggagccagccaaaggtggaggattcatatcatgccttgatttaagtgttcctttcagggatttagtgatggaaaatgaatgttttgttaattaggtgtccttgaatcaaggaagatgtgtgtggaaagaatatatcaaagaacgtggggtttgttttgcatacatggattcaccatcccttttttgacaaaatggtttcaatgccaaagaatgtcaaaccgcattttgggcgtagcaggttgtgcattatacacaatggtggtaagaagaacacgtgcgttgcttagccttttggattctaaaaaa

SEQ ID NO: 5172 - DNA, 1200 bp, Glycine max
  Soy_ogl_802 Gm03:1987101..1988300 Cluster 24
taatacagaagggtaatttgggaatattaaaatgttgtgggtgtaattagcaaaaatggtgcaggacgcaaaagcctaactgaaatggggtaatgaaatgaagaacaaacagcgcacggcctatgttatgttcttaaaaacataggttttaagggcgcccacattatggacttaaaaatatcacattctttgttataagttttgataaaaatattctcagaaatatttgatttccaataatatgaaatatttatggttttattacttctcattctcatgctaaattgtgtgtatcttgtaattccttgagaataaaaattattctctacaataactattcattcccttttttttcttcacgtttattattttacttttaatttttaattaaataagttttatttttttctaaaattcctaattataatgacaaccaaacatgttcttgaaaataatgtttccagcataacatttctagaaatataatttccaaaaaaataattttataactttaaacaaacatcctaaaagtttagcaacatgcgctcacaaggacggctcaaaaacaaaactaagcactcacagtgagaatggataaatctctttaaacagtgagaaatgtaaagaagatacatttatttggaaaaaaaattattggttgaaatttattaaatattacaaaatttattaagttcgtatcatatttaatgaaccttaaaactaaattaaagaggcaactttttattgtttcaaatttgtgttaaaaaaaaacaattttttcaacaattttttttggttggtttaggcaaataaaaaactatattccattttttttcatataatttctacatgggatattattatgtggagtacaactcgtggaaagcgtggacttggtgaaatgcatggctcaaattaatctttgcaccaaaagatgacaacatcacttttcaatcacacaaagggataaataaataaaaccaaatgaatcccattggcgaatatgccaaatgtggcgaagttaacaccaaaagtcgtgaatcttgaggttcagctcaagtctcataaaattaatgttctttatatacatgcataatttttagtgtagtttattagttagttgggggaggttaagacggtttggttctgcaattgccaaaccttgtattgtgttgttcatctttgattgtgtccgagtca

SEQ ID NO: 5173 - DNA, 1781 bp, Glycine max
  Soy_ogl_1498 Gm04:48807120..48808900 Cluster 24
ttagtattaataatgtagaaggtcctaaactagtctagctgtgcagagaataaggttcttggcgcaattccaaaggttcggaattgagaacttaaccgtaattttttttcactggaggcttcaggaaaaatgaagattctgtctgtgcaaaagaatatgtacacagtaaatcttcggtatgtggacaaaagaaaacttatacatgaaaatagtaaatatatggtgttgtgctttccaggttggtttattttcgaataattagtctatatagccatacctatgctgtggaatgtggatggtgtcttcggcaatcattatatgaatggaaatggttaaacagttgacaaagtgaaaatcacacaatcgaaaattgcctacttactattttttacctgtgtaacatgatgatattttgctacatttattgaagcttcttatctcttcttgacaactttctttaagataaatgaggttattgattaaattttactttaaaaaaagtgtgtaatatatgtttttagtttgtacaaaggcaaatgttaataagtgaaaatactcgttatggaattaaaatattgttttattgaaatgtggaataatatgttcttggtgtgttttaatgtgcttccccatgacactagctaggatttagggtttatatacaattagttataaatagtgtctcgaacaacattatttcagaaaaaatacctataaacaaccaaaaggtccttataaattttaaattttctaaaaatatactagtcatgcatgcaccatgtcgtggcaaaacactaataagaattatttttaaaatttattcatttctgtaattttttaaaaagattaacccatttgtgtaaatttgcccataaattttacacggcacaactaaaatttctccctccaatggaagtgacgacaaacgacgatgaatgaaaaaaaaagttaaaggcttaagaagcatctgactcaaagacaaacaacagggcttgagatcatagacagggcctgcagtatgtatgtgaattcgtgaatcataattacatatgattaatagaaaaagaaacggaaagaagattagtcaaagatcctttggatgatcacatggggaagcaggcttggtgggccaaagttgttgtgactccaacagagaaaagtttacggtaacaattgaagaagttggacactactcattcatgaatcgacccaacttattttatatataatacataagatgctattctaattcatagtcacgctttagctttactaagaacttaagcatggtttctatatatgactactaatgttatttcctaatatattctacatcatgcgctatagaagccaatgataatcttgccgttatcgaagtagatatgattaactaaatcattaaagtgaaaaaatcaaaattggataagccagtccaaggccaaaataatagtagctatgaaaaaagttacaaattaatgcctacacatgaaatatttcgtcaactactttatttaatttttaaaaaaaaattataaaagtttaggtgaaatgggttttaagaaattcattaggacaaatctcaaaagctcaaaaaacacttacatgtataattacaaattatttattaacaaaatttaggtgaaaattaaacccatatcctttggggatgtgagtgtgtttttgttcacttattatttcttctttggtaatgcctgcgttgcttttggcatatggaatatgaagattcgggcaataggattttatgaacattggtaatgaaa

SEQ ID NO: 5174 - DNA, 1332 bp, Glycine max
  Soy_ogl_2430 Gm07:38620686..38622017 Cluster 24
tttgacccttgaagagaggtggtctattaactgcttgtccttctttcttgatagtgcttaaggatcgttcttatccttgcactgctatatgttcaacccctaaaggcagagttctattacaaattaaaataaacaaataacacataagaaggggttgaattgtgtgtttgtgaacttttaaacttttttggagatcaagatataagttcgaaagcaacagtgcccctaaggaaaacgtgtagagggatagagaaagagaaaaacacgcaaaagatttatactaattcgtttccaacctcattcaatcctttcagtggcatggcagagcttgaccaattttttgagggaaccaaaataaaagtgatattcaaatacttaaaattcaacttacataactaaatgcaatttgtactcatatatatgttttcattttcattaaaacaaaagtgagcacacactgtaatacaactattagtatcaaataaacgatcacatctatacttaaaacatggtctttcattccttcaaatgcttgaacgcattaataattgaatcagagataaagttttcagttatttatttttcaatgtaaatgaccatattatctgtaagaaattcatcttccatcctattacacaatcttgttttcataatcttcattgctgaaaaagatctttctgttgtaattatagaaattgaaaaagttaagataagataaactaatcgatcaatcaaataaaatgtaattaattgtcttattctttctgatgatcgacacaattcaaacgtgatgtataagttctttaaatctggattagtatgagtaggaacaaccacaataagatgttaaagatataacttcaaactaatcttttcttgttctctaaaatctatttttttatgcttcattgttatatctattaaaaatattactttcgaattaatgtgacatttatgatataatataagtcaaagtatatacaaaatgataagaatataaatccaaataatataacaagccacagaatggcaaaaagctataaaaattagagtcaatgtaataaaaaaaaaactactatataatctaattaattacattagcaaaataaagaaaaaaaacaacaccaagaaccagactatgaaaagccaaagttacggccatctaacaagatataagacattcaataaataaattttctaattatagaagtctaagaacctagtaaaagataacattttccacacacctcaagttctcaacaaatcaaatatgtaattcttgagatgtctctaggtgacaggctagcagcaaagaagaggcttcaataatgc

SEQ ID NO: 5175 - DNA, 1516 bp, Glycine max
  Soy_ogl_3715 Gm11:3916201..3917716 Cluster 24
tgaatgttttaatgaaaaattatattgtcaataattaatttttaaatgaaagtgttcattgtttttaaatctctaaaaattgattttaataaaactgtttagaaaacatcttgagtgtagaatgtagagacatcatgctcctccaataatatagattttttgtcaaagggtggaacccagtgttccctgtcttaggtggtgtggttcggtggggggtctccatcctttcaattctgggagcttagttggtcattattcagttttatcttaaaccgttaacacaaccactacccacatacattaacaaaaagtagtcataagagtttgtaggacaatattctaagttcgaatattatgattaccacggctgttcttttggaaacaaaccatatccaaactcttctataatatgttattaagtttctacctatttagttcattcaaagttgcaatcaatgaactaactcaattcaataaacttcacttccaaagagttttaagtttactttcttttcttttcccttttaaatgactttaaccgctctatcatatcgacattctgcggttatagaatactacattcaattgggcatttgggtccaacaagtactaggagcttagacaattaacaagtcctaaagataatatatcattttattagattcatactatatatgaaattaaacttttttttataccgcaatccaattaaaaatcaccatagagtaagcttttaactttgatgatgattactcacttcacagatcataccaaagatgagttatagtgtaaaaacttttaaacttatgaatgtgtctattaaactttttttttttttccttccacttacagaactctcccggcaatcaaagaaattgatgccaagaaggcaacaacccaaataaagaagccgtccaactgagtaatggtctaaattttcaactttcaattgttggacgtaggtttggtcgcgtgggacatgggtagccgaatgtgaatgggaagataaagtttaggctgttcgtagtctacctgctttgatccgttcaaaatgtagggtctaattctaaatgcctaggctggcccttccctcccccttttgttgttcctgggctgggaccctgtgattcccaatataattgttaacagcccttttttcttgttttttttttagttgttcagtttaatattcttgataatgactactaactgttaagttgtttcttgtttatattcattcccccaccatgcttgaaggagtcaccttccttagataattatgattatttacttctattaattttttattattagaagtcaatttatcaatttaactattgaattatgtaaattatgtgttatttttgtaattatcacgtggtcaaaattttacatgatttatatacttttaaatatataatcaaataatagtcatttatatattttaaacatgccatatctaaaaacaaaaaggaacgatgcattggtggtgttaattcatttgttaattgttaaa

SEQ ID NO: 5176 - DNA, 1400 bp, Glycine max
  Soy_ogl_354 Gm02:3584101..3585500 Cluster 24
caatctaaaagaaaaatgattgtagaatattttatttatagattttttatgaccgatcgaattatataatttgtgtctactccactgaaacggcatttttttaatgtatctcgaatttcttttttagcacctccaattgcatctttataattaatcatcaaaccaacccctattgaagctaactcataaaaaaaatagttttctcaaaaataccacttggtgaaactttctatcacttgttttcgataacagtcatcgaaagaacatttgaatagagttacacttcaatattcttaaatatcatttttcattggtttttcatatcatgtctcatttttgccggaatgttatttatcaaaagtaactctctatcaaacttttagaatattttccataacaaataacataaacctatattgaatcaactgacctgggattttttgcgttaaatagttggatatataaaatactttatcgttttataatgatcttatatgatcgaatagaaagaaaaaaaaatgatagaacggaaactactcctataactaattttatctaataaggcgttagtgatgtgtgggaaatgaaggaaagatccaaaatctaaacaactacaactataaatcactttgcctggctgcaattacttaactggtcactgttttacatttgttaatgtttgctatgtgtttggctgttccttgatcggtcttcagccacgtgtgttctggtttaaatgtccaatagtggtatttgcttcttttaattttgctcttatgctgacctagtaccctctaagtggttacttgggtgctgacaatgacttgttttggggttattactgcccttactattggttacaagatatgccttagtgatgtacttggtttcagtattctatatagtttataatttatatattcaacagaatgataaatttcttttttttttagaaaaaaaaagactttgaaggccaagaaagcacatccgtaaacgaacgagatttgattaatgaatatttataaataaaaccctcttaatataactggtacattctaatccatttacgatcgagtgttcaacacgatctttaaatttgtactttcagcattatattatgataaaaattaaacattttttaatttaaaagctaaacatactagttgaaaactaattataaaggatcgtgattctagtacgattgaaatgccaggacaaagtaaacgaaaagagaaaaaaaaatgataaatcgatcaattataatatattatctttatatccagacttatccagtagaaaaacataaacaactttgtggaggcttatcgcctggagtcatccatcatccatgagcttgacaatgtttgtcactcattctttttcctaaaggtgatcatatt

SEQ ID NO: 5177 - DNA, 1409 bp, Glycine max
  Soy_ogl_2510 Gm08:4975224..4976632 Cluster 24
atcattattatgtaaaaaaaaaaaacactcgttgttacaatctcacctcaattggtttaatttatgaaccgcaaaatctactccttgatttcatgtatgtaaggaagttatttatagaactagtacaagatactaatgaattagccctcctctgtgttatctttgttttgtgtattgagatgtaggaaaaatgaatgttagttagaactcttcagcaaatgagtaggcttgcttattttgttcatgaatggagtagcatctacgactttattccatttttattaatcaatgaccttcgaatttagttgaattctaccaaaatcttacggctgtgtaatactaccggagtccggaaggtgcgactcagtggcgatttttcatttataaacctacatgttatcacaaattataagtatttttgtgtgtgtatgtataaaagggaagataaacataattattaacagaaaatttaaaacattaatagtataaaatataatttcaaaagaaaatactaggctatatatataataaatatttgagatgtaaataatgtaaaaatattttttttgaaaaaaaaagagattaaaataagtgtaaaaagaacatttcaaaaaataattaatattttccataatcattaaaaagaacatatttttagcatccaaggttgatggggcacaaccttgtgggcggttaattgggaggattgagtattctatcaggtgcaaaacttatatgtgttgtttttaaatatttttattgttattttctaatcaaaactagaactttgtcttaaatacgtatgctaatttttaatataatttttttattgtacatattatccgtcacgagtgtagaattctaaaataaaatttattttaccattcacatgggtagcaattaaaaaaaatccatgtaaaaaaagtaaaaaagaaaatctacatcacaccatacacagttcatttttttaaggataattgaagaacaaatatttgaatcctgctattctaaaatcccagttctcataagtttcatcactcaattcccaccagtgtaaacagaataataggaaaaggctaatataaaaagtagaaaacacaaagcaattgtttttggagcattaaagcaaaggagcaaaaaggagtggcgtttaaccaaatctagctttactgaattctgcaagacatttattagaatctatgcgggtgtcaacggtgaataacttttttagaacaataataaaaaaatattgttgactctaaatgaatttctataaaattcaaaaaaaatgaatttctataaattaaaatcaaatcttttaaataagatttttgtagaggttagtttataagtttaatcaaaactaacgaaataagagtctttaaatgctaaatcaaaccaagtattac

SEQ ID NO: 5178 - DNA, 1500 bp, Glycine max
  Soy_ogl_6767 Gm20:35179201..35180700 Cluster 24
acggaccaatagcattcaatctaacttgctgaataaacatataaaatccaataacctgacacaatctccgtgcgtacccctccgcacctttaaattgatcaggttcagattagtctagttaaaagaagaaaattctggaaaaaaaataatacaattatcaacatttagtttagcttgttcaaattaatattaagttaaaaaaaggaacagaataaaataaaaaatcctcacggtttaaatcattatggcagagtcagtagtgtttatgtcaactttattttaaactttattttaaaaaccttactcctaaagaaaaacattaaaaggcctcagatttcaccctatataaaaatgattagtttgtttgtttagctttattttaaacagtagtaactgtgatgtgtttagtgtttgagttgaaagggaaaaaaatatgaagcaatgagtagaattttgtgaagaatatttttttttaaccttttcatacagtaaaattaattgtgaatgtgattcttctacactcacttttaagatatcattctcaaatacaaatgaactttttgattagttctttcaacatgaattttaccattatttaaagaaaagaaccctttattggtataggaaatcaacagaagagttatacaggtaatgcagctaagaaacgtgagtccacctagctcctatgcagtaaaatttcccaaccaggacagaaaaaaacttagcctgttgttctctttaacataaccataccaagatagaaatagttggaaaagaacaagaagcgatccatgcaggagtcattgatgttagcaaacaaaaacctcataacatgtatcaaccaaccttgtgaagctgctcgttaatctgtatatccaccatgaacacatgccgagctttgctgctttattagcattacttttatgattcttccactaattgccgcaggaaacaatgcaaggaattacaaaggacggagagcttataatcttgctggctagtggagaaatgcttagttgttgtttttgcatatgaaaaacaagttaatggtttaatgctaacatcttaacacaacaatctcaaatatgaaatttattcgtttaaagaaaatatatttaatgtaatacactattctactatcttttcttgaactttgttataaagccaaatccgctacggcagaaatgaagcaaaaatcctcctacctcccgcgggcacataatgggaatgatatgtcagaaagaaggcatcaagaatccaagatctttcaatgttggagcagtttggtatgctgtaaattgagtgcatacaagcaaaacgtagaacaagtcattcccttgtgcatctgtaaaaactgattgtcaaagactcaaagcacatgagtaaagaagaataccaggctacagatatcacaacttctgagagggtcactagttcaagatactaaaaaatcaagtgaccgtgagaattttcagattctccatcatcactagatggggg

SEQ ID NO: 5179 - DNA, 1567 bp, Glycine max
  Soy_ogl_261 Gm01:51045823..51047389 Cluster 24
gaatggacccttaaggtttatccaactaaaatattttttttttgttttttttacgggaagactaaaatattgattccatatatatgattagttatattatacagttacaactatattggtagtgtatttagtttttaaggctatattatttgaaagtaaacaaataaatattttaaaataataaataatttatgaaaagaacatcatctaaaaatgagaaggaagtagtagatgtgatatgtgtgatgactttgttgcatgagaattgacaggtgaccctgcagcaacattcactcacagcactgggttttgtctcatatgggtggaactcaattatttcccaaccctccaaaacttgaattctccaccttgttatttcctttttcctaatgctttttgtcgctgttgacttagaaaatgggaggagaactggggagtccatcacgtgcatggatttgacatgatggaatgaataccaaggaaactttattgtcattattactattaaatggatgacatgaatattctgatgccatcaataacgtcccctggtctggtctgctgtgttgtctgattttactacctttttgttctctcacccaaccaataccccactcattctcatccatccctttaacctatgccccgaaagggaaccctaaccttcttcttgttggtaactgagattttaccttgtttgagagaatcattttaatttcactgcaccgtcatgttattttccaattaattcccccccaagctaacagcacatcggtgattaaacaaagatttaaatgtctttatctttcaaatttaggatgagtatatgcttttgttctaaaaaatttaaaacaatctttttagtctatataattgagaaaagttcgttttaatctctttaatttgtatgaattaacgttatttaaatatcatctaagagaaaaaaatatatatacgtgggtgggagggtgtttgttaataagaacatgaaatcaaaatgagttatcatataagtcacatgctgttaattacttaagtgaagtcttgaactgagaaactaaaactatatttttttttaaattacaggagctaaaaaattgatttaaatttggagtgctaaaaacaattttatccaaagtttaagcgactaaaattatatttaaattttaaataaattgtagtagatgctaatgacctcttattttatgtaccattttaataattatttgcaaaaagtcttgtgtgagaggtttagttaaattagttaaataagatgcgtaagttacattgtgtttgatttctacacaatttttttttatgtatttttgtttccaaaaaactatcaatgaacaatattattaacatcttaattataagtttgcaatcaatttagtgtttttcttaaagcactctattgcatgatcattggggtaaatagtaattgaaagaaaaagaatacttcctctagatttatatataaacaaaaaaaaatattagttagacttaatataaataaatctaattaattttatcttatttaatattattatttttaaaatatcattta

SEQ ID NO: 5180 - DNA, 1600 bp, Glycine max
  Soy_ogl_1861 Gm06:8555301..8556900 Cluster 24
acggccacaagaataaaaggtttaatccaaccaatatttcgttcatgcaacactttttagataacaaattaggaaagatattttgaaataaaagaagctgcataaaaatatgttttagttacatgacttggaagagtacatttcaaataaaaataattattctcttaactaatgtttcaatatgtactcacataagtagttaaaaatttgatataaacgcacttattttatgggtgtgggttccaatatctcttaagttactttcttcaccggtgggcaaccctcttcaaggaaatgctttgatgcttataggctagttaaatagatgtaattgggtggaattgctcgttgtaggtagacttttgcatggaactacttgtggtaggaagactttttgtggcaactctagaatgtcaactcccagttcgggtttgtaaagtaatcatataggtaaatttttgctgactactccagcatgtcattaacactcttccaagtagtattggactgacgttttaaacgcacgtatctcatgattttacatcaaatgttatgttgatgtggaagctaaaaattgttgctttaaaaaattcatgtcaatttgggttcataatcgtttccaaaacacacttaaacctcgagtcagcaataacatggtaattttttctcctaactcatcaccttttgacacaccttgtaactaattttcaattattgtggactacaagaaaacttccatttagcatggacattgatcccactataaagagtcatttagcatggacagacgttaaaaagaatattcttttaatttattaatttcacaattaagcttttttaactcttcatcttacatctttcaagggcgcttttatttaaagttatatgtattttttaacaacaattttattatttaaaaataaaatgcatattatgtgatgttatacacaattttcttttatatttggtttatggctttatctcttttatatctgaatattaaaaatatgctttaaagttaaagaaaataatttttatcttattagattgttcacaacctttttttgtttattcacaaaatattataagaaaaataaaaatcaaaaacaaaaaataaaaaatagtattgtctccgatcaacacatgaggacatttgaagctgaacagaattttgtatatacatatatatagaatattcatctcaattttgtagtttagtttaccattttcctaattttatatagcggtaagatttaagtgcaggtacatggacaaccggatgacttcacaaaactttccttcataggatgaatttatttaaggaaaagaaacagagacttaacaaaaaagaatttgagaaaattaatcttataatagaaacttgtctgtaaatatataatgctgtccttttataattttaacaaatatagtaaaaattaagaaggttcacaaaaggataaaggggcactgaaagcaataacggtagttttgccttccttttactttcattttctatattatggaggattgaaaatcaaagcaagttcttgcttgcctgtacctagttggtgcacgtgtgaagctgagcgaggtttcctgt

SEQ ID NO: 5181 - DNA, 1300 bp, Glycine max
  Soy_ogl_2169 Gm07:3831101..3832400 Cluster 24
tcggcaagctctcggtctctttcactttaggagatatatatgtgcctcttaaattttgactatatttatttgattcaattatttcgattaattagttggaaagaacttcaaataatttgtaaaactcaaaccgtgatttgcgcctttgacttggtagcaccatcctcatgcgtatctcttttgttcccaaaaattagaaaaatttgtgatttgaaggacgatgccattgtcaaaacaaaatgaaataggtctttttgcactatttgtttcttattggagaccagctacaaagtgtgtgactttagtttcgtgctgcattgagaaagcatatcatattacgttggactaagtggagcatctttgattaagcagtgaaagtggggaacattttcactttcatattgctttgttcccataccccatcaatttctattagctactttatttctggttttgtttgctctggtaatgacgcaattaatcatgaggttctattataggtaaccttagcaatgttttatagctatcacccacggtaacttgtggtttttttttttttttatcattaataacttatgttgttgacttcaccaattccagaccatcgatttttttttttttcggaattaagagaacttttatttttattggataataacagatatatcacttatctctcattttattcaaattcaaatattagatttattagctgtcattatctctaattttgaattactagtttatcttcggtcattatctttctatttctatcacttgtaacaaactctcctatttatgtatttcgcgcttcacaattgaatcaatgtgaaaaaacctttgttctcggcctctttaatttttaatcaaattactgcagaagggtctgttatgctgtaaacatgaaattggacctcctaaaaatagtatctctacccccttttgatttattttttttgcggaataaagagaacctttattttaattcacttatgtgatttgaggtcgagtgcaggagaataagaatagattagaaacaaataaattaataatatataaataaggtcatgggtttaaattctcaactctcaaggtatttttggacaaataaacagaagctgaaaacctactaagtactagcccatttatctacattcttggacaaagatccgtacacaaattataataatcagtatccaccatattctcttgaagagaatgcgggaaaattgaaaaacaaaaaaatagagaagatcatagggcataaaaagaacaggttaataagaataagtaaaaggag

SEQ ID NO: 5182 - DNA, 1100 bp, Glycine max
  Soy_ogl_2491 Gm08:3464901..3466000 Cluster 24
cgataacctagaaaataaaagtcaaatgcagaggttttgttagcaagtcataatcgcgctttctttcttcaattcatttgaaccttgtgttgctacttttcttgataaataattaaaaagattgttgtttagtgtaaactttgcttacttcaggataacggcaattatttgatttgatgggtttcatattataaataaactcgtaataatgtgacatataaaattgaatggttgatatatatatatattattaagaaattcttttttccgctttataaaagtacataccgtgtcggctagtgcaagaactgttcatgtacgtagaaggtttgctctgatgttccttatgaattttagttgagatgaggttaattattcctaaactatctcaagcacagcaatgtatagaaagataaattgaaaccttacgcgatgcagaagaacatcagcataaatcctaataaatagattaaatgtaaagttttcaatattccttgcaattgtctggaaattgttatacccatatggtatgaaatctgataggtaccagaattttttaattagatgccccattacatcagagtagaatccattcaataacacggcttaagaatcctaaatagaagataaaaggtaacttcgcatagattgtcttaaatggttattgtagtcaaaataataaaatgtatttcatatgttgattaagtagtcatgctaaattactaatcaagcactccttttttgaaatatcacaaaaggtcatcaaacagataaaattcaaagtgattttagtctttataaaattgaaatttgcttttagtccacataaaatccaacaacttctacaaagtttaaacactttaattcaacaacttctacatgactctaccaccaaacaaatttaaaatcaagtgttgcaagttcgttagttaccgaagggtgtaagatagggaatatgtattagaggttttaatactcgatttggatttgagtaatttgttttgtgtttagaggagtctacgttattttactttcaccttttcctataattaatctctaataataattcgagatgagatttctaaaattaaattgattat

SEQ ID NO: 5183 - DNA, 1223 bp, Glycine max
  Soy_ogl_2742 Gm08:17216678..17217900 Cluster 24
atatcagaaattcacaattaaaaatcttaatcactataaacgcgtgaatcatcaattagtgagaaatgattctagttattaggagtgtcaatttagttgaaatcacttgcgttatgataaggtttgcaagccatgatttatataaaaaaagcaacgattattgatcataccacatttttattctctttcttataaaaaaaaatcaataaattaatctaagctaatcaatgaacaataaaatgcacagtgaagaatataatccgattcattttgactctttaaaatatagagttgaatttaaaacaataaaatctaatgaatgaagaatatagtagcatagacaaaatgggcactaagtagatgaaagaagtgccaatggctacctttctttcctaggtcggcaagttcccacttcccaccacccatatctatcaaatattcaaatccgacccacaaatttcaaattctaagctacgattgaaaagtaacatggaatcgagcaagaacgactatgattcatttattcgatttcctatatacacgctatctttgtgggatagagtggacctctaccgccctcactccctcatccacacaacttgttttgaccttcttctgtttttgtttaaattacaacaaataaacccacatgattttatgatagattatatttctaatgtttctttaagacttcatattaaccaagttatcccatacattactacaaatatttccatatattaataaattgaatttttatcagtcttattgatataacttttgtttcacaaaaatgaagcaattgatataaactttataaatttaaactaacactataacgaatttcaataaaatattatgacttatatggcgagttatattatcaggccgatcagactcatgatatttatactaacaatttaatttctgttaaaggactatgccgacaaaaacaaccacaatgcttaacattttttagttaatatataacttttttactaaaaaagtattcgatatattttaattttttgaatcttaaatattgttccgtctaagttcctactaattgtttatctttctcctttcgtcccttgtctcagtataatttttaacctcttagtccgatgttaggtgaagtacctacaaaaatgacttcgattatcaattcaatattcaattgagcctgatgtattttttcatctatatatgaaatgattgataat

SEQ ID NO: 5184 - DNA, 1242 bp, Glycine max
  Soy_ogl_3987 Gm12:3250201..3251442 Cluster 24
agtgtgcatcaaatattaaataaaactaaagtttatcataatggtatatcttatcctattttatcatattccaaacagatcctaaacttttcattatgacaatttattatctatatgttttaatagtctcatttcaaattattaatctttaatataattaacttagttaattcttcctctctaaactaacatttactctgactacccaatcatcatcgaatcaaacatcatatccaaggcagcttggtgtatctaagatcatttctatcattgttatcaattagcataacaaaaattgtgcctttagcttgacaatattaatatatatgtcaaaaaatactatgaagcattaatataatcgtgctgcagtatatcaagaagcttgtgcctttagcttgatgtacaatgtttagcaatctcaaagttgtggatatcaattgattttgcattttcgtcttgtcataattagtcggggtgataaaatcactatcgttctgagagaccagacgtgatagttgataaatcaggcactaatgaaaaaaacaaagctttcagaatcgtagaaaaatgtacaagtaatgaaggttattattggccaatttttaatgcttttagtttgctttgtttattggttttgtccgtttccatcatatatgatctattatgaagtaggcaaatgagaaaaaaaaaatattaaaggtgattaactaaattttttgactggaaataattattagtaaaatcagtgaagattctaaaataatacaaaatggcccaaaaaatatcccatatttgatttcttctttatatttcaggtacagattcgtcaattaattggggagattagccaaggagcattaagagatcagcaaaatcactgcaatttgaccgtttatcccagaatattacttttaaataaaaccataaaaagtgtttctctaaattattgtgagatggtggagggccattattaattagataaccattgcacactttttctactcatgcttgttgggcaataattatattatgtattaacagcaaataacgcacgtggagacccagcaatgcttttgaactgataagtaataactacatattttaaagaacgatgtggggttatattcttccctgctaaatccgtagggtttattttatttgatagtcaaataacaaatatttctaatatacttttattcagtaagtcagaataaaattaaattagaatttgtttggatgaag

SEQ ID NO: 5185 - DNA, 1126 bp, Glycine max
  Soy_ogl_5269 Gm16:3369701..3370826 Cluster 24
aaggatgaggcgcttagataaggagaggcgaagggagaagagcgcagtggagaaatcctcgtcgcttgggtgaggagagaatgtggtgatgtgattctagagagggtcttcaatttttaattgacacacatcacttactcagttaagtcagactctagataaaaaaaatatatatattttaattttataagaattaaaaacatactacaaattttatttgtagaataagatttctaactgtttttttttaatgtatattattgtttgtcacacttattatttttttttatataaaaaaagcatgttcactaatgcataaggaatcatatcgtacacaattttggttcgtttcccatcaaacccacgtagttttggttgtcatattttttatgtgccgaacatgataactttcagatcaattcgcccgtcgttttcttatttactataaacaaaaaagagaattgttttcttaattctagttcgattttgattattggaactgatgaatctagctcattaattggaactagcgggtgtgggtctaagtcttacccaatattttgtttagttttttatgtttctatgtcacatatatctcgagtccaatgttctaagctgatcttctacttctgctcgatcgaggctgcttttctccttcggaagtatatgacgctgttttctgtgattttttttatatgcaaatagtaatttattagaataaaaaatagataactaaatactggattaagaaataccatgattcagcaaattagtctgttacataacctgcaattcttttagttttctatcgattttatactttctgagtgataaaattcttttatcgattttacacagtttactccaaaattttcaaattttcaaaaatgataatgggttgtgcattagtctctgtttctttgattggtccagccccttaggtaatgctcatttgcacgaacatcgaaaatttggggtttcttttccttattactataatattataattataataatttacaaatattttttaaggaataaaacactgtttgaagcctagtttggtacgattttgatttaaaattaatttgaatcaaagaagaaaagaaaattgagtactgtttag

SEQ ID NO: 5186 - DNA, 1391 bp, Glycine max
  Soy_ogl_5575 Gm17:8038910..8040300 Cluster 24
cgaactcatgcacttgatgacattgattttatcgaaaattattttaattagtttattaacattgaatcttccttttaaaatccctccgattgcttccttctttattgatactttttattgaatttattgtgtgatttacatttatatgaatgggatgttgtttcaatctaatcttgttttggtttgaaagaattaggtaatttgaagatcattttatttatttttcataatttatcaagatagggttggtaaggagaatatccagggagattacattcttctatgatttggttacgaaacacgcgaggctgttttcaaaggaaattaaaaaaattgaaattgtttatataattcaacaatttccttaaattaatagttagtctgaattttgaaggcataaagaaataaagggagttaattaattattttacatagaaaatttagcttgcaatgctgaagtatagttttaaaaaaaagatctagatatagaataagatctgtattctgaaattaacaaataggttgatgctgcattaaaaaaaaaaaaggttggtgctatatatctggcgtcataaaccagatacatgacaaaattaatgctttgaatggacgcattaacttgtaatgagatttagaaattacaagacttctccaatcttctttactgtgttgttttgtcggtgagtgatgcagtttcataccaatcggcatgtacatttcatgattatatatgtttttcgaaaaaaacttgctgacagctacatgtgcgtgtacgagagacagattatatctttaggcttaattaataatttgatccttaaattatttaatttgatcccttctattttttctatttttaaaatacataaatttagtcattttcatccaattagatcaatgctgttaggattagaaatttctgcagttttcctttataataacaaagaacatttttttttctgaaactttattcttatagctaggttaatttttcttcacactatggtgtaaataactaaatatagttataaattagtcccttatgcattagaaagcattattttaagctacttaccatcattcccgctaaataggtgcacagttttttcttctcgaaatgggatccgttagtcttcatggtctgcaccagttatattcaccttgaagaacgaggaatcgcggtagaagaatgagcacagaatttcaaagagttttgcagttacaggcactgtaatgtaagccccacatcgcacacagaaaaaagcatcttggttggtcaacatgcaagtggtgcgttttgtggggggtgttgtgttattcggttgttaaatattgttactccctaggaaatgatttaacttaattggtactggaaccgaaaggattaaatt

SEQ ID NO: 5187 - DNA, 1003 bp, Glycine max
  Soy_ogl_190 Gm01:47988..47919700 Cluster 24
aacaacactaacaaacccacacttcattaattatattgaagcatacattggttgcaaataaaatcattgagttttatgtcctacaactctagtgaaagcaattttgggattaatttaatatacacattagaagatagaagggtacgaagcattttcagattaaatcttttggtgttgaaaagggaaaaataatagaggtcagacttacaaaaagaatgcaccaaaattgacacatcaggtgcagagttctcaacagtcaccagagcaaaaaaattggtgaataccaagaggaaaaatgatatgcatacagtttcagctgggtgtatactatatcatttatataataagaattaaagtttaaaaaaaagaagagaagtaagtgaaatatatgataagtaatgtgatgaaatacgaagaaagtcagagaaaaaagttagaaaaaaaaagtgaaaataatgtatatcattaattgttggtattaatcttaatttgtttaaatctattcctcatgtacatgtttgaattaaagttagaagagattaaaaatatttttactttcaagacaagaaattcattttatgcattaaaacgcataattttacattagaatttacaaacatatttttgtaactttaaatcaaatgtatcctaaatgtagtccaagatagcaccatagacatggcttgatgtggatcagtcaaaatcgtatgaacggcaattctagcaaggttgaaagtgattcaaatgatactgccgtgaccaacgttttcaaagatcgatcaaattaagtttgacaaaattaacattagattgatcgatgcttttttatctggtagttgaaattaattggagtcagaagactagtgtgtatacctcattcactaccttgctattattttcttcctcttttgtaatgactttttggactagcttgttcaatactttatccagcacttcaacatgcaactgctcctcttcgcttggcaccatttactacttgtca

SEQ ID NO: 5188 - DNA, 1038 bp, Glycine max
  Soy_ogl_5026 Gm15:12902163..12903200 Cluster 24
ccagacttagatccactcctttgatgttgtcgaaactgatagcaatctttggaagaatatcacgagtgacttgtatgtcatcgtttcggtgtcgcatgcctcagtggtacacatgtgcattctcgtatgccacgtgggttttcatgtcaaaccaccatcaccatcacaacaaagagaccatgatccccctaccataaacccagcttcatcttcgcctcaccctagatcattaaccaaactcataaaaccaatgcacttatggatttggtttcagtttgctgattgtagcttccatattttgtaattaacggagttggtaattttgaattttggaattctggtatgttggtttttgatttgggtaaatttaatttctatactttaaatcttattttgaaaattttctttgataatttgattttggattcccaatatggattcctaattttgtaactattgaatttagtttgctaataattttgggtaaatgtttttaaaattcttatattggcttgcagaccttggtaaatatgattttttaagtattgatgttgagtaaatttgatttttttataattagtataattgtttaatcttatttaggtaaatatgatttttgaattttgatgtatcctaaatgatgaactaaagccatatcacggtacagaaataaagtttaccttcttcattgtcatcaaagaataagtcaggccacaaaatttgaaaaatcacaaatgatgcaatatatatgttgacaatcatgcatccaatagactcggctctacattctaaaacacttaacaactaattagtcatgtcccatgacatggtacaataaaatcaatgccaataacttaaaggtgaaaaggcaacacatatatcaaaaatcattcaactgacattagtactaactatgaagcaattattgacattgttaggacacgcatatggtagtggttgctaccacaacctaagatttttcagtgaccttccacatgtggaatcacattataattcactaactttttcatataatct

SEQ ID NO: 5189 - DNA, 1017 bp, Glycine max
  Soy_ogl_2669 Gm08:13996701..13997717 Cluster 24
ttggccaactgtatgatacaaaaaaaagtatataatcatctcaccaattctcaactttgtcaatatgtttcagatgggtaccctaatttagttgagggtcatgattgagcactctctctctctctcaacatttgtttgaacacttatgataaattaaataatgtgaagggatctgagttaatgattgagagctccaaagggtgtatgatatatatatatgacaatatggaagttgatgcatgtgactgtgtggaaagaagatgaaattggagacattaaagaaatatgagaaaggtcaggtgttattgtttttgcttataatcatgaaaactaaattatataatttgagttttagcataatggccaaatacaatgcatcaatccttattataaaggtcggcaatagcatgtctgtcttaggttgtacttcttcttgaccatatacacctgatgtaaaatttgtgattactttaatttattcgatttagttaaaaagttaattttttttatcgatagaagatagtattagaacaattcatccggttaattagttaattaatttatttgtttatactactttttacttctagaagttattttttctaaatttcttgtgtatgttatgtgggtatatatatagcttgcttgataagcacccatctatgtatgtatgcatgggaaatgttgtctcaatgaacaatgaaggatacaaggtttattcccggccccatccatatcataaagcaacatgcagcatgatgttgtttcacctatgtacgcatacctagtgagacatgtatgatatgcgtcccaaatcgaataaaccatcaatttaatcttttaattattattatttttcttatctactctttaaagtaataaaattatataagtaatttctaaaatattggatacctatcaattgatatatttaatttactaactatcaaactaatttgaaaggttttcaaatatttggaagattacttagtatgactatttttaatatttaagaga

SEQ ID NO: 5190 - DNA, 1016 bp, Glycine max
  Soy_ogl_5012 Gm15:12401785..12402800 Cluster 24
cactaacatgaggtagtgtgacagcaagtaatatcagttagctagtctgatatcatacaaaagagaacaaagttgtgatgatatttataaatgcgaacaaaataatcaaagggtataaatgtattgtttctagattcattgatcctatatatgatttttattgataaaaatatcttttcaaataaacctttgttttattttttaattcttctttaatttgtttgtacgagcaattatttaaggacattccacttgtctaaagagtaataatatttggacacctatcaacttcaaacacttgatcacacttttaatttttctttatttttattttctttatcacattatatattacctatgacacttacatttctctctctttatttctctataagtgtcatttagagttgggagtccatcatttattttactttccaaacacattatttatactaatcatttttctttatatctccttgtattatgttatattgtatattatacttaaatctttctctcttttatgcctctcttgttttggggtgtaaaaaataactttgcattgtttctcttctaaaatatggttactttaatggctcaaagagttggttaacgactcaattgttactttcatcatatatatactgtgaattcctgcatacaataccgtatgggcttaactaggtttaattgttcaaggaccaaatcaggctaaggttcttatttattcatctctttctacttaacacatattaatattctctctctctgtacgtgtatgtgtgcttgtgttatgtctgcgtgtgttgcatgttgtataaattagtgtgtgcagtgtacatgtttatatcgctgtaatagcacaccagaggaaatataacacactaactgttattacttgttgtcacacttgaatggaaccatgcatgtgcaatgtagttgcaccaaatgcccaaagggaaccatcctcaacaattatgatccccacacaaaccaatcttgtcagcaatttggca

SEQ ID NO: 5191 - DNA, 1338 bp, Glycine max
  Soy_ogl_5966 Gm18:6600601..6601938 Cluster 24
tcaaaatgtataatagaacaagatattgtatgagattaaaaaggtattcattttaactccatttaaagtgacagaacctaaaaagatagaatcgttttatttctcttcacatgtcaaacactcttataagaaaagaggatacattaaatccccaaagaaaggaagttaaagactttcacaaacctgttatcgaaaaaaaaaagactttcacaaacactatatgttaaaatgattattgttgttttaagctcaaacgttatatttacaaagagagtacattgatatattcgttagaacttagaagtacataattaaggatgaaggttgttgtttttttgtcaactaatattttaatcttttttccttttcaccttatatctatcctctcttcacctctaataagagatttacaacatgcctctttgatagggttttatagagtgggttaactatttaagaaaatagtaaattgcttatatgcaattaaattatttagatcattataattgacaattggagtaaaatattggcgtgttgtgtataaaaaaaagtttaatgtcaatacacttttagtatgaaataattttacattactattaaatcctaaattaatatttaaattattttaaaataattattttacaagttaacaaatttatcatagtaaattatgattaaataacggtaaaaaaaattatactatctgtatataactcttactctaaaagaaaaatcctaaatagaagacttaattaagactgtatttatagatgttgggaggtagcatgcatgtttggttgtgaagtagtgctactctatcatggatcgtcaaaggaatgattggaagagaagtttattttaagtgttttcttcacacaagactcataaatttcatggtaactaaagaacttctaaatctttatactcaattgaacaacaagtcacgttcgagtagagttgtctgaatgacgaaaacaatatgtatcttgtatgttgttaatttatatactctttaagattgttcaaataaatgtacgttgtaaaaaaaaaaaaagattgttcaaataaaataaatagtacaaattgtctttttacctttttttgtctttacctaactttctactacctttaaatgtgatattactcttagatattgaaattatttatagctttataaattttgtactgtaggcgtatttggttaagtatttcaactaaacacttattcaacaattttttttttataaaaaaaatgcctattcataagtctaattataaatttgactgaaaaaaattaaaataacttactttcgataaatttcttttagatgtttatta

SEQ ID NO: 5192 - DNA, 1400 bp, Glycine max
  Soy_ogl_466 Gm02:9991601..9993000 Cluster 24
taaagttaaatttataaaaataaactctcatacaataacattttttaaagaattttttttctatatctaactaaaggtatttaaatcttcttatgtaacactcaactaattaatctcctgccaaatcaatcaattttgagaaaaagtaatacgacttgatgtctaaaccaaaaattaaacccagaccttgattacccaaatctcaaaccaattgtttcaaaccattaaagaaatacttaattcactaaaatgcatcctaggtccaattccataaacatttagattagttgcttaattttttggccaacccattgaggcatgtggcgactgaaaattgacgacaaacaaaaagtccataaaaatgaaagtcaagaaacatagtgacacgacccttgaaaataaaaggcccgtgccgtgcccgccatgtagttgtttattcgttcctttttattaatccttcatccattaatttcatctttgtttgaattgaaacttttatcaagttcaaatcatgcttgcctcttcttttactttttcttcgttatctctttcagatgctgattgaaacttttatattaatgtcaactagcaattgttgattgatgtatttcatactttaattatgtgttttatttttggcgaaagtctaattatgagttaaaactaggaaatgcaatatatatgaaatagcaaggtaaagtataacatgctaacttttttgagagaaaagaaaacatgttaataatctaacgcaatccatccatgaatgacattaacctaaatgtcactatgagaaaagctaataccaattccaaataaaaacttagacgcaattaagaacaactagtggttggttagttaaggtaatatttgatccaatttgctttgagttgctgttgctgcataaagaagaaggtgaaccaactatatttttaattttttttttgaaaaagttggttttacaaacttttaactcctatttctttatttatttctctatttatttcaaatttctaaatttgaaaatataccactttcaaaatttaacttaaaaactataaaaccatatattgaattttaaataaatatattttcttagtctaaacatttatttttaaaccagttttaagttccacaaaaataaattatttgcagttggaattcaattcaaaagcctgtactgaaattcataatgtattataaataaagtgttttcaaatatttttaagattgaggggggcacaactccattaagccttctaatatttagttaaattacttaatatttctacaaactctattgcttttttttttcaattacatcacttatcttctcatatattgttttcttatatctttctagtgtgtaaaaattgttcaataaaaattaaaaacaaata

SEQ ID NO: 5193 - DNA, 1400 bp, Glycine max
  Soy_ogl_1063 Gm03:43074501..43075900 Cluster 24
tttttgggttaaatagtacttgaaatattattccagtgatgaaataaaataaggacattacatcactttgcaaatttgcaatgctctaattagtaacttactgtaggacctcatctatccagtatacatcacaagatcaaaagctaaagacgccaaagcgtgtgctactttgttacccatcctttcagtaaacaagagttcgcactctcctcctatctacttagaacaatacaatcatctatgattccctgaagttaacttctgcttctagttctttgggcatttgactttttttaaagtgatcctgtataggaaaaagctgataacagtcattcttgaagatagctccccgcaagcatgagcctatctatatagtagagcccatctatatagtagatggctttggctacaattggttggttctaaatgaaaacatatagaacgtgttgcagcttccaggaccgcaccatcatagattcatagttctgcaatttggtccattgccatgacaagtatagaaagagtcagttttaccacaaagattgtgaaaaattgattgattttataattaaggatataattctcaaataattgtgtgacctaatgatgtattaaacttgcaatatggttcattaccataacaattacaaatttgttattttaccttaatttttgtttgttttatgtatatttattttttttatttctggataagaaactaagtatctttcgaccaattgaattagaaattaatctttgttcattaagtgtaactctcatcgaatcaagaaattttgcataatttgatgtatatttaagagtaggatatcattatcaatattttcatttacagaattttttttttctcactacaaaatgcacccttggtctatttcttttttccttatcaatatggtaaatctaaataaaacagttcaacaattcttgataatgaagaaggtattaaagtctcatatcaaggcttaacctaacctatttgaaggcttagttaggctttgaaaataatcaaattaaacttttaaagacagctcacacatgacaaattaacgtgtaatgctagtttaaaaattatatcatgaattatttctacaataaggatttgaagaaataacaaatcatgttacggtaccatcattagatgttataactaggcttttaggtcaggttgaatctttcaaatgatctctttttatcaccgcaactataacgtaatactatctatggttttataaaatgtgtcataacttatgattatgtaaaaccttttaaaatatgctagatatttaataagagtgaaacataccttaaaagtgaacctgtaacaaaaaaaaaaaaaaaacaaataaagctagagttttgtaattctaaattaagtggta

SEQ ID NO: 5194 - DNA, 1175 bp, Glycine max
  Soy_ogl_3349 Gm10:3326401..3327575 Cluster 24
ttctttcatctaaagttcctttcttcaatagattctcttgctatgtctactctttacatgctatgctgcattatgcagagggaaccaaaacctgaataattcatttgggtacggtgttcaaatttgtttatgtttatttgattcataaatttgtttatatatgtattgtaaattaacaaaatatggattcttttgatgaaggcttaggggggaaaaaactttacaagcgaatgtttaagtagcccttacaatttatgtatttctgcatgtcaaatttgtgtggttaagaggtatttattgtgtgaataataaatacgttttaaccttaagttgttggctatttgtgtaaggttttttatggtacaactttatatatatatatatattttgctgattaaaaaatgagtatttctgcatgtctttatgccttttttttttttttttattgttaattaacatgcatttcatttttcgcttaacaaatgataagaaggcgattagaccctcagtcgtatcctatccaatagagtgccactaatatactagggaagtcaataacgacctaatttaaataatcactatactaattaagattagttttttttttacagcatcgttaagatgaactttttaggttgtgtttagaaaagttgaacggggaaatcaaacgtttcaatgtaaaacgtcaaagtaaccgcctaattgcttctccgttacgtttagattaacgcttacacaaacacacaatttttaacatgtgccatttaaaaaaagaaaagaaaaacagaggatctggaaagggaattatttctattttcttttaatattctactaagagataccttaatgaaggttaaagttatactaataataggtaattttaagagattgcttacatttgaaagagattgctatatatatatatcttcaacctagctaagaaagatacaatattgtgtctagttactgtatcttgattaaaatgcatgaacagacggaagattcccgttgaaaataaggaaccaagagtcgagcctgccgaaaataaaaatttaagcttcattaatcaagcattaaaaggtttcacatttattgtttagatttagatactttgaatcaagattgatatttaaaagtgtaattattaaaatagattttaatattgatgtatagta

SEQ ID NO: 5195 - DNA, 1093 bp, Glycine max
  Soy_ogl_1961 Gm06:15514847..15515939 Cluster 24
tttaagtcaataatttataaaaataaataaatttcaatatttttacgaataattattgtatttcttaacaataaacaataaatgatggttagcacattccagagttggtcaaagtcttaacgttatgagtaaataccctaaattgtttgggtcaattagatttagcggtttttttatactaatatccaattatagtgtaaaggtttgtttttagcaagagaagataaaaaaaaaacatctctcaactgtttctttttaaaaaatatttatttattaagaaataaaagttatatatttcaggtaagaaactagttattaattaattgatgtagaattatttcaaaaattaattttagaattaaaaaagtatgaaaaaaaaaaatcaaacaacctctaattaattctttgaggaacccattctgtctgctagcacactcttacgtcgattctgctaagcaacgtttacaaagtcgtaacccgaaaagcagatattatattgtaatgattatatataggatgggaatcggtggatatagtttgaagataataatatcatttaatttgcattaacgagagatgcgcatatttccacacacttgaacaaaataagtatatatggagtatatcatactaaaaataaaataaaaacaaaaaaagatatatcattccccacacgtacggaactttcgtgattagcctttttggattataaaatcactaataaatgattggtcaacagattttttgtttatttatttatctatcttgccgagataaatcatggttagtcaaaattataggaggcatcatgacaagaaaataattattttatgttgctatgttatcattcattaattattaattaagaaaacatgcaaaactcagtcatatcatcatttattaaataataataaacttgattcactaagtagcacctaaccacatcaagaattgtttaatctccatttcagagttgattgcaatttctatatcttcaggcacctctttaatttacaaataataatagcaaaattataatatggtaataaaattaaaatgaccatgctgatctagaccacggtggatgtaacat

SEQ ID NO: 5196 - DNA, 1081 bp, Glycine max
  Soy_ogl_2321 Gm07:10333701..10334781 Cluster 24
gctttcataatcgaatatatgatttagattaatgcagagactcattaacttcttaattcacttgaagtattcatcctggtagtatctaatgcttgatgttgggaacatgaattggacctctctaatattcaaagtagacaaaattgtaactaatttacacaatctttaatgttttttctaggttgatgtcgacgagtatctcacaagaagaaaaatccttttctataattcttaagaattgtcatagggtaatcgtcaaaaaattaaaaaataaaataaaaggtattttatatatataggaaaataataaaaagcatttaataaaagaaaattgtacttaatattttagaaaacttaaataactattttttatttaatacttttattttcaaattcatagaaatttatatacccattgtagcatatgtatgccttaatatttggatttggttcatctaaaatgtggaaaatacacataaaatgataaccattaattaaaaattatcaactattgggatctttagctccaggctccaacggatacaccttttcacttttaaattgtacaagaggagcagaaaacaaacaaaacaaaaaaagaaatcattcaaagattactagagctgaaaacatgattgatgaaaactattgataagaagaacgttaattttttatttaaagcatcctaatattcttcttattttagaattaaagcatcctgatataaccaaccaaggtccaatataattattaagtatattgctagatgttcgattttctaatcatatggatgaagaagattttattaaaagaggtaaaattcaaaataaaataaaggttcaatcctaaaaaaaaatcttgcataacccattaacctgtctttacatttattttatctattaagtgcctacgtaactcactaactcttttattattattaatactcactaactctaaacaatgataaattaaatgaaaaactccaaatatttaagaaattaaatgaaaatattatgatatttggagggataaaaacaaataaataatattctatgaacaaaatcaactaatatgtgaaatg

SEQ ID NO: 5197 - DNA, 1100 bp, Glycine max
  Soy_ogl_2638 Gm08:12658601..12659700 Cluster 24
tataaaattgttccctactcttccatgcaatgacctaagttccacttcaaaatcattttacaccatgttccagtaatcaccaccacctcctttgaaacaagataatcacctaatataagttgtcattatctctaccaattgtcatatcacttccttacccccttaattactttgccttttgccttgcagaaaaagcccaatccacccgctactatcacaccgtgttctagtgattgttgtattttaaaggtatttcaaaagacaagagttccacgttgtctagacatgttttgtttctcttgtttataaatggacttgggactaatgcttttaaagtagctagtacagggtcaaagagatcggtgatttcttagaaggtaaatacgtagtagttctaaagaagaagaaattaaaaaagattagtccataattaatttaattaaatttctagtatatcaccaatttagttctcaaagtatatttcactctgtatcctaagtagtctttaaaataataaaattatttaaatagttctgaatatttatcatttaagtccctaagtttgtgtaatttaattagtaaaattcggggaccaatgatttgtttactatttaccacgatctatagtacttttaggactattttttttaaaaaaaaaaactatatgaactacatagaagataaggtattattttaaaaaataaaattgacgatatactcatttaatttcttttctttttgaacgatactcattggatttctgtgcacactctgtaaaaaaaaattatatatctactatcatttaaaattgatgctaggtataattttcttgataattattataaaaagcaatatttagtttacattttacacgatcaagcattagataataatatatataaaagcttgataatataaatacttttttaaattatcaattcatatattatattgtgacagtttaatatagttagttaaatatgacacatgaactgttttagattccttgatatctatataaaaatacattatgaatttactcaatttaactttcttaattatctttaaagttgtaaaacaacaactatttattttagaac

SEQ ID NO: 5198 - DNA, 1000 bp, Glycine max
  Soy_ogl_2652 Gm08:133131..13330700 Cluster 24
aaatgtataaaatcttgatcattaattttcttacataaaatattatataaatatgaaataaaagaacatatgggccataacattgatctgtacttaggtgatccgtttacatcggtatctcttgattatgaatcttctatgtctttgatttcgtggaatctcaatgtgtgtgattgttaaatgcgtggtatatttaattgaaacctagcttcaagattaagctaccatatacataacactattgattagtgatgtgatgatgatatattaccacagtactaaaattttcaaccccaaatgacagagattacgtatcagtgtaattaactaattaattaattagtgccttggtcacaaaggttttcctgttttgtttcttttgatgccttaaattagatataatcttattttcaatttgacaaatttaatttacgttaatatttttttggttgaattttgagttgttttaatttgactttttttcgtatatataaaatccccaaattaacaaataaaatttgcagaagctcaatttttcaaaattagaaataagcgaactatatggaaaaatgttgtacccctatgaaacgaaaaggtgaaatgttccattttttcagcttttttattaccattatctcacttaaatcaatacgagggttttgtgtaatctagatggttttttcatgctttttgaaatttttgtcactaagagaattcaaagagagttttattaacgatatgaaaattgtaggaatcggtctattctcgaattccgtatgtaggtgagtgtacccaaactctatggctgcttttgactcatatataatattgtgagcaatgtttctatcactcccatgcaaacaatatctcaatgcagcatataactataccgcaacattatggaagtcatattaatattaatctcagacttattcaacgcatccatattcacacattatgatcattaaaaaaaattagaagtatcataaaatatatttta

SEQ ID NO: 5199 - DNA, 1064 bp, Glycine max
  Soy_ogl_4091 Gm12:35266101..35267164 Cluster 24
tatttctttatgggtaaagaaaaataaataaaagagataaaatttacttccatgatctctatgttaccggagttagtttcataacttccagatgggaatatctttcttgcttctagtaaaaaaataaaacctgaaaattatattattaatattcaaaatttaaatctaaacagtactttcaataacatttatacagtatggtcaaacttaattattttttcccctttttccttcctaagttattctttgcatatatcaaattggtcttcatgaatactaatgactttaattatcaagaaaatgactttatggacgtatttctaacgaaaatatgactttaattaccaagaaaatgactttatgaacgtattcttaacaaaaatatgacttcaataacatatgtttatcagattttggattgacttggttgtttagaaaatatgataggaaaacttatacataaaacaagtatcatattttttaccccttaagatttagtcaattatcaacaactaattattttagattgcaggtcagtgtagataaaattttcaataaatacttattaaagaagaaaataaagagttaaattgaattgaaattgttacataaattaaaattaatttacctaagtcaattttgggaaagattatatgcgaaagcatctaaaaattgagatgtttaggttaataaaactcacggaaaaaaattatttcctaattttttttttctctaaatagtattttgtcaatagttaatgttcctttttttttttctgccttcctagaattattcattgcatgccccaaattggtcttgaatcctgatgtaatgatgttgatactaatgacattatgaagaaaatgactttataaacgtatttgtaacgaagcatatgtctacgatattgctaggtaatttagaaattatgatttgatacaaaactgattatgtcgaaaaattatgcagatatcaataccggcctcataagatttagtgatttatcaactatgactttgtgcttattataacccaatgtgaatcttgttgtatcataagtcaga

SEQ ID NO: 5200 - DNA, 1000 bp, Glycine max
  Soy_ogl_5739 Gm17:37187101..37188100 Cluster 24
ctaaaacctagcaaagctcaccatctttgattagaaacgctaaactaagtttaatactttagtttcctttctctccgaagtcggaagacaaattggctttaagtataatactaattattttatataattttaataacagttgttaaataagggtcaatatagaaaaaaatattagaatttaaaatttataaaacaccaataattctaaaataaaaaaaccttccataaaaaattctaaatcatcaatatttttgtgaacgaatttattttagactcacttttaatacattacatgttttttttttctttccagactaccaaaattcacgcttcaattagaagaaagtatatatacaaatttgaaaaggaattatttgaaggtgatgtttatctaatgtcaaagttttctgtcgttgcaaatatgggcgaatatcggtcaacacgtcacttctttaagttgaattttcaacttggtacaaaagctacaaaaggtgttagtggattagttccagacagtgtctttaccttcattcaccttgctgattttttgggtaaaatttttcagacggactatttgattggtcagtatttttttctccactatcattaattttttttatatcaaaaatgcattttaaatttattgatactaatgaaatataattatatgtttacaaatatcatcggaatcctcactgctgttggtgaaggccatgagtacgagaaaattggtgattggtaaaatatgcctaccctaacctattacaaaacatcaacatgacacattatttttaagagtcaggaatattggcaccaactctagaatccgatgaacaagttaatgattatgtgatcttaatgattatggaggataaaagggaatatcatagctctgactctgtttgtgaatctaacgaagacaacaaaatataaaatcaatgattcaccgttaaaatcctaaataaaattaaatgttctgaaattcaaaatcacaagttga

SEQ ID NO: 5201 - DNA, 1268 bp, Glycine max
  Soy_ogl_6495 Gm19:41771733..41773000 Cluster 24
gtttctaacattttggtggcttgcggaatggaataacttgaatcttgtgacttagtcgtactgttggatttataaaggtaaagtcttggttataattttctgctaaacttaacaaatctcttatacagttttctgattattatgttaacccattagactgtattaaataaacctatctgtaattgtttgtatttattattattgtatttggattgaaagtactccttacatttaattaaattatgttggcagaagaattcctctgcgagtttgtttttgaaaaaactaatacaataacatcccgtgaccaatgtgacgacttggaaaaagatattgaataaagaaaagttaattaattataaaaaattgaataacatcatatgatgactaatatatagcgaaaaacttaattaatcatttttaataagatatttttaattatatttttatctataaaactcaaaatcaaaatcttagttaagggaattgagactggttatttataccaagtgacattaattatagaagttatttgggttgaattgttcgttcaagttttgtgaacacggtgaattaagcgaaagaaaaattgaatgctggcatacaaaatagtaattaatgaaatgataattttattaattagacttgagcaatgtgaatccatgccgcaatgtcattaccttgatctcattgcattgttaattgttaaagaaacaaattccgtgattcacactgtaacaatgtcacgagcatgtactcttttctcccgtaatacaaaaggaacaataactaatttccaataattaaaatttctatcaaacatatgattggatattcttttctaattaaatataaagagattggctgcagagattttaagagttaagactaaaagttggttggactattcgcatatataacaaaaaaagttaaattactgccataacagtagttaactttatttcatttaaaaaaatcacttattattaagacaagagtactaatttgtcaatatttaaataatgattttaattaagacttgaaaatctaacattaaaagttatataatggaaggtaggtgagagaatagagatccagcttttttttgtttatctatcctttcagttttcatttacttaatgaaatttgttaatgtacacttactgattttttagttgaaattatagttatattttaaaataatttttagttataacgtgttaacatattcaattaaaaaataaataaatgtatgctaaaaaaaatct

SEQ ID NO: 5202 - DNA, 1100 bp, Glycine max
  Soy_ogl_1939 Gm06:14173901..14175000 Cluster 24
tttctttgttccgaagcttaaaagtaccgttcgaattaccgctctctgccgctagaactcgtgttcggctatctccttcggtcactggcacaacaagaattatttttacttttttttttatttgaagttgttttcttgaaagatatttttttaaaattaatttctaaaaatatttttccaataataccaatattggggtattaattagttacaatttgagcttaaaaaaatagttacaacttaaactgtatcctggatcctgtatccaacacacatgactagtatatcttgatcgtcaaaaatgtgttgagaatccgtcacttcaaaaaagaaggggaagatgtatgtgcttcataaattcacataccagtacctttataaatgcaatgttgatacaattgtcatacaagttgacaaaggttagcataggtataacgaagaagagggacatcaatatggtatgataaataattttatcacttaaatatttgtgcatgagtttgatctttaacttgtatctttatgtgtatgaaaaacataaattgaaagagattaatctcttaaataaatttcaatatcttgtgatattagatgttaaccttcagctaaaaagtacattaattaaaaaaaagggttgaaaccaaactaaaccaaccacaaaggatgtgtagtgggtggccacacctttaccaagtcctgcatggagccatgcccccccttaggattggattatctaaatataatatacctaaatctcaagaactagtatcatccatttaatttggttggtataatgtgtattcccttttttccatctttatttcatagaaaaaagacagatttgtactcgacaactttcaatcttatccccataaattgaagtccacatcattgatgtttaattagctctattatatgagcccacagtgcaaatcaacatgtatctatctaccacaaatacgagtccacaaggcaattttcacgggaaagaacagagttgatcctttatacgctacccaacgcaaacccccatatttttttcttcttcaatttttagtgatcaagttcaactagcttataatatctcaacagttttatgt

SEQ ID NO: 5203 - DNA, 1000 bp, Glycine max
  Soy_ogl_3017 Gm09:5680101..5681100 Cluster 24
agcaatgaccattttaaatcatattgaatcttaattatgcatagctccaaagataaagtagttaaaacctatattttaagcccactaataaaaatatatttgttaactttttctattaaaaatataaaaaaaatctttaaatttattttaggctcctcacagtcttgttatgcatcatacataaataatatagattgatttatttaaacttaaccttgattgttaatataaaattagatgttgaatatcacctatatttcctattttgatattctattaattctttaccatgctggtttttaattcatagaaattaaagataatataaaaaatttacaattgagctaaaccttaccgtgatttacctttgtttaagtcaagcagttttatttaatgaatggtcatggataagtaccaggtaaataaagtgaaaaatgctgagacatagagataaatctaaaccaacatataattaacaagggaatacataaattactttatgtaacatcgtcgtgacttggcaatccttttccttaatttgttgggttccattttgcgtcgtagtggggattgttccatcgttgaatatgattcgcattattttttttctcttcttttctttcgaatatattcgtgagattttgagtcgattctgtcgtgttactcaaaacagatattgtggattcttatgatatggaccttgcctcaaaatttaagcatggttcatgtggcaaataattaacacaatcactacaaaaaaaaaatgttgtatacagggactgtttaaaatatagttttttacgattaaactgttaaaaaaatcattttttagtgatcttaattaacctcaaaatacaaggctccctcaacgcagtgaatcagaagtttatggctcacacagaagatatagcttataatgcgattttggacatcttgattactagcaacccaaatttcttctgctaagttacaattccttaatataatcaattagacgtat

SEQ ID NO: 5204 - DNA, 1100 bp, Glycine max
  Soy_ogl_2393 Gm07:36333801..36334900 Cluster 24
aatttgaactaattcaacctttttaatttatttcaataattttgggacttttaaataaatatctcatttatcttctatataaatatattctttattatatgtccttagagtgcggttgatacacgctaccttataatataaggagaataatacgggaaaagcgcttgagctacagaataattttttatgttatgcattgtttgataaagaaaggacattacaagcaaaataatgtaaaatttattgaaatatccattttagtattagctatttaattaaattttattttatttaacattattgatattatgtattataaaataatatgtgtcattagcatttggattccctaatttaattctctcatcttgcgcaattatgtaagcaattgttagggtttcaattcaaaaaattatcacatgatataatgagtaacaaaatttgaggcttttgttttatcctatgatttttttattttttatttttgtacaccacattcattttgggaatcaaacacaattatttttgtcctgccttgtccttcgaaattgtgtgaattgaatccttggattattttgaaaaacacataattataaatacagtataaattttgatgctagttataatatttattggatgacacctaattgttaaattctgggtcctccctacatgtgccaattgatacacattcaataataacatttttacgtactctacaattagtaattaatacattcgcatattttttgtgagattctcttttcactccctttcctccaaagagtagaaaccgacgtttttccctcaactctcaagtacaagaacagattttatcaaattttgaactaagtatttataatttaaaaattttaattcatttttttaatttaaattttttaattcaacttttatgaacttaaaattttgtaactataaatccttgaaaaaacatataaagttattgcacctctgttaactaagtactatggaattcactattttcagtctttagtttggaagagacagatgatgggagagaacacgtgcttgtagctactggtcaatgctgtgctttgtttcaggttacagcattatca

SEQ ID NO: 5205 - DNA, 1090 bp, Glycine max
  Soy_ogl_2709 Gm08:15681709..15682798 Cluster 24
tctcatattctattccaccctttctttcctttaaccttctattcctaaaataaacatgtcaaaaaagaccagcaaaaaattatttctaattagttgataatataattttcatactattaagatatgtctattaaacttaattataaattcgaaaactatttgaaatcatctagttcttaagtcataactaataactatgcaaatgatttttcttttctaatttttcttcttcttccaaaacagatattattttccttcctgataattcaatctatacatttttttgggtactaatattcatttatgcacttaaaataaatattaccataaaaagaattaggggcagttgggagcaaattgtcttctcaaagaagcaaagttcgaatgataaatagtaattatctgaagccccaaattaaccgtttataaaatataaaaaatagaatttaacaggtcatattttaaaaaaataaagataattataataattagttaaaaaaaagaattacaatttattatctctctctgcccggttattttatttttttaggaaaaattatattttatctttaaaatgcatacctttgattaattataggaatcaaatcccaaaaaatattgcacttgccgtggatgggcccttacttggttctctattgtttatttgggttttactcactgagagcatagaaaaaaaaaaaaaccctccctttgttcaaatttctagtatcttgcatttcgtcctatctcaaaatttggaagttttcgcagataataaataaaagaggtagtttgaaagatacctaacactctttttggattttggacaagataagaagcagagggaaaaaagggttgagaaattagaataataataaagtgaaataatgtatttaaatagacataaaaatctatttactttgacgaataaaaacacaaaaccacaataagaaatttaagtccaaacttaatatcttttacaaccatatctcaaacttatattatatcagatcctctttttaaatgagaatgattaattaaaatatagattaagagactcacttaaaataattataattactcattcaca

SEQ ID NO: 5206 - DNA, 1372 bp, Glycine max
  Soy_ogl_3066 Gm09:20229429..20230800 Cluster 24
gggacaggagttgttcaactggtacaacattaataattttaatctatcaaaattcatttatacaaaacactaaccctatgtttgatagaggaaaaagaaagggatgaatgagaaaaaagtttaaaatttaaattaaatcgaaggaattttttttgtttttagaagtcagccattattcatatttttcttttactctctccgatcaaaacaaaaagtatatcatagttgatatttttttttcctctttattttcttttcttctactttcatatctttcaaatggatcataagattctttaatcaggatctaaagtttaattttttacttgagctcattatgacaaaaggtatttacttcaaaatgaatcaatctaatagaaagaaaaataattaagcgttaaatagaaattttagataccttccgattgcactaaaataatatattttaatctaataagttgctttaaatttgagttctaaacacataattacgttaaatatcaaaagaaaaaatattacaaatattaatcttacttaaactgaatttttttttggcaaaagacacatccgtaccctcgtacaaaaaaatgatataaaagataatacatacgtatccaggtaattgtttttaaactttgattttataaaattaatttgaccaaatgtgagtttttttttgtatagtcgaatgtgagttaaaaataaaataagtcatgttaaatatattttttttatctaaaagtgatttaaacaaacaaataataaacttctacagtaaaaaaataaatactttcattcaaatgtattaattttctatatctttttattcttttcatatattttgtcatatagtaaagatgttatgaaggttgcaacaaaataatttgaaattacacgaccaaacaagctataaaattaaagcaaaattttatgcaaattggggattggaaaaactgaagaaagaatgaggataaagagtgggaagagaatcagatgccatgcgatgagagtgagatcatggattgaattttgaagctatgattgatgcataaaatattagggcataattgagtcgagcttgaattggaattaggggatgtggaaaaagggtccactgaatagtgtgatggggacgtggtgcaacgtctcaaggagacaatctacgcagcagcaatcatttgtacgtcggatcttatatgggcttcccctaatctatgactctattctacctgcaatgtttggttctcttctctgcctgtgcatgtgatcatgaatggtgtgatgatattgagacacacagtataaatcataacatatttgtttaattagttaacggacaattttatataggaatgaaatgaaaaaaagtaaa

SEQ ID NO: 5207 - DNA, 1261 bp, Glycine max
  Soy_ogl_1339 Gm04:41730340..41731600 Cluster 24
gctaaatttaatggcttgaatttaccaagaccaagttcatgtatgtgtgtgtaagctagataaggggccatgaacatgaaaaattgaggtccaaaatggcgtcttcaagtcacgctgtcatcataagaagctatcgctatcgcattgcgtgtatataggtttggaagatttttcggacaaactagctcacaccacgcatggaaagtttacagtacacctataagtcattatcaacaaatatttgattttgacttgattttacgtttaatctctgtaatttatattgcatgtgattttgttttctcaagttattcttaactttttttttaatcagcaaaataagttgttcttaactaaaagtttttttttctatttttaaattaaatgaactagggcacattaattttccttcattaaaattctcaatttattttttatccaaatattttaggatttatgataaaattaagatatgggatcatttttaaaaaatagaaataagaaattgagtggaaacttgaaaaaataattattaaaaaggattttataagaaacaagatcagggtttgaagagaaaaaattgtattttttattttaaatgaaatttgatgttttgatcgataaatttttatcatatcaatttaatttattcaattataaagatttttagcatgaaatgaacatttaagggcttttaagcaaaacaaaatcaatagagaaaatttacaaaattctgaaaaaaaaataatttatatgttgggaggaaaaaattgcacagtctaaattagggagacaaaaatataattaccttataactttttttcatataaagccatgtataatgttttaaattgtggtaggagagacttcgaaaatcttgataccgtgttcatattttatttaaaggaaaatgttgaatattattgatgagaaacaaaggagatacatcaaaaagatattgtgttgatatttaaatcaaggtcttcgggtgatcaaaaaaatcataaggtcttcggtcttcactacaaaaaaaagagaaagtatataattgcaaacacttagcatctatcaatttgatgctaagcaaacattaaattgatatattttttccaacatgtatcgatcattaataattttaaaaaatattttctaataagtgttggttaggtcaaagttaattattcatttgagcacacaatctaaaatcaactcttttctttttgtaactcaaccttattttttcaaaatcccaaccctcact

SEQ ID NO: 5208 - DNA, 1580 bp, Glycine max
  Soy_ogl_6468 Gm19:40172401..40173980 Cluster 24
gaataagtaaatttaaaaaattggatcttataaatagaaagaatattaatatggttgactgataaccatgtagtgtggatgaaatcataaaaggtgttcatcaaattctaccaattaaaattaaataataaccataaaaaattgtgcaactttggatgatacatgacacattgctttttaactgcaggaaatgctggtcgataaccatacttcttagtcatgtgatcagccttataaatagttttccatactctgagagattaatttttggctcttaattgaaaaatatccttgaataccaaaaaaaaaatgaggcatgtgaaaagaaaactcttgcattggcctattattaattttcggttcctaattatagctaagagtgcttttaaatctccaactactgcatttaggagtgggccaataggtgaagttagcaagcataattgattaatgttgccagtaacaaattgcatcagagggaaaaggagaggttgagggccaggatataacattgttatttgtcacagctatctctcaataaagaaaacacaacgatattggagcagagggatgactagtctgtaatttcttttgtttgtactttttctgctgcatggggaggagagtggagatgtaaaattgagctacaacatgattttaactgcgattgcgatgatgattgtagttgtattgcagtgaactaaaaaatctttacattgtgaataattatgaaaaaatataactataattataattgtaattgtgaaatgtcaaaacatctttgatattacaatcgcaattatgattgcgaactacgatttaaaatcattagttaaaactagtagcattaattattatagcaattttgtcattactcattattagtattattaagctagctatatcgtgtcccacgtgaatttcatctgtttaaatcaaacaacctgtttggagcggtgtaattgattaggaaacgagctgcttttcttatgaagaggatgtgtatttgattactggataaatccctgttgaagaatcatatcatttcagttttgaaataaatatattgagattctataataattaataagccatgctcacccatatatgtgtcaagacaagtttcttgatctcttcttgttggagtcactgaccatttaaaaaagttgtatatttttaaaaaatttaatcatttatatatgatttaataatctacatttatggttaatttttattatatatataaatcaacttaaagaatatttttttaataattatattttactttaattattgaatttcttgaaatttaatacttgtaatgtgtacttaattttaacggttacatttcaagaatatcaatagttagaatgaaaagtaactttttatatattctcaatttcattaaaaaaaaaagtgaatcatatacatgaaatggatggcattttggagaaagagaagcaatatcaacataggaaaacaacttaattttgggctaatcaagattatttctcatacattcataatttctatatccttatcttagatatatctaatatatgtatataatatattcttat

SEQ ID NO: 5209 - DNA, 1000 bp, Glycine max
  Soy_ogl_845 Gm03:4605501..4606500 Cluster 24
tgtaataactcagtaaaacaccacaccgtacaagaacgaaggacattattattgaaaaaaatagtactattatcaactaatttcattattgattgggtcacttctctttaggtagattctatcacgaggaatatattaagatgctatgatgcgtttggattttgtaataataagtaggtgacagcaattgactgggctaatgaatttaagcttaaaaggaaaataattaaataaaattagcccaacattaatcacatgagtgcatctaacataataaatgttccgacttttcctttacacatatctcactcatcattcatttaatatatagctaatgcttttttagagaggacgtgtcgaacttaaaaagaaaaatgaaaaattagatatgactaaacaaactcttactatcgtcgtcgcacagggtgtgtttggtcccaacaatgtgggtttttacatccaaacagaattttttctgttgaaaattttaagttttttactcaatggatgtgatttacgcctctaaatgtgtttctaagcacagtaataatcactgatatttatttattcaaatgataaaaatttaattttctttaaatataattttgaattcatctcttataaataaaataaaaaaatacatcgagagctatttttttttaaaaaaaaaatctatcctacttgattttacttagttagttaagtcattacataatttacattctaatacagaatttttttttaaaaaaaaagactttcacgtaatcaattatcagttatgtatagtcaaaagatttacaggttatgtttttttttttacaagcaaccggttgtgttatgtttcactggttgagattcttaatttaattagtgtaatttccaaacaacttaattgatcatttattaatgatattaatgatgatgagcatttgttctccgacaatggtttcacgtgaccatgtaataattttatttattttttctttaccatataggaagg

SEQ ID NO: 5210 - DNA, 1226 bp, Glycine max
  Soy_ogl_5128 Gm15:46013375..46014600 Cluster 24
gattaacccaaccattttagtcattaaaaaaacatgatttctaaaatttatgattgtcatggatcatgaattttagacataaagattttctttttttctttttttttttatatcaaaagtccccttgttctttttatattcaacaagtagtactaatattattgagtattatttagagtaaaatgaaattcaaatatttcaaataaaggagatcgacaatcatatttttcaatattcaaagttttatttttaggtagatattttacacttgtaacatcaataccaatacataattcattatgttctactttaattttattctcgtaactctcatttgtattgttctttgtaattcaatgttcgaccatgagagagactacataaatcagttaaagttgttttctaaggttgaactttcagattgggaaacatccaaaataacagtggaggtatcactatatcatgtacctatagaatgttgaacgtatatgatatccaattctctattgttcgaaatgcattaagtacttttcattaactctacacacacaaaaaaaaaagtatttttcattaactgaaaaattcactgatttattgactagaatttagacagcctgatcatattaaaataagtaggacacaaaaccaatttttgcatatgtatgattttatgatttgattcttttggtctctgatgcaaactagcaaaattcttatttaaacccaagtaaacaaagggttttaatgtgattttgggtttgacccattttggttttttttttgtaggatccattttggtttctaatagcataaaaataaagaactatgaattttaatttaatttcgagttgtatttgaatagttagaatcatatgatagatttaagtaacatcttctatctccctgattgagatttttgtaggtttagaggaaaggatatcctatttgaaaaatgccaaagcttttcttggtttagagagagaaactatagtgtctcggcaagaaatatgacatcccaacaaatttgaagaataaggaaatggaaaacaaactctcctccctttttaaggttcttatcattactccctttacttcaggtaattattttttctatttttttaaaatgtgcatgttaaagatctattttattgatatctttatttggatttacacattgtgcagttggtttggtgacaagaaaatgtgcaaagaaggatttagtccta

SEQ ID NO: 5211 - DNA, 1480 bp, Glycine max
  Soy_ogl_630 Gm02:43539001..43540480 Cluster 24
aaaaaaaaagaacttattcttcaatatttcatcacacaagggttatcccataaccttaatcacatatctaattatacccttaaaccactcttttttgcccaatatatagtcctcactcagtccctcctcaacacctccaaaggaacttgtgtattgtttttcatcccccaaacgccttccttctctatattttgactctagaattttacatcaaaagaatctccatttgtttgaatcttccattttcatttacctagcagtgcaacacattgaaattgtttagatctttaatacgtaacccaccctaattttagaattgaaaataaactctattttccagtttacataatttatattctattttaattatttttttataagccaaatattattaattattaatatgaaatgaagagagcataaggaatgcccctttgaaaccaaaagttcaatctgtttgccagtatatgatattttattttaattatagttccaaataattaaaggtataatccagaaaaccataaaaatttatgctagtaaagtaaatttaaatattaagaggatttagttcagttaagacaatacattaattattataaattctttggtgtttgtctttaattcttactaatgaaaaattaatttaaattacattttttctttactttcttactatgtttcaaatagtttccctcattaaatttttaatccaacttttttttaacacaaaaagaggttaaagcccaagcacaacagaaggggaaaaaaaaactacaccccaagcatgatgcttgcagcatcacagttggtaacattaagagaaatgttataagcacattcaattcaaacatattctttataattacttaaaatttattgaaaactacaatattaaaaaagggagtcattaaatataatatacaacctattaattttgatcatttttaataaatttcaacaaacagatctaccaaaactaaatcttgctgaacagagtcaaaagccctcttggctaaacaatcagctacagagtttaaaactatgggaatactcttgatcttgcaaccgcatgaagttgcatcatctttttcatgtcctggaccaaagcaagggctaactgattcgagtcgcaattctgagacaccaacttcgattcactgcttcaatgaggatatgagtaaagcctctctccaaagccaatttcttattactacatcctaaagtgtttttgaacgtgcttcctgttatctgttcttattaaattattaatcgagaaatcatttttgaatcttaaaatccatattttttaataacttttacccaatcttttctcaatccaactcaattcgaaatcctaaccaagttaaacagttatatttggagacagtaataaatatagtaaaacctgtcatactaaataaagactagcttaattatgtagttaatccatttcttcctttaatcttggaggactagc

SEQ ID NO: 5212 - DNA, 1002 bp, Glycine max
  Soy_ogl_625 Gm02:43220315..43221316 Cluster 24
tatgcactctatttagctaaatgacaatttattttcttgttaataaattaataagagtatgaactgatgattacatttcaagtatatatgattcctcgtgatcagagaccagagtctcaattatccaaacaaaaagcctcaagtcacattaagtgttttggagctacgtacttgatcttgggatcaaacttcaacttcacgtatatataaatataatcacacaatatcaaagccctttaactcggttttcttgctacttgtcatttgtttataaaacctaaaagcaccaaccacgcaaataagcgaaggccaccatatattactaatagctacgctcgctagttgtagggttttgcaaccaccggcgagagatgcgcctatgttgggagaaaaaagtggatatgatgagtagtaggacccattatggagcccaaagcatataaacataatttagtactccactattagtttattgcattcgcttaattaattatttgattgtgctgttgtgttgtctaaccactatttgttggctgggtgttctgccttaaacaattcacccactattagtttttttaaagctatggacatatatgctaaagatttcttacattggcattaggctcaatagagtgtgcacttattatagagttatagtggaaaatgttgtttttaacacattctcatttaattataagtataatgttaagtttgcgaatttttataataagtataatattaaaagttatataaataatgatttttattaattaatagtatatattttttaataatgtataaacattaaattctcgaattaatatgtatgagtgaaactaatcttaatcttctaaagcaaaatcttagaattgaattgaagaacaaataattaaaaaaaaagatgatactaaaaataattgacaagtttctcaatgttaattagtcattaacaaaagccaatactcaatatcaatatcatattaaaattcttacactataggc

SEQ ID NO: 5213 - DNA, 1200 bp, Glycine max
  Soy_ogl_1358 Gm04:43037701..43038900 Cluster 24
tttggtagaacataactttagagagaataatacctgttcagatcttcttgccaacaaggcctctttttttaatggttttcgttgatctctcatacggtagtttcataatttaacaggaatatatatgatttcacaaactaaaagtttagatagtttgtcattgcttgggttaattggtttttcccccttgcctttttgttcaaatcttttctattaatatgaatttctggtttgttggccatgactttgcaactttgagagtgccaacatagtttagaatgttcagagttgctttgccttcaactaaaaaaagggacttaattaaaaaaaattacatgaacaaagacctaattagctatttttagtttaattagttacttcaaaattttcaaatagttcagagaccaactaagtaatttagcttattaaaaatatggtatgtcacttgtagtaattagaagaatacgaagcccttaaattctctatggcagtatggctgaacaggagtaatatattataggagaaatactagtaatatatttttttgtattttaatcaataactaaaattcattataatttaggaaattataggtgaaacatatcaaacagaaagtgatatcgaaatatttttttgtaagaaaaatacttttttctttcgttttacatgctactagctagcatttctttattttccgttataaaagaaaaggaggggatcgaaatattaggacccaaatgttcaatatactagtattgggtttaacaaacatcattcatcgtctgaaataattagaatataaaggcacttttatagacccaatggtacaaaagaggcatataaccaactattttcacccacatttgagtgagaagggtgccaaaggttcctcgtgttaactggttcgtcagcaaaaggcaattccaaagtaatgttccatgcatcattgtcctgcaccaattcgaattggtataagtctaacgatagatgagagggatagctagctagctaccttgttttcaactaactcaggagttattctgacatgaaaatcgaaaagatcagacccttaatttattttatttgaatattgctcaaagagtattatcacctgatcgacaaaaatatttgttgcaaaagatgttgatatttaacacctgtgtatatctcaaacaaaattatcttcaaaagagtgtagga

SEQ ID NO: 5214 - DNA, 1419 bp, Glycine max
  Soy_ogl_2227 Gm07:6078301..6079719 Cluster 24
cagtattattttaaaatatattatttattattttagctttctgatcaaagttattggtgaataaaaaaatttatatatatatatatcgaaaagaatcatatatttacggacccctctctgatgtccaccaattggctggcacaatagccacattgatatttacttaacatttagcaatgtaactcaacatttaatgtgtcatgtcgttaagcttgtagtagtggacaagcaaatgatgaaacatggtgacatttcatgatctttcagaaacttatttggtgacaacatttaaggatatatgtggggaatctagaatatcttttggagctaatgtgagagtttcacaaaaacttagatatattgttaaatactatctcctgtaataaaattttgaataaacgtttatttcataacttccacggataaataattaattaggttgtttcttttttttaattattgtttactagttaatatagtaaattatcctttttgtatgtgatctatgttgcgtgtatttgactgaaaattatcaccaaagtttttcacttaatggatggtttcagtttattgtacctgatttattgttttgtcattttttttttcattcttgatcataaatacccaaccaaggaaaaataacaaagttggtggatttgtatttcatagcattaagtccaacccaagatataaacccaacaaaactaattaaaaccagtaatgatcaatctagctatatatattaactagttcctactccaatactaaatagttttaccacaaaaaaaaataaaaaaaaaattcatgattcagagaagagaggtaggaatcttgagggacaattagagagttcaaatgaaaggatgtgacagagaagcatgtcctaataaagtttcatcggagaacaagataaatcaaaatgaataaaaggagagagatctagagagttaaggaggggactaaagagaccatgagaaccacaaaagatgtcagttctagaagagatccaaatgaagagtgtagttgcccacttcttagaggagataagataataatacctaagcatgtgggtgtgcaagcttgatatggaaagtgagatcaggagacatagatcaaacatcttgttcgtgtattgggtcccttcaatttcatttatgttcagcattggtcatttttaaaataattcatattcattcatatatatatgacataaaggaaaaaatctctctttcaaatcaagacattatctcaaaagtttctcattcagctccacattacgggtacaattcttggatattagttgaaaaaacaaatagtcataaaaaaggatataaaagttattaaactggtatataaatttatacaaaaaaaagcattattgtgcataaatttaaaggatataatttaaaaaaaaaaaaa

SEQ ID NO: 5215 - DNA, 1000 bp, Glycine max
  Soy_ogl_2499 Gm08:4566901..4567900 Cluster 24
tttttttttccgtgatcatgatattggttactagtggcaaagtgtatctaaattcgctaagtcaaccccactcatcataactttaggttaagttaaactaaaaaaacaaaaactttataatatttacaaaaagatgaactcagatcactttaaaaaattatcttttaattctactttttattttagttatgattatcatttatctaaaaacaaaatactttatactctattttttcatttgtagagatcaaactcaaaatattaaaatgttcacaacaatactttacaacggaaaaaaattaagtaaatgaaaatataaagaaaaaataggtcaaaactaagatggattttaggtagagtgtacacagttaggttgagtcgggtttagaaaacctatcacctaacccaattaaatttttttggaatgggttaggttgagttctaatgattttattgttaaatccaatccaattcaatcccgatcacaaacaagtcgagtcaattaggccatgaaattttaaaaaaatccaaaaaaaaatttaacaccaaaattcaaatcaccgtcgaataaaaccaaatacaaatttgttcattttgttgtctacaccaacatgaattgaaaataaaatgtcaagcactaacacaaaataaaaagttgttgtttaatgtgttgcaggcttgcacccataaaacaaacactcaacaaaataaatttgataaatgataatgatatcagcccaaaaaacaaacaccaataatacaaattaaaagtctaaaactgaaaacaacaatgcagtttgttggtgagccataagatccaatgcgccaatgctggataattgctcaaacactgcaagcaaaagaacaaaatcaattaaatgacattataaactaagttgaaaatattaccttacgaagtagtgatcctaactcgtaatactagcagtctcagtagtagttccaaccataacaatatttaaaggcaaaccataaaactcta

SEQ ID NO: 5216 - DNA, 1007 bp, Glycine max
  Soy_ogl_5172 Gm15:49131401..49132407 Cluster 24
tatcatcttcaatgttgtgatttctatgtttgattcaaacatagtgataaaagttgttaagagaaaaagaaacactcagaaaaggttaatattcagaagctcacaagctacggctgaaactctcacatggggatagaaaacttctcacaaggaaaaaaaaaaaaactgatatcattttgagtaaattttaattaaattatttttcatttaaaatttataaaaaatacacaattatatgaatcacagtctgtgtttaataaatcttcttatgatttgattatttttaatcaattttaattactaacaaaaaaatgaattaaaattgttagtgactgatatttttcttttttatatgtcttactttctagttttcccacttattcatatggaatgaatgaatgatgaagtgtcacttgaaagcaaaggttggcaataatagtctgagcagtaatgcccaaaagagcaatcaaaagatcgatgatgtgatcgcaggtttctgaaatcacagacacgatttcatcaaattttgaattcaatatcgttatttccttgaactcctagtactttttgtaaagtctagagctcttgaagcaataaaggacctatcactagtcctatttgtgtatttcatgcttctggctgacagccataaaaatgactatgaattatgggatgaagaaaaagaggaactgcttcttcatcgactaattaaagtggctggctagtttgaaacattcagactgatgctgctcaaatcaatctcaggacaatggatagtgtaaaattatgtacgtctttaacactatagttccctctctttcttttgaggtagtttttaacactatagttaaatgttagtggacttcaaaatatcaaccttttaatttctttatatacttttggctagtaacatgcaccgaatattgaaggtgtttaattttgttttagatttcagtaagattaatgagcgtgagtttgatttttttaagtactcatgtgcaatatgt

SEQ ID NO: 5217 - DNA, 1045 bp, Glycine max
  Soy_ogl_6147 Gm18:53101556..53102600 Cluster 24
catataggttgagagattagtatcataagaataaaaaaataatatagtaaagatgaaaaatgtcgttactaaaagtagtgtgctatatttgatactattaagtagcaatcattaatttaaataaatgagattttaatatatatgccagacaataatctcttgttattcaaacataatgctcgtaaaaagcagttcttccttaatttggttgattcttcgaagaactaatttgcctgcatatatacataaacacgtgaaatataatataacattttacacaatccataagctacacatcaaatataaaacaaaatataatataccattttaaaaaggcaattttcactgagttttgcggatatggaaagaaagcattatataactaagagataaacaatgaaaaataatgatttaataatctttctagaggtctagaccataagatgccttttgagcttgtttgaccgctgattggagtatgtgaagagacttttcttgaggctttgcatgcacactatgtgtgtccttcttgcaaattcaccaaaagacatggcttcaccgtgcaataatagaagttgaagatactactagaaaaagcatttaccataactaggaaatttcaatttgacaatctagaaattaatttgttataatagccatttaccataactaggaaatacaaggttttattttcacacacgcaacaatgtgaaagaaaaagtaatctgtgcttgaaaaataagttatttgttttatctgcatgtattgcttcaaatggttattctatgctctgtttatgaataaactttagacataatggatctgccgattgaaatcagttctatacctccataactaatcacctttcttttaattaaaagtagaaagaagctaattagcaaaggagtgaagtcagaaataattgtttgagttatattttattatttaatgttgttttttgtcaattcttataactgataaaccatcaaccttgaaaatgtttttgtcccactggcaaatgcaggaatcttattccaaaagttta

SEQ ID NO: 5218 - DNA, 1081 bp, Glycine max
  Soy_ogl_6494 Gm19:41756201..41757281 Cluster 24
aatttattgaaaattacaacatgagagatttattaaatattatatgagactcataattttttttccaattttcaagaaattacaataaataaaatataatatgttaaaagagtgtaacaaaaaattgttattatcatttctcatattattagtccaatatggaaaccttgagctgctctagtctacccaaaagaaaaacccttttaaaacttggagaaatcatttctattactaacaatcagtttcatacttttccaaataataataataataattcatactaaattctgaccaagacgaagatattcctatggtaaaaaaatgtatttttttagtaagtgtttaaaggaagtgaataattgcaatatttggaaaatcctaaagaaggaaattgttttctccacagaaaatagtgattcatagttgtcgctagagaaaccatcagatacaagaggtatcgataacaagatactactatgttgtgacaaggtttttgacagcaagccaagtataacaactagtgacaaagtggatcttatcgcacaaaaactggtcgacacagaatatgaaggaggcaacaagttaatgtcataattgtatttcgatgatcgtgtctttcaggagctatattggctagtcattacatggaggaaacaaaatccaattgttattaataaggatttggttaaaaaaaggtaagaatgttcaaataaacaatcatttagatgaaatcatacatgcaaaaagtacaaaaaattatgggtataggcaaaaatagaaatgattcaggtgagaggttattgcttactacactttcatgttgcttcttgcactaaaatattttttaatcttttaaaatatgggtacatatattttcagacaaatggattacagtaaaaacctactgaaatgggtggggtatccggaaaaggttctcccaaatattgggtaattttcgttaaacctgagaaaatattttatgaaatgggtggggtgtcagaaaaatataacaagaaaggctatttcaatagcatcatccaaaatgcttatacaaactcaattcattatctcagggtaataa

SEQ ID NO: 5219 - DNA, 1055 bp, Glycine max
  Soy_ogl_2244 Gm07:6972601..6973655 Cluster 24
attatttccaactgtataagagtgtcccctagtataattttatttcctttagtataattttatttagttagttcagttggttttcatgctatgacccaatcaattaacatccttaaacaaagttgaattcctgctattttttaatcgatttatttgaaaacccaacttattctgactgtattaattgtttttactgttaatataatatatttatttattagtaaaaaattgtttctttattatggtttagaagggaaagatgaataatacattcctatatatatatatattttaaatagcatgtatttttttataaagaaataatcttcctgaacataatatgattattatagataataaaatttgttaaaccaccaaataatatttaacacaactatatgtgcacgtctgttgcaatgtactagcatgaaatgttaaatcatctaacgtgagcatggcattcacattgaatgcatcacaagccattcttaaataactatatcaaaagagtaaaggctccaccatctgaactgtggtacgaaaaactcccagcatctcctgtcttgtgttaatttttttgtgttaatgaaagtttaaaacatgatttggccagcaccacatgtgatagaggactgtgccaagaatttttggagtcttatgcaaaagtatcagagatacttaatataacataaataattattactcactattttgcttttaccttttttaagttgtgaaatcattaaccaaaatcactatcttggggttccgatttacttttcttcccttgggaacagcaaggagttctcgcaaaaccaaaactcattcattatatttaaaaaaacaaacaaaattgaatatcgaagtttcatactatatattatatattaaaaaaaattacatctaggttctcttctcttccatctattacaccagttagtaagatagagaaagagacataggataagtgagtgtctcatgtctctttttctctaattagagattattactttaagagaaaagtttgagaattatcccttaagaaaagagagaat

SEQ ID NO: 5220 - DNA, 1100 bp, Glycine max
  Soy_ogl_6347 Gm19:2508901..2510000 Cluster 24
tttccaaacaaagcgatatttcacattctaggcaaccggaaattaagtctccatttgttatgcacatactttgtgcatttccactttccactcaaacttgggcaagtgtttgtttttcaagtgcatagggtgctgatgcattgcttgaattggattcatggaagattgtaatgatttattcttctttctttccttttgcgttggttaacatattctgatcttaatggttaggatttgggattgaaaactgtttttaagttgaaaattttgatctgtccatgtgaagatctgattcaaaccagataataatttcttttaataaattagactcttcttttttatctttacaaattttggataaaattgccgaagatcataacactgcatgctagcatatttttgttttgcagattcaatatggttatactaattcagatgtttgctttcctctgtctctgttgtagatgctgatcttctattgtggaagaggtggcatgtttccttgggtgtcattttatgtattgctgattttgatcattgtgtatttttcatcatttttaaaactttaaaacttacattggtatgtttttcttttcaagcagacaaccaccaactttacctgagctagtttgtgtcagaggagatggttaataatgtagctcatgacatcactattggcaaggattttagaattttttttcaaggttaattttggttcaggaattcagctcactgccttttagggattgtggcttggggaagtgttatttaactaaatagtatttctttttataaagatatatatttttgttctaaagaaaactaggttgagtacgtataatattgtatagaagaatgtagtagtaaaattaaactaggatgacaatttgggatgggcttatgaacctacttcaaatgtaccatttgtttctcaactgtatttgcaagcatgttgtgttatgccagcaattttcggtcttctccaaagtttttattatgttatagcaatgcaagttttgcatttagaaatgagatcatatattgtgtacatgagttgatggaaaataagtgtccattgtctgttttccacttgacaggtg

SEQ ID NO: 5221 - DNA, 1088 bp, Glycine max
  Soy_ogl_4369 Gm13:30696970..30698057 Cluster 24
ctgaagctcaagaaattaatatagagtatagttatcttaccgaagaaagtgaatcaaaagaaaataaaaatacaatgaataaaaagtaaaatggcttgtaaaaaaaagtaaaatgatttttagattatttgataaaaaaatctctttcttttatttatttctaataaaagaaaaaacacataaaaataaagatagcttcgtcttcttattatataagcaaattaacttctttttttctcttcgttcagtccaaaatcgaacggatcatataaaaaggtgggtctcactttttttttctttctgtttcatccttcctttttaaaagcttaccaaaccttagaagataacagttgttttttcccatttccgttccatctttttttttccttgtttctcggtttgtaacaaaataataataagattttttttccttttctttttaatttttgctagcacttcctctttaacttgtttttttatatttaattattgatttaaaatgggaaagcttgagtcagtattaacgtatgttttctttctttctttctaatatcatttgtaattcatgaaaaaagatgagagatttgagataggggctggttctgcttcttcttcttctttttatttatttattaaataacatttacaattgatgcagcaaaataaaaacaacgaaggaacaaagtcgtcaaacatagtgcaaaatgaaaattacaatcattggctaaggaattaaacacaacaaaagtaaaaccacccccgtcaattcgctctcatttgtttcagtggattctaatttataagtgaaatcagaacaaatcatacgtactttgcattctcatgcttcccatttctcaaaccaaaagctaagttaaaaaaaataataatggaaaaatagcaatggtgaggaagaaaaacaaagagaacgagagaacattaaatatattatgttttttatattttaatatatgatgttcaattgtcaattaaagctcaattaataatgtcaatatatatcacatttttttttgtataactaccttttaaaaaaataaacattataactaaaaaggttagacgattaaata

SEQ ID NO: 5222 - DNA, 1197 bp, Glycine max
  Soy_ogl_2333 Gm07:14500804..14502000 Cluster 24
tggatctctttgaaataatatttattctagcaaatcacagaagatgctgcaaactacaaaagacagaatcaaacaatgattgtcagaataatgacaatattcttgaaaggtagagcttggtgtgcagaataataagacatgaaaatgaaataaagccattcagggtgaaacatatttttattgttactttactcttaaaaaaataaaaagcataaaatttcaaaataatatttccgtttctgtttgaacggaaagaaaattataatcaacgtgtatgattgacaaataatctgcatgtctcttaaacatattataagttattcgatttcacaaaaaaatacctattgaaaaatcagtctagatttcattatcttgaagactaaatttatggctttcagttgggaaactcttcaaattaaaaagagagagagagagagagaacacaaatttgaatttttaaaaaaagataaaataaaattttgtttccaaaaatttcctatttctattttttctgcaactacatccaatctaaacataaaattaaaatatctaaacgaacggggttcataaagaacatgaaacgaaatgccatatcaaatgcacacgcgctttgtatgactgtaggggtttgatcatatgagaccatgtaccgactaccgaatactcctaaaccatataagtgaaacaagtttttaagtacaaaaagacggtagtgccccaaccaaaaaactgtaggtcaacttcatagtagtagccttcttttatagggaacgctggtcattaaataaattcctatgaacaattaaggaatagaccaaacccaaagtacaatcctcagtcttgtgtggatgtggataacttttaacgacgcaaagtcttcgacgcactaaataggaccagaaagtgaccatgagcaatttattataattgggctccacaccaccttacggaatcaaaagttatctatattaagcaagttatagtgttgttatactttgaaggctttacacgaaacatccaagtttaaattttggaatagttattttgtaggacacatgaacaggaaaataaataaatttctccgagggcttgaacatcacaccgaataaatttattttttaaattgtcaatgactgcttaagatgaatgacaaatacatgtaaattttcagagggcttgacacctaataaattcatc

SEQ ID NO: 5223 - DNA, 1382 bp, Glycine max
  Soy_ogl_627 Gm02:43327719..43329100 Cluster 24
tttttagatgtattaattattttttctcttatatatatatccttacttaattattctatccccaaatatcaatcaaaatcaattaaatagataaagaaataagaaaagaataattttaaaatgataatataaataatttacagatttaataattaactaaatcaactatttctcttaaggagtttgaattagttaaaagggacttataatataggaaagaaagaagtaattgagaagtgagacaaaggtgataactaaactaaagcaagttaagatattagaaaaggcaatgaagcatcaaaagatttgtccttcgaaggagcaagtgattttcaaaattaatggttagaaactactttactgtatcaagaaagacaaatgactcctctaaaatgctatattcactactctaaatctgcaacacaacatgatatatagtgaaagaaaagatgaatataactttctaacttttaatagtgcacacatatatagatcagaagcacgagccttatgtgacctacgaattttttgtaggtcatttgtgttgatcctatcagaagccaaagttcaaatatgaaaacttaaattttaggtgcagctttgacctacctaacaaaagtattaagtacatcttgaatctattagataaagcatatttatcacatgtttcaagttaatagcttattgtatgtaagtagggcttagattcagcatcacatttgtattcaatgtttacatattttaaatatagtatgtaaaaattgattagtcaaacaacttttctatatggtattagtaagtcacccatccgactaactagtggtgctccatactgtacatagccaccctttttttagataccaccactgtcaacaaccttttacaatgagttgcaaccaccaccaaacttttcaaatggctttcatggtgaacctcgatgaacaagattactttaccagcatctcaggaaaaatattgcctttgtttagtattttttatgcttttttcttctcgattataaatagtcatcaacctctttctttacgttctaataccatttcatctcctcattgttgtcatcttaagtcttaacctctaatggcatctccttcaatgtcaacttcaccaatgtccctttgtgacaccacgccacatctttacacgaggggcttagtgaagaacaatattagtagcctcaacacctcattatattttcacttacatgacccacacttggaccattccataccaataggtaactttcttcactcacaccctcttttacttaaattcccaataatccaagcaaaccttttactcttcaaattgatttcaaccaaaaatgtctaacaagtattcaaaaatcaatcttaccctctaac

SEQ ID NO: 5224 - DNA, 1157 bp, Glycine max
  Soy_ogl_2323 Gm07:10438444..10439600 Cluster 24
tgaatagtttaattgctttggtatttatatgcaatcctagctccaaccaacttatgagtgatttctaaaaatatatattttttattttctttccatgacacccaaatattggactgatttgtttaagcttaaaataattttaaaataagcgttatttaaaaatgttcttttaataagtaaataggatttatttaccataataagcataaataacttttttaaacatacttagaaaacacaaaatttcttattttattacaataagtatttttttagaaataaatttaaataaattcacccattaaatagacaaggaatgctaagatagacacagtacatttcctttaacacacctccataaataagtaataggttcaaaaaaattagttgatgtagaccaatgggagaaaatatgtgtaggaaagtgcgtatgagaataggaccctaacattcctcttaaataaattcgacatgcttgattgaattggtggaaataaaagccaaaacaaataacgatatccaatgtgccttttaccatgttacctgtggttattcattgatactaaatgagagatgagaagttcttcaaaaaggactcaattctttccatcaaaataatttcacttttaattaaaaatataattttttttttttttaaatagtgtgaattagtggtgtaatgtcttgaacttttcccctctggtagttactaaaactaagtatgatttcatgcagtttccgggtctaatgcaggataaagaagtgaacaatggtttaggcaattcttttgcattttttgagaggatcaaccaattgctcaggtgaaactacatgaactgatttgatgaaaacagacacatagaaactaaagtattactgacaaaaaaaatttgttactaatacttgtgtcactaaaattttactgatgatttttaaaaaattacatgcaatttttttatcattattgttaagttttttttatgctcctgaataaggtgacacctctatatcaatatgctttgaatgttaattactggctacatgaaatgcatatgctactgaagcatagcttgctgcttatgctattcaatccaatccaaatgtaaagcaaattaaagcagcaattcaaaaagaaaataactctgtgtgaacactgt

SEQ ID NO: 5225 - DNA, 1300 bp, Glycine max
  Soy_ogl_5665 Gm17:13124001..13125300 Cluster 24
acttgttggcaggtcttccataacatattccaaaaaattaccattcattatttaatttatatttgattgactgcaagtcatttctattcaatatatgcgtgtgtggtcctaaaatacatgtacacaagatttggtgtacatttgcaaatcaagaacaaatccgattttggattaaatttagattggcatgccaagtgagtagttcatctggaaggtcaactatatacacacaacttatcataattaatctttgcctttcacgaagacgccaagtttgcacttattgacatttgaattttgacactatatagtagataggctacaataatcatctcttccaagagaaatattggaaaaagctgtgactgatgatgactatttttctgtgctgtattttgtccatataccctccagcatgaaaggtattaatgacttcggggactttaatttgattcgttcagctttaaagtacatcaattttttgtcaaaagaggagagaattagtgtggggtaaataagagtgcctgaaacgcttcaaactctaatgtctttaattccttgaaggctagaaaagcttccaaatgagggaaaagagaacaatacattaaatttagatgtaacactttgtggtcctgcatgctgcaatcattaagggtgaataaatcaaggggaagtgccataatgggatagagggaaaaataatactgtaataaaaaagaaagtgtcattttgttatatagatccttcatgtaaacatatgtttcattatcatatgaccgtatcctttctttgctttattccaaatctttcagctttcttcattttatggaactttaataggctagcttgctcttggatccagtgcagcaattgctttaatgtgaacattatcaaataaaaggaaaaaaaaaatacacttgtaaaaaacatttcattttttaatgatatatttgtgaatgattaagaaaatcacaatgtgggtggggggtatatataagtctgagcttttctcttccccggcccatccgaagaaaatggaaacgactctgacttgtgcacaaatttatgaataagcaaagcactacttgctttctcataatctaactatagtaatattcatacattttattaggatgtttcactaaattaggctacataatgattctgagatggattaaaaataaactacttaaaaacttgtatttaatatctgtttttttcttcttttaattctttggccatttggtaatcttgctgatatttaaaatacttgcggaacagctagcttcttttagacctt

SEQ ID NO: 5226 - DNA, 1075 bp, Glycine max
  Soy_ogl_3874 Gm11:17720201..17721275 Cluster 24
ctccgtacgtcgttgtgccgctacaaaatcaccaccaaagtcgctccccttagtttttcacccttctttagcaaatattttagggaatggatcgaatcggagttaacaaggatgaagagaaatagagaaattttcatctcatttgttcaaatgcatggatttggcttgtgttttttagatctgggtttgtttagatcttatgtttttcatatctgaggtttttatgcaaaatgggttttttgcaatctaatcttcttcttcttcctttcttttgataattttactcaatattgggactttaggtattattggttgtgcctggttgtgtgtttccttttttttccaatactgttaaatgttgaaggtgtgaatttatgctcaccaagtgcttgttaaaattcgaatatctgaatgttctaggttttgggttgtcgatgttcttgcgtttctgtttctatttttctaggttgtggatgcttgcataattgttgttggttaaagatgttctgatctggattctgggtagttagaagttaattagaacatattcttgcgttttttaatttaaatatttcagtggcaactaaaatctatcattacttgtgttaattatagcatagaggtatttaaaaagaaagaaaaaatgttttgcggtgattattaaccgctaatatcattatattattaataatgttagctttgcatggacataatgaccatttaaactactctaaaaatataaaaaaactaaaataaattttttaaaaactaaaagatcaaagtgataaaaaaaaatatcaaatatgtcatttgacctattttcaaaattaaactcataattattattattattcaaatttaaatgaaacgtccttatattttaaaataggaaatatataagtgaaaataatgtaattttgtaattgtttatcaaaattagtaataaaaaaaacgttctgaaaccaaataaatcctaggtgaaacaattatattaaataactggtttataaatgaataaaacagatgattgatacacatcaaatgtaaaggtgaaaataaaacaaaatacaaagtt

SEQ ID NO: 5227 - DNA, 1000 bp, Glycine max
  Soy_ogl_4095 Gm12:35533401..35534400 Cluster 24
ttatatatttatcgttagctgatctatctagctagtataatgtataatgataattaagatgtacttttttattggcaaaaagatttaaagtttaaaccctatacttttgatgttagccacactgatctaatagttaatttcaatttaaatagattatctcgtaatatatttatatatatcgaataggttgtctcttaatatataaattatcactaaatttagcttataaaaatgttcttcattttaaaaagtctcattctcaaaattctaaatatgtggagcggtggtactggtgttatatcattaccaattcgaaggttggaaattactcccctcgctcccttcttcttctcattgacgtggtgtatgcatggaggcttgcagcactatttaatggcgcagtgtagtgtaagtccttctcccatgtagtgcctacctgatatatcatatatttttatgtgtgtatatatatatgccgggatgtgtatgaaagcaagagtggaacccagcaactctctttatggttatagttttgcttcaattgcaccctgcaagtcttttcgtttttgtgttgtaacaatatagtgtcaatattaatctgcatatatataactaggcaattttattcgaactcacccgacatgtcttcagacctgatatatattatagatacaaatctgggtatgtatttttttctttatctttacggtctgagatgtgttagttaattcaaaggaatcatcaactctgatgaaaagtcgtttgcataagttattattaatgattcgtaatttacataagagtaagctctttcttcgatattcaaagatatatagttctttgacagtaaaatgtgaaaagaattattcctttaaggaaaaggacatgaatataatgtgtctgaatggagaagactttattggaaaaaaaagtaaaatccatttttgtaatttttacgtcttggatgttaatccaataacttcctacttaaaaaatacct

SEQ ID NO: 5228 - DNA, 1000 bp, Glycine max
  Soy_ogl_4239 Gm13:23832001..23833000 Cluster 24
tcgattgaaactcgccacaccaattacaggcacccagcccaccaacactaaatacagggttcatgacttgtctcaggatcgatgttaacacctctaggtttttttttttttttcttccatcaactttccactaaggtggttgattttaatttgctcgattttaatttatagggaaaagtttttcatcttcttaatttgtggatcgatgtgtcttcttgtcacccatccaaaacaatttccaaaagtttttattctccccgcttttgttgtagtgtattagtattggtcaatctgcacaactgtcttggctgataattatgatgcagggtaaaatgtgttttgttttatataaatagatgattaaatattctgttttaatcttttttattttttttagtttttatcatagtaaatttatttatttattaaataatttttattttttatatattctcttctggagaccatcttaaaattgcaaattacatgtagacatcttttgtggcgagatttaaaccttgctttgtcatacagtgagggactaggatcttttgataatttttggaagaaaaagaagagaaaaagctttgaaaatggataaaaaggaagaattgagcaatataaatcccagtagaaaagagaaatagtatatatgtttaatcaggaattaataaaaatattttcctaaatgaaaggccaaaaaaaaaaaaagaggattgggaaaatgagaatttatgatggaaaaattattaaagttgagtttaagagtttgcttatcaatcaatcaagcctagatgactttctcatcatcctttttcctaagcttcattacaacaccaagtaaatacctcttgaaggaatttggttttttgtgttggaaatttttagaacttttgcaaattgatgttagaaattgattttctctatgtaagagtgcaacaagctcatgcacaagaatgaaaccctaagaaaggatagagagcttgaaattatagataat

SEQ ID NO: 5229 - DNA, 1000 bp, Glycine max
  Soy_ogl_5141 Gm15:47663001..47664000 Cluster 24
agttaaaaaattgtctaccttaaacaatgataaattaagatcaaataatttaggatttactatttttcccctaaacttgttaaggtttgcatgggaagcaattctaacaccattttaagggaataaatgtcatatataataggcaaaaggaaaacaataaaaatagacctcatatgatctgaagtactctttctgacttttatcatctatctgtattttgtacattgagtgtgaaattcttgtaaatagccaaatacaccataacaatttggtttatgcttttcgagtactctatattccattcaattattacgtgtcaatgtcatttttctcaaacttttcatatattgatctcccaaatataatagtaaaataaatacctccagattttagaccagggattatattcaaatctaaaaatgtcttaatgaactttttaaaaatgtatatataggtatattgggttaattttaaatttatgtgtgtaactttataaatacttgaatctataacatgaactaagtgctatttaggttaagattaatccaaatggagtaccaaacaaaattacttcaacttcacctcatttatacttttttcagtttatttgctcggttgctcttttttatttgaaattgtttaatcgcacaaatattcaatgcgtagtttttctaaattgccgcagtgactgaatatattttaaattattttcagtgaacaatttaaaattaatataaatctgtgtatattccaatgtttcattttttaaaatttttttaatatcatcctgtgacattcatggcaactataaaactacaaaagtaaaggtcttgctatatatttaagctaaagaaaattaaggctaactgaagcatagtttcaaagttcaatataaaaaataaaaaataaaaaaagcatagtttcaaagttcgtactaagaatatttatttttttattgtgattggttggtgctaacgtagacacatgagcaaaaacatga

SEQ ID NO: 5230 - DNA, 1200 bp, Glycine max
  Soy_ogl_5339 Gm16:7503801..7505000 Cluster 24
tcagagatcgtggaatgggttgaggtgtcaatatagggtgacatttgtaggaattcttgtttgggaaagagtaatttccagaagaatattaaaaatggacttgtcttcaatagttgatcacaatttcaatagttatgtaaaaatggcactgccacttgccaggtcttttgcataacacattttttgtagttgatcctatctcaataattatgtgaaaatggcattgccagaatcttttccagaccacagacccatttattctctttatagaattagaaagaatagcatcagaccggaacattgacactgttgcatcctaaagcaaagaagtgtttgctttcatggtttagaagtgaacttgtttattcggaggaatcatcaaaaggaaaaatgagtaccaatgatgttagtatggagctaacggcatgtttggttccgcgttgtgataaggttatatgtgcatcaattatgtgaaaacttgaaacaataaatacaagtttcttcgtaaattgacaattggacgtgaatttggttatgcaatgacgtagaaccaaacacggactaagcttaattaataagaaatttcttacttgatggtgtcattaaaagacaaaatatacgatgaatggttatgaaatctatatacgaagttcattcctcttgttttcaatgcattaaactaacatttatttaggaagataaactacaagaattttaggttgctgatacctgtgattatgaaatattcaagctcaagattaaatacaatctcgcaatagttgaaacttgggtatgaagtactatggtcccatttgtaagaaacaaaatgggatattttttggtcctttttgtaagaaatattgacatgttctaaaatcttttgaaggctaaattacttggttacctatactttattggttatcctatttacaagcaaccaagtattcttctatttacaagcaactagagtttcctgcgttctttgcatcttgaaagaggagtaatcattctttttggcatgtgaaagcggaatagacatttggtgtgacttgcttaatcttctacaacaccaacaccataaaacacatggttttcaagcaccaccatggctctcaaagagaagacgatttttatttttattttatataaactcactgcccaaggattccaatgaaatctttgttgaggattcattggaca

SEQ ID NO: 5231 - DNA, 1200 bp, Glycine max
  Soy_ogl_2182 Gm07:4405401..4406600 Cluster 24
atttcgactaaaaaggattaattgtttgttgttgatgaatgggtcggcctgtgtatttataacttagaagaagcatagccagattcaaatcaatcttgttctgtgcaccaaattaaaaagaagcaattgaatcaaatgttaatgttaatactcaatttgtaggaatgaaaagaaaaaaaatcatgaatgactctttcgtatacaattatattcataaatttttgatcttttaaagtttgtaacaaactgaacttctgaagtttgtgaatgtctcaatcaggaatttgtaatatatttgtagcacggctgttttaactcttcccccaccgcactttgtaaagatattgtattttaatcgttttctacttcacacaagaatgacttaggaacaattttatttcctattgtttctcaatgaaactacaactttcataaaataaaaataaaaaagcatgacagagatgtcagcctacccctacttttttttttcgaaaaataaaatcaattatttagaagcatgcaatgcacatggggaaaaattgattacttagaaggcatttctatgaagtttatcaaggaaagtttatttgacgaggccaaatagagatataaacccaattcacagagcggcggtggaataaaatttccgttataatagagtgacagctaacaaagtgcaatatgattaacataattggtaaatagttagatttctttaaccatgttaataaaagttcaattccctggtcgtgaatatatattttgataatctctatgttttatgtctatctatatatatatatatggactaaattaagagtggataagggagttaatgatcaccataacgataaagactaaatcaataaaacttgcatgtaagaggaccaaattaagagtatgcaataagggctaatgtcctatttggttgtaatgggagaaatatagtaaatgaaaatagaagagataattttaaaaagagaaaatacagtagaaataaaattggatgttaagttgtttggaggaagagaaataggtaaaaataaaataataaacatgaaaattactcttacaccctttttatagtaggttgaacttcttttaaaacaaacacaacaaaattattgagcgtgtaaaaacatccctctctctaacttggacccttcataaatcaataataccaaacaaggccgcttaaat

SEQ ID NO: 5232 - DNA, 1057 bp, Glycine max
  Soy_ogl_3766 Gm11:6162101..6163157 Cluster 24
agcaagaaaaaaggctccatgttctacatattcgttgaatattcttttattcgactaaacaataaacatgctgcatggatagtaatttgtagagttagatttgaatcaaggtgattttataaaaaatactctaagtagaagtacgtactttttgtttggataatattagaaaattgtttttagcacagttttttttccccctaaacttacaattaaaaatgattctgtcattttgtgggtgcaatcataaaaaaattgagtctaactaaaggtatattcgtatatatggaataaataacttgactaagcatatacatgaaatgaaacaaataatcttactcaagtttctttaatgtcagcaaaaaatacttctacactaacttcagtaagacttttgtcgaaacattatggtcaatggaaaaaaaattatattagactcattctaaactcaagttgagaaatgttaagcatgaatctaaacatacccttcacagtaatggttataattattttttctcattatattactcgtgtgtgttttttgactcaagcgagtgttgtaaatcacatcgattgaataaaatattataataaccgtaaatagagaacattgatgattattaaggatgaaaatttatgaatatatatgaaattttattaaaaagtcaatttttttaattatgatgactaaaaaaatcttaaaagtagatattgctcactagaagaagcatggtgataaaatatgtatgatattctaaagtatgattctaattaagaaatgattttaaagtgtgtttattccaagcttcgaaaagttttttttttttttttgcagaaatttttttcaaggttaagttatttttaagaatttgaattaagttatttaacattttaatgttggttttaaatttagaaacttatttctagttatttttttattatccaaaaagtatcttttttttattatcatgttttgtttttgttattttcatggtcaaggtaactaccttaatttatcgtgagaatacttaaaattgtaatataattcaaccaataa

SEQ ID NO: 5233 - DNA, 1200 bp, Glycine max
  Soy_ogl_4650 Gm14:4399201..4400400 Cluster 24
aagaaattgacaacattcaataaattttttaatcttcattcaaaataataaacaacttttattttgatcacttaattaaatgaatattaatatataggatactattttctgatgcaaatcatataacacattagctggcttaatttgtgacaaggcagttcctttctgtatttccataattatttttttacctaatcaataatgttaaattacgttcaaaatgagtctttttcaaatatgaagttatatttggcaaaagctatttcagaatgtaatttcacattgcataagagcctttttgaaagatttaaaaagtgcagaaaaccaatttgaaggtgcagaaagcaattgcctcgtgacaattgcacgcatatgctggcacatccgttggcatgaaaatggccttatgttacataattgcttaattgctgagatagcagatgaagtgatcgtcgacgaaaggtctacaaaagagttggtatcttttttgtttgaaagatgatatagggaaacgttacatgtatcattatattatgcatatatataatatttttcatatatgtcacgcattattatttatgtattttatttttcctgttttcatcctaaaaaaagtggcgttaatttgataacatgagagttaggaatgcgtaaactatgtatttttttatcaactgtaatcacttatttgaaacttaattataattaagactttttatgtcttctaatataaatgtattttattggaatcaaacacacctggattcctacagacttagtgtgttgtgaatcgagttatatgtgtaaattatatataactccatattttttaaaaacatatataattccacattcaaaatataattattgcacaagttttttaattagaagcaacggcacttacattatgcttaatcgttgctaacttgctaacacccaagtgcttttaaaaactttaccgattatctagatatatactatattatttgaataatacatggacttcattcattttttgccttaaagttatatacgaacccaaaaaccaaaagtacatactttaattgaaccaaaacaaaaatgcatttctatcctaatttatataaataaaaaattaatatttatttatattgttggtgtaaaattgttatacaatgaacaaaacaagaattatgataaatataaattttaattaaggta

SEQ ID NO: 5234 - DNA, 1501 bp, Glycine max
  Soy_ogl_6902 Gm20:40875985..408735 Cluster 24
gaaactaaatcgagcatattgtttttgctatttttagtctcccaaagtaaagttaggaaattaaaaataacatttttataaatttgaaagactaaaaataaataaattttttatgagggatcaaaacaaaaatacttcaaatttttaagaaactaaaaaacatattattaagtctttcgtatgaaacaaaagtcttcatctccatgatatattgatattcttggcacaaaattaagttaattagcccacagttccatactcaaatataattgtttctcttataaaaattatttatggtctaaaaaatgagaaaagtgtcccgattcaaaataagaaaagtctccaacttaagaatatacttataaaaaaggattttgcttctagcgcgcactgcttaaaaaattaaaagagaaaattaacaactaattttttgacatggattaattaatagtaatacaagtgaatattttatattaataacatgattaaaaaattaattttttttattgaaaatcatatgaaagtgcatttaaaaattatgaagaaacataattttacaaatctcaataaaatatttttccttcttacttaattaatgctctaacgcagtactgtttaatatttgcgtatgaaaaaaatttatattaacttcattccaaagtaataaatgggatctcgaattttaaatgtattaggtgttaaagctctcatccatgtatttaatgtaactataagccttttatcacggcttaagcattttgtggcctgaaggtatttgcaatttggtgggtgaatcggattctctgtgatcttaacttcataaaaaatgaagtgaaggcaactcatccttactacccgatagtctccaagatcaaggctttatggcagcaggattggattctttagtttaagcataccttgagggaggggaaccaaattgcagattctcttgctaaggatcgatgatgctcaaggggttgatcatttgattactttttatttttgccctaatagtcttaagcctaaccttttagcgaatgctttgggagttttgttcctaaggccttagtttccttttctgttcttgtcttttctttccctcagcattaaaaataaatgtaactacaagtcttacaactcaatattataattaagttgaaacaattttatattaattaatttgcatgctgagagttattaatatatatgaaactcgatctatgttatttcagtggacaatttttttataaatattttaaggattaatttaataattcatttttcctctacacttcattttagctaagtgttatgatgatatctctaggcaaaacatgtgacctgatgaaacctgacaactcataggtgatagctagctgcacccacacattatcagattgtctgatgtccaccaacttgttgccttaagttctagaggaaaaacataatggcgggtattattttaattaaagagtaacgttataacttactattgttttac

SEQ ID NO: 5235 - DNA, 1125 bp, Glycine max
  Soy_ogl_4709 Gm14:6262001..6263125 Cluster 24
tgattactcattgaacaataaaattcaaaagttagccgcatcaaatgccagcataaaaaaatataaaacaccaacattatcaagtgcccccaaatctcgaatatcttgacttttaaaaaacatcacattttccacttcataccgaataccaagccgttggatatattttatttttagttcaaacttcaaacaatataccgatagaagaaaagtaattttttttatgggtaatttaaatttcttaactaatatcctcaaaacatcagttaatgtttgtattttcctttgtatgttcaaacttagaaaacactcaatcaatagtcagcagcgagtgggtcacaggatctcttactggtttggctaagtgagaggaaatcaggaaactcgtcaactagatgaagagagagacaagtgtcacactagcactaattcaattatagacaaaagggattccttcggccatgcattcacattttacatactcaagaattttatatgattaaattaaataaagacaagtttgatttattaaaataaaatataactcgtcagatcttaatctaataattccattcaaaggcaagttcaaaaactattacggattttccgcatttgtaatcgtacattgcattgcaaacttataatttgtagtatttttcaaaatcttggaagacttgattataatattacgtgacatgttatagttagttccccttttcttttgttaaagataatccataatattgtctacttttcttcaatctaaaaacgagctagctagattcttcttctcaacttaaaatgacacaagatatattagcaagtacaaagtttaatagtctatttcagaagctctttcccctgataataaagaactactagttacagtaaaaagaagaagaagaagaactactagttaaaaagaactctaacttcattcttaaaaaaaagttttctcaataactaaaaaataaaaaatgaaaatgtcttcaaaatagaccaattcaaatacgtgtatagttcaccttaaatttaacgatgtcatacttaaatttaagaattagatgaaagacaagtaaagatttatacctctcttatcacatgtttcattaaaaatctagataa

SEQ ID NO: 5236 - DNA, 1142 bp, Glycine max
  Soy_ogl_6826 Gm20:38000059..38001200 Cluster 24
caccttaagatgagtgaactcacaagaaattgttttctaaaatctaatagaacatatttctattttttaaaaatgaaaacaaaagaagttgaaagtggagaagtcgttaactattgaatgaaaacacaattatctatatgcttaattattaatttagtccttgaattggagagtgtatttcttttttagtctttacaattttaaaatattattttagtccctgaatttgaaaaattattattttagttattggcataataaattgacactttgtgacaatttttaagcaccttgtgatgaattttttagctctttataacagttttcaaatgcaaattcaagtgactaaaaaataaaaattaatttttgaaaacagctaaaaaccattacaaagtgtcaatttattatgtaaggggactaaaaaatgtaatttttaaaatttaggggctaaaagaatatttttgaattttaggaataaaaaaacatatatcccaaagactaaaacaataagtaagtcttatctatatcagcctatagacttctatatttaattatataacaattttttataaaattttagggggaaaataatgtttagtctttttttttctcaatccttctcttcatcaagcgaaaaagatcaatgattaattcggagagttcggacggaaggtaagtaaaatctaacaaaaaattgtttctgttaagaatcaaaattgaatacttcacaaacaatctaaccttaactttaacacattaatcacttattttcaatccgtgtctagtctaatcgggaagtataaatataaatttttctccacctctttcctattcaagattcagttggggaaagacataacacagaataaagtccacacgctgccaatacactgcctccataaccgaagccaaaaataaatcctatttcatcactcatgatattccaatccactgcatgcacccttccatgtggtgacaatgacaacacatgcacttcatgacccggaatttaagttaatggagatccaatgccttcatagaaccttgcttcaaattattggatcccacctactagatgattaaaggagaggttcaggaaactagccaactgtgggaatttctccatcaaaatcgttgctaga

SEQ ID NO: 5237 - DNA, 1055 bp, Glycine max
  Soy_ogl_5203 Gm16:447101..448155 Cluster 24
aaatttaattaatgaggtattagttaaagtgtactttttggcttaacaaatagaccgtaaaaaaatattgcaaaatacttgaatgttataattaagttgagataatcagatttagaggggaaagaatcgatgttttgatactattatacaatcttgacgttgcatttgactagaagactaaattgttatatatataattgttttaaataccaaaaaaataattttatcataataatactatctaatttaaatataattaccttcaccgaaaaatatcgatggactatataccaaaaaagagaaaaatcaagctgtctcaagaaacttaaatgaaattttctaaagaaggaatttgtaattttgagaaaatggataatcattttaattgtcataatagctagcttggatattaatcttctgctagattactaaagtgaaaataaataatgctcacaagttcacagtttagaagaaattgtacgtggttagtgtcattataaatatgttgaaaataaagttaaaaatgattcaataactttatacaacaaatcacgtgaaagaaagtaattgtacgtagcagctacaactctttacaattttttttgttgcagttcgcgaacatgacatcaaaaagacaatatacattcgtattttcctaatcatggctataatgttataatattgatcggacgatacacttataaaggtatttctaaaaaggaaaaaaaaatagttcctatatacattataaaattcttaattttaatatttctagctatttcacaatccaatattttgatcgctgaaaattaaaaaataagcactggtctcttgagaatcattatttattgaaattcaaagagtaaaaacatatttaaaagttctgaaatcaaaatattgaatgatgaagtacatatactaaaaccaagaattttataaaagtataaagattaaaaacatttttttccttctaaaaattaatattatgatccaaattaaaaattttagctatgtttaaagtgatggtcgtggaattgatatagttcatctgtctc

SEQ ID NO: 5238 - DNA, 1100 bp, Glycine max
  Soy_ogl_5934 Gm18:5138742..5139841 Cluster 24
gtgctctagataaaaaaaatcttgcacaactaatacatggaagtgtttgtgagagggcttgagaggagtctatttatatttctgttgattcaaaattttgaaagagttattatatatttatctgaattcaaacccaattttgatctaattaaatttgaaatatatgtgacccattaagtcaacttgatttgatttgttgatataatatatcaatattaatggcatataactaaataaaaaattaaataatatacatttgaggtatataatattttataatatatattttaagataaatactttcaaaattagtagtatactaattaatgtaatattatactaaacaaatccatgagtaaagaagttatattattaatacataatcattcaaaaaagttatattgtttttttaaaagagtttatatgtcaattaattagattgagatgatccaaagtataatccaaatttatatattctcaaaatatataaaatataatttcttaaatattaatttgtcaaaggtagcttcggcctgcaacaggttttgagagtacataacaggtgttgagaacccctagatgcaccatatgtacaatactctgaaactagcactttttttttgtttttatataaaagtgtaactagcacattaattgtaaaagaaataaaaaaattaaagattaattctaataaaataaaaatttaggatatttatttataaaacaagtagaatttaggaatattgagcactcttttccctttaaagatgaatgcaaattgtttgcattattaactactaatgcgcacacactaaattcgatagacataaatttgggtacttatagtagaagacacggtaaaaatagattaaaaaaaattaattacgcgaaactaacaagaaaacgacaataataagaagactgacgcattagaacatactataaacctcttggaaatgtttagaagaggcattagtcattcagagaaatgcaccatacttgttattattcgtcacatactaatacatcatattccataattgaagggcatctttactaaaaatagaaattaaagaaagagtttaacgtgatgcattatg

SEQ ID NO: 5239 - DNA, 1000 bp, Glycine max
  Soy_ogl_4480 Gm13:36216001..36217000 Cluster 24
ctaaagaacatagacattggtggtttaatttgctattaaatattaatgttaactgctatcttttttcccttttgtgtgtgattatcaaataatgattgattggaaactattggtcgagagtaaaaccaactgaaaatttttaaaatcgccaatattttctttccattgaatgcgtaagtaagtggtgactccaaaagaatttttagcggggaaagacagaacgtaaggtattcgtatattttatactatgtttaagacctattaattaaattaaatgccttgtcctgaccacacaatacaaacggccaaaccaaaccacgtttaagataggaagggcaatataaaataatatggtatgttgcgttgccacaagttattgtcctctttcttttctacttttctttgttgtttcttgctttgccttgctggcttcaaattataaagttatcttagcatgttattcggattgcgtttttgctattgtaaatttgagttcattcgattggatgttcgtgaggtttaatagagattatagaacattaataatttatgttcattatggttcaatatggtaattggagattactagcgttcccaaactctctccctagctctcactcgaagtagacaatgcgagtgaattatagaagctcaaaacacgtactctttacaatatctttttgatcagctgaagatgataaaaaagataattcacgtgaggaattttaatctaattttttttcaattactccattttaagaaagggaaaaaacgaaaatattgatatttactaatatttaataaaaattgctaacgtgataatattgcaaatccacgctgtataaccaatattcgatgccactgatcacattattactatataattgatcagacttttcagaagatatctaagaaacttgcttcaataatacctctcgtgttgtattagaatagaagtttaaacagcgtgtgattaaaagagaaaacctttaatatatat

SEQ ID NO: 5240 - DNA, 1059 bp, Glycine max
  Soy_ogl_5320 Gm16:5474001..5475059 Cluster 24
acacaacccctctttttagtaggataattttttaaaaagtgaagttggatgattcttgtgtcaagatttatttataggggtggtcatgacttttaaaacctttttaaataaacactattgatttcttcttacaattttaaaaattacctcccttaaaaaaatcatcatcacaattcacacatacttctagttttttttgttttagagtaacacacacttttagttacaaccttttttaccaatttattatatcttaaaattatccacttgaattaatgattgaaaaataattaagacgaagaaatatcttgcatcttttgcctacaaaggcaaggtggtgattgattgatttttttttttatgtttgttgattaattatttctatacgtttttcattaatttattccaaaagttccacatgattaggaaatagattaatctgattacttgaccaggttgacaaaagaatgcaagacaagtatatattaacattaatttttttgtatcatattaacattaaatttaaaacgcatgttaaacaaaaacaatatttactttccttcctatgtatcattcattacaacgtgggtcaagtgtaggaaaaaaagttcttgaaataagccaaataactttgtttctatgataaagaatcaaggagatatatttttaattttacaaaaaattaaaattatatacttttgcaattaatttaaatgataaatgcaattcctaatgggttacttttaagttttaaaacaaaattgctttaaataggctcgtgctttaaacaagttggctggggcattgaaacttattttataatcaagcctcaccggattttatggatatatggaccgaccaatcagagagtttgggtgaagaaaattgattgaacaaagacaattgaaatgagatgtgtattttacattaagattattgggcccgctattggcatcaccctgcaccacgccaaacacgagccggaataaaatatcatctgctactgtggaaagggaaaggagaacaaaaacaaataataattgaagtaagcaaatttga

SEQ ID NO: 5241 - DNA, 1092 bp, Glycine max
  Soy_ogl_1275 Gm04:7224501..7225592 Cluster 24
ttgttttagtctctcttttttttttttcctttaaggattttgcatgaagccttcatggaagcctaaactgctttgaatcaattcactagtttaaggtttcttttatggatcttgagctctggttttaaattgtttttcaattcttggtttactttctttctaaatgaatcttaatttttctctcttgaatattgattatgaattctattaattaggttggtgcattatcattcaaatgtgaatttcactattgatgaatatggtaagcgcttgaattggcatattctatttttagatacattaatattgatttggcatatccaagttgggattaatagggtggtatgtgatgcttaatcattagtttgataaatagccattttaaaaattagtttagaaacttagaagatgcttgatcatcaaacccaattacttaaatatcggatgctcaattcgatagaattctctttaaattgattaattcggttaattttgaagtcaaacaataatcgaattaagaataggaagttacaatgtttttttgtcggcaaagataatatatgtataaataaaaataaagaattggaagttagatgtattaagaaattgatgataagtctagttagataacttaactgattggtagttttattgaattgaattatttattaattgcaatttattttcaatcttgaaaatctcatgaagccaaggaaaaaaaatgttttgatcttttggacaatttggcggaggagaaatgaatatgcaggtatgggaaaacttacaaaagccaattatctcatagcgtcacagacagtcagacattacgggaatgccatttggctaaataacatattattaaggttaaattagtttatgaatccactaattaattttttatgtttgatttttaaaatttttaggattcaatttgatattttaatatttaaaattaatttaatttaatcatactgtctaaattaggtcaatagtattaaaaaatgattatttaaaatcatttaataataattttaaattatcacaaaatataggatcaaatttaaacagcaaggattacttaaattaatagtc

SEQ ID NO: 5242 - DNA, 1194 bp, Glycine max
  Soy_ogl_1922 Gm06:13540207..13541400 Cluster 24
gtgcaatatatgaattaatacgtcactaaataaatttaattttttacgtagttaatattatggtcgagcgcttttttaacgatttgaaaaaaaaatctaatttggtgagacaatctgatttaaaaataattaatagattacgttattattacataaaatttaagaaacttttatgcacaaggataaattccgaaattaattattaagtgaaaaattgcaaaattcaatatatttaaatgatttttttttgttttaaaagtaatatgtatcatagccctgcaaaaattgcacataatgttttttcataacataatttcagtactgaataaaaagttttagatggtttactaaattgttttacttggttataagttttaatgtaggaaattcaactagttctggtagtcacaactaaaactaaagttaatcatgtgaatcacaaagtgtgaaaaaagattaactttgttattttcacttgtatatttactaactcgggtagccaaaaggaaaaagataaaagatgcatcttaaaataatgatgtctagaatttgataaatgattaaaactcaagcatgaaatacacatgatatatgaatactaatatatagctgttttttgcttgttgtagcatgaccttgaagaagaaactcgacattgttatagtgtcttcctatgttgtccaagttactgctattcaagagaaacttgaacagatgtatgataggcatgatggatttaatgtggatgtggagttcattgatggttttcaaggttgcgagcaagatcttattatcttatcaactataagaaccaacaatagagtatcacactatgttttctattttttattgtcttaagtgttttagaggatcatattaagtgaaaagttgttgttggttcaaaattttctaggcactgcttatggatttttggggaacgaaagagcccttacaaacaatgaaaatgtttggagggctattgtgcttgattgtaagagccggaaatgtttctttaatgtggaccaagacacaaaaatggcaaaaactattttggatgcaatcgaaaagtcagatcaatttgattatttgcttgatgcaaatagtgtccattttaaaaatgcgctgtggaaggtatgtggatcttgaccttaattttcaaaatgcactgtggaaggtgtgtggatcttggactta

SEQ ID NO: 5243 - DNA, 1199 bp, Glycine max
  Soy_ogl_3446 Gm10:38695913..38697111 Cluster 24
taaaattcttaaaatattattttatattttatttaataattaattaattaataatataaaattattttacattatgattttgatgagcactaaactcttataataaaaattaaccatacgtttcagtttacaattgcataagagtataattaaaaaagcattgaagttacgtaatttatttactcataattttgtgtcggatatacaagtgaaattataattaagtaaggcgaaagagaaaagcataataataattatcaaacagaatcgtcaatcaagacatgatattgatcatcgatgagcttttacatctttattttacttttacctttggatgccatgcaactaattaagttgcgcaatttgccaacaatcattccatttcccctcttctcactattcaaaataaattattaaacttacctcaatcgtttaatatcagggttatgatactttttcaaaagatttgaagttactgtcagcattcactttcataagatcagtccttttctcatctttcaaatttaattattcattaattatgaagccgaccttagtctattaagaccaagattatgataatttgaagttagtctgctgataatataatttttcattctaaatgtttgaaataaactaatatcgatcactattcatttcatgagaagaaaaatgttctttttatgaaaatatataaaattatctagtaattaacagtggaagtaagtccaaataagttagactttatctaaatctaacccgctttattttataatttcacgacccaagtctcctcttagtatgtcataacattgtccttaccaaaaaaatgacattgttttttaggcttgacatatataaatttggtatatatagcttgttaattgttagcatgtttaaaagcttattgtaatagatcaattaatggatctataattacctaaatatcccaatatacttacaaactaatatagctctatcactaaaaaaaaacaatagatttatatatggacgaagacttgttgtgaaacaaaccaataagcatacgtatacggggtaacgaatttatcgaactaaaaatggttaaaaccacacaaacgtattgtattttataaatattaaaactaatttaaaacatagacaataatactttagttgttaaagtcatgatattatattatatactaagtattaatata

SEQ ID NO: 5244 - DNA, 1300 bp, Glycine max
  Soy_ogl_5390 Gm16:31193901..31195200 Cluster 24
aagactaatgctactatattaatctaattatgacattgagagactctttctgaggacttggcaacatgtcatgatctcatttcaactttacaaccgacaattaaattaaatgataatttgctgttaaactcaatccattgcatcaatcatttcagctacttgaattttctcctgctgatgggaaatattctttcaaaaaatgtcacacatctcccatgctttaagttatgcctgatcataacaactttgataaagacttcacaaggatatatacctctccccctccaacatcttttgtatttttgtgtaatctgattactctaaactggccctgctattactatatatatgtaagagttgggtcaattttgtcaccaacctcttgtgcctactattactgttactattccaatgtattttcttttttctagtcatctctatcaaagtagggtacgtatgaaaggagtgcaagtaataacttcttccgtctctaaggatagaaaaatgcgtccataattatcgatcaattgaggtgacttatttaataacatatcctcaacttgtaggaaaggatatggattcttttactagaatacatttttgagaagaggtgaaaattttaagtatatctaagccaaataatcttatagacagcttaaataacttaaacttgcacacagatatttcaggtctcacttaagaattaaatattcaaaatatagtagttataaaaaatttattcatttataaaaaaaaatgtaagaggaataaaagtgaggagattgaattatatatattattagtatataaattatgtttacacaaatatttaataaaaagtcaattaatgttattagatatttttaaaaatattttgctcaaaaaatatatagttatagtaaaaattaaaacgcccaagagaacttttctctggccctaaactgcgtttctaattgtacacaaataggctataacaaaaacagccctcctcacaaacagaacaattgccaaaagtcaaaatcctttttttataaattgaaagggtgagaaatgaatgtatcatcacttagtgtatgcttgaatattatctttttttatggaatttgattttttttgtctaattgtttaacattaatctaacactcattattttatgtttttacattagaaagtgtaaatcctcatgccaatcaaatagatttcaagacactcttacatattacacatgaaagcttatcccatgcaatgttgtatcaaacaaactactacctcatttcctatatataagaaataaataatt

SEQ ID NO: 5245 - DNA, 1100 bp, Glycine max
  Soy_ogl_6253 Gm18:58693201..58694300 Cluster 24
ataagcacgatcatgtgattatggaaaactgacgctcctcattcaggggctatatgaaaattttctccgcaaatcacagaattccatgtgattgtacttgaaaacactggtggccacaacattcacggatttgttctttcattaaagtatgttatctagccagattaccaaatagtatcaatttaattagaatgtcctaggcttaaattcacttcttattaccgtaatattatgattgtgtaattttagtttcttaacttttttttttaaaaaaaaaatcatgactcccgatgtttttttattgcacagttcactaattgttagtctactatcaatttttattaatagattttgttgtaatataatatggtgacatattaatgtgatgaatgatacgataatttaatacatatatggacatattattagaaaattaaaatcatacaatcacaatattttaagggtcaaaactacactcttaactttgaaaataattgttattattgtaaaagtcacatgcatctaataaatatataaattgggttatgaccacaattttaaaaataaatatttatcatttcaagcttctctttatcgtaacttttaaaggactttattactacaagccatatttcttgtaacttctatttaactattttttaatgggctctatacaagccttgcattacatagaaacaaaagatggagtacatgacatgtgaaccattaaaaaaagaaaacacatgtaagaagaaaaggacaaagatgtgcacacaggttattaatcctaatgaaacaaattaaaacatatttacaactgcatgggaaaaaaatggtcacaccacaatgtagcctgcaaaccaagtaaaaaaaatgcaatcaaccatagatgatacattcaataaaaaaagctcgcatacatggtaaaaaaaataaaaaaactaaagcaattagacgacacctcctagttgaagaaggaacaacctagacataaagactatggtgcttattttgggtgatgttaaggtgtacaaccatcacatcagcatgtcaatattacaataaaacccacttaaaaaataatatttactaatgattgg

SEQ ID NO: 5246 - DNA, 1374 bp, Glycine max
  Soy_ogl_4968 Gm15:10116301..10117674 Cluster 24
acatttatggttttaattactatttctagtgtattttgattgactttaaatatgttttttgttatcacttcgcatttagcatattcatgatattgaacatggactcaagtaacatccacaccaaatgtacaaagctaaaatcataattcatgctttatttgtgatacaataaagtggaaaatcataatgtgaattctgtcttccttatttagatcacggcattacatgataatcagatgtcattgcatcatgagccatgtcaggccagtgagtgatttaaattcccaaacattcttgagcatgttcattgttgacctattagctggttgtctgtgttgaaaagaaacttttaatccatgttaaagttaagattgactttgtaaatcatttataagaataatacatctcacaaccaaaattagtatacattgttgttcttttaccttttcctctcgacaacaaaatttgcttttatatgggttttaagagaaactgatgtcaaactatatttcctacgcattgatttaataaaaattgatgtaataaatgctctttaattttgacacatgcatttcttacatcagttaaaattaccagttaaaattacaaccaatgtaaaaatgatttccacgccatctatcaacggaagttaaaaaagttttttttagtgaggaaagcttagtatatgaaataaacttatactctagaatgagattgttggaataaaatataaataagttgggtttttcgttaagaagtatgaataagatcattaacatacgattatgtattttttccttctaattaaggcatgccttgcacggtacacaagctaacactagtaagttgaatatgcaacaattaatatataaggaaaatcaatttttagatggttgttgctcttttgtctttttatcatgtttcaaatttctttgttgaagtgattcataatatttttatattatccaattgattgttgaattgcgggaggtattatatggttcaggggtaatggccaaatcttgatctaatctgggtacgtatatgtgttatatatatacatactaacatatcaagttaaaactttgattattttggtaaataaaaaataaatatgactgtaaattatatttaaatgtttaaaaaatgaaattattttttaagtggttatataacaatttattaagcgagtatgtaatataattaatttttaatttcgactatacatatattattatataattaggatttataattttcacatttttaaaataaagagtcacctcatacgtttgtgtgtgcaataatttaattaagacagagctgattaaagtggtctgttcatcaggaatatttatacttttatttaaccat

SEQ ID NO: 5247 - DNA, 1109 bp, Glycine max
  Soy_ogl_2962 Gm09:3247301..3248409 Cluster 24
ggtgttttataaatttattgaggttcattattggtttagtacttcaatttaaaagtcctatttttttagtgtctaaaattttaaatttttttgtacgtgaatttttttaaattgctttttttaaaaaaataaaattatttccatgataagtttgcaatttgttccacaatttaattttaaatttttaacggttagagtttacatttacaaatttaaattatgaggaattaaaaaatataaatttcctaatttagcaattaaaaaacatttaaatttcataatttatgaagactcttatacatcattataggaaagaaaaaaaaattgttctaatacaatattcagcttatgatatttcgacacatacttgtactgtgttcatgccaaagtggtcgtactatgtaaggttgctgattttcctaaaatgtttgcttactttatgggaaatcaaatcatcatccctcaaaaaaggtaaaaaggtaaggctgttttccatctggagaatattgcaatgtttccagttcctataataacgacaataaagaagccaatttcaagcaatgaacacgaccaccctagcaccaagacgccaaactagacatgttcatgtgggggacggtcttccaggaaatacctacctatatatctgatatgaatggcataatgacacacgataagacacaactcaccaatagtttgggctttttaggtataagatatgggttcgatatgtaactagttatacgaaaaattaacattgtattaaaaaaatttgagacaattttttttataaaaacaatatttattttgaaatagaggaagtaatatttattattatttttaaaaaaaaagtaagaaaaagagatcactgggggacaaaatatattgccgacacctgaatgagaaaaccggactacctaggcacggattttcggaatatctaataaaattacctatgttttttgtacggaaaattatgtgtaacaattatggaaagtttgactggagtgattggatcagatatgatttaaactttaaagcatgcatgttgcacagtaacgccgaagaaatatagatgaagaaacatgttttgaattaagagaagggcc

SEQ ID NO: 5248 - DNA, 1100 bp, Glycine max
  Soy_ogl_701 Gm02:46875101..46876200 Cluster 24
aacaaggtacacaatcgtctcttctatctcatccccaacatatattatatatatacttgataaaactaaaaattgtcaaaaatattacacggttccatgcatgaacataagcagggcttggcaagggattgtggccccctccagaaacttcagcagcaaaatcataaggtagaaatatatatgtgtaaaaaaacgaagaagaaaaaaattctattcactttctattgaaaggtatagaggaatatctttggggtttcagatatgttgtaacatgattaattgtgggctatctttggtgaatatgtattcgttttatgcatttcttgttcattaatgaaattgcaatttctgataaaaaaaactttatattaaaacttaaaaggcatgagaagatataaaatcgaataagttccaaatacggattgacagaccactaattctgtggaacaaataatcattgactttgaaaattataaattgattgcacattgcttatcaatcaaatcaaatttatatgcgtcaattattcttgattaaggacatgtactccaaatatttattaagtccaaacttcttataatagtgtcattagtgtgtgtgtgttcgtgctccatgccttctatatattatccggtcatcactgattagcagctttatttattaatttattctaaaaagttttctacggtaaagtttattaaattaattaagtgtttataaactattatgaaatatgtccttcgttattatggacaatttataggtccttaagtcacgtggatgtgttgattttgttggcattcttgtgtgttgagtttttcgcgagtaagataatatattgttatcacaaggaaataaatatattctattttttttatttgacgaaaccattgttaaagaatcatatattacaaaataccttttcaatcattgtcttatgattgttccactgagattatgagctcttctatacatttaggaaaacaataaatattgctctctaaatcagtggtaaacatggatgcttcttcaacaactctatacccctaaatctaagtattattttattgatatacatttcatatatagattaaagttct

SEQ ID NO: 5249 - DNA, 1000 bp, Glycine max
  Soy_ogl_434 Gm02:7208201..7209200 Cluster 24
tatgaactattttaaaagtcataatcattattaagatttttataagttaactgtgtaaatatttttacttacagtacataaaaataaagtaatatttatattccaatcccctcttcttttactgttgttacctccattgattatgtcccccatgataaatcgtctaacaaaatttaagtcaacgtacttgattgtttgaaagagatgtaatgtacccatattttccttgctcctgcttcaaaaattctaatccaaggaattattttcctcaaaattacatgcccatctaaatccacaataaatacatgcagtacaagaaaaagactcttgaaagaattagttaacccatataaccctagcatgttgtgaatatacaagtctgattcaatctgtgcataatgttaaatatttatttccattaaactgcatgttgctctttgaaaacatatatcaacgatacttgaaaacaccatgggaaagcaagctgtgagctgagatgataaaagccaatattttattcccttgtttaagaaagttaaattaccggaacggtgaaagtgttggccaaaaagacaaagcaagccggccttgtgcttccaaaaaaatattgacgcgcgattaaatgtgttcatcttagttcaggtaaacttaggtttgaaattttttttctcaaaaataattttgatgattaaataagataaatgtaattttatgatattataattaaagtttttatttaatggtaagttttgtaaataaatagcatatgcagtaattgtgtcagatttatatattgtcatttaataataaatcgtcatatatataataaaattattcacttttataattattttctcaaaagctatcatattaatgataatttgtagttagttgatagtgtaattattttttacaatgacaatgcatatattttaacctcaaattttctaataagatatatgacaaaaaaatattcaatgatccatgtatgggtcttatt

SEQ ID NO: 5250 - DNA, 1300 bp, Glycine max
  Soy_ogl_705 Gm02:47061701..47063000 Cluster 24
attaagaatgtaaatacgacaatgtgaaacatttgcacgaaatatgatgctggaatggaggtgactttgttttctttcattacttaattttttattatataatttattgatcaaccaataagaaatcagcaatcaccaattcgtgcttataagtacgtagttaacattttcctaccaaataaaactatgttcattctaattagtacgtttgatactgttaatgcttgattcggcttaattttcactttttgaggaaaaaaacaattatatttatattaaactcttttcaagaagttttaaaaaaagattatttcttccagcatcctatttaaattaagaatcaaattattaaataaaatgtcttttacgtaaaatttaaatgtttttccttataaataaaaaaatcaacttgcggttttgccatagttaacaatgtgttcgttacccatttctgatgtgagtttatgcatcctcggatcctcccaaaagttatttggatgtaattttttacgttctatgtttttccaaacattcttactaaaacttggaaaacttatgtgtgagtgaactcaatggtgaattggtcgaaaagcataataagttcacatatatcaccttgaatgcaaggataaagaaaggagtagcctatggattatttttcttacctaaattaaagtcaaatattttcttctttattaaatgttattgaactatctctacatatatgtaaaagaaacttgcaattatattgtaaagacataatttgcacataatcactctgcatctaattgtaagttttgtctatctatactagactagaattttccaagaggaatagcccctttttttcccaaaaggaatgaatagctcttgatttcattaagcattaagtacataaatgaataaacatttccttttggtctctgttgttttattacctacaatatgtatataaggcttgtgattgtggtttagaagatgctttgcaaattcaaatgtctctccctctttatgcatccatcttcccaaccaacaccaataacggagcaaaagtggaaaaaattagttcatgtttcttatatccgttagcagaggtactgttagccgttgaactttggtttgtgctagactactatttttccaaagttcattttatacacacttggatcccaccaaatactatcttttcaactctatccttttcagtttccctcctttgagtctctgacagtgatggcatcacccattaacttgtttatgcaaggagtaattcaccggttgtgcctataactaaacaaca

SEQ ID NO: 5251 - DNA, 1100 bp, Glycine max
  Soy_ogl_2529 Gm08:6596401..6597500 Cluster 24
tattgtataagtaaatatgaatatttacatggtcatccgattatacaatatccagtataataaatttgtttataataattatttttaaaattatatcaaccataattttttattaattgatagtgtaatttattttatactaaagttgtacagaactaggttcttattagattaattaagaaacaaaaaatgtttatgatccatttggtatggtagagagaaaagaaaaaaaaattgaaagaaaaatatatttttttagaagttaatctttgttttctttctccttttttctactagtattttttattgttgatttgtttcatttgtccaaatatacaattaatgtgctttctctacccaaagaaaacacagtaacaaaaaactctacaaaaaaacacaattaatgtgctccgaagtttcaacgaacaccataaacaacgatgaaaaaaatgacaaagcaattaagaaaatctatttgacagttccacaaattaattagttggtcttgtgtgtcaaagttgcaatatttttctttggtgagaaatttcaaaatgcaaatcagtgtcaaatttactattcgatcaatatagatactagataggaccgcaagacacattaactagttagcagtagctactcacttcacatagggttgatctagtgatgagattttagagtagaatgcaagaagttgtgccatcattatatactaaaaaaatacttctcacattttatgagaaaataatctgtgtttttaataaattttaatcaataaaaatatttgttaaaaaaagtgtattaacaagtatattactaacattttatacaactaaataaaaaaatcaaacacttttaattctcttttttttttctttcactttcttttataaatgaagaatatataccgttagtttgtggatgcaaatgtgcgttaatggttgaattatccgcttgatcattcagttctctcctatcggagtctctgcacattgtcacattctatacttaaaaaataaaaaataaagaaaaccttaaaattaggttatggcatgcaaatgtgagcgtaagaaaaagctgtttttgtggataccacatatgat

SEQ ID NO: 5252 - DNA, 1111 bp, Glycine max
  Soy_ogl_1684 Gm05:35389590..35390700 Cluster 24
gggtaagatgagtgaattttaaccatataatccatatagatagttaagatgaaaatgattaaaacaactttgatcgcgctcatgtataattatgtgttcaaaagtcatcatgtatttttttttttaaagaatggttatataacttttaatcgtaaatattcagtatagttatatacaactaaatttactctcttaacttttatatagaaataattttcttactacatatatctcatatatagagagagatggagagaatccttttaaccaaagtatctagtagaaaattcgtatgaaagatataaacattcaatataaattacaaattattaaagaatttgattatcattaccattattttagagatttaacctttttaaataatgtgttaagaaattattaaataatatttttttttgtttctcataacgattctcacttaaagacaaatttatttaagaaatattcaaacattaaatataccacctcttctgaaacttagttcgtcatgagattaattccttttactaaatccaacctccatcattaaacaatatttaaaaaaaaactatacaaacaagacatcaaaataaaattaattaattttgtattaaatttgagttctttttaatcattttattattgcaaaatatccattaacttgataacaactggtctatgcaaagcaaccttatactatcatctattttagtcaataagtatctttgaaaatttaacaattttcttgtaatgtgacattataatttttaaaagacaaataagataattcaacaaacgttcaccaatttttttattaattaaaattgataatatatgcttgatcaaaattagtagtgcattcggtgtacgttaattatattcaataatgactttgattcaaaatttatatcccctacttcgtcatctttttttgtttcttttttctcttgaaaaccgtgtcaagaaagaaacttgaaatttacagcacaaaaataaagcaagaacgagacataacactcaaatatgcaatcattattgttggttgggaaacgatatatcactcaacatatggagcattgcttaattggttttgttatgctgctgattatat

SEQ ID NO: 5253 - DNA, 1100 bp, Glycine max
  Soy_ogl_6480 Gm19:41045401..41046500 Cluster 24
aaactcaaaagctatgctataattaagttataggtctgtttgtttgagttgaaagagaataaataagaagaaagatgaataataaaataaggtgagattaacactcttatattttaccttaattcaaaacttttaattttattttaatgtacaaaatatgatgtttaagaacttctccaagaaaaatatccatatgtgtcattatttgatttatgaacttaaaggtaagggtacaaggtaaaaactatcgtgactgtgagtccaatcttttttcattccaagttgtttgcaatcttaaaactcaagtcaaactttaaaaaaaaaatggtgattttctttaaacttaaagaaaataacgttaaaataataattttttttatataagtatttttttaagaagtaaatatgatatgattcttaaaataaataaaatagttttaaacagagacaatttaaacaaatacattaaaaaataaaaatttatttattttatcaaaataaacatttatttcaataaataagtttaaacacacttactcgtattattataagatgagaattgattggtttaatttttttaaaatcacccaatacaaaggaggttgaacatgcccatctctctctgaccctctccatctcttccttaacaaaataaaagctatagcatattcttaacaaaaaaaataaaaagtgtaaaaggagtatcggacatcattgctattcagcgtaatactctaagtgaatctttcttgctacttgagcccattacgtcaagtgcaagtattttcacgaatacgcaaaacaattacaaattgtattattgctcagtagcctcataattatttaggatcgtcaaattcattttgagatctgttggacaagagatacggtgatggaggaaagtgcctcgtatatatgccaaacaagagcatgaggaaacacgtaaatgttaagaaattattaggtaataggtaattctaaatcatatgattctcattagttttcatataacatgtactcctatttaagtgttatttatttttctcgtaatttaaaaaattcaaatacagtacatgtttgtagagattgattggaattta

SEQ ID NO: 5254 - DNA, 1062 bp, Glycine max
  Soy_ogl_1245 Gm04:5806254..5807315 Cluster 24
cactcacaattgtacagatttagtctacgcatataactaatacattatcttatactccacttttttaattgtcaattttttggagaaaaaatatttttatttatatgcattttttaagtttaagggtacattcattattttttatcaattatacccttacccacattgatgatttttcacatttttaaattgataattgaatcttttaaaggtgaaatacttatttattggtcaataatttagtggataaaaacataaataaaagctattagtggagaggaaaataattgtattggaaaagtgaattcacaaaagttataataaaaaagtctaacaatttcatcaaaattaaaaaaaaaagctttcttaatttgtacaaagtacaaacaaaccttaaactataatcattcagaaatagagggagtagtaaattgacttttgctacagttcataaaggaaacactgttctccatgtgcaaattttattgaatcatgatttatttttttggataagcaaagtcattttatttaaatagaagagttgggttaaaagcacagagtgtgcccagccaaagaacaacaaaatacaataaatccctcataagaacaagcctccccttaatatgcattaaagtaacaagacaaaatacgttgagcctctaataagcaacaacaatacaataaacgaaccctcatagacatgctatatttatatatatatattttttttccgaataaaaatgaaggatataataaaccagccaattgaacctttgatgaagaaagatagggaaaatattgaatcatgatttatatatacgtcaggcacatttttattcttctttcctctgtatctctgtctatcatagcagggttaacgtttagacacttaaacaattcatacactcaattgatattctttatatatttttttcatatctctcaacttcatttacattacataaacaattatatctattactcatctttcctagctcttttcttatctcacgctctatcttgatgaataaattattaagtagtagagtatgtataccgtgc

SEQ ID NO: 5255 - DNA, 1000 bp, Glycine max
  Soy_ogl_1499 Gm04:48814001..48815000 Cluster 24
tgttgaaaagtgcggttcagatgtgtgtaggtgactgcttggttatgtagtgattgattaatgattgacaaaggcaaaagatagaatgagaaacaggtaggcgtgactggttcaagccaaggtagcaatggctgattcaaaaataaattttaataaaaaatacacgcaatttgaagaaaaaatgtcaaaaatatgattgacaaaggcaaaatatgatcttcctaactaacaagcatttatttttatcaattatatccttacttgtctcttaatatttaattaatttacatatgtttattatagagtgaaaaaaaagtaaaattaaaaaatcacaattttatattagaataaaaaatctattatatttcttgaaacctgatgtaatttttatcaaaagaaaatgcaacttgtaataaactttgcttttaagccacttgcaataatttatggaattaatcaatagtattaatacacgagtacttgtacgaatattcttaattagagattccaaaattctatatttaggtgtattcaattagattttaaagtattttaaaatattttttttataaaaaaatatgtgatattcaattgagatttttaaatcatacaaataagtctcaggaaaaaatataaataacacatccattaaataattccaccaaaatccgtgagttttctctcttcttttttggctgccactgattaccaattttttttctctcctatcatacatcatctcttctctctattgaaagcgggggtttattggattaacaggtccatgttatagcaattaatcttgtgtgcttatactgacaacaaatatgtttgtgtcagcaagtgtacacatgttggcatttttgtacaattgcagattgaagctattttgatatgactaggaggattatgtggatgtatacgagtgaggcgttgctgtatgtcaatgtatttggttcttaggactatctcatgtatcagaataggtttattgtgcaac

SEQ ID NO: 5256 - DNA, 1400 bp, Glycine max
  Soy_ogl_3739 Gm11:5059401..20800 Cluster 24
acgtcatcacaccatttgcaacaaaaattaatgaagaatttatgtcagcagaccattcggtagacttgatgttagaacgaaaattcgtgagattgtgtaactttaagttggagacaaaatgtgcatctaaacttaatttcaacacactctttgtatatgttcaataaaaacattatttattaaaaaaaattaaaactaatacccttaaaagtcattacttaatactgattaataaggaaataaaagtattattgtttatagtaatcttatgcaatttaaataagattgctttaagtaaagaatacatacatataacttcatcaaaaggagataaaagcatagcccgatggttaactataatatggaccataaaattagaggatatatattttttttcaatgcttagttgtttagcaattcacatttcacactgtagtcaatgcgtctgccagtaccattaatcctagggataaaaagaggagcagattaaacattctttctgtagtttaatgtgttgtaaacaataatgcgcacttttcttttcaatgatggaaactttgtctacaaatatcatgttgtctcaacaagtagtatgaaacaatgcaagaatcacacaattcaaaggtgcatagcaaagcgaaaagaaagtggtttaagtctttaattatttaggtaatctatcatccctttctttttgttatcttttgaatcaatcttaaatccaatccgtgcacgtaatttattcattccacagtgtttaaaggtgttttcctttgtcaaggcagggttggccacttaatggaaaaaaggtgcatgttgattaattttagttttagaaactccaatgttaaacaccagtagtacttggtactaatcaactacctataacgggtttagtttatgataaaatttgagaggaaaagttgcactataatatattataatgataggatcaataagtagatcaaatgataaaactaaatttgatttttttaaaataaaattttgaatttaagtatgtggatgaaaaaaatgtaattaataataaaaaaaattataaaactgtttagttaaatttgtaaatataaattcattcataaatttaataaatattcaatgttaaaaaaaatagtagagagagggataatggtcaaaggttatgcatgagggctatgattatagcagacaatgtgcctgagactatttggagcattgtgtggccacgttttgagccagagccgcgcgtgagcaatgattgaagcctcccttggtttgctaaactcaatcatgaagggactgcaaccaacttaaccgttgggacccactttccacaccctttcagccaatgccattgacacagccataggagcttctctattcccactatacaatattgcatc

SEQ ID NO: 5257 - DNA, 1156 bp, Glycine max
  Soy_ogl_4693 Gm14:5894601..5895756 Cluster 24
tcaaagatgtatatagatgcatatatatatgcacgcattccctgctgttgcacagaatttgaaatcgaatcaaagaaatcgggaaccctggaaaaagctaaagaaacaaaggttaaaggtagggaaaatctggctgctgaatggcatatatttggattttatgttgttaatagaagggagggtgaatgaagaagcaaacaaagaaaaagtcacagatataatactaagaagaaagaatatctttgaagaaactgacaaaagaaacacaaccagtcagctaactttccacttttgttgtttgttgactaataagaacattgctttttccatcttttttcatggctccaatccaattatatgatcatcatgcaaatatctcatttgtcactccctcgtatatattcatatggcatgatggtattagctagtatccatgtaggaattaatgggagcacacagcaagtgtcatcactcatcatgcatgagtgaaatgaaaatacatatatgctatatagtaagcgtgagagattcaatctaaatgttgctaagaggagcttcaccccattagattccatcaattaagcataccaagtatagctaggaggtatcattcatcgatctgattctgaacccgacatggttcaaggaaatttggaaaaagccatgcacataccagctgtcttaatttgaaaggagacagaatatgtacattacaaattaatctgaccccacgtgttgaaccactagcacttcaaccttcttaatgacgcacttaacatttatcataatcattaatacttgcttagaaaagttgctttggttgcacttcctagggagaaacgggactagaagtgggttgttggctgggaagacgtgtcaaaattttgacaaatcaaatgtttcctagaaaaaaaaaaaattgtttcaaaataattgttagtgtaactttttaatataacattaattatttttttttacttatacccttataatattgacggtaaacaacaaaatctataaataaattaatgatgatataaaattaattttgtaaaattatcactttcttttttatttattgttttttgttggtctatggaaaataaccaaggatgataattattttgggatggagggatgagtattttagtaggtg

SEQ ID NO: 5258 - DNA, 1300 bp, Glycine max
  Soy_ogl_2598 Gm08:10756901..10758200 Cluster 24
ctctggacttggagataataatataataataagaaaacatcaaaatgattgaaaacatgcaaccgaagtttatatttttatattaaaaaggaaaaaccaagaaagcaatcagcaggggtcttcgttagttggatggttagtttactcatgtgcaaatgtgtttttttaaataaataaaaaagaaaatgatgaattgaatttgcagttgtttcgttcctccttgtcatattctgcttaattattgtttttaactttaatcatttgataaataattttataaaaaaaacaatcaacttatttacatttttatacttgttaataatctatatggtgtattaccaatgtggttgacataagtgtggttaaaaatctggtataaaattttcctttctctgtgaacatggatttgaatcatatatataacactaatttttttcatttagtgaacaaccctcttcaaggagatctttaacacttagaaactaattatgaataaataaaattatttgtagtttgaatatatatggtaatttttttaataattaaatttttgttgacagctccaacatatcattagccccgtggtagttccaagatgtgcccatgctataccattttttctaaaataataataatatttatcatatgcgaccagcatttttttatgattttgctttaacaagtattcgtatggaattgtttgaaaatactaaaaaaatcttaaaatgtttaagaatgttaatgtttttttatatataacataagaaagttaatgttatttgcataaatttatttatcaattaatcaaaattgaaaaagtaatttaaatggtaataagaaaaatggaaaggaagttggtgatgacatgggacttgtatcatccttaaaaatattttgcttagagatataatcagggacaacaaatatcttggtactttatattcggctatacagcacaaccctgataataaagaaaggttcaccaggatctcgttaacctaaaaaatgaattaatcataaaaatattttattgaaaattatgtttagatgttatgttgagagggtatcataatatttttttaatgttttctatttttaatttcctgaaaagtattttttttttctaattctaaattctcttataacattttactaactttcctactagcaaaatagagaaaatattaactattttttttatatatttgaaaaacatgatttgtttttttatttgatactcataaagtatttgaaaaatctgtagaaaaagaatataacgttattcgtttgtctgcttcta

SEQ ID NO: 5259 - DNA, 1115 bp, Glycine max
  Soy_ogl_2664 Gm08:13574501..13575615 Cluster 24
tgtttgtataattccaacaagatatatcttgtaaattttttcaaagagaaattcacttgtacaatatattcatataattaacgttttatataaaaatgagagatgtaggaaaaagaagggaaacaatttgtgctaatatatattacaagatatagagaattagagagagagaaactaatataaaaaaatgttgtatgaataataaaatatttttaaatgttaattttcggataaaagaattaattaaggggtcaagaaaacatttattttataagtgattatcaaaattattacatgttttttttgtgaaaattaaagcaaagataaagatatcataaaagggagtgtagaaggattattccaatccatatacaccaataagccatcaggctattaattacaatctgtgcaatacagtcaaaaaacattaatacaccagcagtcaggaatatcctatatattcaacgttaatctcagaaattgccaaaaaattaaggggcaaggaacttccaagttttgttaaacaccacattctcagataaagaattggatcctgtcacaagggaagagagtagaaaattgtaagctgaacaaaaaatataatataaaaatgagaagcattctcatgcaaatttcatatacctttctccccttttaccaatacagcataagagacagaataaaggtctcttccaacttcacacccaatgccatgaccctccgttaaattctcccccaagctcgcaatatagcgtcattcttattttcagtaatctgaaaaagttttgagaaggcatcttgaagagacatattccaatccaattaattgaaattggtcgcataaaaattattatcttacttttactatttttgtgtttaaatattttaaagacagtgaaatagacaagaaaagtctttttttaaatcaaataattccaatctttttattaaatttgttaagcactccttccatcccattttgtttaactttagaatagatcagaatattatgaaataagataaaaataactatatattgaagatcaaatttatcgatacaataatataggaaccttcactatgattaaaaatatagggactaaaaaataattttc

SEQ ID NO: 5260 - DNA, 1130 bp, Glycine max
  Soy_ogl_5504 Gm17:4377195..4378324 Cluster 24
tatgaatgtgttaaaaaagtttaatgtatgaaattttattagtcaaacataaatgatatactactaaataactaagaacaacttttaaatgattttttttccatgctagcttttcctatcttttgaaatcatactttcataaatcccccccccccgtttgatctcatttttgagaggtgactagacaataatctaagtcaatgggaccacaaggaaaaatcatctttctctcttattagccgttcacttcatagtataaatatcaatgcgttgactatctcacgtgcaaagaaaaatggattctttttcttttcattttttgtttttttatgtatgcctgtctgaatgtcattgactgctcttgctaagaaatatcactcataaactttgtaactacgatgtgtgacatgctaaaataaaactctgattcatattttattcgaagttgaatattaaagattttggacgagtaaaaccttagaatagtctaaatgaactattttatgaagatgaatactcttgtaaataaaaaataagaatgcgatgtgatgaagtgttcagacatttgttttttttagtcagcaaattaaagatatatattgatacaaaggatacccaaacctatatacaaatggtagacaccatctcataagagaatatctccatatataagattactcaatattaatataactatataaatatttaataacctaggatataccaaaaaatctatctttcaaaaaagaaataaagaatcacccagtacataaatcttccccgccattaaaccaatcaagtgttaggacatttgtgacaatttgtcaaagtactcaagatattcggcaagaaagtctggagtagagaaaaaaagtcctaaatttgaatggaagagaagataaaagaaaaataaagtttttttgaaaaaccattttctctatttctttctttcaaaaatttgtctttaaccaataaaaaatgtatcatcatttatatgtttttaatttttttttcactcacttaaacacaccataaatgtcctataaaaaaaattaaagttacaacttgtaatgaagttcataaaaaaacagatgaattcaatatatatatatataataacaacatattga

SEQ ID NO: 5261 - DNA, 1291 bp, Glycine max
  Soy_ogl_5278 Gm16:3773090..3774380 Cluster 24
gttctgtcaatatgtgtaaagaatttatgttaaaaataataattagaaaataaattcttaaaatataaagaggtttgagttgttattactccatatactaattaagggagtttattttttgtttaaagggtattattcctttttatgtaatcactaagaatctatcattaatattatgtctatatttaatatttaaattggatatttatgtaaatggtcatgtaaaaaaacttaataattaataactaatatttactgataaaaaatttaatttttgaatatatacgtaatagtcatgtgctactccattataatccagactaattcatatagcatgtgctaaagtaacataatctctatatatataaaaaaaggtaacataatgtcttcaatttgtttataatcacttgtttattttccaactagttaatggctttagcttccgcaagttaaccggattctatcacatggagatctatatctatccctggagctgctgatgtattgagagatatggtgtgggcaatggtagtatttcattattatggtttgataattggtctaaagaattaatggacccttatgcaatcaacttccttctattaatatacctgaatcctgacctcgttgtgcaggatgtcttttatcatcatactctgcatttctcttatctttacactattggtaggaaataagaaaaaaaattcaacaaagacacaataaaatgaagattgaaattcatgctttacttcatactttccgacttttaaatataaaagattcataacagaaaataatcgcaaatcaatttgtaacggcccataaactcacataaaaacagaaaactgtaacagacataacaatagaacttctaccataaactctaataaactacaataaaaataggtattgattcacattctcaacactatcacatacttcagcaaatcatcgttactgatccagtggcagatcgatgattatcacattgatatggaaattcaatagtgcatatgtctaggacaggcacgaatctttgttcatagcaagtctctggtgatattaattattggtcaggaatcagaataatagtttatatgagtcatatatatatatatacagtattatatatattatccctaatatacatgatcgatctacatgcacagtgatactgtaaggctccataatttgacttggaacacactttggacaaggtacaaatcggagagggctggttttggtggtctcattacaaatgaagacggagaatagctcgagggagacgtgt

SEQ ID NO: 5262 - DNA, 1289 bp, Glycine max
  Soy_ogl_3777 Gm11:6713201..6714489 Cluster 24
agtatagatttttttctagggtttgtggtgatctagttagatcattcaagtttgtgttttatacgtctatctatctaatatcgttaagtccttatttgtcattgttcctcgatatttgaaattgggagttagtttttacaatcatgggccaaacccctaacccccaagccttttgggatgttgttaggtaggattttacaatgactctatatgggtcgggttgacataatcgatttaaatctatatacctaattttaagggtgcacaagtcatcagtctcaagccatcgaggagaagaggttaagttaaaataggtattagatttgatatataagctaagaatatgatgcaatcttcctgccttaaattaaatagcaaagagaagaatatgatgcaatcctcctgccttaaattaaatagcaaagagactaagttaaaatgggtattagatcatattgactaggaatcaatcgggaggatacaaaaataatcctttattatttatttcaattttttaatgataaaataaaagacattagtcaaaacaaacactaaagaagagtttattagtgcagcatcgatttagacgagaataaatttaaatacataattaatgaacattaaatgcatatagtaaccatcgtaattagcgagtgggacttttgccgcatggtaaccatgcatcgacttagaaggctttttcccccctgtattattgtccaatccctgaatcaactaatccaaaaactcaagttatcctttcattgaagcttactttttatttaaaacaataaagatatatataataactaaggattaaatgtatatcatgtgatgaatcaattatcttaaaatttaggggttggaattcaaaaaactactatattagtaagaacacaaagaatgctcaaacccaaataaatgagatcgatgaaatatttcaacacaatattaaggtactacagaaaatgtgtgaaataggtctaacaaaatttagagttggttgaacaccgacactactaacgtcaacctagccaatataaattagaaataatccttcattattgatttaacttttttaatggtaaaataaaaagcgttagtcaaaacaaacactaaagaagagtttagtgcagcgaggactcagacgagataagtttaaatatataattaacgataattaaatgtgtagtataaccatgcatttagcgagtgggccggggttgatgcgtagtaaccatagcatcgacttaaaggctttttttcctatatattacctatgattttac

SEQ ID NO: 5263 - DNA, 1000 bp, Glycine max
  Soy_ogl_385 Gm02:4955501..4956500 Cluster 24
attttgatcctctactaacttttatagcaaattaataacccctcaaaattttgaattattatataattaattagtctctcagtttaaaactgcattgaaataagggtgtttaaaattttcaattatttagtaagggtgttaatttttttttggtattatatgggctagaaagcccaaaagaatattacaaataaataaatcctgagggtgatgatctccattatattagaatttaacaaatgacctacaaatgctggatgttcaaaactcatgaactccaactctatatcacaaataaaattagctaagcatcaacacatctattgccttctctacttaagtatgaacaattataacattacctcgttgcattaaagaatgaattcctcgaaccaatctaagacgaataacacaactggctccagaaccagtgagagacttcacaataacttatgaatcagattgaataattaatggatatcattctttctccttgaccaacttcatcccctcaaagttctgagaagttaacaacgtaggttaaaagtgaagagaagttaacgtaggttaaaagaaaaaattaaaaatttaaaaaataatttaaggataaaattatacaataaaatgtaaacataaaataaaagtatttcttttattattagtatagatattatctggtcaggtcagcgtcatttttttttagacatactgatttattgtaaagcctgtagtaatatctcttacagcaagtagtaaatttataaatcttccaagcatatccagtttcagtggaacatttactttagccaatcttgtgcacaaagattcatcccaaggatcttatgctatgttctagcgcccgtgtggaccaggaggcacgaagcaccaatgaattttcttgtcaattttttttcttaatattctgtgtgtttggtgctaaaaagaggaataattaaacgttaatgacgcaaaagatgaaagttttttttacagagatcaa

SEQ ID NO: 5264 - DNA, 1000 bp, Glycine max
  Soy_ogl_6 Gm01:533101..534100 Cluster 24
ttaagtgccaacttatcgatgtatatctcatgtttggcttattgagccttatcggatatggattgggctaaatttgaaataaatacaattcatattatcttttttaaaaacaaaaagaaatacatgttaagtaagtgattattaattacgaaaaattagtatcaaatctatgggcaccaataattaatttacatgcttaaaacaacttaagggaatgactaattttaatatcaaagcatataccacataagttttttaaccaggaaaaaaagtttaaaattaactgaatatcttataaaacataactataaactatggcttaatctatacaccacaatgaccacatcatccctggagtttcctttaattcagaggctttgctctcctactatatcgggcaaaaataaaatatatgcatcgcgtcagataaagatcattgacaagaaataaacatttttttattattagagtggagattcggccaattatattaatataagctcgaaactttcatattagataattaatctttaatttattagtattttatgacttaagtggtaaataacttagtttctcctaaataaaaatttcattttaagttttgtaaaaaaaataaaaaaatcctttagcctcttaaataaattcattttcaaattaatcgaaattaaatataaacttattgtttaacttactagtattatattagcaatataacttcaataagcgtttaatttatattagcaattcaatacgcatactttctaataattattagtggtataagactttaattaacaaatagttattaattaaaatttatacttatgtatatgttaatgctggccatattaataaatgtttataaatgttatattgtgtctgaaaaataaatttattcatggagatattgaaaatctctttagtattggcaatcagaaaagtcttatgtattgtaattattttgacttttttaaggataattatcatgaatttatat

SEQ ID NO: 5265 - DNA, 1047 bp, Glycine max
  Soy_ogl_4869 Gm15:2305383..2306429 Cluster 24
tggttattctcagtctcagccaatcttaattagcttatacaagaagaaaacagttgtaaaagtaaataactttcaattgtataattcattgaataacaatataacaaactcttacacactatcattatatatatattctataagtaaaacatattcattttattataacaaattaggagaccataagatagtgaaatatttttacttgtttagtcatggctaccctatttacacataaagaatcacccagtagataatatatattaataattttatatcaacaaatttatctgttaatatgacatattttatcatattagtgccaatttataatgtttgtatgaataaattaatttttaatagatatgaattatatacgtatgtatgaaattgataatatatgacaatttttttatctacctttttatattgatattaaatgagttgaataattaataagagaatggtcttagttgagacgtggttgatatatgatgacaaattattgcccacgttaatagtgtgggagtcaagtgatgctgattgtgttttttcgttggccacacagtgctaattgtgttctactaggcttctaacaaaaaggaaaatagaagaaaagcgggtcccgataacatacatatatttataccaaaactgctatcagtgtaaaaataataaaatatgactaaaacgttgtataagggagctgtttattgactacttaattgcttatcgttgcattacacattatactactgtacaagtcaaatcaaaattttgttaagaaattagccaatactgtctaaaaaattgtttaaaatgacattacttgacaaaaatgacttgtatccatggccagaacttgttaaagtagtgtcacctaaaaaaatgttctggtaataagccacaaaaattgataatcattatcaatattatcattggtcaagtgctctaacgttagtatcaatatagaaattaattaagtacatgtttggatttggattaaagtttatacatataaatttcaatcaaaagtatgttgtggac

SEQ ID NO: 5266 - DNA, 1057 bp, Glycine max
  Soy_ogl_5446 Gm17:1325501..1326557 Cluster 24
tgttgactgcacgtcagtatacactcacatcacatctctgccccaaaactttcatcctttcgtctcgtgatgatgtcaatgtcatcattagtgctaactctcacattgctagtctttctttctccatcaagctagatgactagtcaaactactatcaaacgcacgtttaggataactgaattttctcaatttcattttttttaaatcccgtttgaaaaataacaagtgtgcttggaataattgctaaaatttaccattttttaaaataataagattttttcatgtatttgaaaatttgaaacttataaccattttttttttatgttttttctcataaaaaacgctatctccaatttgaattaaaataatttaataagtaagaaaataaaaaaaacataaattaaccgtttatacaatttcaattttaccttatacttttttctttgctgtaaaaactttctttaattaaaaataaaaatcctctttctatttatttttatgcatacggttagttataataccaatttttacactttcttatccaaagtgtcggtcatgatcaatgaatacgaaatggtacaaaaggctggccacatagtggacaaaacttaattactcttctttatcttgttttaacaaatttatgaaacagaatatattacagtattacaatcacattttaatttatgtattgcttgaaaatttaatgatatttcttctttttagatgtttccaatatcttttttaatagggatatacaatctactgtattttttgttactaaaaatatagagtaatatatttaaaataattaaatatatttttacattaaaaaagctaagatatcatatgtgaaatttaaaaaaatacaagggccattaatgtaatttaccctatcgagtaagtttagatataaaaatataaagttatatttaattatattatattttattgaaatacttacaagcttcggtctgtgtgtgttttttatttaaactgataaagaatacaaaaatagactaacatttaaagaataaatttaaaacaattttataaa

SEQ ID NO: 5267 - DNA, 1393 bp, Glycine max
  Soy_ogl_2575 Gm08:9257634..9259026 Cluster 24
acaatattatggaaatcatatcatttaccaatcctaggtacatttaacaacaatattttttttgggtgaaaatttaacaaggctacaaataactatgaaaatgactcattatttgacaaagtaaatgattaatttaattttaaatttgtatcttacttcatttaagtatcaaaaattaagagaaacttacataagtgacttattggatttcattaaatccctaaaaaaaacactttttcccccttattttggtatttagtttgagagacttaagtgataataataacataagtttagagattagagattaaaatgagaaaaatatactaattttgatcttaaatgaaacttaagattatttaagtttttcttagtttcaatcatagatgaagtaaattgattatttagtctatttaatatgaatgtaaaaataaatgtcaaaatcaaaatgtgttaatgccaccgaaatacctacaagcaaaaaaatgatcactattttttagttaatcaaatatataaatttgtgatcttttttcttatttcattcttattcacgtaatcaatcttatatctctcatctctcgtgatgaagataacactaagaattttttaactttagtgatggaaaattttattgctaacctttagcaaaataatttagtagaataatatagtaaaactttgtagaataatatttcgaaaattcaatgaaaacgaatttagttctcaataaaataattgaatatagtaaaatttaatttgtagaataatatttaaaaaaattctatgaaaatgactttagttctcaacgaggaatatgcattacagaattagggtgctactatacaactgatgatatatataaactcatatattatatacactaatatttattatttctttttatctatcttcttccatggatcatatatatcaaacttatcatattcacacttctcgccttctctttgtaagtgttatctagtgttgaatgtctatagattatttttcttgtgctatttatcaatcactgttggaatatctgtctcaagtagtccatgctcaacgaaaattcagatttgattgtttaataatattataacagatgttcacatacaatttcgagtagtccctgcttgagtttcaaattaaactatgcgtgatatacctgattagcaaaatgatgtctaaatttaatcgccaattaaataaaaatttaaaaaatgtccctagattgtgtcaatattaagatgctctgtattaattaatcaaccagcagttttaacttttaggacaacaaagatatttttcgtacagatctttttcttctacttccgtcagaacttaatacacctgctaaaaggatcccagtccaaacaattatagacaaagc

SEQ ID NO: 5268 - DNA, 1051 bp, Glycine max
  Soy_ogl_52 Gm01:2421450..2422500 Cluster 24
tgcataaaataagtgaactactacttttgagaattgttagctccttcataaagtaatgactaaaattagtttagacacgtatcttaatggtacctcattacttgtttaacctcttgctttggtagaactttgtgtcagctcattattccagttatcacctggtcttcgagtagggtagggttatgctcagttggggaacccgccgggtcccattttccttcacaataaccagatgaagtagtggataagctgtctggtcaacattgtattaagctctgtccaattgtgaggatagaattaagatacgtgtctaaactaatttagtcattattttatatcgtaatgagtgtgttctaggaaaattgtaagaaatagttttaatatttcttttttcgctcaacctcgactcagacacgcctcacacacttacccttcttaagtatttcaatttaactgatgctaatttaagagagtaaaatatgtttttattttaggttggttaacttatccttaagtaaaaaatgggattaagggttaaacaatctaatcatagatgacgggtgtaattctcgtgtacttcaagatggttgattgcatgtattaattgtgacaatcatctatcttagggttgtttaattttatttttatttgggataagttaaacaacctcttttaattcatataaatgagtttaatgaacatacattattagtatttttttatattatcttatcaaccaataaaaaatttaaatttttacatgatttttgaaatggttattataaacaacaaatttacaatatacgatcaattgtaacttgataacaatgtgaaagaatttcgtctggataagcacaaataaatacaaaaaaaaaaaaagagaattaaaaaatagcaaaaatcatttaattttgctttcactctgaaattcaaaatcttatcttgtttctttttcattcccaatttgcatctcaattagatttactagaaaaacattaaaatgaaatgcagaaaaaaaaatagaaaagaagaaaacaataacaaaacagaa

SEQ ID NO: 5269 - DNA, 1300 bp, Glycine max
  Soy_ogl_370 Gm02:4074501..4075800 Cluster 24
atttacgcacacccaattgttttgactctctcattttttcctgttttgacatttcttaatattaagctttcctttggttttattaccaagattaaaatatttgcatcttggagatctgaaagaccggtacacctatcaacccaagattgtactttctactccaaatcttgtttcaatcacattcatagagagtttctttcgtacttatcataaactctcttcaatgagtcacctttcgctcccgtttacatatagatggttcagtcgtcgtaagttggttgcaagttctctctaatgtaaagatgttgacactcttcttttatccttaatatcatactaaaggtaagttactttattgtgtattctctttttattttcataatgctcgctgataagatgtctgcattattttgtaaatattcaatcttgcatttcaacatatccattcaaatatgtctttcaatccactctaattgtgtaggatctatcaaatcttgctgtaatggaaattcaacctcggcgctttgttagattggagttattgaaaatcaaaatggttccatatagaaggatatccaaagaagaaataatcaggacattgaagtatttacttcataactcttctccactaaccatcagagttgatgtcataaattggtgaaagttatatccctatttcatgctgaactattcagttttcacttcctttattttatgtttccctttctccctggtactctatccacacaataaattatactgtgattgtgttgattatatatatatggtttattatatatttgttttcttatttgtctttgttagatgaaaagttttaagaaaccatacctacaatttttattatgatggggttagtaaaattcatgattaaactcttttggtggagacttacttcattatgactacctttccttccctgacactcttacagcaaatgatagattgctacattgtcactttatcagtgcgggtttataccttgttaaaaaaaattatcaggctttaacatatgaaatttttaaatgtaagaaactgtcatgagcaacatgaccaaaatccagtattaatatcaagaaatacgttcttgggtgatgcagaaacaactcagtgacagttttagtttaaagaacatcattaggagagaaaataggatcaaataatgacatgattgaggaaataacatgggataaaacagaaaaggaaagaaatagcatgggaaacacaagattttgaatatgaacagaaataaaagttgagcatgtaaatcaacaacaaaaga

SEQ ID NO: 5270 - DNA, 1440 bp, Glycine max
  Soy_ogl_2136 Gm07:2618961..2620400 Cluster 24
attataacaagtttctcatttagaatttataaggccatataaattataatatatatcctctcaaaaagaaaaattaggggaactccgacaggaaagataagggtataattattcaattaaataacgtgaaagtgtaacatgttactaacgtcaaggaggtaagtgcaggtatctcttaaaaagatcctatgatggtataacgtcaaggaggttatatagtgacgttgtctcttaaaaagattccatgaaacttttgcttaactaggagccaatccgtctggtaggtataatgtatcagggaatattaacaaaccaatatgatttcggtatttggagttattctaaatgtaattaaataatagacctacaatcaagtgattagacacaattccataatgttaaagttttaggtcaaatcattaagataatattaacgtttgatgtttaatgaaaataatttttgttaaattttacttctcagtcaatttttaaattaattaaatctattttttcttataaactaaagagttaaaaataataatagaaataatagacccacggaggttgagccgtcttcataccgaaagattcgtctcgatcatattgataaggttaaggataacaatgtagggctaacatacgaaggataaagcagtcatttacatatgatttgaaaaggattttatagctcttatggcaccgaataatacttgtaatcggtcatagattttctacttgtatggtgggatcagaagagagaaaggatatacaaaagataatatatatagatctttctcatccttacattgtgttaggatattcttggttcctaacaatgtcactttgtacttaaaaaaaaaaaaaacaatgtcactttggacttcatatgattgggaaatttgaatgttaagtctgtgttgaaaagtttgatgaaacatcataatacgaaactagctcatacaatctgaagttgatgtgattgcgattgattttgatatattgcccaacaaacaagcctaacgtggcatttgacaaaatttatttatcgaagtcctaatttgggttcattagaaaagagaaaaatagtcttatgttatagttagtatatcgcataatgtaactcaaaataattacaaaacatgtcagttcaagtatagttctgagctcttaaagcattttgcccgtgcttgaaacacaacaccgccacaaaaagaaggttggatttggcccaggggagtcaccaattatttgtttcaagttttagctgtcctttgctttttggcacttcagtcattttcatgatggagtcctttaaactaccttagcatcaagtataaactaaatcaagcatcttgtctcgtaggttcataatcctagcacaccacaaaactctttttttctcaaaaaattgaagcaaaaatttcattccaatgctttatg

SEQ ID NO: 5271 - DNA, 1100 bp, Glycine max
  Soy_ogl_2218 Gm07:5451701..5452800 Cluster 24
ttctaagaatatataccaatctgaaaagccaactaattagttctagagaaacaaataataaaaagaacaagtttttcaagtggtcgactaattaaactcgtggataaagcagtagattcaaattagtctatcaaaaatgttatcatgcatctagaaaaagaaaaagaaatattgatataaaaaaattggacgtaatagaaaaagagatatatagagaaaaatgatttttgtgagaaagttcttatttgtttttattgtgtataacaaaactgttgaaccagtattataagattaatttcgtaaaccaacgtgcacgactggtgttgtagttaagttttgtctcttctagattctatccgtaatacaaaacccttatcctgaatggtcaatactatccttttattggttaaaacatcttttcattttcatgcaaagtcgttcttaaagttttcttaacaatagctagcacccttgtatataagcaggcccataggtagtaaggggtaaggggggacggttcaggccccattgttaaagagagtccagaaaaatcagtcaattttattataagaaaaaatgtttttgattttttaatattgatgctccaatttcatattctcgacttattttaaatcccttcgattattaaaattcatcttattcaaccattatagataaataaatttttaccaaaaaattaaactcctattaacacatagtatttgtgactcatcaatttaattctatttttttatcaaacaatatctgaactaaacttataaaatatggggttcggtttttttttttatcaaacaaggtctgtgcgaaccgtggctacaagtctctacatttctacttgtatctataaaaacaacaatattttttttctaagaataacaatctgaaacgccaacgtacttactaattaatattagttctagacaaaaaaaaaatcagaaaaagaacaactttttcaagtgatcaactaattaaactcgtggaaaaatgtttgaatagacatcttacacctcaagaaagaaagaaagagaaaaaaaatacaaatataataaaatttcgtagaaaaagaaatatataaagta

SEQ ID NO: 5272 - DNA, 1035 bp, Glycine max
  Soy_ogl_2954 Gm09:2818266..2819300 Cluster 24
tatccttttcaatataaaaaaattaattgtagaaaagtgactttttgtaaaagatattattaacatagttttatcatagtttttcaagttattgtattgtaatttttaatatttttatttatgagttcaataattaatgtcttttaaatatctgctggtatgattcttcttagcgagtttctattgtatctaaagaaatttaaggattttggtacaattattcaataatgaatcttttgttatctgcacatgtataggagatcatgaaatgaagcaagtgattttgaaacttatgaatcaggtaagattatgctgtaactttgttttatttattttattttatctcttttgtttttttacattttgcaggttatttttccctttatttggagctgggcggatattaagtattttgacctttccttcttcatggggatgcttctaatgatagagttattattgaaagtgctgaagctatactcaagcatgcatgtgctctaatttttgcacatcttcactctggattatgcatatcattttgtgttaccaccaatttcttcaatattagtagtttcttccttgattattgtttaagataaaaataggctatactgttaaaaggaaaaccaccccaatcttttttatttccctgtgccaaaaatatggttcaatgcatagtcatgttgactcttccctcatattgctttttattaagatatttcatttatgtagcattttagattcatctttttagtttacttcctggtgcagcgaaatctaaggaaaagagaaatgagaattcaatgtcttgataattcttaagaataccaagggttgagaattgagaaaaatctcaaatattattctatcaaagtctcacccattcgttaaaaaaataaacaaaattgactttttggtgaactctactctactagtcaatcctgccctacgtcacttgcatgcatacttatcatagtcataccacatattcatatgaatgttattttatcttacttatcttggtattgatattgt

SEQ ID NO: 5273 - DNA, 1644 bp, Glycine max
  Soy_ogl_3597 Gm10:47009357..47011000 Cluster 24
atgacatctaatattcgtaaatttatgttggtattgcacatcacttctttggttattatgtgcctatatgcataaaagaaaaaaaaacttaagagcactttttttttttgttttgaggggaacttgagagcacttaagagaccatgagaatgatgatttgaatcaaacgcgctcccttattattgttttgtttgtttgtttattctatgtcattttgcttttcccaattagattcattttaacagtactaactagcaaatactatcaataagttaattataaaaatgaagagtcttgaaggctagcttcaaaacgaaaattcacaaggtccagtggtggctattgtcaggttcaaatccccaggtggtctagaaaatatttagccggagccaagagttagcgttgaagaactcaaaattcgcatttgagcataaaaaacgtttagatggcattagaatagacatttatgttcaccctgcttaattattgctatttatttaatgcctcctgcaggggaaacttggggacaaacaaagagaatccaaagagagggcttcaacaactacggcaaaagaatggatactcttatcgtttaatagtttagtaatctaattgtggattgaaagttggtttaggtaagtttacataccggactatttgtatatgcactattattatatatcatgctcatttggacaagaagtttatatgccatgtattaacttagagtgggagtagagaggagtttataggcctacccctacgcgagtgtaccgacccatatatacttctcatctcactttaacaataaagcatgcacggtaaagatcgccagtgatttaaataatattagaaacaattgtagttaaacaactaatatacaaactaatgatagggagtgctctagaaaaacctaaacatgtaagattcttgtgcttaattatgtttcaacacattaaataagaacggggaacagggtatcttatatatttttctgtttcgttaggaagtaataaatatattatattgaatattttaagttacttttataatgaatccttttacattttaatataacaaatattttcttttttaataaaaaatttacatatttccatcatgggcatgcagcagtatataatagaaaatattatttttaaaagaaaaactataactgtaaaatgacaatgatccatacatgtgatttaattaaatattgaataatcaagatcgtttctttctttgatattataagaatggaaatgaaagaatttctgttttttttttattacctactaaaagcttacaaatatatatctctttctctggtatagaaagagaatgaatatttcatttaattttgatgcttgcggaataaaagagaccgaaccaaaaacacctttatccaatatccatataaatgatttttttttaaagattacatatgcgtgtattaattcctttaataaatatgtttctttgttatctttatacaaaaaataaaataaaaatctactgttgatttcaggattcatgattgagaagttggatttaatgaaatgtttatcttctgtttcataccgtcatcaattatgaagcagaggtaatcaaactcatggggtagtttagatacaagacagcacc

SEQ ID NO: 5274 - DNA, 1037 bp, Glycine max
  Soy_ogl_4617 Gm14:3563864..3564900 Cluster 24
actttaacaagcagcataaaataaatgaagaacaatgaatttaaatagatcaataaaatagaaagcttgtttaggataattgattacacaattaagcaagttgggtcaataaattgaacctattttgatggtcttaatatcagtttatatttccatgtaacgatctaatcttgtaagtctaattcttttgtgttgatttaggttgatccaacgtttgcgtcattataacctttatacagatttggcctcgagcctacaatttgatagcaagaatgttttgtcagaaaaaaaaaatttgatttgtctatcagaaaaagtgaaacgtctacgaatctaatcaactagtcattagtcattatattattttgttaacttttcatttttgagctgattttctttttgcaacatcactgaatgtaaagaaaataacaatcttatttcattctgactgccccatgaagaaaatcttatttcatgaagcatagtagcatatatagatttcgaagttaatccaactgaatcacggagaaaccttcagggttactctctttgttattacctcgtttgtttgcattagatgagtttttcaataagtctttaaaatttaagtcttgaaatataatttaatttttttgtccactagtttcaaatctaaaatgattgagtgtcagtctaacaatgatcgagatctccttaatttccttccgccttttatttatttattttttaattaagatatatacattattttgacactaaattttcgaatattgttatagtggtacaattgagagacatctcacgtaaacataaacatcttatatatcatcaactatcgaggaaaaaaagtatggatatcttttaattttattaaaaacttaattgatgaaatttgtcaaccatagggtacaagtggaacaagctactttatcatgtctgtgaatagtaaatcatacgttagtaacagtaagttctaaagcatttatgttattaaacgtgtataaggatatcctatccatgtcttggaattatagaat

SEQ ID NO: 5275 - DNA, 1000 bp, Glycine max
  Soy_ogl_5823 Gm17:40592701..40593700 Cluster 24
aatctagacttttttaacctaatatatgctatagtttgcataataatttgctttgtcatctctattaatgcacccaatttttttttatcacataatatttgttctaaggaaattttttggataggaacaaaaagttttaataatgactatattagcttgaaatttttatttttgattttttttcttctttcttgaaattgcttataaatattaaaggatgagcatgacaaatttatgctaggtaattaccaaaaagagaaaaagttagactaggaaaatactaaataaatataattcttactattatacgactttcaacttctcccatctgaaattagagttccttttaaatccaaagggagtttttttttcgaaaaaaaaaagtaggagccctttctttcgatgaacaatagaagagatctctcaaagctttgcgaggattgaaaggatccgggaggagcaggtagaaacatgacaacagtcggaatatttaattatcttatcagtgaatgattctaacttaaattttcgttacagtaaccataacatctgtacgctttcttcctttttttgtaaaatgtcttacgcaatattaatctactagtacaaccaattggatcgagttttgtcccattttatatcgtaatgcagttaatcaaaattattaattagagaagaggtcaatttagccacgatagtaacaatttgtttctctttgacagaagatcttccatggctgtcactttaattctatattaattcatcttacaaggatcgttgttataaaatgttgtcattatcttcaatcaacattgcgtacgcaatgaataatgtccttgtagtgtactggaaaaattcatggaagtttggaattaaaaggacattatcattacttaatttaaaacgacttgatgacggcttggtattaaaagtgaaaattactgtcgcttaattaaaaccactttagtcggatcattaaattaaaccgattgattaattt

SEQ ID NO: 5276 - DNA, 1589 bp, Glycine max
  Soy_ogl_6299 Gm18:60189812..60191400 Cluster 24
ttatattaataaattggattggccgagttttatctcatatattatcaagacttgattgaattgaatttgaattcaaataaataatcttattagaattttgagttggataggaacaaaaataaacctctctcaatttgtcctatgcccacccatataagcaagagtgagataatattttattcctaaaatggttttaagtcaaatgccatctcttctttttttttgtttggacgtagagaaaataataataatgaaagttaattttctctaattcaatgaagagaagaatttttttatctaatcagggagaaaatgaaagaaataaaaatgtaatgaaattaaatgattttttatatgatataataaaatagtaagtaaataggtaggaaactttattattttaacatttttttgttttctattttcttaaggaaatttttttttcttgagtctacatgagttgatttccccccttttcttttactctcttcagcgagaaaatgtaaacttctttcttactttttatcctgcccattttctttttactttattatcttcttaaacaaacagtattaatgagtggaccacatacttactactaattaattatcaagttgaatcaattaattgtttgtgttctcacttgaattctgtcatgctggatttcgcatattgcatccaagctaaggtttaagtgagtaaatgatctctcatgttttcacttttatacagtgaattgcatgagggattttattttctttatgtagtgattatagatttatggatttaactggtatgcacccggtgtttcaatcaatcacaaaatattatatttaaaaaaaaaagtttaaattttatcctaattaccataatagttacacatattatgaattgtaattggtaaaaactttactgataatgtataataattattaaactcatatttaaaaaaaaaaaaacacacagaaggtagtctacttatttaagaagtgttgcctctaataagttaaggaagaaattatttgatctaagataattgtagattctgttttaaacgaagaaattattattttagtgacttctgtaaatctcgactattgtagataatggctcaaaacaagttatatattagtagccaataataattcattaaccattaccctaagttatttagccacttataaacaactttgcaattaaccattcttgtacacgaacttacaatcatgctttgttacatcactagggaaaccaaaacccttactatagatacgaatcctctttaagaaattcgtcggttaataatcaatatgcagcattaacagaattatactgcgttttgcttttctaaaggtagatatgtttttattggccaagttagagtatgatcaaatatagattaattaagaatcaaattccaaatagaatgcatgcggcgagtcattttcataaatttcggtttgatctcgtttattttatttatagcataatctctatgacatattatataaaccaaaccattgtttcaatataatacaaataaaaaaagaaagtatagaggaatccttctcttatgaaacataggtgtg

SEQ ID NO: 5277 - DNA, 1100 bp, Glycine max
  Soy_ogl_267 Gm01:51453101..51454200 Cluster 24
taaagtttcaatttaactatctttgatcacgattttagttagtaagattcataattcgatctaaattaaaattttaattagtggatgaatttcttaaaggatttaaatttaattttattccagacgagaaataaacattttaatgtaaacttgcgccaaactggaattaagatttgaagttttatgtcaacataactatcgtatattcatatatacttgatagagatgtctatttctataagaagacaaatgttatcataagatatttcaaaatacgaagtgttttcttaattcaatctaataataatgtttcatacaggtttgatattcacacgtaaattaagaaaatatgtttttacaatgatagattacaaatgaaatgaaataataataccaacaagttattgagttaaacttgaatattttaggtaaaattttagatttgagtccattctttgtgaataaaaaaaaacgtaattaacatagtagatcttactaagaatagcaagtggaattttctggataagtatacattttttaatttagtggcaagtgtagtggttcacctaaataaataagggttcaaaaacaaaagaggaccataaaaaaatgaaaaaaaagtgttgacaaagtatatgatatacgaaaatctccccatatcatcactcaacaaaaaaacacaaccaacaaatcaaatattttcaccaagttaacaaatcaaatatttataaatctataatatctgcactaacaactcaaatttgattaaatataaagttaatatcaaccaagacaaagtctaatgacaaattgattataaatgatttttctagtgtatatatagataatgtgatatgagctaagaagtgaaggagattggagtggagcaaatgctagtctgtgagaaaagagactgctcaagttgcacatgggtacaggatctagaactcagaattaagatacaaatccacgctaaaggctagatagaaaaatgcaaaaggatgcaggtgaatacaatatcaaacgccaaaacataccagaaaaggaaagtgtatataattaacgttatagatacaaggcaggcagaggcaaagataaag

SEQ ID NO: 5278 - DNA, 1000 bp, Glycine max
  Soy_ogl_670 Gm02:45266401..45267400 Cluster 24
agagatcctaactaatttataaaagagtgggaaaaatggcagggtataaataggagggtaataataagagttagattggattgggagtagaggttggaaggaaatgcaggagtctcaaatttccttgagttgcgagagatacttatctgtaattattgttttgcatcttctctcttgattctgcaatcgtattaattcagattcagggagaagagtgatatttaattagtctcattcttttattttcaaatcttgttcctgttaaaaatcatggttgttacttgttacttggcaaattgtgaaacttttgaatgacttttttgctccagagttttcattagttttggtcgacatttttatattgtgttttcataataacaacaaagaacatgaaaagttttttttttaaaaaaattcgtgtattatgtgtgagtgagagaaaaactaacttataagttagtcaaaatactttataagttactaaagtacttacgaaacacactcaaagttatatcctttgacaaataaagaaatttggaacttctatgattagaaaagttatcctttaagtgaaaagtaacgacaataggtaatcttatctctctagagtggttgtaattaagatgcttaggaatctttccagattttagtccacgaaacatattaataggtgagtgtaggaattgttttcattggtaaaattaacttttatcaaatggaaattatttttttttgtataaatattataaatatgaactaataatgtattaccaaataattaattttgttagtatataaaattaacatatactttcaatatattatattattagtatttttttttgtttcctatatgtatcttgttcgagatattcttatttgatacatgatttgacattaaatatgggtatcttttttaatatgaatttgaataatgatttatcaatgttataagaaattaacttcttccgctggattcaatttccgttgattatatcat

SEQ ID NO: 5279 - DNA, 1579 bp, Glycine max
  Soy_ogl_6192 Gm18:55949701..55951279 Cluster 24
gtttgaaaacccgttacaaaaaaccacttttatgacataaaagctataattattagcttttccttaaaggtaaaactcacacttataagatgtgtagccaaacatactatactacatatgcagctttggtggttacacattatgaataatctttttgtccttatatttttacaattttaaagcatcccttgctttggtagtgcttttttatataataatttctaaaatagttctaacgaaaatgaataattaatcaatacttctttagttcttctgtagttctgtcccaaaatatctatgccttaaactatttttgagaaaaaaatgcaacacctctttgagacgtttatgggcttcttaacttgccttccttatcaggtcatgaagtttttgatgacatgaagtactacctgttgtcactaatttgctccaaagcataaagaactgaaaaatatagttcgaaatgatacattggatattttatccttctctatagcctataggtactcaatttcatgtattaatatccatgtcaattcattgctgaaattggaccatatagaaatatggattaactttctctctttctcagcaaaaggacaagttagtgggcacctcattttcatggccatgataataatggatccattgaagtgtgcaccaaatttgcattgaattattggctaacgtttattctgtctctaccagtataacctgtccaagggacctaagttgactagttccctagatttttcataagtaactaacatgtcaattttggaaaatgcattgatgtatggagaagattccagatgtatttcggacacaaataatcataataggtaatattatataaaaataatttaatgataattaaatacaaatttttaatctttgtctctagggaactaaccagtaaaactgcatttcattactactctaattttataatttaatttttgttactctttcataaatatagctgcactacttgcaccataattatgcatcaggggagggtaagatttaagccagcccatgaagttaatggacccaaactgatccaatccaaaaaaaagaagttcgtgtcatcaaatcgatttaaatttaattgtgtgaaacagaaggtatttggttcataaaagttcaataactcaaattcaatgaaggttgaaccaaaccaagcatatcctcctatacttttgtagatgtttttaaatgtcatattctattctcaatcaaaaacattcttgtatttgaagtttggactctaaccccattttgttcttttctttgcccttgatcctaatcctattacgttgatctattatcattatctcacaccatttactctattggttgtcgttcttttcactttttatttgccttttttatttgttcttatcattagatgttcttccgcctctctagtaagaacaataaatatcagagatattttgaatattgaaggtcaatattttagattaatttagttttcatatactgtcattgtaaaatttgttgtactgtaaagtaattaaaaatcagtaaaggtataaattttaaagtaatctttatt

SEQ ID NO: 5280 - DNA, 1000 bp, Glycine max
  Soy_ogl_730 Gm02:48203801..48204800 Cluster 24
tttgtctaataattaattcaatttatgatcctctaaaataatattttcttacaaagactctggtcgttatatgatgtctgaattatatggatagtgatagattcctatacatataaatgttatctagaaggccatgtgcaactagatggggttgttgacattttcgtgcatatgaatgacatatctctttttgttttttcaaatgttaaattaatattgaggtgcttatatttggcaattttgaattaagtctgaatattttaaaaatttgtgattgagacaatgttataatatttttaacgtgctctaactattaattttcctttttttttccgcgatcaactattttaatttccaatagtatgctacccgtgtatatacacaggttatctaagaattgagatctgctagaaatgcaaagcaattagggatcgtgtacaagatatattaaacattttaccaactaaccatagaatctttttcatcaacacgactagatatttttaaaagaaatcaacacaagtatttaagcaagttttgatttgaaaattctgcataatcccccaaaaggaaaagcaaattactcctttaatgatatttcagtcctataaaatttagtccattaaatttaaaaatgtgtaaagtaatggtgtaatacttaatatttatgaacaatatataaaaccaaccttcgaatacaaaataaaataacagttaatacataaaaatacctttacatatgtaaaggtgcatcattcttccacccgttcttttaactttggttcctgcaatagtaagtaaatgcttcacaatcataagtttgctttataagttaacgtgaatttcatcataaatcctacgtcaataactcactgctaataaaatttagaagaatagagagataagtttttttttttactgaatatagagagataagttgtaatgtcaagtaaaagtgcatcatattttgtaataatatggattaaaaacaaaaattatt

SEQ ID NO: 5281 - DNA, 1066 bp, Glycine max
  Soy_ogl_1103 Gm03:45594735..45595800 Cluster 24
cgtaagcaggttataacaattgagatgttagaaaacaaaaattattaatattttttacatatttctacatttttttacaacttttagattaatttgtattgttaattttattctgcgattgggaatatacctattaatgcaacagagcatacgcaagtaaagaatttatcatctaattcatctttttaaattgggcatgttgttgtgaaggtgtgaatgatataattttttttttaaaaaaaaagagtccaagaaagcaaaataaaacaagtgtagattaagcctaactatatgtctggtaacttatatttatgtaaagtaaaacttggatttatgttattactccctcttagagagctatgtattatgtatgaggattgagtagctacataaatatatagtacgttcacgtatttatgtaatagaattgagacaacaaatcatagatatactttgctaatcaaaagatgtatttttctaaattaataaatgaaaactaagaaagaatttattattgtcaacttttgaagaaaatgaattcatgctctttttttaatatttagaatcagaagaagtacatttgtttttttacataaatcataaggacagctaacaagtaacaagccaatttataagaacataactaaactttttctttttgttatccataattaagaacatgactaaattatatccaactatgcattgtttttgcattctctccagtttagtcgaaaaagagcttaaagttgttttttgtcaaagtaaaattaatactaaattattctttcatttatggacttatatatatatatataacgtgacggatggaaattgctccattttctgaaagcataaaaaaaaagttgtggcctagtagttcctactagtctacaattgagcttcacctttccaacgcgtaagagttccagaaaatgactaccaatatcaatatgcgttggttctatgaatatgacgaccaaaggcaaacatgatttaagtgtcttttttttaagccagttaaaattaattttgatagaatagtgatgaaattaaagtatcacag

SEQ ID NO: 5282 - DNA, 1247 bp, Glycine max
  Soy_ogl_1771 Gm06:3005801..3007047 Cluster 24
aacccactgcatggcatgcctagtgccctttttcacgcggaattagaaatggtgcttgtccttttgcaaagggggcttcatcccactccagtatgtatagtataggtatccacttcctaaatttacagatttcaacacatttttttctaaagaagataaagactactaagaaccactttttagtcagcttcctttggtaaccacgctagttagctatctcgtgctgtgctatatgtatgtatacatttttggcgtgtttatgccgttaccaaatagtagtacaaattaaaattattaacaccgagctaattagggtctttttagaccacaaatctctttgacttgggcccgctaatttagcatgaaaagtctaatggcttcatttatgcctgtagttgtattattatatgatggcggtattttgtttttcagtaaaatttatcagtttatacccgtcaataccaagttttctagatagagttaaaaaacatgataaggataaccgatatttacaaaatgcaaaagagcacaagaaaactaagattgacagattaactcaacttaaagaatagggaataattaatcgttagttaattgagtttgcttttaatatagattatatgatcacactatcaactaattaaaatttatttaaaaaatattttttttaaatagctattacgaaaatcaaccatttacacttaaatatataacaatacttaattggataacagtataacatttacttgttactgtagtccaattaaattctatttaattacatgcatgcacatttattatttaattattttctaaccacatttacggtaatacttttttagcagatgttactgaaaactaatcacttggaatgaaatatagtatttcttaacaaaatgttttttttttcatgtacacaatcaaggattaaactgtagttagcatattcaaacgaaactatttactaactgttagcatatggaaattttgagacgtgaggagcaaaaacatctcaaaacctacttatttaatttgatagtggactaactatagaaatggatataaaattttcgtggatgaggttattgacaactagtttagcttaattgtttgactacatgaatcaggaaatccttatctccttgttgttaattctaggtaagaagtaggcctgaaggtatagtttgtattgataattatgtatcatattcatagactcttgcgttaattatagagaatatataact

SEQ ID NO: 5283 - DNA, 1100 bp, Glycine max
  Soy_ogl_3632 Gm10:48779601..48780700 Cluster 24
agaaagaatattccgaggcaactcaaccatatcctcattcctcaaccgctctgatacaccttagcttctagctatctatatacatgtaggaacggattcacttgttgtgtatgcacatgtttttgtcattaattcttattaacttgtttctatagtataaatttgacaactttaacagttgaaccaagtgatattgtattaatgattatggatatcaaatttaactattcaattaatagaaacaattgtaatgtggatgcttcttttttaagtgttttatgctagtgaatgcttatcctgatactagactgcagtgacaagcatgatcatataaatttcatttaaaaaggtgtggctactctgcctatgcaacaaaaaatgtgaaaagtactaatggcctactatagtacaacttaggttaataagtcacccttgtaaccataaacttttctttacatatagtgaacaactaaaacaattccaggaattgcatgcaattaatattctatttttttccactaatttaattattgaaactcccttgaattgggaaatattttaatataatttatttttaaatactactagctattttcttattttccaatgagataaaaactaatgaaaaatcattcttatcaaaccattgtatggatcttgtttcttcttattttagatctactactgaaggagtggtaattaagatcacgtccatcgatgccaagggtattgttactcgggaaaattgattaaactcaatttgactactgagcatcggatacctatgtaaccgaacattagattaatcgaatagcctgtacaggatataagtgatataattgattaattggagggagctagcaatgatacactcatacagtcacgtgcttcttagtctttattttttggcctgaaccgcatgacattgttctaaaaatcgtaatatatatgcaaggatttgcacccctaaaaagaaaatgcaacgattcatataatgctagcaatctcttactacggttcaagtcttcatgcagcagcaactgctacatgatctcattgtccacatgaggcagataaacatggatccgagaaaatcttct

SEQ ID NO: 5284 - DNA, 1300 bp, Glycine max
  Soy_ogl_5442 Gm17:1263501..1264800 Cluster 24
attactttttcctatcttatatatattatttttagtctctatgttctttttccctttttttaaaaaatgggaattatttcgttctttggcaatcatttatattaacagcttcaggaatttttttataataagctaaattaaaatctgtatttggccatgaatataccttgtacaaaaaaaatagaatctgtgcaattttcttcttcttatcttatacccttgatatctaaaagttatttttttagcaattcgtgtagagttaagtaaacttggataaaattcatacagtactgatttgtgggaacaaccacttaatatttagagaaaattaagtttttaaaatcaagcgcgtaagttattacgtgcaagtaattaaaaattatgttaaatattacgattcaactgataatgtcaaattacagaaataatttgaatcataattaatatcatggcaaaagtttctttcctctttcatgaagtcattaacatagtaaaactaaatttcataagagtaacacacaaacatcctattttaggaaaagtgcatagcaatttctatataaagaaaaaacagtatacctccattaataggttgctgtaatttatcttttgaggaatttgtaatttatcgaaattatcctatgcaaaattcgtttgattaacatacaccacacacacacatacatctactacatagctgttagttttttcttaaaccatttatttaccttctcttttgaaattattggttaggtactgaactgattcatgcctgttgcttacaaggatttgacacttctgcaatagatcgtggataatcgtttttaactgaataacatccttatcaaatccttaaaaaaaaaaaaaatccttatcaaacaccagcaggcaccagtagacacttctcaattccctttgaaataacattaaatacttagggcatggtagttccacgtatttactaacatcattatcaaacagtacataattatttctaccgttttttgtctatactttagtttaggctttaactagtttttctactcatattccgaaatctatgctttcgattgagtttctctcttttatccttaccttgagaaagcgatttataaatgtttttaaatacgtaaatatcttttggcataaagaaagacttctatctatatcatgtaagaaaaataacacttactattaaaaaattctttcaacaaattaattaaaaaagtaaatatttatttaaaatgagttaactcaaatatacaattggtttagtagacttttgatatttgtatttgat

SEQ ID NO: 5285 - DNA, 1098 bp, Glycine max
  Soy_ogl_5471 Gm17:3198301..3199398 Cluster 24
ggaagtcgctataacaacctcaaccatactaacgtttttgacccctcagtttgaaactgactttgctggataactctgtacatgcacacaaattagctaaatctcagatttatattagcatatttaatcctttgttaatagtagtagtaagtagtattaaggtattcaacaaaaaaaagtattaagttgtcgttgatacctctaagaaattagtgtagaataagacaaagtctcgcataatcaaaataattaaatatattgatatatgttacacttttcataaagaggttttacttttgattcataattagtgaaaatgccaagaacatatttattttatcacactttctacaattgattataatcttaaataaatatttaaaattataaaagtgtgtgagttttcatgattttataatttataataaatttttaacagagaagatggtttaatttctaaacagttaactcctctttataaataaataaataacagtaaacaactcgatggctgaaaaaacatgaagaggagatcaggagaaatggagaattggatctttataattttttatggatgataatatttcaactcaaaaaattttctgtaacaaaatttataatataggtattttttatgtctttccgttgtataacgcgtttcatttcacttttttttttctcttgttttggttgtgaagataagaatagtcttatttgcttagtacgttcacgtatcgaaggacacgggtgtagttaatagttaataaggaactaccaattaataaaacaaggtggcagctagaactagataggtatatttgcactttgcacatggatgacacacgccgctacaaaagagaagtgtttacgaggtgtgttctgtactaataaataagatcccttattttatttttgtgattaagaacttcgaacttcgtatcccatttttttctttgaatttacattccaaaaaattatttaaaaatataaaatataattccagaaactaatttccaaaacaaaaaaggttgtgaagtggaaaaaaaaaagataagtacaaagaattaaccttcattcaatggttttacatttatgtag

SEQ ID NO: 5286 - DNA, 1100 bp, Glycine max
  Soy_ogl_6197 Gm18:56213801..56214900 Cluster 24
taatagattttttttaaaaattaaaaacagttgcagtgaagttactaaaattcaatgtcttgcattttttgaaaatagtaaaacaactgtttttcgtaatattttacagagatcacctttgacatttctcataccatatatatttttccagaggctcaaaactaaaacaatttttctaataaataaacatctcagttgccagaaaatcagattttcaaaattattgaaaaatagtagacgaattttcgaaaaatcaagaaaaatactagacacttctcaaggtcagggaacaacataacttttaccaaactcagattctcaataaaagtaactttcctctattatattcctctgctgtacacgtgcttgattttaccaattaatttcctaaaaatacttcttaagctttttaggtcaagccagccaatttttgtggttagtccttagggtatgtctatgaacgagcagcccagttttccaagaaaaggtgttgatttttttttttttttaaatcaaaccaacccagcttacatatttacacaaaaataaagaaaaattagtgtaagtgatcagaataaattttaaaaatttctacaacatcctgagggtccaaaataggaaaatatggtctaacttcctcaaaacctgcttccattaattttttaaaaaacaaaatgctctcagtccaaagtaataaacatgcactcttccatttttaacaacaaagagagatacacatggtacaatacaactctaaacaacccatattactcaaaaacaaaagaaaacttggtctatgaagaaaagagaagaaactccccataccttactcttaaacaacactaaatgcaataaaataaagcttgagctagagaataatatatcctaatttggttggaaggggctttgagatccatggagaaattttagatagaagctgaagaaattagggaaacttggagaagaagtaaatgaatagtcacaaatgagagtaggagaaaggaaagcattttttaaaattaaaaatgactccccctattcctattaattgtcagcgaccttctccatgggcttgggggggtccaagttttgattttaat

SEQ ID NO: 5287 - DNA, 1257 bp, Glycine max
  Soy_ogl_6638 Gm19:50021301..50022557 Cluster 24
aattttgttaacaccacgcaactccatataataggtacccagtttgtattggcgtgatgtactcttaaatctttacgttgcgattacaagagtttcaatgttcatacattaataatattatacaattgaaaataaatgttagatctcagcaggatctttatagttacttgactttcttaataaaattaattaaatacaaaatttcaagcacttttcaactcatacctttataatagaaaggtgcaattttacgtgagggagtgtctatatacgcgataaagtcgtggtccaaccgttgaaacgtgcaatgttaaatttcaaattgaaagaaccaagaagtcaagaactgtgtttcaaacaagtattattcaactctttcccactgagcaagtaaggcacgtgctgagttctgactaggtgtcacatagttacatcacagacaagggtaaaacaagcttcacacgcaataatgtagtatgatgaaaatgaagccacgtagttttttcaatcttgttaagtaacacgacgacccttgttcacgtcatagttgacaaaactattttcgagttcatgttctgctttggtgactaccatatagtcttgattaggagttcagggatattgcatgcttgtgtagtcgtttgggcacggcctcttctcttccacatagctattttgaaaaccttcctccatttattgagaaaatgaaagaaatacgttattgaattaatggatatgtagttgacattaacaatatagaccataattaagatccatggattgaagtgtatttactatgaagtggcttcttattttgagtaacatagctatcaataagggttaaacagatctttccatcttttcggccacgcagtattaattccttggaaagtttcatattgaatcttactaattaatgtggccataccatattaatttttcaataagcaaagactttattaacaagtactttgtgtgtgtgtgtgtatatatatatatataggattaaatttgattacaaaatagtatatatagtccgtcatttttaagtgtagttattagctttagtaaaaaaaagtgtagttattagttttgacataaagattgagaaggaaaatgagtggtacaattttcgctaaatttttcttattatatcttttctattttcatactaccgtattcaatacggtgttaaaaaatctttgattactggttaattatgggtagaattaaaaaaaaaacatttaactctattaa

SEQ ID NO: 5288 - DNA, 1200 bp, Glycine max
  Soy_ogl_6931 Gm20:42330401..42331600 Cluster 24
ttagaaatgccacactcgtggaccaaaactagcatgccaaattacaaactagcaacttaaacacagttattcaactgagcatagcatatacatccacatgagcatatagcatataataaacataaatctgttaaagaaaagggggtaaacaggagaaggaagattatatataatagattttacctcttcttacgcttagccattatattgtagtccatacatctccgtaggtataatgactataagacagacatgtatattgttagaacagcatgcgatgatattatcttcagagacccgaaatcgggagagttcaagaggtaaaaaaaaaaaaacaaaggaagcaataggtactactaaagagaagtaaatagtataagaaattctcctaaacaacagatagaaaaagagataattttcaaaaaaaaaaaaataatgataccaataatatcagccctataactcatgcaatatatcccaattcccaatataagttataaataatcacataaaacataatttacataggcagaaggagtacatatctttcagcacaactcttaattatgttgtagagctctataggcctgcaataaacagcaaaactctctttcgcagcaagcttctcttccgcagataaatgctcccaaacaacttcatttgtttggttgatcagtgcttctagaatttctgcagaggcaattgatatcagatcagcatttgttatgttgcacccttttttggggtgggggactgcagtagtttcccatggaagagaacttacgtttcagaagctaccattcttgctgaagaagtctcaggtatatctgacattgatctgaaccttgacatatgcgaaattttcagaagcaacaaacctacaatggaaaacaatgcaacagatcatcaaaaccatatattgaaaacatatagcaacatttcagatatagtgaaattccataacacaattgaaagcaatggtactatctaagatgaagaatcgaataaaaaatatccaagtatatagaaggtttctaacttgaaaaaataaataattaaaatttatgtagaggaatttggcacctctaaagtgagcaattcactttagaaggtgagtaactagcctcagttgatataaaaatttaattgttgatatttcaacacattcataatttgttatgcccgacaattgattttctc

SEQ ID NO: 5289 - DNA, 1500 bp, Glycine max
  Soy_ogl_7014 Gm20:46239201..46240700 Cluster 24
tgtttatatgtttgcacccttttctgtttaattttctctcatcatccgcttttattttgtgaccttatcgattgtactgactactagacaattgttggcttatcagctagagcaaaattgctggggccttctcttatacaggtcaaaattctcatgcaatggtaaaagaatgaatgagcctaaaacatttttaaaaaatggttgtgtttattttgatttttaataatttaaattggcataaaaagaataaaacaagtttaagaaacaattttattttattctaaatcatttaataggtttctcgttcaagacaaaccttaaattcactttcttcttacatttgttttcacgagagacgagagacaccttcagatcaacctactctagctggtatgcattatgcatcacaattacaatgatcaccttcagatcaacatacaaaaaagtaaatcataacgtatatatggatgttataagggaaggattattgctggtcacctttgtgttggggccacgagaacaacttctatgtgtcaattttttatttgggcattcaaatgttatgcgatgcaattattttttatatataccacctttggcattagtattatacgatatatcactcttttttgcatcacattcagaaatataatgcatgttaattaatttggatctatgttgaaataccagagttactttcatttcactgtaattaacgttattctatagaaaattttggtgtacgtatgcacggttgctttcaactaaaagtgattttgcattcatattctcagggttggttataaacttaattttacgaagaagaaaaaattgaacatagataatatcactttaaattcatctttaaagcaaatttaattctaatatataaaattaatcagctttattcaaattaccaggacattttttctctaaaaatcaaaggattaagataaaagaaaataaagtcgtcaaggataggaaaacatccaaaagattaaaagaattaaaacaaatataaatatttttttttacaaaataagagtatatgtctcgtcaatgctatgaataatattaaaaatatataaattttagacaaatctaatattattaattaaattaactaatttttctaatagtaatgttattttacccaagtatgatggattgatggtgttgttttccctttatttcgttcgtgggccatgtggaagggcttatccttattctccgaaggtgcatgaacaattgattgtgcgacgtcaaaatgagtttaatgttcaatttgttttactcatataaatgagttgagttgtataatttaatccaccaatttctattactcaattcaatttaacctataaatctgatgagtcaacaacagttggtttggcactgaccatcaccaatggcaccaccaccgtgttggtgtcacaatataatccttcacaaaccagctgattatagtattatgcacacacaaaatgaaataaaaggtat

SEQ ID NO: 5290 - DNA, 1300 bp, Glycine max
  Soy_ogl_7005 Gm20:45420201..45421500 Cluster 24
catttcttatttaatgaatatcacttcaaaatttttataatctcaaacacatttttaaaatttataagaattaaagtccaacatatatttataaaatttaagttaaattccccttgaatcaactcaaacacatttcttatactttacgagcaacttttaatagaataattttgtttgttaactttatttccattagatataataaaatttaatttattaaataaaaattagttacttatgagaataagatatagtctcagtcatgagccgaacagtttcaaacttgcgagcccacacaaattggattttccatattcatctccaaacccaaatattacctttcctctcttcaagaaagcggtattttgtagtttatttatttataaaagaaaacggtatttataacaaggctccgaacccaaccaaaattataactgaattgcctcaataattctgtttatactttatccatcacttggacgacataaaattactcacttttttctttattcgcacattaataccacactcgaaactaatagagactacctttaaattttcacgtaaataaatagatgactttctaacggagagatgggaaggcttctattttttttttgtttacgtgagagtagaaggttcaagtagtgataccaatgacttaataacgacgaaaatggttgagttatggattttttttattcacacgaaaaaaatagatatgtagaagttcgatctccatcaataataaagtcatttattagttccacttatttaataagtgtttgtttgatttagagtttagtaaaaatgattttaatgaaactaattttaaaacgttatatatatttagaatgtatatttaaattaattgcatatctatattaggaaattaatctaaatatatcgataattttataatgtcttttaattataaaatgacatatataataagattaatgactttggtaccattaaccccatgaatcaaattacgtgaaattattctaacttaattaataatttttagtttaacttttttgcattaagtatttgaaggaaaattgttgcatataatattttcatatggcttgagcataattgtttcctataaatgaatgatacaagtgatatgtatagaaaagcaattcacttaaaacgtgtttccattaggagtgtttttgggaaaaaataacaaaaacaatatggggttaaaaggacaacacacacacacagaggttgggaatagcaaaatccttatttgcataggagtaaatgcgtaattgtccgcaaaccggaa

SEQ ID NO: 5291 - DNA, 1120 bp, Glycine max
  Soy_ogl_1247 Gm04:6017809..6018928 Cluster 24
ctattggtgtgattaaactcatttaattattgaagttgacttttttattttatttcttttggtacgttcaaacttatatatttaattgattcagaaaataatggcactaaaactctaaggggcttttagtacaataatttttttagtttttcggaaatctgaaatgtttggtttacttttaaaaaaaatatattcacaggaaataatatttttttggaaatgttattttagttatgcttctcacacagttattctcatggtgaagataggaatctagctttctcaagttaaccaaattactttgattatttaacgtgataaataattaaattttatgataaaaaatatcacatattctctgatttttcaaaaaaacttatataaatatttctaaaatattttaaccaatcgaataaattttactcctttctcatgatcataattctcatgattcaattttagaaatcatgatttgcccatatgaagagtggtgaagttctcattgattagtaaagaagcttttcttttgagaaataaccataaaatcatttttcatgtttatgattaattgccgtatagattctataatggttaaagaacacttaaatcaacaactaactatttattctaatttttaaaaattagaatcgatgttgtagaatttaggacttttgttctaggatatatctgtgattttttttttacttcgtataaaaaaaataaggaatactaaataaacattaaaattccaacattattggataccatatcagtgatatgtaaaaaatacatttttaatcatctttgacaatggttaagagataatacaaattataagaaaggagaaaggaatttaacactgttagtaatggtaagtaccttttgttgggcgaatcctgaaagttggaaatggcgtcatgccatcatttgttggataaaaattctgtagccaggttaattgaggactgctatcccttgtcaaacccataatcattcaagcatatcaaatcttcatattttaatggaaatggtaaactcattaactcagaatggaaagtttttttttttccttcttgttttctgccactgaaagtacgtatagtaatttccctagagtgat

SEQ ID NO: 5292 - DNA, 1100 bp, Glycine max
  Soy_ogl_2915 Gm09:708101..709200 Cluster 24
gcttaaattttatcttctatatgtcacctattgatcagaatcaagaaactcataaaatggcatataggttgcgacttagacacttgctgaaatagtcatattttttgggacacaattttaaatcatttgttaatctattgaagagtagttgtaataagaaaccagtaagtgagcatgcagtgatcacacaaaagcaaaagcaattaggatgccaaacaaaatcaagctcaaagaggaaagagggagggcaacaaataaatagaaagtccaaaagatttcaacacaagaaaggaagaagttgcagtagctctattatgcatgaaggcaaacgaagaagccaaattatgtgataaaaaataatggcaagggaagaggagaaaaaataggacgaaaggaataaaaggagacaaattgaagttgcaagaggaaaatggggaaccagaagaaaaaatgaattttatttttgcaaaaataaagttgcacaaaattatttgtacccaatctctctgttcttgtggagaatctgatttattgctttacgcattctctcattctcattctcttttttaaagaatcttatcttaagtttgttttattttcccactacagttcttattactatttaggtttctgtttttttgggctgttgtgtttaactttgggcttctgttgtattattaggaatttggcccatgatacacagtgttccccagcacaaaaaaagacatatgttatatccactcttccttttttctaagtacactcgcattcaccaactttacagtcaaatgacttaagtacccttcttatttcaagttgtcttgtttccctcatactgccgcacactcccctatgtgacaatacactccttccatgacaattaaacacttttccttcttctttttctttagaatccttcctctctttcactctctttgattcaatatcttgttccaattttccattcttccttacttgtttggtctctttctaacattagggtttttttcatcctccaaactcttcaacacagtacgtgtgccttcctcttttttgatttatgcataattaaaattgcttttgtgattcacgaattttac

SEQ ID NO: 5293 - DNA, 1000 bp, Glycine max
  Soy_ogl_5262 Gm16:3017301..3018300 Cluster 24
aagtcttaattatgtggtgattatgaaaaaaagtatatataaaacattacttttattatttcttaaattattgataaatctatattcagtatatctactcaagttataactagcacagccaatataaagtaataattgatagatttcttgtgcaaattgaaccgtggtgtccgcgtatagcccattcataatagaagctttgaatactgacggctgttgctagattggtcaaaatacccttcatgtcatatttgatttatctttctctttataataacaaaacatagctgtgtgttgtgtgttggttagaaaggaaagaaataataaaaataactgagaaatggagtggattttaaagacgtttaacttgagagaaataaagaagaaaaatatatatataaaatattttcaaaattagataattatttttaccaaaatatggcttttggctgtttaaaacccaaacgtaataaaaataactctaagaaaactctaaaaatagccacaaattccccttatcatgcaacttctgactgttttggatagttcgaaaacctaccaaaaatgtcttttgttatgtaatttttgacaatttcaaatttgtattgatacaaaatatattgctaaaaaatttcaatcacaactatattgattgtttattaatgcttaaactagcgaagaaatataatggtgccattcttttatttcttttcccccatcatttcctctccagttcttatttcctctccatttcttttttaccaatcatactcctagctaattcctctgaaagtgtaagtgctgtttgagtctcattaaatgaaaattcttttattagtatgctaggatttgaaggcttttcttctgtttttattctttccttataaaaaaatcgagctaccaattctttccctaaaatcttaattatataaaaacaacatcatttagagcaatttttggcttcactctcgaatttggtcctaaatttttttatgttggg

SEQ ID NO: 5294 - DNA, 1411 bp, Glycine max
  Soy_ogl_2853 Gm08:41670601..41672011 Cluster 24
aaattgtattttcattgtgtatttaatatgatggtgagaagaaggcacatgtgagaggaaggggaaagaaagaggagtgagttgaagtgtttaaacaaaagcataaaatgatgattttttttcaaaaaaaaaagttaaacttttatagagattaataacaattttgatagaaaccaacatcaattccctttttatacaggctaacattctagatactcacaagccattgaagtaatctaatatgtagctgtattgaaagcgatactcgaaagacagataagaaatctatgcattcataatgtcaaaattattaattgaagataagctaattgtgttagacctcaaaccacaccctacctactttttctataccaaagcatacacgcaatatgagagagaaaataaagtggtcttgtctagtgattatctactaaatcttaggtttaggaattctttgaaggattaaatttttaatttagaaactactcagttaatgtacatgtataatagctaaattttctttcctctataattcaatcatttatagtcatgttacgctattaaagatgttagacaatcatagcctcagcctcagaaagtccaaattttaaaaaatggatcactgcattatcaaatattagtacatcaaactttattcagacaagggattaaatttaaaacccatttttaccagatttaattaattttatatatcaacttaatataaattattgttttttccccttgtatatatcacaagtattatttactggagataaaaatctcactcgagctaattggtagcgccattataaatgataaaatttctccctctctatatatattaaaatgttacaataccctcataagagatctaattgtcaatcttctaccgagatcaaaatacaaaattagataatagaaaaaatgcttttgatataaaataacatctcacaaaatacagtaaaatggttatatagaagataatgtcttatctagctatttctatgtctacataaattttatagttttcaaatatttatatattatgaagtcaataatgaataaatgctgggaattcgggataacatctacggtacccacactggttggatatggtgaaagagataagtctcccatttgaatttttgttaaaaaaatgttcatatttactgttcgacagtgcttcgaataaaattgcttaaaaaaaaggcatgtgaaaaagaaagcttaacatctacagtcaaatgtggaaaacaagataatactttaattatttggtctaattatgtaacattctttaaatagtcaaataaatccacaccttgaagtatgtaaaactatgtgaagataaacgaaataattttttttttgaaaataatactctctcggcttcattatagttgttctg

SEQ ID NO: 5295 - DNA, 1000 bp, Glycine max
  Soy_ogl_4651 Gm14:4408401..4409400 Cluster 24
gacataaaatccctatctttcgatattatttgcactccaaccaaaaaaaaaatgcatgacaagaaccgtctacgtgtgttttttggtgttccttatgatcagccacgtcttatatatatcagcacttacctgcaggtagattttacactacgtcggttttaattagcaattatcacatgcatattcgcgcaggtgctctcagcaagcacaaattaagaattaaaaatgattcatatatatgcgtacatgatcaggttgataggagacagaaactatctcccactcccattgagtgggagcaaaaggaaaagcagaatttccccaacccaacaaaattaaaggaggaagggaatcatccataatctcgcacctctttaaggataagttcttaactatccatttatccttaaaaaaagaaaagaagaaaaaaagggtaggttcttaatagtactgtgtaagggtgtaaattaaacgagtagagttaagcggattatttgaagtttagacctgccttgtctcttgtttatttaaatcagtctaatgcaaagttttaacttggcttgctatttgttaaggaaaaagaaattaaatgctttttagtaggaaattttttcgttaaaacattatgaagaatatgattggctgagaatgcatgtaaaagaaggatgtgcagcaacgtaaaaatatctttttacaaggacccagcttatatggttattcattctcacagttcatgacaattggttcgaactaaatagcacttagaaaaaaaacagtagtgtagcttatttaattagctcgtttataacctaattaattaatatttttattattgatatttttcttacaatttttttattctggaacttttatacttttttttatcaataatgatatacaaattactctttattctaaatattccatgtacaaacaaattaatttcatttatctcttcctaacatgttataaattttattatacctaatgtatttttttt

SEQ ID NO: 5296 - DNA, 1100 bp, Glycine max
  Soy_ogl_1479 Gm04:47900601..47901700 Cluster 24
tcatgttgtatatacgtcaatgtggaatttatcaagttgaatacatggcaatggaagactcaacacatgtttggacacgtatgcagttaaaggcgaagatggacaacaaaaaaatcaaaattttgaacggaaaaaaaattgaaagattttgaccaattagcaaaaaatttagaaaacaaaatcataaataaaaacaaaattaggactaaaaggattatatatgtatatatataatcaatcatccacttaatttttaaatactttttcttgcaaacaaggtgtgtcattcttctagaacaaaataaactaaaaaacctccaaattttccgttaacaattaaaatagctagtgccaccgtgccggcagttggcaagtacaaaataaaatagtgaaagattgctttctatgtatgagtcaagtagaattctccatccaaatcaagtgtcacacatgcacactcatgtaattcccaatcacagcttttccttctggtttaacctattattaatatataaaatatatagtattaatgtttttctttaaattgcagcattcgttgcatcatagcttctagtcatagccactatctttgacatatgtagctatataggtcttggggatagaaatataagagtctggatagaaaattatattgttgatcgaattgctctaaagaatctgtcaatttggaaacataagcaatcttcaatctaacaagactttaaaaaaatgaaaaagatatatttattttttaatttagcttcaaattataatatatattaaattgatttgatagtaggtaagaatcttttcattcaccttgagaacaatttcattttgaaatagtcttatcttgagatttgtaccagttagattttttttttacagtcaaatactatatagaatgaagtactgttctaaatcttgacccgggagagatattttcaatctacaaaattatcagttcaattccacgaggataatataaggagcacggatataaactcctactatttatctttacagttatctttttcttccactataaaaaagttgtactgactttatggaactaaatagaataaagcaagcatgcactt

SEQ ID NO: 5297 - DNA, 1100 bp, Glycine max
  Soy_ogl_2473 Gm08:2763001..2764100 Cluster 24
taataaaacatttagaacaaactcaatgctaaattttaaatgtttatgcacaaaaatatttcctgattaataattggactcaataagttttccatctatacagttaaaagttaaactataacgaacatgaattagactttatggtcttctttatccaattttcgtccctgcaacggagagaaaagttttcagtagatttcactacacttttctcctcctcccttaattccctttataaccaaataggtaaatgacattttctatctttctagattcggtccacctaaaaataattagttttgttttttatttaacgtttttattctaaactcctatccaacatcaaatcatcacgttttcaaaaaaatttataaattaaccttgaaacagagaaaattttaataggggtatggtaagttacttctccaaaaacatagcaaacattttatatttttgagaagaaaaaaaaaacatctagatcccactgcaactattctatgtacgtatttgaaaccaatttcgtgaaaactatatatatacaaggtacaaactaaggtataatgttggtgaaaattccaagtatattattgtacattggtgaagacctaaattttgaattcccatgcacggtatcgccattttttctgcgtcggcaggcaaggatattgatatcttgagaggatagattttgtccaagttaacattctcatattttgttatcatgcaattatttttaggcaccaccattgctttagtggcagtagctcttgcaattcatgaaccatacaaataaataatcgtataattattatgctaccccactctccctagctcgtcgtttcaatcaatttgcataccatatgtgctctggactttagggcacacacgggatttcataaaatcatattgcctaaaagcgtgttttgactattatgcaagcaaggcccctccacagtattccaccgccaacaccccttgcctccattcctatgtatataattctttgatctttcttattcaaagtagttaaaaatgggtgacatgagatttaatttaaagacattattaaataggttttaaaaacagtttatgattacaat

SEQ ID NO: 5298 - DNA, 1077 bp, Glycine max
  Soy_ogl_3829 Gm11:10588201..10589277 Cluster 24
atccctgaaaaagttgttctttacgctctgtcccctttaaattgagattttcctattttagaggtggacataaaggatgccatggagaagcatgagaaacaatgaaatgaaataaaatcacaaatccaaacagcaaagtgtgctattgtgaaagttgttgatgacagagaatgaaaatgggtaagtgatttgcaatgaaaagcggcgggggctagctgttgctctttcagcttgagagaggtttatgacaatgaccatggtggctattgcctatcaattcccctaatataatccaatctcatggattatgtatgctcaatggctcacattctaataattaaatatttctcattcatgtatcatctatttttttacccttcaatggctaatgtttggcacatcacacagttttattgactttgaatattagactccaacattctctttgccgattcaacaactaatagtcgaggatgaaatgcaattttcaacattaggtatgtgtgttcacaaaatgaactttaagaatcggcttagaaaaagtccaaattactaatagtaaatataaaagtagatttcttgaataatgcacatttgttcaatagccaaatttatcgagagaagagaaattcatttggattcgtggatattatttgtatatatatatatatatggaaatgtaataactcaacggcaatattgtgatttataaaattgggaatgagctaacttaaaaataaattaaagctcatgattgcaaataaactataatgggatgtgaaccactaaatttgttttttttttatttttaaaagttatggcttctcattcataagtaattcatggatacaattggtaattaactcaaagaatcagctaccagcatgaaatcgtaatactaacgtgtgaactacataatttgcttaccgtttgcaaaactcgtcctaaactattagttgctaaagtacatgattatttttttatttttacaaatcatagatattatctgagaagttttctttacaagaatttaacataattatccagttaagatttaaacttaagacaactcgtgtg

SEQ ID NO: 5299 - DNA, 1000 bp, Glycine max
  Soy_ogl_4836 Gm14:49104201..49105200 Cluster 24
tattcctttatgattcttgaaattttgaattgccatatatttccagtatgtgatgtcatattcttcagcagccgcaaaaatttcttttactaacttttgtctatcaacttcccaagttccaatggcatcatgttgttggacaatgatgcttgaacgcttcccactatagccagacacgcgattcagttcttgcaaaacaagttacccatgcaagcacaacagccattatcttaaaatattctattattgagaaaaataattttttttatcaaattaattagttaggatcactttatctttgatgaatcacaaaattaagactaaaaaaattaaatatacactcttttgaaaaattatctttactttttctgtattcacactttgttctttcacggattgaactagattccatcaatttaaaacccagaagtttatggtactaaacgtaatacactgctgtaaaaaggaacaataaggatgattttaaacgacatataaaaactgttccaaaccattgtaaaactgtcatatttatttaaaaaataccaccgccattctatttaagtcgggttttcgattaaccgacttaaaatggaggtcgtcaaacgtatattttaacgtacagatagcaacatcaacaattcaggcagatattttacttttatatctatcacttgcaagttgcaacaatgcatgcatctagctcctttttttcatattcttgcggtaattaattgcttacgttcatttggaaccaatcgaataatatatcacgtgtatttaagtaagccactttaccataaccaaatgtacctaccttttctattcaagtggatcctatttcgccaattgccaacgcaacttgccattgaatgggataaggagcattttgatccgtcaatggttgctagggctgccaaagaattttccataactatgtgcaagcataaaatctgtgggtttattgataatagggtcaaggaatttctttagggtgatc

SEQ ID NO: 5300 - DNA, 1068 bp, Glycine max
  Soy_ogl_5578 Gm17:8097201..8098268 Cluster 24
caaatgaccatttcgaaaataaaaacaaacttatacttaaaaagtgattgtcgctggcctgtttccaaacataacatgataattaagtcatttaatccaacagtctcttgtgtttgaactatatatgaatggcaatgcatggcgtggaatagtgtgaatgccctctttgccctgtgctcaaaccactctcacacccttgtatcctttccggccatggcctacagaataaaataaaatgattctcattcaattctattcccccaacaaaaaattaatagggtaacatatgttctatcctcatctccataaaggaataagagcatcttcattgagctcgagttgcttatgagattcttaaactcaaaaacaattgacgtaataattcttatatataagaattgccacctatataagtaaatcaattttaagaattatgagacacattttaagttattaaaaagtataaccgtaatttggagggaagaaattgttaaagttcttgaattttatgtaatatcattagaatcactaaaagtgaattaagcaactctaccataattacactattcaaaatgcttgatgatgtaaagtctttaatttctgatatttataggataatatcttaagagaattattgagattgaagattttttttacaatctaaatgtttgagatgagtgatcaatttgagtacttgatgctttggtaatagatactttcatttgaaaaaaatctaataacaaaatcatatgttagaatgcatacatatgaatgccaaatgccaatacaatgctaaattgacttattgacagtaatatcatatatcatgtaatgtaaacgaagataaggtagttttgataaaataggaagcgtaacatactatttattccactgagaggtagaaaaagattcatgaaaatctgtgctttctacgtgctactttttcagtgcacaaatataggatttggtcacggcttgtcactttattctccaaaagatgaattctgaattgaccttttactgttcatgttccagaataattttcagcacagcatagggcaatggggc

SEQ ID NO: 5301 - DNA, 1060 bp, Glycine max
  Soy_ogl_359 Gm02:3714401..3715460 Cluster 24
gtgtgagagagagagagaaaaaaagctgcaagagaatatagaaatgcaaatcacggtcgtcccattctttttctggtcttgtcactatccacttctcttttccccgcaattccctctctctctatctcaacggggagaacttttccgtcccgttcgtaatttaattaaaactaaaacttcattattcaccattcaagttaatttcatggagaaactgtgactatgtccgttttttgagaaagaagagaagggtgctttggcgtgcaaggaagagattaatagagagagagaagacgggtgagagggatgcatcgtcgttggtttcactcattcatggttttgtgtttggtgacatagatacagtacatgtaaaaagttgcttgtttctccttctgtcttgttttatctgcggtttcccgccagctgacaagcaaaaacaataatataaacataataagatttatgatatgaaaaaaatatatatttaaaattaaagataatttgtatatcatgacaacttgaggcgaggaagggcgtagtaaactccgaaatacttcggggagttaaaaataaatatagatatgaggatttccgatagcaagctgctgtaagttttacataataagatatatgtaatttgagtaatctcttaaaaaatattaagaatttatcataaaactaaaattggaaggttcctatgaaaattttgagtatgtgtttgtcacaatttaatttggttttaatcatacaatcagtcaatcacgattagtttgaaacaaattaaaataatataaagtactataatatatattcatgtagtgtaataataataaaaaaatcaaaagtaatgggtgataactgataagtctcgacgagcacatgcaggctccattcatgaattagttgaagattggattgcgcacgaatgtttctggataagttttatatatactaaaataattcaaaagtttcatttttgtttaacattaaaacaattacaatcaagctagctaattttaagtatataaataattctaaagacattagatatatgatgtat

SEQ ID NO: 5302 - DNA, 1143 bp, Glycine max
  Soy_ogl_1854 Gm06:8335058..8336200 Cluster 24
ttttaagcaaaataatttcatgttagactaatttttaaagaaactttaatccaaattcggatacccttaatcggtaagaaaggtgagacagaagtctaccaaaaagttaaaacggagtcaaagttacatgatgagtgtgggagggagacgtatgagaaagattgcaccgtggatagtaaacttatggtgatatgatattatactgtgaatgtgattattctaattaacgcctagagtgtgggagtttggcctacttttgaaatattgattgataaaaacgggtgacgttaacactgtttttataagaaaaacagagactgaaaaaaaaaaaatacactggaaggggcgttgacatgtactgatgatgtaaagacatgacaaaagaggtaagtgaaatgaaaataatgtaaataaagaaaataaagcatgcatgtagataattgacaacgcactgagttggtgagaaatgaattaattcgatctttgaatcgagcaaagaaaccatatctttgaatgacattgaccttctttaaattcaggaacaattcgttcatgacatagaaagagaaaatgttgaaggaagtgtgacatttggaatttaagttttgaaagtgtgaaattttttatggaagctaattttcaaaatgggataattttgaaaaaaaaatatattataaaaaaaatacgagaggggtgcattaagaaaaaaaggaaaataaaatgcaattgcccacatttttctctttatttatttattccattgggatcttggaacagaagatttgggctaagagtccaattatgctaatatagatttaagcccaaactgatgaaaggttctgttgaaaaaataataatttaatcacatcaaagagttatatagtaagttgataatgttttatcttattgataataataaatattatatcttattgattccttaaacttacaaatatgatggacactgaatttacaaaaattgttcacttcgatgtatagtgtatttggattggtggtgaaagactcaaaatcatatcatgatgacattatgaaagaaacttggtagtaattctgtgttgttttgccttcaacatgaaaaatctgaattgattttaataaaagtaaagacaaaccaaacatgct

SEQ ID NO: 5303 - DNA, 1410 bp, Glycine max
  Soy_ogl_2089 Gm06:46269053..46270462 Cluster 24
tgtggaaaatagaaatgaactattgatgaggttgttcttttttttttttttctctctctctctctctgatatactgttgataagggtataatggaaaggatcggaaaaaaaatgaatctatgcggattttccggagagattatggaactataggattgttgtattgttcattttcacacttaataatctctattccaatgttctaaaatataaatgaaatacaccagtaaagtaacaaccacatttgtttaatataagaatttctaacattcactcatcccgataataatattaaatgtgtttgttttcccgttcaatatcctcaaacggatgtttaaggagaaatattccctagactgaaatataagaagaagaaaaaatgaatttcacccataaataaaattaattaataccatttaattttaataaactttctagagtactctttacattaattacctaagaaaaaaattattaaaaataaaagtccaattaaatataggatattttagaaatactaccgttaaatgaaaaaataattaaagtttatttatattttactccaacatacgttgaactttttttttatttatactttgaagggagtaacaattttgttgcttttcataaaacagtactttggaacacatgttcacaaaaaaaaaaaaaatggtaaaacaaacctaacgtgaaactttgaatctctcctgcataattgtaccatatacacgtgttaataagaattggctcaacttataaattgacatctataaataatggtatgattttatattgatagatgtatacagcattaacttatttttcaaatatttaatctacatttattatttttatttatctttttcttcttattacatcaccacctattatgcttacacattttctcattagggatcaagtactaatattttggatgtccaaaaattatttttgatacatatatatttattacaagtctttactgaagctcgagataaatctttacttttaatggtgatgtcatcctcctttgtgaaacttgtttttctttggaaaaaaatatataatataatactatctaaaaaaaagttgttcaacaatagtacaaaaacgtttacacgaacacaatgtgaaagacgtgttccttgatttttgactgattctacaattttctctcattccattatttcatatacttgacttatctgaccacctcgtttggattcttaccaaatttttttgaaccatgtagcatcactcgtaagtaaattagcctaccaaagaatatgcaaatatgttaaaaagaaaataaccactattattcttcttatggaagagtacatccttgcttctaaaaaatatacagtgtatgcatataagatagggatatatatatatccccaaaaaaaa

SEQ ID NO: 5304 - DNA, 1004 bp, Glycine max
  Soy_ogl_2876 Gm08:43741701..43742704 Cluster 24
gcttaaaaaatcttcacaaaaatgacaatttgtgacggtattggaaattctaggaacttaattaaaagaaatcaggggcttaattaaaaaaaaaaaacttaggaacatatttaaaatttcataagaaatcttatgccgatactgaacggccttgcatacttttatagggtgaattttatctcttatctaaatcttttcttgataaatatctcttatctaaatctaaccgttggatgaattttaacttatcttaatgagtttttatcatatataaatctaaatctaactgttaaaataaatttgattagggaatcccgaaatataggattttatcacatacatttcaaatttcaaataactcatcaaaattttaagtggaattaaataattatattgtgataaaattgtgttgtgtattagatatataatatatctttttacattgaaattcaattgaagatttgtaagattgcacgaaatcttctctattttcactatcttttcattaacctccttaattatttgaaaatcattaaataaatatttttatacattacattaaccctcttaattatttgaaaaatattgtaccttctttttctacaaggaagattgcttgaaaagttttaaaaaaaaattgtgcaatctcataaacatcagatattgccaatgttatttactttatctctaattattgatattttgtaattatagaaaaattaagaatctcttaatagaatagaagtaaagccaaaatgttaggttccgcatatttgaacttcgtgtgttcacgattctgatttcttacccctcgctttgcttgtttaaattctgtttacagttgttttttttgtttaactgtttggaagggataagtatttagaactagtaccgttgattcctataggtactattgccatatttggaaatcaaacttattttagtttgtaattcacacgcaacaacaattaagttttttagtaaacgaaaattttaaaaattag

SEQ ID NO: 5305 - DNA, 1134 bp, Glycine max
  Soy_ogl_2948 Gm09:2403867..21700 Cluster 24
acacaaaaatctatttttatgtgtggaaaacaaaaggttggtgctaagtgctgctaacacttggcctcagcaactcaagaatatgaagacacaataatcttgtgtttttccatcacactgttctggtgcattgatgcttgcaacgtcattaggagaaaaggtaccccggaggagtgtgatcacattatcttgttgtgttccctaaagtggaaacaatgaaacaagttcccaatagttcaaatccaattgcacaatctcattcattattgtcaagcatcaattttgacgaaacagaacgaccacatactgattacgatctaatggacgatatagagtgccaagaaacaaaaattggaacaattaatcaagccatgaacataaggacataacacctttgtgtggctagcttttaagtcttgttatgtctctcttctttgtatgtgctagaaacagtagttgtgagtttattgtaacttgctactgaaagattgtctggtattaaagcttattaagagagtgagatagattgttattaaaaattagtatttgatttaaagaatggaaatgattcattgataataaaagcgttggattctgcatgaccaacacattttttttcccagaaatttaaggtatttctcagttgagattcaagaactacactatcaagatattgagattatgtaagaagtttatctctcagtttatagatgtttttttcatacacatacaaaaaaagaaacatcaaagttaaaatttttaataccaatccttatgggattttatctaattcaaaaaaacctatgagaatcttgtcacaaatattttttacaattttaatttaccaatatatttttaaatatattatatattaatctattaattgtattttaatgaaatagtctgattcaatcgacaaaccttttcaagttcagttcaattgaaccaacggtcttccagttcagtttcattcaatcttttgtcctcaattgaaacatgaacattcctgattaaaattgtcattacaaatgttattaaacaattatgtatgtattatagatactctaagaaaataaaagaatatttttttttattgagacaaataaaaatacatccatctataatttttaaatg

SEQ ID NO: 5306 - DNA, 1000 bp, Glycine max
  Soy_ogl_3827 Gm11:10437301..10438300 Cluster 24
aacttcatgagtaacaatgattgaatagatcattagttatcttatttgactatgcttaaatagttcaatataggtagttcaatataggtgcattatcacttcatgatggaacaatatactgaaattgagctaatcccacaaaatatataaattgtagtcctaagtatactaaattggaaaggcacattattaatcttattcaacttccataataacaacttattttctatagcaaatgctgccctcctaactcttgctcatctgtaccatctttcctttgacaagaattgagaagttcctacaatttcaacaaaatcaatactcaatgctcatggataccaatgatacagaaacattcaaattaagctggaaaaacaaccaacattgttgcacaaaatcataatatgataccttactcattcgtccatattccccaatatcaaagaagatcttacaaactttaacatttgtcttaaaccataatctctgtaaaagaagtgacataaaaaataaacataagattgcattaattacaaataccaagagccaaagataatgtctaaatgtagtaacctcattctttgcttcttcaaggcctttcagactaaatgtaagtcaaggatactgctcctcttgaattgtaatgttgattctcaatatcaaaatactgctcctcttgctcctcaagtgagtactcaaatccatagtcctccatatcagcatctatatatacaataaaagagaggcaaaaacttagtgtcttataagcccaaccaactggaatagagttttttagttgtttcttatagcacacatgttgagtaattaagcacaacaataatcaattgcatactttcctaacacaatccaaaataacaatgacacattccaaacatcagaaaatcctgtttaactcaaaattccactatttttttgggggattcttatagattgccctcaacattggttcgtggtgccagcctcatacaaatcgacaaac

SEQ ID NO: 5307 - DNA, 1004 bp, Glycine max
  Soy_ogl_4626 Gm14:3822601..3823604 Cluster 24
atgcaaacagcaaaccatcacaagcaactttcggatgtagcattgttctaaatctaacacttagagcagccacgtcaaaaggagaatggaaagagaaataaagaaaaaaataaaggctttaatggcggctagtttacattaaagattagaatagttttctatctgacctttatggttcatttaaaaaaactttgatacttcaattctttgtttaattgatagcgtatcattcttaaatcattgtaatcaaaacagtgaaaaacaatcattactaaatcaaagaatggagtgaaattagcgcaaacgtttaaaagagagacaaaaactgctttctttttcctgaacgcatggctaaacgatatctttcatgttgaatcgctgatagcatcttgtcatccatctaaagagaaagcaatcttgaagttaattttttcaaatgatatgattgatatcgaagcaatcaataaacacaacgagtcatcgttctactcagatatttttagtccacactgattttgggttgtcaacaatagacaattaattaatagttgaacgcaaggatgccttattgtgaatgtatcaaatttcttatataaaaaaagtattatgtatctatcaaattaattgttggcgtgtatttatggcacctagctggacatccagcccacggggataaactccctagtccaaaggactttttgaaattttgcaaatgaaaatgaataggaggctttgtcataaagggtatgtttgataagtatttttagctataagaaattttagggttgatcacaacgccaatgcatgaccaactgtaaataagggttgttcttttgcatgcagcgtcaattgaacattaccaacagccaccagtaactttgctgccattttgtgcaaagtaaagacacacacattagggtgagatccccaaaagacatacttgcattgaaaactattttaacacctgtaaggtaaatttaatatacttaaatgcttcatatatt

SEQ ID NO: 5308 - DNA, 1000 bp, Glycine max
  Soy_ogl_5915 Gm18:3032201..3033200 Cluster 24
tgactagtttcgtgtaaaaaaatatttaagaatcaaagtttcacattaatttcattataagtatatgatataaattatatctaatattgacctcgatcaacatcaacacttgtaagttaaggtgataaagcatttgactataaaaacaggttattatatgaattgggcctagactcaattcataacaaattacattattagcaaaatatgttccttggcttttttttcttcattagtacgttatatgggcatgaaaatgaattacgaatcactatcctcagtactcagcaatatttataatgcgtcaaccacatataacactcctctctctctacatgggtgtgggtggttaggcactcttgtctcaattacactaccccaatttgctatttaaactaattaaattcacatgatgagcagctagtgctacttgaataatgtgattcattatcatatgtttaaattgctcatgatatatacctaccctcgaagtaaagaagtgcgagttcaacagttgaagttttcgtagttgctattttaattaaattcatatatataacgagcaggtagtgctagttgcgtaatgtgatccattataatacggttaaatcgctcgtgatatatcctcaaattaagtaaagacgaagtatgagttcaacagttgaagtttccgtagtttcaaagatttgcgtgtgaaaaaaatactacttttgaatatacctttaaagtgtgaaattgcccatgatataccttcgaagtctcgcactccaccaaaactatgctcgatttgatatacaagtaacatttaaatgacaactaccaataggccatattcagtataatcatcactgtcacaaataaatatgtcggaatcctgttgagttggtgatccatggtaaaattatgggtcgtctttagttaatttggataaaccattatatcatttacaaaatacaaatatacagtaacttaggataaagtactttttcgatattatttg

SEQ ID NO: 5309 - DNA, 1010 bp, Glycine max
  Soy_ogl_6611 Gm19:47353301..47354310 Cluster 24
agtgaagttcaatgtttatcctctaaatacttaaatttgcatcataaagtaagattttaataagtaaaatcctagctaaaagtagaacaagtttaatcaattggttttccttttcttagtatcataagatactcttttggaatgaatttagtaaaataattcaaatgtgagggttaatttttttttttttaacaaacgttagaaaaatgaataatttaaaagataaaaattaagaaaaggcgaggtagagaaggcaattgtgaatcaattatttgtactgattcgtataatttgtttgggacgtcttacaatgagttgtaatccctattttttagaatatacattatgttttttttttttaattcctttcatataaaactagaatgtttacaccactaaaattcagaatatgaaaaggactaagccgctgataaatttagataaatattggaaattggaagaatatattttccctcttcaacattttttatttgtttataatttaaataaatcctcatatgtctcgggcaattgcttccaggtttttaataaatttagaaaagtaaattcaataatttttttaagagtgtgtgtggatgagataattcaaaattataaaaaaaaattaaattctgaaaattttaaatactttaatttaaattttctatttgaataaaaaattaaattttgaatcaaccataaaaaaataataataataaagaagaagcagaaaagaggcatagttttattttgaagaactttgaggactgcgatctctcccttcagtctgggtctttttcttccatcccaaagtttgtttgatcgtttccatgaccttcttgaagattcttctgcttttgttcttcaattgctgcctttgcccgccgccgctacttttcttttcggattgctcaatctccaactccaagtgttcgaccaaaccccccaaagaagcacctttcagtcgaaacgctttaaaaagcttaggtaaatctgtatcatcttctcct

SEQ ID NO: 5310 - DNA, 1200 bp, Glycine max
  Soy_ogl_1930 Gm06:13800101..13801300 Cluster 24
taaaattgatatgattaaatgtgattaattaactttttttaatagtgtataatgtttttttttcttatatttaaaatcaaaagaagtatgtgattagttctatgtgggatagtattgacatatcttgcattctaccaacataattcagagtttcagaacttgattcataaattctctttaaaaagatgtaagcaagagagatcacataaaggatagattcaactttccaggctgcaaaaacaagtactactactaaaatcatgtgggaaggaaataatgactgctctcttatttgccctcggttgaaagagacatgtctgttagcatagtttggtaagttcacaggattttagttaaaaccacacatgaaccaatatgagcaaatacatagtgctcccttcaattctcgttacttgcatagttaggtgacgttactgactttgtgtgcatgcattgattaccatttgtgtctgtcaaatgaattttgcctccttttggtttttgtggattgaaattttaggaagagggatgacaccccagattaagaatggaaaaatttccatgcttaaacagtaatttaacaagttacaacttaaaaagtacttgtagaaaggtgcttatttaataaaaatagtttttaatttaaattatatatttattaaaaaattaaaaaaaaaatccttcgcaaatattttttcattcacaacatccaagtaatttggatcaagttgagtatggtcatcacccgaacacgaaacccttaatttggagtacttgacattaaaattaccaataatagaaaaaataacgagaatgtacacttaggatacaatcgggacaattaaaatgaaataaaaaaggacaggagagattatttgtaatgacaagtatttagataaattttatcatatcaatatatggttggcaatattattatatggtaatgactaatatactctaataagagtaaaaggtgggtgcataaaaaagagatagtaaaaggtgggattaacaaaaatgagattgtgaagttgaatatgtggctatgtgaggaaggacatactgcgagatgattgtatataaagagatatattagcatgacagtaattgagaaaaaatatgataaaaaaatcgtttaagatgctttaaacacatctaaagaaggtctttgggagtatcactgaggagaatatatttcat

SEQ ID NO: 5311 - DNA, 1102 bp, Glycine max
  Soy_ogl_923 Gm03:37291201..37292302 Cluster 24
tgttgtttttcttaactttgccgttaaacatttaacagtgttattttctgaatgtaaggtaaaacttctcattggtttggttttgtagcacgaatatttttacactatataaatacaagtgtcgatgatatgccttaacaccaactctgaagtgtgatttgctttttgcaggttcaggtcgtggtacaaagaaattaactgcaagatgtacgaattatttgactttcatgatattgttaaaaaaataaaagtcaaaacaatacaatggtacgttttgttaatagtaaatcggaacaaattatcttttcaagcgtgcaaatcaatcaataaaaattaacctcagatactcgaaaggtgagtgtcatgtatgatcatgtgaacgtgataaatttcacttggaacaagaaatcacatgaggattttagtaaagtaatcaaaattaaaaaaaaaaaaagttagtgaaaaaggaagaagtagtcacatgagactggattactacatactactcttgatagaacactttcccaacaagaatgagttgtttttgttagttttatttatttatatatctatattgggcgtgagaccgatccttattagaatatttttataatatatttgatttgatatggaacataccgtgcgtgcgacatatctctctcatcgtgcttagatgacaatcatgaatactaattattattgtcagaaattaatatatagtgcgaaaggtatcatctaatgatacatgagattaatttgttaattaatatttctatagtttcgtgggtcagcatacatacatatatagcacaaatcatggttcgatgtaagagagggacagcagagcaatggttcatgggggacactaggactacataaattaatttaaatattataaaaacaaacttaataaacatagatttcttgataagtaagaacggtcacgggtcgaattggtgagagtttaagagatacttagatatgaatcgattaatggtaattgtttaaggttggataaaaaaatttatatattattttacaaattgaattgaactaatttgatcatagttaggttgactcggattaaatcatcaaatcaacc

SEQ ID NO: 5312 - DNA, 1110 bp, Glycine max
  Soy_ogl_2159 Gm07:3328301..3329410 Cluster 24
ccggctggagaaagggaaaagttatcatttgtggttttcctttctaaacactataatatctcaacacgtctaggaaattaaaatatctaaattcatctttgattaaatcattcatcgaaagaaaaatgtcaatatcacaagaaaatgccaatatcataaactcgaaaaaacttctattatgaaattatatataattacctgaaatggagagtacatataaaagttatttgatttttaaaactaataactcaaatatgtttcgccgggtggattcagatgcttggtttagaaatgagtctcgtaacaaatttggatttagaaaaacaccaaatgaaataataactaacagaatcacatgatcaccaattattggtattgttattttagccttccttattgtagcatttgattgttactttaaagtgttaaaaaaggaaaaaaaaaatccaatgcgtaaatcaatgacgagatttcatcttagagtcttaatcgagattgaatatgtaattatattaaatactcgaaaattttgtcagttgtaattttatttggctccataatgattattttcttgaacatgtagttgcattaactatttagtaaaaatttatcactcataataatcttattttgttattcaactagaaaaagattatttctaggaaaggatatttataatctattaatataaattttaagtgcagattagataaactgaacagcaaagaagaaaaatactaaatgattattatgacaaatgaaaaattatacaatttttaattgatatgttaatttgtgatatatatgtagtaatgtaggtcgtggatgagtgcatgattttttgtatttttcctcatgaagaagaagctcaatcacatggaagtagagtgtggaagagaaagatgataattatggtgacagcagaaacgatagcgatatctacaatactcctattgtacgctttccttcatgtttgtgtcataaaatggaggacctctatttaagagaaagatataagaataatttcttgatatttttattttctcgttccaaaatttggaagcattaaatggacggtatcattaatagtagatgctcgaccactactaa

SEQ ID NO: 5313 - DNA, 1000 bp, Glycine max
  Soy_ogl_3126 Gm09:36415801..36416800 Cluster 24
atattctttgtactaaatattttgttgtaaggctaacatacattttaatataaattttgtgatttatttaatttagatatacattgcatttacgcacgtttagtaattaaaaaataattttactaaaacgaataagcccttaatgtcaatatacactttttttcaaatttagtcacattttgtttttggtgaacctaagttatctctcagccaagaaaaaaattctcattattgaaatccatttaaaaattaatctttatcaataaatatttttatgtacatacaaacttaaagatcgaacttcttagcatttatttaagtgaccaaagtatttattatcagcttcaaattatccttgtcttattaacataatgtatgcatgtctgcatatattttctttctccgttttctagtggtgaaggatgattctattactttgagcaaaaatattgtccaagtaccggtaaataatacttatgtgttcctctaaaaaaaaaaccttctgtgttgagcaaattatgttacataaaagaaaattatgctattatcactttaagcattatttaacttatatgtacacgtttgttgatacgtacagaaataatatatcgaatattttgaataataatttaagtatttcagaaatattatataaataataagtagctaaaattatcttgtaaatacggagagtaattatacgatttgtgagtggtcgaaatcatttctctcaagaaagcctaaaaaagtttgtagaaaatgcactctttcaagcaatttctaataaaaatttcgttaggtgcacatacatgatttattccattaattgaaactattgaaaataattataactttgattacttttaaagttaagttcatacatataatattcgtcaagtcaaatatatgtgtttttataggttctacagaagcttcggcaactaatttatgcaatggaatatttgaaaaatgaaaaaataaaattaataattagaacatc

SEQ ID NO: 5314 - DNA, 1300 bp, Glycine max
  Soy_ogl_1560 Gm05:2728401..27130 Cluster 24
tcctcttagtgttcgcgttattttgcatcaattttttgacgcttagtagatatacatggcatgaaatgaaagcatggccaatgctccatgattgtttgctggctcccattccatgagaattaggaagacttttatggctgacccaactatcaaatcaaactttacttttagtttaacgcgtgatgctttgaaaaattaagagttaacaaagtgtaaagtctttcaaacctagacttaggcctttaattttatagctccactatttgtggacgtgaccaatatgacacacattagcagctcttactaggtcaaaacatccggttttattttttatttttttacatatatagaagtataatcgtgttcaagagaatgtgtgcacttgcgtccaatctatctaatgctccacaatgctatgacccttcataaagtatcagtctgtacaggaatacaatttgtagaaaatcctttgtaactgttttttttttaactcagaaaaaaatattatatataaaaaaggtaccagtagtatcgaattacagaaaaagtagcaagatcgggttactaagtatttacacagcatataaatactctactcaacctttttcttctcttttggttttacgaaggtctaattggaaatgggaaaggaaaatgtggaagatataggttaggctccacaatattatactccttcacgtccatttgattggtatataattttatagagatttttttgcctaacgtgagatgaccgttgttatttggttctttcattgctaatgtttattgtcgaacttctgttatattaaagtaaaaagaacaatcaaatctgaatggacatattaatgagctttcgacttctgtaatcttgttatcatttcagttgttatataaatagtggactacacatgcatcatgtttcattgtcaactagctgaagggatcgatctgaataacgttttgcgttcttaatataggtgtagggttttgaattcatttccatattcaataataatccttcttattttatctattacaccaggaaagaaaaatgataactacatggaatgaatataatttcgtacaacgacttgccaaaagataaagtgaaaaatgtttcctgtgtttttggtcaattattcatttatttttgaattcagtttttatacgttttttcttccaatagtaattaattaattttgagatattggaatcattttaatatgaaaacttttccaaaacattgataatacgggaaatcccttgatatctactgttatggtaagtagtttcaatg

SEQ ID NO: 5315 - DNA, 1200 bp, Glycine max
  Soy_ogl_5570 Gm17:7659801..7661000 Cluster 24
gtagtactaatctaaaaagaaattatggcggtgatcaggtgggtttagtttaataatatcaagttaatgggtatatacagtgttaaaataatatattttaacgccaagttgcgggagaatagtgtaaggttgaccattgatctgatagaagaagatttgagatttaatttgtttgcatatatacatgcatgtggccctgatcctttgtgcttcagtttttgattaaaagataagggaggagcccaggtgtcggagttgcattagtggggattagaaaaatcgttgctactgtgtggatttgtttggtagctgcagctcaatttggataatatatatatcctagttcgttcttcactcttaggattcctatatggggttttggccatcttggtcgttgcattgcatctggtttcgttattaatgcagtctgaaatatagtttgataggaattctgtaaggtatagacacgtcgactggtaatttaataggaatgtacgtaaatgtcgttttctacgtcaaaaatatctagtgcttacgtccattaatgtaaatgtgtatatacctatatggatatgtatatggtgatattgttagctagattttttgagtttagacattttattcaattgatgtacttagttttataaaataggttaaataaataatttcatagtttcttttgaaagtttatattattgtgtgatttattgggaacttatgaattattgtgcatgtatgcttggatttaagtataactatagtaagcatgttagtttattgtgtaagattaaataaactaaaatttataatattttataattaagaatgaggatatattaattatagtgtttataaatttataatggtataaaatctataagattaattccgattaagatcaatttaattagtttgatttaggtcattgagttatgatacaaataaataaatggttgtttttttctctacagtataagtttttatctcctcttaattatctatttcatataaattttgaaatttcatattaatgcaagataaaaatatttccttttaatggttaattatttaatatttagtttttttatagttatcactttacttatatatctcattaatttctttacccaaacaatgataaaaaaatataaacataaccaaattaagatgctcgataaaattaagtaagattataggaat

SEQ ID NO: 5316 - DNA, 1394 bp, Glycine max
  Soy_ogl_5253 Gm16:2309407..2310800 Cluster 24
gctcttatgataacaccaattctgtttctgacttgtttttttgtggttggccttggccatggttaatttcaatgcttgaacgatcatctgtaaaaagtgcacagtactgaatcactatctaccatatcatcacgatgcatttatctgtttcacagactgtatgaagcagaacgattgcacgcttcttcaattgcagtcatatatattccaaagggtctaataattgtgtgaatacaaatacaatgctataaacatttgcagccacacgcattatctaatttgtttgtattttcattagatacatttttatgctgtagcataaacttatagtatatagtgtcacagcacagccttggagacccgtgctgccaaagttaagtacaacccatgccctgaaaactgaaatggggaatgattaagtagtgctatttaaaaaaaagaaaaagaaaaagagaatgatggggcctttatgttattctttttcttattttaacgcatctttctggcatgaccaaaaattcgtatagtgagaactgagaaccaccttttggcagcttgcgcgtgctttccctaaaatgcttaaaactactaatggagctagtagctactagatcaaatattatttttttatatatataacaaagatcaaatttatatattatttagtcatagatatatgcatatatttttcagttggcttcctggtgtccatattggctttccctaaaataaaatccacttttatttttatccttttctacttctttcctacctagttcaattcttatataacggaatcaaagtataacatcggataatagttcaaaatcacatgtcacaaatgaaaggctgcttatatttgtttagtttcctcaatcaaaactaaatctagttatttccttcttttatttttctcaaaaacaaacccaaggttgatatgaggagaaaatgatgcaaatgagtattacaaaaagtttatgaggtttctgcttagacaacaaggaagtgacttcactcagaaaaaaaccttgatgatattaattatcacgaaataacatttcagtttgataagttattatatcccatactgaagtaatgtcttcattttctgcacggcatcatccgccatacaatatgtaaacgttcaaaacattcaaatccttcttacattaatataaaggacaaggagataatcaatttggaagccaatgtggcccacgccaattagtgcagtgagactaagaattgggtgtggaaatggaattagttcatgttctggaattaacccaataacaagtagaccagatgtcactctaatcacaaccactgagaagctccgattaacacctgggaactatgctattcgaaataaaatgcaggactcaattcagggg

SEQ ID NO: 5317 - DNA, 1343 bp, Glycine max
  Soy_ogl_6966 Gm20:43992158..416500 Cluster 24
tctaggttgaattgcctaagattattatgttataaatgataatttttactttataaatatttaaaataattgtatatttattttaagggaaacaaacttatttcatttgataagaataatagaagattcaaatgtggcaatacaatcatgatcctggatgcaaacatgaaatctagaggcccttgtgatcctatgagttattagattagtttgtcccggcttgaattggatatcaagataagattgcttctataactagataacaagaaatggaaaggattgagaccagttgttgccgagttcagattgtctgtaatcatcttatagtctgtttcaaaaatgacgttttgcatttgtagctgagaaatccattcgatagctttatgaaaatttctgcctctgaagcatgagggacacgagacaatatgaacgagcctttaagaaagctccattggtgtcacggagacacattaattgcagctccaaagcattacaattggaataagaaacaacaatattattaataactggcacaaaatcattacaattattatctgattggaacaactaattggaataagaaacaacaatatcacattttccagaatgtccttgaacagtggacctatcatctcgtgttagaaaggagataaaatttgttttttttcctagtagttgcagttgatcagtggaagaactttgagtttatgtcaccatccttcagccagtaaatttttgctctatgtcgccagaaggattcttctcgagcaatgaggttgcatagcttatcattgactatagaatagagagaagtagcctcaacatcatttgattgatggatgaactcaagctccttgcgacatgcttctatcttatcacgattaatgcctcaaatactctttccccacaaattcatatcattagagcaagcttcaagtttctggatgagatctctagaaaaagtattattccatccatcgtttagggttggttgaagaagccagcaagaattttcgaaacaaaaattcttcttgaaacatctatggcttccaacattcagcttgatggtgattggcgaatgatctaatgtggacgacacttgattcaagagtttgaaattaggaaataaatctatccactccagtgttgcaaggcctctgtcaagcttctcttcaacgccgtgggtgaattaaagcatctcgaaaaccatgtaagagccaagttggttggtccacgagcctaatttcctcatcatcagaaagatacaccaagggagagtggtgtcattagccagaaaacgaagcaaatcccaagattccttcctcttttgacagcttgcttga

SEQ ID NO: 5318 - DNA, 1074 bp, Glycine max
  Soy_ogl_4652 Gm14:4410327..4411400 Cluster 24
gaaaaagaaaaatctgggtgccccctttgtgttggtatctgtttcctccccctaagcactaatataccaagaagagtgatcaggcccatccttgcccccttgtgttggaatttgtttccctcctactcttaagcttgacatcgaattgccactttcaacaagtgaatttagcggaaggtttggagaaatttattttcataagtgtgttcgtaatttgatgtcatttggatggaaggactatttatcaaatgaataaaatgtaagtgtatatttggtaaattttagaaaataatagtttttttcccctctcaaccgtcgtgaaacatatgtttttaagaatatttttctttcaaaaattcattcaaatccaaatttaaaatattttcaatttaaaatgtattaaaagtatatagtgttaaatcccgaccgaaatttcataaatttcatctatcatacacatgattctgttttcttagcaaagcattgcttttgttcatgaatattttactttttgggtctaatgacgtaatgcgtaaaacaaaggtccatgatattgacacttcgcttttttgtcttctcatccgccacttttcttttctttttttacaaaaataatttctattgtccaacttaataaaaaaaattagtttctatcatatcagcgatacacaacaaatggaaatttcacaaatataatgtggggcgagaagataaaaaatatgagtgtgaatttcatgggcctaaaacaaaataccaaaatatctccactactacggcacatgcaactgggttttcttcaactcgagggaataacaatgaacaagacagcaggaagaaaaggctgaaatttttaggcttaaattattgtgcttaataccctattgtttcaactttgtttgaataaaaaccagcacacttttgcaaaaaaaaaaaaaaacattgcacctaacaaaactggcctacttaaaagtgaatattttgaaagccaatatcaggcccaatctttggcacaacaacaatatgaaagacaaagttcacgaaagacaaattttcaagtcaagtgcatcaataatg

SEQ ID NO: 5319 - DNA, 1000 bp, Glycine max
  Soy_ogl_233 Gm01:49717101..49718100 Cluster 24
aaaactttaaaaaattacactaagaacttggaatgtgttaatatattcgtttttcagctacccaatatcagaaagtgttaaattaagtcacaacatcaacaacaattacagtccaaaagtttcagaaatacttgttaagtaaataacgtcccaatcatatctttttaactcatataaggttgatctcttgagcaagagaaaggcaaggtgacaaaaactatcattttcccagtttctaaaacggctaatttgcatgccatgaaccggtataggatgataaattgtaaagtttagctttacaaaatcgctaccttacttcatgactttgtaaaataatttattttagttttctctattttatttaaaaataaaaaataaaatgaatgttatcttgtaaagtgagaaagtgaattgaaaattatgaattgtagtaacatgcacttgtaagttgcaagtttaaggataaggaatagattaaaccaaagcataatgtgctgctaaatttaattaattacaactaatccttctcccaaattttacaaagtaattggtgcgttaatttatcatataaaattcacatagtataatatcatataacattcattctcatccactttcactagttttatacataatataactctacaattgaccaaaatagtaagcttttgctccctgacacaaatagtaggatagttggatcacattgaatcttttgagaaaaatatactcacaagcctcaactgaaagaacacttgttaaaatcaaaaccaaaagaatgtacaacaacatagtatcttagaacctctattataaattaacgaacatagcgagagattacgagataaaaatatgtgaaaaaagttggttatattataataccagcatgtgtgcatctcaaagtgttcctcttgtgtgatctcaagttggttgtgacaattataaaaataatcaaaacaatggaacagaagtgacctagcaaatgagctccgctcaaggg

SEQ ID NO: 5320 - DNA, 1146 bp, Glycine max
  Soy_ogl_1045 Gm03:42508301..42509446 Cluster 24
aatcctaatcatcagataggaagatgaaaaaaaacctgcacataaacatagccaataatgcggaaatgcgtaattgggcttgatctcataggcctgagccagtcctcttacaagcccgtttgttaactctcaaaatattctgtcaagaaaaagaaaaaactctcaaaacactcctcacttaacatcggagtccattgataattttaaatacttcaaccgaatattgaaattaaagctttttactagacagctaaaatgaattatccaatcccttttcttatcttatcattgaaagactaacagtgataaatcctccctctcttgagaagtgtgtggtgtgaaaacttaaaactcaatgagaaattattcttatcttattaagattgtaaaatttatttcacaactatgagatgagcggatgtaagtaaccacgaaggaaatttcaaccctttcacgtgtattgatcggtgatactccacgtttgctttgcatctcacaactgagtgatgatgcactacaatcatccccgagactctctatctttttgtccttggttaaaataaataaagatgaatcattagcatttcccataattgtaactaaagacaacaaggtacatgatgatgggtattgatgagtgcaagggggttatacttatacacattatgaagaaaaatgtaaacgactcaaaaccttccgttaaatcatgaatgcacaagtttttccctaaatcattcaatttggagtgattgaatattgcaggggaaaaagcaaaacggcttttcaagagggacttgaatagattaccgagagaaccattattagaggggctttgccatcattgttcgtttctgacgagatttatatccccttttatttgattcactcactcattcacgccaatttattttactgctatatgccgtgtgcttatgggtttgctttggaaaattcggaggtacccttttgcctccttaatacaatttctctgatggtacaatttgaatagcatttgggttgttgaccaagctcatgttcctgcatttgaaaagaacatgcttgaaattttgatgcgataggaactcatgaggctacaaattcggtcgagcagaccacgttccatatatgcatgatatgggacaaaca

SEQ ID NO: 5321 - DNA, 1100 bp, Glycine max
  Soy_ogl_6726 Gm20:33483401..33484500 Cluster 24
ggtacagctactagtttatgatcacaaattcacgaataagatgtaaccatccctattgaattattcgaactaagatcttaagggtgcatttacttgtatttttattttctaattacaaaactgctatcttgtttgttttttctttttgtttttaaagattggtacatgttatactaaaaagtatttttgtttttttatttcttgaataaatcttgaaaacaagataatattgaaaataaagtgacaattttataattaaaaagcaaacaaaaaataaaaatatgacataaaaacataaaacgcctcctaagtttttatgttgagactagtatggatatatagagacaagaacaaaatccaacattgttcaaaatataatttgaggcgatcaattgacagagtttttgtctcttgttctctcagccccatactcacattcacccaaaagcaagtaaatgttgcttatcacaaatcacaatattgaaatttacacacaaacagagacaaggtatagtgtgtaattgtatttccattaaaaattctgttcaattcaacaattttcttcagtcacattaaaatgtaccgaataacatgtaaacggctattcaaacacatctatagactacattgagtatatattcgactacacttatacctttgtcactgaggttggtagatcaaaagaaactaaagtaattaagtactatcctattagaattcgaattgtatattatcattacttaggtactcctttgttttattattattcttaagtgctgatacggattaaaaactgtaagttctgattaactgaatgcacacaattatcatacatcatgcaagatttttcctttcaaagtacacgagtagtagcggtttatacggaaatttgtttaagtaaccaataattaagaggtcacgatgttatatctaacgcacacggacatatattccatatcttaaatagctattttcatgcgctgtctcttgcctcttctgtaacatattgatactaaatagctaaattattgatattaatatatgcattatgtgtttcctaaccactacgattttgttttttttagtgaaagcaactaaaa

SEQ ID NO: 5322 - DNA, 1162 bp, Glycine max
  Soy_ogl_1855 Gm06:8342839..8344000 Cluster 24
aaggtaacttcatgaactgatacacgtgtctcactctcaaatatttacatttcattttaaacatatatccattggattttgaaaagttagtgcagcatcctttttacatgaaattttaattgcaaaactaacagtttctagcaaaatctgttaaattcaaatttgggggaagggtgacataagagattcaaacttccaaagaaaaaagagacataaaaaggtaaccaagattctgaagtaggcaaactttagtgagaatttgcaatcattttgaccatgtaggggaaaaaatcagcgactctttcgaaagaccacacagcctacaccatttctgtgttgctcggttcatcaagtaaaaaagtttttctgtgtcaacaattttgcgttgcgacacatgacaaattaaaacacttatagagtctgtttaaaaacacggagaattttcgcgtttggatgcaaaaatcctaaagcaactcgagtattgcttccgaatgctggttaggttaaactcaactccttcgcagtctgaaataattaagattctagttgcggcatatggtataaagttatggttaaaagtgttatatgagtttgaaagtcaattatgtcaagatgaccccaagagcttatttaagaagaccagatcaaagaaattcgcagtctcttaacaaaaaaaaatgaagaaaatttcgaaaacaaaaaagagttcctcaaaaattaatttcaagagtttggacttctactttttttcttctttatttcaaaaatcagaatttaagaacacatcatctaaaaataataatttaaaagaaattttgagaatagaactttcaaacagctcaagtttaactttataattttagttttaaagtaactttcaaactaaaagaaatcaggcaaagtgctactttggaacgtaatatataacgaggtctgagttcattctatttagaagacgctagctagtgatgcatgtgaggttgaggaagtcattttcacacaacatcacgtcaaataggagtgtggaaaaggaagtaaaaaagcgtcttctaattgtgtgtatattcggcactgttttggtttttcagaagctaagacagatcaacttcttacaaagccatttaccatgcaaccgaagaagtagttggctatgaacatgaat

SEQ ID NO: 5323 - DNA, 1200 bp, Glycine max
  Soy_ogl_2117 Gm07:1592001..1593200 Cluster 24
catcatgggtttcaacaaatcatttttattgatgagttaggaccacaaatgagtgtagtcccataccaaaatatcataatgtacagtagtcccctgctagaatagcctcagaagtgtaaagtgccaatccacttggcacatggtaattaaccatggttttcaaactaaatcattactatctcaattttggccacaccaggacatgctcctttaaaacacatatataattcaatgtaccgaaaaatagtgtatcatattcattcatttcttccccaaggtaatttcttatctgtcccgtacaaaaataaaggtaaattcattctctgtcacaataattattttatttttcattttttaaggccaaggtgattgcgaaaggagaacaagaaaaacatgatttgtgtttgtggccgttgtttgctgcaagtgcaacgaaagatgaggtcattgcctgtacatagtaatagcaccatatctttatattatattaatcaagcatccccactgctaccccttcttatatgatatttttattttaatgtcacaccttacttataatttttaaaataattattatataaataaataattttttaatgtaatttattattaaactttattaagtcaaattttaaagacttatatttttgtccaggagtcgttgtctcattcttcaacataatgtggtgatattttattttatttatatttgagttcaattgattagtattaataaaatgtttaaatttgacagttggaaagttttaaaacctaaaaataaaacaattgataaaatttctctcattcttttgaaaatctaacttcatatataactcatttataattttcctacttaaattaaaaattactcatgcaatgcaacatttgttaataatatttgaaaagttataactaaaatctaacaccacaatgcaggttgacataaatagttaggtatagaatataaagtctcactttcttcacgggaataaatgtgaatatcttaatattacttttttcactgatggataattctttctaaaacaatattctcacactttaaagttcaaaatgtcaatcacttatacagtgttcataaaattgccctcattggcgatggataataaataactttcaatttttaaaccaacttataatcaaatcaatataaagaaaaaactaataaaaccatttgatttc

SEQ ID NO: 5324 - DNA, 1100 bp, Glycine max
  Soy_ogl_2861 Gm08:42962101..42963200 Cluster 24
acatgtataaatatattatttatatatttttaaatttttaaaaattataacgtatatttctaacttaccctaggaccggccttcacatgaagcaaatgaagtctttgttttaggtcccagtcatttaacattagtattttgtataatttttattatttgttttcacttagaaaataattactctgaaaatcaaaataagaaataataattactcattaatttcatttcaattagtgaaaatatctcttaattgacgaagcctcctcaatattcaattctcaccaaaatcagctcaaaagtcactatctatattcttttaattttgaatctcttatcacttatctcaatcaaaatataattattttattaaaatattttctttttgtaaaaaaacttattattacttttagacatacctcattttaaaattagctttaggcgtaaaaatatgttaggttgatcctacctcacccacgaaatccactcatttttaaatccatgtttcaagagtgttttccaaaataaagggtaaaacttgattaattttagtatctgaacttcaactttgatgaagatgatcattttgatattctcctcggataagaaaataaaactttacaaaggattttccaaaggaagatgaagacaaagatgctccctttactacgcgatgatgacttaactatgacgcagttagtaaagttagtattaaaaagaagtcaatttgttattttttttacctaatgtttatttcaatttcaaaaatacaatttgcagttattgtgtttctgcaaccaaattaagtaacatacttacgtgtatgcatggggcttaatcaatggtcaaggagttccatggcctagggcatactgctcaaggagagctatccatgtttgtgtttgttcataaatcctctcactctttcttactttaaagatttcctcttcctttattttttttttcaatgctcttccgtatataaaagtaggctaattaattgcattgatgcccataattcacattttatttaacacaaaaaaatcttaagtttcaacaaattaaatgttgctatcagtgtcacaaaatgataaaaaaaaaaa

SEQ ID NO: 5325 - DNA, 1300 bp, Glycine max
  Soy_ogl_3553 Gm10:45461701..45463000 Cluster 24
gcactgttgaatttggcaaatccagttcgtgtgcaatgaaattggcaagaggactagatcaatgatgaaaatcatgaaaatgctatttagccagatttgcattatttgaccgatgaacgtgaagtttcacccaccaaattagatgctgtgcgtactgcagatatatactttcaaataatgaataatgaagacgttttgcaatccctgacctgactttgcaaatcacaaagtaactttgtggtatagccgcgtttagataatgcatgcatgatgcattcctagagaccagaggttgcaaagcatccagaatccagatcacacgatatatatttcacaattcagtacaaatctaaattccacgtatgttatggctttggcttgtctgttctgtaccttataacgtgacatcgttggtgtggataacatggatttgatctcggattcggagtaatcaggtaatttgggaattgatttcggattgataaaattcattatgatgaagaggatggtgatgaagataacttggatacagaccacaataatgattttgattcggtctgaaattcatttgtttcgttttcaatatacaagtgaagattaaattcatttctcattaacactttaggaggaaacttcatccattttgccaaaacattgggtgaagtattggtggttggaagttcattataaggagtttgatggcacctttaagaaaaactgtgccaagaatgaagtaaataacttacctatgatttataattagattcaaggccttacaagacccgcctctattgaagaacattctataatacagaacacacatatataccaatcagtccaataattcggacgcaagcccatttaaagtaaaggagaaatattggtgcgattaatgatgatgtacttaatttaagatcacttacaaattatgcagcacaggtggagtcgtggagaatattgaaggagactacttacagttggagatgaataaattcaggtgttatcagcacgagaaaatctggtatgtttaatgatactaatgttacatggacctacaatggattacactttgttcatattcattgatactggtattttacttagaactttgctctttggttagttaagcaataactgacaaatgaaatgacacatcgaatctgctttctctcccatctatcatcacacccaacatttcattccatcaaactgattacaattttataatatttcacagttgacaataataatcaaataattggaaagtaataaacttttaccttttaaatgtcaacccaaa

SEQ ID NO: 5326 - DNA, 1074 bp, Glycine max
  Soy_ogl_3953 Gm11:38017401..38018474 Cluster 24
tttaattttctttattgctataacttcttagttctgatagtttttacgacaagatagcatagaattatagaaaggagataacttattccccgccaagaagcatgttaaatacaactctattcaagttaatcaataaattagattgtgctgcacctaaacgatttttaaataaataaaaattatgatatgatatggtatatatatacattaaaaaaattaaaaacagttttctctcttattttagttgcttaccaacctcgtttgatgaactccgagcagaaaagtttggatttggatgagaattattaacgtacaaaagtagaagaggagtggacccaacacaagaaggttcataatggagcattgtggctagttacgtcacttctgtgtttattccttgagaagtgtactccctatcacatgggaataccagtatacatattgatttcgttaatttgataatggagtgataagtacgcgcgacaaatataaatttaagaatggtaatctgcaaaatatttgggcttatgatggaaaatatatttagttttcttcgaacaagatcataaaactttatatattacgaaacacttgttcatgtatgcatggaaataaaggaaaatagctaggtggaaagaattaggaagaaacgttacatttttcattgtttaattgtagaggggaaaaaaagtgagacctaaaagaattctctcctgaagtggagagaaaataattaaaaatatgttgaaataataaatttattcatcaattcatcttaaacttttttgggtgaaactctttctctcaattttatatcttaatttgagttgaatcacgtcagctccatttatttaaggagaaaaaattccttcagtgtctattttagatttttcttagtatataagaattagagattttattactttatttgtctttaattataagattttttaactaatttttatcccttaataaataattatcacattaaatatgttaattatgtatactattatttcaaaattactctttattttttatctatccacttacttatttcttattaatatttgg

SEQ ID NO: 5327 - DNA, 1400 bp, Glycine max
  Soy_ogl_4884 Gm15:2972401..2973800 Cluster 24
aaataatccataataaatacatagttaataaatcgtttacttgaacgcctgaaattttgtttgagaaaaaaacgcaaaatgattaaaaaaaagtcttgaacgaatgtaaaacaaagggacagaatttggtgtcaatataaattgatctcatctttgtatatgccggtgtcactaaagttggaaatttactgaactcaactaaaaaactggttggtaacacattaattgacggaatttagttcttttaaagtaatactgtctagtagtattatccttggttcatagcccagcctcaaattttgacaaataggatgcattcatagcgttatactattaaatatcacatggaagcaagatcattgataagggatatggaaatggataaactaagtaactcagtatttgcaacttggtcaatatataggagactgagatcagtcaactctacattggtatgcatgctttgtagtctaaatcatatactacatccatattcaagtaaccctgtgttctcatgttggtcaatatattattatgctacgaagtttgccttcaatttaatatgcaaaaagttttgtcctactgcatgtactaaccatacgggataggaatcagagacacgagaagaaacagtttttccttacttggcttaaaagtcggagtgattacacggttatcaagttacccaagtaaacccaacaagttaaaacaaatactattaatcatggattcaaatgcttgagattgatagcatccaatgagaaacattccaaaagcgtatttatttacttagccaagtgattcccgtcgtgcattgggacattaaattaagtaaaatataacatggtattattgacaaatataatacaaacaaaaagaagggaataacgagaagatctcagattactaataaggtcaaagttcaattaattttggttaggattttattattattttaagtacgaaacatattttgtattcatgataaactgtaatactgtatggtattttgtaaccaatggtaaattgtaattgtataattaatccaaaagtagtgtcccgtagtatgttatttaggctggtttatatatatatatatacacacacacacaacttttttaaatggactcgcaatataataagattttttcttatgagaaattgtaacttttgttcccattgagaagcgtagttttatttttctattcctaggagtgtttgtttaatccaattcggcaagggggaaaatacacaaactaagcttaaaaagaaagaaaacacttttaaaacaaaaaatgaattggtaatttggtattgggatggatcataatcacaacaacgtgaatttaggggttggtcccgcatacaccaaatcctacaagttgccacacccacactag

SEQ ID NO: 5328 - DNA, 1300 bp, Glycine max
  Soy_ogl_6290 Gm18:60085201..60086500 Cluster 24
ttctataaaattttaggttttcaaaatcataatattgtacttgtctacatactcctatattacaatgtaatgatacttgatgatatatcatatatacaacgcgtacgtgtacatatattatgtgcatgtaaaagtggtatatgcatactatagctttgaacaaatataagttttctcaaaacacacacacacgcattacgcataggttggttatgacatggcaaatgtggagtctcttagttgaaacaacatttaaaaaattaaacgcatagtaatgtttgtgaaaatcttggtccaaaacaaaaaaaaaatcttggtcataatagtgtttaattaattaatggtaagagatgagaggagagagaattggaaaaattaatcgtaagcgattttaaaagaaatgcatagtgtgtgattttcttccgtttaccggttgaaacatttaaaaacatgtttggaatttatttgaaacattatgatcgacttagaagcttgctattttctcactaaaataaggcatattaatctctttatttttcatttgtttttattgagacttaagattaaggaaattaatacacgtggtcactttaaaattctccaagagtgtagagagaagtaacatcttgcaaaattttgcttatgagtatgattttttattcgtataaattgaatatagagatattagagaatctataacaataacttatgcttcatactcaataaattgaactaaagcccttatttgcctataattatgatgacaattaaagaaaataaccaaaacttatgttcaaattaagcttatgtaccaaaccatatgtaccaaaaaaatcaagttttaatttgttatatatgaataaccatggtcattgtaagctacgtatgtttggggagcttttgaggtttggggacttgtaatttaagagtgaaccagttaggttgttgtttctggggctttaaaattagttcaattttcaaagaaaagaaaaattgtttacctttaaagaacataggcacatgcaatgccaccaaaatcgcatttagaagcactacaagaggattatttaacaacccatgaaaagattcccctaagagtctaagactatacagtaccttatttctcattgatcgctaattgcacggtacatatataactcttagaaagtatcaaagggcctgctcgaatgacaatatcttcttgttgattcaaactctgacacagtactagtagtcatctttgtcaacacttgcttcactctactgcaatggatattggaagttcatcaagcattccttc

SEQ ID NO: 5329 - DNA, 1000 bp, Glycine max
  Soy_ogl_1012 Gm03:41301201..41302200 Cluster 24
ttcgcaaaggacacaaacatttacctttgcttgctgaagtagctcatcgaccattagccacgagcgactcgatggcaggcagagggaataatttagacgcgtttttatggagaaaatggcacaactgaaacgaaatattgaaaagatgaatactatccaactttttctattttttattattgatttaatcttatacgagttcgacaaattacttatatccactcttcgtttaacaaaactcataaaatttattcaacgataaagaaaaatatacactgacaagaagtcttgaaaagaatattgttaacatttttatattaagaatgaatggatgatcagagagaaaatacattattctttcgcatattaaaattaaatcggaatagatcagttttaaatttgctcctacatttaagtttttttaaaagtgattgatgatgtttcattgaccgtacaacattgattttgtcaagtggtagaatggcttgtaaaatatcagagtctaacatagcttgggggataattgtgtttctttaagcatttagaatttttttattaataaaatcgaaagatttataacactcatatacttatttaactaaatgagttaaatccttttgtttatctaaattagaatttaatcgcttatcagtaattacgtgaaagaaaatatataaaaaaacaactaatattaggaggcattattctcttaagtaaactaaagaaaagaaaggcatctatattctgataatcaatacaaattaattatcttacaagcaataaatcaaggtcatatatttttattaaatgttgacatgactattttaccggtgccaaatagagataaataattgttgacttgttcataatgtgccaagtgggatactaaacaatctattagttattgacccaaataaaaagacctattaatttaatattttatttttaatatatatttttacattattgtcacgtgtttttaaactctaatttatctcac

SEQ ID NO: 5330 - DNA, 1106 bp, Glycine max
  Soy_ogl_1194 Gm04:2672868..2673973 Cluster 24
ctcttaaataataatacatataaaattaacaaaaaacaactgtctttgaaatttattatgttaactttaatttttttaaaaaaattatgagttcaacttgaaattttttttattcttccctttatttcattccttatcatgtaagcggacaacctacgtaaatatcaatattttgattaaattacatttttttgttcagatcggtgaaatagtatagaaatcagctgtactgtaacgtacgtcctagtcaacggtggttgagcaaatgcattagatatgcctactgtgattcaacgctctacttttattttatcacatatatgtgagttagggttttcaaagcatatgcaattaaaaaataacgtacttttatttatactaatcaaatcctataagggtcagaaggaggaaattaggctacaaaataatagaagcttgaattatgggttaccaaaatacctaacatgaataagtgagatcaaacgccgttaagagaaaaagattttccgactaatttttctatggactatctataaataaatactatctcttcagcctttctgtcctctttgatgcaaaaaaaatatatatatattactgtaaatgatcattgagacttacgatattatgaaaatttagaattgagaaacattatttatccttaatcattcttctatttttttataaaaaaaaaaaaacataatcctatccaatcattgacgaaggcaagggagcttgatggacaaggccgccgttatagaaaatgtttagtatttgaaagcgttttacctaattaatgtgttccccttaatcaaataataaatactagagtttgcgtcccaaaatttaaattatgatgttgtttctataattaactcatcttatgttaaagctaaaaatgttattgatcacttaattacttttattatttgcagtttctacttacaaacaagagattaatctactaatatatataatttgttggttatgtaagtttgttagttgagcaaatctctttctccttgccccgggcgcatcaggattcaggagcaatggaagggagcacctaccgctagttaccacaagcaccacttgtaacttaaaaa

SEQ ID NO: 5331 - DNA, 1344 bp, Glycine max
  Soy_ogl_4576 Gm13:39590557..39591900 Cluster 24
tgggagaggccaatatgattgggcggctagaaaacccacaatcccattgtctgaagagagaatccgacacttatatctatattaattttaaactgccatagtttaatcacaaggaataatgtatgtggaaacgaatgaacgcgcgtcatgtcttgcttttttggacctccttttggatacaagacttgcttcatttgtctttcatgcattctctttatcacagtatatttttttgtattataattccatctccgtgcttatggaaagtcatgtggctaatagcggccaatacatcaaccaattaataatacactcaaaaaggtagagtgacgttgatcaatatttcaaaatagagtatagaataatgtgctttaaataaccaaagataccataaaaaaaaaaaagagttaattcaaagcagagtcaatataatactatatttaagttcatacaatttaactgatgacttatttactcgacatcttaactgagtcagtggccgactcaattttaataggaaaaagataaatagcattaatcaattaacacaaattgtaattataatatacttgatatcttaattgagtcagtgatcgactcaagttttattagaaataaattttcaacctcttcaccactatcatgtattataatatactaaatagcatgactcattctaataatagtaataagtttgtattaagagttttcgtactaaattttcttataattttaattttagttgattttgaagtccacagtttttcttaatgttgtggagatatatagattattatttgatacatcttttctaaatacttatgaaggaaaaaaagtttaaagcttgggtttattttaacaaatgaaacattggacatggaccaatcaatggttaatcagactgaaaaaaaaatgatgagactgattagttaaattcctccggaaagtgagctagaatgctagctacaaaattgaaactctaaaataccaaagtcattgagagtgtaagcattaaatatatattagaatctcatttcatttgtatagcatgcaatggtggatttggacttgacagattttaaatttttacattgtgggaatccgaatttggttttcaagttattccttgtatataattatgaaagtatcgaatgaacaggatagcaattaattagctagctctaatgttagcacgagtataatgtattcaggctctattataatcataattcataaacatacgaaagttgcataaaacaataaacatatgaaggtttgtggcgctaatcaaacaacctgattaattaatcagtaatcaaggagttggtaattaattaacatcat

SEQ ID NO: 5332 - DNA, 1190 bp, Glycine max
  Soy_ogl_1277 Gm04:7340711..7341900 Cluster 24
ttatacatattatggttcattttgttttcagggtgtttatgtcattttgggtacaatatttttgttttcttaatttttaacacattaaaatatttttccttttattttctcttattaaacaattcaaaaaatcatcttattttcttatatatttttttcttttttatatatattttttcctttcactttcttctctaaatcaaacagaaaactactagagagaaaagctttagtgagaaaaaatctcattttgggtgtaatgctttgggttctaaaagtaacacttcatatgcgtaatttttccaacaaatacaaaatgataaaaaaaattatgaggtacactagcccctgtatacaccagagggctccgcattctgaacaatccaagggtgttcaaggagtttgtgcaatggtagacgttgagaggaattcttaaccagcatctgttaaaaaataaataacagaggaaagagtttctcagtaaaatgtttgaacacgcatctcatcaaaggctatccttgagagagagaacttggccaaaaaaaaccatagtgctacaagacgcaaaacctgactaatgaatgtttaggagggaacttgagatccacttgtacggtcctgcaaatttatattgaatgtttgcaaatagtttgtcgattataaaaaagacaccgaacgcggaaagcagcattgaagtacaatagattcagtagcactctatttgcttcttaaaagatcactctttttagaagcacttttttttaattttaaacaaaccggccaataaaaaacagagtttgtccatgttactaatgctaatttatattcaactgcttagtgcttacctcctgtaagtatcagaatgctctttagcttcaaaaggagggactccataaagaaattcagcacagcacaccaaggctccatatatccacactcgcatcatgttctgcactaaccgctattgaaacctcaaaagtgtttagaagaaatattggtgcctcatctatggagagtaacataaaaagtattttgaaacagtggttcatgtcacataagcatacccatctcaggtggaagataatccagtgtgccacacgtggttcgcctatgatagaatgtgtgcaccgaccacccaaagtctgttattttcagttcaccctaacagtgaaaagatattgacatgatga

SEQ ID NO: 5333 - DNA, 1310 bp, Glycine max
  Soy_ogl_3817 Gm11:10125101..10126410 Cluster 24
gcaagaatcaaagccaaaaactaccgaccaacatctctgctgaatgctaatataaatatatataccactcgcctcagcattaaaatgaggaaaaatagtttcacaaaaaaaaatgatgaaaatagttctttcctctcctctactactctttcatttcaattcaaatccttttgtgacttgctcaaaattcgtaccctacggctctgataagtggaaaacagtgaaacattggttctattctatttcttattgatctgttagtttcttcttgttaacaatattagtggaatggtggttgttgaataatttacaatatataatatatactaggtgttgcagacgagttatgtatatggatactattactcagagtcacactaaccattgggttattatgatcatcagcactatatatttgacacgatagtgatattgtggaaagagatctatttatatgggccatgtttttttgttaaaagaatggtggagcctaacgatgaagttggagttaattgggtacgttaggtgtgtgtttgaattttcgtttcaacacctcaaacagttgtttattttaattcatccaaagagtgattttttcgtttggatacattgaaatatgtacggttatttaaacacactctaagcatttatgataactaagaaagactaaagatagagagttgcttcctataccttaattttaagctttcggatagagtaatccagaatgtaagtttagatttcgatgcaggaaacaattacgtgcttttatttattttggagataatgtcaccatggaagtttggactcttatacgagctacgagacaccatgttcaaaaatctccgccggttcattacccatttaatatttaatcatttgtaaagacatacagtagtaaactaaatataaaaaatatcccaaaaaattcttgatgaaagaccacgagctactgatgtggattcatgtcaagccatttacttttttgaatgtcgttagacatgtgatgtgtcacgtttatgcaaatgatattatgaggtctcttttgttgtgaacaaacaagtagtgaatctttagagtttggtcatgacgagtcctttggcgttgcagacaaaaatgaatgtgaggggcttatatttataatgatacttttctttcctcacttcacttgcacgccgggtttttgtaccattcgcttctcaattatgttatgcgtgattccctcacatgcatgacagtcttttaagtatgtgtcttttctaaaactaacaatatctctttacaactttctttagttaataataataaga

SEQ ID NO: 5334 - DNA, 1100 bp, Glycine max
  Soy_ogl_4561 Gm13:38846801..38847900 Cluster 24
gtgatttttttattacaatctctgctttgtgttatggggtatgattgtgttggtgagggaacgatgaattggagtttcagagcaacaagaatgtggtggttaaactaggaggagcatcatcgtagacagtagcaacgctaaagaaggagataagaaaaacagatgagggacaagggtaaatcagtaaagatgaatgaagaaagaaaaaagaaaaaaaaatctcatccatctaatttaaaattaatatatttgatagtctgcctgactttggtacaaataagttttccttttgcatgctaaagagcatccccaaacttactaactcttaacgggcttagatctcgagtccattaactcactttagttcatctcttgaatcagttgctttcagatgacaccaagtaaggacccacctttccttttcttaaccctatactgtatatccttctttgtcctttggagttttacataaatctttaatcggtgtataacctttcttgtatccacatgggtagcataaaagcatttacgaacaacatcctcaagtaaagcataggttcactcatcaatttacctatcaactaggcatacttgtacacattatctaaactaaacccaataaggcaacagacatgtctcacatagacatattcacagcatatatttcgtgatttcatttttgtttgagttgtttgcttagttttattattatggtttcacctgacttactgtcatctcaatcgactgagctctagttgtcaagagacatttcttttgctctgacctcttacataattcatctcaataaggcaaagattaaccatgtattagttgggtatgaaccatgcataattcattctagaatacgagaactttagctgtgagttcctcaagtacgtgatatgtgtgaacgtggatcgttatcgtagatgactaataatagtacttttttttgggtctaataaaggaactcgacacttggactgccctacatccacatttgtcgtttgaaccacgtgtgcctcgctgcacaatgtatattagccactgaaatatgctatatatatatatataattgaaggaaaatgcaaccgacagtt

SEQ ID NO: 5335 - DNA, 1000 bp, Glycine max
  Soy_ogl_6418 Gm19:38415101..38416100 Cluster 24
tcttaacatttaatactaaaaagcaagtacgaaaattaataaatgtagcaccataacaaggatatgataaatagaactttagaggtgaagtggcaaagtgaggaggtagatgaacgaaataccgaacatcaaagccaaataaggggtatggagcaaagtagggaggacgatgatgttcttacgggagttttgaagagtttttaactattttttaagtcaattcagggcatgcaaggtgttgtccaatagtttttgagttcctatgatagagctttatgatgattcgaagaaggatactcacaagtcacaagcatttggtagccttccaaaccctcaatgaaggtagtaacactgtgctgtaagatgttcattgttactttaaaggacacaattttgaagtggctaatcgggttgccctatcgatctattccaagctatgaggatttctcaaaaaagtttttggcataatttgtagcatataagaacaatcgattagattagtctaaaggagtgagtgaagtagctcgatcatgtgaggaatttggtcggaatctcatatagttgtgcaacgatgtggatcctaaatccatgtatcatctgggtggtgtaaatatattgtcttgatttaaaagtagatcttggagccattgggaaatgcttgcgtatctaatggctcaatgaagtagtgcttgcttaatgggaatgagagggtggtggtatgagaagatttgggaagaaggattattgtcttgagtattgacatcaagtttcttttccatgaatcatgagaggaaagcataacatgaaccataatgttataaatgtgaggaggcaaatgacaataaaataaaagttgttgaaaaaataaataaatatgtcctttgggtctttctttggtctaccagaaaaaagaaacaagaaaagctaacgatgaataaaggctactcccgaggaatcagctggctaacagggctaaacacaagggagttggacacgaatt

SEQ ID NO: 5336 - DNA, 1000 bp, Glycine max
  Soy_ogl_231 Gm01:49604301..49605300 Cluster 24
aaatataaatattttttcagtgaaaatttaaatcctgattcaccgtattttattattttaatttttttgcggtatatatttcattgctttattaacctagtgtcttctaaattagtatttttttttttgtttatcatttttcgttattgaccggatattgatacttgttttggtcaacacagcttgatatatggaacatgcctttgtcttgttcgttgtgctgaagactttttagtccagacccttactcctccactctgtccattgttgcagacttgcaggctttatgagaaaaagaaatacggtaatatccaatcactggacgttataaagcctcgtgacacattcctttgagttaaatgatatacaaaataatgtagacacctggggtgcgataagaaaagaaaaaaaaaaaaagtgattgatttgattaatatataatgtgataaaaatagagaaataaaaattgttgttggggagaaatcataccttagtggaagaccaccacatcaacatgtgatctcagactctcagtcaataatcgcttgacacttgaactatttgaagatactcactaacaggtaggtaacgatgtttaggagcttttgttttaagtttttttttttcccccttatcttccgcatatctttttactctgcaaatctcgtgcaaatatcacaggttaataccacgtttcctctaccaaaatacctactccatcacggaattacagatcgagctgtgttatatgatatgtatggttgttaataggaggtaacatcaaattcgcgatggtgcagtaccctattccattaacatcttaatgcttcagaactgacattatcttattgtgatcagccatatgcaaaatattctagcaacatataacttctacaagtttatttgaatcttggaaggaccaaaataggttttgaaaagagaacaacaaatataacaagtttcgtacagcaatggcatggggcttgatctgcaattccgg

SEQ ID NO: 5337 - DNA, 1100 bp, Glycine max
  Soy_ogl_756 Gm02:50187001..50188100 Cluster 24
ttatagaaggataatattagaattatccatcttatttgagtgtaccagcaatttgttagatgcgcaaaacactgaatgctaagattgtaactaatttaacccatttgtctctaaatccatatgctattagaaccttctccgggaaagtccattctaatctgtcataggctttagatttactcatgtcaagctttagggctattccatttgtgccttcttaatttgctccttctcttcaaagcatgaaagtcctcatgtgctatgactgtgttgtcttgaatcaatcttcctcccgcaaaggtactctgatatggagaaatcaattctgttataaaactctaatcttaacagtaacacaataatctttgcaataactttagcaataaaattgtgggaactaatgtgtctaaagggatttatattctccagttgtgggagtttaggaacgatggtcacaagagtttctatacagtacagaccggtaatgtgaaaggactaaccatgccttactgtcacctttcaatttgtgtgagcatatatatcctagatccttggattgtattagtagcatgaaacaagctcttgttattattatctccccatttcagccattccaatctaaatctttacccccagtagttttacttccatagtcctcctttgaatactctgcattaattcctcacaagttttattattatgggggtcatttcggagaactgttagtctttgttagagtctacaagtctatatagatttgcatatgaaaaagtttttatgtgccactgtagtaaggtatttttgcggagtttttttttttcaattaactatttccaagcatctttcttacccttcatttttcactatggttccacagtgcttgtactttcccataacgcctcatatattaagatttggtaaaatacactgttattttgtatatataaatattgtgaattattgctctagtctttcaatttttttatttattttgattcatatatataattttttttaaaaattaaaatagtctctgttatcatttattaatgacattgacataatacatatttaaacatgtcacaaaatagtgagtgata

SEQ ID NO: 5338 - DNA, 1000 bp, Glycine max
  Soy_ogl_1772 Gm06:3036501..3037500 Cluster 24
aattttagaagtttatataacttgtttcacggagggaaaatatattatagaagcaattaacgcgacttctatgcgggtcaaatgagtgtctccaaaatatcaatgaatccaacatactagagagatattttagtttatttcacgtgagatattattggatatttaattgagaagatatctgagtgtgaggggcaaaggtttatactctaccctggaattacagacaacttggcctcccctcaagtgaaccaattaaactatacaagatgagagatgttggcgtcgcgacaagataagcacatggcgattctgataatagctttctttcttaattaatatttcttcgacctctgctgatatatatatatatatatagtccatatataccaccgtatttctagctagcaacgtagcaatatatgtacatactttaattttattgcctgaaattcacgcagtattgcttaaaactaatgagaaacttgtgggcgagagtttttctataagcaaaatttaaacttacggccttaaaagaaattcaaaattactttaggcctaatctgcatgctgggctatctcggcctaaagcattttaaccccataatcgcgtataattattgactggaaggaagcaacaatcaactgcaagatccatgagatacacttgaagatagaagattatactttgacttcaaagaaaaattatcctgtcgttacattaaggcagaatatctttgttcacaagcggctctaggcttcgtaccaggaaatctagctcatctttgattcctatatagatgatgatgcttgctagtaattaacattttgtttaacatgatgacaaagttgatgaaggtaatgatttgttgggcatgactgatattttatggccggacaaatactttggtttgaaacacttattatttatatcgtgttatatttttataaattgttgcaaccctatttaccaaataatcatagaaataatttgttaaataat

SEQ ID NO: 5339 - DNA, 1000 bp, Glycine max
  Soy_ogl_1942 Gm06:14320401..14321400 Cluster 24
tttgatcgagcatcatgcttgatgttctgaagcctcacaaactagatattggatacgtaacacgtttttctttctcttgtacttgctatcggtgacactaggggtgatgtgatgttttggaatacccagcaaatagacatgtacatgatgtctacagacccagaagatgctccaaatcaagcagagtaagcatagcatgtttgtcaacttgtcatactacaaattttttgatattgttgttcctcatgtgttcttagtactattattccccgatcaaaattaaaacttaattttcataatccgcatgataaaggtttgtattaaaagtcattaaagattactgcagtgagagatttagagtgtttgacacttgattgagaaatgcttcagctgaaagatcaattggcccttaaatatgcatagttagtgtatgctgggaggtgggttgatccactttgtgagtccttggatgcattcattagtgactttgaaactctacaaaggttcacgggccgacctaataataaaggaggcttaaaataaattttaaaagaatttttttattttagtttattgagtttttttgctagtatatgcaacttttttaatgtatgaaacatttttttcctttataaatattaatgaaaaatacgtttttttgtgaacctaaaatgtaaattttaattattttatttttgggtaggttcagctattgtagtgggaaggaagagcgcctatgttttctctatacggaagacatttcatcgtttgagagtggggagatatatgatcatgctgatgctgttggctttatggtcttccattgaggatcggagctatgcttcagcaggttgtctaagtgctacttccaaacattagtgttttaattgtgtctgttttagttttattgtatgcctgttttaatataatgtgttgttaaaattgtaatatataaataactaaatttctgctttttttccaaagcaatactcgtttctct

SEQ ID NO: 5340 - DNA, 1511 bp, Glycine max
  Soy_ogl_2536 Gm08:7001501..7003011 Cluster 24
attaccatcgtttaactatttcggttaatcgatggtttaatgcgtctacatttattgttccttattctctgtgtaacattctttacttggtggaggctataaaataaaggggctcatttgctcaatccccatccttgagctaatctccacatatagttaatcattttgattagtgtagtgcttaaactgtatccaaagtaatccaatggttaactttgatgtcttattgattttactttggctcaattttccatttccccttagaataaaattgttttttttcctagtgatgattttctataccaaccgaacaaattagctagaatgttggttcaagaggatcactcaaattggtgttgtcataataccttggctgagaaaccttgccttgatcaggtattccttttttctagaataattgaaatgtgtaaaatactttatctctctaggttttcctttctcaggtaatacttaatctaggtttttttttaattaccaaatattaatctattagttttgttagaaatatcagtgaggagaaatttgaaccaacagatctctcttccttaatctaggttggtttcatttattgagggatctttgattagatctaggtgcaccgcagtcttcaactttggctagtcaagtttgtggttttattgatagagcaagagaggaaagtgcgaaagtatcctaattctagacattaggtagtgctttcagagggcatattgtcaaacttggaaaaataaattttaaatctgcaactgggaaggcatgttaacctgcttgctacactatggaggaaggcaaataatagatgtcaacaagtagaaatcgagaaaggatgtcgttgcactctgtaccatgctattttctactttcctaaatgtaatcaaactatccaaagtgtgtttattacttattaactaaaaatagtctttggtgtagatcaaccgagatggtagtatttacaagtactgcgaaagggttgtaattttgtaataaataaatattatctatgtgattcttcatagtagtatacgagttcaaaactttgatttaatttattcttcgtgaggatcaaactcatctttgtctttcctaattgtaacattatcttaacctttatctatgcatattcttgcatgtctttaataatacaaaccggaaattttaattaggctcctaatttttttatctttcgtgggagttatttgtaactaccttaaggttttgtgcgacaattataataattcaaatgtgggtatttttttttatacatgagaaagcaacaaactatctaaactcaactatattcaaatgtgagtatgaaattcctttaatacacttatgtttgaagtttataatgacgatttttcctcatatactttactataatattgttgaccccatttttattgttattactttttcacaaagcaacttctttctcatttcaattttttcttttaatgttcttcgtttttctaatgtttgcatatttgtag

SEQ ID NO: 5341 - DNA, 1160 bp, Glycine max
  Soy_ogl_4614 Gm14:2863933..2865092 Cluster 24
caagtattactataaaagatattttagaaagattttttaaattaaatattattaactgaaattttttaattcatgtgttttgttaattatttaaatttatttatatttaggtctgtaatataagctttgaattcaatggttaccttgttggaatagttgactaatataaaatgataagataataatcatatatagaataatgcatcccaacggaagttacataaatatataaccacccctatgggcagaaagttttcgtcaacaatataagagtaggaagaaggttttatgatatcatatcattgtacaacgaagaaagataatattaaattgagagtaagttaattaacagtgtcatgatagcgagtctcgctaatccacacaatttaatgaatataatttttttataataaatatttttttctgttaacaaatttaacgaataaatttattcactttaaaaaagaattaatattataaatttagaaatcattcaacttaaaaagcttttgaaaactgtagggttgaggtgttgaacagattgatcattgctgtaatccccaaaatgtcatattggaaataattattttaaaagtgtaagttggaaaactaattaaggactcttgttttaccaccatatataatatgttcaagcttcacaggctggaaagaaagaagcaacactgatcaaacaggaaatttcagagaggtatccatttcagttcatttttcctagaattcaatcatgaactccaatatcgaagttaatttcagatgaccacataattcagattataccaacaccagatcatactcctaatcaaagtcatgagcaaagtccaattgtcacttcaacaaagtcaccggcaccaaaacatgaaaaatagaggagtgaatgaaatgactccagaaaagctgagtaagtacgttatacttgaaactattgcattcacaagagggtaaattccagagatcatgtctttaagagtttgtttattttacattttgaaaaaattgaatttgaaattgcttgacgttaaaaaaaatatttatattattattattatacgaatgatatttcaacaatcggtttagaaaattatttttttactcgaaagataaaaaagtagaatcacttttaaagtatgagtataaataag

SEQ ID NO: 5342 - DNA, 1100 bp, Glycine max
  Soy_ogl_6178 Gm18:54859401..54860500 Cluster 24
ttaatggcacatcaatttcctagtgggagttgctaataatatgaaagattataagagatttatctcacttgattatactacctttaagtcattgctttctttcaaggtaggtgatggttctcatgttgattttgggaggacaatttgatatataggatattcctcctagtttggatttcccacaacttatcatctatcattctttgttctcttgttctgtagtttggaaagggatatttggtctcttgatctttttaggttgttattgggcaaatcttttttcaattccaaactcattgaatatagtattgataaacatatttttaagtccataggtccctctaaggttaagttttatatttgggctataatgctcaagagaattaatacaaatgacacgctacatggaggtttgaaggccaaacaaggctacttttcctaatgtgttatgcttaatgctagattttacacgtatttctttgttttgcatttttggagaatgctaggtgccaattccacaggtccttgaaccattttttcattatttagctttactgattttagtggaagtatagaaaccaggtttttgtggtaacacataatctatgctaacactttggcgtatttggttagtgtgtaattctgtcattttttatttttttttatgtagtaattctgtcatctttaagtagatcaacttggtgtgtaattatgtcatctacttggtgtaaagtacatggtctttttaaaagtaatttatttctcctctcgtggttgttgtttttctttttttacgtaggatctcttcctatacttcttttttattttgatgattttcttcttttattactttatatctttcctatatgcttattacatgatattttgttacagtcccggcattatgttattaattttcaatagaatcggtggtcatattctccacaagattatatccattgaagatgacacagttctcaaaacattcatgattcaaccacctgcttcaccggaataagaaagttgacttcatagagctattcaatgaaaaacttctagtcaagcaagaaaatgagaaccttcagattgttgatgtaagc

SEQ ID NO: 5343 - DNA, 1000 bp, Glycine max
  Soy_ogl_6431 Gm19:38618001..38619000 Cluster 24
ttttatctcatcatagtttttttttatctcatcagagctgtgaaggtatttaacaaaataaaaaactattttaattgtgttgcctaaaacttgagtcaagagtaactgagtagtagactcaactacagtccaattttgttgcctatatatgggccttttcactgctatctccaatgcccaaaccaaccagagaaaacaggaaacaaggtcactcttttgataatcctattccctccacattctccttattccacaagataatcatcactgcaattttctcttctcaccaaattctttctaattgaatcccaaacataagatactatgtgcataaaattaactttaaaatgaaatataaccagttggcatattacatccaaggaaaaagattctctaaaatgagtttctaaagtgagcaaataaagatatatcaattcttaaatttaagcagattaggttatgatgccatttaaatcaaatggattcatacagccttacttggtctttccccttgatgaaaaccccaaatcgaatcataaattcagcatctcacatttaataatatatggctagtgctatttccactctcctttattactaatacacttccctttttaatttttcttcctaaaatacccaaaaatacactccctttcgtttctctctccatggatctttctcagtgaaagaatgcttttctaactttgttgttctactatcaacaaaatttcttgaaaatggaggtgggggaggaagttctaacttctaactctgagatttcaagtgttaactttgatttatatgtaattctgtatttgcacttgttgtgaaaaagaaatcttccttgcttgaaaatggtttcctactatgccgtgttccttgatgcagtgacaattgatatttgggttgcatctcctttcccattgtgctttaaatttgaattgtgatgtggaatttgtagaatagttttctttttcccttccctatgtgattgtacgtg

SEQ ID NO: 5344 - DNA, 1073 bp, Glycine max
  Soy_ogl_4724 Gm14:6718428..6719500 Cluster 24
aaatgttaaatttgagtaaaatttttatatataaattttgttcttattaaggagttatgagaaaagtaaggtctactaacagtaaatgaagtaaggtgagagaaaaaaaaaaagctcagctaaatcgagcttaacagtgtaccagtgagatatcatttgttcttaaattttagtatgttaagataataatgcatttaaattgtatttgtgaattttgtggacaagcttttcttggggaagttttcatcctgtgaagtcactccaaatcatttagacttttgaaattgaacttcggccatttgatttagcttattgttttcttttttcatgtcaattatgtcgctgttaatccgtagataatttgcgtttgggatgcatcatgtattagacataagcatggcgtaatgcttcccgaagaaaataaaaattatttgggaaaatcttaagtagatatttgtcaacgtaactactcaaatcaacgttaagcattcatttttaaataactagtaagtattttttttttatgaaattaacaagtatttcatgtattccagggatatttttatatgcatgaatgaataattttttaaaaaaaaatatatcaagttagatctaatagaaaaagttagtacgtttctcataaactaaagaatattatttgaatttttattaagataaacatttatctaatcacatcttttaatttcttatgaaggttatcagtggaaaaccaaacaaaatttaaatttttcaagcaagcttatcaataataaaaaaataaatcaaagcccaaaataaatgtatttgaattttatattgtaaagaattaaataattaacaaaacattattttaacaataatttataaatatcttattatacttgtttaggatcgaagaaatttaagtattgattaaatattaaactgagttaatttaaacgtgttttcaaatattaaatacatctagcatgtaaatggttacatatagtgcaggagttcatatctcatttaaaaataaattgtggtaaaaataaatacatgttccaatcaaaattagtcctactcatggaaag

SEQ ID NO: 5345 - DNA, 1200 bp, Glycine max
  Soy_ogl_657 Gm02:44756801..44758000 Cluster 24
aattgaaaccaagttcatcaaaagttagcccatcttagtttcttcggtcgattttgaaatgcttaaatccggcccttgttatttccacccaacgttcttgctttttaatctcaaattttgcttgtaatttcatactcctgacaataatgtgtttctattttgcaaaatacacagtaaaaacatgttttctttgtcttagggaggtgtcctccatatataatgaaaacgaaaaaaatgctcagagtaccttttctaatatctcctttttagtattttatatggttgattgaaatttattaaaaattatcaatttgtagaaatttatttttttatttaatatttttctctctctatttaaacttggactcacaaaaatgatttttactcaatcacaaagatagtactagaaaaaaggtattaaagagaatgacattagcattcataaaaatatatttctgttgtacaaagttcatgaaaaaatatgttattgttgtatacggaggatgcacccctaacatagcataaatgcaattatgtaaaatttacaagtaaaaagaaaagtttacaggcgataatgacaatgtggcagaagggggagtccctcaaattaaaaccaaattcatctaaaagttagaccaataatagcccatcttaatttttgttttgggccatcttggtttatattaaagcttcattttttccttgagcactgatcaggtgtatgaattttccaaataaatgtcattatgtttacacagcttttaatagtaaaaagtcacctcaaatcaatttctgccttaataaatcttccacgttactcttacaattaagacatttggaaaccaacccttattataagaaaatttatctatagtaatatatggtatttctcttaaataatttttttcttctagatattgtatcatcaatgttggagcacatagactaccggatccaacagtctcaattcacgcaaagacataaattttattgttttgtatttctgggagaaccttaatttattctgtttcttagtgccagtggttaaggactaagtagttaacattttcgttgattgatcaagtccttttcataacggatgaattccaaatattttatttattataaataaataaaaacatttttattaatggattgaattaattgctattataatttcaatgtataaataaaatatcc

SEQ ID NO: 5346 - DNA, 1198 bp, Glycine max
  Soy_ogl_1890 Gm06:102272..10262069 Cluster 24
tgaaagcatcattatcgttactctttatcgggtatatatatatttcaaaggaattggagtccatctaagaaattgtcacgctattataactaagcagagcaatttggtttggttcatgatcagctgttattaattttgtaaactgtgtcacgtaaaatatctgctatcgtcctgtttctgtatatcacgtaattgttacatcaaagtgtagccagacacgttacatcgcatgtacacgtgcaaggatgttcggtaaaacagaatggatgagaccaagtcaaccagaagagatagacgtcgtaaaattaagacctttgcgtcttagaaatgattagcaataatagtcagagaatgaaggttacccaaaaattaattaattggacatcatatcatacaatagatatgtcagtcaacgtaaaccaggatgatgcattacttctgtcaaataaatatatctgctttgagtaagctctacaagactacaccacgaatttgttataagttgttactaaaagaaaaagctgcagagacaatagaattatagggtgtgtttgttttgaaggaaaataaatattgtattttatttaatgaaattcatatttcttatattttattttaattcaaaataatttatctattctttttatctgttttctataaatcaaacacactcatagaatatatattttgcgggatggtatgaccaagtatatatattctaaaaggttacgtgtttataaaattttacgttatattatgtcatattagtatcatcatttatatatatatatatatattaaatacttattcataagtttaatatattttgataaattttaagaagtttataaaaaaacatatttgataaatattaacaagttatttatccgagagaaattaaacttgactttcttaactaatattttgaatttaagtctaaagatgaaaaaaaatatattttaagaggaaaattcttataaaggtgatcaactaccagtttttttttatagaaattagttatccggaccaatgataaaatgataaaaaaaagttaatttgataatatttttaataaaacatttaatttaaattaacaactaatatgtggtgtcaatataggctatttttatcttatcttaacaaatttattgttaaattttttaaaattaattaagttatttccataaatttcatagtt

SEQ ID NO: 5347 - DNA, 1100 bp, Glycine max
  Soy_ogl_6160 Gm18:53672001..53673100 Cluster 24
atgttggtccatgaccatcataattgattatgggaataaaaatgtcaaaattatctacaatttgaaatttaattttattgcttattaatagaaaagacttttgttaatgtcatgtgagaaccgaattaacatgcttaaactatgtcaatagttgttagaggtaaaacttaattaggaaaaaaacagataattttaatgaacattttatgtgtctatgattcaagacaatgaaaaaataataatcatgaaaaatttagatatttaatgatagaaaatgaaatgattaaacaatttataatattctaaatctaaaagattaagatgtagattgataatttatattagataaatgctaactagtggtctaagggcactggttaagtaaataatggaggaatttttttttattgaaatgcaaaaaatataatctctcatgattttcaaaatatgatcttatgttatttccaggaaaattctttctctcttgattccttatattaacttctagataccatttgcaaaatcctttatataatataaactttttaaagaaaatttgcataagaccacaaactttctagatacccatgcctctaaccattttcagtggagtctatattttcaatcatgtttaatctatttataaaactcaaatttaaaatcttacttaaagaaaatgaattcaatatcacttgaatcaattattttttacttaatagaaataatttaattcctcttacttattttaatacgagtaaataatttatgcattattatcaattacactttattaatttttataatacttacgttaaaatacacttaccataaattttaatgaattatcactataaaactttttacgtgcataaatagtaaactgttgtagtatttacttaagtataatactccaataagaccaagaaaaatcacaagaactctccacgtgcgggagtgatactgtaactttgaattacttaattaagaagccaacttagttgcaaacttgcactgagttccgtaaatagaaagatggggggattcagcaatcggcaccaaattaaaaggagtaaattgtagcatttcttggttgttgtgta

SEQ ID NO: 5348 - DNA, 1200 bp, Glycine max
  Soy_ogl_3682 Gm11:1581601..1582800 Cluster 24
aaaaaattataaaataagatggaacaaaataactatttttaaccaatgatttgataattagatctgacttttaattttatccaattatgaaaattaatattaaataaacctaattaaatataatataatcaacacaaataaacacttataaaaacacaattttgtctcctaccacgtataatatttgaatttaattttttttaattcaataataaaaaaatgttttaaaaaaagtgtcaacagtgttattctttttttctcaaaaactaaatataaaattatttggattatatacgtgtgcgtataaatatacaaagagaaacaatgtatcaaataaacaaaatatttttgagaaataagaattataaatataaactagtaaattatatgatacttttacatagttatgtgatgctaatttttaatcttgattcacgtataattatataatctagatttataattatcattttttataatataaatcttttgcaaatttagataattattattccttacatgcaatttggcttgaatatttaaaataatacatgaccattccattacaaattgttatatataataaatttattaattttataataataaaatttaaaaatatatcatatgtactactttacactttgcacaagaagaaaatcaaagcattcaaactaagaatgttacatttatataaagtactcgaactcaaattactagtgtttttattttatttttttttatctaatgaacataaaaattgctaaaataagaggcgaacagaatggcattctacgtactaaattagaaatactaatttgatctagcttttccaatgtaccaaaaaattaccaatactagctttgttgttgttcttgttgtgtatatccattattatgtgggatcctcgtctatccctctcaacatttaactctaatctgtttcccactggcgagttgttttcattccacatagcacgtaggataaatacaaaattttgtgttttattgtatattaattaatggtaatttaaacacttaacacactgctagagattgcatgtatccttaatatagttattaccaaaataatgaaaataaccttttcatccataaatgagtttcttcaagctgaaccccttaattaatctgttcagcttgtcaatggatgattatgcgtcgaaggttttccttaggaggc

SEQ ID NO: 5349 - DNA, 1100 bp, Glycine max
  Soy_ogl_480 Gm02:10544401..10545500 Cluster 24
atttgccttgcagtgaaattaatctcttttattatatacatattagtatatgtgtgaaaactttagtctatagaaatagaataataattttcatattcttaattttaatactcttaattttcatattattagtatatgtattaattacataataaaacatgctataatacgtatctactgattaaattaatttagacttctggtaaattccttgaatatccagtttcaagtttcagtcataattcaagtataaatctaagcaactgaaccaataaaatcatgacatcattgcggactcgacactactttagtttttatacgttaaaaaggggaacaaaatgaaaactgttttaattatccaattataatgaaaggtaaatgaggtgtgagaatgacattggtggaaataaaagctgaggacccataactttaatcaacatgaattattttaggcgagttgtcagctggtctttaattcgatataaattttcgtatttactaatactttaatttttatctgtgtggatgaaatttccagaaatgctccattgaagtacgacactgctatttatttatttctatttattttcttgtttattatcttttttgttactcatgttaaattttataaacccaatttaaattaaaaaataaacttagacgacagtacaatatcacattgtaaaaaaattctaaaaaaatattactattttatctatgagttttccaactagataggacttgattaagttaatcataacgaatatataattataaatattataaaacaagtttgtccaaaaaaatattataaaataaggaagttaaacagaaagaagcttaaaagtaccattagataaataattagtcgcaagaacctgcttggatgcattcactggtgtatttatgttacgatatgtaaagttgaaaaagaaattaaatttgaagcacgacagtagatatgtagctggaacaatatcttcgcttccagtgaaaatttatttcgtcaattatgaaggtaattaataatgagctatactactcaaaccaaagtaaacacgtaagaaaagatggttggaaagtctttcacgtattttttt

SEQ ID NO: 5350 - DNA, 1400 bp, Glycine max
  Soy_ogl_1362 Gm04:43613801..43615200 Cluster 24
ttctaggtgcttgagattaatttcatataactgcttttttttttaattaatattactatgttggtggtaattgattatttttctctcttgggtaaagttcagcaacgtctagaaaggtcattcaacttctattagggtgtcacgtcattcagtggatgcttgccaatgccaatttctctgctggcttctgatttttcggctcttaaacgtgttagtgtgcgtctttttccctgattccttgtaaaattatttaactcgatcgttgtatcgaactcctgtgtgcgaatgcgacaaactcacaaggcaagatagaattctcaagcacggggagattttggttatatacatcaatcaacagggattgggatcaaattataataggcactaaatttagtgaagtgacgtataacttttaaaaataaatctcatcaatttaattattgaatttaaaatgtataattacaaattaattagcaatatcatcatttcaattcgtacacatatttttattactcaaaattcatataactaagaacaagaaacaacactataaattaaatagaaaaatattataaatttgtttaacatggttcagtctcacactcctatattcacaaccttaacttcaatctttttgttaaaaaataggatttccctcttatgttagcatacataactgattactgagtataggcttatcgagttcaaaaaacacaataaatatttaaattatgtgaaattttataaacatgatccacatgatattatcacatagttatataattaaattgtaattttttaataaaactattaaatgtttaattttattatatttgacactcaatattctttcatccctatgtgtattctatatgtaaggtatcatgtgaaaaaaagtagtttttgtgaaaattaagaatgataaatacagacttttaaatcatattttaatattaaaattaaaaaaaagcaattaacatgtttaaatggccttataatcgttaactaattcttaatccatgcatatagtcacttatcatccttcaaatttgcttttatagtcatcttcagcgataactgatataacctatgtaagcatgtgttgtcttgtttgcaacgtgaagaacgttaattccatatttgaccatagatcacgcataccaacttacaagtaatatttatatgagtaacttaattaatacattatatgaggaagtataagcttgttaactcagatgaaatttctttgcttttagtcgggacaaaaatttgttataaattgattacgaagtgtacgtttattaatcaatattttctggtatcttgcttatggtaaggaaagtcttgatacggggataatcggatacacaaattaaattttgtatggggtattgaattaa

SEQ ID NO: 5351 - DNA, 1000 bp, Glycine max
  Soy_ogl_1865 Gm06:8796201..8797200 Cluster 24
ttttttatatatttaatttgtagattctccgcaagatttatttaaaatgagtttaaaataaatgtaattaaattcttaaaacaagaaaatatgcccccctctacttatgatttgttcgtggatattttatcaataataccaagagtaagctacagttgaacgggaacgcaaaagctagttataaaaatactaattaataataacaaatttcataaaagttggtaatgatcgagctccaaggacgttgggaggaaagagtcaatcatttacaaaaacaaagcacacacttttgttcctctatgatgccttacaaaagcaggattaatagtttaaagaaactattgtaaatcagcttttgtctgttgtattaggcggctagctagtttcaactttaaaggaagaataaaagcaaaaccacaagcattgtgttttcgtgcaaatctgtgttgctcgaacaatcaagcctagggcaattatattattatttatgttccctaaacaacaccacaagcggtttgaggacgaggagaaaggaataaaatgaaatagtatctcaaataagttaactaatgcaaatttaacaaaaaggtagcaatacacactaaaataatgcagaaatgtctgcttgtgagttttaattagattcaggttaatttattcgagcaaatttgtcattgactaacaacttgtagatacaataattagaaaaattaataaagcaactaaagtttcaatagtctaatttagtatattaatctaatatcgttcaatgattctcacacgtatgggttgtagtttagaaatattgattgactaacaaaaaaattgattgagcttgttgaattaattaaaaaacttctttcatataatgttagaatttttctaagcaaagtcttattaacgttgaattaattaatatttttatgaaattattctaaacatttaaaaataaaatactttcactcttaagatattaaatattttatttatttttatttag

SEQ ID NO: 5352 - DNA, 1257 bp, Glycine max
  Soy_ogl_4286 Gm13:26770344..26771600 Cluster 24
gagacattaatgtaaattttctcatgataatattgtcatataaaatttatcatggaataaggttattttgcattctttttctttttttggtagtatatataagtaaaagcaacaaaactattcccaaaggaactgaataacttgaaaggcatgagcagatgaggcactgagtttcgcaaggaagatctgcacaaaaaatcccttattcccaaagggtatgcacaatgaaattttttcactttctactgagtatctctttgatagacgctataacagcagcatattctgcattcttcactcgacacttaagcacttctctcaaaaagaaaaaaagaaaaacttatgctgcgtgggcactgagtagcattaatgcttggaaagaaagagattagaaaatttcgggattgaagatactgcatattttgaagactggtgccaatatcttaatatcaataagatttgtttgatttagagaatgaaaatagagaaaataaaaatagaaaataattttttttaattaaaataaaatttaaaatatatggattccatatgaaaaatataattttttcttcttttatcctaaatcaaacatagcctaacatatcgatacacgatgtatattgatatgatgaggagatactcgattatgatacacttctttattttgtctttctcaattctaattgcatttgaataggacaaagaattgactcccaactgactactgagaatttcttacatttatgcttctttttttctctctctcggtttaacttaatttcatatctaggattgaaatttaaacctattggttaaatatctgaaacaattttgcgcatgttaattcacacattcttagtttacatcgggtaaggattcaattgtttttaatcatattttattttgttatttaatatatagaaaaaaaattgataattaagattttatgcaatcaaacacttttgtaattgtagaaaatctacacgcaaatcacgcacccctttatagcttgaaatcacttactaactctcacagttcagagtcaaattaaaggctgtgtgtgatcttgacttgaggttctagaataaagagatgatcttgttgagagtgatattttcattgtttttgcatttgaactgtgatcatatattgacacataaaaatgactacaataatatcaccatgcaatgctatcggtttgtctgaagtgataaatacagataggttgtgctgcctgtggacattcaaaatagccat

SEQ ID NO: 5353 - DNA, 1004 bp, Glycine max
  Soy_ogl_4217 Gm13:23277301..23278304 Cluster 24
aggggcggcgtctcttatattgtgacttgtgaaggggggttggcctaccaattattttcagagctcattatcaagctttataaattttcatttttatttttgagcttgagcttcgaataatgaaaattttggtttctaactccaacaaagattagtatcataatttactttgttttgaagattttgaccttgtattgtgtctagtgtaattggattgttgcaaattagaataatgaactagaatattaatttatggtatgatggacaggtaaatctttattttttaaatatgtaattaggaatttgatcacaaactctttgtgataaaaaaaatatttatcgataaagattaattttttaaataaatctcaaataatttgataaatgagttcttagctcctaatcaaaacatatctcccagagggaaaaaaaaaaaaaagcatacatataagttactccacatatcatatgatgacagcccaataagaaaaggaggcatgcgtaaagtttatgtacaatagtcatcttatatattagcttttaaaaaaaacattattgatgttttagtatttcttattctaaaattattaatattttataaatctgaagtcttattaattaatttttttcatatatttctctatttaaaataactagatttgatattaatgaagaatatcgtacttacaatgtaattaagaaacacttcaataaacaataaatcatatttatagtttatattaaataagagtatttagactaaatattttatttttcactaattaaatgttctttaacttattcactaactttaaatattaataagcttttaatggagatttttttaagtatcttttaatggcgatagataggcgatagcattaatcagttaagatctatgactgaaatctttaggaaacatttttttttaaaaaaaagctaaatatttcattgaataagtgcctgaatcaagcacaaggagtgcccaatgtaaacaagagagg

SEQ ID NO: 5354 - DNA, 1139 bp, Glycine max
  Soy_ogl_6134 Gm18:52312501..52313639 Cluster 24
aatcttaaggtggtaagacgaattagtaaaaaacgtaatgaatctaattcaacttagttaccacgaaagtagagataaattcaattagatacgttttaattaatatcttgtaaaagagtaaaaattacataggttaattaatttaccttcaaagaaaagtaggaagaacactgaaatataggaggttaataggaaatcttagagtgaaaatttcaatcttgaaagttttctaaatttgaattttatatatatgaaatattgctctatctctatttttaatctattttttttattttctcaatcaaatctctaaatgtttttcaaattgttcaatttttatatattgatttgtgacaattccaaagccaaaaatgcattccatgtagagagaactattatttttattactagaacgatactatacacttgcagtaacatatcaataattgatgtaaagcatgtaaccgcctacatctgttgtataaataacaaatataaaaagaatgtcgtaaaaaatcctttttctacattacaacaaattaaataagaaaattatctcaccttattctatcatattttgaagacgacttaaccactaaacaacctctaaagacactgtacatatatgtggctataagtttacttgtcctttttattccggacagtaagcagcaatgtcaattgagcaaacaagttgccattatatcatagaaattatgtgaaattttggcttattatgcagtaattatttcatacattagagtatattaagagtaatatatcaacaaagtttttctataaatataaaatggaatttaagaaatgttatttagaaaaagatgtgtggtttcaacaatcattgaaggagaagaaattttggaagccacaaactcatggttttgtacgattgcataacactgaaatatcataatcaagtaatcactcacattctccgtgttgagaagcaaaagataccaacaaccaagaccacgagaagtcgagaatggctgaaaaactaaacacgtagtaatttattatggcattgaataatgcaaaatgcatttatccaaaaaaaaaaacgcaaagtacaaaccactgtacgactatacaatactttatgatggagctttactaaaacc

SEQ ID NO: 5355 - DNA, 1100 bp, Glycine max
  Soy_ogl_5550 Gm17:6535301..6536400 Cluster 24
atatacaactagttgttcgataacaatgtcagtggtgatcgaggatgtgcgtaagctatgaattactgattgcactgtgttctgtttttatttcatttaacttaaaaaaatctataattgagataagtttccatacgtaatgatttcctttttattttgctaaagatgtaattttaattattatattggattattgcggtataaatagtaaatgatttactaattgtgtgaatgtataaaaaattcaaccacaatattaagaaaaacaaaagaacttgtcttggcttgtcctgcttattaaaaagccccccagtggcttcaagtgtaaaaaaaaaaaaaatactaacgtagcttgataagttggtttttaagatggggtaaacttttaaataaattagacccaacattaaaaatgaacttttacctcacgtgtaaacatactacagtcagacttataattatgaaccaagccaagctcaaacttcaaggtgttcacactgtgattttgattaattttgagcaaaaagtcatgtgaactaaatatacaaaataagtaattcggtttgtttcgatttgaatgtaatattacatctaaaccaaattaaaatgatactttatagtttagtttgaatcaattttgtgatttttatatttttaatctattttatatatttttaaaattattttaaacaaaacaaataaaaaatggaacaatgtaaagtctaataactatgagttacagtcaagccttggaattgacgtttacataatgatgattgataagtaacagaacaacaacaaaaatatacttttacatcattatatttttctacaagtcatgttagaacttaattaaaaatgtgtcaatattatagtatagactcttttattcaagtgagtagaaacattagactctaactttctgtttgtaacacgataaatcataacagatggcttatactacaaatacaaagttagatacattggactataactttgtttatgtaatataagtttattacttcaatcaagacatttaacatagattaaaagtgatattttacatcgttgcaatttgcgatgaagtagatcctacgatt

SEQ ID NO: 5356 - DNA, 1200 bp, Glycine max
  Soy_ogl_3912 Gm11:35863401..35864600 Cluster 24
atataagaggttttaagggtggattgaacatattgcaagacattgtaataacaaaaaatatttcattactaaggtgtttgatagggaaggaattttgagtttcatgagaatttttgggttgagaatctttagtttttcatgcttgatattcgttataaaaaaatgagattactgggtaaataatggatgcgtttgtttaaatttttaaaaaataactttaaaataagtgttttttatataaatatttttttaagaagcaaataaaatttgctttttgatgactaatgtttccatgaagggtttttaacaaaattttccacgaaaacacaaagtagtaataatgtttgaaagattataaatattggaataattttatagactaaaaaactagatgactaaattacatggactaaacaaatattaagaacaaaagtatataaattatttcccccccttacagtccctattgggtggtgatgtgaagttgtagtgtgttttccgatcttaacgactgagactattccggtttccaactccttttccatcgtttataaattctggtactttctcaaaggacaaaaccttaaacttacatgcagtatatcatagttgtgttgttgttggtgctttgaacaatcagaattaaaatttcacatcgataatacacatacacatattaaagaattccattaaatgtcatcccttattaccaaggtgagactccaaaagaccaaaacaccaacaacaactacagagctgcatctaatttttttttttctttcacaaactgtaactttgcatgaagccttgaacacgttgtactcttcctcaggtaattcctgtttgcttctgtttatgtttatctctttacaaaagtgagaaagaaaaatactactaaatgcaataagggtgtaagacgaatgtaaaagataagggtggaaaaaattgttgacaatttaatatttagttttaggtcatttggtttgtccaaaaactagatagttttttatttaggtactttgaaattgtatatgcagatggcgaaccatatttctgaggaggttatgagtaagcaaagcaatggttttgcaagccttaaggaggaaattgaaagccagaaacagaacattattggcgtggaaaataagaatattgagaaagatgtttgtatgaacaaactcaatgaatctttgaacatgg

SEQ ID NO: 5357 - DNA, 1026 bp, Glycine max
  Soy_ogl_4287 Gm13:26788675..26789700 Cluster 24
aaaagtatgataggattgtaggactttgctaggttttgtcgaaggaaatccgtgtataaacaaaggaataacatcaccaaagctggattgtttggttatgaacaggcacgtaatcagaaatcacgtacaagttttggtctttatcaaacacaaaataaagagagacaaagaaaggtgggtacacctttcaactgttaggcagtccaaattcttagtctcaaaagtgacgtctcaatgtcggattttgttttcttaaagaattcaaacttgccaaagaaatttaacttttgaaaccctttatttaatttgaagctagctcgttcccatgagttaaattccataaaaaaaattatttaacgaaagattatgaaaaatcatgttgagaacaaaattaatcttttatccaataaattaaaaaatatccgtaatttctgacataaaaaaaaaaaaactaactggttcatcctcgtgtgaaattcaatttactcttaagtctcgtggactaaaaataaaaaactattgaaagcttactaacgtccaggtccctcccatgcattaaaaatagggaaaagtcaattgacacttcaatgccattttattatagcctaaagttgaaattgaaagagtggtaagagaaaaaaatatacataagtataataagtaaatgacctgagtataaaataaataataattattaataataaggtattttatacattaaggcgtctatatattattcattttaaaaaaatagcaaatagtcaatgtaaattggcttaagtaattagaattttgatatgaattctcattttttttcatatatgtgagtttgaatctttctgatgtactgtccaatagtattatataaagcaaaagtacataaaaataaaggtggaaaagttgtatggaaatacatatttggttactagttagggtaatttaaaagtatttttaccttcttttacagcaaaagtacttttacttttaaaacaataaattcatttttcttcattatgtatattgaaa

SEQ ID NO: 5358 - DNA, 1270 bp, Glycine max
  Soy_ogl_4212 Gm13:22987101..22988370 Cluster 24
gtggcgtagaagcaatgaaactgtgttcctgacagcaaaggggcgtttagttgggtaaatttgaaaatttgctcgtatcttttacactttagatgctaaaaagaaatagagaggaatttttttaaaaagaaaaaaatattatgtgagattgtatgttatctaagtggatatacagagataaaatcttatatttagattaagaaataaaatcattaaatgataagtatgattaaccaaaattgatcatttttaacaaatgtcagataatcataagagagtattgaaaaaagaatacattaacatttctttatatagataagacaaatgatataacttatttaattaaatagaaaaaattagaatgattggacaattttgatcgttaaagaaaatacttcatagtaaaagagatacttgaagttaattacttctttcatgggaattttagtgtgtttaaattagttttcaattctaataaaataaagttgaaaccaaatggacaaataattgcttcaatttcttaattttcaattttcaattttctaccataattttggtggtaaaattaattttatgaagtaccgaaacacactattagtagtagtagagattttcacgcgagagaattcaaatgaaaatcctacttaaagttaaaaggattaatgcacgagtactcgggtttagatctcctcatgtgatctttttattattcaataaaatgttagtctttaattaaaaataagaaaacatgttttttttacaagataaaagaattttaaataatactcaaaaggggagacgtgttttaatgtaaagattttattttaaaagaacccaaataaaaatttcacttaaaaagataataaagaggagcaatttttaacataaactctacccttcaattttttttatccctcctgtaatggttgatatctaacataaaactctacccttaaattctttttatcgctcatgtaatggttgatgtcttgataatccaagtggttggagatttgaattcctcttgtaagtcactcttcaatatttccgagtctccattgaattggtccatccaacgtgctaagtattaatattaacggtgattatatttatattttacttgttcggaaaattatatttcttttcttttctttttgttatgtttgaaaacattacgtgtttggttaataggtataaatagtcaaagcaatcatatgttttttttttaaaaaaaataacaaatattaacaagtctggtgataaataaaat

SEQ ID NO: 5359 - DNA, 1000 bp, Glycine max
  Soy_ogl_5592 Gm17:8787101..8788100 Cluster 24
ccttagactaattatacatagaaaataatgataatgtatttaactaaataaaataagtgtataactgatttattacattatttatgaataaaggatcatgtaactaaacactaatatgccacaaaaattatttattttaaaaaataaaataactaaatatcttcacttaaaaatagaaaaattaaaatcacacatttaaaattacagaaaatcaaaattataatttaacccaaccaaaacaattttatttggacggtttgtgtttaattcctgtgttatcttttaattttgagataaaacaacattacttccctagttttttttttttttacaggacttgcctaaaaatttattaaagaaatgtcataatacctatacatgtaataaaaagatacttacacttacttttcattttttatcatttaaaccccacaattctttatcctattgaaaaatgaaataattaagatttttattcacatataattgtgattatacaagacatatataaaatatggtaaagtaataaactctaaattacttgtaacttaaatttaaattgtaacaattgaccattaattattctatatatcatatcaacagtgaaagatatctcacatatattctttcatttctttgtgactgctataaattatctgtaagacggtaacctctgatatctttctcatttctcaagtgtatgacacttctttcttccactattatacctataattgtgatatgattgtcattttccgtaaacaacatttccatttaaaagaaagaggaaagggtacccacggggttgcatttgcacgacaaagttaataagattaattacacttccaccacataataatagtagttaagaatttgtcataccactttatcccggttgatatttgacagcttcgttaatgatatgctaatatcttaaaatacttctattcgaaacaatagatattccatcttacttaccaaaggtgtgaattcgaattga

SEQ ID NO: 5360 - DNA, 1009 bp, Glycine max
  Soy_ogl_4995 Gm15:11412192..11413200 Cluster 24
tctatgaggtgaaaataaggtgtttttttttctcccttcccaatttcctccacaaaggaagcttaacctatatcttattcatcattgttgtaaaaaggattatgttcacaagatacttaaattcgaattaatataaaatatatccttacttttctcattttacacatttattaatctcaaaagaatgaaatatatttttcaaaatacaaatactccaattcatatatcctcttaattgtctagctgttataggtctaacagatcagtgatatccctacaactataaataatttttcatgtaatcaataaactcgtgtcaaatagacaactagagtttttcatgtaatcaatagcatatagttttttgaaagtgtgataataattgtttatggatattagagttgtggaaaagaaaaaagagatgatgacagtgacaaaaaatgcacacatgtgccagcagctctcatttatagaagcccactgtggatcaacatcttctggaatttctagccgatggttcataaaccctacagctccaacaacctgcaagaatccaagagaaactgttgttcatatatgtactcactgagcatgaatagacagtgaaatcaattcttttacggcgttggcggcttcagcttgaattattttcttcttcacattttatgttttaggaatcgtgacacgttagaatattaaagaagaataaataaaaaaaaaatatttgattagattatacagaggataaatatgcatgaatcttttaggtagagtttttctttttcatttagatcacatttatcacttatgggatacgtgttattcaagtcaagtatgactattattactagagttggataaaattatgataataaaaatttccgtctggtatttcatattttaatcggttagatacacaaattttaaactcgataatactaattaaacaatgacaacccatgttagttgatttacatgattaacagtcttttttttggtataacttgaa

SEQ ID NO: 5361 - DNA, 1043 bp, Glycine max
  Soy_ogl_2084 Gm06:46160358..46161400 Cluster 24
gttaatgggtcaaacttacaaactctatatacatgtttgacaacttaaattttgaaacaatctacctttcaatctctttatttttctcggcttgtatttgtttttaattcttagcattatgagatttcactgtgctttcgattttagtgcacgaatcgagactcacatgctatgtaaattttaagaaggcaaattagatattaagttgtactaaatatttgccataatttgctttcaaaatggtagctaatctttatcacaacaaatattttttcttgtatttttcaactatttgaaagcaagctatttttcaattattgttggctattattgtcctaaaaattaatttagtgaataacataatttattcgaaattagtagattttggaatataattaataggaattttcctaaaaaggatttagttaacataaatatcattaggataaagttaacataaatatcatttttatttattataaattcattaaagttcttggtgacatgcgaaattgcttattattatttgtaattttgggtctttaaagttctttaaataagtgattaaaataaaaaaaaaatctttaaaggactaagaaaagactttatattttaaagggactaaaagattatttaaacctaaacaaatctttggttacaaaatacatgtatcttttagcctctttaagttaagacttaagaccactatagtctatatgccatatattactgagattttttttaaaaaaattaatcataaccattccttgccctattaattagttattgggccaaaaatgaataaagttagaagaaaataatattttaaattttcaacaaaaaaataaaatgaaacaaattacagatttaaaggcgataatattcttttaaataaaatgatttttttagtatgcaataagggtatatttcaaaagcaaaaactaattcttagaaaatatagatattaatcaccaaaatagatttatcgttcttaataaaatctttctttatacacataactaaaatttaaacggtgattaaca

SEQ ID NO: 5362 - DNA, 1200 bp, Glycine max
  Soy_ogl_2247 Gm07:7422301..7423500 Cluster 24
acatccgataatttaaattgaacacgctcttatagttagttgcttttatgacaaacgtggattgatggcgctcaactaaacacgcatgaaatgttgtatgatttgctgtttaacttgttagaaaataaaaatgatgggggaaggaattgaaaaaaaaaatggttgatttaacatgctactaagtactaattgttttctacaaaactcgctcgaaataagtaggctcacatagtcttgtaagttatagactgattgtctgagtttcaaaccaaaatgacaagattttttaggcattttgaagtgcaatttaatcatctgcacactttatttttatgacaatttaatctcacccccagctgaaaattttcatgagtttggtcttaatatattcttaaagcccactttatctttccatgtaggcctatggattatgggttggaaagttcatgagagttcacccgtggtttactataattagttacaattatatataattgatgaaatatccattacaaaaaatcaaattaaactcattatggaaagtgataaatatcaatgaattctagattgggaaatctaaaaaacaatatgcattctaaattactcaatcctaaactatgttacataggttatggaccatcaattttgaaagttagtatagttatggatttaataatatgaaacacaagatgcattctagattactcaatccaaaactataccaatataattctggaataaatgactgataagtaatacaatatagttatgaattgggtattcttgaatgtatattgtagtcaagattatctaatctagaactgttacataacttttggatcatctattctgatattatgttattagtatatttttgaattgaataatcaagaacacaatatgcattttggattactcagtccagaattatactaacataactgcagaatttcttatccaaaaagaaatatattttgcttactaattatactaacatattctggtattatgttagtatattttttaattgaacaatcaggaacacaatatgcattttgcattactcagtccagaattatactaacataattgcagaatttcttgtccaaaaaaaataaaaattttgcttacgaattacccaatccaaaaatataaggagaggttaaaaaaaaccttatcaacttagtgtgaccaatggct

SEQ ID NO: 5363 - DNA, 1082 bp, Glycine max
  Soy_ogl_2004 Gm06:17215576..17216657 Cluster 24
tacgctgaagtgactcttgtttttggactatttggagccaataaatttgtttaatcatttatatttctctttgaagatagaggcctaacagaaaaggatgacagatattagaaagaactcaggaaacaaccgcttgtcgcttacccaacctaaccattaccaacggtgtgatagtacgaataaatatatttctagatatatagctatatagctctaggtggctgaataaagttagcaactttggactcaatattacacttttactatcgataatatgatacactctgctattgaagaaatcaattttattgatactaattctaacataataactcttgccaatatattctcagagtaatttttaaaaaaattgctctccaatcgttaaagataagttacttgttattatggttaaattaaaataaaatgctgacctaaaaataaagcaattgaagctcaactttaagtctaccaataaaaaagatatttgttcataatttttataaattaaaaaatatctcatatattaacaaaaagaccacatatatgatggaaaaaagtttaacatataacttttatttaaagtaataactttttctttaaaatttattttatgtatcacttatcattcaactaaccctaaacaaatgaggagtggagaatagagattaacacttttaaaattaggtaaatgacgtatttggtccatgaaagatccactcagtattaaagtcatgcttaaaaaatgaaaatcactaatttagtccccaaacatgtaaatgttacaacaatttaagattattattaacctatcatcattttgagttaacgttaatagataattgttattgacaaggcacattcacatgtggaacataaacaacatgcgttgtgtcatgttaaaagaccaaagtgttactaaaatgtttctctattttatccccttaatctcaccattcacttaaggttatttttatcattcgcaatagttaaattagtacataattcccgccttctctctatttgtctctctatctacatgcataatttattttacttttactaatatataagtttgtttg

SEQ ID NO: 5364 - DNA, 1300 bp, Glycine max
  Soy_ogl_4185 Gm13:21344801..21346100 Cluster 24
ttttcacaatatgaagatttcatgggggcatgtatctgttcattctgtggcatgcttttcacaatatgaaagagaaatatcaccaaatcaactttgtcatgactatccacttttgtagcaccgacgcctctaaacaatctgagataagtacttaaccgattgcaactaaatattgttgatttcaaatttttataatattattataatgttagattgcctggttttatgtattttgattgtgaagcctataaaatgaattataaaaatatttttttgataaactttttgagaaattttaaaataagtaaagaaataaaagtttagaaggtcatataaattacttctaatatcttatcaaattaagctactaatcaatctactttaatggcgtttttattttcttagtgtttggattatgtgcaactctggttctttgagttttttttagtcaattaaataactgtctttctaaaatcaagtaaattactgttcaattattagtttcatttcaagtgattctcgatttttatttacattgaaaaaataaatataattctcttatgatctatttatgaacaacctcttatttagtctaatgattgttggtgttttttatttatttatgaacaaccttgcatctacgccacatttttttatttatttatgaaaacaaaaggttgttcataaataaaatataagaatgagcgttctttcgtattgtgggttgctaatatttcttttattttcgtccaatgattgttggtgttttttttattgaacaataattgttggttgggttgggctcagttgtgcataaatgagagggcttaagtactaagcaagacacttcacatatggttgttgcttcctccacttttttggaatgttttttttacttgttggattgaccattccaaaagtcaaaatttgtacttattctcgaatgtaatttaacattttagattgaacatttcataagctaaaaaaaaggtgcaagaaacaacttacaaagtacaggaaacaacaaccttcacataggacctaaggggtccacctgagcctaaggaccttatcaagcgcacattagaaaggatctgaatttgtcagcaatgtttttatcaccttcataagtataaacaacctactattttgaggtgaaagaaaaaaagaaataggagaaaggaaaattccagtaaaatattttatagtgagtttaaattttatttattattatgtaaatttttttacagcatcaataactaaaatttatagcaaatatgacttccaagaatatatatta

SEQ ID NO: 5365 - DNA, 1000 bp, Glycine max
  Soy_ogl_2317 Gm07:10024801..10025800 Cluster 24
tcattggattaaagagataatatgttattatgttacattacatgtgataaacggtaagagatactagtattacttaagaagaagaaaaacagtaagagatattttatcacatgaagatgaacgtttgtgacatcaatcaaagttaaaattgttagtgcatgcaaaaaattgaatgaaagaacttttttaactaagaaatcaaactgaaaaagtttcgagagcaatcaatatattagtttaatattcgatatgtattttgttttaaaatatataaaagtaaattaagagtttatttgtttaagtttttttaaaaaagaaaacaattttctaaaaaaaagcacttttctatttttttatgtgtttgtttaaattattgtttttttattataaaaaagcagctttatttaagaaataattcttacatgatgttatattgacttttgtaaacttgggacgacaacatctgataaaaaaacatactgacgattgtgattgaaaatttcaaagagcaaaaagaagatccgaaggcgaaattaaagtcaacaaaagaatttattatttggaactaaatggaaaattcagtaatttttgggaaaaaaatgctcatgtctatattattatgttattattaaaaggtctaactcacttgtttgaatagttatgataaattttctcatattcattttttattcctatttatataaaaaatattattgttatttattgagtttaaatttgaatatcattacccaaaaattgaaactaaaaaggaaagtgcacgtggcatggtattggtcatgtggtcttgtggatgaatacgaactacgaagtatgaacgattattctacgaagacgtgcacgtggcgttgtcgtgatcatgtgaatgaatacgatgattctacgacgaaagtttcgagaacaatgagcgttgaggaatgcgagtagcgggacaagtacgtaatttcagacagtggtagttgactggaatagctacacgtgt

SEQ ID NO: 5366 - DNA, 1214 bp, Glycine max
  Soy_ogl_4854 Gm15:1496501..1497714 Cluster 24
ggtaaatggtaatactatattatcatgtggatagagctctaattattattattattaatttgacctttctcggggaaacaaaattttgtcttacctatgcattgcagatgccattctagatttgctttagcttgatatagacattatttgtcatctgaaaaatacggaattaatccactcctcaattcatttctctcctatttttctatccaacgagagacacttatcttgcaatatatataatcgcagtttctgtctccttctactccatactccattatatatagtcatacatgaaattatccgaacccactatccaactttaaagagggagaatatatcaagaacgagataaatatgtagagtagctacttaaaaaccaatctttattatgtttgatagattacaagaaaagaaacaggagatgcccagatgggtaatataaatacatacaaaacttaagatttttttgtcccctccaagacttgtatataagaataagactataaacctttgtcctcaccaacgaatacgtagataaattgctgcagagttatttcaatttaattagtgattttaaatttgacatttaagtatgttattgtttgaaatattcaaaatataagctttatggttcataatgatcctattcttgtaaaggatacacgtgatttgttattaaaaaaaaaagactaaaataattaataagactatcctcatgatgtatttgaagtttatgataagaaattaacattacatatatccaaccagatgaataaataggaaatttattaacatgcattcacttaatttttagaagatgtattttggcaagtgacaatttcaagtttttttagcatatacacaagatgtaacttgttaaaatactttttatataaaaaaaaaaaaacaagttggtgtagtttagtaaatgcgtgagatttattaacacatatcccgaagggatattttcttaacctataacttcaatttccataaaataaatcttagatgtagcttgttaaaacattccctttcacaaataagtagatatgcattagcaaattctgatacagataatgtaagaatcgattcataccatttttgcgaagaaaaccccctctgcaaattatggtttaaaaagaaaagaaaatgaaggaaaataacttcataacaaaagaaatgatggtaagtataaagaaataaataagaag

SEQ ID NO: 5367 - DNA, 1200 bp, Glycine max
  Soy_ogl_2661 Gm08:13478401..13479600 Cluster 24
gtcaaggttataaattatgatttccgaatacattaataacaattagaatatcatcattttgagtagatgtgaaagagagacatgtgtcacaaaattgttcaattggtttcaggtgttgcatgaattttggtgcatgcaccctttaaacgtttgttttggtttaatgtggctcttaaatcataaccataaagttaacctatattttatgttcttaatcaatcattagattctctataagtaatgtttcaataaattatgatctgcaaatacattaattacaattactactatatatcaacattttggaacattttacggctgcattgtgcattgtaattgttgtcacatttgcccacactgatgtgactacaaatgcgactgaaacagaaatttaaaaacaagattaaaagatttgaggctacctttcccattttgattgtagtttttatactattgattgatcccaaacatatcttttctcaggacttaaagttgcttgatttcaaagcaagttcaagattgtcgtttgaactttgaaggcattcaattagtcatgaaaatttagaaccggccatgaatttctatattcaatattcattcctttatagcaagcttgaactgaggaaaagagtattttttttgttcagtaagtattatttctttatttttaaaaaatggataattaaatataaattaccatgtaacctttaataatcttttattcattttttaaaacattaattatacaattctcattttttttaaaagtaatgcctccatctaatttttctcaaaattcctccatcaaagacaaacgacttaatgaaagataagggcaatgagcatccaagcagtgtgtcatttcaaaagattcggtcaaaaaagagcaaaggaaagacctgtttccacgcacttttgttacattataagataacaaaaaaggtttgccattattaagacagattaactaagctaatataataatattatattgttcaatcgccctaactaatagtccttttgttaccgtgttttgtcaagatcttttaacgttggaaaaaaaaatatttgttacctatggtgggacatttttgtagttttggagttgcaagtgggaggaaatatttgagccttagggaaagagcaacatgcaaaggcacctgatactacgtactgtcacgaagataaccatcttcaatt

SEQ ID NO: 5368 - DNA, 1164 bp, Glycine max
  Soy_ogl_3776 Gm11:6629238..6630401 Cluster 24
gtcatctggattaaatttcaacttatctccctagtatactagtgtcacccaacttaataggattaggagcagcatatatatcgtgtcatttcttccatcttggtaacactatatatgatgtgttaggagtaaattaatgttgactcaccggtgatgtttatcaaaaaccagaagacagcaatatgatcgatgacattaaatgtgtctagctcagaattatgaatatacacccagaaccaaaataagctggcacttggtgttagctattaggatcgtatacattgatgagctagctagctagagagcatggaaaaaccgtttagaagaaaacgagtacagaagtgctgagccaatcaatcttctttcgtgtttctgctggaagaatctattagatttgtaactacgtaagagaattggaagtacactaattaatttgagaaatctttgacaaatattaaataataagaactaggaaggaactcaatcgcaaacgttcatgaggaaaatcaatttcaagcaaaagtaaattccgctgtccatagtattcagatccataagcatatacatcacgttgtttaagaccaacaacaccttttacttgattttttaaaagagtaacgtccacgtgtagatatcattacttaataatgattaaagaagcaacgttgcatagttaaaaatttggttttcactattcctttttacagggtctatactgaaagagaaaagttatggttccacagttaaacatgcgtgctgtaaatcttggaagttcattctcacaatcatttagggcttaggctatgtttagatgaaacttagaaaagtatttttgtgaattctaatgtataatttcaacttgtaatgctcaaaatgaaaaaggaataaattgttgtttggggagtaaaaaagttctgctaacttaaatacaaacatatgcacttagtattcttattcttaaaacatcatttttttttcttgagaatgtgaattgtaattttcaaaaatacaatctcaactaattttattcaaacatattctaaattggaatgaaaatttatgagtacgtgtatgattttttttttatgcttttatatattgttcattttattatttcactcttgtttcatagaaattacatatctttcattattgttaattcta

SEQ ID NO: 5369 - DNA, 1168 bp, Glycine max
  Soy_ogl_3873 Gm11:131433..132600 Cluster 24
aaaaatattaaactatttattgtccctattaaaaaaaaaatctgaatccaacactcttagctatatgaataaaattaataatgtgcattaggttcattgtctcctcagctttcctctcgtcgatatcaaatgcttttcctgcgacagttattattattgcctgcaaccattttatttggaaaaagttcattgaaataataataaaaataattattataattactactataaatctatttttaattttctcttcacatcatttgtcatttttttctttctatatttttcttatttctgtactctccattccaatccatgccaaatagaatggagttttacaaatgggttaaataaccttttactacctataagattattttgattttattatctaaattattttttttttagcatctcacatttttttatatttaatttaaataccaatcattattaaagattcgttaaatgatataagactgatgacgtactatttcattagtttgtgacaatatcatatcattacttaacatattttcattgacaacatcaaatattaaaatcaaatataaaaaatatgggagtgttaaaattgataaaataataatttagatagtaaaattaaaaaagcctatttcataaaataataaaaagttattttgaagacgaaatttaccgaagtaaataaagcttagatatatttgttgctctcaaatttttaagtagtttttatatgctttgttttgaagagatcgaggtcacatagaacaactaattaggctttggggattatgtttacttgctttggtcacatgtggatgtggtatttgacactgtatgcactgataaacaattttctttttgcaccacttgtatgcaaatgcttattttttaaacgcgtagtaccaattttaaatattatattttcaaaagataatgacgaaatatatgtattcttttgctagctagtgaagtggagttgctctaatttagaattaatgggttgttattggctcaatggatccatccacatgcaagtaattaatactacaagcattgcactcaatgaaaggaaagctttattgggtagtacgtgattgaattgaagaattatttatcaagatgatatttgggacgggtggttctttcttttgtagtagtgcctctc

SEQ ID NO: 5370 - DNA, 1000 bp, Glycine max
  Soy_ogl_5019 Gm15:12677301..12678300 Cluster 24
aaggaaaattaattctacaaacataaatgcaattgttccacttcaaacataaatatcgtctcaatattcaataacacaatatacggtcgtcattataagtgtcatgcgctgtcacatggagtgggttcataatggaacaaccgtattgaacgatctcatagtttgagaagttctatttatttatttttattaaggaagttctattaaattttaaaccacgaaaagtttatagaaataaataaactttttttttattataaacaaactggcccaggtggaaagtttttctcccatatgtttttataatcagggaatatttagaacttctgtttgacacttcaatagtctcactattattgggtggaccagttttaaagtaaaatgattcttcaaatcgtaattacgtacttaaatcaagaattaaatcttaaaccttataacttacttttggattttcatattcaatttgtaagaaaagtttgtgtagaatagactaacacttacgtatcgatttttatagtcagtttgattgaatgttaacaaagtgatagaattaagtaaataagaacttttaccgccaaagcgccaacaaaccaattaaactattcaaagatacaaacattagctggtattacgtgtattttaaaattagtttattttgtatttgtcccttcctgtatctgaagatatggtatttggatgatttgattttgtcaaaagcttcttattatcacttaacatagaagtctactagtcaaactcagacatgagaaggaatatgtactgtataagaatagtacgacacaagtcaatctgagagagagaggaagacattattaaaatactcctttatgtatataagaagtcagacccgtataaaattagagactatgaatgttatgccattagaactggacctaatggcaactcctcaaaccaagggctgtactgatgaacacaataatttattaaataatattaataattataatactgtcca

SEQ ID NO: 5371 - DNA, 1200 bp, Glycine max
  Soy_ogl_2777 Gm08:20860801..20862000 Cluster 24
ggaaaaaaactacttttaaaaaacccataaggttaatttagattggtttgataaaaatatttctttcgagctaatctagtctaattctttttaaagtttggattgaattgattatttcagtttttgctttatgtagtatttttcaagggatgattctttaatttattttttttggacttaaacaaaaaaaaactctttaattttttggttgaacataaatgaaatttcattaattagagtaagagtaaagtcttaaactaaaaaataaattattctcttgtctaatttttcatttaagaaacaacactcattagataaataaccaaaaaaccttatatctcattataaatcacaactttggtataaattataacaaaaattgaaatgatttcaaatttatttgaagataataaaataatataaatttaatatttttgcaattcaatttgacatgaagcctaagataaaactgaacagaataaaatatatgtcaaattgaaaatgtttttatcaacaatttaattaatgtgcatactttagaattaattcagtggtttggttggtaaagtttttttttttatttattatttagatggcatatatctttaggatcactaggcattataaggatgatttaatgataaaaataatagaatagggagaaaaaattgtaccttcgaattcctttattaacctaaactaacaactaacattaaaaaatttagtgataaaaaaatcttttagggttattataggctatcaaacctccctccaagtattcaataaattcgacacttaaagtgaaaataatttgaagtcagattcacgcatggtaatgatttagtatggtttaaatgaatttttcaacgcccttaattttgtctttcatcctacatttcacttgtcatagtgtttaaagttcacgatcttccacaatttaagttctaacttttctctcacgtctagattaacgatataaagtacatgtatattttcttacaaaataaggcataatgtattaaaaattgtttgattaaaaaaattaatggtcatattcacagaaaacaagcttccaaaagtaatcgtctcatttcagttttggtattccatcccttgtttctttcctttcattttttctttcttttttaatgaggaggatggccaaaggcccttacatccctttgtttctaatggtaggat

SEQ ID NO: 5372 - DNA, 1000 bp, Glycine max
  Soy_ogl_3850 Gm11:16533301..16534300 Cluster 24
ataaaaaggatttgtaatgggtcaacattgtaaaaaaataatatgattaatgcactagaataaaaattctttgcataaaaattcaactcataataaaatgcttcttacttccatatattttaaaaagatacgttatgttaattttaatgggctagaataaagtatcaaacatgtttattaaaataaaattatataatttatataagaataatcttgattcaatgataagttttggataaaatatataataataaaattattgattgagtatgtgtatctcacaaatttgtgtgagaaaaaactcattacattagtcttgtaaaatctatttctttttttcaaaaatcatattattgatgtaaaatatttttctgttttgtgaatgattaatctttatcaatcaacataatttaccaccttgaatatatgtcttcttctaatatgcttttttttcatttacaaatgctcaagtccaatatgattaatttttttatatatatttatagatagatacatattcaattgaatatggtgatataagtgcttgctttaggataatcgaagcttgattttaaaagtagtataattgaaatcattaaaagacaaaataaactcattatttcaaattatacattaggtagatgatttcatttaaaaatttgggggtcctatccaattctacatcgacatctctcttcattggcccaacttagcacaaccgaaaagtaggccaaattaatcataaccgctgtacttacgagcctgtacaatttgatgctagagtttagtgatgctcaaaaatattgcaaagtgtgacatatggtcattcaagttccaggtatacatagaaagtatggtcatcattaagtgaaagtaaggttatcatgaagttctcaaaagactgcctccaacacatggatagattagtcataaattggcaccgatgtttttctaaatccatggatagatttgagtataaattagcaatataccccaagtt

SEQ ID NO: 5373 - DNA, 1716 bp, Glycine max
  Soy_ogl_1796 Gm06:5495401..5497116 Cluster 24
acctataagcatcaccattcatcaacattcatgagagtaagcacaaaggtcaatgtaaacgaaggattcttcagcctcccgaagccatagaaggtcaatgtaggttttctaattaagttcttttatatgaattttgtgattttcttatgaattttttcttcaaatttggttatgattttggcagaaatatgtttattttcttaaatttgttgaaaaaatcattgattttatgtatttttgtacaaactctgtttatcaaataacttaatttgactcgtagagtttccataagattaatttaaacataaattctctaaaagaaattattcagtagtagacaaaggaataaactcgttaaaaaaacctaaagagtattattaataaactaataatatttaaattaccataagaaattatatcataaaaattttataagtttaattattttggcccttccaaaattttagtcaaactccgccagtgattctaatactgttataaattattgcactcaaatttcttgcaatatatttttggaacttttttttttatctattttctttatcatatcacacattttattttatttttctctttctgcctccctcctttctaactaatagaagttatttcttgaactacattaacgactagtattgcacaagttatttcatgaaaaaatgcacaggtacaactgttttttgttctaaaaaagtataactttttatcaattaatttgttagttgctattaatgagagattcgaattaatataacattttttttttctcatttatcatgttaagctcataatttcataatacaagtacaactgtataaagtcaaagaagcgattgagtagcttgtgtttatagaaaataatgtgctcgattcggaagataatagaatctgcgaaagtagattctgttgtctcatatggcaacgagacgagggttccattccaaaagtgatggattagatagaatgaaaggtatcattgtgttagagtttggacgtaaataggcaagatctagatatcttaggttttgtttgtatccttttctagtcatgttctccaggggtgtaacgcgccaacgcagactggacataggcccatacgaacaaacttctaactccaccttaaacccttaataatgtagcgcgtgtttgattttctgttgataaaagttttgtgcttgtttatcaagaaacgattaattataacctaaacaaagaaacaattaattatcactttttgcttatatatttgagaattttgtatggacgaaaaactaaagaccatcagtatctaataagtacttttcgttagttcaatttttttttcatgagatttgtacgaaatgacatgattaatgtccaatcaaatataactttttcgttcatttcaatttgtgttcatactaattaataatatccacatttcatatcaaagatcctcttccggatccatctctacacctagaaaaattaaaagcccaggcacatatatagaaaaaatgaaaagaagaaaacaaatgatggagaaataaaaagattgaaaaactgtagagagttagagataactctgcccgaagaggaatcatgtccatttcatgtcaatatgttatgagaactcctgtgtgtgttcatgatcgaataaaattctatgacagataatgccaaccaatgttccaattttaatttatttttaataatt

SEQ ID NO: 5374 - DNA, 1000 bp, Glycine max
  Soy_ogl_4018 Gm12:7826601..7827600 Cluster 24
taagttcaatctaaaattatgatttttttttaaatagaggaaattaaatattttttttttaaaatagaaaaattaaaattataaatttaatgaaatagggagacaaagttgtatataagtatattttaagtgttaaattctcctttattacttgttagcggctagacttccttaattagaccagaacaaataattgatatccatcttacatgtttgtctaactccggtagaacctagtaataaagaaatatttcaatgattaaagtgctacgattttaaagttcaaagtgacgctctttttaacttttaattaaagaaaattcaactaaaataaaaaattgtcttaatagcacttacaccttttttgactgcaatataataacacacacatatatatatatacacacacgcaacattaaaacacaagagtgtagtttgtcaatgaaacgtacaactggagaagttgtagtacaaatatcataattgcattgcttaaccactaatgacaattaaatcatactcataaatttatttatgtggtcgggtggtgcaaaattaacgtcacggagagtgatgggttaaattttatctaacgaggggaaagtgacaaaggtaccttgtgcccatcatgggcatcaaaaattgaaagttcaaaggttaaattatgcgacagcagaacttcaagtatctcgtttcaatcatcttccttaatcctctctttaataattactaatagattccatgttaagtggcttcttgattagatattcgataattaaaagcgatgttaaccatgttgaatacttgtaaagtgaaaccacacctgtcgccaaccaattcgagttcaagacatcaacttgcgtacgtagttgcgttttagttttcgtggatcagttaaagcattgaatcatgcccttatatgttctacagttctgttaatttattttgagttaaatatgcttttgtcctatactagatttgatttcagttcattgaaaaa

SEQ ID NO: 5375 - DNA, 1471 bp, Glycine max
  Soy_ogl_4356 Gm13:29934530..29936000 Cluster 24
agtgaaatcttctgtttataatcaattcttgatgatattgcatattacaataatgcacattatgctagcttggccgaaaactacgaaattagtactatatccaagttttctttaatgtctttggatcggtccagtttcgcactaccaatatatactgacatttctttatacattgcacaaactctctcaattctttgaaatacattacattatactttttttttatagtaaatattgcaccatactcttctacaagggagattgttataaatgttaaaaataataaagagagagaatttgtgtaattttacaaagggagattagtgtaatttattttaaaataatttaaagttaaccaacaaatttcaggatttcctaatctgaaaaggtattctatttcttagttatactttttttttatctaaagtatttacataattcctagagtacatttagtattttcagtacaaatgagttctggaagtttatgttaggataccaaatttaataattatgaattctatttttatttaactcaggaaattattgttctttgtcttagtgaatattcaatttaacaaactcactcagaacgtctaatgccatcctagaaaaaaattaaataaaataaaacttggaaaataaagagagaaaaaattgacaacaaatactgcttatattttgtgtgtgtgtgtgtgtgaataaaggagtcataggactaaagcctaaaggaaactaaatatagaacagcacagtagaattatcagctaacaaatcaaggttcattgatgatggcacagaagcaaattcctaaactcttatataggaagggtatgacctagattagacatgacaaagatgatgtaaaatattatgatattttttgttcaattccttacaaacccctacaagaagcaaacaaatctggcatggtgtatgtgggcaaaacaaaggtgggacaaagcaggaccatgcttagaaatcttgataaatgagcctccaaaactatggtcaagggcgattttttattttatttttaatgttttcccaccaattttcctttttagaggatcttgtttaaaaacattaaatatggacacacattttaatagagatttggacctgaatttgtcatgttgtaggaaagtaaaaagatcaacccaacatcccgaaaattcttaaacctaagcgaactttgaggcgagatctctttaaattaatataagtactgaaaaattagtgattttacaaaaaaatataaaaagatttttcctctggtaggattcgaacctcattcacctacataaaaaatactaacacactttactaaacacttgaaatttatttgaaattacaattgacaagtcttattttttatttaatgagttttccttttttaattttataattttcaacaaattttaagtatagtcccaccatccatagagtgtgtataaaaaggtatgttatt

SEQ ID NO: 5376 - DNA, 1027 bp, Glycine max
  Soy_ogl_5658 Gm17:12909159..12910185 Cluster 24
ttgtttgccctgaaaggaaggggaagaataggaactttttattaaaataatggatctgcaaatagaaaaaaaaaaaaaaaaaggagataggcatgacaatttccctttttcttttgggcctttgaatgtatcagttaaagcagattttcttttgagcctttgattagctagaacaagtttttggagtcgacaaaaacaaaaggaataagtgtgtttttagtgaattaaaaaaaacttaaatttttttatatttgtaacacgcatatttttacctacctgaactttgttatataaaaaaaaaacaaatcatagatgaaagtaaaaaatggaaaaccaaaaaatcaaaatatatttacctaaattcacccgaatctcaagtgttgcaaatctataaaaatgatttttataatagttatgtaataactttattgactactttttaattgtgtactcagattagacaattctgtttaagttagacttttaataaaaatggcatagaacaatatgttaaattaatccgtaaaacttacaattataatcaccagccaatttagccctaaaattgtgaaaaataaattttagacccaaaattaattactattaattaatttgatatctaaaattgtatcgttcatcaatttaattcttaatattacattttaactatttttttctttgaactcaaatttggttgaattaaatctcgggaatttatcaggaacatttttaaataatttaatttttaatttgacacttgttagtcaatttaatctctaacattaaagaccaaattgactaatacatgtcaaatttgaatgtagttattaaagttatgaacagccgtcaatgttagagacaaataattaacgaatcttaatttcaaaaagagcaatgtttatttttaacgatttcaaaaattaaattaatcgatacttataattttaagaattaacttgttatattacccacgtattagctctgaatcagacatcaggttaagcagaaaaaatcaacaaatggaact

SEQ ID NO: 5377 - DNA, 1035 bp, Glycine max
  Soy_ogl_5165 Gm15:48948087..48949121 Cluster 24
gaaagatacatggataaaaaaaacactaaaataacaaaataagatacatggataaggtgatcatattctatagatacatataccaaacatgcaacttattgcagcaaaatataataaaattatggtatcatgtcaaaagcatcatgtataaaatatataaattataaattatacttcatccttttctttttatttgtcattttaggttatttagtagaaattaagaaatagaataaattttcttgattctaataaaataattgttgagtttcttgttttacttatttctctttctatttcataataaatgaatgtggaaattaattaaagattaaataataaataaagatataattgacgaaggaataacgaatgtgattttgtgaacgataaataaataaaaataatttttttaaaaaaaatcgacggttaaaaagggtcaaagggagtaataaatcatatgatttacactttggtgagttttttagactttctttgaaacaaataatagtaaaacattctattcatccaaatcaaacgagaataaatgctttcttcttcgacgatcaaaggaagattcctgtccaaaatgtgtaaattaaatagactgtgcaagatacacaacatgtatcattaaatatataatttataatttctccaactctcattttattgaaaattgtcatattttgcatagtgggccccaccattagtaaactttgaccagccctcacttaacaagccattcaacccaatccatgattcccaaatggacagtaaatctgatatgagacaacggaaatctagatgattaagactctccaatgccttctattcctctcccccatactttatattattccaaagctaattcatttgtaatttggtaacagtccattcatctgtatactactataaatgtacttaggtgacaatttacttaaccgtattaagggatttgaatttctgaaataccacatcttccacctacatctcaatatagacatcttctatcataaggttattctaaaccta

SEQ ID NO: 5378 - DNA, 1200 bp, Glycine max
  Soy_ogl_2068 Gm06:44077301..44078500 Cluster 24
tgttgtctaattaggacattaattaacatcgtgggattaatatagtgtgtgtgtgtgcgtgaagcatgtaaattgtgggatggttgactcttaataacagctaattgaactcttctaaaggatatgttaggtaccgaatttgaggacaaatcgaggttcatgagttacttcctcaatatcctcgatcacccacatgtgtgtatggttatttttcctatttgcttaggacgagatacgatacgatacgtttctatgtcattatcatatgcagattcttttacacttctgggaccccgggatactaggcaaagtaatcatacgacaatatatcttgccattttgattttgaattaattacagaattgttaggtatttgactacatcaatttcctcggcattcataggaaaagaaacatcttcttgcatattatttacctatacaataaaattgatttcaacttattaaatgctagcattaatgagcttgaagttagcaatatagtatatttttttcatatgtattctcctcctttagaaccaattctattttgaggtatatatatacttatttaagcaagaagttgaatattagtctgccacattacttgtgagagactactctcttcccaatccctttagtaacattcttcaatagtcataaacattttgtcatatatatatatatatcactcaaaatataagtctaataatggtcattaatgatttatcacccaaatagcacaatttttcctggaaaattttctaaacaaaaacattatatgtattatattccgtgtatggccgacgcactgagtggtcctttccaactagtaaataataagaattataaaattctccctttgatctcttgacactgaatttgatttgacgactcaaatttactttgttatatatatttcacataaaaatatagaacaaattttgatttgttatcttatggcttacgtcttaagtttggttttgttagaaaatgactcatcctgatttttaagatccacatgcagtatgcgacataattataaaataactttaggccttaaatatcgcgttacttatttattatttcatacgtgatacgtattacgcttcatgatcacaaatatttgtatattttttaaagcataaataggtttatatatgcacattcatttttttatttttttaaaaaaattgataaat

SEQ ID NO: 5379 - DNA, 1455 bp, Glycine max
  Soy_ogl_163 Gm01:44509046..44510500 Cluster 24
ctatcaactattttttatcctttctaaagaaattttttgacttcatcactgatttgtatacttgaggcaatgagtaccgaagatctaaattggtattaaaattgggttcgtaccgagcctatttaaacataaaattaatggtgtatagattgttagatttataatgagatattgaaaccttctaaaagtaagatttaggctcctaaagaatgtgaccatatcatgggtccggattaaatattaatttaaagacagtttccaattttctatattacaatatatatgatgatagattttaagacaataaaatatcttatatataaagtcatgttttctatgatcgatagacactgaacacttgcataattatgatctttaacgatatatgcactttttttctaagaccctcagtacttgaatcatagcaggcagctaactaatttaagtcgagtcagatagacttatttaaaatataaaacttacttaatatttattttctccataacctaaaatcttatttaagagaaatcaaattatatgctagctactttctttttagataattattagctgcttaattaaaccaatagatgttggttatacgtaatttttattatgacccatatacaatttttcattgatcaattttgtttttgtttttttgtgatgtcatgcatcaataattaacaattgtcttttatgataaacaacggacaataaaattcttttgtttttactaaataatgttttacaagtagatttataatagcttctgcagttaattttcatgcttccgtatcaatcctatatatgtgagtgtggctgtcgtctcatcttaatatttattaaatatttattaaatttgtctaacagcttgtcacatgttaattgttggacagtgtaatatatatacttttttcacttctttttttcttgtttcttagtttgaattgttttttaaaaaacgtgatttgcatgggtcccatggctagtttaactatgtatcattttattcaactattttttttgttagtccattttactcaactataccaaatatatagttgctaagatgaaaaatccttttcaagagttattctatatcacgcacgattaccgaacgttgacgtttctccaaaaataatcacagagctttcaagatgatcgaggatcatccaattatttgtactgaaccttatcaacttggtccttatcaagaaaatcaacaaataaaaccttccattgtcgatctcttttacaaaagcctaaaaaaccttggttgggtgttttgtctttgtttgatttagacaaataattggagacatttcgatcctttccaacgtatgaccaatattcgttcttataatcttgtacacatgacctctagttttctttggggtgtttttttagtttaccatgttgtttggaagtcttggttttattatttatttatat

SEQ ID NO: 5380 - DNA, 1034 bp, Glycine max
  Soy_ogl_6119 Gm18:50890001..50891034 Cluster 24
gtctcagcccattcacttcttttaatttagaaatcgttctttaaataaagattaatctaaaactaaaatttcacttttgtctgaaagcttcataatctaaaaccaatcaaaacagtttcaaatctatatgcctgaatatactttttaaatttcttctgctttcagattttggtttttcattaatcaaataaaagattcaaagcttgttcttaaaactaaataattaaaatcaattaaaataaaatgggtcaccgtgatcgttgagtttacgcatcttgtggatttaatttagaaatatttaatgcttacgtacagctaggtataactggttgcatcaacggggaacaaatttaattaatttcatgttaaagtaaagcagtgtagcttgtacctaaataaattaaatgggccaacaaggtacaacataattaataaatgattagatttcttaaaatatgtcaatagagatttaatttttttactatacgtatagcaaaaactttgttagaaaaaataaatttcgtttcactaatctctatatgtcgtgagggttaatatatgacttttgtctgtaaaaatatcttttaaaaaaatggtttatttggtttaatttaaaccattgaatggatcaactttttttttttttactggtggtaaccgtttttaatgtaatttttcaatactctatttcttaaaaaaaattattgaaaatacaaaaattataggtctcatgttttatctagtaaacctctctttttattttataattttcaataaattttagttaaattaatttggaggtccttgaactatttgtcacttttaaagtttaatgtcaagcgggtaatgataaagtcatggtcaacgaaaatgaaaagtgatgtaaataattaatcaaaagtagttaagattttttttcgttgatcataagaaaacataattcaatacaagtatgctaaaaacaataggtgagaattattttaatctttccattatagcaataggaacaatgacggatctacgttaattaacat

SEQ ID NO: 5381 - DNA, 1014 bp, Glycine max
  Soy_ogl_5150 Gm15:48185187..48186200 Cluster 24
cattgactattttttgcttaatcaatcctaaaaatacatatattatgcaataatgatatccgtttctcattatggtaacaataattatgttctattttattaaaatggtacttatatattattttcacacattgacctttatttcttttaaaaaaattatatataattcttcgatttttatgttaaattatttacgaattatctttaaaataataataatataatggatatcacttatataaggtacatataatttctagattgagtaaaatttaaatatttaatcagtataattatctcatgcccaacacttttttttttttttgaaaaggagagtgaaagagacatgtcatccgtatatgtacggtggtacccaccaattttctttgccccataaatcaaagttatggaattcaaagtcaaaacttggagttggactcaccggctgctatttaaaaatttagtaaatttacacacttcattcttccacatataatataatcatatattcatatattccgtataagagcttatctcattcataattttgagtcaacagatcagttgtctgttaggtgattaaattgaaaacttttgttgatcaaagaaaagaaggaggaaatttataaatatatattttgtataaaaatattcaatgttttaaaagaatgaaatttaattaaaatttaatacatattttaattttaatttacaccaccattcaatcacaaattatcatttaaattattttaaaataattgaataactatataaaaaaatttatgtataatttttttctcaataagaatttaatacttaaaagacataattttatattagaacgattaccatgtagcaacataaaacgagcttttaaaatgtatcactcgaactatggactataccattttagaatatagttcatatgataaagaaaaaaaattcacactcactcaaacagttgttacagacaaaatattatgttcaaacaaagtcagatatttgtaattgtgg

SEQ ID NO: 5382 - DNA, 1059 bp, Glycine max
  Soy_ogl_1914 Gm06:12032925..12033983 Cluster 24
aagatcacattttaattggatcgagggagcatttaggtgatcaagtattttgttcaacaaggttgatcgagacatttattgaaataagttcacaatatttattttgatgagttttacctcaatacttggtgagatttattaagacaagttgaagggttataaaacggttataaaatactttcacaagtctaaatatactttatacaaattattttatacgcatgctaaatgtaataaggaatgaaaatggtatatttaatccacaataaaagctataaatcatgaattatgaatgagaattatatgacgttaatttatttttatcttattccgtttttaaaagatcaacattcttttgtagatgtatttttaatcaatccaagaagatactaaagtagttatttttattaaagtgatttctctttcgatgattttttttgtcaccatataatgcgtgtaaaaatatttactaaatttatcgataactaatcctcatcgaaaaaattgattagttatccttaatagagtttatcattttaattacattttttattcataaattttaaatataaatttttgtttaagaaatatgaatctaatttcacttaaactaacgacatatatattggtgtttcagtgataatttaagttcaaatattagctccataaacacagagaaaaaacaaaatctcctatatacttacttctttgggcattttgactctttaatatgtaaaaagatttttcctagtataacttattaataagcatgccaacaaaatatgttaagggcgaatttgcctttccttgtcccctatctccacaaaaagcagtgcaaagtttgaggttgagttgaagagagacaaagattaaaaagaaattaaacctaatcttatccttgttagattttatcaaattaggaaaaatctgcaaaaaaccatctcacattttttaaaaagtttcaattttttttatattttaaaataaactatatattatgttattaattatgccttaattttattagcagataatagttaataaatcataaagtcttcc

SEQ ID NO: 5383 - DNA, 1034 bp, Glycine max
  Soy_ogl_6019 Gm18:11712867..11713900 Cluster 24
ttgtattttgaaggatcttggacgtcatattttgtttttttactaaataaaataaaataatttattaataataaataacaaaatcattccataaatatatgaaataaccatgctcttccgacttccatgtttgtacaacaacttgtctcctgaatctaaccataattcgagtaagtgcattacaattttccctcctacaccaacactatattgtcctagttagcgttctaaaaaaactgatttggatttgaattgaattataatcaatcttaaactgaattgatttttttttcaaattagttcaagaataaaggagtatactgttttataaattcaaaactgaattgtttctataaaattagtttggttaacggaactgatttttacttttgaatatttttttatttgaaaaaaagtaatttgaaaacgagtttaaaattgattcgactcttaaaactagtttaaaactagttaaaaatcaattcactccagaatcagtgttttaaaatcaatttagttttgaaccaatttttaaatcagtttgattatttggatataaaatcaaattgattaaaacaatttaaaattagtttggtttgatttttttaccaaattaatttttccatacccctagtcctaatctgtgatatttttactgttcaaccttcgactttgtgatattttcacagttcaaccttcaactttgtggtattgttctaattctagaataagacaaattaacttcttttctcttaaatttaatttaaaaaattgaagaagtaggaaaaggaaaaatgatttccctttccttattggaccaaccaggaaaaagagctaagaatcagggttacaacctcagaaacataccaactaattctttagtccattcaatgcaaagataattttgtaatattgtcaatacatgtaacatgaaacgcacattattacgttgtttcgtcatacgcgcgtacacattaatttgttatctataaaaataaaatcatgtcattttcaaaatattatgtatccatgtg

SEQ ID NO: 5384 - DNA, 1048 bp, Glycine max
  Soy_ogl_1270 Gm04:7128012..7129059 Cluster 24
ttgcccccttctccaattatataagcgagttccctcttcaacctttcaagtttttcaatttggattttggaacatagtttttctgttgagatttcagcaagtccagaaatatgttttagctaggtattactgtggaaaacaacttcgtattaaagctacaaaaacaatttatttgtatttttgatgcgtaaaataatttatttatataaatacagggataagataaaaataggccaaacacaaaaaccatttaattaagtcctaacaaccccaaattagttgtcgtatcttgtaattaattaagcattcccgttgaagagacaatattttacatgtttattttcttaaaaaattttatcccaatatataaacctagctacctgtaacagtgcagagggacatgtgctctcactcaatttaatttttataatattattataccattatatttgcaataagttatgttgttgttgtttactttttcattatgttagtttttgagtaaattatatttaatctttctgtaatttctcattttctcaaaatacatatccctatacctttttggtcacaattctctagtacttttctttacatccctattctttttatagatcatgtatttattcatacaatttaagttcaatactaactttaatagtcttttttgtatataatttgttttgatagacagttgctagatcaatcgtgtttccatgtaatttttaatgttttcgggagtttttctccttttattcataaaaataataattaatagtctttttgtgagagatgagagagaaacaatctatattcgtaaaaccatttttttccaataacaataaaatcatcaattcatagaaacgactaaaactatttaaacacattatcatttttttcgtgaaaaaaaaacataaaaaaccaaaaaccaaaataattacagtcattctttatcacttaaaatcatgaaatcttcaccatcctttatatacaagttaagatatatggtaggctattaaaataagttcaaatattaaaagttataatt

SEQ ID NO: 5385 - DNA, 1300 bp, Glycine max
  Soy_ogl_1965 Gm06:152701..15610000 Cluster 24
taaaataaaataaaaaagcaataataaaaaccattgataaaaaagaaaaataaaccaaatatgttttctaacaaagttatcaatattcctagctaatccgaaactaacactatgggagagataagaatcttatccaaactttttgtgtacttatttttattgtctaaatgatgttataatgtaccttttgggtggtaaattaacgtttcgatagtaccatgctacaaagatggtgtacatgatcatcatgtgttatattgagttgagtggggaattaaggatattattctttgcaaaatctgatatagatgggagccatgttcacttgtaactgaacaagtgcgcaccaacttgtgagtgttttaattaggtatgggctctcttctattaaagtggcagacaaagttcatgccccttccctttgttattctctacttttaaccagccatctcaatcaatggcggaaacgtatactatatgatctcgtacagcatacgaattctgtggaccaaccatgatatgtccttttaatttctctcgtcttttttgggaaaaagggtttttttttttttttttgtctagtgctgccactaagtatgaacttcttaattagaagttatatatacccaaaaggttgaaggaaaatatatatatagtttggatttgttagaaaactttctaatcaaaaccgtcaccacactaaatagggcataacttgtaaagagcttattcgaattaatttattaaaaggttctcttaaaaggtaaaaaaaattaatgtacaaatattcatttcagaaactgattcattttaacaaatgttctttgatacacaaacaaacttgatgaccgaatctgtaactacatcactacatgcttaagtctagcataccatgatattctttttccaaatagaacgtttttatatagctgcaggtttcaatttaaagatgatgctgaccctaaatttcgtaagcaacgtgactatctcctataagacgacattgagggagcaacagatagtttattgacttatttccattccatatatatactgcccccaccagattatttaattagtactgcacaatttcgttagttctagggtgcccatttttcttttgtagtttaagcacttatgtagttatagttatgtttatcataattttaaaacttgttcaccttttctttctaggttaatttagctatgaataccactaagcatgtatttaccagctaaattagtgatctcaacttaaattttgaatttaccgttacattaaatatttttggaacttttt

SEQ ID NO: 5386 - DNA, 1258 bp, Glycine max
  Soy_ogl_2315 Gm07:9896901..9898158 Cluster 24
ccagttattcgtgtaatttttttttagaaggcggcaacatcgttattggataaatctgtcgattagtaacaaaatagtgcacaagggattcttgaattgcagctcttacgagtcttacgaaatactaaaattttaaagactaatttcattggaggtttgacaaagagagtggggtttatgatgatatcaatgcattaacaaatacaaatcaaatgaaatataagttgaaatagtatgaacattatatttaaagtattttttatttctctaattattggtacaattttaaataatgttaacttatgcaacttgacttttaacaataaaaaattgacaaccaaattttatattcgagagtcaaatccatatatcgctgagaaacagaaactattggtttcgaggtggttgaattattaaagcgatttgaatttttttgggattcgaattattaaagcgatttccaatttcaactagaacaaagatgaaacaattgaaatcccactgcaaaatatctttacattggattgcttaaagattgataaaaaagtaatcgtggagaaaatatctgaacgtgatcttatagttgggaattggactgaccataaataagttttgggggcacagcttaatcataagctgttatttttatgtgatcaacaactgagaagtctctttatatctacaaacgacaaaggaggggggaaaaacgaaagtaccttagcagaaccaccattacttgtgctaaacaaatttgctaattgtgaagtttcctaatgattgcaagaaatgacaaagttatatagcttttgagcgaataaataaaaagggttaagggctttaaatcattttgtctaatctcaacttaggtggagaattttgcattaggacctgttcgacagtgttttgccagctaagcattttctgctttgatgagttattcatgttagagctagtggttccatttgtttagcttgattaacaagacatttattgatggagatttaagactcgtgtgtgcattggccaataaattgttccagattatctaattattggtgctatattgttaaatgcagaggggtactagaatactaaccagttttgcgtggagaggttcagataaagcttatattcaaggaaagctaaataggacatgccaaatcattactgacataataaggagttgtgtaccgcaccttgtagacccaaggccaacatatatgtgccagattgtaaagaaacctgggttaggccagag

SEQ ID NO: 5387 - DNA, 1000 bp, Glycine max
  Soy_ogl_4121 Gm12:37369401..37370400 Cluster 24
atttcagaatttaacaaatgagtattttgtgttccaattatgtctatgcactatcttctgattttaacatctatgttcatgagcctattaacctattatcacccacgacccatgttccagttcaagaccagtggacagccctcactaaacactgtcattatttttgtttttaagctctaaaagataagctcacggtgttggatatggacactcttggtcacccacccttagggaagaatactagagagtagtagagatatcccaagttctgactgagaattttctgttttctacaggatttttttagacaattttattcaaaatattgtcaaacatttcgcttgtatgctttcttgttcattttttttgtgagactttcttcttcccttacaaatgagaaagtaaaaactagatgtttttgggataaaaggtgtcacgtatgttatctataaaagataaatattagtgatactttttctaatattagatatgataggatgggtccaatgaggcccaaatgaaagaaaataaaatagtttaaaggtgataagataatacacttttttgcagagcatttaacaaattaaatcaacaagccaggctttctttttctcttagaaataatggtggaatcataatatcctagaataaaaagtagtcaatgtcaactatttcaattgccacttttccaggatcttcacgtgtatttttattggcttgaaactattgttgtatgactgacttgtatcttgataataaacagcatatacggtgatacttactaaatacatggaaatgaaggtagaattcaagtgatactatgtatgtttgagttaccttgaataaactgaggcaatgtttgagcttgcctctggtaattgaattaggcaagtaaggcttacatatctgttgcatttagctctacttcataatttggggtgcaagtgatattctcatgatgtgattgaaattgtttgtatttgttaattgagcctttagg

SEQ ID NO: 5388 - DNA, 1200 bp, Glycine max
  Soy_ogl_4306 Gm13:232801..234000 Cluster 24
ttgaacaatatggcctattgttatttctaaaggagctagataaaatatggaataaaaattaaatgacatggaatggaaggatctatctatgaaatttataagaatttgtcatgcggtttatgtgaggtcataagtctcccattttctgcccgattttgggttgcactggcttatgttttgagttacgattatttcatctccttctttagttgccacgatggttctactaccttgccttgccttgcacgatgttttatatgtttatgtaggcggatttttttttagattacaaatggaaaagaaaattagtttactatttgtgtattgatggatctcgccagtttaactgttttctttcttactgatccataggaaaaggataaagtctttttttttaaaatctcttttcattatttaatttttaaaaatttacttttccggtctcaaaataagcaaaaaataatattgtttagttaaatccaaaggactctagcttactaaaagaagcttaatagttagaaatatagtataaaacctatatctctagattgtttagttaactgtttaattttttaaacttgttagttggacgatatgttttatatttaataaggataatgattatagggaaatggattttcatttcccgccatttctttcattccataaacttttgagataataaataaaatacagatgatacaaactttatgaaattaatgtgacatttattatctaaaaaatttagtaatgaaaaaaaatagaataacggaaatggagagatccaaatccagattttatatatatatatatagtcacaagttacactatgtacgtagtgccattaagaataacaattggaatatgtcatttgaaacagaatcttgtctgcaagaagaaaaagggcctggccagaaagggaatgatgctaaagtttatacacaaaatgtcagttttgtcttgaactgagatggagacaagagaagagaaaataggagtataataaagtgtttgcggaatagatagtcacatgcacaattgcaaatttggtttgcgtgtgatttgataacaacagtgtttgctctcatgtttgatatgcctcgatgatttgactcagcgatttggatatatcaaggatacacttctctgccatttgaaattcctctcacactttttatgctatgtcacaccaaaacatcc

SEQ ID NO: 5389 - DNA, 1400 bp, Glycine max
  Soy_ogl_6198 Gm18:56268001..56269400 Cluster 24
ataatgtccacttctgcacagacgccacacagcaaaataattacactacgcttaaaatgatggcaaaaagtgtttttattattcacagcatctcagtatacaacattatgagaatttaatttgattgttaattacatatatgaattatattcttcctcattgaagaaatgataattatgatgaacaatatgtatcttaaactgcatatattgcattgctgcaattaattggacattctcgttgatgtaattgagctataatgagattcttccctgatgtaaaacagtaattggatgatattgttaatatcacaagtgatttacaaccaattttgttttgcacaaatctctcaatgatatatatttttttcaataaacaacaaatacatatccctatattgtaactgcttacaatttgttttgtagatgatattgtttttacccgttaattaaaagtaccaacattcgttgtctaaagatgcatggatttatgaggtagtgatcctatgatagaagcaaggaatatgggttacggtcattatctcttgtattaagcctatcttagtgggttgattctgaaatatttataacataataaataataatcttaaaacatatgtaaaaaccaacataagccatattagtcattgtaattgttgtgttggatatatatataaggccttaataaatggatccatttctcaaattttgtgggtaggtgtgaagagatcgaattgctttctgcaccatacgttttattacctatacctccctgaactttataacttgaccagacatgaaagccaccgaggaaatacatactatgaaattgtttttcaataaatgaatgttcttgttcttgattggattatccgcaagcctatgatttagtttttcggatcacataattggtaggtgtcatgtaatcattcccaatttggttgtatggaatgttaagaaaaatatgaattctggaccattgtgaaggattattttttggctaaaaaaaaaacccagaacaatgtcaaatgcgttccggagtaacaaatcctaaatatacaacaaaactcacacttatggaataacttattcaaagtacaggttattgtttctgaattacctaatatggaattatgaaaaataggttgttccgtaaagggaacgtcacaaacaataattgggtttcggatagggttgttaggtattgtgtgagattgccaagatccacaagattttgcatgagactaaaatgtaacaactcacttgcactcctctctatttatagactatacctccatcatggttcgagtgtaaatgttgaacaacaaattaaacaacatgatcgcgattttgactataccaagctcaatatgcaaccaccctacttatctcactctcaaa

SEQ ID NO: 5390 - DNA, 1100 bp, Glycine max
  Soy_ogl_2824 Gm08:39101601..39102700 Cluster 24
tgggcttaagttatgtggactcaatatctatatcaaaagaaaatccaatcatgatgttttaactagaccaaatttgccacaaaagagtttcaacctacttatagctcattttacaaaaattatgcctttgttagtggtaattacaaaattctattataatcattaaattaggattaataatagaaaaggccaggctaaaatgagttatttctttatatgataaacgtaagaatttactcttacaatgtatatactaatggaagagaaaaatatcaaattaggaacaacattaaaaagggagtaacataaatagctaaagccaaaaacattttcattttttggtgctttgctttgttaccaaagagcttcaaatcagcttcctctacaactggaacttgaccaaagggctgcaaaaaatgtatatccccttacttatcaagggcaattacttcaattggttacatgaaaaattcttgtgcaagaaaatctcatagaatacaaaatgaacttcaatcctacaaagtgtaaacatagaaattaatgacaaaaggtaagaaataattcattaaattgaaactttgtgtgtgtgtgcctcttagaacttaattaaccaaattctgaacaatgaattgtgcctgttagaacttaaaatccaaattctaaacaatgcagtgtgtctcttagaactcaattaaccaaattcttatatctaggggagtgtataaagtggccattaagaacaatacggtgtgcatggatttaaactaacctggaatcaatttgggggttgaaaaccaattctgaactatttagaaaccactttgggattttaaacaccacctttgagttaaaacaggttctgaactgtttcaaaccacttttaaaattgctttctaaattgaggtacctcgatggaaaatgaaccagtttatgatcctttaaaatcagttcaattgtaaaaactttaataacatttaaggtttggtttggttttccagcccaaaccaaaccatgtccacccctaaatgatatatcataaaattgacactaggatttctagcaattaagaaacaaaaatgtagtccatctcactattcact

SEQ ID NO: 5391 - DNA, 1221 bp, Glycine max
  Soy_ogl_3085 Gm09:29896845..29898065 Cluster 24
agaaaaaaatcataaatatactgaatttactttactaaggccgagagaatttcttcgatattactgcatctagctcattcataaaacaaattaaaggtgcgagacactttaattactgaaaagagcatatagctctttttgtatttggacgaaatattgaactaagagaagatgaaattagcatcctaataaccagtaagtaaaaacattacaaattgaaaaataaattggtcattagaatattagacacgagtcatcaaaagattgaggctctacaatggcacactattcttctttttcgctgatattttctagcatctactttaaattttatttatttgtattatggtttttaatttgataaatttctgtcatgtcctacaacaaattcatccttctatcaattacaaatgtaatcgtcttaaaaaaaagtttacacgtgtgaactcactttgctatctttttttcttatttattagttacttgtcaccactttttttttttgttataataatttgtcaccacttaatttggacctttaaacttcttttcaattctacccaaaaaagggggaaaattttcaacgattctcatctcgtcacctatttaccccaccatccatcacttatatattcaagagttttagacgaacacaactacctttatacttacatccattcagaattaatatcccgatatagattgatttatattaaactttcaacaaggctttcgtcctttccagctgtttcatcatcgataaaggatggcatgatcagaaaaacccatggtgggatattcagcatgttttattatcagatagaagaaaggtccttccttttgttacgtatatgaaaaaatggcacctccttttcttgatgttatggaatctaactttctaacgaattcgtcttatgccccgtgaaccaattttcaacggtgtattggtgagataaataaagagaaacaaacgagatattttatactgccaagatgttgattaggatgggtcgtctaaggaggctgaaacatgtgttaaacttaagcggttaaaagattatatcgaattaatgaacttaattaagatattatttcattaatttttttagtttttatttttaatttcctaaacattaaatgataataattgtaggcttgtcctccatttagttaggttattttatttagggttctgcagtgtgtaagacatcaataaaaata

SEQ ID NO: 5392 - DNA, 1015 bp, Glycine max
  Soy_ogl_840 Gm03:4504213..4505227 Cluster 24
caaaaaagatctcatatattgataaaaagtttatatatgttgaaaaagaaaccctactaaatagctacctcatttaaagtatattattactcttaaaaataattttagtcttcactcatgttggatgggcccttctttcatactcccacatctacaattaagtttgtttctcctctatatagaaataaacattacttgtactattacatctccacatgacatcaatgaaccaacacattgcgaccacaacctccacatgagctaaccacaacgacacctctgcaaccactagtagcttggtaaaaagctaggaataattaagtaaaaaccaaaaattacaattaaaagaagttaatagactttgaaaaagacaaagctggagaagaatttcataatgataaagttgaaacaaaaaagaatgagctagtgaagacaaatcttaagatcagaacatcttgaagacaatgagtacttagggacttgggaaaatatgtaaaactttaaaattttagctaagcttgactcaatggattaaaatgaataaaaacataaattttttttaaaaaaaagataaacttaagaaaaaaaaagctttttgattaaaaatattgctctaaaccaaaattgcctaaggaatcgtttcccctggtaggtattgattccaatgtgaaagaatctagtaacaatttaaagaatcaaattttgagcattgttttctcacaaggaattaatcgatttcttcactcgaagaattgattctcacacgaaggaaatgatcccccccttcatggaattgattcccaatagctaaattagatttgctagagaaaaaaaaacttgattttaagttaaactaatatatttatactatcaaatcatataattaaggattttaaaattaattattttgtgtcgtaaatccctatataaagaaatcctttcattaaacaaaatagatagaagtgactaaaaagatgtgggaggtgcttggttaggattgtgaaatattttaagg

SEQ ID NO: 5393 - DNA, 1044 bp, Glycine max
  Soy_ogl_889 Gm03:35987401..35988444 Cluster 24
acctacaataacacttttaatcatgaagctgagcaagaatcaaatgtccatagccgtccagtcatcttaatttctctctcgtgattatgagccaggccccacgtaagtttcattttattttattttattctgcctatgccagccatatatccacttactgaacagaaaaaagaaaatcacgtttaattatacaattaatcaatgcatacatatgtgaatatttacggctcaactagtccttaatttttatttggttatatatatacattaatcatgttcaatttaattaagtttcatcattaatttcattagctatccataatctaacatattgcctttgtaatgtttaaaacatttttttagagcagtgctatttgttacgaataaaaaacagtacgaattgcacgaaataatgacgtggaaaatatctttgttttaaactaaatcttaactaaaaagattaaaatatataaattaaagattttatgaaaaataaccttggtgtagtttttatgaaacttattttcgtacttaaaaacatttttctttttttatgatactattagtaaaagtaatttccaccaaaaataataattaatttgttgtcgagaatcataaacacacccaaaattatatttttttaatataatttatttcatatattaaagttaatcagaattcaaatcatgtacttatttgattttcatccttcttggcttcttgtcatattgcagaagatataatttttttttatacagagcatacaattattttatgagcaggtattttgtccttcatcattcaaactgtttttgtgcagtgtgaacaatttctctttggctccaattgcatcagaattatggatactccacaaacagaaaaaattggcatttaatgcacacttaaaataaatcccctgtcaatttcgagcagtaatttgttgagatcggcaattattttaatcgattatatatacgccatcgccacctcacattagtcctttcctaatcttcctagtagttcaataaaaaaatattgaacacg

SEQ ID NO: 5394 - DNA, 1000 bp, Glycine max
  Soy_ogl_2225 Gm07:6003701..6004700 Cluster 24
gatatatatccatttcttaaaaaaaaaatacatgggttcattttatttattatttactttccagagtctgagtttgtgctaggtgatttttctggcaatcttctaatgtctaaattttttccaatgatagtgtcaatcaatgtcgaggaaacctttcagcaagagttagagataaagtgtctgtgacgtaagctagagaaagagttcaaagagagatattcactagtgagataacattgacacgacaacgagaacattgacatataaacataactaaatggtttagatccattttcctttgaacatgctcatttataagtgtaaacatgttagggtgttcattttctattgagtatcaatgccacgtgaataataaatttatgttgtttatttgaggcttggagaaaatgaaaaaacaaacacacttaatcattggaaaggaacacaatgaagtgaggtaaatgatttcttgttcggcctatttttttcttttacttaaaagctatttttaaatttaaattaaaaacaaaaggtatattatatttaccggtaatagtataaaataattctattaatattaattgtatattatacttactactatttcaaacaatgtcctggactagagtgatgattgcttctcttttctttaccggtcattattccctcatgagtttgaacctgggtataaaaggtactataccacttggtttataaattacaaagtttatatatattgaatataaaatcatatgtatatatgtatatatataaatttgagtataaaatttattactattaaatatctcagttcatgtagtttaatcctttcttatttattatgataagaagatgcgtgtagtttattaatacaagactttgatatttaattattaaattaactagcatgttaaaatgttataatcatcacttgttttttttgctggatatgttacagtactatagtatacatcactcatttggttaattcctaaaacat

SEQ ID NO: 5395 - DNA, 1100 bp, Glycine max
  Soy_ogl_2239 Gm07:6751801..6752900 Cluster 24
atcagttgggtggcaagaaaaaaactggatgcatgaagaaaaagccgaaagaacaaggtaagacggtccaattctgctgggatgtgaatctccactcctattttgtttttattcataaaatctgccttttatttaaaggaatgtcaccatataacacatgaatcaaatgggctggtttttcaacctaatatttcaagttcaagttatggatatacaattatattaaatatttggataaaatttaatcattcataatggttatatttaactcgagcaataatacttttgttttataccataaaaaaggaaagtctcatacttttaaattagttaggaaaaaattgaaatgttatattgacttaataaatttttagtagtttaatatgtttttagtctcttaaatataaagatctttctattttaggctcccaaatccaaagttccttttttagttctcttaattcaaaaaatatatgagttataatttattcattttattggacaaaatttctataaatttgattcacaagaattgagtaattaattttttaatagaaatgaaagttaaatatttaggtttctaattagttgttagcctattccatgttaatttagtagtttgatcctgaaatttctttatttatgtatattcagaatatgagtgtgacttattttaattgatcctattgaaagtacaaatcataaaatggatttgcatgtcatcttgatgaagatgattttatcctgttagatatttattttagtgtatggagcatggaatatagaaaatgaattctaaatatattaaaattatgattcatactaaatagacctcgcaaccgaccttaacccttaatattttgagatcatatctagtattcagagtttacttcaatctagtatcgctcttgtagtttgcaccgaaacaatattttatccctagatgtctagttaattgttacgcctcaacccattttaggaagaactaggttcctctgggttctagtagaactgaatccaaccatgtagaatatgaagatacttacgacatgtattgtaattctggaagctgtttatgtcaaacaaattaaagttgcaaa

SEQ ID NO: 5396 - DNA, 1200 bp, Glycine max
  Soy_ogl_2857 Gm08:41791401..41792600 Cluster 24
tccaataaagacgctttcgtgcacttttcgaatcctaaaagtttatatcttttaaatttcttccctaaatttgtggtgaataagtttgtagactacttgggatcaaggagtggccacactagccattttgtgagttggctttttttatataatttttttggttgaggttaaatcatctgtctttgtgtgtgtttttatttgcactatttacataaaaccacccatatgtggtaagagggtttcttttctattttctgtatccccatttatacataagaatccatgcttcaatacaaatattttagctctttacttaattaaaaacatgactgtagaattctcaattttatttcgaataaaaatgtcaattgttattttcctttttttctcaactccgcagtgagttttataaagagataaataaacaaattaaattttattgttcattcgttagtaaggacattaattataaattaaatgctagctctcaagtctatacttatattcttttatgtatttctgctcttatcatgaatgaaatcacgtaagtatattttcataaataaaaaaaagcatgattgtgaaaaggggtaaaaattatccgcaagtaacattgtaacatgcatatcttatataaattctacgtataaaattacagttgataattcccatcctatatatcctattgacatgactcatgactgataatcattaattttgttattgtaagaaagatgtaatttaattttttattttaagaattcaaaataaatggtgatcttcatctataattatatactataaatttcaaaattacaaatcaataactttcaataaattaacggatgatgcatttgttgggtctcctaccttacgcaaaaaacaactttattagagttgtcaattataaatttaaaaattacaataaggcatgtgtcaaaacgacaactttcaataaattaattaatggatgcatctagacctcctactttaagacaaaaataactttaatttagagttatcagatacaaaactgttatgtgtacgtatagcttatttttagcatcatttaaatcttcctctccttcggttacataagggaaattgttatatgtgttaactgtttctttaagaagactggtgtatgccatactttaatggctgaattatttggccttctcattggtcttcatgtggcat

SEQ ID NO: 5397 - DNA, 1111 bp, Glycine max
  Soy_ogl_3795 Gm11:8087453..8088563 Cluster 24
tgactcatacatagttaaacaaatttagtggtatttgagtaattgataagaaaataaaaaataatatagcgcaaataagagagcatgtgagttgcattaaaattcgttgaacaaatggcatgattcaagaataaaaaaaaaactattaaaagttaattttttccacaaatgtgagttattaataacatgattggaaaaaaaatactcataagagtatacaaagtctttgacaaatgattcaaccctttagtatcttaatcaagattagatgttcaattctctacttgggaatgaaatcgtgattggaggtatcaccttgttccaaaataaaccaatgcaatatgagggagaatagctaaatgtgaaataaaaattataaatacatccttgtttaaaggggaaaataaacttattaagagttttgatgtgtgactcaatttttaactattcaatttttatcttgatatttttcaattgtgccctaatttctttataaaaaaatcattttctaattcttagttattcattttttgtccatatatcttttaaatagataaagtttgattataaattaatgattataaattgtctttaaaagttataacctccaaaaagtaaccccattttgctaaaaaaaagtaggtaaattttaccaagaaggtttaacgtaattagtagattactcggtttcttaaatatgcgtatgaaatagattttattagaagagataaaatatgctttgataagttttatgcattaaaagttaatctcatgatttatggagataataatattttgcttgaagaagaaggaaaaaaagtctgcaacaacatgatgacgtgactcatacataattaaacaaaattagtggtatttgtctaattgataagaaaataaaaaatactatagcgcaaataagagcatgtgagttgcattaaaactctttgaacaaacggcatgattcacgaataaaaaaaaaggggcttgattccatcgtcgggtgggagcattttcttaaatttgtataaattttaatattgattaaactcatctcgatcatatttaaaatgaaaatatacgttatcaatataaaatattaaacaattaaact

SEQ ID NO: 5398 - DNA, 1058 bp, Glycine max
  Soy_ogl_6649 Gm20:1301..175858 Cluster 24
gtgttgttaccatttacatatgattttaaaaataaatattacaaaattcacgatttctagtgatacaattatcgggattgattgataatataaaaaaaagttgtatacttttagtgttaaacaatttaaaagttgatatatattatgtatttgacggtgaagaatcatttagcaatattaaaaagcacacttagtaagaagttgaaaattgttataatctttttatgtagcttgaactgaaattaattagaaggcaatatcatctttatattgttatatgttatattatagattattcatatttctataccaaaaaaacatattgattctaatgcaagacttcaaaaagcaattgaagaactaacttcactgatttattctatttgatgtattgagaagtgcaagaaaatttcactacacagattagaaaagaagattatacttcaaaaacagattgagaagttataatacctcatatgtttacttaaccaattgaactaaactctttcactacactttatttgttgattcaatcccactcaattttatttttagtggtaattctggttttccttttatcataactaattcctaattaattaaattcatgcaaccgcctttttactactaccatcaatgtcaacgtcagcaggaacaatcttagtccagaaccaatgtgccttccatattctattcatttcttcgattggaacattcttggtctctggtaaaagcattgcaatgaagatggttatgatcaccacaaagccagcgaataagaagaagagaccaaacttgaggtgacaaggcatggtaaggaagatttgagctatgaaaaatgtgaagaacatgttcattgccacattgatttaagtctaggctatatatgtcttttttctattatatttataacttaatattacatgaatatagttatgaggtaaaaagaaaatgtaataaatataagtatcatggtaaacacacatttatacttgccttgattttaattaaaattataaatgaaataattaacttttccactccttagtcgtcacctc

SEQ ID NO: 5399 - DNA, 1300 bp, Glycine max
  Soy_ogl_3111 Gm09:35509601..35510900 Cluster 24
tggaaaatcatctaagaacctaacctgcaaccttttgtttcagccttttgcttttatgacttgggagaacaatttagagtggctccaatttaccaagttttttggattccttaagattgtatacacctatatattataagtacgaaagataaaaaggtagagtcatataatatgcgtaaatggttgttcgcggcaaacatttacatggagaacaatagtctagaataaagaaagtgaaagagacagataacaaattaaaaaggctgtgaagtatctaacagatcgatcaggttcataatatatattactgtttatatttttattgaaaattaaaaaaattgccgtggatctaagcctaaatgttaattaagaaagttcatttttaccttgcttttttctcttcaaattaatttattgatctgatatagaaaagtctacttaagctagattgattagggcggggggaaactagttcgctaaaataaatcaaacactagaagaattagtaccctatatataatatgggagataatctcttctccttgtttactcagcattaaaaaataaaactttatcatatttttttaatttaaacattactacatacttatagcacacaatattttttcattttgagataaaaaaattttatatttaattcagtttatttcaaatagatatttttttaactttttgaaagatataaattgttatttctaccttaataaatttaggtttggttctttgtgtggaataggtgggaggatgagtgccaacattgagatgtgtcctccctcccttgatgcttagactagcttcttttaaaaaaaaaagttatttctaaacagattaacgattattatatttctcaaaaagaaaaaatctcaaacataggttaaattaatggagaaaaaatattaaaagaaaaaagattataaacagtaaaacttattatatgtttggttggctacttttataattacagttaaggaaaaaaaatcatttaaaattttttgtgaggggggactttcgtatttagaaagcattttatattattggttaatcttaattgagattggtagacttaatattactttataaagacaaaggattgccagcattaggtacattgcatttcttccttcaaaagtaaaatcacagatcaagtcccttcactggagtgatgagatgcacacaagctataatataagcatacaaatataacttgtcttcgtcttaataattgtatcaattgccaacttactccatataatatttctttctgcttaattaagggttc

SEQ ID NO: 5400 - DNA, 1000 bp, Glycine max
  Soy_ogl_4272 Gm13:26120301..26121300 Cluster 24
tctaaaatgatgaggcacgaacttatacagcaagctcttgtgagaattgtcggcaacttgttgtaagagctccttttaattttcgagcgtccattatcttttgatttttctgttgcaaaagcaaaaccattgtcttttaattaatcgaaccttcaacctcggctttacatcctaacctagagtcattttccttattcaccttctaacgtgcttctgttcttatcgaatgtttggtaacacgtccattacccttcgacgtggatctaatttgtctttgtgtcatattcttgactttgacgtgaatttagtgaattgcaaacacgtacttgcttaatgtcctgatggaacttcggagagattggggaaagatatgatacatataaggatgtcaattatcagggttaatttttttattaagatcaataataagtagaaatacaagaagtacatgaaacttaaacgtcaagtttaaatttgtgtgtgactgtactatattttagtaaataatagacaaattgctggaaaaaattattatacgtgcaaatttctcacgtccacatgaaaagaagctaacaacaaaattctatcttcgattttgtttagtgatatatataaaaaatatacatgacaaatgtattggttgtacaagtaataaagtgaaagtaaagtatcattctcacgtaaattatggtttaataacactatgtaatagtccttcaaaaaaataactatataaatagttaattacacatttgatcaagtaataataaacaaattattgatttttcatttatcaaattagtttacaaaattattaacatcgtttaatttaattcttaaaatgataaaaatatcattttatttcctaaaatcatcaaacatcaatcattttggtctttatattgattacttcagaaacaaacgtaacttccattttacaatatcaaggatcaaaattaatgtcgttttataaatttaggaattaaaatgagatttttat

SEQ ID NO: 5401 - DNA, 1000 bp, Glycine max
  Soy_ogl_5057 Gm15:15206801..15207800 Cluster 24
tatgtttatgattcttttcctttcgaaaatcaattgattttcataattttcatacaagtggatcaaatgagattagtttcaccttgaatcaataaaaaaaattgaaatcataccgcaaaatccaaaatcattaaattcaccttgcatagcatttgcttcatcatatccttgccccataaccttgacaggcttaaccaatattatgtaagcaatgactctaaatccaataactccaaatccaattttaatgataaagcatcagtattagaaatgtgaacaagaccaagaaaacactataactttccctttcttacttgcatgatgtaaagccataaccatttgctttgtaagatatcttgagattcagaaatcaaaatagcaaacaaactatctcacagataatcaagtataactttagtggtttcactagaaatagctctagcgaatctttttgtattataggaattgttaacaaaaaagaaatagctttatcaatatctttaatgtaacgtagatactgttaacttaagatttcgatgattattctttaccacttcctgaataacttcattgtagttaccaagaaaatccaaaagttcaaaaaaaccatacttatttttttggtaaattgtcttgtcattaccacgaaaagctaatccttgacgtgcacaataaaaaatgaatgaaatcaactattgaaaacaaaatgaatttggttttcattttaaatttgatagattgtttatatacatgacaacttcaatacgttgcttttgttcatctaagtttgacaatttgcctatgcttgattatgagaactatttagacctccaacattaacttgaaatctttcatttatctttcaatttgtaaaacacttatattataaatgcattggcattacctttatggtatccaagatatgatctaataagatgacaacataagcaatatattgcaccatgcttttgactatattctaacctaatgtcattttaaa

SEQ ID NO: 5402 - DNA, 1279 bp, Glycine max
  Soy_ogl_894 Gm03:36231201..36232479 Cluster 24
ccatgaaactgatattttttcatttttttcctcccaatatctataattattaataaagacaattattcctatttgaatatacattttcttaaattcttttattctctaactaattctaaaaattaacttttaattgaacagttattagaaaaaattaaataactcctgtaacagctatttacatcttttaattatttttaatttttaatttaaaactaaaaaaaatggtaattcaggtacatagtgcctgtttccaactagtttaatataatgggaacacttaaaatcttgaaaatgaaatcatggcgcacatctttgagcacattcactctaaattgagaatggacaattgacaaagcaaatcaaccatgtcctttacaattactcattaatatttaatcctactctgatctgatcagatgaaaatttagatgtacataatcatatattttctgtttcctcggcatatttcgttttctaaccctcatgaaatatcaatccagagccttaatgagacactttctgcaatagctgctatcacactcgagcctagagtaaggaccataaatagttttttttttttaattaaaagaacctaactcaaagtatttttataattcaaagtcatcagactaaccctcaacgcgtaaaaatcatcaaagtgagtgttatctttttcaattaaatttattctatacccacaatcagataatcaaatttctatcactatattaactctgcaggacattgttagtaagagccttactactttgctgtgccgttggtacagtgatactttctttttttgaggcaaaaaaggaagaaaaaaaatatcactaggcagtctccgaaagagtgttaacgtgttgcaatcaggataaggaagtactttaatttggtcattttcttcgcatgcaattcctgatgacgagagtttttcgttatttgaggattatttttatttcattttttccacttatttgaggagtataagtttataacttccctaagcaagcaatttattgaaaatagaccgggactgatattcaacctaaaaaacttacttgagaaagaagattgtttcaaatcacggttaacagactccttacattaaaggctaaacataggttgacaggaaatatgatttttcgtaaaacaacgcaggtaaccaaatttgacgtaaagactaaatatttgtgagtgagtcaacgttagattaggatcgacaactaactgaactaattcacatataatataatagttgattcgatgattaact

SEQ ID NO: 5403 - DNA, 1058 bp, Glycine max
  Soy_ogl_6509 Gm19:42401801..42402858 Cluster 24
cagcaagaatttaaaaaaaatcgaaggcaaaaaaattccctctcaatatggaatatttaattgcccccactaggatgcctgtcctggcaaaacaaaaccatttggtcattaaactaagatgaacggtaatacatgcaaagaaaagagagaaaatggtgtacaaatcttaaagaagtggagaaagacatggaagatgagaaagagggtatgaaactttatgaatattgcatggcccctttactctgccaaatgtgttttcattcaaattatgcttgcgttaatttgcaattacaggtgagtaaacgctgcatatatttacgtgcttcccttcttttttttcgttaattaatttcaccgaaatctaactgcaacaatatgttgcattcagtgaatagtctattaagtaggagagttccatgatttaagtatactatattaagcttattttactcaataggagactcacaataatagtggattaacgtgtcaaatatgttttaaactttatggtatcaacagcaaatttagaagaatattgactgaaaataataaacagctagcaatttagaagaatattgactgtgaaaataataacaggtggtggtgaatggtgatacagctaacggtgaccatgttgatgaagatgacaatctataacagtaaacagtagtcctagcaaggataatccaatcaactagtgacttgttagttgggctgttttgttttgttaataagaaatcaaaatgtcgggaatgcatgttgggtgttggttggcacaatattataatgagaacctgagaaggactaatatcatattttctaacatattccttttaaaaatattattataagttaaaatttattcaaaactataaaagtgagtaatactcattagacttatgaaagtttataatttttaatatatttactttagtgtatctttttaaaaaagtacgttaaaaaatatattattaacattttctaattataattgttccctcgaatgtataagaatgtgaaatatgtagaatttttttttcttacttttcgactccaag

SEQ ID NO: 5404 - DNA, 1100 bp, Glycine max
  Soy_ogl_616 Gm02:42916601..42917700 Cluster 24
tgcttcaccgagtagtttttcattttctttcatatacacttttttttcctatcataaagagagtatttcatatacattgtttgatcatggcttgcaggtaaagtaatatatttttattttcccttataggcaaagcaatatctcatcttagatttcaatctttactgtgaaacaatttttatgcgccaactaattgatacatatatcattaaataatgtactgaaatatgagcctacagtcacgttaattacgtatatttaaattccttttttcgttttagaaagtttaaggaaatggtattatgaagttatgacgtattacaaacattaacaaatgtttatactaataccaaaacatgacctactaaaatagagattgagtgagaataacataacttagaaactctgaaaaaaaaaacaaacataacttagaaaacatacgtcaaaaccttttcggccccttcaaagcttccagtatatattctatctgctccaatatgaagttatcaatactgtttttgtggaggttgaatagttatttaatttttttgttcttgtgttttcccccataatttttttcctaaaatagtaaatatagtggtaatttctttagcaattgtgacccttcctaattcctataacttatagtagtgaatcatcaatcatgatcactaatcaatcactcaatcttgtatgaccaattcataaacacggtgacaatgcttcaaacttcgaccaatagttaccaaagatcccttgtaatacaaaatttaacttaatatcccctgttttgtagccatttgaccacatatcatcattttggatgaccaataattaacatttaacaaattgattggtaaaaatagaaattgaattggaccacgaaaactctagttaatctcagtgccacttaggatgctcggtttcttggattcagtaagcaagcaatagacatgcttaaacatatgtttccaaaagagactttaggacacaaattcctaacccttttctaatgaaatatttgaaattcaacttttttcacctttcacatttcacctcaaaatggtcatgggcaactaataaaacacacttatcccata

SEQ ID NO: 5405 - DNA, 1200 bp, Glycine max
  Soy_ogl_1967 Gm06:15653301..15654500 Cluster 24
aatttaactcaaagattacactcttcaatcattcaattgtacccaataaattaatagtgtccgaggtttatctcttctacattttagcttgttccactttgagttcctgcaaagcacttattttctttcatgaatcattgatagacatcgtcatcaggccttgatgacaacgttgtttacagcgtgaatattgccatcaagaagctaggttctcaagtgacccggcttttctgctccacaactctccctacttccttcaacaattcagctaaccttttcttgttatcagatatataagattgattaagtgattaagaaaggataaaggaagaaagaaagataaaagtggtgagtttgaactccccaaccgacaattttaataaaactaacaaactaatctttgccgataaagaaaacttctcttctcatcatccacttcaggattttctgtccctagcttctcctccctcatgctaacaacgtactctagaatttgaattgcatcatctagcctgaaatacaaggtcaaacctcatgaggatttggggagaaaagaactaaccatgcatattgtggataatctaaaataactcatacggtttatttggatgagaagaaaatagaaatgagaaaaagtatggataatgatgcttttttttttttttggtttagttgaagaaaaaaaaaagacagaaaaagaaactgaaaaaatgttgacttttagaaataaaaatttaaaaactttattttctttcattttctattgaataaagtgataaagtgattgcctttcttccagatcaatagctacaaaagtttcaggaggtgaatcaaaaagcccaacgggaaagtaaatgcagtctcaaacctagctaacacataaatgccacgtacaatgaaaatcactcattatatttgttaattaagagtagtattagctcattagaaataagctctataaatagagcacttacacattatcatcattgtatcttttattcaatatatcaaatcaaaatgattttctattgcactcctctcctctattttgaactctatgatagtatgatgtatgacctcaacttgttggtgttgcttgcacttctcctcaaaccaattaattcatctgagaattctgataatattttcacatgactgaatgaattatattcatacgagtggcatgactcgataaggcag

SEQ ID NO: 5406 - DNA, 1000 bp, Glycine max
  Soy_ogl_2838 Gm08:40989501..40990500 Cluster 24
aaagtgaacaaaaaagaaattatttaaacctaataataaataccatgagtagtataatacaaaatatgttgctggtgtcctacttgaaagtattaggggcgtttcttactactttatttaaaacaattcaaaaaaaaaagtaacacaaaaagaagaaaaaatatgggtgaaaagtgaatattaaacatcataattattaattttaggaggtttggatttatgtttctcagatctttgtactgaatttaataactctttaagctcttagtgcaatatatttcttatgttgatgaaaaatgataacttggttgatttttccgttacagtcataaaatttaaggagattgaaaacgtaattataaaaattttcaaaaaggttgaactaaagttgcctgtatggggggtactgcgaagtagaaaagcttttaattagttaaaatcttgttactttttttcatgtctttatttattattttccctttcatgtcgattaaccttaactcagtaacatccaatgaaaatcttgttaactttaagtaggaagattatatatgataggaaggcttatttttcttatagtctaaatttacttaattataaacagcgaatttagacaattagctaatgatgacgaatgtattctcattctatttccctaaaattagcaccacaaaccaagccgatgaggacaaaatataaaaagtgtaccaagcgggaaaaactgtttgatttcgttaacgataggtagcacatgttatgttttgtcaagaagtagaaccaaagaaatggaatgctcacgaaacgtttggagacagttttgaacattggtagttcaaaaacattagcagaaaagactgaaagatgtccccatcatatgcctttgggagtcccatgttcatacatgtcacccctctacgattttttttcatgtgttaagtgtgaaattctagccgccccatcttgttagtagttactacattaatgatttgagaatgacaag

SEQ ID NO: 5407 - DNA, 1300 bp, Glycine max
  Soy_ogl_4308 Gm13:27601301..27602600 Cluster 24
tgaacattagtgttgaaccaaccgatcgttattaactcttttcattgtaataacttgaggaatttgaatttgaacggaattgatggtttgacgttgatgcttcatttaaatattcatttatgatcagaaaccattttttctctttcttttaatggtcagtaatgtcaatctcattaaatatttcctattttgtgtagttcattctaattttgagcatgacacaatcgaaacggagaagtaccctatgttaaggacgaggcatgacataatcgatattgagtgtataatcattcatgtatattaacgaatggctaggggaccaattatttgctactcttactaaagcgagatacgccgtgtagtctactctacttctttaatttttcatgggctaatccaattattaactggaattcaagattttgttgttctcacactagtggaagctacgtcactaatcactaaaacatatcctacctagcctactaaggctattctattttgattatctgttgggtgagcttttaatgatgaaattagataactttgatgaacctttttctttttgtttcgctaaatgtcatggaaaggaattagagaactttatttaacagttcgctatcttcctacccacaaatataaatgattcttatattctttattgtgtttgtatgaaaaatcttgattcttatgctcttttcttaagaggcgtcttctaatagtactaccactagtacttcttaattgcttataataattttttgttatctagctaaattgtccttcattactttgtctctttactcaaccaaacattttttttactacttagacttatcaaattagactcctaatagggtacaagtattaaatatagcaaatacccagatataaatttgaatgtgagtattttttttacttttagatatggatatgaaggcaagtattatggacaccccacttaagtcctacaccttttactatctctagttataatatttatttctgttcttaaagcaaacttaaaggtgtatttaatttagatgagagaaataaaaataaaatagaagataaaaaaatgtgagtctgattgaataaaatataaaatttctccccattaaaacaaacacatccctacttatgaagttgctatccttcctttccatcaactaaaattaccttgacttattatctaacattataataaaacttgcttttaacaataattatacagtgacaaactgacaataaagtaatgaccagtaaaacttatctcaaacgacaacttttgtggcaaata

SEQ ID NO: 5408 - DNA, 1000 bp, Glycine max
  Soy_ogl_4377 Gm13:31004101..31005100 Cluster 24
taggatttaccccataataggcatcctttaagaatctcactcaatccaacacaagtttattcacaatcatttatgttttgattaactaaaatatactgggtttaattccttaacatatatccccttcaaacttagcataatgtcctaattccttagacctacaaggattaattaatgcaaacattatatttagaatttaaaaaaaaaacacacattaagaagttttattcttagactcatccaaatataaaacactcaatctaagttgcaactacatatacaacattggtcattataaacacaactttaattaatcattctaatgaccaattagcaaaaagcattaaagaaaaaaaataatttaatctcatggtcataagacttgcattgaataaaagaggatgcaatttcaagtgattcccatgaagtttatctatccctaacataagagaatctaacaatacaaaataagatgataatggatcaaattgattgcaatagaaacaatagaaaataagatgatataatggatcaaagtgattgtaataatcaaggatcttctctcggaggcttgagtcgtcaataaatttattgggaaactaggtttttcatgcatggagatatactcctctgctggaccgtaacattagcttttatagtgcctcaaaagtttgctccccattgtttggtgcaacgcctcaaattttccttgttggtgtttaacgttcaggctcaacgtttgaagccccacatgaccttaaataagaattatgatgatgatttgtgttttaattagagctagccaaatattccaaacactattaaaacttagaagaggtgccttcaagggtgtcaatgttgattctagtaattccccattccggagcacttcaagcgttgacatgtcacacgcctacgacattacaacatttttcctatcatttctaccattttacaacttttagctgagactttcaaaattggggtgtctactataact

SEQ ID NO: 5409 - DNA, 1000 bp, Glycine max
  Soy_ogl_1218 Gm04:4278401..4279400 Cluster 24
ggatgtcatgttcttagagcaattttaatgagtttctcttcccatttaacgagcaggtaacaatttacggagtttctcttctcattgaaaagcaatttagtgaataccatttgcgttgaattgcttaaaaaagtaaccatttcatttatgcaattgtgggctatattaaaaaaatataataatattatattgattttaatttattggtaaatttatttttaaataaaagttaactgttacacgttgcactggttgatatattcgcacaaaaaattagtcatttaaaatataattttttaatttaattgaaatatcccatatatttatttacattatttagtttattatgaaaataccattagaattaaatggtttaaatgatccccttttaattgcattgtcctataataaggattagtttggatcttataacaaagatcaaaggaagtagtacatttttaatgaataaaaattaaatttaaataaagaaatacaaccatcattccattcaactgttaaaaaagaatttgactgcaaaaccgtatcctttgtaatttttaccgttattgactccttttgtaatttttacacgaataactatgtttttacaaatagatgcggcggtaaaaaaaatgtaaatactaatcacccctaaaattttgtgaaattacacaaacagataaagttcaaatacccctaacattttcagtgaacgcatgcgccattcaacgaccaggcatataaatttgattgcaaaactgtattaaaaaaagttccggacctacttaaaagaagaaaaaaatcagggacttaattaaacctttttttttagagaggatgtttaaacttcaccttcgtcctggaaatctcttctacaaatctttcattatacttcactggcggattagttcaacattccccactcttttgaatttcttgaaagataacattaaaaaattgtcacttaccaagttaccataattcaccctcaacaaatgtc

SEQ ID NO: 5410 - DNA, 1049 bp, Glycine max
  Soy_ogl_4379 Gm13:31025801..31026849 Cluster 24
ggaaaatataaacataatattgacaatctccaactaaaagatgacacatatctctgaggcacataaaattttaatagaaaagcttgacaacaagaggtaacaattaataattacataactctcaacatcaaatccttcaaaatgtattctctgcaagctttggtgttttacttcttaaaatttatcatatagttaaaatatgtcttcaaagtagagataggcatgggttcatacataaacaaccaactagaaggttaaataattagaatttagcatgagcatacatgacaagacaaaaagtttttaattcacgtataaaaataattactaattaatattccctccacttgtaccactcaacaaattatttacaaatctaacactagcagtagtataatactcatttacttctcatcattatgcctgttattttaatatccattaagtttaattggatattgactattttttaatttaaatttaaatatgtactattatgaaatcagtatttaaaaaaatgcttaacgactttttggtttatcataataattcttattgtcattctaaagcttatccatgttattttaataagagaagttcaaaagatggtcactagctgatatgttactcctttttaactctagattaacaaatgcataaatgttacatttctattttactttaatgcttgttagtgaggaaaaaaaatcctactctttcacgtaacaacttaagtttcaccaatgctaacaaaattagtggtatgataatgccatacaataatctcaattttggtcaaaagtgcaagaataagataataggaagagcaacctgctaaggagtggtgctataaatgccaaaattgaaggaagatgatgtaaaattccatccataaatcatctaatgcgtaccttgaatattacaacaaaaaactattactttcttcaaaatgtttgcatttgagctttacactagatgcaataaagagagttcatcagttgtaattaagttttataaactagagtctatacatacccctacgtaatagc

SEQ ID NO: 5411 - DNA, 1100 bp, Glycine max
  Soy_ogl_4580 Gm13:39694301..39695400 Cluster 24
cgttacatactaccttgaaatccttgttgccattagatgtttagaaatatgtcatattataccaccaagtgatataaaatataatatttgaatcattttacttttggtctttttaaatttgaagttgttttttttaatctctaaaatttaaaggaggttctttttacttcctatacagtatgagttaaatagaaaaaaatattcataattcgtgataaaatttaacggtgagaatttgattttttattttattttaaatatatttttttatgactaaataccaccaaaatcatatcattaaaaaattaaaaaaatcattaattattttaaaagtcattttaatttttttctgatttgattttgataattttaaactgtcagaaattatattttaaaatttaaaatagaaaatcaacttttaactatcaatagtcagtacaaattgtgaatattttgttttcctgttaactcacatggtaacgggagtaaaaagaaaattatacaattaaaaaataattttaaaattaaaatattaaaaaaataaatttaaaaaattaaatatatatttaagtctataaattattttgaaaaaaataaattttgtgaaaacttaaatgaaagtcgtgaattgaattcgtgagctttgaatatctatttgtgtgtttagactttttctcttgttactgcaaggtgtggcagtagtatagtttaaggtaaaagtagtgatgattgattgtaccattgggagtaaggcaactaggtagaaacagggtggcaaggaaacatttcactatcattttttgttttgaattattcattatcctctctatccaatgacagcatgaagtcgtggtaaagagaaagaaaaaatattgaaaagatgaaatgactgattgatttggtttgcggcatctttattggcactaaagtgagattttcgtggggctgaagatgcgtttgcagtaagatagagattatccctgtctttggacgataaagatacaaaattaatgagtagaaaatttttatgatttattttatgagttatgacgatggcaaaccaatgtagagagcattcccaacatcaccttctttatcgg

SEQ ID NO: 5412 - DNA, 1100 bp, Glycine max
  Soy_ogl_6476 Gm19:40852201..40853300 Cluster 24
tatgaacattgtcctgtggtgctatgatatatatggtgtgtacctgaggaccaaagctattttagtttaataattgttggttgaaacatagggacttcttatcttttgtctctagtacatggtgtgtcattaaggtggaaggttggaggtgtatggtaccgaagataaattcaatcctttaaaattaatttgaaaaaagtgaggaataaagagagtggttatgtttattttatgttattttagggtgagatgggtatttttttttttttgaaggcccctgaagggtgttttgagggggattgacactgggttctatgattgaaggggacgaaataaataaataaataaactttattgtgaagagaaaaaaataagaatttttaattttattacaataacttaattttgtcgattttttcaaaaatatttttcaattattaattttaacttatctcaatttaaagttactaaaattttaattcactcaaaaacattatacgtatatttgactcaatagtttgtatttgtatctatttttttagcagaaaaaatattttgtatgtaattaagtatattattttaataaaattactatgtattttttatggaacatatatttatattttacaatacgcttaaatatttgttggtcttttaaatttgagttattattgtttttagtctctcaatttcaaaaaatattcttctttttaacagaaaaaaatattttttttaattactcctaattgatttttggccgttggaattcataacctctgagactttttaatagtatatagagactaaaaaggattttttttaactaagagactaaaaataaaaaatataggaaacaaaaaccaataataacctaaatttaagaaccaaaattatatttaaatctttacaatatttatatatataagaaggttcttatttattattttattctggacccataaaatgccaaaaccgatcctgaacttaatttgttgatgatgaattctatgccaactgcaggggctttggctgccccataattggtgtaatagggatgttatagcaaaggtgaggcattggcttagcataaaggagaattt

SEQ ID NO: 5413 - DNA, 1100 bp, Glycine max
  Soy_ogl_6594 Gm19:45392101..45393200 Cluster 24
taaatttataaacctttttttctctcattagaaacctacatttaatgtactcatttgtgtttgtcattctcgtataaataataaaattacctctttggacaattagttatactgatacatctcacaaaaacgaaatcttatagaattagtttaatttaagattacaatatttaaattaagttttttcttacaataaactttataataaaatttaaatataagacctcatgaattattcaatctgtaaatataaacaaaactcgcttgccattaatggaactttgtcaggctatattttctagtaactctttgactcagctgttgaattactatactgcacacatttagattattataatgctaaaaaacaattgtgattaagaaaatttaaaaataaatgatgccactttcatttatactgacttgtttatatccaatgcacaaaacaaagtttcatatataatttgataaatatctgtactattatggcttaatagtctatcaaatgactatctatttgggtaacggttagatataaaatttgttgattatcatatattgtaacaataatttatttgggatatacaaggttgtttgcatggttaagaaagaaaaaaagaaaataatcaccagttcaaatttttttttctgtccaaaaattaattaataattaataattattaattaaaaaaaatgatattttattaaaaaatgaaaaagataacacttgcattccacttttgcatttagcacattgaatgagacttgtgcagggagagctttcagtcaaagtatgaactgatacctggagcaacctatgcccagattagcatctattaagaatctgtttctcatgaaagacagtgatatatctatcaataaattttctgaaaaggaaaattacaaaacttaatcctctgctagtttgctagataaagatagacagtgatctttcaagccatgccgacggtgaccaatgcatgagagtttagactctcacttctctaaccaaatgtaatcctcctcaattactggtcacgagaaatgttattcactaaacaataagatttacggcataaagtgccttttgcttttaaata

SEQ ID NO: 5414 - DNA, 1300 bp, Glycine max
  Soy_ogl_2579 Gm08:9330701..9332000 Cluster 24
atatgacacaaccttaaagttaattaacggtaagattcaaatggaaaaatgatttatgatgaatacctgaacactcaattacatgaaagagcataataagggacataatgcaaggggaccgaaattgaaaataagcttaaaaactttttaaaaatctataatttttgtgaacaatggtgaaagtgaattttgaactaataatcccatttcctaccattagatcgataaactctggcttactaaatggacactttcacccccaaactttaggacgacaagtatcataaatgttagtgggttgaagaatttaatgagtttgtcaaagtcatactgagtaacgtgctttgttttagtactccactattatgcatttatagcaaaaagtccacactccactctcttcaattcatggatgcttatccaacattgcaagttgtcgttgacgtttgcctagggctagaggttagcttagcttttttggatggctctggcattcaaaccaaatctgcaacccgtgatccatagtaatgatcaatattcgttcctacaatttagttttgaggtaaaatttggtctgcaaaaatttatttcacagttagtattttttcgaatctaactcttttcatattgtttctcttctcctttttcattttccatttccccttcgttttgctagatctaaaaaggtatgtaattatagggatcgtaaacttatttaattaatggttggtaccaaaaattttcaaatttaaatatgtttaaaaatatagattgaattaaattttattaaaataaatttgtactagtaccaaccaattagttaagagtaaattataaagtacgagtaatataattttatatgaatagggatcgttgactaatttaattaaatgattggtaccgaaacttttcaaaattgaaataaattaaattaagcttttttactgcaaattaaaatttatttaagataagtttgtaccaaacaaggtttaagttaagagtaaattataaagtagtataattttatatgaataatttatctcaaatactttcaatttcattttaaaatatgtgaaactgcattcaataacgatcttttttttaagtacactaattaacgaacttgcaatagtatgtcttacctaatgtctaagcacagggatagaaatgtattttatcagaattaaattttcccctatttgagaatttttctacatttgatcaccttcacttaaaagtttttaattttttttctgaaagaagagccccagatgtgaatcttgatgttgatcgaatcatg

SEQ ID NO: 5415 - DNA, 1500 bp, Glycine max
  Soy_ogl_2860 Gm08:41866701..41868200 Cluster 24
attttgttattaacaaatattagttattagaatattaacttttattaataaaaagattgagctgatgattttttttcttttcccttaatcatttaattcaccttaaacatgtaattttgcaggttaattgtcctttgtaagaatttgaacaaagacaagataataaatagtagtaattacagctttttcttttgatactaatatagcagaattggaatcccaactacatgagcttgttttgcaatagaatcacccattttgcaggtctgaggaagaatgttggtttgcgcagcaaccaagagctgcccccattattaatggaccaaatataaaaattaaaaatatcatttaaaattgatatattaaaattaaccaatagtaaaagattcttaatggctaatttttacaaaatgtaaatattaatggtgataatcattggatgggttaaaaaggaagagagataataatgtgatggccacctctttaatttttttttatgtatttagccacccttaataattaaaattaacatcctagctccgccactgggaaaagaatccatgcatggtcatcatcatgatttatggagatcatgaagatgatctttacgtctaaaagaaaaaaaaactaatttttaattatcagttgaaaaatattcttggtgaaaagaaatgtataatcttctctgtattttatttctttctcagtctaagtatcaaacatcattagatactcatgcatatattattattcaatgttgagtgccaaggtgaatttcctcgatgcttcgggcgttagtcatgcccgggcattacctcatttttcatggctatgaaatttctgttgtccctttctgcttcgttgttgttacaagaattgacacgtacatacagctactgagggaagaaagtgagatcccataatcttcaaagtcctacacactaaaaaaatacatattcgacttcaagttccttgtttgtcaatttcacatggttctttttttctgcgtttggacgatttgtacgggcaataatagtgtactttcaaggacaaaagcatacggtaacgactttagaaaagaaggatccatatgaaattataaaaattaaattaatagtttatttgttccattagcaaatcatatcattcacaattatgttatttatactatattttaatatcactactttcactttattatcatttaattgatcatattcacttaaattttttccctctagtctttcttattataaatttttactgcaaaaaattatataaaatcatcgcataaacatgtctagatttgcatcaactagctagttcccgtggtagaatatagaagatttgcatttaatatgtacgctttttcttgaatatataatattaattatataaaaaatttaagacttaaatatggtttaagcctaacacaggtataacattttttataattatttaatttttattataaaaaatttaggacttaaatatggttta

SEQ ID NO: 5416 - DNA, 1148 bp, Glycine max
  Soy_ogl_1595 Gm05:4912401..4913548 Cluster 24
atagatcatagaagtactatttatctcaaaatttcttcatggggttgggaaggagcttatataggtatataccctacacaagtcataaaattactagacatatatataaagggtacattttgcaaataacatcaaatctagctaatctcacagatgaagatttggatatagattccggatatgctacgatatcaaatttcaataaattaccagggatttgcaaaattgatcaattggattttattttttttaaaaaaaaacgtgtttggctcttccagcttcccttccacaaaaggcaaaacggtttcaaattcaagcttaaaagagaagaatttaaaattttaatacctaactttagaaaactcgacataccatttttcataattttaatttatttatctattttaaaagaaattatagctattatttatattttaattcaaccaatacataaaaaaaataacaaagaaattgaaaataaattcaagagttatgttgtatttttagttaaatttataattttaattttgttaattaactgtgtgtgtgattttctttgtcatgaaaaatctggtcaaagtttgacgagtactcactaattggtcttattcgacaacccaactaaaggaagaaaaggattgtcccatcgccttgaggatgtgccaaaaggatgtgaatcctttggaagactttgtattcctaaataaagagaagaaggaggttcaagacttcttctttaagtatgattgcataatccaggatctacacgtaaggattttgtttgatgacttcacaatgggcgttatttagatcctaaacgtgaccctcttccaacttcatcgatctgaatgattggacgattattcaaacattttgagctctctgtctgtatacttatgtgaaggctagagctactcgaaatagctatttcgagtctctttcttgattatttttgttgtcggacaaaaaagataacaaggtgagtttggttggtcgagatgcctgctcggcctttgtttcgtttcttataagaattttaagactgattattttaaagtgatgataaaattgaataggaggatatatatatatattctttcatctcaatttttactcaatcaaataacttgaaaattatttcactttca

SEQ ID NO: 5417 - DNA, 1030 bp, Glycine max
  Soy_ogl_626 Gm02:43253901..43254930 Cluster 24
tccttttgaaacgctgaagctctctgggtccgcaaattcacaatcctcttcataagcatttaatttcagatttcctgatggttaagaagaatagcttaaccatgtgaaccatctgatatataatcaaattactacctagaaaataccaagggatattagttttcttttatgtcagtcattatatggaaagcaatcatttggaggttatcaagtatgaaagaacaaactatggtactggaagtacacttcaggcatgccctttctagtttcttctgagtgcagtaattcctatcccctaaacatccacactcaccgatatgttttgggtgcagtaaatataaaattgcatacatgatagtataagactagcagtgttttgtaccaagacagttgcatcaggggagctagcaacagattatacgagggaaaatgctacttgttatgaaaatgtttttgtaaatcaatatatgacggagctgattggtttttttttttgaaattatagtgtgccttgatttctgttggttgtaatcatatgcatgctattaacatgtatgtgttcgtgcaattcatgcgtgaaaactttcgtacgcaatagcaatgctcttgtacaagtcatcaaaccctgaagatgatgaggaactcaggatgcttaatatgcacttcatcgatcccaatcaagttgattaaaagaagcaaaggttgcatagtagagtttaaatttcataaggagggatttagtacacactcataacattgaagaacacttgccgtaaaagaaaatttgggacttcgcctctaggcctctacacaaatgggcatacagctctctgacagaatgtaaccttgacttccttcaaaacaaaaacaaaaaaaaaaattaatttacatgtcaacatattaatatgtatgtgtgtgtagattattccgatcaccgtctaaagaaaatggcaagggcgattttatcctgttagtagttggattatgggtttaatgggatacggcttgcttaaagaaatatcattctctt

SEQ ID NO: 5418 - DNA, 1085 bp, Glycine max
  Soy_ogl_3660 Gm11:241801..242885 Cluster 24
tctattactttttttcttctctcaattacacatttttaatattctcttttgatatttggatgtgcatttcacaacaattttttctcaaccatataaaaaagataaaactagaaattgagatgcttatgctgaaaatttgattttgacccaattaaaacccccaaactattatatgaaattggtatatgcatcatggtcatatatattaagaggtttagttgaattgattaaataatatgtataagttattataaactatctgagttcttagtaaaaaaaaaaaatatgcaccatgaccatatatacctaatgaaagatatattggacattttaaaattaatataaaatgaagtaagtgtaattctttcatattaaatagcctatttattttataacaagaatattctccatattatcttcaaaaaaaattaatattctccatatcatgcacgtgtttaataatttagatacatattgacagcgggaaaactgtagctgggtatgtcagaaaaagaagggtggactggaccgaaacaattttagtgttgttgtcattgccatgtcttactggtatgtgtttcgttggatgaaaggaaaatagggaaggaaataaaagtttaaaattcgaattgaaaagaaaataacaggaaggaaaatttaaaatttttgtatctacaaaaacatttttttcatttcgttaatagtatttttttttccttctctattttgttctctcattttctctcctatcaaacgcaaaccatacggtcagccttaccgggtgtatccttcttccttgtgcctccttttgcttctgtctctctgacttgggtggtgatattttgataacctttctttcttttatctttgtttttatgtttttatattgataaatgccagttgctgatggtaaattttttgttaacaagaaattaaaaataatgacattttctttctttcttttttttttatcattaaatcaattttataattccttaaaataaattgtttttctttctgtatttttctcaagttgtcaattattgttaactttttccctctgacttttcacagtacagtacagt

SEQ ID NO: 5419 - DNA, 1400 bp, Glycine max
  Soy_ogl_4417 Gm13:32976101..32977500 Cluster 24
aacaaatatgcccttaggagtttttcagcaagcattgaaaaaagaccatgtaaataaaaataaatgaatatgttaaataaaggtatcccacaaaacttaacactttctttgacaaatttaattaaattgtaaatatataaatgaatacgttaaactgtattaaaataaatggctacaaaaatacacacgtgcttgtttaatttgctattaatatactactttcgcctttacatcatcaataaacttaatttcctattcttatcctatctttttatactatatatattatttatttttatcatcagacgagtactatttatccttaagagactaagttcgcgcaaatatgagaaaaatgacaaagcaggaagtaagggaaattggcttttgtatgtctctgggatgatttttgcaacttgaagtcttgaactgagacatccctggaatgtgtcgaattcgaaggacataacataaccatggaaaagctactgtgaggtaaaaacgtcacctatactattatctttgtgttttgacaggttatggcattccataagtgataccgtaatatttgtttgcaaaaatagtggaagctagaaggtaaaatctcacgacatcaatttgagcaagaaatagatttggtggcagtttcggttaacattatattcaggccggtgttttattagctagcatgcataatattagaagcatcgaccatgcttgtgttacgtgtctttcaggtgttaaccctggttttgaaactctccttatttttcttctatcttctcattgtctaaaattctaaatcctaagttactaattataataaaagcttgttagttctgttacttcaatcactattgagaaaatttgttatatcttagaagacttacacattagccaaaggcaaacaatttatgtttaaaagagataaatatgaatatagacatgctaataatctattttcgtctgtcgtagaacatctattcagcatcttaattgatgaactataaaaagtggttaacgcaataacataagtggctgaagaaattttataatgtaaatagtttgattgatcaaatacttatatataaaataatatttgatacttctaagagttctaacattaaatttatactgtaatagactatcaaagtaaaagcttgattcggtaagaaaagtttgattatattaatgattaaattaaataatgctacaaatatatttgaaacaaatacaataaattatttctgtgtaatttagcctatattttacaaatgttatacttttcaaaccgtctctcatcatactgtacttccaaccagtatatattactatttgaatttttctcttattgttctttttggtagctacaaattttccaacatgtgtcatcaagtgtt

SEQ ID NO: 5420 - DNA, 1020 bp, Glycine max
  Soy_ogl_4241 Gm13:23835001..23836020 Cluster 24
tgcgtggagggagagatgctacgtttcatttcatggccatggcccttttggtttctttctcttcattcataatttagcgttgccttgtgtttttgtatttgtaattgtattgttggatgggatatgtttttagaaatgaggttgatgtcaaaaggagtgacaaaacaatcttccacgcgttggaatgttgtgtcccattgacgccattaccatccatcattcatccctttgaatttatcaatcttggactgccacttgcaaattagaggcaacccacccttctcatataaacattttttgtctctattttttaatacttttcttttggtttaattgtatttatttttccttgtgggtgtgtttggtttatgaaagacatcaaaagaaaaaaaaaaaggtaaaaaacataataaaaagttttatgatttttatgttgtttgagaggaatgaaaatggaaccaaagagtttttcttttcctcctcttgtttttgtttgtagttctctctctctatatctctttattcttctaaaacacaggtattctatacaagaaacaattctgtgaatcatgcaggacgattataaatgataaagtgttctttctaggtatttaatgtaattgctttctcacaattttaaaaaaaaaacaactgattttcctctttttgtttataaagaaaatagaataagttttcttttatctttctattttctttataagcaaaagtaggatagagaagaaaatagaggatatatatataggattttgataacacgtacacacttttggtaaatatttatgagatttgttaatgtacaaagtcttattttttagaatgaacgcggtaacaagctataattaaaaaatatcttaaaatatattaataatataactgattaacacacacacttatactaaaagataatcatgtatatgatatataagattcactcgtgattaaggaaagaggtgaagggaggttgtgagatcgaattcttccaaactaatatttttaaca

SEQ ID NO: 5421 - DNA, 1159 bp, Glycine max
  Soy_ogl_5363 Gm16:29180001..29181159 Cluster 24
tgtttttctttttatttttttgggtctagcagaaatatacatattcgatctgtgtgtttagtgctaacaagaggaataatgaaacattaagacacaacagatgacagttttcttacagagaccaaaggaaccgtgatctttcatagatttcctacacaggagtcaacgtccatgtcctttcgttcttacggagtttgtggaatatgagcaattatcaattgtatcagtccttataataataataataatatgaaaaagaaaaggaaagcgtgtacattgttttattgtgtgtgtgaaaagcaaggacaccatcagaacattataggcatcaaaatggaccacatgttggaaattctccccaacattttgcgtgcctctcgcccaatgacatttcccttttctatttcaccactttcgtacaaaattatattctaaaaattagtttttaaaatcaataagtgaaaatataatcaaatagaccctcaagaataaaaaagaagaagaagagaactatatctttgggtcaattagactagttgtgatacaaaccccaatttggatcacaaattcaacatctaatccttgaatttttttaaggtaattttctagaaaaatatagaaatcaaaaggataaaatagattgaaatgagaaatgatagaacaacgtcacatgaattgataagttaagatgaaaatcaagggtaatcctaagaatcaagaaagaatttctctcacaaaatttcaaaattttattttaaaatgaatctaaactaattataaagttaatatttttttattatacatagactaccaaggcacatgactaaacatccaacaataaactaaaaatattaaaagtcaaataaattaataaagaggcttaactctaatacaaatgataaggtctaacaaaagttcaaatacaaaaaatgtataatttattttcttccaagtgaaactcgttatgtaggtcttcatctggtggcttgttttataaacatatctatagggaatggtattgtatacgggcatatgagggtgtatagatacaaattacaagtgacaggttggatagttttttatgtcatggattgggagaggatagatattagttacatcactatggtacttgtttatgtagcaatcttttgtaagagtt

SEQ ID NO: 5422 - DNA, 1419 bp, Glycine max
  Soy_ogl_6398 Gm19:36490714..36492132 Cluster 24
tgttgtgccatctcccaaacattctttgaatttgtgaatacgtactagatctatcacaagttcaaagaaaatgaacacttggaaactacatctgcattatgagagaaagtacagcaaagtcacatctgtttgtctgctgtgatgatttttgttctttgacataatataacacagtggctgaatgaatgtgtcaatcaagtttgctaaacaactagggacttagcccacaccatgccctctttttagacgtagcttcttctgttgcttaaaaaagaaagcactattgaggagtttgagactttgagttattatacctaacggtttctagaacttgttatcatggcttgagagaaacctttcactgataattatagcctacagtcccgtatgataaggcagtataactaattttaatccaaacaagctctaaagaattagagtgtgtttgaaaaaactttttttttctagcatggctaattttaatccaaacaagctgtaaataattagaatatgtttggaaaaccattttttcccaatgttaatggacgttgaacttaatgacatacaatatttgctcattaaattattctcttcaaaagtattaatgatttttatgtatttcatcatttcacccatttaaattaaataacgagctaatgaatctcttttttttttgccattgaacttcccaattaaactttttgtaacattcataattattcaatctacagtgttcggtaattcaaacatactattaatatgttttgtcgtttaagaaaatatatcacaacagattcaaaacagtaattcaaacagactattgatgtaaattttgtcgttttagataaatataccattgcgtatttaaaacaatatgtcaaacgtactattaatatatattttgacattacgaaatatattaggatttttgaatcagttagaaatccaagaaggaacgttgaaatcaatccttcctctcatgctttttcgttcaaccgatttcaaatgagtgcaaacaataaaccattgcatataacaagtcttgtttatttgatttattgtttaagaattttattttttttaatcctagtctctactaaatgatcttttaataaaacgataggacattaatggaatgcgatgtttaagtattttaatgtaaaatgatatgatgaaatgaatacacttctatgttttcataatcaaaggtatttttacattcttttaaaattaacttaaacgggagatatgtgacaactaggaagagagtagtagttgattggtgcccacgacgaaaacacagcgcgttgaaacaagtcctttttatatagcatcccttctaaaagctagcaaatggaaaatagtaaccttcaaagctgcaaagatgcacgtttttgtatagctgtctttggtgttaac

SEQ ID NO: 5423 - DNA, 1000 bp, Glycine max
  Soy_ogl_3275 Gm10:199501..200500 Cluster 24
gttaaacatttcttatttaatttttaactgcagagcatcttgtggacgtactacatcgatcttctggagttaagaaacaactccacagtggtgcaattcttatttaacggttttacatttatttgaaaaaaataaaatgatcaccacatacttaaaaatttatctaccattaaacatttgctgcgtttttggtagtttaattttaaactgcagagagcatttggttcctttaattttggactaagatactctggagttaagaaacaattgcatagtggtgcatgattttttaagtacttatgtgatcagtaaatcgtttttaatgctagactatttatatatagttatatgtttcaattttgatgtttttaagttcttaaaatataattattcttatttgatgcaccctatatatacataattacacatacaagaaaagatgatttcatcaatattaatagacaaaagtggtaattatttatatctcttaatctaaatttaaattctgatattagatatgaaataaatcatattcaaatctttaatgtctagtcacggttatgaatattattattgcttgcaagagcgaatattttgtatcaatataaagtctgaaaataaaaaatcttttcactcgctttcacgggagataaacattatggtaggaagcaaatcaaaataattgcactctagagcattaatatctcttctttttttatgctgccattcaagaaaaaaatctctcttttatgcagagcattaatatctcttgaaaatatatcagatcaaataattaatattttttatttgtaagaattaaaaatgataccaaaaaatttataacaattacatattctttttgattaaataagtcaaattcttttggtggatcaaagataatatatgaataatgaggtattaaatctataaaaaaaaaagagagagatattatgatatataaaaaaggggaaagtgatatatggcaggttgttccgtgtga

SEQ ID NO: 5424 - DNA, 1000 bp, Glycine max
  Soy_ogl_3004 Gm09:5024801..5025800 Cluster 24
ctcccaagccatttcttgcaaactatcatgcttacatgcaaaattatcgatagagaaagttataagagttttatctttcaatctttctaacccataaagcactgaatcatcaccttcattatctttcaataaagattttagctcacttacattcaccattatattcgatctaagaaagaaacgtgccagatctagaaaaatctcttgctctttgtgatctagaccattgtaactcagtttcatcacttaaatttacctttgtaggaggaattcttataagtttgtctagcgtacgttgaaatggtattgaggaagtcaaggtaggaaaacaattttccagaagtggcagatgtcctcgaccctgaagctaacaaaataatcatactttatttgaggagctacgttttctgacatggatttttcctctacacccttctgtttttgaaataactgacagacaaagaaaaaagaagagccaaagaaatacaaaacatttaatttccagaacaactcaaacaaagtatggtgttgcagtggaacatgtacacagtggatctttcttaatttgtctctataccggaatatgtatgagcctcaaggtagatataactggatagagaaatagagttagaaattatgtggaaaaccagtgtttataaaactgaaaattgatatctaatactagttgaaataaggaaggagaagctagggtgtcatattatggaaaatacatgaatatatactagctttttcatgataagaaagctttcaaattaagcctcggttattcttctcttccctttaatcaaccaaaattgaataattgatggagatcacagtaacaaagtcatttgcctcgaatactatatacatgtctgccttgcagtttaagaagcaatttcactaataaattttcaactaatgatggaaaaaggaattgcttttaacctttacagcctaaaagtccacctatatattttttattcacggaaaccaactt

SEQ ID NO: 5425 - DNA, 1300 bp, Glycine max
  Soy_ogl_5191 Gm15:50404401..50405700 Cluster 24
gaaataaaaggatctggattctttcttgtgggagaatctaaatcctactagtcatgtatgaaaaaatctagtaagtattatgtacatgtatgtgatatgaatgtttaaagctcacttgtgaatagattactcatttgaattacattagtaaccattcaatagctggcatactagagataacataccctgggcaatgctaaggataaaagaaatcaagaataaactaactccattgtacaacaccttcattcattatgccatattagcgacccaacaagctcaagacattgagaatgatcatgtgaaccagttaactaacgtaccgcaggaaacctagaaaacccacatgttagcatacgacttgctacaacttgatattcactagcacaaaaggaacatgtgtgcacatcataagaagaaaacaagacacaaggagtagtatatcgccatgattcagtgctatgagaccaaaaccacacgatgccaatttccaaaatcatgaaatgagaacatggttaacaatgctcactgacgtattaacaaaggatatcatgtgattaacagttatagccacagcaaatttactatcactgtataattctatagatacgtgtagaaaggctcaaaggttcagacaagtcaatcacccacaaaaaaaaagttattctaccaaacatctgccacacaaccagaacactcttttcaaaagatctttgctgcacacatggaagacaaggttagagcatgtgactggaaacaaagaatgttctatgcacatatactgatcaaaccgccaatattatatgggtttaatattttatcgagcaaatgacttgcaacaaaaaaactcaaccaatgcaaaacagagaagctaaaggcaggtttttttccaaacagattattaattaccacagaatgatgagaaaaattattaaattaaggaacatcaaaagcataatcaacagactcagaatacattggcctttgaatgttcaagttctacagcaaaacaaaatttaccaaaagaggaggtgggaaatagattatcttgagcacagaagctttgcaatctcaagtttgagatacaaataaaattaatcttcataaccacatgtgtaatttgtgactgcctacttggttttggctaccaattgtgtagttgagtagttctttgtccatttttttttgttggaatcagtcctgaaatgatgaatcatcaaagccattggtaatgtctgcatattcctggttgatttcatttaataatggtttttgggtcttgaatttcttgtctgattgc

SEQ ID NO: 5426 - DNA, 1300 bp, Glycine max
  Soy_ogl_2703 Gm08:15472901..15474200 Cluster 24
aacttgacgacatgaccatattacattattgaaatgcctcgagaaagaccaattaaaccgttagtttcttgggttttgtcataaaggttagattgagtgagataatgtcggagatatttcaaaattcggaaggttggaagtgttcaagattcctatgatctcaatgtttaaaattagccaccttttgtgttttgtcttcttgttggttctatatcgttcctacttcctatgatacttttttcctagtgtgtattttatttgaagaaacaatattatacacaagaaagtatgtgagaaaatttgaaggagggtgattacgcttgtcttctcgtggttctctctctttaattaaactttatttttaattaataaggaggtctaacttgatgaaataatgtgagtgaattaatgtaaattttttaatacctatcttttgattttctacttccaccgataaaaaaaaaaaaaacttcattcttaattagacgttaaaaagtaaccgaaatgaaattaactaattaaacatagagcatataccaaaacattttttgttgtgaattggtgacaattgataattacattgattgattggtcattgttccctggtgaatccgattataatttctccccacacccaaaaagaaatatccccctatattgcttaattactgtcaaaatcacagtagaaaatgattttgagattccatgtgttaaccaagcagagaagggaattgtaaccgcattattttctatactttttccctgaggtcttctgatgagaacatgcatgtttcatgaacatttccaaattatgattataccataacatatttttttaaaaaaaataactaaagtattagtgataaaaaaaattcgtcactgaattttgtcacttatacataaattttttggtggtgcttttgaaaataatcttagaatgacataggcacacatatagccctggcccttccaataataagcttattttatgcatacccccttttgctttctgttatttgcgttgattattgtctttcaatcattcattcatctttgcaaattgcaatgaaacaaagcagatggaaatcccaccaaagtccgtactcacagctaccgcgtatgctccatacttttccttaaagtgggtttgcctttgtttttgggccgggtaggggggtactccaataagtttctataacaatcagttgcagaaagtttatctttcttatgggccatattcagattcatttcatattcgtgtgccttttcttcacatggaagtcaattacaagaggagagc

SEQ ID NO: 5427 - DNA, 1186 bp, Glycine max
  Soy_ogl_5145 Gm15:47940315..47941500 Cluster 24
gctaccaatttcaattggattggaatatgtctcttcaagatatgccttctcaaaacttttgggtgtgaagttggaagacacctttattctgtctcttctgctgtattggtaaaaggggagaaaggtatatgatattggaatgagaatgtttctcatttttattatattttttgttcagcttacaatattttactcttttccctttgttacaggatctaattctttatatgagaatgtggtgcttaacaaaatttgaaagtgccttgcccccttaaatttgttggcattttcatagattgacgttgaataggatattaggatccctacaaaatctagagggggtaaatcttgatggcattggtccgcattgtctttttctatagttttctaagaagactctaatcacttatttaccttatcatcagaattctcagacgaattggtttgaggaaatatgccaattaactatccctaacaaactattaagaactaactaatatgtctaactaatcacactactcctaacatacctcttgttctttctcttacaataatattttggataatatttttcattggcttggtttctcttttgtgttgccttcttcttataggttataatttgttcaatttggtcagcttaggtgtgtaaagtaaggaaattatctttattaatttggcatgcggttgtcttgtttatttagtttctaaggaatgatatattgttctataggaaaaaagcatgatattattttcactcaaagttagatctcgacatggattattgagaaaaaaaattacaattctgatttttttttcctgacttgtggctgatgcctttctgtattcctctgattgtaagcctaatggtgtaatggtttacatgagaataacccttatatatactccctcttatgatatctttatctttgcttttcacaaaaacaggtaataaaatttataatcatttataaaataaacattttcttgagcccttaattcttttatccgaaaattaacatttaaaaatattatattatccataatcatcttttaatattatttttctttctgtttctctatatcatataatctatctatgcacatattgtttccctttttaatcctacatcatatctctcatttttctatgaaacgttatacgaatatactgtacaagtaaatt

SEQ ID NO: 5428 - DNA, 1000 bp, Glycine max
  Soy_ogl_5603 Gm17:9221401..9222400 Cluster 24
atccactttaattaggttcgtagattgaagttattcaaattagctacagaagctttaacaacgcattatttttttttttttatatttctctttaatgcacattttatcagatgttttgatatgtctaatcaatgacttgaatgatcactctatttggtgagacctacgacatgcattttatttaataacaaatagtgtgaaaaaatgttactactttcgccaaataaaataaaggttactactatttttttttttttgtttaatccaaacctttccggctaaaagttctcctaatgtttttcccatttccaaatatggatggaaagttcagtaatcacaatttagaaattatcctaatcttaatcattaaaatacaattgcagctaaccaactgaatttgaaataaaatagggaaaaagtattatattttaagttttcaacaacattagtttgtcattttcaaattaaaaaaaaatgttatattattcctgcaaacatttttttctaaacatttttattgtcactcttgagaaaatacaatttcagctagcctaaggaatttgaacagggcccatcttctaatccccgggtacgtgaaaaggtatgttattaattacatattaaccaagatataattcatgggcaagagctttccttctttaaatttgcccaatgagcaagggagaggggagtgggtgttctcgacccatatgcacgtgaaaagggggaagaaactgaaagaaccgaatccaattcgttaattcctgttcctacattcagttcctagttggcaactattttggtcatgctttggatttgagtataccctggctttttaaaatgctttgtcatagtctttgttggaacaaggatattataataatcaaaccaaacacatgaatcaattaacaaaaaattatttaatttaactaaagattaatttcaagtttaagttctcagcatatagtaattagaaaaattgtcacctataataatttta

SEQ ID NO: 5429 - DNA, 1029 bp, Glycine max
  Soy_ogl_1328 Gm04:39841601..39842629 Cluster 24
aagaataaacaaaaaagctgctaatagattaatttggggatgaccatctttttaattgaatacatgcaatatggaatatatttatgttatacatagaggttgcagttttagtgattttaattaatgattttgtcaaccaaaagtgtagattagtctctcagaatctatgaaattatctttttaactagatagtactgttttggcatattgaacattagattggatccataatccatgcatgtaccgggtatatatgggtatcaatgccctcaatgctacaagcaagcatcaatttgtggatactggaccaaaaaaaaattgtttctaggaaagtgacaatcacattttgtgggcaaaatatttttccttgattcagatcaaacatcaaacagtttgtggacaaaaccaaatatattgcaataagaaaatgttaacagaatatgaaccatcatgaacaaataaacaagtgcatatttcatatcatacaagggaatttctgactatacgggcagaggaaacctcatataatgtgaaaataaataaataataaactctacaaacttcacggtaacaggtactggggaaatcagattcacatacgaaatagagaagaaagaaaaaaccaaaccaagaagcaagaacaaaacaaacctgaaaaaacaaccaacgaacactagaaaagtgaagcctacgaacactgcaaacgtaaagctataaagatgaattcatgacataaaatgatagaagttttgaggggttttcgtggagaggaagagcaaggtttgttaacttgctttacgtttcttgtattaacgtgtaattataaaatttcccattttaattataaaatatccaattaatttttcaagaattttaaaactattttactaataaactattcaaaagaatttcaacttcgattataaaaaaaaaaaaataacagaatttcaacttctttgaaactcatattccgctaagaaaatagtgtaccaaacaaaactaatattttagtttgggtaagataaatgc

SEQ ID NO: 5430 - DNA, 1062 bp, Glycine max
  Soy_ogl_2708 Gm08:15680601..126 Cluster 24
aatcaccatctacatagttggtgattagctgtgaatcagtgatcttctaaacaaatgtggaccctaacttagccttttgcttccatattttgtgaccaacaataccattttcttgaccataacacacaaccagctcatttatctttcatctcaaccatattggatacatataattaatcaccacacaaaaaactccatttgtaaacttaattaaattaattaaacatggttgtgcctagtccattgcttctaacctaattatttgatggctcatcctcctggcgttgcacattaattgattaagatctaattttgtctgcgacaattcctacaaatcaggtacacggggtgcttgcaatgtggatattattatttttttttagaaaaaatgtaaattatattaaacccaaaatgatacaataataaacgggacagctagaaaaaatcaaaagtctccctaatacaagaagacctatatcaagatgttaaaacaaatgcaataggtgcgcttgtctatacataagaaacttaatcttactaataatctatattacagaaaattgataatcttcaaaaatcaacttgttcctagatagtcagatgcattagactttaattgttatagccggacaataaaattttccttgaacacctgatgtggatatgcgtgtgttttctatattcatattttgcatattgttaatttgcaaatgatgaaggaataaactatatgttggtctaaatataaacattacaatatttgtttaaaattaatttgtaaacagctgagctgccaaatgttttcaaactttcaagggatgatataagctagtgtgtaagctagaattgaaaagcatcgttggacagatagaaaacacataaaaaagggatccaacataaatgtaaaatattgaatataaggattgggagtgattataaattggaaaatttgcagaaaaatctttctgcgttgaaataacccatatttttggattaataaaaaggaatggaacatgacaaaatgagtagaacattattgattgttatgatttggaattttaa

SEQ ID NO: 5431 - DNA, 1001 bp, Glycine max
  Soy_ogl_5986 Gm18:7709901..7710901 Cluster 24
taaaattataaggactagtttcgtgtgttaattaattaaccattattagattattctttgattctatttgtaaatggataaatatttgaggtttgtgtctctgaaagtcttccataaaacatgtggctatatatatattccatttacaaggctaaactcaaagaggattaagtcgaggaatgccccccaatgatcatgttcaaaagtaaattcgggaaaataattatgaatttgattttattaaggaaaatggtatgaaacaagatttttagctatttagtttcaactctctctggcttgtatatagagtgattaacaagggctaattcaggagaaacaaggcagaaaataattttctgatagaatataattctactatgaaagtgattaatttggttgcaaagtattgccttgtgttgcattcagatcattatttattagctctaccgtaaattatagtcaagcttatattatataaaacttgaggttacggttatcaataatgtcaaaccagcacagataaactaataaacagttaaattatgtaagtagagatgttgattcctattccagtcaaagtagaccataactattttaatttacctttcttgatattcttgtatataggaggatacaattgatgacaatccaatattcaatatggcctgaaataaaacctttctgcaaacttagccacatatatagctttctgtttaatatcatgtggagctttttggatcaactacacttccctcttcatcttttccttcctattaatattcatggtgtataaaacacaatattcaagtaatcacataccaagaatcccataaaaaatttgccccagggccgaggaagtttaccttatatatagggaacttatatcaaattggtggctccctacataactcctgagaaacatgacaaacaaaatattttttggattcataataaatattcttgtgttcattttctgtattttttttttttgcattaagtct

SEQ ID NO: 5432 - DNA, 1400 bp, Glycine max
  Soy_ogl_424 Gm02:6841301..6842700 Cluster 24
aattaaattactataaatttattatttcgtatattaaatacgtgtcaacgaagttaaatcggtttgctgtttttacaactcccttttagtttaattttagcaacagcgctaacttacataaatattaattaattaaattatagtacattgtaatatatcaatatttaaaatacaacaatgacatctttaaaaagtaatctaaactcccgagtgatgtttcacatgaaaaatattttagagacctaaacatatagtacaagaactatgaaaactttgttctttgagttttacatagtacaaaatctttttaaggttttttatttgaaaaagtaagttatttttgtatattttttcttcaaaaaaattaaaatgagagtagaaaagtaaatttggagggaaagaaaggaaatttaaaacaagtcaattacaatgattaaaatatttatacatgtttttaaatttaaaattataagaatgaaaaagtaaattaatatttaagatctctttcatgtttttgtgtattaaacaagatttgttttacctccctcttcattaaaatctctcccctccctttccatcaattaaacaaaatctcttatcaaaattcattcattctctctcattcccttccctcagttgttgtatataagtgtggattttttttaatgtagatactcttctttttttataatacgagcgtattaacacgttatacttttaatgtattttaagataatctttaatttaattataactttctaatacattcatactaaaaataaaagtatgtacattaataaattctatatatatttactaatatacatacacttatattttttaatatgaatacattaataagttataactaaaaatcatcttaaaataaaagaacatggttaataaatgtgcttttaacgaaattgacagcaaacattgaggtatgaattctgtagaagccatctttgattaaatttggggaaaatacacgtatgtccattatttcttttattttgaagactttcataattattttcgttttagattaggatgattaattaaagtaaacacagccactttgtttttaacttgcattacggataacttaatccccttgctttgcatctatgatctaactaaaaagtaatacagtcacgcggtgttatgagagtgactaagatttggggaagagaaaaggaaaaagtaaatgacgacatggataagtacatatattggtcctcacacatattagtcaccaccaaatattccacggaaaaataaggtgcacccaaaaatctcgaaatgggaatggggttattaggttgtagctttggtggcttgaaaagagagaatgaggccaggttcaatggtgatctagaaggggcccatagcaagatcaa

SEQ ID NO: 5433 - DNA, 1876 bp, Glycine max
  Soy_ogl_784 Gm03:1056101..1057976 Cluster 24
atcaaacaaatcagtatgtttatgtttggagacttttttttcttcttaaatgtatgttcaatccaatacttataagagtttcttctacaaacataagttgagcatccgagagacagattcaatcgtgtgatataaaatgagattttattgattatgatttgaaattgttttgctctaatcgatccagaatacttcaaggatgggatgaactagtattactactttgccaatgtcaccagagatgagggtcgtcatttaggaagactctggttagtatttcataaaataacaattatcttacatgaaagatgtgtctagtgaaataagtcatggtggtaattataagagtttagagatgacatgttttgtggtttaataatgttactttataatgtttcaatattggaatagttgaaatagtagtttattaagtacttcccatacacaaggtccatgaaagaggtttcttttgtagaacaaacggaaaaagttaggaaactgtctcttcctgtttttttttcttcctccaaacctaagtgaattgttaggagacgttttctgtctatttatcttttcccttttgctgttttaattatgtaaagtgcaattgtaattatatcgtctgatcgtctctctctccctatatatatatagtgaatttaataaaaacaattatcccaaaaaataaaataaaacagaaatcattaggtttcttcatttagttgctccataactctgttctaattattaatgtaatgatagcttatataaagctagctaggattatagttgtattgtcataaatggagtggtagctcgtccttttaaagttaactagttttttgttcttagaagaacatcaaaaaagatgtggatggagttcctaataaataacaagtaggatttcatagtcaaagaaatactcatatttcttgagaaaactttttccataccaaaagacaccacttattcccctcaacagatagaggttgagggctgtctcatcagccaacataatctttgctcttccatttcctacctttttctttctctatatattctttaccactatatattcaagatggacgaaaaagggaaaatgttgggaaaaaatatcatggggctaagattttattgttggtattattaaatcaggtattcatcattttttttcttcagaatttgctaaactgtagcaatatttcctacaaaactctttgtaaaaataaattaaaacaaaaaggccacttatgtgatcttctaaaaatagtctactcaacctagataaaatcgagtaaaactgtgattgttcctacatataattttaatatctattaaataaaatctcactactctccaaaataagttttatttaaaaataaagtatgactatccaacaaaatttaacccaattgataaataattgaatttcataaacatgtaatattcactttgatagtatttatgcctcaacgaaattaatctccgaatgttagttgacaaatatctttgttgtaaattactacgttaatcctagaaccatattaacataatataatggatatatgtgccaacattccaacaattcatggaagaagataatataacattattcctcattgatacaattattagaaggggattcataaatattgttttttttcaaagattagagtcttaaacttaatccaagttagtatctctctatgtcctcttagcaaattgtatctattaacttaagtattagagtttttttatatgtatccttatctctgtagatataatttacagtaggtgaaagaaagatatttagtagaacaccattttgacttcttattttccttagaaaatgaaaatcaaccaaaaatattatgct

SEQ ID NO: 5434 - DNA, 1707 bp, Glycine max
  Soy_ogl_3181 Gm09:38915194..38916900 Cluster 24
ctttttaactgttcagcttgaatcttttacttgagatttttttttcagactgaaatgatccaaaattaaccggagtttaggcgtttaggttaatttcagagaagtaattttcctttttacaacatcatgaaagagtttaaaaaaggaatattttctctaaaatcagttcattccaagcatgtattaaaacttgaaactagaaactagaaacacttggtgtttgttcagattggatacaaatttgccataaaaagtataatgaagtaaaagaagagaactttttgatggactccaattacaagacatttgggatgaaaagaatgcaaaagctcgaaaattttgggtattttgatgataataaaattaagagtaaggtattcaaaacttcattttatttattaaaatttaaaagctaaatgatattaaaagtaaatgtcgtaaaacaattattagagatacttatttattaacattaaaaagttaaagtttaatgtgggtttgaactaccaaaaatgcatatgttatatcttgtctaattcaacctcaaaaattaattcttaagataggttattatctatttatatattctattttatattctattttgacattatttttagttaacgtgtcactttgatttttttttttcaaagttaaggtatttttcttcttaattatggaagaaaagtaaataatttatccaattttttaacaaagaaaagtgctgtgtttatctcaactggtttgcttatgggcccgtttatttcaactagttttttttttggaaggccatttatctctcaacttgtattaatttatctatgacacatatactaaagtaattttacaaatcacttacaaatcataataaatagttgaagtataaaaatcttctacctatgccattcggcttatcttgtggggctaatcgaattgacataacatatataatacctgagtggtgtgaatgtgaatgccacgttgaaagactgaacaatgttttgctgattgtgattttgatgctcaattccgctaatcactgctcagttgctttccgtcgtttttgtcatttgggaatacttggtttatcaaacagtttgctgtatcatgtatgtataaaaaaattaaaataaagcattggttggaccctcctctagctttctggagttgttcttgttccgagctttcaaatcattcgaggatattttttagctggtcccaatttataaatcaattttaatcagtacatagtaataatagttatagcattttttatattttttttttaaatcacgagaaagcctgttcccttatgttttggatttgaaatatagtgtatggcgagttttatgtaaaactatcaaaattataactattaataacaatagtaagtatctaaaaaaatagttaagtatagttaaatttactctattcaaattaactgttattattaacccgttaggatcagcttagtgatggattagtaatagagttgaaatagatgcataaagatttaaatttcatccccattatcgtcattataaaaaaaccattcttattattagatgatgcttacaagatcttctataattacaagttgaaaattcatcaaataactctatttaaaataaaattaaatgttaattataacatcatatacccttaatattttgatttatttatgttttgggacacttttagactcac

SEQ ID NO: 5435 - DNA, 1543 bp, Glycine max
  Soy_ogl_4670 Gm14:5316258..5317800 Cluster 24
atatgtgcacacgagtacaaaacatatacgcattaattttgtatatataacagttttgacgttggttacacccacgctctctctttggccacgaataagattcagttagacagttacacaatcattttgtgtcgttgttaaaggttttaatcacagaccacaaccacaaataagaaataacattttgttgcataacgatgaaatgcccacacaaactttttaataaaaaaaccagtctgattagttggcttgacagggatcttcaagttctacagccttcttgattttgaattattgcgcatcatttaatttatgatgctttatggacctcttttgttagattgtgatatgttctttgtgtgattttttatattcccactcatgaaaaaaccttttaataaaaaagtttactatctgaaataaaattacaagtatgatttactcactatctaaaattaaaaagttgtctatcttaagtatcctattcaagagtttaaaataataataaataaattttttaaaaaaatttaagtttcagtcactaaatatgatagtgacctataaacaaggtcatttaaaccacaattaataactgattttgcaaccaaatttataaattagttgctacaattgatattttagcacccaaaaacatcaatcactaaattggcctttattgatcattagtgttgtaatgagatttcctttgataaagaagaactaaagaaatataaatgaggtgaaaatttattgttgaattcctacaaattctttctctcaagtctttgtatttttttttaaaaatcagcaaaaagaaacttcattaagaggaaataggttaccaggaatactcatcccttacaaaccatggaaacagtcaaaggttttataagctaatacctcctcttgcttaactgtataaacatcttgcaagctatgttcatacttattatactatatttacactccatatcctgacagaattttgtacattgtatttcctatcataattggtaaccaatagttatatccctaactagctattctctgtacctagttggtttcctatcttcatgcattggtatgctcttagcaattgacccttcttgctcaatttgttgcccatcccaaatattgtcacgttgttatgtcaacattttggtagatgttcatattttattagttgcaaaatgtaattggcaatgttattaaaatcaaattaggcattgactcaatcaagatatcaagacaatgggtcattggtcgataataacatagcttctgacttagtgggtatgcgttttaattattttcaacaacttatctttataaaaacatcctacaacttcctttccacctccatactcataagctactttcataaatttaatcaaagaaactcttttaaatacttcataattctcaaacttgtgcttcaactacttatttcaacccggtacatgaatgtagtatgctatttttcatttgctcttcaagtgttgtcactttctaaaatctattttgccattaatatgtatcttcc

SEQ ID NO: 5436 - DNA, 1500 bp, Glycine max
  Soy_ogl_5814 Gm17:40272401..40273900 Cluster 24
cagaaaacgtaatatatatttattttacaaaaatgctttagcaatgttgatcattgttaatatacccccgatttcatttcccttcatttggcttctctaaaagcttttttttttatgaaaaagggttaaaataaatgcatacattttctaggtacatgttataatcgagttgcctgtttaattttaataacaaaaaaaataatgtctataacaacaaccaaaaactttcctttcaaaaaaaaatataacaatattagtgggacaaaaaataaataagatgaattaaaagacgactttattacgaattcaagagcaccaatctctttagattgaatatttcatgggaagaactaccaaagaagaaaaaaaaaaacttgctatgtatttgtgttggacttaagttaggataatattacttattggtatcttgtctgatatgttatcatttaacagaaaaaaaaaataaataccaaagataaaaatctggaaaaatcagatagcaaaataaaataataataattttaggtaacaataaaaaaagagtatattttaaatatgaaaaatatatttaattcatgttatttataacttctcaaggaaatctaggtgacgagttttactaattaataacttctgtacaaagctagagctgtatggggtcatagaagaaggtgctttggtcaaaatggttccccccaattctttagcttgatcctcgtcataattacgtaataaggtaattatataagtaaagtcaaatagagcagaatacttatttcatcagaattaataaccataatgttgataatcatagaaatgaattatgaccaccaatccgatgagcaccaacaaatataaactactaatagagtagttagtcaaattaagtaaaagcacattcattttcctcaaattctaaaagaatctaggatgtgcatatactctaaagagaaagtaaaagggtaatataaaataatctaaaaataaatattataatttgtataacattattaaaatagttaaaatattcatctaactcccctgtagttattaactgatatgttattgattcattaaaaaaaaaaaaagcactgatatgttcatgtgaacatgtgctcgaatgatcgagtttagctccaaaatgtacacgccacgttttcctcccaatacaaatggaacaagaaaattaatacttaaaaggtcttgggttcgaggtcgttgctaattttcgttttttttttaaatggaaatgtgttcaataaaaacgaggttgaattgatgttttttttttaaaaaaataatttttatcccattttaaaaataataaaaatagatttgtggatttatgttgtttgttttactttatgtctctcccctcaagctactctttctcacttccctggtcgctaatcacagtcacagttgttgattattgataatggtgcaatcgttgatcatcgataatggtggagttgttggttgcggtcgccgtttatcggc

SEQ ID NO: 5437 - DNA, 1104 bp, Glycine max
  Soy_ogl_3595 Gm10:46931497..46932600 Cluster 24
tacattttaggttaatcatcctgattaaattgtactaaccaaagaataagtaaaatccattattactacctaaagccatgatgggctaatatttcaacctgtattaaatgaaaataagatatttcgatttatgcatgatttaaatcaataattgcacccaaataaattatttaaatcagtaaactttgattaatcattatagctaactattttaaaaaaaaaaaatcaatggccgacagaaaatataaaaaaaatgtatgtcaaaagatagaattttttttttactgaaaaagaaagacagaatcttaacatagaaataatcaagtatgttaattatactcttaaaaaaacagtgtttaaaaatcattatactcaattgatatgtgttaatcattcaataatgaatgcattatctataagttacaaaaaattgtcacactatatatctgacacggatgagctggaacggattggtggaaattatatttatccggccttaaccttatcctaaattttaatcgagacaattctttaaattctatttggttctttaactcgaataaattcgacaattaatgatcatattagttaagtttgagcttatttaagacaggactagattgactcaaaagtcaatatataaaaaaagaaaacttcaagatgttcgttcagttatggttaaaagttaaaacaaaaagtaaatcatttttcacattttatcatgtatcctactttaaatattttttttatcagtatcatactttaaaactataagattttgtttaataatgtataattaaattataggttaataaatataaaagtgttcaaattgagtttgatcatattatctaacatattatgtgtatgtgtatttctgattatcaacatgtttggtatgatgttattaaggagtagaaacacacgagactgatgttaatgtgaaaaaaaggagcgcgcgtcatttgaagcaactcgatctaatttgcttttgtgtcctttttttaaaactaatttgacacggaaatatttatatacacgtatttttaaagttgaagcaaacacaatatattgccaaaaaagaaaaccaaacacaatatacac

SEQ ID NO: 5438 - DNA, 1600 bp, Glycine max
  Soy_ogl_5243 Gm16:1981701..1983300 Cluster 24
tcacgaataacagaagaaatttgtgcttctgaattttccgtatatccacaattttgaattagcatttcgaaattgaacagtatgtcattatcacaggacactaatcatcctcatagttcttcttgaaggatataaattacctgtactcatttgattttccttttcctattccctcaatagaaaaacgatacgtggtttgaaaaataactttctctcttatttgctattattttgctaagtgtcatttttttatgggaggataaggaacgaaaaacacaaaaggacaaatgatatgaatcttgtagaaggtgagtttttacaatagtttagcttaatcttctaaagattaaagttagtgaatcttgttctcgagtcttctttttctgagtgaaagctagatgtttttaaagattcaatattgggcggagaggtgatcgagtacctaaaagtattctagtagagtatatcgtcaaattagtctttaggatttaaaaattttcaatttgtccttgactttccaaaatgacattcattttatttcatttttttttaacttgagtatctcttgaccgacaattaatgactaatgctttgaagcagtgagattcatttaaaggtttcttttaataaatattttttatatgcaaacatcaaatattaaatttctaatcacatgtttaaaagataatattatctatcaaacatgaccctctatattagttattcctttttagtataaaaggatagtaaaaaataaaataaaaaactaaactaaaattttgaaaactaaaatgatttgtgtaatcttgaaaattaattaaattgaaaatttactcacaggcacttatgagagtcaagtaaacgtgactttcaacttaattaagaatctaaataatattattagagtatctataatatatagttgtttatatgaattgtttatcataattttatatagatttaaacattttaaacaaaaattaactcctattctaagattgttaaaatgagtttataaattaattttataggtcctacaatacttaaaagtatgttttttacggtataatattattaaacaataattacttatataagcaacttcacaatgttttagtgagaaaaaaatttaaacaactttacttaaaatcaaacaacttatataaacactctcatgccgttcgaaaatgaatattggttactacctttatataggatcatgccctacaatacaatccttacatttgcaagatggacaattcagagtgtagacatgtgtaacagccgaggatcacggaatgctagttatcctagacgttagtggtggtctctttgttgggacgataaagtagtattggactcaattgtggatagttcaatgcattcatcaggttgtgcccatcaaagcttttatccaagatcagttcatcccctattgaatactctatccaaattgagtaacatacaatgactcctaattaccaaaattatcgatatttctaaatcacctggttatgcgttttaagtttaattttccggataatcttaattattatcaacataacagcttaaaaccatgcaacaaggctaggtttcatgt

SEQ ID NO: 5439 - DNA, 1327 bp, Glycine max
  Soy_ogl_5531 Gm17:5540801..5542127 Cluster 24
tatttaaaatatctaaacttcctgttactaggtctatcattcaatagatacggtaggccagttgtcatagatattttatttttactaacaaatgttaattgttattaatttttatcagtagaaaaatcaaacctatgatttttcctttttttaatcatttatatctttacggtatactaattacaaatgtgatgtgagatggataacatgagagacaaacagaggtaagaatgtaattaagattaattattaatgaattttaactagtgcattagaaaaacagcactactaagtttatggagtggcgtagtcatccatccaaaaagagaataatagttaatcaaatggaaagctacctttgattttgtgtagatgcagaaaattcgaagagaaaaggcagtgtggtgtcgtattctcccaacccacacaactttacaactttataactttatactcttgtcgaatgaaaacaagttctcaacgactctcctcttcaaatctcccccatttcctgcttcacaaccccttttattccaacctacaacaccaacaccattcatacatatttaattagttagtgacgcatgggaaacgtattggaaagatttttctttctttattcatcaacaattatcggtcaaagggtatctttttatgtaaattttatatataatatattcatgaatgtcattctagttgaagtgattaatttcttttttttttttttaaattaatccatggtcgtgacatcatgtgaagctcacataaaaaacaagcacatacgtatatagtggcaaaaagagaatcttcaatcttaacaaagtttaaacaaattagcatatcgaatgaataagctaaattgacaagaaaaggtgttggcaggcctacttcatggaacttaaaaaatattatttttaattttaagacaaaaagtatagtatatatattttttaactttaagacaaatgtacttggaggaataatcaaatatgttaccaaaataaatttattttctatactgagtttgaagcttttcaaatgaaaaatcaaacataatccatggtcgttgaactttatttatttatttggtttggatgtatgacttgatgcatgcttttggattaaaattcatgaacctaagtttgaaccaaaagtgtgttagaaacttaaagtttgcaacaaaaaaaaaaaagagtttacacaacgtgttttgtgtttgatgaaatgaaatttattgaaataatacttatcaaaagtatttttaagtatgtaaatactaaaaaggacatacaatttataatgtaatactactaaatatgaactagta

SEQ ID NO: 5440 - DNA, 1800 bp, Glycine max
  Soy_ogl_709 Gm02:47092101..47093900 Cluster 24
cttcttccggcttttgacggatgggttctgcattgcttaatttatggcccatatctagccgtcaatcacgtttcttatgggtccccggtccatctattttttaacacttttgctcaaacaatctacaagcattataacttacacttgccttttgggtttgttaagttacaagacagtcagcaacatttatttaatactaacatacatcaaaatcttgctaatatttaatcacaagataatatctatattaaatgcttgtagattgtatctacaaacacttttaagcaacaactaaataatcgaactacgtaaaaaaagatgtggtttaagttacatagacaatagaatgcctaaatgaattctcctcacacgctaaatgcgaccgctaacgtaaaaaaatggaaaataaattgtaatatgaacatagatttgatccatttgtagacgattgtaaccaaattaaggtagtgcatctgtgcatgttcaccgtttgggtaacaatactaagtgagtgtacggactttgatgaagctagctaatgttatggcatcaatcatatcctggaaggcccacacccacgcacattcttcatcgattcattttgttaatactatcgtttatcataaatgcgcacacttgatccttatcagtgactggcgtgcacataactcaatcatttgcagctaccaatctcttaaaaaagagtaagtaatcacatttctggctttcgtcaattgtgagcaattttttatttgtaccctctttctttattttttttctagttatttaattaaagcaattgatttctaaagctcttgtcaatgatgtagatgttgattatagacgcaacgagggattggctacttggtccaaattgtgttttgcatggacaactaacaatattgtatgatgtagttgataaataatattgtctctttattacattaatatatagagtatgttagttgatgttaaatatttctataacttttataattgttattttaattttttaaaaaataggttggtgttaaacatttttacaacttttttttttctttttctatcatttatggtattttatacatatattaaaaagtgactttaatttttatgaaccatgggtataaagattttcacaccgttaatcaattaaaaataatcttatatataacttttaaagtatttgaaattattccaaatataaatttttaaattattattacaaaaatcatcaatttttttgcaatatactatggtttataagtagatggtggtaaataaatttcttaataaactatgcaatttgtaaatattgcttaaagtgaaaataattacgcaaaatttgaataatttaaaagtaaaaaatattgataacaacaattaattggataaatagttaataaagttgggaaaatgtaatttaatttaacaatttataataagaacattctgttttctttaagtaatacgtaagccaatatttaacaaaatcttttttctttgtttattagtgttgttttttttcttctaacaatatgatttatttcataaacaaaattagaatttgaactttaaatcatgtggttaagaaatattagtctctgtcacttgttgcaaggttgttggtactcttctctgttaactagcaccgaataatatttagcggctcaatggtgatgtctgtaggctatagggaacaatcaatcagaatgcttgggcttttttcggaaataatgaagtttatgttcttgaaaagacgttgaggcctagcccatctatgttaagggccgaagttgc

SEQ ID NO: 5441 - DNA, 1416 bp, Glycine max
  Soy_ogl_3590 Gm10:46731532..46732947 Cluster 24
attgttaaaatgtgaacccaaatgcgaccagagtatgaatatgatccagcgtcacattctttgttcaccctacttgtagaaaaacatggctaaaaacgaatattatagcattgcaccctattaagaaaatactttaaaatttaattaaacaacttatcttcaaggatatattttcaatgacaaagagcaaattacaataccataaaacattatataacaagattagaaagaaaaaaaaatatgaaatggattaacgaaagttattcattgttgtatttttattacattttgggtttcttgaataaattattttataaaaaattgtagaactaaatttgatagttttataataaaagtgatgatttaagatatatagcaacttgtgtgatttattcattaaatttttagaataacattgctagataaaaataaatcttgatttttataaaagaaaaagagaaaattaacctgtaatatgattaatcaataatcttatctcttaaatatatgattaagatttaacttgagattcacacgtatgaaaaaaatagtaaaagtcaaatatttcttaaataaatcttattacttctaacaaatgatcattaactctttccccatagacatcggattaaaaaattatgttagcacttagcagagttataaagaactaaatttatgtataaaaaaaaaattaattttaagcaaccacgtgtgttgcaccatgcactaaagttactcgtgtacaccttttcttgttaaagaaggaaaaaagggacaaaaaataaattgaagaaaatttttaaataacaatgtattgtaaaaagaaaaaaaaaataataactttgagaaagaaaattcaaaatatttttctattttttaaatatattttttgaccttggtgtttttttagcgtcttctttgattgatcggtttctggtccatgatgttatgggagaagtggcacgtaagacaaatacgatggcaatagttggcggaggcagggtgctgagtcgatcaggtttctttgctgatatcagaggaagacaattacaacagaactgtcactgacacaaacccccctatcaaatcttcaccctccagcttttgttttctaccgtgcgtccttttcatcatcattttattttaatcaattaaatttaaaatatcattataattttctcataattttataatgttaccttgttattactactatattttacaataattttacaacgttatcagtataacttattcttaaaataatccttattatgaaaaaatattaattgactaatcattttgttagcagtatatctaaaagcaaagttatcataaggagttcaggacaggtttcgaaattatgaggaggttttaggtttcgaaaatatttctaacattccactcaattaatcc

SEQ ID NO: 5442 - DNA, 1518 bp, Glycine max
  Soy_ogl_1887 Gm06:10154701..10156218 Cluster 24
tatattattatttaatgatgtgtaatatatactaaattagctgatgaaacttaactaaactggattcgctttctgccactgtgaattagtctatattataagaaataaaaaaattagctcaaataaatccatggatctcaaataattgtctttaattcttacagctaaaaaaaatattacaaaaaaaatgaactatcatttatgcctgtatcatccacacacttttctccattagtttttttttttaatgcaaagaaataatattatgtaatggcaccacagatgccgcatcagttacaattttgtcctagtgaaaaaaaaaaagagataatttagcttcttaattttttaaatattaacctaacttagtcgtgttctacccattgactgagctgacttgatatttaaacaaaatgtataaaatgagcctttatgcatagttaagtcagaagctgtagaaatgtgaaactataactaaaacaagttttatagattatagttcaaaacaaatcagatcaatataaatatattatcatgttatgtaaggtaaataatttcattaatcatttatcattaatgatatatgagtataaaagtgggcgtacgattgatctactggcatgtttgccttattctaggtctctcggcttgattaatatagtttcatcatcagccccctttgtctgtattaagccgggccactagcttgaataaatatggtgtgtagtgtgtactgatataatacataataattaaaaatacaaactctgactaaatatatctttaagaaaataaaatgatgaggaagtagcaactatggttgtttccttaagtatataacttaccgattttatgatatataatgaaatcctatgaaaatattttaaaaaacttaagtacccataaaagacctactaggagatatctaacacttatcctcgagttaaagtttgttaaatttataatttataacaattaaacaccataaaggaaaataataacaaaatctaatcttgtcccgatacagttataatcttgaaaaaacatctttaaaagattatatagaattataagtttatatacttttaaaaaaattcataaaaaagttgcgatgctttgaataaagtaattaacttatccaaatatatacttttaaaaatgtatttgttgaaatatatataaattttagatcgcagtcctaattaagaatatgtatgggttattgtgttatatgtcatgtgtgagtagctaaaacactggaggttattttaatatttaaacgtatatgatattttctcttgtataatagcgaataagtaacaaatttaagctaacaaaataattgaatttatagtattagtcgatccttatgcattaatatgtatatacgttattattgtattgaatttatacgtatatattatgtcgccttgctattcgtgaaaaatgataagtatcttaacaatgtaacgatggtatacatactttgggaattcaaactccaatttccttgtgtgc

SEQ ID NO: 5443 - DNA, 1300 bp, Glycine max
  Soy_ogl_3024 Gm09:5834701..5836000 Cluster 24
tactaaggacctatttggtgtaattagaacccaagagattaagtcacacatttataatactttaaagactcaattgacatgattagaatgactaaaatcatttcaccaaaaaaaaaataatgactaaaatcattaatttgcaattcctaagaaagcaaaactacaattaagccaaatcattatcttggtaaattacactttttcttttatgaatatgcttaaattatatatttttattttaaaaattacacttttttaaagcctaaaatgcacaattatcaaattgatgaaacaactagcatgagattttttatagtttcatcagaggtctgatatttaagttttagatatgctatgttaaatatcttaagagaaaatttttctactcataatgatcctacatatttcgaatatgaaaaaataaattaagctaaatcataatatatatcaactttaatttaatattcatacactattagtgtattctaacgaaattctgttattttctttttcttaaaagagagtttatgagaatttgattagaacacactgaatatgaaaaagagaaacaatacagttattttatatttaaaataatttctgatatcttcataacatttttttttactttaataatgtaggaaagtattgtccttattattttcaaactcacaactctgtaataagctagactccaatatgcatgtggcctactacttcatagtatattgtctttaacgcattggatgcttatccgtgactgaagaatatcaacttcaaaccagccacatattcctcttttgtgttgactacacaactcttctatatgaattaatcaacatgcatgccctaccaaaaagggtgaccatgagaactataggtgcatggtggtggctggtgctaactacaaaagagtactgaaagttgttgtagatgtcaatcgagtttaaaaggagaaaaaaaaagaagagggcatctctttggagctttctatgatttctgaggaaaattgaagaagccatcattgacgattcctacacatgcattattaatcatcaattataaagttcactttttagatttttcttcatatcattattatgttgaattacatattattcaattgaagatcatttttttttcaaattatttaatttaattcttcctacgatattttttattgattttttttcttattaataaaaatattaaataatttttgaatgttggatattaaatttttttaaaagtattaagaaaattaactaaaaaattataaaatgagatagcattatttgtt

SEQ ID NO: 5444 - DNA, 1077 bp, Glycine max
  Soy_ogl_6441 Gm19:38855024..38856100 Cluster 24
tagctgtattattttatacatatttttaatgttcttttttcttgtaccaaacaacataaaaagccatcatactttcgatctatttattttcttttcttttactttcattattttcactttctttcttaaatcttacatatcataaatacttaaaagaaattttttagtatccatgataattttatcctcccggctaaaacaatattatctgttaaaattcaacacaaaaaaaaataacatctcatatgaaaaaaacacaggtgaccattaaagaaagaaaaaatttacatacacatcctctataaatatggagagtccatggtataattggtattagtttttttaattagagatatctacaaattttttgtttggtatttaactaatcctctcgaaactattttatagtaaagtgatacatttagttataattctatatcaaagttgagggatcaaacctcaaaccataatttaggatttcaaaatctcaaactataatttaggattccaaaataccaaacctatcaacaattttttattcaacttctcttttattacatctattgatgaaacatatatgagctaatagttaccaaaaattaagatttttttttcttttcaataaaggtcaagatcttctagacttctacattttttgttttcttttttatttcttccattactatgattttagagaaataaatgaaatggagatgtgtttcacaaaataaagagtggcgtttatttttccaaaatcatgtaatagaaaaattaagaaaacaaaatggagagtatctttttccgttaccggaaataccggtaactcccgcggtattaattttgtcaacggaactggaagttgcaagtttacgttcagcacgcttctcgtgacgtcaccctcatattcatatataaacattaaacgaaaaaaaaactaacgattgaaaatataacaataaaaatgtgtggtcgacagagattctccgatcgaaggtattcgtttaagaaaaattcctctgcatccgatcacttgtgttctgaaattacagttaaatacttatccgaattcacactttt

SEQ ID NO: 5445 - DNA, 1271 bp, Glycine max
  Soy_ogl_5769 Gm17:39028330..39029600 Cluster 24
tctttctagtttctaccctactttgttatgacgaatgtggcaataaactacgaaaaatacagtgtatgttgttgcatggaaggaaaatcaggaatcccctaaaaagggtactattgaaactcaaagaaaatgaacaaaataatccctatcctatgccaccttcctctagtgtactagtttctaaaagagtgaaaaggatatcaaattcgttcttggaagttggaagatgtataataatagtgtactatataatataatatttccaagtccttattatatataggtggatcttcatgaaagtagggtttggctctttgttcaaaaaataacccttgtccttcccttgtcaccactctctatatagtacctgatcaagtgtggtgtgtttgcagttcattgcttcaatggctatgctgtgtttggtttatctgttgactcaagttgctatccgattattaatggaccaagactatgaatggtgtttcttgttttacggcattacgggtttttaagagcaggcattaactgacttgacaggaatgtggtgaaaaggaaagctaatcccacaggccacaaagcacaatttcttaaaaggaaaataaattacaaagtcacaagtatatatgtttccacggattctagggtgcgaaacaaaatctgtacggtgcgaaagttatccatgatcgttttataactgttagatttcgcacctagaattcgtcatatgtttcaactataatttgtaaacttaagtttgaacgtattttattatgtgtttggtagaaggttccaagcgtatgtttgaggtaaatgtacatttgtagaggaatcatcacccttatttttactttcaacttacttttattcgtttgatttgcatagaatcacatatatggtatttttaacttaaatccaaatacatacttcttttacaaattcaatttgcaaaaacgggtgtttggattaagtgatccatgtttgattaaatttttatgcgttacttgtatgactcacatttgagacgtatagagatccaaacatgctattactattccttaatttaattagtttcacataatatctcactaaattgagtttactagaaaaatagaagttagaagaggttaagtgtgtatttgattattggtgagaaaactgtttttaactccaaaattgattttgggtatttctaatatatttagtttcacattaaaaaaaaatttagaattaattttaagctgaagtaactttgagcagcttctgaatttaaa

SEQ ID NO: 5446 - DNA, 1390 bp, Glycine max
  Soy_ogl_1042 Gm03:42293401..42294790 Cluster 24
tgtaacaggataatcacatatttgatgaaatacctaatgacaaactcctatggtcattttattacagtatatttttgaacaagtttctaaataacaagcctaagggtttttaagttaatttttttcctttaaaacctctctaagtcaatcctatcatttatgtaggagtttaaacataatgcattatttggtattgttctttacatgacctctttgatacaatttgctcttcaatatatgtttggttaggcttcacctgccttcacagttgttctatattttgaacttttaactcatttcttacatcacgaacaacagattgtctcacagggtgaaaaatataggaaggtttggatataatttatggttgtcccgtaacaaaatagtttttaaaacaactgttttttattttattcaaattttatatataatcaaaactcttttatggaattggtttgtctaaaggaaggaggtaatgttttactttattagactagccagtatgttaatctaatacttctgtactagacaagttttgtcgactgactaattatctttcttatgagttataattgtgtcctttttaataaattttattcaagcttataaaaaaaattcaaaccttgtattaatttctttttcaaggtgaatatttttacatacttgttttcctgcagtctaattagcagatagcagttatgcaaggttaagagcagtgtggggagatgcatacatatgcaaatcagttacattatttaaataaaaaaattaatatcctgtatatataatttttttatttttcattttttatttgtgtgtacatatatttatcttaaaattaatctctcaaatttaaaggaacgcatttttattgtcccatttttatgtttgtaaaacattttcctttgcaaaaagaaaaactgaacctctgagctagcggacaagtcaattggtgtcagattaattagtttaatccagtccttttaaattcaaggtttaactaagaggttatgttaaatatttaaaaatatatatttcatgtaaatgatgtctgtagtctatgtcaaaaaaagaagtgtgggagaattttttatagatatttctagctatgtaaatgattaactgatagaaaaggtatgagatcaataattattgtctagatcttatgatgacttctgtgtactcattaaatttacgagcatgcatgttctcgcgactttttaccaactataactagtttgcagcttaaaaaaagattacattatttattagtgaatctaaatgttaagatgttgtaagttgtaacaaaggagcacattgtatatataaatgagaaatcaatgatagggaaacaaattgacagacacgtaagtatctatcaaaatcatta

SEQ ID NO: 5447 - DNA, 1100 bp, Glycine max
  Soy_ogl_5944 Gm18:5478201..5479300 Cluster 24
tttttaactttttgaacataaattattgtttaatggttgttgactactattgtcttaaaagataatttactgagtaacataacttatttaaatttagtacatttttaaaatatgatcaataggaaatttcataagaaaggtataactaacataaatatcaatttttattataaatttattaaacttttttggtgacatataaaatttaatttgttattgtcatttgtaatttaaggtctttaaaaatagtctttgtttttttatagaatgaaaaatatgtttaatatcttctattgaaatgtatttttcattatatgtttttaaattatttagaaatttttgtatgaatctattgcttacatatttatttgattttgccccggtcattgagtcctgggtcctggttcacaataattataatggaacgaatgaaataatttttatattactattttttcttataaattaaaaatttaaatatatgttatataaaaattagtcatcataattatatatagataatggtatgagagtatttaatttaataatatttcattgtttggggttggcgatcgttgccaaggtcaattccatctcatgtgctggccacagatgtggacattctccaacgtacacatctcatttcagttctttgctatgaaacattcttaatttagttgttgattccccaacgttaacgtcagaaatcataatcctagcttagtccttcatcacttctatcactacctttgctttgttcctcccctagctagctaattctctttgactgggctattattattcatgaaaaagtcattcatatgtgttattataaatttaatgcaacctttggcacttgcattttatatctatgtggaatgaatttgcttaagcataagtggagaaagcaacaaagcaacaacacaacaacgcagacgtttttattgttatttcaaagccattctagatttctagtaactttcagtatagtcgacatcattttcattaagaatctaattaattgttgttgcagtcttattatatttttgcactataagcttattaaaaattattttacttataattttttaaaaaaatat

SEQ ID NO: 5448 - DNA, 1756 bp, Glycine max
  Soy_ogl_2167 Gm07:3680701..3682456 Cluster 24
caatgcattataaaaaaaaaacaaaaaaatccaacacgcggaagagctgctcgtattagtttcttttaatttagtagtttaccttataaaacagcaatggttttaaactttattttttttttataaaaaaatagtaaaagtaaaataaatgaccttttataaagttatggactagatattaaataatctaatactaaaatagtcgatagttacaatctgaaataataaaatgcaagtacactctcttaattttactgctcagatttgcatcttagaccatcactcaaggtaattgttaatttccctaatgcgaggatgcaactttatgatatattacgtatcaacataaaattagaaattcctaccgaaaatttaaatgtgaagctttttttaatgagaagttaacaccaattaaactatactttgactgaaggcttcaaagaaaagtacagatggcaaatttcttattcaattatatgaaatctgatatttagcaaatgactttttttcttagatggagaagttgctttacgggtcaagaagctgaaaagacataagaacttaagaaattgcggcccatacaactatgcttaatttaatagcaaattttgggccaatagaacattttgggcatgctattatccaacttatcaaacttattatgtccaaaaatctgtttcattttaatggtgtttgtaggattgtagaagtgtcccggttagtagtaaacaccgttgggctaagtgcttcagttcagcccattttgttattggcatcagaatacttagttttcaattctttctatttttcatctggtcattttttattttttttaaagattttttcaagtcagagaaataattaagtttatactgatagctataaacaataaagatacgctaaaaaatgtctaaagcagagtttcatgtatctttttcttcttttgaatgagctgcccaactcttaataggctgagggtcacacatatcctgttaatgggtgtaaggttctacaaaaatcaaatttgactttgttaaagtgagtggagtgatataaaaggtaaaatgcaaaactttaacgagcgtgtattttttccagtggaagaaaaatacacacagaaaaataggtgtggtaaattttaaagaggtttagtgataaaatttagcatacttatcttgctttttgtatgtatctctcctattaaaatttttccaaagagaatccacacaaatataattattgataaaaaaaatcaatgaaataaattttatcatggttgtgatacatgtgttttatttccatctcaattgatagttttcacattaacagttatacaattttacatagcttttcattgttacacttacaaccttcactttaagggaatcaaattcaaatgcctattttaatttccatttctaactaacaattcctttcgttcgtgtcttttaatatttttaatccaaaaaagaagttttttttttctccctctccatttgaattgaaaaaagtaaaacaccaaggggtgctttcctattatatccacataatataagagatcctttttgtattgcttttgtgtttagagattttaagaaggaaaaaagcaaaagacaatagggaacctattgatacacacgcgacaagcagcttgaaaagaattctcatgatgttgggccacggttggcaaaccaatttcttttcaaatgatactttctttctttttttccagctaagaagctttgttggaacgtct

SEQ ID NO: 5449 - DNA, 1300 bp, Glycine max
  Soy_ogl_4510 Gm13:37250201..37251500 Cluster 24
taacaagtagttgttatactattatcaacttattaacgctatgttcattaatctactaaaaaaatatacatctcattgaaagaagcatttatatttaatattgtccgattgcgttttaaacaaaattgtttccaaagaaaatataacctgaaaaataaagattttcacgctccattgagtttgagaaagaaagaaaaaacaaacataagggtggaaaatactggatttagggactaattaaattcctggattaatttttcataagagtagttagatttattaatgactcaattaaaaactaaatacaatttcaacaaatttctattaaaaaatagttcaaaaatctaattaaaaattgtcaaataacttaaagacctaaatattaatttaagcttcgtttaatataaaagaaaataaagtattaagaacaaacagaaaaaaaaataatgttgttttcttgacattttgtataaataataactactttttttacacaataataataacaactacttaaagactgaatatcaagctaatttaatgaatttgcatgatcaaactttacgttataaacaaatcatatactacttattatatgaataaaattgtttttttgtcaagacatgaataaaattggtatacacgcacgcaataagttctgcccggaaggaaataatgatgataattgacaataacatacattgagtggtgttgttaaggttgatgacgtacgtgcaacgtgaacattagctccatagcctccattcatctgaatcttctgacgatacgaagaagcaacagttgcagcaaatgatggttttctgcagaaagaaacatatgcatgagaaagacgggtcaagtcattctattcagggcgcttgctttattttgtcggtgcgagaaggttttatatattactggcttattttctaatattaattcatttttgtctccataacaaaaaagttagagttctacgttcagacatgactatatagtttggatttgttgctcaaccaattatgttgagtcatagtgaggattgtacaagttttagatatcccatttaatggtttgtgattttgcttatatattcttcttgctaattttgcttagcatgagttgttgattttcaattttagatcatgattcaatgagttcctgatttgtagattaagagttgttgattttgtttactgcatcattttttcttcaaaattttaaatccacatcttctagcattacatcactagaaaatttgtagcatttaacagctagaaattgagaatacatttttttc

SEQ ID NO: 5450 - DNA, 1241 bp, Glycine max
  Soy_ogl_5762 Gm17:38653601..38654841 Cluster 24
aaatatcattttcttcatgttacttcctttgattagtggactatttcttttaatggataagtattagttttcttagagatatcaataacaaaatttaaacatgagatcttttatgtggttatcttttttatttatttttgagtcttttatttttaataatcaagtcaattttatatcttctcactaagaaaatttaaacataagatcttttcttcatactttttttttatctatccttgagtctttcattttcaacaaccaaatcaatcttatatcttctaaaaattatttattttaattggagcagaaaagaaattggaaattaacagtgatgggagtcggtcatatatattatatgatatttggtatgaatcctcatgcatgtagcaactaaaccttacattgaatgattcggagaaatcacttggccataagatccaaggttgcagtcagggtcattttcagtctgttatcgcaaggagaatgtaatcattgcttgctcatgagtctcctatcatgtgagctagcatctgatagagttgagatattcgagaattttgtcctaaaatccgaaatgcatgaaaattttaccaacttatatcctaaagtcaaacgtcggtttaatttttatctaaattatttggatatattttaccaaaggcaaaatagtagtccaaaggccaaagccaataatccatcttctaatatatgcctaacagcagtttttttattaattatgaattttatctagagagacaagatttattcatgtcttaaaaggattaatagttttcaattattcatgagacatatctttcatataagaaaatcattcaaaattaaactagtgaacatcaattcttttaatatagctctctttttttttaactgcaataatattgctcttatttatacttatataagatcgatatattaaattaaatttcacttagggacagatttgaaactccctatcatataattatatcctcataacatttttataacaatttttagatataattaggaagaaaattgtgagataaaataaataatgcgacaaagagagtaaaaaagccataaaacataaagttatagaaaatattgtaaataattcatatataagaacgaataagattactctttcttattcagattcatgcaatttgtaaccgaagggggtagcagaaaatgcatgagaccaattaattaactaaaatctacttgatgggggaaaaaag

SEQ ID NO: 5451 - DNA, 1500 bp, Glycine max
  Soy_ogl_414 Gm02:6449301..6450800 Cluster 24
aaacaaaaatacgaaactgcaaccacttttttttttataacaaatgacaaccacttttaaactttactaagtatctatctttgaaacaattatttgtttataaagttttaacctttttttatagaccttaagtatttttttatcatcataatattgatataatttttatttatttataagatttatcaacaaggacttgttgataaatataaagatcttttagcttaagtaattttgtctgaattaaataagattattataatataagtgactaaagcttaatttattaactttttaacttggggctagcttcatcttgaatctgaaataaattttaacatgtaatcatccttatttcttattggacttcttgaatgtaatgatactgatgcttatctatagttgaagttaattaagacaccaactttaaagtttaactatagcatgtgttatttatatataggaatttggaagcttggaaagttcttctacatcgccaattattagttgccttggttgttattatttcattcgaaacattgcctatgaaaagcatgtggtgctatgtttctatcaaatcaattcaagtataatataattaagagaaagtaattgtcccctttcctctgtttagcttctttgtgtgccttagactacataaaatttatgagacgacaataacagaggatctagcctaggctgttcttcccaaagtaaagtttagcaatgatgataaacaaagaagagaacgctgctggctgagaaagaagggcaaaagaaagtcaaacacgttaaaataaataaattgggtaacactactaaacatgctattttccacaggaaaataatctgcaaaaatttctgcagatttttctacaaaaataatctccagaaattttctgcgaattttataaaatgatatccgttcttaaaagtaaataatgttgtataattaatccatgaatttaaaaaaaaatcattgaaagtatatgttaatcatatttgtccaactattacaagtaattaatgtatgacttaaataataatactaacaactgataaaaataataatactaacatgtttgtagattgtgtttgacagctttctggcacaactggtgcccttaatataattctttgaaaaacacgtttgtagattaaaataacagtaagtggttaaatttttttgtcgataacaagtgattaaatttaagaatttagataaaattcttaggaatttagagatttatttgaaattccctttttatgaaaactcatatgtgataatgttcaacacttttaaataccaaaaaggtgatttaaaaaaatagtaaaagtaagatgatgtgtttcttttaaacaattgatatatatggttttgatggaaatggatatgtgtaatttcatatcttaaattattagcaagactatccggtactcgttagacattagtaatgtagtgtagttcctaaaggacatgtttaagaacgtaagccatca

SEQ ID NO: 5452 - DNA, 1700 bp, Glycine max
  Soy_ogl_4899 Gm15:4039201..4040900 Cluster 24
aagttattactacttgtattaatcattattagtgattcacaaaagaatatgcttcttaatatttctcatttgaccaattatatttacatttattatcaatgtatgatttacatttatgtaatttataatgtaattaaactcgttaagtacatgaagcattaaattttaattgaataacagtataacgtatttatttatttaatttatatattggttcacattatagattacactgatggaaaatgttttattttcaagaagcagccgaaaaaagttcataattcactagtatttttaatttgtattcctttgtactatatgtcaaaatattgtcctaagtttttttttacacaaacaaataaaaactagtaaatagataaaagagtagcatataaaaaataaacatatatatatgatcgaaagagtgaaacaattttacaaaaataatcttataattattaactcattcatttatagactctaataatatccatcatcaacattattagaagtatatataaaaataataattaatgttatattaaaaattaaattaacacttttttagactttttttaacataacacttattatgaaatcgagggagtacatgcattattaatgtgttgttacataaccaaatttattgattataagtacattattgaatgataatatgtttttttacactaaaaatatcaaaaattgaaataaaagagttacactaacataacaccttataaaagttaagctctgttttattcttatattatggtaatcttctctttagtataaaattaatgcatgtgatggactaaatttcattccaatatccaaaggtttttgtcttgcacggtattgatagaggtaatgtaatagttttgctgaaacaaccacagtcaagtaaatgaacttttttttataatatttattatacatatacttttttttccacctcacttttgccccctttttttttttatctcttatatttccatcacattatgcatcattctatcaattttcctctcaacctttttttctgtctttctcatattttcatccaatccatccaccctaggtggatgtcactgctttttttcctcggataatcatgacaattttcattcatacgaaatgcatgagtgagctttttaattaatggaattactttctctaataaaggaataagaaaaagaatgagctatatcttagaagacaataacacagcatctttttttaaaaaaaataaatgatggtcgaacatatttcattgattattttacacggagaaatcaaatatattgtagtttaggtatcacaatacttgatcttttttttttcgataacactatacttgatctttgatttattagtacgagtacacaaaaaatgaggaacgcagatttttttttccggtagacacacatggctaactagctactattaaatatcattctttgttgtgtgtgacgaatagttcctcaaaatcaaatagcatttaaatgtgtaatattatagagaaaaaaaaatgcaacttgtacctgccagctgcggatgagggatatttttttttatatgttgtacctttaaggcattaagtgaatatatatgtatgtgcgaaggctacgagataaatatagaatggggtatagtatttggtgaaatatgacaatgttatcagaacaatagtcactttc

SEQ ID NO: 5453 - DNA, 1122 bp, Glycine max
  Soy_ogl_2468 Gm08:2491279..2492400 Cluster 24
gatacatattagtacataatacatcaattataaaagagataatatatgctaaatataaatatatgtagatttgatcgatagtgcaagtggtgacttaagtattcatttaaattttaaaactattaacatacacatcaaaatatgatgataaattataattttatttttaaaacatatctaaatatatgtatttttgcctgattcttttgaaatttcatttgataccggttagaaaattattttatttgatagattcttatattaaaatatgagttaatgtttatgcatataaaataattatatatagtcatcaaaataattattttaaaaattaacaatttttttatacttgatggattgtaatttaatgcctgtgtaaaatttcttatattgttatagtataaccttttttctctaaaatatatagtaaaatcgattgtaaatttaataaaataagtaaataattataacgaacttcaaattgtttttataaatctaaataaaaatctataaaatagaccagtcggccaagggttgtgggtgcgtggtcttgtgttcgtctaaagtggtagacgcactgacgctacaatttcgtttcaatgtttcgtctaggaaagaatttcatattagccacataaaatatgatatatagcaagttttaatgaacatgtaattactaagcatagtttttatttatttatattttacgattatttgttaacttgataaattaatgcatattagagtggaattatttgtgacaaaataattattttttctaaatttatcttaaaaattaaaaaataattcttttcaaaataagtaatataaatacagatttagtgtctgtttgagtacaagtcataagctcttttgagaacttctctactaaaaatataaagaaaacattgaaaaccaaacaataattttttttattgcatcaaattattatttattaacacctaatatttatatatgtaacattttcatagcatattgagagggggattttaagttttatgcattcttcccttaaaattgctctaagtatcattttcatcgtctatgtaccaaaaacagaaatcattcagtctaattttgttgttctatgtacatatgctc

SEQ ID NO: 5454 - DNA, 1599 bp, Glycine max
  Soy_ogl_3393 Gm10:6570060..6571658 Cluster 24
caatgcgtaattgagttatttactaaaaaaccttctccctaattttcttttctctccaaataataattcattatatcaacttggtttcgccatttccaaaaaaaaaacagaaaagatgatactgctctgttttcagcttgccatgaatttggaacaggtagccttatgagtgtaaaaatacattattaactctaattctcttgcattagatttaaaaaagttatcaatatttatttgacacctaacatgatcaatcccactttttagacatttattaatgatggcaattacttaccccgtaactttcacatagctagcaaacaaggcatcacttattaacttataaattatattatcttgatttaacttcagatggtatgcttgaggtgcctccattatccatatatgttataacttaaaaatagagttaattaggataatgtaacacacaagccaataggcactttatttatgtggatgccaggcaaatgatcatgaccagatatccactttcaaacacgtgcctttaattaaaaaggggatgaaaacaaaatatttttcatcataaaaggcttgaagagaaatcgagtagactaattaaccgtcagattagataagaaaagattttacttgtgtttggcttttcgaaaaaaatttaggaacataaaaagcctttagagtagtgttcgttttctgggtaaagagtcaaattaaaacaacaaattattacttcttctatgtttttatattggatttcataaaattattatttatagtataatactgaaccaaacatgtggttaattattcttttggttaaacacgtggtacgtaactatgaagatttctgattaaaataaatgtaactatgaagaaattttactaaatacaaacaagcttacactaatgaaattaattttccattgtactcttgaaaaacaaaaggttcaagaaatagctatagaaaatatcccataaaaattaattgggacaaataagaccaagcactgaaattaaaataaattatttgccataatcattgaacattattatttttagaataatcattgaacatgataggattgatgtattaaatatattacatatttctgcattaaaggtgaagtcatttataacaatataatagtatatccaaggggaggcttataattctgatatgtattgtctggtagattctcgaaagatatataaattaatagaaaaataattaaagatgtgagtgaagaaaatggacaaagtacgagccaaaaaggcattattctgaatttgaaagttatatcaccaccttttcccggttcattcatgatggatttcacataagattcggtgtgaatccaatttaaaaaaaaatcctctacatataattacactattattccttttaattcagagtagtatgattttctttttcttaaggaacgtatgatttggtttcttaagacttaaaatttttaacctaattaaatttttattttaaagaataattaatcttgatccttgttatgattttttattttaaactcctagttagttatttttattcaatctctactgaaggttcaatatctctgatgaagg

SEQ ID NO: 5455 - DNA, 1423 bp, Glycine max
  Soy_ogl_2729 Gm08:16496201..16497623 Cluster 24
ctactatttatagtcttatactattccatcagttcatttatacgctctgtgatcatataaaaagtggatttaattaatgaagagacatgttattgttgatatttagaagatttatttatttatcaatccattcataacaatattaaacgctttttaattatattttttctttatttaattctgaaatattttatatgcttattatatacacgagagaaaaaaataatagcataggtcatattaagaatttttttttaatataaataaaaatgaaaggagtgtcaattttctttaatctttctaatcaagtattttttttctttttgttctagctactgtcctttttttttttttttaaagttgtgattgttttattgatacgtttagagggaataaactaacataattgagattgtaaagcaaaaaattgttgtttgtccttccttccttatataaataaaattgtgtagaattgaacctaatgatcttttgtcaatgtttatacaactacttgtactaaagaaattctcaattgagcatcaatgcgttgtatttttcttaatttataagaatcagaatcttcaattaatactattaagatgtacttatttataatatcgttctcaatgtgcattgtattaatttcaccttttctaaacaataacaaattgggtaattaagaatgtcgctctacttaaattcctaattaataaaaaataaagaaagaaaagctctgacttgtttatcgacaataatgaattaaataattgtcatcaacagttatataccattggcaacgtgtagcacggtcctatttaatttgccattccctttgtacgatgtcattaaaggttgaatttggtaaactaaataatgtcatttgatatttattagatccacgtacgtacgcgatgcgatcttgacaatatacgctgaagaaactttcttacctaaaaccttaccaaatcctttaattaaaattccaagatcttaatatggttgaaggatctgggttccctttggataaattaccgtgacacaagtaaaaagagattaaatacatttttagttttttaaattatcatattctttaagtctttaaatttttttccttataaatgagaaaaaacacctacttttaactaaaatcgcacatttccttataacatacagaaattaatttttttatagaaattaaaattaacaattataatattttcatttttcagtgattaaaaatatgttttaaaaaattacacggtatttatgagtaatatatggaaaatatcatattctcttgcaaaatttgggcatccaaaagatattaatagctatgtcggtttgtcttattattctttttagccccgcatgcatatcaatcagattaggtgtcgtctgttttcttttaggccgagggtttttg

SEQ ID NO: 5456 - DNA, 1370 bp, Glycine max
  Soy_ogl_3163 Gm09:37853331..37854700 Cluster 24
aaaccaacttatacaaattcacgatcaacaagttaacctcgttttctgaaacagtaaagaacaaaagaagatatagtgcaaaacttactttcttgttagattctagatatatccttccattgacatatacctttcttaatttagaagtttatcaaatgcattttaaagtatataacatatcattagatcctaagctatcaaaaaaagattctaacctaccaaaaaaattatatttttttcttaaattattaacatttttgttcattttgtttttgaaatgtaaagtgtaaacatgtactattgtcaagtaaatggtggtattaatttgtcggctcttcccaacatttccgtcaaataattgcactgtacatgtttgtcgtattcactttaattatatatcaatatcatttttttaaaatgcaccaattttctttccagtacctatataatggtgatttatcagtgaccatctttatgaaaggtatttttcaattgataaactaataggagagtaaaaaaatttagcacaagaaattaaatagttaaattttagattaaattactaactatttttaaagtggttactaatgtaaactaatgttatggtcaaattattaaaataaaaagttattagctactaaagagtggcaggaaattggacacacacacatatgcatggtatgcgagtcgtgattatttaataaatttcaaatgtaatttattaaaagtattattaataatccttttaaaacaataatattataatgatacgagttttcttaatgaaaataagtatgaatcgttgacatttatgtttctttttcgttttaacacatttaaaacatttgggtctatttgcttaaagaattttttgtgtcacataattatataaatatcttctttttattttcagcaatgtaaaaaaaatggaaacataatttttgttgtttgcatttgtttttttatataaatgtttagaaacggaaataaaataaaaataagataataatatttttttgaaattatgcttaaaaatagaaaatgaaattggattgttttttaaatgaatccagttttgtttgttaaaacttttctcataattttgttaacaaactttttataaaaatacttccgtatcaaatatactattgctccagcttaaactattcatctgagcttaattgctcgtgtttacttcttatgtgattattttaattgaactgaatgacttagcttgcatgtttaaatattgtgattaattgacttttgtttaacgttcagatttgtgcacttcaaccgtgtgtattttaaaaaatgatcattaatttctgatgtgtggaccggtgatcttctgagctatcaaattataa

SEQ ID NO: 5457 - DNA, 1371 bp, Glycine max
  Soy_ogl_3388 Gm10:6305727..6307097 Cluster 24
ctgagaatatagaaaaaaatattttattattctaaaattaaaagaaaaatgagttaaaattttacttgaaaaattaaagatgtcaatttcattagagaattttttaatacattttataaaaattagattgttaaagaaactttcttaattatataaaataaaaatagtatatcacagccgaaaatatatatatagagagagagaaattaagcaactttaatattgtaaatatttttttttagaaatgtatatgcaatttgtcatgattcgaccacatggtgatggtgactcccaactactggtccttacttcaatgctagatatgtatgcatgttattactatcaatacactatttaaaacacttctttaaacatatcatctcttattaattaagaaatataaaaacagaatgctaatttatttaataattttttctcataattttattatttttattatttttaataatttttaatcaaaaataaaatgcatgttaaaaaatgtgttaaaaaaatgtgtttttagctcttctttgattttattaccaagtgtcttgttgttaaaaaataattttattaattaaaaattacttaaaaatatattaaaagttataatagaattaccttaatggtatttttggataaccatgttgaagtgttgtagttcgagttcaatttcacttgaaatactaatgcagaaatgtaatgcatgtttggatgagtgagtaaaattggtattaaattaaaatgattttatagaattgattttaagtaaacttgggtttttgctaatttaatttttgtttaaataacagatgctagaaaaatgattttgacacataatgttatttgaaattttgcaataaaatttgattttattgtgcaattactaaactaggttttgaaataaaatgcatagtcttaaaataaaaaaataaaaaaagtgtgattttttgttgggctaaatccattttttctttctccagcatacaccacacgatgaatcatcatttgtttgcttgtaacctttctccattttttcaatgctcattgcaaccacaactagcaagtgggtttttaatattggttgataaacaattagagggaaacacttcaaaatttccttctaagttttgcatgtatttttcaatccaaattctcaccttaacttctattaaccttcttcaaaaaaaattccccagtccattttttgaatgttagaaacttttgttatcttgtgaatgaaagtagtgaagttaattgggttgtgtcttagaaaattacaacagccactgcggttttgcgcattcacacaacacaaatagtacgaagattaataaaagtatatcacaacataaattattaaaaata

SEQ ID NO: 5458 - DNA, 1760 bp, Glycine max
  Soy_ogl_4969 Gm15:10223241..10225000 Cluster 24
ctatttaggccttatccgcgtatttttactataggattcttgaaaaaaaaaactctttattttagggatcaaacttattatattcatctaaaacataaactgaatcttaaatggactaaaccgatgggatcattttatattttaaaaaaatatataatttgttataactttctttgatgttctaaatcttagcatatgtttctttaccagtgaaaaatacaaaagaaaacacaagagaaaactacaccctcaaaattgatacagaaatggcatcaactcttagctagtgaatctacacattcattggactcacgattgcttatgaaagatcttatgtgattgataattgaagcatcataatgaaaaaaaacaccttccaacactaattgaagcgctacagcagaatcagtttcacactaaggtcccgttagtatgtggaaaaagagggtgaaaaagaaaaaaaatgaacagtaatagagtgaaaaaaaaaagaatcccaagtttcatattttactttaattcaaaacttttatcttatttagctttcattcattttcttttaactctaaagaacacctgatcctaaatgttcaagtaacattgaaagttgtaaccttcattttccagattcactaacaaagaaattgttaaatggtagattcctgaacataaaaagcccatattttggcaaaaagatttaaaattaaacgaaaagaggagatgtggatatggatcatgtggtaaagatatggatgggtgctgtgttaaaaagtacagaacatgccaagaataacttgattaatgaaaaattactttgtcttttgacatttcagggaatcggattcaaattccaatcattttgtcaattcattcaacgaagatatggcaaaagtttacccctttttagacattgatttggtgacggcttcttttgatggattcgaaagtagcaaccaattttgaaaataggaaaaagtaattaaagaggtgtaactgagaaacaaattaatggtactactatgttagaatggaagaagagtaaatatgatcgcttttctttccatatagaaataaggtgaaacttagaatatcaattgcattgtctgtgggaaatgagtattataaatccttgatacgtcttaaatccctatagataactaacaaaattgtctatttaatgagatatctcaacttttctatactaagatggtttcaccacaaatgtagttgttgagaaagttttgtatattttttttatcccgggaatatgttttctgaaaattatattagttagaaatcatatttttatagttatgccataaatatatttggtatgtttaagatactttcgagaatgaaaaagcataatatttaaaaaaacattttgtcccttcacaagaatattggattctcactccttttcgtataagagttttaatggaaaaattaattaaaaacaattcctataaaatgttagatttctgaaaatgatcccttaaatttttttttctgaaaatgatttttaagatattcatatcaaactcttttttttttagaaaaaaagatttctgaaaatgatttttaagattttccgaacaaacactagctaaggctagcattcaacggctggatgctacaatgaatatcagatggaagtataaactttcttttaggacgtccttgagtttatttcagaaaaataattacttatttaagtttattacgtgaaagaattttttttaaaatattttttcacataa

SEQ ID NO: 5459 - DNA, 1943 bp, Glycine max
  Soy_ogl_948 Gm03:38675901..38677843 Cluster 24
tcccccttcaaaaatatgataataattaatgatgaactgttctgatatattatcaagcataagtaagtagcgatatagtagtatggtatgattcgtatatatgagtaattattgttggacaaaatttaagtgtaagatctttaagtgtttgtcatgttattctttagttaaaattgagatttaatcttagtaactcgtatattaaaagtttatatttattaaagataagcgtgacttatttgagtgaagctttaattttaatcaaaaagcaacgtcacactaaagaataacccaaattttgttttacaaaactgagtttcaagaaaaaaatttaatgtgtaaatatatttttaagaataattaagtaaacatatcacgaaattaaatttattttcttttgaaggggaaactaaatttactttcgaaaagtacattcaatatccaaaaatactttttgaatggttaaccaagtatatgttctaactttttagtctcagttttattcttataatttaaattttaaaaattattcacaaaaatattaaattttaaccaaacactttaagagaaaaaaaaatagaatagatttctaattattatattctcaacatttatgaccatacaactttagagcttgaaacaaacattctccgaatttgtgaaaattgtcagacttcgcaatgtaatatttttattaaaataatggtccaaagagcataaaaatgttttggctgatattattctatgatttcatttttctcttggggatagaaaatcagagaggaacgactgagttattgaacttgtattttcttgtctgtgtagtaggatatttttaccaaaattttcggccaatgacattctctctgtcttccttaaattttgttgctataactaaactcatcaactattgagattttgtaatgcgatgattaaagaggagtttggtaggagaggattcaaactgagtgtgaacatttttactgataattgtataagattttgctacccttgagggatggataaacatttgataaaattgatttggaatataattgattttataaaatttattttagttagaattgattttgaagttatgtttgaattttttattataaaataattaggagtaaaattgaatgtaaaattttggatataaagtaaaaattatttaaagttgttcagggcataataaattctggacccataattaattttaaaattttctccattatgaaaccaacacatgaaaatatatttaaaattaattttaaacttagaattaattttacaacgtgaaactaaatgcacactaaattttttcttattttgtaattatttaaataattatttaataaataattttcttacaaaatatacattaactggttatacacaaattaaaaaatttatttcaaacaataaaaaagtaaacgtatcttaatttgttttaatatattattgctaaaaactctggatataagaacttagtagttatcaaatcttgccactatcaatgatatatataaaaatatgtttataatataatattatatccaatgctatatataaagtattaactgcaggtagctgttcttcctcctttaaatactaaagcttttcgactaatttataaatacaattatagttaacgaaaacctgccaaaatttttgagacaattattatgaagttagcacttataacttatgattttcagccactgctagttattccaggaaaaggtactccacataactctttattttaaaataagatgtgtgaggggtcaaaatgaccaaggtattctattttcaaaattatcaaaatggaggtaaaaaatttacgaattcaattttttttaatacggctttgaaaacataattatttttagttttttagaagtcataaattatttaccacttcaaagtcataaataatt

SEQ ID NO: 5460 - DNA, 1079 bp, Glycine max
  Soy_ogl_1809 Gm06:6675301..6676379 Cluster 24
acagaatatcaattacaataaatgatcaaaatcatataaatttgaattaccatgtatatgtaatttctaaaataaattgccaacaattaatgtcctttccgtgtatcttctcaacttttcatttcaatataattatactatagtttttttttttatatataatcactataagttgtttttataaagcaaataacacaataattcattcagctttgtgaatcattatcacaatcatcttttacaattattattcgttctagaaaagtaaaccttatattcataaatgttgtttctctttaatattttttcataattaaagctagcacgaaacttattttgaatcatttgtaaataagcacgtcttgcttaatttatatctattttttgatagctttgttgaattttttgtttcgatattatcaaaatagtagtgggttaattaccacatggtcaaatagttgaatattttgtgcgtttgcgtttaagtgtctcataactactcatttgtaattagaatgcatttttaaataaagttttgtatgatttaaaattaaaattaactacgacttgaaattaaaaatacatataggctacatataggcttaaacttaaaattaataatacaaaagataatacatagaattaccaagcttacaatttatttattttttgaagggagaaacttacaaacttaattttactaaaaaaaatccatttactgaaaaaatcaagtatatagttttgtttctgataatatagttttttttcttctttcagaaactgataatataacttttgtttaatgaaattacaccattagtatagatattgtaggtctacattaataataggatatgttattctaacatttgatatattaatagcatatatcaattatttatttgtataatacattatattattagtatagaatgtaaggtttatgctaacgattccattttttaacacaaaaattataccaacaaatcttgattacaattttccttagaatttaagggataaaggtatttaaatacgataaattactaatcacaatattcaaactaaacggttatttg

SEQ ID NO: 5461 - DNA, 1200 bp, Glycine max
  Soy_ogl_2391 Gm07:36234501..36235700 Cluster 24
agatatcttttggaatcatatatatattaacacattattaatttatcaaatagttactccatctattccattttagttatcaaatttttaaagaatttttattcttaattgtttgttatttttaaagttgaagatcaccttaattactactttattaatcattctcttatttgtctcattgtctttaattaatttatatatgtatttattgtgaaatgaaaggaaaaaaaaggataaaataagaagaaaagtgttagaaacacaatctctaacatatcccttttaacacactttttaattagatgtaacatccagtaaattaaatttttatgatttttaataaatttcaactaataaaaaaattataaaaaaaatgtcttccaacacttgtcaaataaaaaatttcacaactattttaatagaattaaaaaaatattatctttcttaatttctagccaacaacttaaaaaaaaagaaacagatgtgatacaactcattcataataaccgtaatcactcacgttttccatatttaaaataacaataatatataaacattagcttattttctaattagcagtaccatcttgacaatttggtgagcaaaattcaattttcacgtacaagtctatatataatgacaaagttggagatgtgatccaataaacaccgtcctgtatgtccataaatatggtgctgtatgtccttttcaatttgccattcttccctactattgctttcattcttaattatattttttaactaattcatattatttaagaaaaaaaattaattttattcatcacattaaattaatacattatttatattattattccaatttttttacttattattctattaacataattttttttatcaatattcatagaaagaataattaaacaaggtatatagaattttgtgatgtaactaaaaattagaaaaaaaatataataaaaaagaataaaaaactttttttaaaaaaaagttttattatgattaggtttcactaatatctatttaacgctatgtcccatatatcttttggaatcatatatattatacattattaatttatcaattttctgaaagtgaagagatcgttatattggagctgactactcactgcctgtacaagggctaagggctattcaatgagacttcatgaatatatatgatctctcggttgttgaagttt

SEQ ID NO: 5462 - DNA, 1300 bp, Glycine max
  Soy_ogl_3934 Gm11:37057001..37058300 Cluster 24
ttgatttaattttgtatggttgttggccttagaatgaccaatcttcgctttttgtaacattaatgtttttcttggtacgaattggttccgttgataagatttccgattctgtatgacgattagattttagtttaatttctctctttctttcattctttgtgaggggacacgcgatagtgtagtagaatattaactatatatatatatatgcatacttaattcgggttatttaaataaacaaacacactccaacaaatacttgttatcaacattagctagtgataatcaaaggctatttattacttttatgtatgtaatacaaatattaactagaaagagttatagtatatgttaatgagtctaatgaacagaagaaacacttaatataataaggtgcttttctgttcagttaggattgttgaattgagccactaacagtagcttccatttgcaaccacatcacaaaaggcagtggcatctgtggcctaccccactttctggtgaatgtattgccacgaaaaggtaaacctatagcatatcacgttcaaaatatatagaaaatccttagtgcggtcgaaacgtcaaagtctgtctttgtcgtgcttaataattatactactgcagaaatacatttagggcatgaaactttgatatatagacagagttagatgtaagttattttaaaaaatataattgttgttattaaaagttaaaataaaatgttgtaataagttataataattgagagtaaaaatattcaaaaaagatatataatatcaaacgaagatatttttttttataatagttatatattatattataatttatatcttgtgtatatatataatttattttttagtttttcatccggtaaaaaaacatttttcgtaaaatagtttactttagtcgtgtaaactatataactggaaattttatatcaagtaactgaatttaaacttaacggagaaaaaaatgtgcgggtaagtgtatttagatacttgtataattttatgtatcttgaaattttcatttatttttaaataaaagtagtcttcaattctttaaattttcaattctatcgatttaaaataataatatataatttttcacatatatacaatgttttgattcaatatgcagaaataaggaaccaatagtagaatcactgtacaactttcatttatttaatttataaagcatgtgtatagtcaattatttatatcatttgattctattaagtctgcatatcattcactgacgtattattcttttggaatgcagctactcattttttagccga

SEQ ID NO: 5463 - DNA, 1300 bp, Glycine max
  Soy_ogl_4999 Gm15:11468201..11469500 Cluster 24
tttagtgtatttcatcctgtgagaaatacactcaaacaccaatggttacaaaaacaaacaaaatttaggtattacatatgtgatacctcaagaattccattcatctaacggaaaaaaaaaagtttgaatttaaatattgtttgtgtaaaagttgagacaatgtcctacatgatattaggtggaaaatgggtaatgaataatttattttctttttgataaattttaggttttcaacttgcacaagcttgttttcctaagagcatccacaagaagatctctctcttgaggacaatccattcgtgcatatgctgacgattcctttaccactctacaacgggcgaacaacaaaatatgggattatccttgttaagatcctatgaagaacttttgttgtggatgctttaacaacccacttaaggattttcttgtaatgtatattctaattgtctttttttgtcaattcatcttggattatgactagcttggactttgttgttgttgtttttttttttaatattgcaatatttttttttaaaatgcttgtagttcaagctgctgatagtaatcatatcacttattagtttgagggggatgggggtaacagagattatagaaggtcagcgaatcatttagaacgttagaaagttaattaggaatagttaacaatcaacactatatataagatctttcttcattgtatatttcacaatttttttccaatcaattcaatatattgggttagtttgtataaacttaaattttttttaaaaataaacatttttataaagtattttttaagaagcatataatttttttaaaaaataagcataaaattattttttttaagcagaaacaatttagacaaatacattcaaaaatgaaaaaaaaaatcatttattttattaaaataataatttatttcatcaattatcttatgagtagcaatatgctttttacctctcttgtgaatttgatctttctccctttgattcatagattcttcacatcccttttatatatacattttttcctcatccaaaacatactacaaagtggaatatttctacccccaatgaccccaagtatttcagaaggtatttattgtgctttgtagtttgtatgaaatttgtcattattattttttcagaatacaactttcagtcaattactaataaaaattctaaaatcaaactttatgttttatatttgtatgcttgaaatttgaaaaggaagaagttgttggccagctaataatcagaggaactgtgcataacttaaattggagggaatggatgtatgt

SEQ ID NO: 5464 - DNA, 1160 bp, Glycine max
  Soy_ogl_1178 Gm04:2184601..2185760 Cluster 24
agctaaagggccttgcagcccatttaattttaagtctctcatgatgttgtcatatgcatgattgcatctaattgaataaatgtacttttcattaacactgtcaaaattaaatttgtatatttgtgagaattaagattttagtcatgttaacgtgtttataatgagtgattgcgagattactaaggtgtttttcataaatggttttgttattcatataacatctcgtctaatattttatataacaatttgaaaaaaaaaaatgttgctttaaaaataaataaaaaatttaaactctcccatctaaaatccaaacgtacacaaaagttgaaaggaatacaactctcgtattaattatattatcaagtcagcctacaagttgctttaatcttaacagaacttttttttttctaatctttggtggaggttgtttttagacatttttgaattgtgcaatccatttgaaggtgttgacgtatgataaaacaaagaggatgtaacatataaaaataggttatgatgatttatttccttaataaaaatgttgaataataaaaattatttataatttatattaattactttggaaataaattaattttaaaatattaaatgtcacttttaaaattttgtatttttcttacattaacggtgagtttttaatattgatttgatatatccatatcttatatctatatttgtttttatgccattatacaaaaacaatcctaaaatctcaaattttatttgcacatttgctttttaggttttataattgtgcgatttcgatcctttaggttataattatttgaattaggtccttccgatatcaattatgcacttatgatttctttatttatcgtttgttagatatttaatattgtttattaatgtggcagggaatgattgtgtgttgtttgacacatatattaacataacttaaatacatattttttgattttgtagtatcacaattgataacccatgagtaccatggtaatatatatgtcagtcaactatcacaatatcatctaatgtcagttttttttaataatggttatagttagattcgaacccacatcattaggctcacattagtggttcttgttattgctatttttaactacttcctcttaatattttataagaaacaaataactact

SEQ ID NO: 5465 - DNA, 1000 bp, Glycine max
  Soy_ogl_2975 Gm09:3917301..3918300 Cluster 24
ctatttttacgaagtacatccctcctttctctttatatttttaactatcaattataccttttttatttgttaaaacatagttccaaaattaatttttggaacaatatatattaatttaggaaaataatttctagatttactttccagaactgatatatgttgttcgtaaagtgatttttggtagtcaataaacaaaatatgaaatatcaaaagtacctttccttcataagctacaatagttgttaatctataattgctgaacaaatacttatttcaattttaatttagagacaaataacccatatatgaaatttccaatggacaaaacattcagacacacttaggatgtgtcagctttgttattgataaattttagttttttattagccgagagaattaaacccacgacttttccagtattatgtgaacaaggtttaaagaataaaaaataagaatgaagattgaggtttaaaactagagtttaaacaataacaaatgtaggatgaaaaaaaaatagatttaaaaaataacaaacttgggactcataagttgttctagaaagtagttcatggaattatgcattttgttaaaacatagttccagaaattacattccaaaattgatatattttgttcaaaaaattaattttcaaaatctatgttttaagaattaagagagtataataggcaataaaaatataaagagaatggagggtgtacttagcatgtatgggtgtaaatagcaagcaacttacatgaataacagccactgaaaattaaagctctgagttcggccaactggagagaaaaaaaaatcattttgagttttcatttttggtaaaatccaaaaataactgaattacctttcggtcaaggaaaaacaagtaattattttcacaaaccaacttaaaagggatgaaggcatacagttgattacgttgggactttctttaataaatctaattaccaatttactataataagttttgaaaccatttagt

SEQ ID NO: 5466 - DNA, 1177 bp, Glycine max
  Soy_ogl_5907 Gm18:2687324..2688500 Cluster 24
tatgttactattggaacattgcttgtgttttttatgtattccttattttgtttgcatcttttaatacaatctgtaatcacacttggcttctaatttttctatcctttgataatattttgttcactatcttttttgatcatatttatgttcaatacaacttctgatgttactgtattttaatgttctgaaagaatgtttagtttgagatgtttatgaaagtttgtctatataacaatgttgcatgcaagctttgtcattttcaaatttatgaataattacacacacaaaaatgataattctcaagtttgtttcatgttcttgcatttcattgtatgattagaaaatcaagaatttttaatcacattcacaaaataaaccttaatattaggctaaaatatcattttttttttcattttggtcttttatattttaaaatttttaatttagtcatttaagtttgcaaagttactcaaaatgattcatctatcaattttaaactaattatgctactgtttgtttattttaagagaaaaaaaggttacttagtgataaagtaatttttttatataggtataaacatttaatcacaacccataatgtaatgatatgctggttaatttttaaaatatttattttaaagtaatataaattataaattatgattaaatgatgatataaaattattttacataacataaacattaaactcttattttaaattaaataattttaatataattgtgattaaaaattgtcgcaatgtttagattaattattataattaaaatcattaatttaaatatactggcgattaaaaacctcaattttatttttaaaagccacaaatgatccttcatcctggcgatcttcaaatcccaattctaaaaattcaaaacccccaaactccatcaaacaacaagcaagaataaatctccatcaattaaaggagggacattggtactttggtaccaaatgaagctttatcaccacctgtgccataacgtgtcatctttatgtgcgcacagcaatgaaagctgcaggtggttccatgctctatgatcaacgccacggtttttcaaacccacgacagtactatttgtgactaaaatattcacacaaaaaaaaaaactacttgtgactaaatgcaagtgtgcttcaattaatgcagtagaataac

SEQ ID NO: 5467 - DNA, 1100 bp, Glycine max
  Soy_ogl_1040 Gm03:42261701..42262800 Cluster 24
aaagagtacttctatatagaggaatcctttatcgttattatgactccctatgcaaattaatccattcctattttacatagaaaaataggatttttacttttaggaatactattttttattatatgaatttaatttttaatttgaatttaaaatgtttaaattaattaaacatacttttttaatttttattaatatatgcttttaagattgtatacaaatatattacttttattgctttaagtatataaactttcaatatcttaaaatatatttttaaattactgaaactttaaaaatctgtgcaatatacaaaacctgctagtatccggttaacgtggaatttgattggctcatacaacttcgggcttaaattctataattcgtgtgtcatttcttttttgttacttaatctgattagtggtttttttacataaaaaaaggtagattaagaaaccaaagcccaaatgcatcaagctcaagcccgaaggaatagaaagctcggaattaacgaaacgaaattcaacagggaaaaattaaagattccataaaagagagaagatgtactgtgcattgtttggatgaaaagaatattaagccgaagctccttggaatattctggcattaattagtccctaaagccaatctgaaactaatcatccatatctatttataaaaccttctccaaactccaaaggctttcaaagttagcccattatcaatttgacaatctctgcagatacagctgcaacaattaccagcccacaaacaaaacatctaacggtaccaaacatgtactaaaattttatggcaaaactagaatagtaccagtgttaatgcacgaattgtcacaatttctttttatattatttaatttttattttataaaaaaattataatcatttggtaacgtcctatcaagcgaagctaattaatactccatccgatctttattaattaattaattcactagaattagataaattaataaattttaattgagaggattaaatttattttaaattaatatttttcttcttctaaaactattcctatgaacaaaactaatgaacattgatgaattatatttttctcactgtgac

SEQ ID NO: 5468 - DNA, 1370 bp, Glycine max
  Soy_ogl_5007 Gm15:11961301..11962670 Cluster 24
aataaagtataaggctaatgatttactattgagttccaaaatgaaattgagtgttcttggaatttcaaatcacaagttgaagtaaaaggttggagtccccgtcatttttacaaaggaacattgatcaagaagatgacttatacgatgaaactagattatttgttaacgagcctaaaaaataatgttacatctgcaactgttttgacgggccctaatacaagaaacaaaatattggttcctagaatgagttcggtgcctaccaaccttggcttaccctttaaatttcagagataatttcctttgattttgttttgcaatgacaattaacaaaagtgaagaaaagtctctatctcatgtgggcatctatctttcaaggattgttttcgctcacagacagttgtatgttgcagtttctagagtaacatcaagacagggtctttaagattttgatattagacatgattataacgtatgcacatcaacaaagaatctatagtatatagtatatacatataagaatgttttctaagaggaacattaacatgtaacattttccagagttgtaagcaataaattcttatttgttaattttaattttaaattaaaattgatttatagttaatgagtatcaattcaaatgatgtaattagatcagattaatgatttaattgattacaatcaattagtttataattatcatagtcatctaattttataatagactaatgtactatagatactaattatataacattcaaattaaatcaattaaaaattatggagagaagaaattgaaaagtcgttttcaacctctaattattaaataaattgatagaaatataatcacatgcacgatcatatatctccttttaaatatctaattctcactaattctataacaagagaagggatttagcaaattatagtttgaattattaccatcacttttttatatttttataattaaagtaattaattattgtcaaacatattttatgattaagtactgtcaatttgaatcactaatcatttttatgaaatgacattcttaatttatttaaaatatcctaaatacttatagttgtattataattctattctattgtaattttgtcatgattagtataataattcgtacatccttaattatatttgaaatatctataaaaaatttcacaatatataaatataataattataatgattgtcataattgattgatagcaatcaaaattttaataaatgtcttcttttttaaaataatttagaacacttttactacaattgatgtcacaattaaatcaatttttagtatatcaatgtcaattaaattgatgtcataattaaaaaaaataaattctggtgcagtg

SEQ ID NO: 5469 - DNA, 1082 bp, Glycine max
  Soy_ogl_55 Gm01:2467519..2468600 Cluster 24
tgaagtggatacaaaaatatgacaaattataaatttctctttaatgcaagcatgaaaatgcaatttttacatgaacgcgtatgcttgagctgtaagcaatactcttgggtcacaacttggataagaacaatgtcccacaactacaagttcttctcgtttttggtcaagaacttgagatcttgacattttccagccattttccttttccatgtccagtaatcacactgttcattcgaaccccacacctgcttgagatgcctacacgatatgcagatggcaagaatactgaatctggccaccaaattaaaatgctcatagttccgaacatgatgaccaattatttgcacatacggtacatatttaatatgaaactgggatttttttctctctttcaaatatgttatttaaagtaggataaaaatagagcatattgaataaagaatggataaaagataaataggtatataccaaaattaatggtcctttatcaatagtcggctaaatatttaatgtacttttttttttaacttggcgttgaatgcgtattaactacatcagtaatattagcaacaaaaaccgaaattctaatcagatcaaccgtccacatttatgaaggtttagatatttttttagtttttataatttagttttttttcttatattttttaatttttgtaaatgatgtttaattattattttttatttttataacgctttaaatagtattttattattatctaaacagattaaaaaataaacataattcagaaaactaaagctaaaaataattttgtaaggatgaaaaataaacattaaattataagagttaaaaatatttaaatcatttataaatcattttgaattcacaatcaacaaatctaaaatactactatcatttatcactaagtatttgtacacaacacaaaaatatttttaaagtgagaaactactttgacatacgagcaaatacatggaagtctataacggcaaggatggataatggatttttcagtgaaattgaccagttctgttcagtttacatgacaatacttatttttcatttcctattcattccgtacaaa

SEQ ID NO: 5470 - DNA, 1038 bp, Glycine max
  Soy_ogl_419 Gm02:6528401..6529438 Cluster 24
cctcattttcatttagcgaatcccctcccactttggtaatatcttctctcttcaccaggatttccttttatacaccttgtatcctaattttaaaattgaaccaatgaacttgtttctaatcttaaaatcaaactaatgatatcctttgtaagcactttttgtgtctgaagcctttacctatatttgattgagacgtcatcttcttccctaaattttatttataaaaaatgataaaatccaaaatctaaatgataagaataatattcttatctttattaaaaaaaaaatctacagatttgaattaaaaaattaaaatgttctcttaatagaggattaaccttaacatctctctatggcatcaaatacttgagccagattctgccctatcctcttttgaatatttagagggttcaatttttgtttgttttccccgtttcaactaatattttttcaggcattgagatttgccttttttttatggctaatctttagttcgtctacttctatatagtttttccatttatgatttttttacttttattttttattgacaagaattagttaaataatagaataagaatgtctaaattaagagataaacccaataggtatagcttagttggtccaaaggaccaaaacttataggaatattttggaataccattgtgtaaaatttaagattttaattacggtgatggtaaataaaaaaaatagaagagataatcaatgagaagtcaaattaactcaaatttataatttttgataaattaaaatgttatgaagaaagagtatcgatagtatttttgataatgaaataggtacttatcactttagttaccctaaaaagtcaaagtatagcaaaattgaatttaattattttgaattaattaattaaataatatataaaagcaaaagcgagtgcaaatttttaaaagattaaatattattatatataaacatgagtaaaacattcaagtaaccccttagatataagcacgtaccacttagaatttcataattcaagcataaagccatcta

SEQ ID NO: 5471 - DNA, 1000 bp, Glycine max
  Soy_ogl_798 Gm03:1858401..1859400 Cluster 24
gtaatcgcaaattatgcccatgctcatttaataggtaaaaatctatcttattatgagtaatttgggtggatgttcattaaatctaggaccaaatatcatcctaattcaattattataccaaacatgtcaaagatagtaacatacatttttaattatgcatttaagtcatctttaaatctaagatattaatgtatccatgtcacgaatttaattttctaaactaaggtccacactttaaagaagaaaatatatggtcatgattattgattaaaagtttattaaaaaaaatattgattaaaaaaattaaagagattttttttaataacttcactcacacacacacaagtataacacatactatcactatctcaggaacagatttttcaattaacaactttaactccatattttccttttctcattatcaatttagatgagtcaaatcttgtagtattttatagttgctagatgaaggcgtggaatttaataataattcattcatcattcatctgggtttaaaacaatgtaccactatttaagaagattaaataaaagcagacaaaacagaattcaacttggcaaagtagttggatgaaaaaatgaaagaaggaaaattttctgtgctacctaatcttagcataagtatgtatttttggttacataagtaaatgtttattaaacataatcaattaaaaatttatgtttttttaagataaaaatttaagttaatattaaaacaattctattaagatttttttaatatatatgtgtgtttttcaagacattccggttaatttttttatatcaaacacttgtgattgaatgagataattttttaacttttagttaattttcaaccacttgttagcttttcaattatctttcaaacatttacttaacttttcgactaaactaattttatccaacatactcatactacaagataaatgaattttttaaacatgtgtgatgataagtgtaaaaaattactttaatgtaa

SEQ ID NO: 5472 - DNA, 1098 bp, Glycine max
  Soy_ogl_2478 Gm08:2871501..2872598 Cluster 24
gaaaaaaaatattaaaaaaattaattctttaaataaatatcaatatttcaaaaaattaatcattaattttcattaaaaaatattcccgtgcagacttttttaacggtaggataaacagttgttaaggtaatggagaaaatgctgtctcctaagtctctgacaatgagcctccacttaagtactatttttcgcacaaatcatagttatacaaaaagcaatcaaaatctatttggatttcttgttatttgaattagttagaagtttatgattttaaatattttttttttattaagcactttgtcttaaaaaaataaataaattaacggttacagaatcgcgagtcaaaattcggggacctcggatgttaaataaaataatcgttctttcaaataaaacagaacaaaataatcttacactaacaaatactattcttttgtaaataatcgttgcaaaactatcgttgatactgaaaagtatttatacgttataaacataatgcaatgctcagaaacttttttattaattcaaaactagtttaaaatatttaatatatctttaaattagtgtaatttaataacttcaaaggaagataaaatctcaaacgtctaacaagtaatttttttataaaaaaagaataatatatataaaagtaacttgacagctatcaagttattgaatgatcagtaacgtgtagggtataacttaatttttttttataaaaaaaaacacttattcttttgaatattgtagtattgccatgtgtatagagttgacataaaatgtcacactcccattactgagtattttcactactcatttgttaatgagtgaagatgggtatcatggtacccttatttacgggtatatgttactcagtaatattaaaatactaaaatagttttatatgtatattttatttatacttattttttggaatataattttttggacttatatcttcgtataattttagttgagtttatattttggaggataattttgtttggagctcacaataaaattgttattttttatattttttaagaattattcatggatatttctaattgtgtagaatatttgagtattttttgttgg

SEQ ID NO: 5473 - DNA, 1347 bp, Glycine max
  Soy_ogl_3474 Gm10:40551554..40552900 Cluster 24
ctttttctccctaaaagttcaaaccacagcccacaacttgaagaaattgctctagaatgtgttttcttttctttccttttccttcatgtcatgggtcacgcatgtcatctgagccaataactacatgttgtcgacttaaccatttcctgttgggatatgcttctggatgatttatgaccgtagatggaaaaaaaataaaaatagtgagacacctgtcacttacaaatctcacggtctatggactcactaaaattataccacttaaaattagccattgattaacaacaacaaaaatagccattgaaatttgaaataaattagtataattgttacaaaaaataggatttctacaatagttaatataattttcaacaggttctttttttatatatatatagaaaatttccaacaggttctactataataattttgcaattccttgtaacatgatattatcatattttctttattaacgtgagattgaaatccattcaggcataccctccatcatattcatactttgatcacgtctcatgtttctataggggagtgcattagtataaaggggagtgaaaatagtaattgcctaatatttttgtcaagatgtccatatttatagttttaaatcagtgtttggtttctttttggattttcagtttgggcttggaagggttggtctgttccagatcttgggagctactattaacacgatcacttttgttattaacaccattactaaataaaatcaattagcccataaattttacagtcgtcagttttctacttaattaaaaggggtaacaagaatattgttaagatgtttagtaatttttacagctatttattgattaatgaatgtatttacagttaggttttatacactttctttgcataattggattagagactactggcttttataaaaaaagagactactggctcttgatctcatttttcatgatcatattttacataatttttttattatatttctaaaataaacatcagtggtggcactatattataataatataataaatttagttgcctttaattttaatgttctaaaaatacattatgacaataataaatgtatcaaatcatcctagaatattagattttaacaatattgatcttgatcgttttgaggaccaaggactaatttgttgtaaaagaaaatgacatgggaagactctattaaaatttgacaatgaagggataacgtatatatttattatggtatatatttattatgggaagaatattaaattgatgattatgtatcttgaaaaatcaagtaggtttggacatctcgagttaacaaatggattagaatttagacacccg

SEQ ID NO: 5474 - DNA, 1100 bp, Glycine max
  Soy_ogl_3560 Gm10:46074201..46075300 Cluster 24
aaatcgttttttgtttttgtttcttgtttatggaaataactgtcatatatgacactttgcattaacaatagaataaaaggagacaatttacttatagagaactaaaatgaacagtatacttgaagagattaaaagtatattaatcttttattatattttaatattatgtcatttgttttaattattgcattgtttattttatttttggtagaatattggatttttatagataaaaatttaaattacaatttttttttcttcaaaaaagtgttatttgaaattttatttaaataaaagaataacattttaattttaaggaaattaaaattatatttcagtatgatttttttaaacaaaaaaaatgttattttctgataattaatgaatgaacaatgattaatgtaaatccatatattatttaacagctataaagataaagagaaagaagtgagagaagtattttaataaagtattttttatgcataaaaattaaacgtgatatcagaaatttataatattcatatatttcattcaatcggctgaattaattttttctattcttgataagtttttgtgataaaaaaatatttatacatgactattcttaaagaatataattaacttgatttcttatgactttctacctttttttttaacaatatgtctttctacttattactctcaattaacattatatattagtactatattactccgagtatatagtagtgttggtctcccaaataatagcaatttggagcatgacacttttacagccaccctaactagaagctacgccgcactattgttgaaaatttaatgacaccgcactttagcatttgttatgaatgatatgtctatgctttttcatcatcaacttgctcccttgtagtaattctactcctactcaccgcgcctaccactctagtaattattttggctatctctctcgctagtattaatcatcaacccacactccaatcatcatttcatcattttactcaacagtaaatcaaccttccttgctattattgttgatgttactcaccagcaaatcaattttattagtatttttggttattttaatggtaaaaatgttc

SEQ ID NO: 5475 - DNA, 1300 bp, Glycine max
  Soy_ogl_4848 Gm15:1021701..1023000 Cluster 24
gatccaattaggtatttttcaactttttcttttcttttctttatctgcatgaaaagaaaacaacaaagctagaaacgtatttttcgactttagtgcatgtttcactgtttaaatatttaattatttcgtttcagggtggtaatcccaaggttagatctatactttccaacaaaatgtttatgataaacactattaatcattgttaaaaatttaaaatatttttattaaaaatattagtaatatattttactgtgatttttatcacattctctacatataattttcatttttaattctttaaccactaatttttatcacattctcttatcagtttcatatctgcctcatgtaattagcgcatgattttcaagcaactgataatactagcatctaatattaatgcagattatagcttttccactttcggcaagttctcatagcattttgagtatgcatgtctttcgttttaggaatttctggaccacgccttattgcatgcttcggattgaacttccaggtttcaaagccgtcatcagttaaataagcaagtaaggaaagcgaaatactgtaatatatagctagttatgttatgtcaacagtataatctaaaaataaactttggcttttaaattatacatttaattattattctattgctaaggagatgttaagtgtcaaaaaaggttaatttagtttataagaatcaaactaatatctcataagaatattatagatttaaatttctttataatatgagaattttattattaaatgatttataagtatcgttgtaaacgtaagtaaatattaaaatatgtcataatcttgataagttttaaaatctgactcacttaaaattttataaataaataaaaaaagaaaaagaccttaaatccttaaccgatcacgatagattcaacatgtgataacagttagaattacgttacttgaacctgaaaaaattgaaatatatgacatcgtataattatattgagtttaaattctcttatattgttgaataatatgatatgattatattgaacaggaaaaaaatagttgtgtaataagacctaccataattaattgtaaaaaatattaattatattatttgataaaaaaaatcatttctttgtctctccaatataatatgattctagtgttactaaataatataaaagatctaatatctaataactaagaatttttatctctaacgtattttctatttatattttatatacacacatctttaaaatataccataaaatccaagcgacaaatttttattatccttattttt

SEQ ID NO: 5476 - DNA, 1200 bp, Glycine max
  Soy_ogl_6270 Gm18:59195101..59196300 Cluster 24
agctagcttctattaaactctcgattgtttcagaacacataacagtacaaatttcacgtgactgcttagtgcttacatatttttgcaaggggtccatctgccttttatgattataaagaccagacaagacatgtttatcagttgcgattattttttacagaaaaaataacgatccaaatagcagaaatcattctatttcacaactttggtcgctcttgtgaaagaaattttattttaactccacaaatacggttatggacttaatgtatattttcttccgttttatcattgttttggaactggaagatcgatccaattaatccgttcaaatcagtttttgttgaattattgtaaaatgttgaaagtttccatgaaaagggttttattttcacaagtgcacctattgttttatattatgtatttattgtatatctttaatagaaaaatacacataaatgaataaaaattaaattataattttaaccttaatccttttttttccttttcttctcatctaaggtgaaatatccaaatgtttctaggttgcaacatctagcaattttttttttcataaccaagctgtcgcctgtgaatctcgtccaaggagaagacaatgtttactataaaacttaaacaaaagcaacaaaagagagggaaaaataatacagatttgatttttatgatgtactccaatgttggactacttcacttgatatcaattaattttaaattaaaatctaactgacagttgaaatatttggttatgtcctgacaatgtgttgcatggtcttgttgaggaagaaaggaagaattctcgttttagtaatcttggagctcataagctagtttatttatgagtgagcactacaacatatatgattaaaatgcataaacaatataaagattatcataaaattataaatttctatatgataagtttattaattttataataaatatttgaaaatcgtatttaacttttttattaattaatagtgcaaaaaagttttatacttataatgcatgacattatactctagatttaaatgagtttattgaaaaggaacattattctttttaaaagtatatgtaatttataatttatatggcactgtaagttggatgtaacattttgtttgtgtaacatgattataatttatgaacgaaacattttcttattcaagaaataagatatttttc

SEQ ID NO: 5477 - DNA, 1339 bp, Glycine max
  Soy_ogl_6550 Gm19:44088758..44090096 Cluster 24
ttaatcatttttttcatttaacatttgatttttctcatttacgtgatagttaggatttatatatcgagtatgcaatgtaaaaagagaatgtatacacacattgaatacttgtaatcaaacgtgcacataatcgattatgaaatgtttttggcctcttatcttaataaagccatagttttaaaaaatagtttgataatcaattatcattcttgtgataatcattggtactgttgtatttctgcattgttttaaaggaaaataaaaggtgagaccacactttttttattaatttcttactattttgctctatcaaaaacattatttttcttaaacttatttcttctctctattatttctttaccatttatcctttaccaaatgaagagtttgtgcttggaagaactattttaagaaaaacaacgtttttcaaaaaaaaaaatcttaaaaattataaaagaaatattttttttttgtttttaacataagatatcatacattgtttaatgggatgaaatgtctatataaataaccaacttacgaatgtagaatctatatgcttgatatattcaaaatcatgcattgtgcacgattgagtagtgagttgtcttcgatttttatatattaaagagtgagaaaataaatcatgtcagagaaatgtaggggaagaaattgaagtgtctgcaaggatcacatgaaatgaatatggccgtagcattagggtgagagtagtggctagagagttgaaaaaatctgaatgtgatcgattaatggggcgactgaacctaacccccgtcccgcgggtattaacgtgggtgggaaatgggaatacatttacgtacacaggtaatgtaatatgtacgctacattatgaatttataatatgatatatatggaaatgtggaagactgaaactcaaacaggaaagtcgtaaattgcaaatggaaaaagtcacttctgatccacacttgtttcgccttttaatcacttcttgccaacgccgtgcactgcatgcataaagagggtctgcaacaagttatcagttcaccaggataatttattcaattcacaaataagaaaaaattctcatactttgtttcttaatattttattttggtataagttagtattcttttttttttatctattcatacatttattaggggtggacaagtgaaggaacaaatttagtaactatttaagtacaaactaatcaatattaattggttgaatcggttcgtttattttattttttaagtaacaacttaaaccattaaaccaaactaacctttattttactcataaaccaaactaacctgaacatgtttaaattgggcctatt

SEQ ID NO: 5478 - DNA, 1392 bp, Glycine max
  Soy_ogl_6884 Gm20:40282401..40283792 Cluster 24
aacaacatgtacttttgattattatttctccctcttgcactttcaattggcacattaagacattgaagtttcgtcaatccgttttccattaatgtttaaaagattctaaaaaatctgtctacatcttaaaacttctgcatgaaatatattacaggtgaccaaagaagaaagcgagttcgtctttttacaaaataggatcaaagatagcagaaaggtgaaagtaaatcaatttacttgaaagcaatataactgtagaagagtactaccaaaatcgtcaattaattgttgtagaattcttaaatttgagtcttattatatacaattacactaaatatatactccaccaaattcttatacccgtaataagtattggtatttatctagattttatttttttatttagttattctatctagctaatttttaaatcctatacacacttaaaaaaaacctatatttcttttgtatcatattaattaattacataataatgaatttgaattataattgaatatgtttattgttttaacaacctcttgaatcactacttagactcaatcattttattcgaagtatatatatataaaatgttttttatatttgtatttgttaaattttttacttattttaattcaattaggtgtaaatgaacaattactatatagtgttattcctaaaagatttatccctaaataacatacccaaattataagaaaactcatagaggtaactattgaaaaatttatatcgaaagaaaaacattatcacctataataatccaatttaatttgagatgaattgtctttcacaaaatatatatgttgattatataaaaaaaatagagaaataattgcaacaatcaaaattaaaaagacaaaaatatattttatgagtatttatttaaaacgaatcatactggtttctatattgacaaataagtagtatatcttataaccaaattgataacctttctatttaaaattagatttaattttaaatcatatttatatattttagtttacctaaggggttggtctagtggtcactacgttagtatgtagcataaaaatgtgtacaagaatattttcaagtggaaggtctcttattcggatcctgtaaaggaacatgtggatatatatctaaaaacattaaatgtttagttttaatgtaaaggagcatctacttttccatacttatgttgattgataatggttacctcttacggtcttcctcttgaaaagttctcacttaatgagttaattaagaggatttatatataagatgacgagaagagtgagtttggactatataaattataatcatggataattaacattaaatttttaataatcaaattaccacttgaaaaaaaaaatcctattgaacgcaaat

SEQ ID NO: 5479 - DNA, 1398 bp, Glycine max
  Soy_ogl_2198 Gm07:4938803..4940200 Cluster 24
cgtacgtacgtctccttctcgagctgttttccatgcactcttaaaaaaaatcatgttgaggcatcaataattgtcggctatatttaagcttggttatattctcctgtgcttcgacacttttgtggtggaacatatatattctccacacacacataccaatatctgcattccttggtagttaaggctatgtacgtttatgctaaaattgattttaaaaagttgacgttaaaacaatgttaaaaattaatttgttttgacatagagaacttatttttgttacgaaacctgaattccacatttaaaaaaaaaaaaaaaaaacctaagttccacaaaccataccaatacacgtataaactttttttattttatttacgaaacacctgtaaaattttaagagaagtagtgagttgtaatttgtgtttggcataaaacaaggttactagctagacaaaaaatatatatatataccactaaacgtgtaaatcaattaacataaagttatttcagttcaaattttaatatataatgacaactacattaattataattacattaattttgtccaactaaaatgaaattgcatgtcttttataaaaaaatatgtgtaattatttaaaaaaaactaagcataaaatattgaccaatcaaatgtatttgtcactctcgtggcattaattttgtaaaattcgtcttcgcacagtttaacatttttctttgaaataatatttaaaattgaatttaaaaggattttgtttgaatataaaataaaggttttgagataaaaaaaaatatttgattactttttaacatttggtgagatttaattctaaaatcattctatttatttgaaagctttttttctacttgtcttaaattgatctattttactaatcaaacctgaagtatttttcaaactgaaatttattgctagaaacatgattttttcagcaaaccaaacaaactatacataaagtaatattacttaccaaagttgaagaaaaatctcgaaccatgcaaaaagtaaaagaaaagcacttctccatttcggccgccaatattttgtccattgtttttaatttgtgtgaaatcaaaattatagaggttgacatactaaaacacaattaaatttttttatcacggtatattatgtataaaaaaaattatactatcaataaatattacaaaaggtagtttcattatatgtgaccatttataattaataaattaaataatagtgtaaaaaaaaaaaagcattcacattttaagtgcatattaattatagtctataaattttctccccgaatagaattgtaaatcactatacaatctatgaaagaagaatcagatgattgcttttgatatgcctttgtcaagaaaaatcagagtattcttttgata

SEQ ID NO: 5480 - DNA, 1026 bp, Glycine max
  Soy_ogl_1386 Gm04:44218275..44219300 Cluster 24
acattgtaaatgtaatctaataaagcagcactcataattcatatagatatatcactgacaattctcgtactcttgtttcctagcgatcaacgttccgacaaaatgtgtagcatctccgaaataaactcaaatttaaagtaactgtcaaggatatttgatgcttttaggtggtaaataaaatcatatgacgcttacacagtaaatatgttcggcaattttagaaaaataaattgatttgcatcaaaattttgattttcttgtccaatggtagagttaatatttttttgtttttgtaattaaaaaattaataaaaatatttatcacttaatactatattatttaggtggagtttaggttaattataaccaagttaagtttgggcaacataaaactctataagttcaaaattataaagagcaatgtatctcgatgtagtcaaactttttttggatgacaaataactctttagctataagttgtgaggaatgatgaagtttaatggtttcgatggtacatttgaaaattttataattgtcctttattttaatcctcttcgtatagaatagtctgtttggttattcaaaattgcattttgtttagtcacaagaataaagttttaagttaaatattaagaattacgatgctaatttagccgtcaccctatcatatcaactaatgtaaattattctaaaaaatatgattttttttttaaaaagcaaatccatttaatatttcaaaaacgtgattttcttaatacttttcttactaaaactgttctaaaaaaattttatttttagaaaaggagaataatgatgctggttacatcaaagtgtattgcgtccatctacatgcctaaaagctcattcatcatatattatgacaaaaacctgaaatcaactcaattaggcattcattagtcatgtttggacaagaagcgaagatgaaaaaaaagggaatactgcattgcatagcacggaacgttgaggtacagtgaaaactgaaaaatgattggcatagtggcagtgt

SEQ ID NO: 5481 - DNA, 1300 bp, Glycine max
  Soy_ogl_903 Gm03:36495101..36496400 Cluster 24
accattgactattttttttgtgaaaatagcaaacttttactatgcactcactgttatatatctttaatatgcactcactgttttaaatccaatagcaagattaataaaatcataccaaatgattcgttttacagtaccttaagggtgacatgtgtggtgaaatcatgataatgactgcatatcgtcagatttagttctcaattcaaaattacaagtgaatacataaaacaaaatgcataaacctttggtttctttgtttgtttagatggctaaaacaatacattgggtaccgttttcaaatggaattggatttatattaattgtttaatttgtaattaaaattgaattggtcttccatgtttttttaattttcttatttaatttgtatattagaattctaattgtagttatgaatctaattttaaaaacaaagtttatattacatctagtcattagcttagactttaaagataaatcatatctaagcataattaatgttgcagtaaaaaaagtataattaatgttatattttattatttcgcatcttcattgctttcatatttcataaaccattatcgtttgtctataattattatgacaatttcttgatgacatttaatcattgtttccttcagtctttttaatttgaccaccgttattagtgacgtcttatagttttaaatttatttcagaattatatttttaacataatagaattaaaattaaaattggaatttctaaatatagttatatgagaaaatagctaggctttacattgatatatagtgcaaaatagttttacaaacatgctaaagtatcttttttctatgattactactcaaagggctatattcagcgagtagagatacttcagctcagcatgtttagttcagtttaatttttttaaaaatggtttatttttaattttaaagaaattaaattgtttttttttcaaatattttccttcacagataattccatttctatttgaggtatggtatcggataataaacatcaacacttctcttgataatgaaattcaaactttaattcactatattataaaatactaattaaatcttttgactaaacccaactcaattggtaattaagttttgattattaaaaagtgaatcatgcatagacagagtacataatgaagaccaaaggtcaacgcttataaaagctattatcattaagttaaacctagccatacgcaagcttagatcagcaaccctattgagaaaaagaagaggagggggtcctcctttccgttcaagctagagccatataaacatct

SEQ ID NO: 5482 - DNA, 1214 bp, Glycine max
  Soy_ogl_3147 Gm09:37140810..37142023 Cluster 24
cggaaaaacttagaaactaccaaatactatgaaaacacaataaacactaatattatttttagggagattaaggtttgttttgtttaggttgaaataggagataaattttgttaagttttctcatgtagattcatatcttttacactcaattttaattcatttttttctttctatttctaacattttttttcatttctctaaatcaaattcacccttaaattaactagggagggaaacaattttgggtaggttactttaaatcaaaacattcataattaacctgaatcctccctctctattaatttcaagggtaactacaaactactattaatttaaaacctcaggagtatataaaaaataaaatacattaactaaataaaatgtattaactataattagttacgttatcataatttatttgtaacatccacccatttaatcacttagccacgtgtattcatccctatattaatcacatatcatatttatcccaacttttaacttcttaaaaaaatattaaatgatataataagtaattaagattttggtttaacttgaaatgatgatatgtgatagacaactaagaaatataatatttttcaaaaagaaaaaacttaaaaactaccaaataatatgaaaacacaataaatattattttttttaggaagatgaaagtataataaacatgccaattaatgagagaaacagttttggtaggttacttaaaatcaaaacatgaagaacctgaatcctaccctactaatttcaaggataactacaaactaccataaattttaaagattataagtccataaaactaaaatatattaactaaataaaatataggataaattacagcaatatcttccaacttttatcgaattacatataacttcattttttattttaattttccacactaacactcctttaattaatttgaaaatattgcactaatcatttcttatatatttaaaaatattacagtgatacttcttcagggtctctttaaatcttacactaacgctctctacaaaagagaaaatataacagttaaaaacaaaacaaaaatatttatgtaattacactaaaccttagaaaatatcactataattgacactaaaatatattaacttttttctgctaaaataaaatatattatccaaataaataattagttatatcatcataatttatatataacagccaccttt

SEQ ID NO: 5483 - DNA, 1054 bp, Glycine max
  Soy_ogl_930 Gm03:37510347..37511400 Cluster 24
catccctgtggattcattgtaactttgattggaccaaaagccttagaaaaagtttataactatgaatttagtgtatttttttacttatttttatttttaaaaaaatttccagatgtattacatttgatatggtaagttaagtttaagtttctcttgatatctttctttaaaatattcatttccatctattatatattttcatactttatatgttcataaaataacacattcaatgaaatatttaaatcaggaaagagatagctataaaaaatttatttaaattaaaattataattataacataataatttacatattgatgtgactttagctaaattgttcatcccatgaattaagtgaaatttttacttgcatttataagaagaaaaaaaatatccatcccttgtgttaactatctaaaataacatttaactttgattgcacaaaaatttttagttaaaaagttaatccctgtgagtttagtgtatatttttcaacttcaaattgacaaaaaaaaaagtagttaaaagtctttaaaaacttacagaatcatgtataactataagataacgagttttatttttacttgaatcaatctaaattttcatttcaaattatttttttcctaaaaaaatacaaccaaacctcgtgatttaatgttaggttataaaacttggccacttccaacataccacccaaaaatatttctatagcacttggatctttagattaatggacatagaaaatattatcttgggtcaataagttttgcactaccatcaaccaaatattccctccaaaataaataaaaagtactaccaagtttgacattgtcttgcaaatatagctgacaattagtattgtaataacattcacagtatcatgcaagaaaatgttatgaaaaaagaattaaactgtctattataaacgaaattaatatctcaaaagcattcagtctaattttaatagtcatcataaagctattaaaaaacatagatgaatttttcatgactgacattggataataacttcaccaaagttatgtaaaaaatctt

SEQ ID NO: 5484 - DNA, 1005 bp, Glycine max
  Soy_ogl_941 Gm03:37739896..37740900 Cluster 24
atatcagatgactttttttatttatatataaatatagaggaagtatatgatttaataaaagcacgggtgtacggttttcttctaaaaatacttataggcttattataggtagcaccgatgagatattagaaaaagtataaatggcctagtttacatttcattttggggtgtttggttgccacataatttggctgtctctgtttttgcttgaccagacagtgacatatcataggaggggtgtgcttcataattcactgttagctaggttaactaggttagggttgagtatttgagtaatgtattgactatctcaatattaaatataaaatctatctttaattcaagtacctgtaaagtagaagagctacatgagtagggtgatgtcagaccaaaacagtgaatcctttacttttcagtaaaaaaactttttgtactaaattttatattagttctattaataaagagtgaattaagttatttacaagaatcaaaatgtaagttcattaaaaataaagtattacaaatataatgtatattattactacatttgtctaaaatatatattgttcttattcaaaaacatatccttagaacctatttggttgtccaacaaatttgattgcccaaataatgacgagatttgatttttttttttttattgtcaagattacttatgtgatcaattgattttgaaagatgtaaaatttataaactctaagagtagattgattctaaatgtaagagttatcagtcttattaaagcatgctcatatttacattttcaaagttattctttatttaaaataattttttaaattaaattttaaaacattattttaaaacataattaaattttcaaaaccaatccttttaaaatcattttcaagaatttattaaaatttaaaaggaacctaactttaatttcggacaaactgctttttactctctttttttccccttctccattacagcaagctgcttttttacttaacagatctagttagc

SEQ ID NO: 5485 - DNA, 1202 bp, Glycine max
  Soy_ogl_945 Gm03:38092699..38093900 Cluster 24
gtgaactttctgccctcaaggcattgaatgtgattatctttgaagttaaaagttaatggtgaaagagtactactacatgttaagaaacctcttaacatgaaatgcataaatgcttgattttttatgccatacacatgttttttcttactttcttttttattgttatttcaatttaattaaaaaaataggaagtgatgaacccttaacagaaaactctcgtgcacctattctgagttcttcatgttcacttcaaaagtggtgaacctaaaaggctaaaacgttgcaagcatgcaacactatcaccgcacctagtcacttcatacttgtatttttttcattttgagattaatataatgttttaattagaaaaaaagtctaaaatgatttaatcttaaaataaaattaaagttttaagtaagtaagaaataagagaacaattttattataataatttaaaatttagaagttaattatattaaagaatcaaaattacaaattaatttcagtttaattgctatgtgttgttttttttcctaatgcactaaaattagctgtaaaaaaagactactaaaattatagttaaatattttttatttgaatgaagaacagtttactttttttgagataaacaaaataaatatataaatatttaaccaagaaaataaaaaatattagtataatttttttctattactagtaagagtaatattttatcattttagagcttcttctatttataaaaatatattaggaaaaaaacattattcaataacttgaaaatataaaacacatttcgtatttattataattgaaaatatataaaaaaaagttataattctccatgttgtccgtattttgtgacgggaaaagagaaataaaaagaaatgatagatattaatataatgtttaaaataaagaaggtttgtgtatcattacacattaaaaaaaaagtatgaatgaatatcatattggagtttatctctgaactagatacgtcaagagttgccaacaacacaataagtatgagcagcaaagccattgctttgtagacattttctcattgcaaatgtcatatttaagtagtttagacatagaggatgcttgttatacatgtgtcctgccttacatggtagagtagcatatctacaatcaacagcaataaacgcatgtttcgaccaaagatgacaagctttgcattgcca

SEQ ID NO: 5486 - DNA, 1097 bp, Glycine max
  Soy_ogl_1100 Gm03:45535504..45536600 Cluster 24
gcttgtaattttaaaaattctttgtttccatactcatactcacgtgagttgtgttcttatcatatgggtatctaaatgcacatatctgggtccattacctgcatttaataatatacaaattattttattattgtctttgaaatcattgttaaatgataattttttcaatgccttaacttattttagcgtctattaatggattttatcgtgaattttaacgggtttataatctatttttaatatttttcattagaaaatattaataattgtttaattagtactactcttaaaatattaattagtacattttaagtacgtacactattaataatgaaatttcttattttgaaaaaataaaaaatagataaacgcatgagtttgtgataaattctacgcaagtttataatccgaatgtaaattacaaaaactgaaaaaacaaagaaaaatgagaatgatttttttattaaatcacattaaatttaaaaatcatttcaatttaatttaagaaaatatgcatttgtatgtgtaatttctaaattattgtatcatatctacttatataaataaaaatccatgaaataaagtatttggtatttaccatgtaaaataaataaaaaagataagatttagaattatttaataaatttgtctttatgtaaggttgaattaacacattcatgaataaggggagcataatctggttgaagaagcattgaattgtcgaaaatcatcataggaattatggaatgcaacaacatacatgataagtgtgttatgtgtaagagtaaataaaacaaacagaaacagggtgtgcatctgtcgggcttggaactcttgtgtgttgtgctctaaagatgcccaaacttcttcaggtgtattcctccctctttccttccaaaatctaaaatcttgcgcccaacacgcaagctttctttctttcattcgtgtttatgccattttcgtttctgttcatgtctttaccttcgccgctatcactctccgtttaaatactgcaccctttttaccacctaccatcttctttttcaccgccttaatctccacgttttgtttaacttctgacatgccatataaaatta

SEQ ID NO: 5487 - DNA, 1000 bp, Glycine max
  Soy_ogl_6217 Gm18:56848201..56849200 Cluster 24
catctatctttattatcttcggaaacacctaatactctctgtctctactctcttgccaaacgtttctctataatataaaatcattaaaattataatataaatttatccatattatctcatttcatttaataaaaaagtttacaataaaaatagtatcctaaaatttatccagcacaattaataaattgttgggttctttaaacatgcgggtaaggattggatttcatgatttacgtatatagaagattttattggaagagacaactcacttacatgtctctatgacttttgattaggaggatattttacttttgaaaaaaagatgataaattcttttaaaacaattaaaatataaaagtgataagtatttgaagatatatatagttaccagcttatcttatttcaactttcaagttatgaccaagtaaataaatgcctttttataattttgttaaacgctttttaatttaattaactagcttatcatttatcaactataaatattcagctagatttttaatttttagctagtttatctactaaatttgtcacaatcatcttatatccttctacctatcccactaatattctatgaaataagtattacataaaaaaaattaaatacatttaatattttaaaaacatagattgtatttcatttttttcttgtttaataaattaaaagatttgtaatatgttgtaaaaagatttcaaattattatatctattattaccacgtgattcaattaagatgcatttcgaaaaatagttttaaaaaaaccattttcaatttttttagatatttgttttcagcatctttagtagaaaaacctcccacttctaataggaagacattttcaaggcatatggcaaaatgttagtagttaatagtacatggcctaccagaaaagacaatacgttaacgatccattaaaacatcacatgacatgagtgcacgctctttcaacatgacaatgaatgaatttgtcagcaaattgca

SEQ ID NO: 5488 - DNA, 1000 bp, Glycine max
  Soy_ogl_241 Gm01:49933301..49934300 Cluster 24
ttgttctatcgctgtgctataaacactataaattactaacagaactaattaataacgtgcacaacgtgatttttattaatttttcttaaagtaagaagtcaaagtcaattgattgaatctagctcatttttgaagtgcaggattatgagaaagcgcgagagacatcagattatacgaaatgcaagagatctcaagttactcaggattttttttattattttattagcataatattttaaaactaatatatttattatttagattttaatatattatttcacttaattgttaataatatggcgtttatatcattcacatgtgatttattttgaaaagaatgaacattctgttatgtttacattttcataaaaaaaaaatattttacacctaagtcctagtgcatatgacctaaacttcttaccactagataatattttattccatatctttcattatagatatctaaaaataatataatattttatattgcgtgctctagctccaactttattggtgcatgtctaattgtctattacgctgatttttttcttcttcttttggcaaatatatactctgatcatgtatgatggacatatacagatttttatactcagcaaagtactattataaatacagatttttataataatacaaaaactgttattacaggcagagtatttttttttatgagatttcaggcagagtatatattgcttaatatgctaactcaaaaaaaaattgcttagtatgttaaactatataaaggaaattataaatttagtttgcaattaacattctacagtttgtgtagccaactaactcaattaactaaacatattggtaggaaatatttgaattgtattcttaaaaggtagatttgttgttgataaattacttacaagaactaatataggattttttataaaaaatttgtaatatgattagacttgagaatgaaatgattttcaattcttaaacgttattgccaaaataaaaatca

SEQ ID NO: 5489 - DNA, 1000 bp, Glycine max
  Soy_ogl_902 Gm03:36365901..36366900 Cluster 24
aatcaaccaatagtgacatgtgtaaacaaatactagtagatcattttagtactaaaacaaaaaaaaaatgagaataatagcatcactcttgtcacgtgcactgcttcttgtctaccttcaatataaaaacaaatattataatgaaaaggaagaattagttaataaacagttacagttagatgtaaatgtgtgtcggtattaggaacgattcccaatggctgaacacatgtccgaaccggttaattaaacccggccgacacgctttcccaagctttcaagctccactccactacttacattattatattttagaccaagtgttatagaaaacagattttatttttaaagatatacataaaagtatatatatattaatttttaattgaaaatttaaatttttgtattagttatgtattttttataactaagatcgaaatcaaaagagaatagcaaaaggaataagtacaagagttcaccagttggtttaatttagatttagagtaaaataaaatttaaataaatttgattggaataattagttgtgattataaaaactaataaatttatcgtatatagtgaatttataattaaatgtagagtaaaagtaccatttatataataagtgagagatttacgttggagaattgtggagcaaaaaaaggtaaggaatattaccttggaagcaagaattaatttttttattggatcaaacaaaaaaaatataaactatgtatattctaagtacatgtttgatttttcgttaagaaaccttcaaacgattcttgaattgaaaattttgaattcttacttttcacataacatacataagaatgtgtgcttatttatccaaacattaaattaagcacacctttaattcttgcatgtaaccaaaaaagaagaaaggcacatgatctcttccttgaacctaattgacaacaattaattttgttatgttgatgtcattgaggtttctttgatttgtttagacgaaaaaaacaat

SEQ ID NO: 5490 - DNA, 1055 bp, Glycine max
  Soy_ogl_1422 Gm04:45808246..45809300 Cluster 24
aaagtcatgagagggttctatatcaattctaaaactgatgtagagtgtcatgaaaaaatgatcactttttacattgatttataattcaattatcataaaaattgatcacttttaacatcaattaagatactaatcaatacaaaaataagtttttttttaatattatttatgttttagcttcatctcaagttgcatataattatacacatgtctgtgttatgttacaagaataaaagaaaaatgtgttactattacaagaataaaaacttttttaagacagattattaaaaatgatttttaaacactttttatttaaaaaatatatatctaattaaagttttctaacattgatgattaggaatatcaagtcaagttgagtggaagaaattgatctcttacaatatatattcaccctaacttaataaaaagtattaagtacctcttcggtaaaaaatatatatatatattaagcatcttctattaaatactttaaataattaaaagggtaaatattgacttattttaaagtattttatacaacaaatatattttataacattttaaaaaatgtttgttgatggataagaaaatgatagagattcttgtaaattaataaagggatggcgttgaaaggcaaaggttgtaagggtccctatggtaagtgggccacacgaaattattgtaacccttacgagcagcccccttcatctcttctagtctttctactatctgccctctccacgtgcgttctcactgggccccaccttccatctggataaacatcaccttaccatttttttaaaatatatatttcttcaccagctgccaattttctttttgtgcgccgtgttattttcatgcgggaaccaaaaatctttataacaccaatattcaaagcattcaactttttagtaagttgctagtattttaaaaaataaataaatatttcttctataaaattgacaaaaaaaacctaaaattctcagattccaagcacggacctggtcatgctccgttccttccgattctctcattactaatcaatgacacatgta

SEQ ID NO: 5491 - DNA, 1000 bp, Glycine max
  Soy_ogl_2982 Gm09:4082301..4083300 Cluster 24
aagaagaaaaatggagcttggaagagtataattgatttacttatagccgtctaagcttactatgtcaccggattctgaaaacaaaggaaaaatgctttgtttatgtctatatttaacagcagcacactttcatgatgaaattaattcaacaagattcaaaattaaagtttggaactcaagaaaatggattctctcatgttaaatttttacatgactatgacattttcatgttcatctctcttttcaaagaaagtaaatacgtgggccaatattaaaatttgcatacaatttagaaaaaagacttttcacataatatggtcatgtaaaaaatcaatttgagactaagttgttatgtctcatggataattgataaataatttacaagaaattgtccatattctaaaaatctaattgcaacttctgcgtgaatttctacattaatgtgttgcgtaaaaattctctgtttatttctctctttttgaatgtaaacatgttttaatataataaattattaattttgagtaatatcgatctccttagataaagtcttgaatataaattttatgaacaaagaaaaacatttcattaaaaataattagttaaattttatgaagactaatcattaaaaaaaatattgaacaatatttcatagcaataataacatgatagcatccattaattaaacttttgcataatataatcatataaaaattcaacataaaaaaaattcactcccatctagtttcataagtacaaactcttcattgaggttggcatcaacaattttcatcagaataacagacccacccagccaattaaatttatttacatatataaaccgtacatgcaggagagtgggatcaacatgcactgaactaatacgtgtagaattggcctaacataatgcagtaggtagaatagaacctcccctagtaccctgcacgtaaaatcattaattttcttacccaaaagaaagataaagaaagaatgaattccattt

SEQ ID NO: 5492 - DNA, 1200 bp, Glycine max
  Soy_ogl_3164 Gm09:37949001..37950200 Cluster 24
ggaaattatttatgcagagacctacctacctatgtatattccactaaaaattcatttgtggatggtgagaggaaaggggcaacaaagaaaaagagaaaaaagtaattaaagacattggacaatatgtgaaatttacgtataaaaatattctccctaagtaacagaactctttttactatatgtgatctcagggtcctggacaaatacattccttctagcaatgaatgattaaattacgctttatttttaattaaaaaaatgtattttagtccctctctacctaaacggtattaaagattttgcttatgtaactaaggaattacaagttacttaaatgaaaatcaccttgattttgcattctttttattaaatatcccatcacatgtttgttttcattttaaagtattcattctgacaaattttgaaaggactaatacaaatatttttcaaattacagaaacaacaaaaaatgtaaatttagaagataaaaaaatattttaaatttaaaggactaaaaatatatttaacccttataacaaattatggattttccaacattttttcatttttttaatttattagaatttaattttgaatactttattataaatgttaaaaaaataaaataaaaattcaaaacgtcttttgttgacttcacaaatttacttcaaattttaatttctttcatcttttaaaattttaaaggtgataataggaattctaatctaattgttgatgttataagataaatcaaaaaagagaaaaattatttgtaaaaaaaatcatttttataagtcgaattaaaatatacaatatattaatctcttaaaatattaattttaaattttatttggaatggttttagtatatttaagaaggaaagtgtaatttatgctaaattgtatattctcaacttttacattattaatataattaagttagaatctttcaccttttttagaatacaaatgttacaaatttgcggccaaattaaattctttcctgcttttaaaaatggggaaggacacaaacccattattttttgtatatatgagatctgagctttacctttgagtgtattggtaatgagaatatcatataaaactccttattcttggaaaatgacccttgatggttctattgaagaccccttgattcatatgaaaggtgtgtgcatgtgctccttctctaaacttaggt

SEQ ID NO: 5493 - DNA, 1300 bp, Glycine max
  Soy_ogl_3662 Gm11:274501..275800 Cluster 24
gcgatgtttaatttctaatcaaaatatgaatgtatatctcactattaaatgagaaaaaatgtaccaacactttctctttaacaaattgatttacacttcttgaacataagtgatcctgtatttttttttatcttatacaaaattttctcaattatcataataatatatcatcccattttctttgacctctagctctcgattaatatttttttgttgataaaaaaataaaatattacatttgtataaattaaataacaaagggatacaaaatattagattatacaataaagttgacacaagagtgagtccgaagggtacccacgagaggacagttgaaaaatgggcaggcgtgcaagaatattaattagcttaggaaggaaaagttgattttttaaaatattttttagaaaaaacattatatataaaaggagagaaatagaaataaaagagaaaaaattgcgataagatgttgagttatgtgaagtgttgcttcatagacccaaaatataaaatacactatatacgtatttcaaggggtatatctctattctctagtgttatgagtcccacatcaaagaaaaatagaaaaattaaaccaccttaatattgtaaaaatagaaaaattatacatgtataacaagtgatacaacaaattgtaccaccttaagagaacgagaaaaaagagaaaattttgaaaaaatgagtaaataaagatagatacacccaaaatattgtatgaatagtcgtatgtctatcatatttctaaaaaatattatatgaataatacaaataatttattgctttctgctgaatccttatataattgattgacttgaaagtatcttatgatattagctaataagtaaattaataaatgtagaataacataaaattagagtgatatataggatacataaaattaagagtttctaaaaagaaaaaaggtaaaagagactttaaataaattagtgatgaggacaaaaaagaaaaagaaaaaactaacaacttataaacactagttgaaatttaaatatacgtaatataaaagctcttattttgtgtcaaacactttttatttttatcaaactaacttttaagttagtagagtaacttgtcaaacacacccacaaactcctaaattaaataaaaattaatttaaaagattttaaataaaaaattatgacaaccaatcgaatttgtataactttaaaagtaaagaaatttaattaaccacaattaaaaaactaaaattacacgtaatcaatataaaaagtactgttaagttaatatttttataaca

SEQ ID NO: 5494 - DNA, 1100 bp, Glycine max
  Soy_ogl_3972 Gm12:1665301..1666400 Cluster 24
tacctcttatttttataatttgaacccgttgctcttaatttttcaactgttttttttttgttttattggatagttattttttctttaagttttgctcctctttgagtttactaagtactttaggtattattgacatttcattttttttccagcttattacacttgattttgatttttatgtttacatgtatgatagtaagaaaatatttttaaaataaattgtctccattggctcaaaatcctggatccgtcattgtccaaacccataagcacatgcacacaaacatatacaattagggcttaatggcttataatatttgaatttatttcttataacttattatcttaaaaatagggcaatgtttttatattgtaaacaaattatgaagatcgattattttacattatagaggacgatcatatttatttatttatagtaacatgtttcattttaaaaaatataatttaaataaataaatttgcattgcttaaaatattttataatgtttaattttttaatgatattatcttaattaaattaatttatttttaagcaacttgcatgagcaactgcattgtagatattctaaagtaacaaaataaaaatatatttatcaacaatctaaaattaattaaagttacaagaaattttaatgcaaataaacgataaatacacttgatttgtcattttgctcttcctttttttttttttcttttccgtcttcactttacttgttaaagagagaatatatagaaagctacgaatcaggcgtaaattgagctagcgtaaatcaaaaataaaattaagagcggaggaaaaaatctcatatattatgagaatattacattcaatttaataaaatatactgtaagatgtaaattacattattgtgtaagtgtaagtagttgaattaaattgaaagtgtaattttaaaaacattactaaattaaattttatcattttaaaataatttcagcaagcaggatatgaatattctaaacgttgaggtcgtaaatgtaattatgaattatggtttttttacagcaattatgagttatgataaaactaagaaataaagatattttaaatacaaatttcc

SEQ ID NO: 5495 - DNA, 1300 bp, Glycine max
  Soy_ogl_5569 Gm17:7655601..7656900 Cluster 24
gtgataccaaccatagtacattttctctttacttttttgtttaaacgttaaacaaaaagaataatctttctgctcctggtggacgagttcagtgttcaccaccagctggtagaattacaaaattttcgtacaaaaaatggcaaatctcaaagtagtactattttattggttaacttatacgttaaacaaaatgaaaaaaatgacagaattcatgatataatgaaaatgttttcatgaataatgaaaatagataatagtaaaaagttgttccttttaattttggagtttgtttttaagatacacatatacataacagataatatagatggtcatctattaattgttattcatttactttctttatgacagaaacatgttattttatatatggagaaaatcgatagtcacaaaatataatttaaaatattttttaatattaatttctctttgtatatatatttaagttatgtatacatatgtaagtatatatattcaatcacccaaaaaaataactaagtatatatatttaaaaaactcatttttataagacacgtttatgtaaatttaaatgatataaaacatttgtaaatatataatatttaaatatacactaatattcatgattgtttatacacactcaaatacatatatactaacatatttttttataaaattaaaaaaataatgaaaaaatatattaaaaatcctaactataagaaattatgaatgatcataaacttaattaataccatcccaagaatagacaagtattataaaggtttgtacgtgtagttttaatgttcaaatagttgcctagaaaactataatgaaaatattctcaaggtaattatcataagaagctactaattaggtatcgaacaaaagttaaatgtgatttcttattaagcacgttgcaagttacaatgtttttgctgtgcctgtgcccacagacccgcgttcaatatgtaaaggaggtgatatattattaatttgaagtagctagctttgaaagtgcatactactatggtcaaaatgtggacgcaataactcattttctttgcaattaagaaaccactttttgattgacgtatactaccgtgtagattcatcattcatttataatccatagtataaaaaagaagaacacatttcatcctaaagtatgcgaagctgaaaagggtggcagcgcatgcttttggtcctagggttgaatgggactttgtgtgattcaaagttagataaaattattataaacaataaaattttctatcaaaatatatttagtgttgcatgtctaaaa

SEQ ID NO: 5496 - DNA, 1130 bp, Glycine max
  Soy_ogl_6843 Gm20:38444001..38445130 Cluster 24
attctaaatcattagttagtgatattatcttagtgttattatatatgcatatgaaatcaaataatatttatagtttaaaataaaaaatcatattaaattacaaataaaaagcgatgaaaattatttaaaataatgtaacgtttcataaacctaatactctatattttgtgatgaatttaaatttaacagttgaattaaataaacaagatacctttgtccaaaacaaaactatgagatatttattaggagatgggaccatagtccaaatcccatataatagatagttacacatggacaaatcacatattgtctataattatttcaaattattaaagcatgtagagttttagttggttacatatcatgcttgtttaaagttaagaaacaattcccctttatgaaatgcaattagagacttcgttttggtaaagcatacgtcttttgctttgctcactttgcctaatgctcgaggaattctttaaaggaaaagatgtacctaatatttatatattaacttaattgaatataaatattggttaggttgaatagtggcaccgagacttataagttataagttttacttatatattgtggattaatatattcctggacacatgaattaattgtctgagaaattattttggtttaatggttaatcttttaattcataggattgatgtaagattttattatatttttatctaaaagaataattcatttaagaagaatttatgtttgattttttttaatgtaaaatcggtttaagtcaacaaatgattaatcttttatctaatgaattaaaatacactcgtcatctcttatataaaaataataataacctcttatagtctgtcttgacaaaaaaatattatggattaatctcgcaaggttacagataatgggtacttagaacaccaaattaagccaactaacagaactgagaaaccgaacacgtaaacctcaagctagattccaaatatgcagaaatttacaaaactttaaaatagaattaagttttacatgactaatatgaaaaataaatatttatattaaaaatatcataaattattaaattgaatttcaattttaattagacatcagtgacaaaaatacttatatatctaaatttt

SEQ ID NO: 5497 - DNA, 1100 bp, Glycine max
  Soy_ogl_2190 Gm07:4565501..4566600 Cluster 24
gatagggatgcttgtggttttcagtcctgcatataatgtataaaaccgggggcagttttagccctagctattattttttattttattttggattttgacccataagtttcttctatttggaatttcaatatttctcatcactttgaaagattcctctgcttgactttatattaatgttaaaaacaaacataaaataatgagatctagaagttctattaaaacttaaagtatattattacttacataagaagcctctcaagattgaacaagcagcaaagatagtagttagaaagaaacccaccaaaacatgcacatacacgttggagaagaattaatattatatactactccagtataattgtgtccgctgctatttcttcaactcttcagtggttgcaaggggttaaattatgagtgaaaacaaataaaaccggatcatgttatatcaaatgtataagataaataatgaaatatcaaatgtacatgttatttccatcctttcatttacaaatcttaaaaaataaaaacacaatacatgtgatatttttataattattaatgaaatcataagatatataaatttcgagaacaaaggcacccttacttattttaaacaatatattttctgtattttttataaccacgattacttacaagtaaagaagactttatttaaaaatggaaaaatagaaataggcatttttaatttgttacacattaatacttcaaatattaaagtggaaatgctttttatagagatttcatattgttaatgttttaaaactaaatcagcaatgaatatactagttcataattcatcagttcaactttagttgaataattagagttgcagtggttgtaattaaatatatttttaatgtattaaatactaaactaatgtgaaattatgagaaaaataagttaaccaaaattttaaattataaaatggttgtattacatgttctataatatcagagaagaaaataataaaaaatagcaattcatgtatatttcatatataaatagttgcttattttaatttaaatatttaaaatgttttttaaatccagttcaattttttttgtcttagttcttaacta

SEQ ID NO: 5498 - DNA, 1000 bp, Glycine max
  Soy_ogl_3234 Gm09:40491201..40492200 Cluster 24
tttgggtcttaaatgagtcataaattaagaacaaaaaaagaaaatagataagttttggtcacttggtatgtcctcgtatagttttgttaggtcttgaatttagtcatattagtcataaatttcggtcacttgttatgtccttgaattgttttctattgggtcttaaatttagtcataagtaatggaaaaaaaaaaaaaaaaacgtagtcataagcttcggtcacttgctgtgtccttgtattttttttttcttttgggtattgaatttattcataagttataaaccaaaaaatattcataagtttcggctatttctataggaaattgtacttccagctcaagtcaagaccgctagttaaaaaatcagaggatgcatatgatgtattctgagagaaactctaatgcaagtgacctaggtaaattggttcttaaagttaaataatatgataatattattggaataaattatttttttatagacttttatataagagactacaaacaaagttgtttaaatatatataaaaaaagtcaaaataaggttgttgtgtaaatagagaaataaaagtaaatatataaaaaaaaatgtcaagtttattttttttttcttttaagtaaaacaaactcacccaaacaattgcgagaataactaacatagaagcaacccgatgaacccatgttgaaaccaggtggaaataaagtctccacttcctaatccgcaagcgacaaaagtaaatgttggggaaaaaacgaaaatgagtaatattaggtattttttaaaacaaattagctaatataattttgttaataattacgaaaaatattatatttttttatattttattttgtcattcataattttgttacagaaatggtaaaaacattgttttgtttatttcactatctttaaataaattttgaaagagagaaataacttcaataattgaggaaaacaatagaaaatcacaatttttttttatcaaataagtcacattgattt

SEQ ID NO: 5499 - DNA, 1000 bp, Glycine max
  Soy_ogl_4910 Gm15:8291901..8292900 Cluster 24
atattatccaataaagaaatggaaagtagtggtttttttttatcttgatattttttattttaattttttcattagtatttttaaaatactcatttgtgttcatatttaaattagttcatagttttaaaatttccgataaaaatatatttgttttttttgtcagttgtcactttttttcttttttcaaatgtcaaacgtttttatgaatagacataaactaaatacaaatagcatacttaatttagacgaaataaaagtgggtggatctgtcgagttctttttcatcacaaaggaagttgtacatataaaatatgttgataaaaaaatataaaaataatagtcccataactaacggtcgcgtaaaaggtaaataaatgaaatatttggtaaaatttaattaatactcaattatttatgataaaaattataaaaattaattgagcaaattataataacactttataaaagattttttgaattacactcaatacttgttgtttgatgtctttgtaggaagtgtaatatatagaaggtattaatataatatttttatacaaaagagggtcagtataatatttttaaatgttaaagggattattataggaataaaaaagtaacattatatgtaatttcaaaaaagctaagaaagtgtggttgtaatttcttcttattaatttatttaagtatttttcttgttgtaaataatttataactgctaaataaaactaaacattggcaataagaaaacgaaataaaactaccaaaacagagagagaggatacgtggaataatttgcaaagagtacaacacatgctggggtcaaatccatttatggacagaccacatgcacccataagaaaacataaagaagattcaatgtatacaaaatgaaaaatggtgttgtaaaatcactttagtgcacttcaacctgtaatattgacatttgacaatatctttaattctctatcgagagaagctatgtcacatccacaagtcattc

SEQ ID NO: 5500 - DNA, 1086 bp, Glycine max
  Soy_ogl_2200 Gm07:4961901..4962986 Cluster 24
atatgtatgattgcatgtctcaaatttatagtttttttattcttcaaatgagaattgttattacctggtatgccttttatgtataatatgtattactcttgtttgttccttattaattattggattttggaaagatttttgtttttatttatttgttgtttttaagttcaagataatattatttatttttttgtcaattatattcttttcacctaatctttaattaatttatacatatgcatttattgtagagtaaaaatgaaaaaaaataataaaccttataactatgtagaaaccttgaaagaaaataataataaaaccgaaaaggggtcttttgggctgaacccgcatcgatcataattggggactaaaattttacatttaatttgaactaaaaaatttaagctgaaatcttatattttattggacaattttgatagactcattttgctatctttataaaaaaaaccgacatattttattatgaaagatatagagagagactaatcaagtcatgtaagttattttaaaatatatataatttttttaattggtcacatgctattaaaaatgtgtttggaaatatattttgcagtcaataaatcattaagcttccattaagacatgaaaactcgtgccaatgatgcatgagttgacatactattaagctttatcatctatctttaattgggacttaccgtggcaattaattgattcacaaatttattttttatttataaattacactaaattagtagtgaacttttcaaactgctaaaagagcctttatagtaccagacctactaaacttttcaaacttggctgtattgccactcttataaagaatacaatcatataaaggttcaaatatatcctcaattattatttgtttcatattattattcattaattttttaatctaattattgataacttgatttttcttggagctgcctgaaagcacgatagatacatgtcgagattattgagatttgaatgcaggaagcaaattctaagatatgcataagaattgttttgtcggtgctcattcaaccgtgattgcgaagaggatattcgtttattact

SEQ ID NO: 5501 - DNA, 1100 bp, Glycine max
  Soy_ogl_3050 Gm09:9378701..9379800 Cluster 24
agtatatatctacttagccattctcaaattgaacccaaatgaacaaggcaaatgctaataagtagggaaaccatgagggtattggttaatgaaattaaatagatcttttttattggaatacataaaaaatacattttcttattgactaatatagtaatatatacaacaaagaaaaaccaggaatatataaggatcccttaagaactaagttctcagaaaggtaagacagcttgagggcactctgttggaaaatcaaggggtgggaattttctaggaagatctcagccttcactaatcacagctatcctttgcctacttaaacatcaataagaaattaaagcacatatatatactaaccatatgtcaagtaaagctgaaaaggcacaaagaaagcaagcctacaaagctggctttgttaaagagaaatctatacgggtacaaagtacggggtccaactttacatacatataacacaagtggttgtgtaagtaatactatttaactgttttaattttaatgtccctaatgaacatatatagttgcgttcaattcctagtttatttttttaatttatacgtaagttaaattagaccttgattacttcaagtgagctaaaaagggacaaaaccttcttaatgtctgttttattcattatttatatataacttgtcagattacttaaaggaaattaaactctttgtcaattgaactaatgaacattagttcctacctaaatataaagaaagttatgttttatcttcacacatgacgtgtcaacataacattaatgatacttaaatctaatacgataaattacaattagataaaataagattttatatatgtttgtgtacccgtatcatgcatgtgttattacgagagtaattttaaaaataaacattagcttctgtcataaattaggtactgattgataattaatatattctttcatacatccagttcacagttaatatctttaattaaatacatatactttcaatatgtgtcttttttaatattaaatatacatataccatttactttcagttttagaacatgatgttcacaattaataaatttaattaaatacatatcctttc

SEQ ID NO: 5502 - DNA, 1460 bp, Glycine max
  Soy_ogl_6697 Gm20:3052584..3054043 Cluster 24
gacagatttaaatctatcttataacataaaatcaacaacgtgagaactatctgccaattagtaagctaagataatatgccagctgtaacaaactaactgccattagataaaatgttatctggtgataagaatattataataatctccgtatttgtttttggtaatgataagttttatattaacaagtatgttataaaatgtctaaacgaggttatttaattgtataaactatattttgtaaaacttaattattaaatccaaaatgacttatttttctagaataacaaactggatattacaatgccatcaggatattatagtggttaattatccctttttcctttgtcactttgccagcaagttggagcaagcaaactattaaactcattaatttaatggtaaactataattatatttttgtacctttttccactcaattgccaattgtcgaatttcaccattttatggcccatgccttttatataaaaaattaaataaaaagacgttgatatccggccagcttttgattgttttacaaatgttgtcttgcttcgtatatcaaaacttagggatataaattcttatagatattccccataatttttttaaacagttgtaattagaatatttatcttttatgtaagacccgaaatatgattataagtaagttttgatgatttgaatcaattatgaaatcaatttttgatttaaaacttagttacacttaatattttttttctcattataaaaaatacttattctctatctattccgaatgatacatgcattttacataaatcaaacataagttctttcgtacattcatactcattagtttcctgtaattacattattacaggatattcgaatttattttacgtggatagatataagaaagatggaataaaagcttaatttttaggagtaaaacttcattaacaagtagtaataataatacacacgtagatattccccataatttttttaaacaattgtaattagaatatttatcttttatgtaagacccgaaatatgattataagtaagttttgattatttgaatcaattatgaaatcaatttttggatttaagacttagttacacttaatattttttgctcattataaaaaatacttattctctatctatcccaaatgatacatgcattttacataaatcaaacataagttctttcttataaattcaatgtgaattgtgagctaaaatacattcatactcattagtttcctataattacattattactggatattcgaatcttttttacgtggatagatataagaaagatggaataaaagcttaatttttttaggagtaaaacttcattagcaagtagtaataataatacatacgtaaattaacatgaacttcataattctaactgttttttattttcatatcttaatttttttttatagaagtagcttagtgtgccgtgt

SEQ ID NO: 5503 - DNA, 1087 bp, Glycine max
  Soy_ogl_283 Gm01:52131314..52132400 Cluster 24
aagaataataaaaatatcttcatggggatgacgatgcatgaatatagtccggcctgcaagtagggtatgaacaaggatgccgccttcggtgggccgcttctcttgcatgcagcttaaggtctttttcttcccgaaccaatttccttttttgtattttacaacattttgttgggtgccttcatccacatttttatttctccatttacatttatttattttaattgaatgtattgatggatctattaatactcttgtttatattttttaatgacggataattacttagtaatttaagacaatcttatgtcagatgatttaggtgtttagtaataaggtaatttttttctcttagatataatttgacgtaaaatcaacaagaaaacttaattggagggagaaatcaacatttcgcagcaaactagaaagaaagggaaattattaggagtaattgacagatattaatacgcttaattaaagttatcgaataagaaagaaatcaaccaattataaaatattttaaatatgatttttaaagtaattattataaaattttacaattttaccatacatgatatgatgataatcaatataattggatgataatacaaattaatacattataattaaattcaataaaatgtatttatatgagtttaatttaagaaattataattacaaatcagagtgcagaatatactcgaataaaattcaataaaatattttcagtaaaaggaaataatggaagtttcaataatataattttgtcgtcaaaatatatccaatatgttaggacttctattgaagacagtggttagagaaacacattttagatcttgagcatttatattcctatttgttattcaaaattaagtcttgagatctcttgtattaaaatatagcgtgactcattgccaaaaaaaaataaaaaatagcgtcatagacatattaattagagttggtataggtaatttttgttgacctcaatgtgctaaataatggattagatgttctcactaataatttatttttggtttaagaaaattatttttttcccactttgagaagccatgagtaagatagaggagca

SEQ ID NO: 5504 - DNA, 1049 bp, Glycine max
  Soy_ogl_3794 Gm11:8046005..8047053 Cluster 24
cattagaatcattccgcacttgttgatccacatagttgatggttggaaatttttatttgaaatatttttaaataacaattttttttaaaagaaaaacgtgatagaaaaaaaaaattaacaagaagaaaaagacaaaattgctactattattattatcttggattgaataggaaatgaataaatgaaaaatgtataaaatataagacctatatccgtaatgtcttaaaggttttgaatgaagatgtagtttttcaattctctttataattttgatcgttagctcatcaattatactatagacaatactctttttgaaaaatactatagataataataatttccactcttctttctttatgcatgccagatgaattcgtataattccgtttcctaccaaatatcaaaattcttacactatatgacactacgttataattaatctctttgattttttttttctatggtacattgtctaattggagttgataacataccccaaaagaatacaattgataatgggaaaaacactttaaaaagtgagaattatcacactatataggaaaaataaaccgtagattgattctgaaattatctataagttttttttttcaaggtgaacccatttataaaattgaaagtttgagtcagctctaaaggtgtactattaatttaatttaaataatctcctaaaaaaattatttaaatcagaaaaacaagacttgcaaaattattaaaactagattttttttatattaaaaatacaaaattatgtgtacaactcattaaataagaaacaagattcacaaaagttttataatttttaatatatttcatttaatagtaaaaattatatttaaaaacaggaaaaatatatattaaaaagtattttatttttctttcttattatcctaattatgaaaacattcaatttcatatctgaaaagtatatctgacctatacaggacttgtttactttttttttccatttttataaatagttaccaaattttaatcttcttttcatttttttgtgattattaaatatttgt

SEQ ID NO: 5505 - DNA, 1326 bp, Glycine max
  Soy_ogl_5364 Gm16:29249601..29250926 Cluster 24
tttagtttttgaaagtatttggtatggtcacattagtctaattttttttaaaaaatgtaacttaaatgataataattaaaatgtgtttagagattaaatggttgtaaaaattaagtttaaatattttgataaaaagttggaaatttcaaaaatctattttaaattttcttaattttagaaattaatgtgacaatggctatactttcagggactatagtagtttatttatttataatattatttctattcattttaatgaattaaataattatttcttatatataagattgaaagtaggatttgttttaaagtcagccttttaaaggaaaatcaatgaatgtgaccactgatgagtggtttttcacatgtttttgaatgttgtagtcgtcgatgattgcttcgattccaaataggcttgctatttctttggccaaagtaagtatgcgaggtttagttttaatactgtggctggctgtttttaaatgtgtaaatgtaaatcagtgatgtgttggactcgtttttgtttatggggagagtgttggaaggttttggcgttgggattatctcttatgtgataaacttgatcggctttcttattttttttaattggttggcctattagtaagaatgttgtgtactgattcttttgctctgttcaggtgcctgtttatatagtttatatttattattattttttattcagctgtctgtcacaattggcattatgttagcctatctgttgggccttttggtcaatggtaacgaaatcatttatttttacaaattttgtaaaaaaaaaaaaacgtacttcactaaacaaaataaggaattatatttaaaatgctattaaacatttttattaaaattaaaatatatgttatctttaacttagaaaaattaatgataaatatatttatatcgtatatttgtactaaataaaagaaaaattagcatgagttatggataaataaatagttatttttaaattctattgggtcaattatcgaacatttcttttttaaagtatggaaatgaatgtgtttgattatagtttttaaagttttcttttcaaattgagaaatgatggtaacatattttttaacattttcttattatcaactaaaatttataattcatttaaaaaagacatagcaattagatttatttagaataatattttgaatatgattatgaaaaaattataatatattaaaaatcaactaatagagataattttttatggtaataaattatgtatcacaaattgttaatttttgtaatgttgatgtaagtcattaagtcggaaatgtattactatttcatagg

SEQ ID NO: 5506 - DNA, 1216 bp, Glycine max
  Soy_ogl_5394 Gm16:31419385..31420600 Cluster 24
cattcattctccattcgcccttacatgtaactaactgtgtcctcatttcaaatattgtttgaccaacaggattcaaatctttatactaaattaatcacagctgtccaccaaaattagtgactcgtagtacgtaatgcagggttgtacctaaatatgcatgatcaccaagtgaagaaaaaaggtgagatgaggatatttgggttgagtaaaaggcttggcaacaaaatgaagaaaacagacaacttcataaagaaaggtcatatccatccagacaagcaaattgtgatggaaggtaatactgcctctgtttagctgatttcgtaggtcaagataaaaattagggttaattatgtttttgtttataatttttttgcaactttttttagtctttaaaccattttttttatcgtttttagtatatactctttcttttagtaattttattttctgtgtcaagttttttttcatcaactttgctttcaattaataatattaattgtcaatattataatcaaattagaagttgaatgacttgttacactattaaggaatctaacaaacaatcatttatgacgtgataaaacatgattataaacataattgttacttaacagtaaaagctaaaattgttaataaaaaaccaaaagaattttatttacaggcaaaaatttaactatcaacaacaaaattaaccctaaaaataataaaattatcaaatatactattgtccaaggtaaaatatatttttaatttctataatttaactttttttatttttggtctctataagttcattttttaattttagttctagtatgtttattttttcaattttgatcctataagatatttttttatttttagttcacgcaagtttgtgtttttttaattttcgttctagatatttaaaccttatctatatttcaaaagttattttttttacatatttcaaaagttattcttgcttttttttttttaataagcaaatatttttattaatagaaagcaccagaggtgccaagttacataggataggatactgccttccagtgctaacaaatagacactgaattactaccaacaaatcactcaggcacccttcaaaacaaaccaagtagttaagcaccatcctttagaatcatgttatatacagccatatagaacatataataagatgccaaagattgcacaagcacctgcgtacaagaatacagat

SEQ ID NO: 5507 - DNA, 1301 bp, Glycine max
  Soy_ogl_5556 Gm17:6984501..6985801 Cluster 24
aagcccatggaatttggggtgtgtgggtttatttttattttttctggataatgtctccattgctactctgcactttttggagatgtgggaaagtatcagctacagtataatatggctaattgggataagtgttactttttttgtttgttctattaatatatctttcaaatattaattataacttcattcctggaaattatttctaaataactaaaattaaaaataatctgttgaaatatttatcactataattttatatttttagcataatacccttttctatattttttactgcaatgttttttatcttttaattattcaaaattaatcttaaaacggcctgaagttaattatactcctaaaatatattgaaagcacgacataaccatgtcaaaatattaaataattcctttttatacaaatgattgtatactatgaatattatatatatatatataatgaatgatgtacttactccaagagttcttaaagtaagtggatcttaataatatgtcatcacatttaatattaaagtataaaattaatgttatgttcttttatttatctcttaattttagttttataagaaaactaaacggtacaaatatttagctaaaaaggtataaaaatattcttttatttaatagtaactaagaaaattagtaaaaatatattatgttaaaacaaaattacaaaatcactatatatttgtacacaataattattctaattgaaataatcagtctgtcctaatatttgataaattaaatttttttatcttaatgtattgaaaccataaatatcataattcggtcctatatgtatggtcctatacatttgaataatttttcttcctttaatttctctttataattttctacaacaacaattaatgacatgtacgtaagtcatgtttaagtaaatgttactgattcctgacaccgaaaaattaagaaaacataattactaatattagttaactcaatttataggatctaactatatatatcaactaatgaaagatatgtttaaagcagcttataaattaagttgtcgcatcttaatgatatatatgctatggtcctgggtatgtttagataagattaaaagtatttttttcaaagtttttatatcagaaaaaaaaaatattttcagtaaataaactttcaaaaacactaatgagttatctcgaaacatattcctaatgtcacttccaacttatctttccttatatacaacctttgaaagattttgttattatgacatacatttgcaggatttctggctaagatctatttgta

SEQ ID NO: 5508 - DNA, 1100 bp, Glycine max
  Soy_ogl_6576 Gm19:44796601..44797700 Cluster 24
aaaaaccaacttacgaggaaatcatacctccacgtactgtaaaaacaaaagaggagactatatattgtttactccatgcatgttattattactacatttagtaaatgaaacaaaatgagtaacgttagtgtcgaagttatgaactgaccttttttaaaaaaataaaataaagtatgtgtagtattattttgcatgatttgactcttttaaacacttacaactaataaaaatcatttctctgcaaagcaaaaaatttagatgttatcataatattttaagttttacaactaataaataagaaagatcaaaaacggtttcatgaatataaaagttttaatgtgatgatcaagaaaaaaaaatgactatcatgctttagctataaacaaaacaagtataacacataattttaaaacagttttataaaagaacactaaatgatgatgatatactaatgcaccacctattatatatatagttgatggttgaccctagaatttaccatggaaggaaaacaaaagaactgtcctcaccatacactaaaaaataagatagaactaaaaagaacaccacaaattatatgcattttcatctattcatatattagatttaatggttgacttaacagaaataaccacagtcaccaatttattgacttattagctgtttgagttattaattgttcctaaaaaaatatttgtgccaagaatttacttgttttaacttttctataatgaaacactttatgacacttaccacaattatatccagttataaaggtctgtgaaaccacatgttgaaacaaaaccaacaaagtattaaacaaaaaggaagagagcaaattcataatcatagcttgaaaacttgttagttgaagtttgacatgttattatgttactacataaatttctcatcacatgactaagatacttacgagtgttccagactcacaacacgtgccttcctgcctttcctacggttggggttcaaactcacttgaagaaagatgagatctgaagtatatgctaccacacaccttcatcaacccaaaccaaatccactgattgttatatataaaaccgttgataaacctttactattta

SEQ ID NO: 5509 - DNA, 1263 bp, Glycine max
  Soy_ogl_4277 Gm13:228301..26322563 Cluster 24
ggaaaattcaactattaattcaaatgaatctttacattgtgtgacaaaacaaatagaaaagattatactaatttatgcaagaagacaatcaaacttttcatgaaaattaatatgattagtgaaattaatcacaattaatcttctaaaaaatttagaattttctaaaataaaatagtattattttgttcaatattcaatgcacattctacaatgaacagtcctaaaaccaaggcacactaagtacccctccatcactcatgaagttaccatatattttacccattattagtgttatgtagtctaatagagttaaactgaaattacatatagattttttaaaatgtaaagactaaaattgtagggaaaaaaagggaaccaaaatttcaaatctaaaattattggaaaataaaaattataatttatctaatttttttccatattacattacatatatattcaaaattttgatgtttatttgtgttaaacgtttattacataaaaaaactgctaatcagtgcatcacattttgcattaaaacttattttattatatttttatttaatatttgaaacaatcgatccatatggttattcatacattgcatgccaatgttattcaatttgaatagcaatatatttggcatataaagatgtaattacttaagatgtaaatagaatatttagtacataagttgccatatgcatatcaaggctaattttgaaacactagctcaaattaaatataataattgattagttggtgaaggactttattgcatttttttaagaataattgctcagtttatgatgttcaccaaaaaaaaattgctcagtttatcagaaaagtcctattctttaaagatattagttgttttagttttctgttaccattggcattaattatggataaattggctgctttattgtatatgtaaatatgtgtagaaaggctatttataccaaagctatcgtgaatatatacaactgagtcattcagtcaagcttgttgtgttccttgttcctagttgcacatcacatcaaagttcccaacaatctagtatcaaataaagcctatgacctgttggaaattaaaacaaaaaataaccaattaatttaatcgatttgattaatttaattagtttagattgtagtttagaccaacaaaaaaatcagttcattaagtcaatcaaattcaatattcaccggccgtgtcatctttcatttttttaatgaaaactttgattgattcttattcttacatttc

SEQ ID NO: 5510 - DNA, 1000 bp, Glycine max
  Soy_ogl_1286 Gm04:7809401..7810400 Cluster 24
tgaacatcagctggaggatttctaactgaaatccaaatatactttaagtgacatttcccatatgtggatcgaaccccaactgttctttaccagttataatgcctcgcctgtgtacattacctaactttaattcaatgacttactgtttatgaggaaaaaaaagacttaatgtcgtaatcatttgttgtcgtatcctactccaactccacaatccacattgataagtgaaatagttttggtttttaggatggaagagctaagccccattacacatctcatgcctataccttaattgatcttttaacatttgtttttcctgaaaaagaggttgtggtggtgggggtgctatgtgttaatgtagggctcactcaaaagttaaggagaaggaaggcacaaagggagggaatattttattgtgagatcttaaacctttactttaaaaaaattacaagcacatatatatcaattacatgagttaaactcattgttttcacattatatatgcaaatatgaaatatttgaacggtaaaaagataaatggactaaactgatatattgatctttgaaagcgtatctaattagtaatttagtcattgattttagtaaattgtatgacttaatcattgaatttttaattttttaatttttttgctatgatttataataagggctaaaatggaacgaatttaatgatttaaaaactaaatcatatatctaatagtggttttggtataacattgttgacatacttttttacatttaaattgaagccaatacattgcgtttttaacgtgtcttcaaacatacagtaatcaaacaaggaaataaattataaacatagtatttttcaaaagtattaatcttaatttacaaaagtacaaaatattttttaagtttattttaatttgtcagtcagacttggtcaattgtccttttgttcatgaaattgcatgatttagaatttgaatccaacagattttcattaaaaggcaatatgtat

SEQ ID NO: 5511 - DNA, 1400 bp, Glycine max
  Soy_ogl_2313 Gm07:9744501..9745900 Cluster 24
ttttgtcacccctttccttttcactgatcctttgtgtttgctgcctttgcatgacatcttttttagccctgtgaattagaatggaagcctaggagggggtattcccaagcaacctgccccccataattcagttaatatatttcaaccaatttctaccaattctagttagtataatacttgtacaaggtaatgtcaagagggtgagttatcctttaaaatgggaattgaaaagagttgttattactttatcacatgggttttgctaggacctaggacagttgtaaaatgagatataaaaggaaagtaaagcaagaatacaggaaaaaaaaaataatataaaggcaattcaaattgtgtggtaaaaaaaaattaaagtattacgtgtgagtgtaaatatgggatttaattaaacgaggattctaatctaaccaataaagtaatgataaaaaaagagtctaaccaatagagtacaaagcttggtttgctaattaagtaagtaatgccatttttcaaatcttgatttttagatttaatttttatacattttataagtataaagttttttttttttttttacataatcatattgtatggtttaatcattgaaaaagttttactttatagctactttagtaagtttactttcttttatttttaataatgtatcaccaccatcctccaaaaaaccagcatcaccaccactcttttaaatgatagtgtaaagcgaggcattaataatatagttctttaataatgttttcgacgcattgagtcgcatctcaagcatataaaaaaagtcgcatttcaaagtttctcaaaaaaaaataaaaaattaatcattgaacaaatgcatgacatttctaataatgaatagtgtgatggaaaacgataaaaaaaaagtatgttaatattattgataatattcatcataaggcaaaaaaactgtaaattaaaagttcagcgaatttatactctacttaattattatctataagtacccccttactgttaaagtaattatcaatttaaaagtttttatttattttgaattactaaaagagtatgttaatattattattgataacattcatcacgatgttgtgtattaaaaatacaacaaatttaaagtctacgtaatatcaataaatactccctcactgttaaaatagttgtcaatttaaaagtttatttcattttaaattagttttctcaatgaaatataaatcttactaataaatatatctaaaggcactatcaaagaattaaaaaataaaatatatttaatttaataaaattacaatattcagtattaagaacttaaaaattacttttaattttattttacaattttaataagtgacttaaagatacccattagtaattgtttagaaaatcattta

SEQ ID NO: 5512 - DNA, 1100 bp, Glycine max
  Soy_ogl_79 Gm01:3294701..3295800 Cluster 24
atgtacttgatattgggatcattagagccattgctgcaactaaaacaaacatagtaagatgctccaaataatgtttttttacataagaaattttacgtaaaaaaacaataaaagaaacgaagaggattgtgaagaagatcacttgcttggtgatgattgtcttctatgtgaatctcgattcataattgtgtcacattacaaatccaaaccccacaatataaaaatacagttcaagaggaagagaaatttatgagtgaaaagaaggggaaatttatgggtttcatgttttcgcatacttgctttatgattcgtttatgtaggtttcattggaatttaattatattatagttaagcatgatatcattgttttgagagcaattaatcatggttataattactattccatccgttccaaaataatgatttttaagattttcacacactgattaagaagcattcaattgatacaaatttaaatcaaaatactttcaatttttcaactacttttatcataaattatcctattaaccaccaatagcaatactttctactatttatcaattttttatgacaaatatctcttttcaatgcaagtattaattgatcttcttaataatatttaagagtattgttgaaaaaataatttaaaaaaaaaaccaaaaagaatactgttttggaacaaaaacaaaaagttagaaaatatcattattttgaaaaacatggagtattttttggtgataaaaaaaagattttttttaacaaaactgcagggtcagatcttggtggttgtgttgcgtagtacaaataaatctttttatgactttcatgccttcgaatcttgactgcacttgattggcataattaatgaaatatttacttgcaacaaagatttgaagtttccttcaaccctcgcaaacatgttcttggcttcttcactcatgattagtccatttgcaatattgtccatatttttcatttttttacaagttaggattgttcttgaagttaagatttgtgatcccttatatgaaatcataggcttagatggttcatttagcccacactggtatgttaatgattttgtctcacgtctataagga

SEQ ID NO: 5513 - DNA, 1020 bp, Glycine max
  Soy_ogl_2599 Gm08:10780560..10781579 Cluster 24
tatttttaaacatttaagtcattttttaaataccatcttttttaacttctattgctctcaacattttcatattttgaagacattactctcttttaatttttcatatatttaaactttttaaatatttgtaaacatgatcgatcgattagacatataacttttaaaataatatattataaaatttaataaacttattatacgttataatttttttattggtataagttaacttagtataattttatcacttgtcctcttatagaacatataactccatataaaaattatgctaacttaatatttttaccagttgagttgaaaaaaaaaacagcacgttgagccagttcaatggcatattttattttatcttttaaaaaataatatttttataatttttttggcataattgattgtattggttcttgtagtattgaaaaatcaaaaaaatatgatctcgtctttcaactttacataataatattctgtgtaagttttatgtttgcctttttcattaaagctattaaaacttaaaatcttatgaaaaaattattaaaataagtatacatatattttttttttggtgaaatccattttaagtatttggactgagtatttacagacattgtcataggactgaatctaaaatgtatatttttggaaaaatagaaggcaagacaggttacatgacaacttgacacttcaattcataacaccaaattgtagtgtaagaatttattgaactagtgcgtcccacaaccacgtgtttggttataaagtgacataggactcaagtatgtcaattaatttatgaagtttcatcaaacaaattttgcattacattctatgcactttttttgatatatttttaagtaccatttaaaaaaaattgacacttaaattttaaaatagcatgttttttcatttttgttcctataaaatttcatgagcagtcttagtctataatttttcttttcgtcagcaatatagtcttactcatttttttatagaaatataatcttg

SEQ ID NO: 5514 - DNA, 1200 bp, Glycine max
  Soy_ogl_3027 Gm09:5938501..5939700 Cluster 24
aagattttctgaatcttgtgggggtaatggcagacccaacttttgacatcaactctcaataagccatttctttatttttcatatgtatatagaaccatctaagctagtaatcaaatgacaaaaataaaataaaatagggacagtgatctccctagctaacacaaagggatcctgatttagagtcttacatatgttgtaacatagtaattaaattaaactaaaatacacgtatatataatcgctagctaataattaatatattctgatgagtataatcaaaatgaacagagtaaattatacattaatatgaacacttttgtttactgaaataatatatgaaataacacaaattatattgtttttttctagaacagaaattatggatatctttcacctcagatcaaatattaatattgtttgtattgtgtgattgttactgatttaagaaaaatttttaaaaaattatttttatttatttgaacgttgagagactttatatcactgaattaatttttagagtttcacaaattatatagctaagtgaaagaaagagagacaagagaaaaaaatgatttataataaatgatgtaataaagagatatacaaacagaaagtggtgttgtataaaatgttaaacaaattgttatatgaataacacaaatttattgtttaccgtgcacaattaaataatatgtaaacataggaagtatttcaaaaaagaaaaataaaaagcttttatctagggactattaattttaccctttagtttttaaataaacgaatattaatttcttcatgcactaatcttaatgtcaattgtctgcttagttaaaactactaacattttattgtacaaaattttaggataatagaatggtattctcgtctatgatagagaaactttttagactcaaagacctttcttttcttttctttttacagaaaactcaaagatctcttatctatattacacatttaattatctcatattgtaaaaatgtagaagtttgaatatatgatttgtcaaatatgacatatttatcttattccattcgtaaatgtcagttcaaaatcaagtgtaattttagtatttaatatatttattgattttgtaaggtgcgcaaaacttgattatgacttcaaccattttagcattcgtgtgtctagtgtgtagttctctccaatcataataatgacaag

SEQ ID NO: 5515 - DNA, 1050 bp, Glycine max
  Soy_ogl_3466 Gm10:40175451..40176500 Cluster 24
agtagtgaaacaaaaaagtttataagaagatttaaaaatgttgtagctaaaatattggtgacatactactcgtacttgattcagggatcagaggtactgtccgttcctagttccaaggcaaaagggatcggcttctgattcctcacgaaaaaatatgcctccattttccatagttccattactttgtttatttgcttcaataaaatgctccactcattattttattatttgcttcgggtggcgatactgtgctcattttcattcgagtgtaaactttgcagtttgcactgtttgaagcatcaacttctatttcaattttaatttgaaatatttttttattaaaaattgttgataatacttctttaaacatactttttttattggttgaatttattaaacgttactatattcctaaaaatatgtgatacaaatttagttctttaatataataacgatgacattaatttattcctttgacaaaactaacatcaattagtctgataataataataaattgacttagacaaatataaattgaaatcacttttatatgaaaggaaatatacttatttatcccttgtcttttgagtaaatgaatttaataggtttgtacttacagtataaatatcttttatatcatggatgaattacaaaatgtcctatctttaaaaaaattatgtttaattaacaatcttgaaagtcacagattttatgaattatgatttattgacactttacaatgtataacgattaaactcttaataaattttgttttcatcttttataatttaaaaagtttattttaatctggttgccattaaaatttcacaaaacaattgtatgcctttttttctagacatgtttccacattcacatatttataatcataaacctctacttttgattatattcattaatctttactaatgtctttgattattttaaataaaaatatgcaacattttagaacaaatattcatttcataaaaaaagaaaaaatattcataaactgatatgatttgattaattaaaattttatatacaaaataa

SEQ ID NO: 5516 - DNA, 1100 bp, Glycine max
  Soy_ogl_5604 Gm17:9234001..9235100 Cluster 24
gagtttatccttaaagcttttttttataaataaaaaaaatgttgagagtctagagaggttttgctaagaatatatatgcataatcatgtatttaccttaattatatgcctgagaatgcaaattagaaagaaaaaaaaacttgtttatgagcttaaaaatacttgtagcaaaagaatatacttgtaacaatataaatattttctagtgaaattattggcaagatccaagtcaaggactcatagtctttggacgaaacaaaccaatataaacgtttgctgttatttcctctcataaattgattgatgcattgcttaaggttttttttttttgctcaaattaagaaaattaagtattccgaaaaaaatatttgttaaagaataattttattaaaatattctttttttctaatttcaataaatatgccatcaagtttattaaataaatacttaataaatatgattgagtttttaatcaaaaggtttaaataaaagtttgatttctgtaatataattaaagttgtttttttcttgttttgatcttcataattttttgtttttattttagttcttgccataaggcctgtttattagatacaagccctgatctatcagaaatataattttttttagtaaaaaaatctcaaaaaactcttctaaccttctattcgaacaaattaactcatatatagttcctataaaagtataaacgtttgttatagatcttcgttattttaattttaattccatgttaaaatattttcatttaatttagtaaattataactataattattcttaaaatacactcgaagtaacatactcacacatatatgaacacccacagtataaggagcatgattcacgcctctattcctagatctattttcgcagatatattatctccatttttacaaagtaaaatttcccaactcaaagctctaaatgagacaatcttcacaaagatcgcaaccaataacgagaatgagcattcctacatgtacttttggatttgattttgaagccaatatatccatggcttaatttttaccagctagagattttagaaaagaaagttatcataatctaggcaaagatcgaaatt

SEQ ID NO: 5517 - DNA, 1000 bp, Glycine max
  Soy_ogl_5838 Gm17:41362101..41363100 Cluster 24
aaaaatagtttaaaggttaaaaatataaaagaatactagaatttttgtttgttagtaatgatgagtaaaaataacttaataatacggaaatgctaccaattagtataaaaaaatctcattgacgtataacaatagaaaaatcttaaacaaataacttaaatacacaaatacttatgtcctataaagtggtaaatatataaaaatttagagcaaaatttgtgcaatattatatagttaagtaagagtatttaagttattttgggtcatttagacatgataattattgaattttaatctttctgttagtttagcattaaatatttgttattgagtctacagagatgttgcttgacacatgagttggtacaatataattacatttttagtcgttttagtatcatttttttaaagacttttagtattataactgtaaactataatatcatcgtttaatgtaacatcaataaaatatgttaaatatttaattgaaggccaactgatgatgaaaagtgcacaattatgatatcttgaaaactcaatttgttggattgaaactatagaagactaaaattacataattttaatacttatgagttaggaataaaaaatataattaataaaattaaaagtccctcgaattattaaaatatttttttactgtacccactttttttcattattcgtgccctttcccctttttgagtgtaaccaatactttttttttatttatctatttgacacccaagctatatatacttttcaggtcccaacatacggtatctcaaggacacacaagtgtagaatccaaagaaaggggcaaggttttcaatgtggattgtctggctgcacttggaaagtttcgtaatatattgtgaatagattttgcaaaggaaatatatggacggggatacccttgtactggaattgagcaccccaaatttaacgtgcatatcaaaatttgcttaaagcagtaaacaaatctctgaatcgttttctcatt

SEQ ID NO: 5518 - DNA, 1019 bp, Glycine max
  Soy_ogl_857 Gm03:5225282..5226300 Cluster 24
tattttctttatattttttaaaccaagaaatttcatatttcatgcacaacaacgtataaaatttcatattatttttaaataaaaaatttatacaaaactgcaaagtaaggaaaacaagaaagaatttgtacatttaataatcaacacaagcacatgagaggtatataaataattcactaaaacaaaaatatattattattgtagagaaacaaaaaacaactaacattgaaataataattaataaaaaaagtattagaatatatttaatagataataaatgtaaacaatctcttgtacaaagagggaataataaggacaataacaataatgatcatatgaaagttgaaaattaagtaaagcaatcaagagacttgatctatggaaatcaatcaaaattaatgtgatctaatttgtgcaattaataataggatttgatgtaattagaatctattgtatttccttcttttgattttttggctatggcatttacagaaataattatttccctgatttttaggcctatattagtttacagaattaatctccctcctgattgtatcaacttcatatcagtgaaatatatccgcttttccaaagaaaccttagaattatccaatgaaaaactattgttctaggaaaagggggttgatgaatatgtccctgttatatctaataaaaattcattttgtggtgatatgactatacacttaacttttcctaatccatactccatatgtcatctaaacatagaaacatcatatccaaaaaaatcttcaccaagacactttttcaaacatctaaacaagagcattttttcaaatatcaaggacaacgaacaagcatatgacaatcaaatgcaataatttactagttgccaaactaggatttgatcacttgatggcatcatatggatatcaattaaactcaattcataaacccttgaagcaatttgctaattgtgtttatgcctaatccataatcttacatcctaaatatttatccaattcaccactcagaga

SEQ ID NO: 5519 - DNA, 1000 bp, Glycine max
  Soy_ogl_3867 Gm11:17347001..17348000 Cluster 24
ctcaataattaatccaactttttctattattgcatcgcaagcaacaacgatataacattaaatttctgccttttaacacaccaggtcgaaattaatcttttggattatgattttatatttgggtagtttcattaaacatttgttgctgtgagtatgatcttgtgatgctgatctacctcagaactgcgtgcagctgcaaaaataatcaaaatatacacggtctgttcaggcatacacctgaccaatttcttattaatttttgtttttgtcttttattagaattgtataattattttataaaaatgaggtatgcagctagcttaatcaatcttatgtttaagtattaggtatacagttagattaaatatatagaaagagaatttttgtcatccatctcattggactcgactgatacaccattgtatttactagtggatacttaaggttgataccataaaagattataaataaagataaagacttatttacacaacaaacttaatgcatatttgaattaatttactttaaaatgtatttattatattttttagaggatttaaaatatataagattaatcggttattgaagtaaggccctctacttaacacaagttggtcttgctgttatgttatgtaccgaaatctaaatcatgttcatcaaattaaaaagtcaaaccctctattttaataaacaaaaacacaagaattaaaagtgtcctaaagttaaaatcatctcacaatcctgtcctgtgcatatatatgtacaaggcaattcggtggtggtgaatgaattgacaccatataaaaaacactttatattacaaacacaaaagaacaaatatggacgctaaagagcctttgaaaatgtacaaaatgacagaaagagacagagaaaattttgacatatctatctacatagttaaaaaaaatacaaaaataaaaaatatatagtcaagatctttgttcggatatgataagaagggaggagaacttggattgaa

SEQ ID NO: 5520 - DNA, 1626 bp, Glycine max
  Soy_ogl_2546 Gm08:7765875..7767500 Cluster 25
ataattaaaaggtctacaatctcgaacaagcaaatagatagtgtaccctcctcatcatattaataaaccaatatagtagtttaagaaagaacttcgtctactttaatattatttgcctagggttgtgtattttttagaattgaatccacctaagagtaactttgtatcccatatttaaagtttagattttgtgcaaactaagtgtatttggataagtgtgggacaaaattaattttaaatgcgattgatttcataaaattgattttgtattgatataatttatgtgaaattttttactatagaaatagttttacaataaaattcaatatattttttatcaaatgagttatatatctaaaattatttcaacacaaaactaattttgaatctaaaatcacttcaacttgaaaataaacatgtaaattttcctatttaaatttatgttaaccattatattaatatgatttaaaataatttaaggtaaaaccaaacacaaagtaatgtctagatagtctgttatattattaggttgaaaaatgacccgacagttaaaatactgtttgaaaaaatagactatcataagagtcatccatgatgtaacttgtaagtagctttcttctgatccaagtgttaactcccttgaatacttgacatccaagaaataggggagaatacagttttgaacaagtcagacataatgaatcttcataccgtttaattttctaatagttttccatgacaggaacagaaaattaaagaaaaagaaaatcttaacaacaaaatgacattctatagtacccatgaaaggtatgaaaataaaaattgatttgatttgtatcatgtttcatgtttgcaattcgcgatccacacacacctcgtacattcctagcatgcatttcaatggggggagtttcgcagtttcttacataggttttcgtgttgcaacgttttgctactttgcttctacaagcaacccaaaatgtggaattctcatacatataatattttttattcatttaattttaacgctgagagagagtggaaaatgggtaccacccctatgcatatcataataaataaaaagttattttctttattagaattataattgtaacaaaagaatataatttagattaccagtcatgcttaaacaataaaaccaatgtctttttcttccatcaatcacgctaaaatctataaaaaaaaatattaagtatattcgtccactcatttgattatcgttttactaagagcataaggaagtttaaatgtgtcaagttttggtttaaagtaaaatcattggatatatcattcacccaaaaggaaagatatataggcacatgcagcttttttttattgtctaaaatacgagtaccatgactccttcatacttcttctgaatggtatttatattaattatatacattgtgcctctgatgaagaaaaaatactgaaaatcatttctctatttcaatcaccaatgaagtttgcaagtctttatcagctaagccaatgaaagtttcctctctaatacaatatttgttaatttagcattccaagtggtcacaaagtgattttggaagtgcaaagctaggaataatataatgcattttattagaacttctc

SEQ ID NO: 5521 - DNA, 1630 bp, Glycine max
  Soy_ogl_4872 Gm15:2521616..2523245 Cluster 25
ccgatctcttaaaaatacttgttaccagatcctattttcaataccctacacatggggttttttccccatagttttcaagcatgctatgagtatgaacgggtgagattcattcttgatgatcaaaatttttttttagttgaaacaaaataaagtaatttttccacctcttgtataaaggattttaacacagaaacattgtgcattcagcagtgatcagaattatcgttcaatatcacataacatggcatcattggcatgcaacacgtttattgttaacacgttacgatcagttgttacttatgcggaactagctcaacctgttgctcctattctcgatgctggctcactcaacatcagacaaaaaaaaatcttcttttttttatcactatactattatatgatattagtgtggagctttgttaatctttaatgaactttttccttgaatcatatttttttatttatattgtttgaattccatatcttattttaaaaaaatcggattaatgacttgttggtggattaaaaactctttaaaatccaatgttcatcagcattggttaaaaagtaatgatttatttttttttataaaaagataataagtatacgatacgaatgtataaagtcctgtacatgaactagattaatgtacatggattttaaagtcctgttaagattaatccttattctcacgagtttggatttacattaatttgatcgctaccttttacatctatgatttaaatgtcttatactagcttttcttaaacaattgaattcatttttgttcacaaagaacaaaaaatgattcgaagtttttaatttgaaaaaaaaatcgaagcatatatgaaattcattgttgcccataattttacttgaataacactactttaattattataattttttatcaataaatattagtttttttttttaattttgttatcagtggagattgaactgatcccaatcttttttttccttatacatcaaattgttaagaaattattttaatgatatattagtcatgtttaaaagtaataataagttattatcaaggtaagcaattatatttgacctgaacaaacatcctatatgttaatatactcacaattcacacacaaaatagataaagaaaaatataattaaataaaaaaatgcagtctcaataaataggattgtagaagagacccgaacaaattatatacgtatctcatgaaaaataacattttattaaattttgatccaattttattcatttcttaaacaattcagactgatcgaaacaaatcacatattattttaatcttaaataaaaaaccaatatggaaggcaccatattttaacggatcgttcacgagtctaatcctagctaataccgacattatatggcataatgggccaagaggatcaccacgaatccaattaaaatattaaatcatagctcttaatgcttaaccacaaaaatcttatcttgaatatatccttatgcaattccaaagtttaaaatatgtgcccccccccaaaaaaaggggaatatctgtgagtacaaaaaatgtatatgtcgagcgtcgataaaagtatactttttctccttctttttttctaattgaactacattaataattta

SEQ ID NO: 5522 - DNA, 1400 bp, Glycine max
  Soy_ogl_3288 Gm10:828801..830200 Cluster 25
catgatgacataacactaacatgagatataatatgacatgtaaaatttagaaaacaatttacaatagaatatgtttgaattaacatgaaaacaatgttaaatgaaaaaaattgtgtttaaatgcgaaaattacaaattaattatgttgtaatttcatctgaaagttcgttggctttggactcaactacttgccacagacacacacacacataatagtgaggtttgaaccctcaactcttcacttaaccaatattatcaaatctgttaaatatttaaggaaaatttgatagagggaccaaaatctcatacaactactattcttcaaagatcaagtttatagaataaaaacttagaaaaccaaaattacataattatgatgtttaggagaataaaagtctaattaaatcataatttttttattcattaaaaaaacttacaataattcacacaaccttctcctatatgggattttggtgatatattataccttatatagttagctctaagaaaggggtggtttcagcctttatcttggtggtaactttggctttttgctcttttataattattcggtacttctggtaccctttaatcctattttggtttatcaaaaaacaaaaaacgtcttactattttatctactcatcattaactcatttaaagctatataattcaattctttgaccatccataattatatatccccatgacagaattattaatggctacactattattcttttttttttcaatttttactttttatgaaaatcatcacgacagatccatataatataaaatcagctatttaataataaaaaaagcggctaccaatcacttgacaagttgatatatcagatataaaaatttaaacaaacaagatatttgatccaaaagagtaaacacacaaaaaattctgactacaaccaaaacacaaaatcaaattcaccgtcacaaaaaatcaaattcaccgtttcaatgtagaggcccttgtcagaatacataagttggaggactttcacaaaaaaacgtgatttttttcttaaaagatttattgaagaatatttttatgaacgtacaaatggaaataattatatattaagaggtgactatgtgctaccgatctgtctctattggcgggtaactcacctactttatatgcctttgaaattttttttacttaaaaacaaatgtaacttgccttccaatattttcattttttagccgaataaagaatttaccaaatatcacgtacgcgttgattctaattgctcctctatcattttttttataagcctgatagctactaatcattcaaaatttccaaaaattatatataacaaaaaaactatacgaatgatgtgctgttattttatacacgcgcacacaagaaaaatgaa

SEQ ID NO: 5523 - DNA, 1427 bp, Glycine max
  Soy_ogl_1511 Gm05:1308774..1310200 Cluster 25
aatgatcttaatcaagtcaagtagaactattatccttcacttttctcttcagaaaacaaatataactaatttttggaccgaaaaataatcccatagaaatctaataaaaatactttgaagaattatgacaaaactaaaaatcctaactaccatgattattaaaagaaaacagaaaaatacctatttagtaaaggatactagttggagattctactgttattgttaatcatggggcatgaagttcacgtttggggacggtgttctaatttctaaggatgtgcgtggactcttattttgtttgctttaaaactttttgggtgtgggtccatctcacaccggcccataacccaatggtccatcggcctattttttagtgcttatcatagcccacccaccgactgaagcaacatgttgcgtgttttttacgtggtaataataataatataatagtatggcctaagagtgtttgggtctattgaattcaacttaattattgaataatagtaaaaaaaaaacataattatcgaataaattacatctcccccgaactttgatgaaattacatgcggcactcttccgttttgatacattactttaacttctactgcaaacagtgttagttactactaggtatcctaaaactaaaaagactaaaaatatttgggttgataatttttctcttcaaaatatatccaatttaatatatgaacacccctttaaaaaagtgtatacagtgagaaggtattagggtaaagagaggaaaatgatatttcaattcttacatttttatagaaaattactatattttattttatacaacttttcactttaaacaaacgaaattcattacataaccggccggctcagagcatagacaaataggcccaaagcctatgtattttatacaatgagagggttgccctttttagggcaaaaataattaacataaaaaataatattagtattaactatacatattactagaattttaaattttaaattaataaaatattattttcattcgaatacatctaaaaaaagattgagtgatataattattttataaattatagcagaattaatttctaaacttaattacaccaaagttattaactaattttatatcacaaaatgtaagaaaaataaagttttcaataatttttaaaatatattaatttaaaataagtttaattacatagcaatgagcaaatatttgttggaggtggcaatttatagttctccaacaaaggttctgtttctcctctggtgacaaagtgagttttcagaaatcatgtgtatttttctgcaataatacacaagcataagaattcccagtatttatgtccgcatgggcaagcatgcaaagagaaatatagtttaggaagaagctatccaagtggaaagctaattatactctctatcattag

SEQ ID NO: 5524 - DNA, 1700 bp, Glycine max
  Soy_ogl_1775 Gm06:3147301..3149000 Cluster 25
gtttcttttctttttcctcttggccctagctgtttgcaataactcagttaaaattttgactattgtttccaagtccaaatgtctcccctaaatctcatacatcatacttcttgggaaaataataaaatatgataagaaaaagtacatttagtaaataaatattcgcattttctgaaaatcctccagtattcataatttattgaaagtgttaatatgtaaaatgaattatagattgtttccctaggcttcctcgttttatataaaaaataataaaatcttataatcaattacctttactatttcttttatttaagcttaaaagtacttttgggtattacaattgtgtaaattggatccttccgttccgtcattcttccgttaaataagagaatagattgccaaaatgttaaagatgccattaacacccacgctaaaggctagcaacaatacttaacctctagttattatgacaaggagagagtatattatttttgacatttaattctttcaattttcaaaaagaaggtagacagaaaataattcccatatcataattttatgtagaaattaaaaatagttaaaaaattatttatggcttatcttcatataaataagaatttttaatctttgtagatttaattaaatctaattttagtcatttataactttttcttaatttttcttttttttttttgaaatttctgcaataactgttgagataacatatctaaagattcgatacatatcattacataatgaaaaaatacgtctcgtgctgggcctgctaaaaagcttgttggaacaacaaattaaggacagtccggagaaaattttgcccgtttgggatcagctcagccatcggcttcaaacatattcctttggtccacagtacaaataagggtgttagtattgtttcctgtcataatttttcttagttcctataaaattttaaaactcttgtaattcttgaaaaaaaaaattctcaaccccttaataggggccaagagtaatttgcctgggctaatagtatctccctacaaatgaattaaggcccaaacatataaaattggaccaagagtccattacgtgtcacatatgaagattgttcactgtttttgataaaaagtttttttttttttttttaaatgagaactatgaatttcattgaaagaccacgggagcattagaagaggctcctatgtcatgttctacatcaaaagagagttgggctggaacatgctccatgcaaactttatcaaccaaaacaaaagctaacttcaatcaacaacaaagcttcatatgggggagggattaacatatatatatggtaatctaagtttatttttttatttgtaaatgttagtcgataatatgttagtttttgttagtgaaaaattagaactcatgatctatctttatttttttcctacttttatcatcaagttaactttatatcttcttttgacaatttaagttgattgacttaaaatcaacataggtccaaatataggtttctggttgtgaatatgcaacgttcttcttgggtgaattttaagtgactacctaggtaaaattccaatttaacaaaagcctacgctcaaaaaaatccgttgaaatctatgttgagttctatcacatgtgcttggtttattcaaaaaaaaaaaaaaacaaaacatgtgcttggctttgataattgcatt

SEQ ID NO: 5525 - DNA, 2036 bp, Glycine max
  Soy_ogl_2929 Gm09:1258001..1260036 Cluster 25
aatgtccattgagatcttacccttcatttataaattgaatggttccaaaggtgcaaattaaggagacttaatttggaagtaatattttcgcatgcaaattaggacgtgcaactagatgaaagaaagatgaacaccttagttgacttcttgttgggagctttttgcatttaattttaaattagggacacggacacaagacttaatttgcatttggttgcttggctcattataaccaaaagttgcccatgttcatgcctccttttcttaagcttatttatttttccaatttcaagtttctgtctccaacctaatcatatgatgctgctaagtggtccctgtggattcatgttgatcaggattcacaatataattcttagtactattattcgtataataatttttttaaaatctattaaagattttggaatcatattacctttttttaatctttagtaattgtagtttgccaatgtgtttttgccacatagaaagtcatttaccatggttttttaaaaggtcaatattaattattaatttattaatttttgttaatgagagatatttgaatccatattgtttcttccttttttttttcttcaaccatcaaactaattttgtaactcctagtcattcaccaaatatatataacttcgttcgtctaataaataataattatgagattaacatattgataatcataacacctacacgaagcacaaataacatggggaccttcatcaaaaccttgttccaatggttgcttagccaaaatttaatttccaatgactagttatgtaaggtctatttctacacaaatccttgcatacctccctccctcaaccttaatttatagtgtttacataaaccgttatcagctttcccattgcagaagtcatagccagaaggaagctatcataataaaacacaaggtttaaccctaagaatctaatccacgctatagtcggtacaagaaaaaactagatttaacgggggttattttttacattttcggggttaaaactagttagtgtgttctgcctgctcaaatggagaggcaaaagttagactccagttggtgaccaccaagtaattttccaatatatgtttcgctttgtaaatttaaattatttatagtttagaaatgtaccaaatgtatctcactactaagtctatgaaagccactcaagccagttttttattttttattttgatgtatcaaaccagttattttcttatagtgatatattttgtttattaatttcactcaaaaaaaaaattcttgacactgagccctttattaaaataaaaattgaagtctaatttctaccacttttcattttcactccattctccaactttcacctttaactaacgttgccatcttttcttcttttattacacaaacctactttttttgtattatgccgtactgtagatcggtcaccatctcgccgtgtcaaactttgctacacaaacaactccaccagggtcacactcaagtctttttaaaaactaaaattgatgtgtatgtgattgatatgactcaagtcaataattttgtttcatattattttcgtcaaccaagtccaccttaaaacttacttaaaacgtatattaattaaaatgctttcattcacataacaatgcatagtcatgctatgaacttaggcccatgtttagagcttaatatcatatatatatatatatataggcaataagattgtgacatcacacgttgcacaaagcaaatgtcactgtatacaaaatatatcaaatctaatacagtggcaggttcagaggatgcatcattaactttggctttatttgaactctttcttgaccatacaatttctcctcccctgcattattttccgcatgcacattttcttctccccgccaaagcagcttattatccgcgtctgtatgtgtagaacctcacaggagcaaagatcaaataataaacagtttttgatgactaaaaagtatatctcttgtaaagttaatcaagacaaaaggaaagtaagtggaaaatagaa

SEQ ID NO: 5526 - DNA, 1989 bp, Glycine max
  Soy_ogl_4867 Gm15:2299512..2301500 Cluster 25
ctttcattttcagtatcaagcatgtggtctgtgcttcaacaaggatggatttaaaggttgtgattttttgtataggagacattatccagacaaacacatggtccgtgaaatgtaacactgatactttttaatgtaagaaaggttttcaagttatatctaacgaatttagattcgtatagtgacattattctatctatttctttattttatttttaatttttttataccagacagaataattctcgatgtggggaaatgatattactttggttgggacaagaatgtatctcgatgtgaagttttctcatcataagttggaatggattctatttcatataacttttttttacgtgaaattgtattgcataaaaaaattgcatatgtcgtttatttacaacattacccaaaatcaaataagtgagaccttattaaaatttgtaaatttttatgaacgagaaatggatttttttttcacatgacaaagtgaaaattttgcttcagaagttcatttcttatgatgattgaaatgagcggaaactattatgacaatgggaagagccatcttaattttgatgagtctggggccttgtacttcatcaatcaaacttatgagcatggcaacaacgggcaaaaattaattgtccaattcttgaatctccgcagtttattttcaatgttaaaaaaaattagcaacaaaacaattaatatctactgtgattttttttaaaaaaaaattgttactaaaatttaatagcctcagaattagcaaggaaaaaataatttgaagtcactaaatttgattactaattctttagtttttaacaatgttttttctttttcacatgaaggcttcttactatggctgatggctccttcaccttctcattttagtcacatatgtagttgtgctgcagttggcaccatgaacgtattgttatggtttagatgtttttccgttgttgattgctttgaagacctatatgtttaggctttaccctttaaagtatttttcagctacctgtcatttagatacaattatagtttttgtgttgtatttgcgatcatgatttgactttccgaatgtaagttttttattcttggttgaagcattaattgtattagattattgggtgttcctttgaccattcagccttccacttttgtattaataataaaataacaggaaaggattttccaccgcatgtgctatatgggactttaaacaattcaacatttaaagtatattattatccgaaaatgaaattgataactagaaaatggtaaaaggaaaggcccacatacagcagtaatacaaattcattgtatgctacttaacaaacatcataagatacagttgggtatgctatgagcaagaactaagaagagtgtggaatttgtgagtttcgtgaaatcaatgcttgtcctgctagacgtagtaatgtatccctgcattcaaatgcatagataaaggcgacaatgagcgcaacttttgagtaattaatatatttccacgttagtcacgaacgtatttcaatcatatttagtgaacgatttttccaatgtgaactactacacaattttattatcttgagactcatttggtaaaatgcaccggtttatggatcacaccaacacagtacagaatacagacaggacctacgcaataaaagcgatcacaccacagaccacacggccgtactcatctgtcattagtaaaactatcactttttaaaactttatttggtctctttttttcatgccaaatccttaattgattttattcctatccagttgtacaacggatttggatgtaaattatacataagtcgtattagagttgctttagctttttagtatctctctcaaatcatacgatttaaatccatttcttattgtgatatttagaatcggggtagataagttaattatttttactagaaaaacaaagtgttttaaccttttagagaaaaatgaaatccactcaccagg

SEQ ID NO: 5527 - DNA, 1578 bp, Glycine max
  Soy_ogl_5507 Gm17:4469201..4470778 Cluster 25
aaattacaaccttttattatttgggctctcatattgtttttagttttgtcgaaaaacctctcctacgttccaaaattgtttatgggtcaccattcatgtttcggttgggagtgttgtacattgggttatgcatgcctcaattttcaactttgcgctatgggatatttttgccgttgctttagtaattaatgaattggagtacttatatatgtccgacagttattatagttagagttctacttcaaatgctttgagagttgtaaaaaaaataacacttttgagcaatcatgaaaatagaataaattacatttctcaagatttgtctttctctctttactttaaaatataggacaaaacttaaatacattgcttttagatgttgtttttattgttcttctgtctgaattcaagttttacctaacctaaataatttgaacaaatttttaatgtaaacttttattatacaaattttgtatcgaaacaaaatttcaattctaattgaaaaacataaacaatatatatatatatacacacacacgcactttcttttatatatttttaagacattattttttatttctttcgtatattattatttcattatttttatcctctctttttttcaatatcacaccttttaaaaaaaatataataagatacgacaacaaaggtatgacaacaatgagagattcaaacttaaaacattatataaattgcacaattgttttattatcagacaaacattaatgaatattgagtcttcaatggtgtaattgttaggaaatatgatttcaggtaagaaaaaggagagaaagatattatattcaaagtaaaatattaaaaggagaaagtaatatttcaagaagtataatgttttttttcttattttcctcacttggaatcatgtttcctaccgtgctatcaaagcaatatcacccacgaccttgaatgatatcttcctttctattcattttttttctactttctcttgcatctgttaattaattttccttcttctttttttatagaaaatttagtgacatatacaaatgtattaaagtatataagtgagggaggactacttacactttaggagagtcagttttattggattaaattagattttaatcccaaattctaaaatgttatcaaaatttattttagcaattatatttatatggtctattgagtcatctgcagcaattatcaccactggcaaatccagtaaattttatgtttgatatgtccaattttttactagagagtatgttagagataatgatatggataaattaaagtatataaattgaaaataattatcatcttacaaaattttaattttatagagttaaattagatttaaacacaaaatttaagagcgattgaatcatttttgtatatctatgggggcacaacaacgagcgaaaaagagccccctattggtttctcattgttatcatttattgaaaacatacacaagacatgtatacaggtgttaactggtttgcgccataagcaagcccttacatgtatgaaatcaaatcaagtattactccgttgagatgataaagttagtag

SEQ ID NO: 5528 - DNA, 1935 bp, Glycine max
  Soy_ogl_6732 Gm20:33879601..33881535 Cluster 25
ttgggtttgcaactgacttattacaatccttgcaatactcccaccaccttatttataatcatgaatatttcccaacacggtaggcaacatcaacatattaaaataacaatacttatttaattcgaaacttattcactatcaagactttagtttaaaattctatttaccaatccataattttttcaatctaaaattctacttcaaaacaggctgtttagttttctgagaatattttcagttttcatttcttaaagactttttattttgaatatttatttctttttgaaaacacgtttgcgttgtttttttattattattaatcttttcctcataagagcattactacttttcatgagtataatccaaaagctgacattgaacaaaagtatttgttgcacattactcccagttggaaaaaaaaaaaaaagtcccataacaaaaaggcaatatattgatattgaggcaaaagtgggcatcattacgagacaataacataatcataacttattataaaaactaattctccccatgaaagtagtaaagaacaaagtataagaaagggtgttgtgcatacatttggaattgggtttgggggctatgttgtccgggccaatcaacgaagagggaactgttgtcattgattaccaagagagaaaaaaatgccactggccaactacaatataaatctatgatgacttgattactttgttgcgttaggaataagaattaaggggcaattgtcagtctaattggaaaagagattgtgagtggggaattagtgtttgttggaaatcagaggatgagacggatcgatgtagatgcatgagcaaaattcagagaacaattctcgagagatttcatattgattataagatacaatactcttccatcttgtaattaagtcatgggagttcataacaatggagtttgtaaaggtcaagggactgaaaatgatggaaaaataaaccaatatctcttcaacatctaaaaaatgctaccctgtgtagattgaaaatgatggaaactacttcctcatgcaaattaaatctttttgttgcaattttctctaaaattgactccacttaactattagaggtaacaatcaagcttatccattgtaactaaagccacgatgggtgggtggtattaatgtttgatgacttatctaaaaaaagaggcacacaaagttctaacatgaaagtgacgctttcgctatgaggagtctatggattttgattagtcgacaatttgatggatgtttctaaagattgtgcatggacggcgggactctagtgactggttatagaaatttggtagttttgtgtaaatgaaatgggtaatattatattgtagatgctcaatatttgagtttcgtttcgtattctaagagtgtttaaacaatgtacgtcttggaaaaaaaaattagaggtaatgtgagttaaagaaaattacacgtacaatatactactataagtttttgacagctggcatgttgtgatgatgaatagtataaactaaaatacatgtatttgttcattataaatataatattttttattttttatttaatacctactgcaatattaataattccaggtttttaagcataatgcattgttaatataataatatttttgtttaggcattgatattttaatctacatcggcactgaaggtgttttaattacccatttgcgttagttattacagtacttgagatcaatttttacgggaaaaaaatccctccattttttagcataccaaatggaacattaactctaatacgctaatagatcccaaaaattaaagtagaagaataaaaaaaaactccttcaaaagcatgttagtaatgcattaaaaaacgtgattaatttatatttaaatttttgttgacaaatgtgcttatatttaatggttcatcttagggataattaa

SEQ ID NO: 5529 - DNA, 1567 bp, Glycine max
  Soy_ogl_6969 Gm20:44006601..44008167 Cluster 25
ttgactcaaacttgtcataatcaagttgatgcaagcaagctaagatctcatcattggatttaaccagcgtaacatataactcaataggctcaacattatatgataccggacaaagatggagaacatgtatgcctcatctttttcgtattcaatatgctttgtgcgtacagtgtgttgataaataacatcagccaccttaatttttggtacattcaactcaagcttttcatattatttttcttcagggcatcgagtgtgatgcgctttcattaatcctaaatgattttgggaatcacattgaaacgctatccctttagaagttcttgtaatctcaccattgtagtacacataaataagatgagatcttggccttggtttagctataaggttgggaatgtttctttttccttttcataatggtgtatgaatacattgtcatgtatctgtatctactcaaaacattgaggttgatatatacaggttcgagtacctccttgtactcaatttcaataaatttctttgatttatataaacaaaatataacttgggaagctcattttttatttcatatcggatgggttaacaacatactttattatacaaataaaaaataatcactaaacaaaaagtgaaaacctaatttctataataagtttcagtcaatatacaataaaatatgtacgaacagatgatgcaagcaatgtagaatatatatttttaaaaattgaatcatttcccttcctttcatctcactcgagagtagaaatgtatttataaatattctttcaactctcttttatgtcaacaaaacaacccttctttttatctttattgtctccattccatctaaaacatccatcgcactagcagcagcaccgctgcaacttccaaccatgacagaggaccacgagaaagccttcgcctttgacttcgacaagagctctttgtctcctccgcgctcccttcagtgtgagatcttttctcagatccgggttttcttcgtgttgtctgtgtggcacatttgggtttgggattgggatagggttttggtgaagaggtcataaaagaaggagggtgagtttttgaggattactctacaaatttttaccaatatcttaattttcttgaggacggcacagtatgcattagtaattagtgattatatttacatactatttttcttacttgaaatataaatgcaacaaatttttcatacttcaaatcaaatagaagacgtgcttaaatattaattagaaattttataattaaatggaatatgtagttaaatattaaccgttaattactaaatcactcctctcacaaaaataaagtgagttgatggtacaaatgggagaataaaagcatgaagctttatatgaaacttgtttgtaattcaaaaatataattaagatagtggtcacttattgaaaatataattataaaaaatttcaattgaataagcgatagatataaaatagtactcttaaataaaattataattctccatgtaaatgagttgaacaaaattataatctttataaatatattttaacgtcaaacttaccaa

SEQ ID NO: 5530 - DNA, 1300 bp, Glycine max
  Soy_ogl_2172 Gm07:4019801..4021100 Cluster 25
acgttagctctgattgaggttcattccaagctcttccaacacaacagcttgcttctttgttatttactaattcctaattactatatgcatgtttggtttaccgttgaaaaatccttaaatgggcgttgaatcaaaagttctgaatttttatttctcacaaaagatacatgagagtatctgcatgttcaacctaacgtttaagcaaacacagacaattatctattacgtaccaaagttagattactttgaattgtctcataatatcaataacttgtttgcctgtttgagctctcagatttcttctttgaagagtgatttgatgcatgtgttggtttagctttaattttgttggcttatctaagttgatttttatttttttattttatgttaagttattttaaatacaaaataaattaacttgaatacaatgtttaactagagtgaagtgattaatgtaacattattttaatgtgataaaattttacattgacaagtttcgccattaagaaaatgagatttacatttattttttacacgtgcataacatattttcactaaaataacttttaatagtaagtttcgattaaataatatgcaccccctaaaaaatatgcctgtaaaatataaaataatttgtttagtcaacttttgataaaagttccgtaaaggtatttatgaagagtttaattttcattagtattaatttaaaaaaaaaaactaaaaaagtgtactattactaattaaaaattattttaaatataatttttaaataaattaagaagttccttaatatgaagaatgttattagataacttggattacgttgaaaaatttgaacatctgggaaaaatgaaaacagacaaaattaacaaattgacaatattttccacacaaggacaaaaaattgacatggggtgagagaggctcgaactctcgacctcaggatcactcaacatagctatgagacctacgcgctagccaactgcgccaccaccccatctgctattgtaatggagtaatacattttaatagaataatttattatttgtcaaatttaattttcaatatactctgtattcataatttggatcaatccgtgaagctctggagattgttattggcactacttcaattggaagaaatgttaacaggtaacaagatgtgcacacacacaatttaatgcttgcatgagtaagagaagaaagaatactaaaaaattatagagagaataacagcataacatttctggttccaaggctcttatatcccctctcataaacaaaaaacaatctctgttttt

SEQ ID NO: 5531 - DNA, 1700 bp, Glycine max
  Soy_ogl_4993 Gm15:11307101..11308800 Cluster 25
aagttgtagaagagtagagttttgcttcatccctcgattcaagattctcaggtgtggactagagatttgtcaggcgtctattcatccaagtttggatatacttggctgattgataagcatgggaatagcctaggggatcattggaactagatttagaaaatgcatctcccggagaatgttaagttctttatttggcagctttgtcataaggcccttcctactaaaagctttatggtgcatcatcatattcctattctagcttctagccttaggtgcaggttgggagaggaggatcttcatcatatcttctgggaatgtgggagtatcgtgtaggtttggaatttgttgaatgtcttggtgcagatcccagatagagttcatttggattggagatcttggattcctttttgcagatatcttaaaggccgagttgttgggtttgctctttggaaggagaattgcagcaatattttctgtgtttctgactcactgcatgcggttcagttgatcaaacaacaagttcaaggctgtcatgcatatgctgcaattgtagagcatattagagacttcttggagggtggagttgaagcattctctgcaagtgtgcaaatgccctagcagaacttagctgtcttgctccggcctgacgccatgcaagtatcttatttgaggctttagttcttgttttcttattttgtttgttctcttccatcatctacaattaaaaataaaaaaaagataagatacacttctcattttgattttgcgattctgcttaagttattaatcgaaaattgaggcccagagaacacaatatcgcagttgattgaacaaaacacatgagttatcataactcataaatttgattgaacaaaacacgagttatcataaattttcttacactgtttgtttatttttacagttttttttttaagaaaaaatcaacgaaaactagctcctattgaaccgaggcaaaagcttgcttagctaaattgtcagctacagaattccaagttctgtatacaccaagtttgttcatgaacctattttctctaaattatagttttaaatttatttgaaaatatatctaaaaataaaaatgtattagcacacacatgcaaaagaaaaaaaaaatagaacacgagaaattaagatctacatagccgaatagagaatattccaaaatgccgcaatcaagggttgcatggtcttgtttcctagtaatttgatacagcttcagtcaactcgttgcacatttgcttttgaatcccaaaatatactttgttgacaactatttgactctttcaaaacaaaataaaaaagataaacaccttgattattattaaaaattaaaatatatcattttaaaaaagtgttagcaaatattttttaatatactaattctaatatattatttactactagttaaaatttattaaaaatttaatgagactcattaaataaaaaatggcattcacaatttttttgtatgtttaataaattttaataacaataaataacatgtttaaaagaagattctaaacagtttgttagtagaaatgatcataaatttataagttaaataattctaaatcttctaatattattcttctactaattctcgtatatattttctttgtatgataagtacaatattaatttttttttatgttaaatgagtatttaccttttcataatta

SEQ ID NO: 5532 - DNA, 1452 bp, Glycine max
  Soy_ogl_5200 Gm16:331201..332652 Cluster 25
ctgtcagatagccattaggcttcagccgcaaaagacaagtagcatcatacttaaagcaaacgaaggtgcctaagattttatggtcctaatgaattatgtatcatgtgtgcatttaattcttaagaattaactctactagctagatatgagcttgatgcaaaattcatatgtacgtaaagttagcaatgatcatatcccgttctgattggccctgcagtcttccttctgcttggcccttttgattagaaaaagaaaaagatattatcccattccaaaacttgcttgttcgaggcataaatgttgtgctttcgaatacttaccatttactttgttcgaggcttttcacgttttatttttctttgaataataacttggtttaaaagatgattgttcctggataatatattggagtaattgtgtatttgcactttgtgaaagattcttctctgctttatctttgtggggaataaattagattaaccaaaaaagtacttgttttaacgctagaattatgcttttgcaagtatatatatatatatttgcttgcttcaaagacatatcactcagacacccacttggcttccgccgcaaaaggcaaatagcattgagctatcatactaaagcaaacgaataaaggtacgtaagattttactgtcctaatcaattaggtattgtttgtgtatttacttcttaattatgaattatactcgttatgagcttcatgcaaaattcatatgtacgtaaagttaacaaattataagttcagaccgggacattatataactaatgtatatataacgccataacttaagtctggatctgctaaacttactgtacgtacataatgactgttgagagtattgcaatggagcaatgatatgtagactttttattattattttaaaacacacacctaaacaacatccattattttttttctatatttctctttaattcatattatatcatctataatacatattttaatttcactaggtgtctaagaatattattttcctattctaatgacacgcattaatggcaaacctacaagtaaatatattgaattttagctagtatatatctttgtttttgccattttatatactcgaactcattacttatcattttttgtctttttaattatatgttaaaatatatttttttattctcataaaattagaaatgttcaaattttgtttcttcaaaataattagtatgtttcatataaaattaaaatatgacaaattttgattcagaattagatttagataaatttaaacctagatgaaaatttttgggatttaaaaactataaaaatacaaattatagaataaatatttgtaacaatttttaaccttcataaattataaaaaaaatcatcacaaattatattatgtgggtttggacaggttccagtcaaaatttgacaattttaattttacaagcatg

SEQ ID NO: 5533 - DNA, 1198 bp, Glycine max
  Soy_ogl_5605 Gm17:9297801..9298998 Cluster 25
atttcaaagtatgatactctttcagaataattatatcataataactaaaaatctattttggaatacctatttcaaaatagaaaattatatttcaaaataggatactcttttaaaataattattcagtaatatgaggtgtctagatgagggatatttgtgtaagttagagtcttttaggagatgaaaaagtaaaaaatgggtgaaaaaaataaaattcaaagtaatttcaaaatatttatctaaaaaagattaaattttaatattaatctttttgaaaatgaacataagttaatttttaaaaattaaaaaacaagtattgataattttcatatatatatatatgatcacgatcaatatttgattcttagatgatgtgataagtcattaagatattagtattattgttatttcattaattaacaaagttgttactttataatagaaactaaaaatattaaattttgcaaaaactaaaataaaataataaattaaataccaaaaaatcaaaataatcttattttacctttattatatataatagttttgagataagttagattttagacacaaggctcaatgccatttctcataagtaattaagttgcaatgttaccttgttttggtgttgtaattaatgtcgactcaaagataaaggaaatcccattgagtagttccctatttttttatatcataaaaatgaaagaaaaaaggcttctaactaattagttttgaattcggaccaatacgtgttttactatttacatatgtattataggaatcctgcatccaagggaggtgttgtttcaatcaataatgcaaattgaatttgaaacttaataaagaacatattcaatgctgaaaagaaaacagaagaaaatcttaatcaattatcgacacgcaccatacgcgatcattgtcgttaattggcccatacccagtcagttttcattctcaattgtgcatgtctgccttctcaaatcataagagcttttcctttctgttattgtttttaataaaaataagatgaacctgcaacaattaaggagttaggaagggcatcatgaaccatatatgcatggggccacatcaatataggtacagcaaaactcgtacgtgagaggctagaaacattggatctctcttattaaccatcttgccaccttccccacttgccacaagctctattaatattctgtac

SEQ ID NO: 5534 - DNA, 1101 bp, Glycine max
  Soy_ogl_6908 Gm20:41111101..41112201 Cluster 25
tgattaaataaggaaaaaaatatgtttgtagtattgtgatgaaatcttatttttaatctcttataattttatatcatttaatttaattttactatttaaaaaaatgtaagaataaattcgaaataacttgttacatttatattactgttcaatgtgttacatattaataaattttttaaagaaaacaaaataattttttcacgttaaacaaaagttaatatccttcgttagaattctatgtgaaatgattaaaaatatttttttataaaatagatgactaaactggataacaagaaactctgaggattaaaaataatatttaataaaaatatatttttccataaacccaaaaatggttcttccctagatattttgacctgacataattcaaccatcgtagtctgcaagactgcaactcttccacgttgttcaaacctacagaaggaataccaaacaatatagaatggaaaacgcgggaaaatttgtttgtacatatagaaacgtaatgataaatgttatttgtgcttttagccaaatcattatatatactacttctggccggaaagctctaattctattcccccatgaacacatgaacgtaaaaacttcgtgaggattttttttcttcttctcagcagattaagaacgtaccactgttcatcattttgttttgtcacttctgttatggccttgaatttctccctatcttcctacgaatgaacacgtgtataaagttttttaagaaaaaagcaagtggtcgtttagattaatatttcacggaaaacaaaggcagttaattagacaaaattaatcaattaaacacattcgtctctttttgtccaattcagtgtttctctattttttttttttattgtttgcacaatataatttcaatgctagttgaatgaattatatgtagcgtgacttctttttttttgctacatgagaaaaataaacacaaaactaaagcaaaactaagacagacgacaagttgtctctgctcgagaacttcattcggaggtatcttccaactagcatcatcatgtccatcgaacttgtttcccatttagccaacttatcagcttagcgtgacttcctaat

SEQ ID NO: 5535 - DNA, 1401 bp, Glycine max
  Soy_ogl_7010 Gm20:45972401..45973801 Cluster 25
tgtgatcatgagaatgagactggtaaatgcttcaacagcctaatgactaaaactatctaactaaaattaataatatctgtataaaaagatatttgaagacttaatcttctaactttacttttttctttaagagtacgatcattgttttgtcatttatgattttatcaatcaagattagcaattatatgctcaaaagtgagtggatatataaactttttatgaatgtgggacacatataaaaacgatctaaaagcttttgaaagtaaatcatggaaaaatcttcgtgacatttagggtctaaatattatgcgtgaaaatataggtattagcaaaattctttgagattatcccaaattgtatttgttttctagttataaataaaatgatataaccatcattgttttttttataaaaaaacaaagtttggctttatttgggtttgtctactttgattcaaatttgttagagttcaaagtaacttttaattaaatatctaagattagaaaatatagaaaaaaaaagttagacagatttttttttaaaagatgtctagtactactatacgtgtgggtcaaatgttcaattaacttaatatagacatgtgtttcatgggtattacaatattgtagaaagttgatgatttttttttacatacacaataaagcatttattaatgtttccttaaaacataaaatatcaagcaaatgacgtatgaattatgaaatataaaagtaccttaaatataactcatgagttgttatcacttttgtaaaaaataatatcatactattatttatttatttaagatttaaatatattgtcagtgttttaaattgagtgaggtcatttttattttgttcctccaaatttaaatttgttttttttatctctcaatttcaaaaatattttttcgccttttttttataatccaatttttttagtctcttaggttaaaaaaaaatcaacatgtcaatcaccccaaaatcaataaaaaaaaaaaatgattgtgcggtgaatgtcaaataagaaattccgacaatccaaacaatggttcacaatgattttgggtcaatgactccaattgcaacacctatgaagacgtcgatactcaaagttaggatgtgagttaagaagtgagaatgagtgaaattggtctatgccgggagaagagtccatgtataaagacattattggtggaaaaaattgttagattatttatgtgccatgtgaaaagttacgtgattgaatctattatatttgagtatttgacttcttatattcgtgttattatccgttctttcatggtatattttgagttaatcatggctgccgatttttgtgataagttattgtatgtttggtgttcttatactaagtgaccttcaaggcttccctatcaat

SEQ ID NO: 5536 - DNA, 1500 bp, Glycine max
  Soy_ogl_2449 Gm08:1351701..1353200 Cluster 25
tgtaggtcaatgatggaagcagctagcatagtttggggatgttggtttcctaattcctaattaggggctggatctctacttgatgtctgaatctaagacaaggttaattgatatggtctaattaataaaagctgctgcatgattttgtctttggcccttgcatgtatgccttcaatagggatggtcctaacctaagtagcaagcagaaatatagctgcagtgcatgcatgtagggttatttttatatgcctggtgttgtgagttgtgaggcatctagttacaattttcaaaccctgttaaataaatcccccgccatttctggactgcccaattcacccctctgtctcctataggctatagccatatcttcttcttcttggacttgctccctcatcaccctgcgtaaggtactctatggggtgtaactaggaatattaaaactattgattcgattcgaagtcagaattaattttaagaaaaaataaatatactattttataaaattaattttgttagtcaaattgtttttgaaaaaaaatttcagttaattgaattgatttttatttaaatattttttttattttaaaaaaataatttaaaaactagttcgaaaatcatttataatcaatcttttacaatcagtttgattttaaatcaatttaactgtttagataataaaatcgaactaattaaaacactttaagatcaattcaattccattttttttaccaaactaatttttagatagctacattctcctactatgctgtcagattttacagacagaaaataaactatatactaaccacgtcaaacaatttttacactgttattacttattttaaatgatgcataattatacttcttgcaatgttatatctgattataaatcgcaatgtataaccacatcaatcatgatttctattgattaatagtaaaactgttttaattgataataataatcagtgaactctaatatttaaaaattagtattttttttataagaaaatttagtatttcttcattgttacttttaggtaaatattggggcactcataccatggaaagaaagtgtaaaataatcaactatgataataacagagtcctgaaatagtattatagtaatgttattttttttatattactcgtctcgctttcatttctttacttttttatataaaaaagaaagaaaggatagaatttttctctcccttttttcttcatttttcttaatagaagaatatgtaaaataaagaagcagtagtaattaataagaatggtgattgttgttttagaaaaggtacatagtatttgtgcggtgaaatctggttggaggtgttgttggtcgggggaggaatgaggattcatgcgcagacagaggcctaaagcatcatcggattcagagagaaaaaacagaaagtgggtgagtgagtaaagaagggtaatgacatcatggttgggctgagagaagagaaatttggcaagcggcggagaaatgag

SEQ ID NO: 5537 - DNA, 1354 bp, Glycine max
  Soy_ogl_2486 Gm08:3272047..3273400 Cluster 25
agcatcgaagtcttataccaaagttggactcgtataggagtaaggatcccatcaagaaatgcagctacattattttgcttctatacatacatgacgggataagtacatcatcgatagatttcaattttaattatttttcagctcgctaaaatactgtatttcgctttaatttagttaatttttcgcatttttggtaaccaatggcatttcatcccttttccaaacctcaaagtcaaacaaaaaaaaatgttcaaagtccaacaataaaggtcttattttttttcttagcaaaagtatatatttatatacagaaataggcctgtgattgaaaaatatttgatacacattcaatatgctatctaacatcctaagagagagaaatataaataatatgtaataggagagagataaaaaaatgaaaaatattaataagaaatttaaaataaaaaagtatttgtatattattattctatgcgattaataaagaagaagaaaaatttgggatgaatcaaagcaaagaataaatagaccactgtagacatcactcatcagattcgaagatctaaagtgattcatatctatatatattccattctaaagtggcaatgataaatagcattttgaatttgagcaacggaaggtgcctcatcctagaattaaagagggaccaaaattataattcatacaaaattcaattattaaaattagacacaactttaaattatttcctatatttaatttttttagtatattttgctctcattacacaatgcaaaaaaaggattttatatagtctagtttcatagttagaataagatggaatgagatacaataaattattttattttatttttataaattggtggaaacatggtcttggtaatttttagaagaaaaatgttaaaaacacattttttaacatcctagagtttgatcgatagaaattggaagaggatggacgataaaatatgttggattggttggtaaaagggagagatagggaaaataaaattaaaaatggtagtagggtttaatgtactatttgtttttattatttatatccatctttttatctctccacttttctttaagcaaatacttatacttttcactgtatatttcttacctatttctgttattttttatttccattattagttctatttcttttctctatatcaaacagaacattagtaattaaggaggggtaattttagataatgataagagcttcgcttggtgaaaaacaaagggtatgaatctgacattttttttttaaaagagttaaacctttgtgagagaccatatcggtatatatttttaaagaaaaaaaaaacatcacttggttaaaaac

SEQ ID NO: 5538 - DNA, 1549 bp, Glycine max
  Soy_ogl_4853 Gm15:1419701..1421249 Cluster 25
ttttcttaattttttcttaactattgtgaaatgacaaataataattaatcactaagagattgggtccatattaattattaattaatagtaacctatttttatctttcgacaagtacaagtagagtgcaccaatcatagaaaaagcccacagcaaagttatgaaattcaaaacaacaaatagcatcatgatcagaaaaatccataatttgattaacgttggcaaattacaccgtattgacaatttttgtcatttttttctagctaacaagcatcagggacgacacattgtcctacagagttaattgatataatcaagttagcaattattaattcttgataactcttgttttcatgaagcaatcgaagttgattaatactccacatggacgtgccgattgattattgaggatttttttattataatttttatctttatcttaatccttcgattcaccagtattttatttatttattaattcttaaaaaattaataatttttatttatttattattattctaagaaaatattaaaaagtttacaataatttatatatattctttagacagaggagttaaacctctttattaagagagcttatgaatcatcctataaattgcaccttagttaaatttggaaaaggctttttgagtgtactggagatgataattcaccacaacatagtaagccaaggcagaacgaatctaatcatgtgctagtcagggtgtcatataataatcctttgttatttatctaattaagtaacatgttagggttaaagacagaggaagtatagtctgtttattttagaaaaatggacgatcgtaatctgaactcaatgataaaataaaaaggtattatccacgcccagtgggactcgaacccacaatcgcttgattagaagtcaagcgccttatccattaggccatgggcgcctttgaaaatctagcacaaagtattttataaaattaatacccaatggctgtggaatttatataattaaccaaagtttaaacaaatttaaaaataagcttaaaattttttttggtcccaataatatagaatttttattttcattatttaaatatttcatttagttttatcccctacaatttttttattgattttaatcactactatcaattaacaattgttaaatgatgtcataataataatattaataacttattgactttaaggagtatgacatagtaattgtacatattttgttttaaataaattgggcttttaaatctttcaaatttcatcaattagtatgacattatctattttttaacatacaagaatttaaaaatataaaaataaaatagtaattattaataaaaaatataattcatatataatatatattttaaaaaattctcacgaatgtaattaaattaatttttttttgtgagaatgatattaaacagtgaaaataaaactggagaaaaaaggaagacttttaaaaaaaaaaaaatcatcaagtaactgttgatcaaaagagaaaaaacacacaatcaaaattaatggttgacgagttactcattt

SEQ ID NO: 5539 - DNA, 1597 bp, Glycine max
  Soy_ogl_603 Gm02:42093304..42094900 Cluster 25
catatttcaactacattataagttagtttactatagcttgcttaacaaatatatataatgagaaaaagaaactaaaataaaaaatatatatatatatatataattaactagaagcaatattaaatattaaaaataaaatatatattatgcaatttattcgagaataaattgcataatatatattttatttcttattaacaactattgttataaaaaaatttataaaataatataaaagaaaaactaaattttaatataagaagaataatataatattattttgaaagaaaaaaaaaactcccttgcaaagtgcaaacaccaactagaaaacacgtttacataacttatattgttttcggcttcttaaaatgtttaaagtgggccgctgtagaaaagtgacggagaataaaagaaaagaggtctgcagaacacgagctggagaaggcgagatgaagttttaggaggaaaatatagtttaagtgcgtgtttgctttaattttttaatgtgattaatcacttaaaaatagaagcaacaaatacttatttatttatgcataatgagaacaatggacgtggagagaaaatctccaattcaaagttacataagttgttccaaacattctgtataaatgtactgttctaaatatttagaatattttattttagcattccttgtttaaatagtgtcgacatatatagtagaatatactatcgaaagcaaagtgtgatgtaacaattccattgtttgggtcttttatttggactcttattttgtttttttgttagcttttgctttgtcattgacatgcgcgtatatttgcacggtataaagaagcataattttttttctgttttttgactgagaaaagttcatgcgcgtgatatgttctcatgacatcgatcgatctcctatattctacttacattatttcatttattagtttttgactatttttattatttttcgttttgtttttgttctttttatttcattgaaattaattaggttattttttcaccttatccacttcctgtgctttcacatgcaatttcacgggttcactattgtcgtaataacgtggcaaaggatgtgtgaagactgaagacagtgtcagactgcgtaaaggtgcatgcgggttaatgggcgcgtgaaatccactccagaaagtactgtttggtagatgaccatgtttgataagataacatgatttttgtttggataacaaatatgaaaaaattgattttttttatgggatggtatttgaatacttcgaattaaaattgattttgagtatgtaattagtaaaataagttttaaatatttgtatgtatcttatgtattcttatttattatattatatgtcgattagtaatttaaaataagtatgtaggtttataataagttttttatataaaataataataattaaaatattaacttgtgaaataaaatgcatctcctaaagattattattgatattgatatatagattattattgtttttaaaaaactaggtttttaaaaattacaacaaaattaataatgttggattatgaaaactagtttttgcaagattagattatgaaaaataattta

SEQ ID NO: 5540 - DNA, 1461 bp, Glycine max
  Soy_ogl_2475 Gm08:2780860..2782320 Cluster 25
atatcctttctcggtgatagcataaaaagacttcatagataatggatgatgaaaaagtaaaaataaaatagtactatgtctatgtgtgtgtggtgaaaataaaatagtgtgtatgagagagggagggggaaggagattcagagagactaaattttactttattttaatgttaactattttatgttatcatttaattataatattatattataaaaaaaaattataataattaatattaaaatattggactctataagtactatataacttttttttctttttatttgattgttgtgtagcataataaacaaatattttgactaattgactaagcctgatatcttcaaactcatcacttaaataaatcataaatagttttgggacaaatttaataacctaatcctgaatgtgaatgagtcaggttatttatttagcttgaagctaaagctacaccgaggtattttttttttctttaacgaattttatttatgattttataaattaactaataatagagtatatatattaaaatattctcaacactcactacttgactagttgtttattttaagatattgctacttaattttttttattattgaaaaaaacatacatatcattaagaaacaattattttttattaaaaaatattttattaggtgaattatttaactataggtaatttaaaagtgaattatttaaagatgacttaaaattatatcattaaaatataatgcacaagagttgtgatattataatactaatcagtaaaagataaaaaaaattaaaatgaattacttaaattaaacctattggatattctcttaaaaagagatgttaaagctggatgcagtgttgtgaaaaccagaccggtttggacctggacccctaaccgggctgggtgaggtatcggaccggagatgtacaagagccggtttggctcggtgtgaaccggctagtttggcggaaagcgatgactcgaatgggtttgaaaacccggttcgggttgaacagatcttgattgttgcttatttaattcgtgtttcacggtgatcagtgcatggtgtatggggattaggtgggtggtggtgcgccggtgatggatcgtcgaaggcggtggttgggtgccggttgtgacaactgggtggttgagatgggaggcacggtggtgacatggtgtttggcaaggagtttgtgcggcgctgagacattgtgtgttttaggttaagtgtagtgggcttgggcacttagggagccgattaaaaagtatatcttcagcttcttcttgcgaccaatgaactgaaaagcaaaagcaaatgacattctttattattttcttagccttaaccttttttttttattctttcttttccagatccattttttttattatatagaattacttaaaaagaaacaaaacaaataagcattttaaattttaaattatatcaaagtaatttt

SEQ ID NO: 5541 - DNA, 1467 bp, Glycine max
  Soy_ogl_2743 Gm08:17226334..17227800 Cluster 25
aaaagggttactggcattcctggtacgtatggtagccgatgaaagtcacttccataatccataatgaatcgggttcaaatgctggtatggaaaagacaaggaaattaaatatatgttctctgcatgaggtatcctataatacctcttttgattatttttttgatataaaaatgcatgtaaagtcaccacaaaaagaaaagaaaccccaattatgttaacccctcatccttaacatatgcaatattagataaatgttctttattaaatacttttagatttttttattatgtgatgtagtcatacaatttatcacgccagcacctaatcaagaaatcatattgggatgtccactcctaattatatttttttcattgataaattcaaattcgaattctaaaacatacttaaaaaacttaaactcaatttcactcaaattaatgatgtctatgtatagattataaaatgcttgtggtctgaaatatggaaaactaatataaataatatatgattaatattacattaagtctctctttacactatcaatacactatttactttaaaacttttgcaataaaccttagaatttttacaaatgttacatttttttttgttttttaattattatttgtgattgcgtcattgatacaaaatagtcaaacctaagaacttactaaaggacctaagcccaattccatgtagacctaactatatgttggtatatatgtcccatttctttgatattgtttattatgtaatttatagggttgtgacttgtttatacttttttggtaaatatacattgtgatttaaattgaaatatatataaaagagaaaagaaagttgaccacttgaactgaatgatgatagtgtgtaggatgtgttcatttgcaataataataaaaaaagagagaataaaaaatgagataaatgaagagtaaaatgatgggtaagactcacatttttacactttattttaataccaatttactattggtaaaatggcaagagatgtacttaggttgttgttgttggaaaatgcaatacattttttacagtgttgagctaaaaatgaaatctagtggtccatttggactgaactagctaggcaggtattcttaattaagcagtcaagttagttggcatcacttgggtaaacgatttgactaaaaactaacataacaccgatcaaagttcgatcagtgttcggtccactgactccattcaatagtttgtcaaatgctttcatgtggctagctagtaccgaaaacgataagagtcacgtctttactcagctcctaagtcctatctgacccaatgaaccaattatacgtaacaacgtcaccatatatttaaattggtatgtgtatatgtagagacagtgcagtggctttggacttttggcctaatagattctcttgcagagtggcattctcgaactgtttgatagaaagaagcgaaaagggcttt

SEQ ID NO: 5542 - DNA, 1600 bp, Glycine max
  Soy_ogl_5918 Gm18:3061601..3063200 Cluster 25
aaaagtataacttcatcagaatgaaatgaaatatagcaaatatataaagtaaattccgatgaaattacagaagaaaaaatcatagcacagaagtaggcctatatcaacaaatgcagaagaaacaagtatttgtgtcaaataaaagaaacaaggcctacaatcctgaatagaagaaacacaacatatatagtcttacttttacatccagtggcagatatgcaaatatcactatactggatatcaaaagcaacacttctacttatcaaacggttgtaagtagaaaaaaaatttgtttctctttttaatgtgtttcttccaatttgtttgtatacacaccaatactataattaatttactgtactcccaagaaaaaagggagaaaggaggaataaatatttagtgatttcctttatctcggtatatactgatatagtttacctttgtgacattcctcatgcttggtatctccctcgctcgtcagcttcttgattatgttcaacgattctttatacttgttttccatttctggcacacttctttgcatggactcaatgttctcaactagctcgggaatgagtttgctcataatagtagccttctcactatgcatatgctccatatctaaagaattttgaatgtggttttgaatgtctttctcaactctcacaatagcttcgttctgtttactcagagcctcctccacataactatggttcgtcattttgctacaaattcaatgtgcctgcattaaagactatttaattgtttctatgccaaaccaaacaatcttaaaatttaaaacgaatcaagcatcaaatgatttccagaaacagctagcctcagtatcacaatttagaagagagaggaaaaacacccatatattcatgaaaatcatgaataagttgatttaatacaagaggcaaaattatgaaatgggaaggtctaaaactctataatgtgaaatcctagaacatggtttcctaaaactaaaacagtgtatgcctcgtaaaataaacttgaagcgttaagaaaaagaaaaagcaagaactaaaaaaggataacaatgtaagcatgtaatggggaaaacatttgccaaaacatccagtgcaaatgaaaatatgctagaatgaaaaatttgagataaaatgaaaacatgccatacccgataaaaaaagacaaatggttaaggcaatattacaaaattagcacattttatggtcaatggtgatgaaccagttttaatttgtgcagatatcgactaacgggtttaaacttcaaactgaaacgtttcgtattaatgaaaagtaagagtagttaattgagctggattaccaagtcaccgcatagaaatccgagaagaaatttttttattgaaatacacaaaatggtgttatttatttttttttttataatttactatgatattcataataaatattttctttttttacttctttaaccaatgaactaaagactagttaaaaagacctttagttttatttgactttggaaaaccgaatgttataataaaaaaaatcttgcctcaaccaatttctttcgagctgctcgtccttaatctcacgctctttaatgattagtg

SEQ ID NO: 5543 - DNA, 1350 bp, Glycine max
  Soy_ogl_3922 Gm11:36189501..36190850 Cluster 25
cccaaacacataggtactttcacaattggaattaatattttaatgcaaatatgctaaattttgagacaagctttagtcggatcgtaggagtatttagtgttgtaatggtttttgctttaagtagcaagtttgttcggcttttcacaggcattttttttttaatttagataacagaatttccaacccaaaaaaattgaagcttgtgaagatatgtcaatatctcgttacaaagtcaaaatcttaattatgatgattaaaaaaacatttataaacaaaaaagattaagaaaaaagtgggtatatttactcttacatagtagtcattatttatattctcttttttaatatatgcatttcacatataagtaaaaaaaaaatctctttcaatgatctcaaactatcctcctttatcaagggatttaactcatatgattgagtagtatgtataattaagttgttataaactctttgacgtcaagagttcgactctctcatttgaaaaaaattaatctctttttactttttatttgatcttcttaacccttgcctcattcaattttttttcataaattgtataaaagataataaaagataaattgtataaaagataataaaagaaatagatagcaacttaacaaaaacaaaaattgtaaaagttctattgattatcagaaaagtaaaaatgaaaggattgacgaaggaagaatgtaatttttgtttgttgtgggtttgatataaaaatagaggattatggcatcttccactagtttactaattgtgatgtatgatgagtcacactcactcaggggaagatacacgttattagcaaagggagcaattgcttaaattaaaacctattaagtattttttttttgcccgtgtaaaaagaaaataggtattgccctccataaaacactattatttaaatgaatgtagaaagtaataaaagatataaataaaatacattggacttttattatgagattatatatttttatgaaaacttataatgttttgtttataaaaacattttagactatatattttttgtcctcactaaatttattttctaaactatattgccactgctcacactcttttgtgttccaaaaaatgcctccttcttccttgtttgcgagggcttcccctctaagaagcacttttctgccgtctcagctcggttgccaatagtgcttcttccccaccacagagctaaagtggacgtggtgacacaagacgaggggcgggctcgaattgttgaaaatgtttaattgagtgatgaaagtatttcactctctatattatgtataataatttataatttacgacataagggtaaatggtgaatttg

SEQ ID NO: 5544 - DNA, 1206 bp, Glycine max
  Soy_ogl_673 Gm02:45292001..45293206 Cluster 25
attaatgaaattattattagaccattttatgtataaaaaaatcattaaagtttaactagatgaatcaattaatcgtcgcatttaacttttaaatatttatattatgagttatcttctgatatcgtgtagtagttgaacaagataaacctaaatagtaaatggaaattttcacctatatgggtatgtcgttaaaatgtagaacacagactttgcattgtttggagcaagtaattcacgggggaaaaaatgttcaacgcgtggctagctgtggtgcatggctatatttaaaacaatgaattttcatgggatctaatcatgtgtatttataaaatatattaaaagtttcgtcggggatatattataattttttagagatcattttctaatggcaactgggtgttagtttgagactctttctttaaaaaaatgaaaatattttaatttgtttgagaagaccataacaaatataataacgaagaccacgaatcgggattaagtgctcctaagtacatatactagtttctgtctcttcccaaagccacatgccacaagacaattaacattctgtagttaataataattaacataaaacgattcttcctacccgagctatttgctctactcacgttggaatatataaatcattttatagagaggactatttatactaaaaaaattaaactcttgcagtaaacgcgctgactgtgctggacagcaattcttgacatcgtaatatgaacatgcatctctattctttttcccgaaattaattactgaaaaaaaaagcattaatgtatggcccatatacagtatgggtctttctaattgtattttattgatatgtaatgtaaacaatttagaacaatgtggtgcatggtgtaaaactctaaactcgtcctataggctttaatttcttagattatttaaaacaaatatagtttaggtttaattagttgttttaagagtatatatatatcatgaggcgagttataatttgttccgatatattaattctgcgtaagttacaatttgacttaatttctacactttatacccagcctggagcaaccagctctagctggtagctaattttgaccagttattatcataatttaatttttaaccctaaaattcgtaaattcgcaacttaatccttcagcagaagaaaattaatcccacacgttactccagtcccatctactttgt

SEQ ID NO: 5545 - DNA, 1400 bp, Glycine max
  Soy_ogl_228 Gm01:49571301..49572700 Cluster 25
atgacatatcctcaagattcttctataagaatcaaacctctagcatgaagatcttgaggagatttcaagtagctggatcttggttctttcagcttaagatccctctccatgatcatctattgcagatggccttaatagactatcctagcttctttgctattacttgttcccctttctttccctaaaccagcctttttaccgcaccattggcgtcaccaaaacaacataaacaacttttcatctactgaaataaaggccaatgatcccattccttccaccaaaaactcacttgaacttgcaattgtaagtatctacacacgaacctattctttgatttttttgttgttgtttcatacttgttagtttggttgaacaatttttaacatgtaattacctggctgctgttatgttgtgatggttcatttagtttgcctttcataattacataatccttaatttgttgggatatagaacttgaatgatttaatgtttagaattttgtatcaatatatctctcgttcccaaacccttattaaacccctatcgcctatcatcctaatcctctattttccttgttattcaatgaaagactgagtgcatggatgctttttgaaaaattgagtctaatctctgattgaaaagatggaactatatggtcttgagacacattgtggtatatggcctgttgcggttagatcgactacgattgtgattattgtgtcgttgcattatgacatttggtgatttggaattactttgtaatgtgtgatgtggttacaactgcatgcagtctatgaaggaaagtatgattgtcgtttaaagaagaaataccattttcgtgtacgaaacttgacaactgcataagttgagccatcttgaatatcttacactgtattcttcatgactgaaaattagtatttttctatttttttaagcaaaaaatattttactagtaaaagaggaaaaaagcacaaggtgtggcactgtatcccactccttgcagtccaaaccaagcgcaccttacataatgcctataacctgaagcacgtaactccctataataagaatgggtatacttataatccgagccccacgcaaccaaacttatgacttcaacaaatgaacacaatcccctgctatacacgacatcataaacctccccatcacaaatattagtaatttagtatttgtctatttgacaatgaataatccattctttatcaaatgcagataaattaaggaggtttttttcccccatagatttatcattagtaaattaggatgaaactttagcaggtaattaaaaaagacataaccattgtgaaaaccaacaagcttcacaatatattcttacaaatttagagctattttttaaaataaatatttataatatgtttggg

SEQ ID NO: 5546 - DNA, 1361 bp, Glycine max
  Soy_ogl_288 Gm01:52277740..52279100 Cluster 25
aaagttactaacattcagttatcttttgtcatctccaaggcagtgtttgatagaaaggaataaaataaagaaaaagaaaacaggtgggtgagaaaatagaaaataaaaaataaataagtgagaaatatgatgaaaataaagatggtttgatggaaaagaaatcaaaagagaaatagagtagaagttaactttctgaaattatttgtttttttttttaagagaaatataaaactactctttttacctgtactaaaccttgtccataatcgactttgtccttcaccaaaactgaattgcttaagaattttttgtttatcaaaatcgattatggttccataaaattatcaatgtggattcctccacctatgttaactttccctcctttgcatcacacgctgcttttggatgaaccatacgattagtcacgacaactggtcctttgtctgctgtaaactagcgactatgagtgtgttgttacgttgaacgtaacttacattttcacgtaggtaaaaaggaagttacttctacttttattgctttggaatctagaaactttcgtttagagggtttcaaacaaaaatccaaatacatactgcgtcgtcaatatttttttgaacttatgaacccttatgataatcatgccttcaccatcaagccatcatctttctcttctagaacgacgatgacaccgaagtcgaagaccaattgcacatgagttgcatgaggacccaaggggaacacggaaaagctatatgaacagtgaaaaaatctttttattttcacaaagattatgtggacgccatcatccctctttaactaaacgaacccacaaaaaataagacacttcttgtctcttctccctttttctctttcttttttacctattttttaccctcataatagtgcataaactttaggtttcatctttcttaacacatttacctccttcgaacacggtctcattattacaaatacactaaacacgttttttccttttattttattgaaatgctaatacgcaatttgtatataaaaaaatgacaaatgaacatataatttcagttttattttcaaacatcacaaccattaataaatgtatattatatctaacggtcaaaatctattttaatttggtactcaactttttgtctttgagttcttcatgagctgccagaaaactgtagggcactggtactggaaaactcaaagtggactttggagtagcccaacaacttgcttaaattggagtatcatatatgcaggaggccaggcctcctggccatgcagacattaaagtcagcaattttcttttaattgcttatttgtatttattttcttatttttttaaatattttgtttag

SEQ ID NO: 5547 - DNA, 1060 bp, Glycine max
  Soy_ogl_389 Gm02:5107901..5108960 Cluster 25
ctttaaatatttgagttgaatattgtgtccctagcgcatataatagtattcagattctctgcactttctgttttaaatagcattagaaattatcctaattgagtcggataagaacactgtatgcacgtgtttgtaaaatgttctgtttaccgtaaccaacatttttccaaacgcaacattcatgttgcttccttgttcatgcctcgaaaagtgtgtttttctcgttgaatggatttgttctaagtctctaggacatataatatatttaacatagttataaatataggattccaactcaaaatctctttttaagttgataatctaatggtagttgattttttacacttttgttatttaagctgtagggtattttaggagaccacataacatcgagtgtaagatagaaaaacacaattctcactctgcagcaatctggcatgcataagagcttttaagtccaataatgttccggtccacactccccacaagtacaccccgaacccaaccaacaaccggccttttatgtctttgacacaaacgaggtgcctgtgctgacacacgaagggcttttattcaattgcaagaaggaaacaaaaagcaaacaaattaagcttcaaagttgaaagttgaatgttgaaagagcagggggtgattaatgagaacgtacaaagaagttgatgtaaatgtgtgttggggcattgaagagaaagagcaggggaagttgcccccagggcccatggttggggggacctcaatcgttcctcacgcactggtgtggctcaaaacatgcccacaccatgatctgagtagtctcacgcacaacgcacattatcacatactatttaattaagagatataaattaatttgtctcaatggtatcacttatttattacttgttcctttttataacacattcttttaattatggtacttttttttttataataatacctttaattaattataatattcttttttcaaacattagttaattaggtgaaaaactatttttcattaaaaaagagttgaaaaattattaagttagaagagaaataaagg

SEQ ID NO: 5548 - DNA, 1800 bp, Glycine max
  Soy_ogl_2226 Gm07:6005701..6007500 Cluster 25
tcgggtggttccttatatatgagccatcactttttgtttttgccaaagaagattttctgaatagttaatggttttgtaaacttagaagtggagctggaactggaggttgaactggaggatgaagcacttccagttcccccacttggaggtggcctttggacaggtgataaaatctgttggatgtctatctttggagccattggtatttggagagtggtaataagatcttacacaaaccctcagagaaactagagagaagaacaaatgcaaacttataaattttgctgattgtatgcttgaaataatacatatttatacttctacatgcacttggaacctgttcattgtactccatgatcaacgagtaatttaactaatgcaatatacgaacataatgatttgatttagtacgtaggtctataaacaattataatacacacgcagattcacccgtattttatatgtaatgtgtttaaaacccatccgttggtatagtggtgggagatttaagaagattgtacaaagtcttcaagtgtaaattttgtcgctgtcttatatataaaaaataaaatgtaataaatttaatttattcattatataagtgacaaaataagctaacctaactcaaatttatttgatgaaatatatgatttaaacttaaaattttcaagtctaaattcaaactcagaaattttaatccagttccatcatgacctagttcggagtcggaacgtataacccataaaagccataaaaaaaatcaagactattcaacgaaaactcattttaaagtttaaattgctataatattcttaaaataaaattgattatgtgatatgtattatgtcataaaaaaatcaagactattcaacgaaaactcattttaaagtttaaattgctataatattcttaaaataaaattgattatgtgatatgtattatgtcaatatatggtacgatgagagtgtactgtacgtgcgaatatgttcgatctaaaagcatatgcatttgatacgtaaacttcagctaagagcgaagccgaagtttgattggctttgaaattaattatatcatatccttttcttcctgatagatagcaaattttcttcggggtttgtgagtaggatttgctagatatccttggccacgtgcactttttttgaactttggatcttaatgtcctttgattgatgatgatatatatgtagatagaattaaagaacgagacaacagaaaaagtgagtgaacgatcatatgaaaatgaaatgattaatgtctggaaatagaagtagctatgtcccggatgaatgttttaattaaagagtattagttgtttctactttagcaagcgtcagcatgccttaattaattatatatgtatgtagtctcgtgtgttttgtattcgcaaagttaacgatcccagacaaaagtgccggagattacacatgcaatgtgattcatacaatccatatatgaattgattggcatatatgcatgatttcttgatagattacacaaatctggtaggaaactgaaattaacttctttgttatttttttttattgtccccatattgttcttttaaaatgatgtcgttttaaaagttatattttcaaaacgacattattttagagacaacacaaaaaagaatgttagattcctaggaagttagggttgggaagagagagggagagaaaagaaaaagaaagcgttaaagagaatgacattgaaaattgcatgttcactatgtgatgtaattcacaagatcagcttagtggttgaaagctgggtaacaaaaag

SEQ ID NO: 5549 - DNA, 1400 bp, Glycine max
  Soy_ogl_2956 Gm09:2833801..2835200 Cluster 25
ttccttcgccagtgtcttcttgttctatttctttaaatattctgtggtttgtttaattgtttttatcttattttccttccagctaccattccctgcattttattcattccgttctatcaatgctttcaaaatcttcactattttaattgcatgcatgacggtgattccctttacctctttttaaattgtgaatcgggtgaatatattatatgctgtgacttgtttggataatacgagacaatgaagcgataatttagcacgtctttcatctactcctatgtttttcttttttccttttatatgcagaaaaatccttattaatgtaacaattccatttttcctttgtgtttatttagaccactttataataataagtataagtatacatattactgaatgcggaaatcaactaataaaagattttttttatattgacagaatattgttataacttataagtttcaagtttaaatcttgatacaaaattctatcaaataattgaagaaagactttatcattcataataattctatttggtataaatatgattatttcccatgaaaaacatctatattttttcttacaaaataagtaaatataattataagcataacttaatgtataagcattcgccattgggatttagtaacagttacaaattttgagtaaattgatgaatttaatgtatatagagatttaatttcttaaagattttaattttaatatattgctagtttaaaaacttgtatgcgtactataagaaatcataataaatataactttcaaaataatattattatgaatatcattaatttaaatttatatatatgacaaacacgcggatgtgaatttttgagagtagaatagattatgcaaggtttattatttaaaatcagagattcaaattttataaataaaagttaataaaattatgaaatggccgggtgtgaaaaaaatagcaaaaattaaggtatattaaattcacagacaaaaagcaaaactaagaaagagagttggataagaaaacgcgcattcgttttttggcatgtcaaaatgccatcatttttaacactggtaagaggtagttcaaagaacgtacgcatgattagtccgtggtgcatggatgatatattacttagaaaataatgagagtgcagaggtagtagtggagacaaacacaagacacgtaataaacgatgctacgtaacagtagagctagaacaaaacaaaacgattgaatcatttgatttggtcgcagaagggttaagttcattgcacatgctcttcacgtgcgtgacgtagggcagtgtcgtggactcttagctggaggagaaggaaagcggcaacgggtctcggcggcgctgtcggtggttgtcgcttcattcaactctctctctctc

SEQ ID NO: 5550 - DNA, 1787 bp, Glycine max
  Soy_ogl_3596 Gm10:46992067..46993853 Cluster 25
taaaagtaatatacaattggaggaaatatgtttaatttgaaaacaagtcagacgattaaaatatataattggcatcaataagatgtacagagtgtcatagaactcgtgcccctccatggataaagaagaaacttgcagagaaagctggtagaggaagctagagacaaaaaaagaaaaagaaatataggaagtcatgattaacatagaatgagttaatttacaaaagttgattatacagttaattggttatataattagttacaaaaataacttacaactaaccaagttaattctaattacataataatcaagttaaattaactgactaaactatctctagttagttacatattgacctatgctaagatgctaagagagtgcatttacttttctataaacaaatactagtacatactttgcaaaaagaagctagaaggttgtgaaatgagcatgagacgtccccatgctaccactgatcttgttgcaggtgtaacgcttggccacgtattctcacttcccacctcttgaactggaatacaaaaccaatactaaacacaattcggcaacaggatacgaagatgagtcaggaacagccaaggtgtcccaaagaccaagaccccatcaagtatggcgatgttttccacgtttccggcaaccttgcaaaaaagcccgtcgcgcctgaagatgctgccatgatgcaaagagtgctcgcccaggtcactcactgccaccgacgtaactaaggtagtcgctggacaggttctattttctttcttatttcactattttacaaacccttgcttataatatcgtgtgcgctttgatatgctttctctcggtgccattataaatttataatggtcctttacacagatagatgaaagaaaaattaattaatcaacaaataaaaataataataatttttaaagtgattcttattaccattaattctttttcaattttaataacctatatcattaatatcatagaagatatataaaaaattaaaataataattatttaagaatatatttttttcacgacgacaaagaaaatatatatttttatctgtaaatgatagttattaattttattttttcttagtaaaaaggattccgactcataatattttttcattcatctcttccccatcatcataatatatgggtaacaaggcggtggatcagagtgacgcaggcggcggagatgagagcgatggggagggtgggttggctgctatggctcaagagtgagcaggacaaggtcaagcttgccgacgttctgaccgctgcaagatgctgaaagggtggcggcagctgctatactcaatgagaatgctaataatgatatacttgtgaggagtgctgtcttgtgttgtagactgtatagtttataatgtataagtctttctcaggtatattactgctctagttttgttgtaaagactctacttatcctatgctatggatttctttggttataacttaattttgtgtttcaatcttttataatttcttatttgcaatcattcgagatcccaaaatgacttagaatttattcggtacccttttcctttaatcataaataattaactgacatatattatttttctctttctctctagaaataatatatgaagtcaaagtttatttttctagaaatggttgtttattagattgagtgtttgaaaaatctcttgacagatttctctgtgaatttaaaatccataaataatatggtaaagcaattgttaaaaatataatgtataaaaaattgttaaaaagata

SEQ ID NO: 5551 - DNA, 1500 bp, Glycine max
  Soy_ogl_5866 Gm18:1426701..1428200 Cluster 25
tgatatattcatgtgctttcttcttgctagcttttggattgtagatactctttgattatcataaaaggaacgaacgactttaatttggaaattgagaccgaagttgcaatagaaatcgttacacgtcttctctagtgtgtatgtattgtttccttttgggtttaaaggatgaccaaatgttgaggccagtcacaatataaagggaactcacgaagctggggaaagtgtttagtatagtttaatgtttaaactcatgcacgcaccagatatcttaagaatctataccagatatataacggttgtctatatagtttctttccattcccattgttggagaattaaagcttctgattatttagcatattttattgtataattttactatatagtattttgtactttaagtatcttatcaaatcttcggttgcaacatcattggagaagatatagtggcattcataatgaatacaagtccaatgaattcactttatgttgtcaactagtagtccaatgaattatgttgtggttggcttaagaatgaatacaagtcaaatttcagctggcttacagtcacagtggcatggaatatataacagagtgttgcgtcaaaaaaacaataatgacgacaacaggactaaatacaatgcatgtattttttttttaattgagaaataatttattctttaaagttctctaaaaaaagtaacattttactaataattttccccactcgaattgagggtattaaagtaattttcattgtttttgcttttattttttatttaaaaaacatttgttcagttaatgagattaatgaattttgtcacttttgggtaacacatgtaaaattgaagacggatgcagaaacaaacacctactaaatgacagtatatgaaacctttatatcaagtacatatattattttctcaattttctttaactttaactcattaagccaatcgatctattacatctcttactttgatttgatgtttcacttatcattaattaaagataaacaatgtattacattttcttaactaaaaattagcatctaagacatatatttttgtagttcattttgtcatgaaaaatatgggtacatcatccgatacaattactaaactaaactaagggaagaattattctcacttttatatttgttatttaaactatcaattctgaaatttctattttgcccactaaccaaattcctccaccccctctcttttcccttccctccttctcatatccaaaaccgttgcccctacaccaacctagactgcatcacccctccctcagcgccacccttctccccacacaaaacgtcgtcaatccacgaccacgccatccctccctccgcaacccattgtcaatccacatgcatgccatcctccccctccatgcaattcgttgatccacacagcaccttgccccatcaagatcaagcacccttgtttctcttttttggattttattgcaggttttgttgttgttgaa

SEQ ID NO: 5552 - DNA, 1409 bp, Glycine max
  Soy_ogl_2629 Gm08:12390492..12391900 Cluster 25
cttcccaagccaatgaacatatctgttgataagaaaaaaatggtttaagaatatttttactcttttaaatttgaataattattttttaaactccttaaaaaattatttttattagtttctcaattttttgaaaagttttagtctctctttatttattgtgtttatgatttcaaaattatgattgttttttacagtcattttttttattttttaatttaattttaaaaaaataatttttgacgattttaaactgtcaaaacatttaactcgtatagtttggtggccatttttttatttatattctagcagtttaaaaacagctacaaattatttttaaagaaattaaataaaaaatagtgatgtttatatatatgtataaaaggaaaagttaatatgtactttcaaaatatcatatcatttaaataaacttataacgactatattaatgcatcaaattccattaagtaaatattacactacaaaaaaaaaaaataccaaactaatgttcgtatcgtccctgaccttgacatgcacaaaagtagagcacaaagcatcaactagagatgagaggggtggatacaggtaagacaaaatatcaaacatgaaggaacgacggggaagatgaagtaacttattttttctcaagatttccagagagccacaacatgtctagtctatagggggggaaaagtttgcgccttggtcattttgaacaggagggatagaggagctcaccgctttggctttgttggcttcaaaggagtggctaatgctgtgaatttagagaagcagctagatagtatcagcagatggggatggcatggagatctttcacgatgatcagaggggtatggaggaactgtggaagcgcaacaacgagaagtatttgaagtgctacctagtaaggcctatcgtgtacatgagtatggtgtagttatgaagggaaagaaaatgtgagcccaatatggtaatcggctgtaatttggttgatgggcagattatggtggagatatatagttccggaaacacaacatgaaatcaataggatcccttctaacaggggtggtgaagcatctccagttgtaaatctaatttctatccaaggcaattccataccctacagtagtgtaattcagttccgcgatataaaggcctaagctagaaatttgtatgccatcaggatcaacattggagtgtcagataagaagaacgaaattcatatggtggataggatgaaaactatggaggaaagagacaaggaagacaagagatttgagaggggggcataatggttatcaaatgaagattctatcttacaatgttagggggttggggaaatggatgaagcggaagttcataaaaaatctgatcttgaatgagggggtgcagtttgtgagtatacaagaaac

SEQ ID NO: 5553 - DNA, 1766 bp, Glycine max
  Soy_ogl_2438 Gm08:573401..575166 Cluster 25
aacatattatttgctactaaaagtagatgtaatcattttttcatatagtagctactagctagtcgatgtctagagcggacatatatatattagtcttttaatttttgtaaaatattttttagatatgcttgtataaaaaaataaagttaaataagaaatataactatgtacgattttaaatataatattcagactttgataatatcaactcatatctaaaatgttagtaaaaataaatcatactcaaaatgtgtgccaacatatgatatatgcacccaacccaacaggcttttttcctctttcatcccacacaaatgtgaaatgtcgcagttttttttttaatatatgaaatgtcccagttaatgtactggcaatttagaaccaattaattcttaattataacggttttccttttttttttctttgatgtttatactcgtttaattttccttttcatatattcttcaaatggttttggattttaattaatggtacaaatattcatattcattgatgttgatgatgatatttattttcgtgaatggttttcattgatgatgatatgatacacgatctggtacaaaacaacatctctggattatggatcataaacttcgcagcttgtagtatttttgctctctttttttatatatgtaaaactgcagggaatcgacatccgatgaagtacttgattggcctacatatctatatggtatagcaaaataattaatgtgaacaaaagaacttgcttcgacttgggatttgaaacattcttttactacttacatgcacaatggttttttttatacattttaaaattatttccacacctttttgtaccttttgttaatcttctttctcttgtgttagaatctatagtacctacatttcttcttccttttttaggttttgaataagagtttatggtctcaaacttttttcatctcgtgtatggtgtgtttgatagaggggatagaaataaaaaaaataaaataaaatttttaaatcaaagttgaatgtaaaaataaaagtctttgtgtattattttactgtttatttttttctttctccaaacaaacacacccttaattagggaagatgtaggttgaagcatcttttcctatgtagcattagcaaaaagatagaacaagcagacaagtgaggaggagaaaatagggcatgcatgtctgtggcgaaggagcatgcatagggtgcaattcttgacgtgccttcttaaagtagaacagcacgcatgaccgtctttccatgttcatgaacgtctttgatcactgcaccccacgtcccccctcaccaactaccatttcctcacacggtcccacccttaaccactttatatattagtttattaaagtttttaaatattcaattattagttcctataattcttacattttttaaataattaaaatttaatttttttctcatactcgtcactatccaatttctagatcttccatgattcttcaaaacttgaaaattcataaccttttccttcatttgattaatcttataattatttgaaaaaaaatctcttaagttgtaaggtattcattgtaaggtataaatgcttacaattttattcaaaataaacagaaattaaataaaaacattttaaggatgatattattaaaaaccaaatgtgtactaaaatacctatatttttatcattaaacacgtgagtcaattgaagcaggattggttttatagaggtgctatttagtacgaaatatagcgatatgaatttt

SEQ ID NO: 5554 - DNA, 1100 bp, Glycine max
  Soy_ogl_2897 Gm08:44995901..44997000 Cluster 25
gacacctatcatttttttatttctttccaccatatttaatatataccaaacaaacttgcttttattgctcctatttccacatctctccctccatttctttgatatctcttcatcacgaaacacaacgtaattagtacaacaagatacaagaaaaaaaaaatgtaatgttcttgaacggacgacatcaggtagaaagtggagaacttggcaacctgtcaaggcctatatagttgtcaagtgtgcatttgctcgtgccaatgttaggactctgcttttagaagtggtttatggcaattaactctagtcaacagatattcctctaactccgacttgattttgatcaagttcaaatttgaattttctctaatttgcaaaatagagtgcaatcctctgaaaatacttgattggttattgtgagaaataaaaacaatatatttagaccatataaccattaataaatgatcaaaattataagttactagttgatagtcatgtgatcccttaaaaactcatttatatttattatataaatatttgtataaatatataataaacactaattcaataaaataaaaacttaattctcttaaaaaaatcaataagaacttaattaaagtatatatctaaacagggcctaaagatttttattctcacataatacaaaacattgttgtgattgaaaatcattcggcttttgtgataactattttttgggcaataaatatttagtggtaaccattttaaaaaccatacaataattaattttacagtaaatctttagactggtaatatataaaaaaaaaaaactcataccatgatttacttggtgaacgcctgaacgacagcccaattactataaatttaaattttgacaacaatttttataggaaaattattcaaagaccccgcatacatatccataaacaagaatcccagaaattgtcttctacaagatctttgctaagcaatgtaagtgagtagatttttatacttattggcagcttatttagacttagacacgacataacaaagggaaattctattcctagctcccatttctctctctctcttcatagcgctttattccagaattactttct

SEQ ID NO: 5555 - DNA, 1539 bp, Glycine max
  Soy_ogl_4871 Gm15:2496501..2498039 Cluster 25
aagtttttcatccaaagcaatcacataacaagctcttttcgaatgccaaggtttaactgcttttatatttatgtttacgtctaatatcccttcaattttttaatatacttcaacatttgaatttgaaatattcaataaaaagcaataacttttgaaatataagtacaatttttgatcaaaagtaaaactacattttgaagttcattgttaagagaagactaaagtgaaaaaaaggctgaaaaaggagtacatgccttctgaagagtatcaacactttttagaaaagaaagaattatgatacttttcttcgtctctcctctacaaaaattaacacatcaaaataagtaatgcgtcaaagctcccatgcattaaatgaagatttagaacggaaaaatcagacttagactcacaacagataattttacataaactttattattaattaaaaatgattaaaactatacgatcaacagtgttttatcaaataagaaacaagaattacaaattagtttaggtagttattaattagataagttaaatgagaagtttatttgtacaaattaatttgtgttcttatgtacaagttaattttgttataagtttattgcatttatctccttattttcttatcacataaatacttatcgagaaatttatcaaaacataatgtagatagtagaaattgactacgaaatcatgctactggttcaagtggcacgtgttattctccatcacgtggtggttcattgggagggaaagaaatacaacgattttgaacaatgagagttggctggaatggttggtgttatcccaaatcaatagtatgttgtctattgtttcaagtcatcttcctcatcactcaagtggtcgcagtggaatatctcttttaatcatacctatcgcgagggtaatggcattgcagattatgacttagtcatgtggaataagtgtcctacatatatctcatctttcttgatgacttgagcactttaatttctttgctagatttgtttagtttcttgtcttttatatgttttacattgataaaaagaataataaattattttgtggtatactaaaaataaataatgccatgagggatattcgtattgtgaccacactccatacattaactaacccaaaggaatggctgtaagttttggggggtgttggcctgttgggcatgtggttgaaaatttgccactactgaataaagtagtaaaggtgtactattcatttgaaaatttgacaattgcaaaaacgaggttctctgactctgagacaactgttttgcctttgttgctttttgacaaattactacaaaattacaacattactcaatcacaatgagtaaacatattaatttacggtttgttaattttaatggtgatctatttattataaaacgcgtcaaaataaatgtgtttttttttcattttcccctcctacaagtacttattgttgagtttatccaaatacattcctgggttaataaaataaatgtattgcttattgtttcattttttttaattactctga

SEQ ID NO: 5556 - DNA, 1467 bp, Glycine max
  Soy_ogl_5008 Gm15:11996950..11998416 Cluster 25
aattttttttaatttacttagtatttttagaaattttatgaacaaaataagacttatttttgtgcaaaatttgaataaagggaaaattgttatctaacatttagaaaattctattataaaactaaagtaatatatttgaatgatatttataaatttttctagaattaagagttattagagttatttgaattaaatattcatattctagtattttacttctattaagggtaaaatgatcattttatattataaatgatttttaaaattttggaaaatttttttaggggtttaaaatggcaacatttttcttcaataacacttttaaagtggaatttgatcagttgaatttattatgtattttctaattttaatagttttatgaatatggatatttttgtaaattccaaattttatataaagtaaatttcaaaatttaatattcatagaaaatgtttaattatagttaaatgaaattatttaagtttaaaagtgaaaataacttgcataaaatttaataaggtatgttatttgtcaaagaaaaaatgattgaacgttggaaagaagagtgacaacgaaatttttcaaggaaaattttcgaagtgttgaaaccttgattaagaggtggtaaaaatttgcttgtacactatggagggctataatgaggtgtataacattccgttttttcactcactctctctctctctctataatcattaaatattttattttgttaattttaattaaataattaatttgggaaaagtggttgggcctaggtacgggttttatgagtaaaaatgtttttaaagcctttcatgttgggccttagtcccttgcatctattgcttgtcatggaaagcttctttcaagttaagggaggagtgattccgagtgagattgtctcgctcatgggtatgactatggtggtgcgtcacagggttagttctagaccacaatttagttgtgtatgtttaggttttgatttgtatattcggaagcactttttttattagtgttgtgatttgattatatgaatttttggttgtgttatgtttttcttcttttgttccaattaggattttttttatgggttatgaaggattgtgtgtgggctgggagttattgaatcaattgaatgttagggatgtagtaaaagtgttttagaattttttttcgatgtttaaaaggcgtgggacccatgaaaaaccttcccatttgcaatcttatgtttctacaaaattgtgtaggtttcacaatggccatgtgagaatgtacttcagttaacattctttgcagttggatacgctaagagacaaaacatttaactaggaatccgagttatatgaatagcgaatgtgaaatcaacggaaaaaaaacatgctttaggttgccaattttgaaactttgccgtccttgaactcttggtgcttttgctttagctttccatcttttctgtcttatcttcat

SEQ ID NO: 5557 - DNA, 1017 bp, Glycine max
  Soy_ogl_6170 Gm18:54354133..54355149 Cluster 25
ttaaaaaataatatttctgtaaccaattcaaccaaattgggtcattaattcaattatactagttaattaggtcaatatagatcaatgacataacttatccaacaagatacttaaaccgttcatgccatcaattcttagttcgtctaattggactggattttgaaactatgttccatattactctctctcaaattgattgttattttgggagattttaaaactatggaccattggttggtttgatggttgacaagggaaacttaactccttaagggccaaaagagaatgggagagaaaaaaatcgtgggttcaaattcttcctattaatatttctaataaaactaataaattaatatttatttattaaaaaatgattgatactttagtattgaaaaaaaatgttgactaatgttctctattttttatgagatattaaaacatctattataattgaaagactcaataatatagttttgaaaaacttaataatatattttttaaattaaaaaagagaataagaacatttttaataaattattctctaacaaatactagtttcttgtttttgttttaaactatgtgaagaaaatttaaatacccgtcattttgaggcggtggagcataaattcacttttgaaaaaacttgtgattttcttgtgaaaattgattttgaaacaccaagataaacgactctaacctcaatgttatatagttttgaaaaatgtgagatgagagtgatgtcatgcatgttgaaagtgatgaatccgatatcagacttcagagagaattgagttttcttgtagaaaaatgtctggggtattcaagagacctgaactctccaatgaattatctgaaaaggatcctttacaaagccttcttccctcttctatacatctgatacccctgtaactaactaatgcagttagttatttcattacaattatttcagggaattagttattgtaatctaatctgccccctgcttatttcccctaactacactctcctaatagagta

SEQ ID NO: 5558 - DNA, 1404 bp, Glycine max
  Soy_ogl_6590 Gm19:45295501..45296904 Cluster 25
caatagctttttgaagagattctgtcctgtagaactttccaacccataagattgatcttcaaaggaaccaaaatgttacaaaatattttgtagaaatggccatcctgctgccgtcttggattgatgatcaacttgtatgcagatctgtccatcaccacgtcacttttgttttttatgcatgtatttttcggtttaaatccgagttataatctgactctagttctgacacttattttttcgattcacaaaactttgaacctgtaaaaacgtgtagtattagctacagcccttcattaggggaatatacccaacttttcaatttaagaaaaaatctacagccaaccatctttcatccatattacacccccacaattagctttttaaaaaatcacatttagaccagaagctaactcaaacaactttgaatgccttgattttatttttgttttttttacattcatatcccgcataaatgtgtcttctcactaatctgctaattattataaatatgttatcctaaccacattggaactgcattgaatccagtacatagttccatatgggcttgattcatcattttgcttcaacttcaacccttggcagttagttatcaagaatagaaatggtgataagggattgccctgtctcgatctcttaatttctagaacttaatttttccgtgggactcttatccaccaatattgaaatatgcgcctaaccaaagcattacaatctccgtttaattacaaatccgatcctctccatcatagaatccataaatttcaatctaattaagaaatcacaatccttttcgaaagctatcttgcaaaggaaatcatttgtttccctccttttacctcctctaacgacatgtgcaattatgatgctatccattatattctttcacttgcaaaagtagattgagaatttcataattcataccactgaatccaacaccttttacaaccaattagctttcatgcatttttttattatatctagagtatctctcatccaagagttaaagatttagtcccttgaaatatgaaaaaatattcgaaggattgactttttcaaacaaaaaatcttccatacataaaatctaaagatcaaacgaccttcaattacatacttaattatctgggaactatatcatccatgtttatgtcttttacacatccaagaaaaatgatctataatcttttttcttgtttagaatcttcctattagtgaacaagactatgaaggaactattagaacttataaccaatttagaattggccttgattgtttccaagaatattttgataagataaaagtttacttccccctgatcaacaagaaccttaccccagtaaaagcaataatcagaactcattcaaaatgaacttacacacctcgaag

SEQ ID NO: 5559 - DNA, 1129 bp, Glycine max
  Soy_ogl_4462 Gm13:35651328..35652456 Cluster 25
cacaatgtctaattttcgaatcaaaggtgtgaacacagtcacacatgcatgactaatgtgatttgttgtgaacattcaatgtggtggaggaggacttcaatatggcaatggtgaactctctcataatagtctcctacaaagaatttgatgtttgagttagttagagaaaagatgatagcaatgtaaaaaataaggattagtgccatactaggtgaggtgagggagttcgccttatgtatgagtgattttggcaagaaagtctttagatagttacgatgcatgtgatttatatgacactgttgtatatgatttcacgactaatatcatgagattaaaatcaaccaaccaacttgtgaatatcatttatgtaaagttaatcctgatgcagattgactttgggggtgtagggatgacaaaatgggacatgccgacctggtgactctctattaattgggtagggcggggtggggttctcggcccaccaactcactgtgtctgtcccaccaaacttgctagcatgtcagtctgcttgttcttgatattagtttgtttaaaataatagttattagttatattataattataatatatgagtattaaaaaaataaaaaaaggatagggactttagtttagggtttaagttataatagaaaaaaagacactttgtgtttgatttgggcatttgactacttaattggtaggctgtgttgtgatttagttatttggtagacttattattaaagattattggtattttgtgtgatttaaatactttatgttacttttttttttcttgtttgctgagaggaaaatgaaacttaattattcacagtgaaaactctacatgtatatgtatcatattttcttttaaaggatgggttaagatgtttaatccgtcaaacttaagcgggttagacggtctcaccccatttttggtgcgtcaacggcaaggcaggccaagacggaacataccaactcattttgttattcctaatgagatggtcttgtagtagttgtcccaccctcaaaacttgtgagatagtgaagattgaataatgatagatttatatatcaaccaaattccaaaacaccattaatggatagattatcattaacaataaggactaaa

SEQ ID NO: 5560 - DNA, 1219 bp, Glycine max
  Soy_ogl_6481 Gm19:41095101..41096319 Cluster 25
tgtgatttgcaaggagaaacaacaacgatcgaagatagagagggatttagtgagtagcagagagggtcaacggagagaaaagggtcatctggttaatgtagtcaacgtagtattgataggaagacaagggcacgacacgtgtgaaagttgatggatgaagatgaagaagaggatccttcttgaaggattgtagaaagtgcactggtggtgttggttcaagtttctgcatcgagttttgactttgaacagaagggaacaaacagtattacaaggagattttgtgttcttctaatactatgtgtatcacgccaaggatcataaagatagatgcaaaatctgacgcgttagtattacttgcaagttcaaaactagaataaatattagatcacccttcggataaaattatggctaaaatatattatttccttccgcctgaaatattttcaaaaaattaattcactttaactaaaaaatagttaatattatttaatgttagcagtcttaataaaaaaatcaattcattttctaacgtactcttacatttaattatatttaggacaaaaaaaattattaaaaataaaattctaataaaataaaaattattttaaagataatatcattaaacataagagatttgattaaaatttacttatattttaccattaaacataatttttttgtatatatttcggtccaaagataataataaatttcatccattatatttttatatattttttattatgatattttatgttttaaaaattttgttttaattttttattgtgaaggaatttaaaatgattttatcatcaatgtcacattaacaccgttaatgttttttattcaagaataattaattcaaatataacgacgactaaaaatcatcctaatgtttaaattaattatgaaaatatttaacctatactactagtaagaaatttactgtgttaagtgttgacaattagtcaaaggtgaaaaggttgttcatatatccaagtgaaccatgaaatgtgaatccttacattacatgacaggaaccgcaatggccccaacttcttgggattggagtctctgtttttctctaacccgcatcatcttccggcttctttggtacgatctgcatgcatgaatgatggctcaaatgaggaatgatacatcaatattttactcctatcactttaaacatttcatattttcattaaccccttgtttagta

SEQ ID NO: 5561 - DNA, 1100 bp, Glycine max
  Soy_ogl_788 Gm03:1436301..1437400 Cluster 25
attagcaaaataaataaaaattctttgtgtgatgaactaaaatataaataaatttaaatcaattctttcctttttaatgataccatcttcaaaatacccctttatgtcaattatcttcttatttttgtcttatgcaattaaggaaatgtattgtttttcttttttagactatcaaaattaaataatattaactaattttcttaataaatatgaattattttttatttttttcttatatttcaatccaaagagaatattaaataaggatatatttaaaagggacttaaaattctaaaacatcactttttttaaaaggattaaaacaactaaaaatatagtattatagaaaggatgtacagattataaagttggataggtattttttagaataaaggctaacaagatattttttaacattttttctaacacacattcaacggttgaaacttattaaaaactacaaaaataaagaagagagttatcaaatgaaaaataagacctattaaaaaattataaattttaattaataataaaaaaatattaaaaaatatgttaaagaacgcatccttaacactttttttttaagatacaatattaggttcaaatttcattctaatcattattctaacctgcaacagcaaaacaagtcttgcatgtgcgtgagctagtgagaaattgatctggaccgtgaaatttattaattaaaaaaatgtacagataagattgattaccagttttttctaattttatttttattttttttactgtattccttcttttccattataccattttgcccttccttttctctttcttcccgtctttccaattaaaaaagctctccggtagcgactatgagtttctattccgacgatctacagcgatgatggtcaaagattttaaccattgcaaccaaatcagaagtgacaagtttcgtggtggcgccaattgaatgcggcaacggagattatcgatgagaagaggagcacaacagtggctgttcgacgagggatggaggtgttcacagtggtgaccggtgagagagacgagtgtgcaggggtaaagtgggaaagagaaagaaaaaaaattgaaactcacct

SEQ ID NO: 5562 - DNA, 1257 bp, Glycine max
  Soy_ogl_6641 Gm19:50117344..50118600 Cluster 25
aatgttcaatcaacacaaattcacaatttattgagcttgccatgcaagggacctaacccactgggctctaaacaactcttattttacatgttggttaattggattcgatgccatatatatatatatatatgcttctgtgctgactgatttttgtggtttgtgatagccgggcagaattacttgccctcgttaattttattacaccactttatattatttataaaagatttaaataattttttagttaaccaacaataattaacatggtagaaacttgtgtttcctgatgaaatgttgaatttagattttagtcattcaaattaaaatatttttaatctctgtaatttgaaaaaaaaactcatttttaatccttatattgaactattttcaaattaggaaaaaaataataattacttttaaattcaagagaccaaaaataaatttgatccaaatttgaaggactaaaagattatttatatttttgttaaataataaaatagaagaaatatacatattttaatgtattttcttccttcacctctcctaaaataaaatatgcaagaagtaacggtacatggtgcgaaaaaaagttatcctttgagtcatatcttttcttttctttttcttttcctttatctccatacatactttcatcagaaatggatcttttagtgaagaaaatgtttaacaattgggatccgtggtcctttgatttttcaagggtttttaaggcttgcactaatggactgatgacagagcacatctctgtgcatgccactttctttttgacttgctaaattgaaaagtagtcataatatatggaaagcataagtcgcaggaggcaatatttccgagatgtgaaattgggtcctacgctatatagatcttcatgttcttattcttctgaaatatcattacttctaaaagatttgaaccattttaatgttatacctttgaaaaagttaggaagtaatcactactactgaaatagtcataaagttaaagttcctgtcagcctagctagatatatatcctattagtatatttaattcaggtaaatgtactactgtaagatccttttatgaacatgaaattgggccacatgtaacttcactcaatcatttgaataaattaactgtggacaaattgaaattttgacatacagaattagaaggaaagtgcaatcaactgcataaaaaccctaacatacaaaaaaaaggggtgttttactccaggtccagggtatttgtatctgat

SEQ ID NO: 5563 - DNA, 2300 bp, Glycine max
  Soy_ogl_3161 Gm09:37770001..37772300 Cluster 25
taaacctaagataatgattttttatatagattataacatgcaaataagtttaggtatccgaatcttactctgagctaaataataaaacattttaattttatgaaaatgaaaaatatattacaaaaaatttacaggatttcaaacatcttcataaattaaaaaaaaaaaattttacaaaaaaaatgataccagattggctaaatcttattacctctcctttgatatggaggacaaaagccaacacaattgcaaaaggaaggtccacaagataataagatccaacattgacaaatgccccaagcttctgccaaccacatcctcttacaatacctttttcacaccccaaaggattagcagaggttaacttcacatcatatatatatatataataaacaaaaggtcaagcatgaccaatttttttgtactcatagagtatgtactcatctaatggttaatactctaaaattaacattcttttctaaatttaaattaaaaattactttaaattgacaaaaatagtcatacatgtcaaagtgtcacaaattagtagttgtgcctttactttttggctactgatgtagtgctttttatttataggcactaaagaagtggaatccattcattttcctaacacccttgcttcttgtaaaattttattaatatttaattttttacattgtacttaactatatattcttcatcatgatgcataaggttcttagaaggtatcatgaaaatataattttagtgtaactgttggtatcactttattcaatacctgataatgctgtttgaattgaatctacaaattaaacacagagcttgcaagaatcggtttcatggatgccacataacggattacttcaggtacattggtaaaaatatgcccccaaatgttccttgtgactatgaggagagtaaatcctaaagccccaaccatgaaggacattaacaatgtcatttttaacagctaaatatgcagcttttggacagccagcccctagttcatttgatatcattgtactgttgagaataaacatataaaatgcaattagacttggtaaaccagcaataatatataaaacatgatatggcaatatttatgttttggtggtaagagttagtcagttattacattttcttcttcatgaaccataaaaatacttttcttttttttagtaatagactataagtagaacatgagtgctgaagggtatgtttggtggtaagagtactaagggtatgtttggataaacttcttcggaaatttattcaatcagttcctaattatcaaatgagtagtaactttaggagtactagaattttctcatgaattgagtgtcaagttatccttctatagaagtcaattttggttcagtagcaaagatcataccgaaccatgagtgctgaagaaaaagcaagcctgagaaattgaggaatgttctgcaaggattcccaggagaaaccagtctaggtgcttttgcaggaagaggagaacttgatgtaaagtgctagtagcactgtgttaagccaatttgaaatgcaaaatgcaatggcagctcctttgatgccaagcccaaatcttagaaccaaaagccaacagataaggacatgtgctaaggtagtgaatccagaagctagcactataggaaggacagtgttatgggtttgtaggaatttagtaatgcaccgaagaagagcgttggctgaaaggcttggaatcaagtatctggcatatagttgagcttttgctgcaattgttttgtcttgatgcagaacaactagaacaggcctcaagtatgcccaaataaaagacattggtgcagtagcgagcatgatgaccactatgactctctgcgtgtgtatgccaaccatatgatactgctgtgctccatatgattgaccacaaaaagtgtccactgcacttgccatgcctatctaaataactaatcaacataagcaacaaatagtatttttttatatggaacaatgatacatataaactatacaaggcattcgaaatttgatatttcatctagagattgacattttttgttctgttcccactttccaaattcaacaaatttccttaacgttaattttactagagtaatgctaaattatgcagcagttgaacataattaacttctccttgtaagttagtgggggctaagaagcattttaggcttcaatccgtgctactgaaaacctctaaagaacttgcatgatgcactttgagcttcttcaattcaaacagctagagagggtttggtatattgtaccttggtatatgaaaaaga

SEQ ID NO: 5564 - DNA, 1700 bp, Glycine max
  Soy_ogl_5552 Gm17:6617501..6619200 Cluster 25
cgacaagtaggtaaatacttgcttaatggggatggattcaagagggattcagatttcatgcagttgaatatattaacgcacttacgcccttagctaatgatgactatttgataaaagatcgaacaaatcatattttaactcataagttaggcttaaaattaacagccaaaatatgaaacattccatctttatttatcagttcatgtttacgtgatcgcatgaatgaagcaaatccaattccttccaagagaggaaatttatccacaaaattcaatggagataaatgcccgtatatgaactatatattatccaaccgtttcatacatgaacatatataattaaaatctcttatacacacacacaccgtgtgtgtgattttgtatataaaaataaagtgtatatttttaaatatttattattcttatattttaaaataaaaaaattgtacaactattactaatatcagtaaaagttaatgtaattatctctagaatctagtatctagattttacattagaaatatttttctaagttagaagttaatctttgaagtgataggggtgaagaaattatagggatagtgaaaggtgtggtgagtacctattctatagcgagagaaaaaaaaagcatgcaaaggcatgctgcctgcaatatgtgaagttcaaagttgagatccacaaatatagtaataaataatagattatattttagttctaagttgaattttcttgaagattaaagaataaaaacacgacatgtaaaaggtattaattcacttgaaactgaggaattgtatatctcataatttatctgtgaatcggctcttcacttgtttaaaacatatctatagttgatcgactttcttagtctagagtttcttcatgcttttgcgtacttgaaactaaactacgagataatgtattcttgatccacattcgatagattattaatattcatgttattgtgcattcgatcaccgaacaacttttatatgactatcaagaaccatactactttaaaatattaatatttaagtcgagattgatatcaaatgaaggataagtgaaaggaaaaataagaataagtttttaccattttttaagatatgcatatggatttttttatataaaaaaaagcatcaccttcttattattattattataaaatttaattgacttttaactccttgcctattttgttgatccgtatatatgtcacggccaaatgttgaacattcgacgagtactagctggaatacatgcgttatataatgtgaagatatatgctatcattcaaaacttggaaatgtggaatcgtcttgcaaattgaaactaagatcgttctttgttccacctgttatttcaaggaaaggagcaggaaagaaggaccaccatatccaaacataagtggttacgtcgaagtgaaattaccctaacgagaactgattggacaaatcagtttgacatgaaagacaagcaccatcgagtacacataccctctagttgattaatagattcaaaaatgctagttctaattcttctcgtgttattattatgattatgtgattggcaatttggcatagtgtgccgggcgaatagtactagtagtaggggcaggcacagttaagtttaactgtttaattaaacacataggagatgagacacccccttaattattctattccaactaatttggttgga

SEQ ID NO: 5565 - DNA, 1517 bp, Glycine max
  Soy_ogl_2229 Gm07:6104684..6106200 Cluster 25
ctgtcatgactcatgagggaagctttatagcacagggtaatcctttttttgaggtaaatgctttggtcattttgttggcaattgcaaattgatcacacttttggcatgctttctttgtcacacattccctgctctgttaggtcaccaagacatgagtaacttgtatgatattattactcttacccggtacgatttcatgcattttaaggtgcttttgtgatctcattttggaccggtttttgggatagctttttcaaattcgattgtctttgctacaacattattctatgacatgaacttgtggcttcctggtcacacgacatcaactccaagaattgcatgaaggctctctttcaaaacatttacttcaaatgtctattcatattccacaaaattctcttagcatattagatataatgtgttttgtacaatatatcatattttcatccagaaattttaatcagttaggaaaacatagacatgcaaacctatagcattgaaaatataataaactactattaaaagtataaatatatatacaattattattttggagtttatatattttggaaacattgaacacttatttttattttattttcaatactataaatttgacaataatgaataagtaagtggaaactgataagtgttttctagaagaaaataagtaaacaggttcaagatctctcctagctttgaaattcagcatatatgacttgtaagtggaaactgataagtgttttctagaagaaaaaatattaaattttctgatttaaaaacgtaattgcaactagaagtgagatgatattaagattgtagattgagatcaatttcgtttatcaatgcttgtagaattaataataaggttgcacttggcacttgctatcatctagtttaaatcagaatgtgttaacgataatgacccctgtttcttgatataaattttgtatttcaagtgataaaaaacaaaagataaacaaaactaagtaagcttcaaataatgcaaactggtcatcgtttaggataatatcttagtttttgcttatatcttagttttaacaccctttatatgacaatatggcaaaaaatatattgtccatatcatgattaggctgctagctagccaaggaagccaagatacgatcatatttcaataagaaaaatactcaatgtacactaaatgttatttaacaaagatgagagacaattatattttagtgatatgatgtaattaaaaaaatagacattgatgaagtgtttaacatataaaagtacttatatattatcattcttttcataattctacccttcacttaaggtcaagtgtcacaatttgaacacactaggacaactatgtgtagatctattcacaaattcctctagtcaaattgcatcctttgttcaaactgtaattttttattttataatcatcataattagagtctttgatttttttttatggtatctcacaaactttaatcttttagataagttatgaaactaatatttcatta

SEQ ID NO: 5566 - DNA, 1160 bp, Glycine max
  Soy_ogl_5432 Gm17:567641..568800 Cluster 25
cttatgcaatatacgaattattacactagtttatcttaaaagttaaaaacacattaattattaagagcatctccagtaaaaatgcttaaatgagttgcttaaaattaaacaatgtaatttaataaaaatttctattagaactagtgacttgccaatgcgttatttaagtgattattaaaaaaagattttttttaatttaaaatttaatatggttcaagttaaatatttggtcaaacaaatttcattgaagtaattttttatattaagttcttaaatctatctgtcacactcacaaatttaaaataaataacttaagtaaataatcatgcatttttatatgctctaatatggaatttaaaaatatttaattattcatcagtattataaaatgatcattaaaaaaattgttaagaaaataaagaagtctcttttagtcggagttgttaaaaaacaatatgtatactcggcttaatgattgttacaagaaattattgctaaacttccatccacttacaagaaaaaataataaataaatgctaaatgtaaaaactggatatcagtcgaacgtcatcaaagaatcaccgatcctgtttccaacgaaggataagaaatggtgtgtgcattatattatgcatgatattaaaaaggtatatacaaatttattttcttgcttttaattaaagaaataaaaaattaatagaaaattatttttaaataattaaaaattttaacacgttctctcagtaactttcaaagactgatctagtgttttgcagcagaagaaatcgatggtgtaattaagaaatagatacaacgagctttttttgctgaatgagatagaacgagttgatcacgaatcatggtttctgagagattttttatgtcaatgtaattttttaaaaaaaaaaatccaacggcagcaacaatgatttccaatggcatcaatgttggagatttatttgtaaggattagaaaaaaaaatagtagctagagtcaaatatgagaaatcaaaataaatacatatctcacagtaatattattgcattcagagtttatattttttttatctgtacgtcattcaaagtttatatagctcaattactgtatcatttgatggaaaatgcaattacaattgtaacacactaacactttccactgtc

SEQ ID NO: 5567 - DNA, 1200 bp, Glycine max
  Soy_ogl_6351 Gm19:2661101..2662300 Cluster 25
ttgaccaagggaaacatatagatgatatgcaaatgatatatatcaaacatctcatacttgattaatatgctgacagctgtttggtctataagggacaacttggttggtttgtgaccaaagaaacaaagaagaagaaggaggatatagttcttgagtaatttgtattgttttaaactacgattggaaatatacctttgcatgatataattagaaaaaaaaaagtaagtgtgaatgatataattagaaaaaaaaaattgtaaaagtgtgaatgatataattagaaaaaaaaactccaaaaatgaaaaataaaataagtttagattaatcctaactagacgtctagtaacctatatttaaaatttggatttcttctgcctaatttaatttcaagttactcccacttagagcgcgatgtatgcatgagtatagtatgttcacgcatttatgtaatataattgagacaataaaccataaatgtactttgtccatcaaaagaagtcttttctaacaattaaatgaaaattaagaaagaatttaatgttgtcaaattttaaagaaaatgaattcatacatttttcttaatattcagaatcaaaaggactacatttgtttttttttttttttatacagaaatcataaggactactaccaactaacaagacaatttataagaacataactaaactttttttttattcataagaacatgactaaattatattcaattatacattgattttgcgttctccccattttagtcgaaaaaagagcttaaggttgtttttgacaaagtaaaaagttaaatccaaatcgccttcagccgtaagactgtagacgacttagtgtggttgagtttacaaagaagccaataagcaataccatacaatcgacacagagtggaaaacctctgtatcttagagatgagaaagggaatacatggagtgtattgtatgggaattagccaggtttggaatagaaacaggggataaatccactgttaaattcttacacctaaacttcttagaaaactcagcgccactcacatctgagactaaagacttatatacaaaggaatagtacaacaaaattacacttctgctctcacttggagtacacttctcctctcacttggttgactcacttggattacacttcttctctcacttggttgactcacacgtgttattttttattgttttt

SEQ ID NO: 5568 - DNA, 1600 bp, Glycine max
  Soy_ogl_1821 Gm06:7126501..7128100 Cluster 25
tgcatattgcaccagtcctttggaccgtggcctggcctgcatgaatttcacattaagatttaagataattaaaagttttttctagctaaccccagtcataatatgctttcttcttcattccatgagagagtgtggattgaggagttcctaatcaggtctcgtacgtcacttttacaaacatttaataattagttttcacattgtattaataaataagatagtatgataaaatgattaaatcttattatatgtctatgataaaatataggttaatgtctattagtaaataatacatcaaagaatatctaaattttgtgaaatttgatatacataatcataaatataatatcaaatgatttaatgttagattgattagtttcgtacaaagggaaaaggtttttcaactagtatcaagcttatatgtgtttgaactttgaagtaaatcttatatttggatttctaattaaggctttcacttttgtacgaaaacatgctggaaaaaaaaaaagctcaaaatttggtttaaaggtttgcggcccagcctcattttcagtagcgatgcctttcggccctttcctttaagatggagagaggttgggctaaatggcctatggattatttcatgcataattttttaaggaaaaaaagagagaaattatggtcattatttcctgcaatcggtaaattacttcctgcaccttcataattttgtgtatctccaaattgcccttccattgtcaatccttcatgtccatcaacaccagtagcgccccttcaaattgcaccttctttgttgttctctcgacgacccaaattcttcaaagttcgacttgccggtctaaactcaatggccattagagatccaactctatccatgacagcaatctaacttgggatcgagtccggaaccgttggaggtgtcaacgactctaatgcagagaataaggcacaaatggagttgggggcagtaatagaggtgtaaaagaagagctcggtggagtcatggctgccttggcgttatgtcttgccacgtgctgctttgggacttttaagcacaaacacgaccccattttggcattgcaccttcatttccagatacgtgaattcgcaagatacaattttttttataattccataaaaacaatttttagacttatgctaattgttgggataaatataagggaaaaattcataaactaaagtcttaatattttaggttaaaatttatttatgagattgctgatctattgatgtaaatctgtccgtgtttattcccttgattacacagtaatgtaatgtaatttatcacaaatttctccacaggtttcaaagcagagttaccaaagaacattatccattccgtaagacatccagtaacaaaacttgcagaggaaaataacaagactagaaatccaacactaatcaagccacaaattccttcccgacatcagaagccaattaaagtttgtagtaaagtgaccgcacccaacggaaccaatatcgacaccgcgcaccaaacactagccaacagaggaattaggtgacgaattgaatgccaagttaagctagcagaatcacggttacaaattaaagtgacact

SEQ ID NO: 5569 - DNA, 2000 bp, Glycine max
  Soy_ogl_1849 Gm06:8258101..8260100 Cluster 25
gcatttttgttcttcatgaatttcatctttcaattcattttcaaaaatttgatctcactattttttattgtttaattttgatttttttattaacttaatatttaactagaaaaaaataacatctaatgactgatatttaatggaaacactaatatgacactctatggcattatcatgttagcatttttattcaatatcgaatgttaagttaataaatgaatcaaatttttgcaattaaaacacataaaaagaattcaaaattaaaatagcaaagtgattaaattaaaaaaaagttataaaaatattaaaattaagaaagtaaaaagattaatgtacaatttttttgaggggataataaacaaaccaaatatgaacatctcaactctagttaggactggtccaacaacactgacagggacttgaaacaaatttgataaggaaaattttgacttatgctaaacacacctttcacttatacttttacaacccattccacttttattttccaagtatatcctttctttttctttttagggaaattactacacccccttctcctatgcaacagaagacaaaacctaaacccccatctctgatgtctaggatgacccaccctcacaaggtatatccgccgcgagccgccagaggtgatttccggtggggacgtttctccgacgtgctccctcaagaaagctggagtgttcgattaattaggattgttttcgagatgtatgagggagcatcatgggaattcctacactggagtaaaagaaaaaaaccaaacaacaccacgtctccatcttcatctgcttcatcctcacgacgtcgtcaacgtgtttgcgttcactctccttcaacatcgtgttgcttcatctctaattatggatctggtttcgttgtggtttgcggtgagtttcatggtggtttcgttgtggtccgcgtgtgttcgcggtgatgggtgcgtgctggtggcttgcgtttgtttggggtgggctcgtgggggtggacggtggtgggtttcgtggtggcttacgatggtgggttttgtggtggttctcaatggtggcttagttaaaatcaatccgcaaaatacaccaaagaaggaatagtaagctatgtgaagtggtggagttcgagatttcatggctcacccttggttttttttctccttccttcttctttatcaccaccgtgccgacaccggcaaccacagaaccaaactcaacactacgtggccacgatgtccgttcgacgagcgagcgcaggctttgccttgaacctcgacagaagcttcaacgggtccaggtctggagcttctttgattttgtccccattgccattaccgtcatttcttacggccctcgcttcggcgttatccgccaaaacaacgtcgtccaggctctaccgtgtctgggcagttttgactttgttgtcgttaccagttatgggttgaccgactgtagaacagtgggtgttcatcttttgatttttttaatttaatacacatatctcgagaacagtcctagtcgaatgctccagttttccttcacaatgggagatttggagagctcttccaccctagcctgtgtcgagagagtacaagggacatagaagggggtaccctaacttctggaaaaggacaaagaaaggatataattggaaaaataataagagacaagaggtgtacaagtaaagatggcgtctttagccaaagctaaaatttttactttaaaaagaaagaattatatgttggtttttttccaacatatatgatatttttgttaatatttatgattttttttactttataaatattttttattagtaggcctaacatattaactttagttgttttgctttgaattgaacgtctatcaagatctttttgggaaaaaaaaaaacttccaaagaattgttttatgggaaggaagatcgacactaagatcaagtaggttacttggtatcacgttttaaaatttgatagacaatgacttcctaca

SEQ ID NO: 5570 - DNA, 1200 bp, Glycine max
  Soy_ogl_3659 Gm11:208801..210000 Cluster 25
taagaaaaaagatgtggcttcctcattagcttccatgatatgaaaaaagaattagtaaatttaatttgttgtttcgtcagccgcaaccagcaaaacaaaattgttagttcaactcaaccaacaaaagagaaataataaatttgacttactggttcaacctcttttctttgtcctcgataaagtatcatgtcaataataaaaatagcaatatgtgattgttatttcatgtgcacatgaaatgcatgccactattaaaaaaataacaaaatatgaaacaacaattcatatttattgcttccaatttcttgtaagcagcgcaatttgaacaacggtgtggtataacattgttttgatttccacgtaattttgtattggtactcttattgtattactttattgacatagcatcaacaaatagtaatttaattaatggttggaatggaataatctgctaacacaagcattttttttagatttttcaaatttcatggaaaaaaagaatatatcatgttagctagaggaaaatacatttcaaatggaaaataaatttcatgcaagagttcccggtctcactgtatttaacgtgttcaatttttatttatttttaactatatgcaaccgtcaattttctatctgctggttcagtacaatacccaaaaaaaaaaacaatttctattgattggtttacgtaaaactcacaccctctttttccttcttttttttagcaaaaattatgtgacaatagaatagtaagttaagaagattgccgattcacctattcttttggtcaaaataggttcttgttagtaatatattgtaaaacagattcattttttaaaatatatataaaaaaagacacaaaaggatcaatcacccgtttatcaatttttttgaaaatgatggcacttgtcaattccctaatcatgaactgactctatttgatgtaattaacgcgaagtgtagagatggaaaaagagagacttggaggaatgagaaccatactcaaatcatgaattggtgaaaagaatttactttgggaatatatttatttgattagaaaaactaaaattaaaattaaccgaacccaatattaatgaattgacagaatggcagatgtgagatggatgacaggtccacagtccaatggaaagcacaccggggcctaaccaagttctccaaatccatgtcggcacccaaaca

SEQ ID NO: 5571 - DNA, 1736 bp, Glycine max
  Soy_ogl_1114 Gm03:46515965..46517700 Cluster 25
tgattatatgccttaaatctataccattacgtttaaatattttagtaaaaaaacatgtatacgttcaaatctttattaccggttcttcctaacaaagccttattccatgccacgccattagttattgcggctcatcaccaccaatcaattgaataatattaatgaagtcattgaaatacattcctttcgtagagcacaaagaaagtaatatccagtttctaatcaatttcccctccattggatttttattttttcgctgaatcaaagggggctttcgctcaattagattcaaggacttggaagggaacctctataaatgaggatagttaatgtatgtttttactctgaaacattcacaattaatttttataaaagaatttgttgtccatctttaatcaaatatagcatttgaaaaatattaaacttaattgaactcggaccaatataatattgctttagttttctaatattaaaataatttgaaggagcgaaatagtaaaaataaagaatttgttcttcttactattttcttggtaataagaaacagcaaacaataaaaataaagtaatattttttttaattagaagtgaaaaaaactcattttttatgttttaaatataattttttttcaggcttaaaaataaaacggaacctttttaagtatccatattcatttgcataaataatattttttttggtgggtcaaaagataatcagtgtcttttaatttattgatttagagattaatgtgatcggtgaagtaagtgagttattaaaaaaataaaaaataaagtgtaattgtttcgtttttaattaagataagattataaaatatgacattatttttacaaccaaatctggcgtgcgtcctctctctcttggagaggcacagtggaagttgagtattttgggaggggtggaacggtgcaaaagtatttaggaccgttagatttcttaaaattttagtcaatgactgatatttttttactttttccttcctaatttacccttcttcctttggtaccttcactatgcttttccctttctctttctacgatagcatccccacaaggaggaaccaccgcacccgcacgacatcaatgaaaagccacattgcgacgacaaccaccacaacccactcaaatctagaacaaaacgcaaccagctccgatgctgcaactccaaggagaaagatagagagcatgaagaaatggtggaggttggtgagtggtgtaagggaaatgtgatagagaagaggaagggtaaataaggaaagtgagaaagaaaaaagaaaaatgaaaaaatatatcagctatcagccatcgattaaaatttaaaaatatttaacagtctcaattactttggtaccgtgcaacaccttgtaaacatgcacacggtgtctctctctctgagaggacgcagctccatttattgttttataaaatttgtaaaacaagtaattaaatgactaaactcactaaattccctccctatcaaagattcccgaaaaccataaaattttggccctttgtgacaactgcaaggacaaggggcccgtattctaattttattctgactcttgccgaccattatttcaagagatacaaattaaagaatattcattaattacttaaataattttaatataataattagtttcttctcaatgaaaataatcactttcatttggttaattaattaactagtagtacgtactgtttagcctgttattatga

SEQ ID NO: 5572 - DNA, 2089 bp, Glycine max
  Soy_ogl_4887 Gm15:3064401..3066489 Cluster 25
tatgctcatagctcgtccttttagcatcctctccctcgaacagcttgtagttataaaactgctccgctgccatgggccaccccaaaattaggacccctaatccaacgattccagtaccgagtttcacccacagtcattgaaaaaatgcagacacctcaaaattcatttttataaagagagatctcacattaggggtgtgcaaaaattaattcactaaaaaaatcaaaataaaatagttttaaattgttttagtttgttcgaatttatattcaaataattaaaccgattgaaaactaattcaaaatcaacctaattttaaaaatttggttctaaattaaattaatttttaatcagtcttaaactgattttaagaattgaatcaattttaaactgattttcaaattttttttttcaaattaaaaaatatatatttaagtgaaaatcaatttaattaatcgaattgattttataaaataatataccttttttcttgaactagaaccagaaaaaatcaattcgatatagattcaattataattggattcaatccgaaaccattacccctacccgtcattgttgccattagtttctgctatgccagtgggtaaccgtaaatgaaacgggcttctgaaaaatccggtaagggaaaggggtcagagtcaacgtggcggtgggttaggttcgtccagaggccaagccgtagctgctgaagataacgtgaaaaacaccgagttccttggccacgctggctgtccatccgaagatgtcggctatgatgcaaagttgttgctgatggacgatggtgttttgtttggatgaggtgcttgaaggctggtctcatggtaggcgatgctatctgtggtcggaggaagtgaaagggatttcgaagaagacgacggaggagtctggtgggagagaggactttagcttttttatgtttagggaggtgctgactattgcgatggtgtacttttttctttgttctagctcaagggctaatgccacgaaaggagttatcagttatgtggccttgtgcatgaaagggaataaaattatcatttcttttctctctgccattcgcgatcgctccttcacttgagagaaagaatctcagccttctaaaaaacactactattagagaaagtttcatttttaaaacgagggtcactctcaaatattctcccaatatcgatcacaagtcataccaaatcccaacagtttagctatttatttgacgacaaacattcaaattaacaaaaacacatgagtcttattattgtttacaattcctttctctttttggtgttttgtctttacaactcatccgtagcatatcaacaacccatgcttcaatatgaattgctttgcatggctaccaaatctccttggagtatatataggtcacgcgcctcacttcttttttactgtttttttttgtcttcaaaacatcaaaacacaggccaaaagcacaccaaatctagcactcaatacatgtacgcccactctacttaaaaggaagctgctagcatactaataacaggaagcagaaaaacacacacacacagttggatgggctaggtcctgaacaaatgcactgggtatatagttgtggctcttggatatatgggatttgattaggctcttgttatttacactccttgtttttctaagtaccctagtaaccctcctttctgcctccgattacccattacttttttaataaagaagcacacccatttttgcttttcagaagtgtctttccaaaataccagaaatgttgcattttaaaactgctagtcatttattacgatccaaagcactacacaaactacaacttagtatatgcaacatcagatgaacttcagagacaacaatgtaacagactaacaggtgagacatgaaaccaaaaatacattaacagctttaaactatagcaagtcaacacccacacctttaaaccccattcgagagcaaacatgttacccaaattgtaccaaattgttttcagagcaaagcatcaaagagctacattatcattcgattaaacattttattaagaaacatcctcgcgtattattgtattacaaca

SEQ ID NO: 5573 - DNA, 1345 bp, Glycine max
  Soy_ogl_5201 Gm16:355540..356884 Cluster 25
tgcattcttataagcacctgtgttgctaacacttttgtcgctgggcatcatcatcctcacctgcttcagtcttagcttggtgcttagagcccaaatgatcgacacctaacatttgtgttacagcctagctactgaaacatatttgaactgttagataacaagttattttatgttttttctttcttatttttactcttcttgaaagtagtttagtcttattacttgtgtttgtattttccccttttactattgcatattcagattggcattattattgaaatagagctttagccctttcatctctcttcttcctcttccctttttctctatattcttacattgctaacatgaactagttatttagctatattgctattctaatttgaatagattctggtactacattgtggcgaattttgtgtttggcaaatcagacacagataccctgagtccctcatagagtcatagtaacagattggttatgtggtgaattgctcatatataataacaacttgtaattagttgctttctgcaactcaaaaaccacttcctgcacctttttaactttttggactctctaatccagaatgtaaaattacattccggattggttacacctttttacattacaaattggccaatctagaaggtaaatagacatttcatcttgttgcatgaagcaatcccgggggtgcaggaagtaactgtggaaccccaccttgtattatgccagcttggttgttctggtgtggggcaaaacttattgcactcccgctattatttcctgcacttgcattatgaaaagctcattccaaaatacaatatatattttagaatggacttcataatgcaatgagaaatacaagaaataatagtggaagtgcaagaagcaacaacctgtggtgtctgggactgaggtccttttgggtcatttcttgttggaagaaaatcctaagccctaaccgctacacctggaaaattttatcacggtaatctttattgtgtgtttggttttgtgtcatatatccaccattttaaaagaaatttaatcaaagaaagaaaaatgatgtaaaaatacaaattatatatataacttttgattgatatacgtctaatagcatataaaaccgacatgcacttaattaggtgaagtaggctatgtatcaaaatgacaaataaatcgtgtttatagacaaattagacgcatgactgtactcagcttcctaaataccatgcggatatatctaagtgaagctagctgttttaaattaaattaatatttatcaaccattattgttcattttgtaactatgcacaactgtagtaggctggcgaccaaaaagtt

SEQ ID NO: 5574 - DNA, 1689 bp, Glycine max
  Soy_ogl_6596 Gm19:45444801..45446489 Cluster 25
tcgttaatgcaaagaatgagagactaaaaattagtttttcaaaaatttaacgaactaataaaaatattttttttaagactaagaaaatacttactgaaatttaaaggaataaaataaattttggtggtggctcttaattttatttatttttgagctgtggtaaatcgctactaatcagtcactccacaaagtggtcatctgaagtctgaaactgcagattaagaatttaagataactaatatgagtttttattttttttggtccaaagacaactgatagcatgattttctttcataccattcactggtccacagacagtggcttccccagcacatatgacctttgtttgaaagtggagataaagggaggagaagattttcttatatgatttggttgaaggagaaaattttcttatttgattagtaaaggatgaaagggaaacataataataatatactgttatgcttttataagtattaataagaaaataataataataaaataaatcctaatctctcattttcttcctcccccctttctctcattttttaaattaaacaaaacagaattcgtaaaatttctcttctttcatggggagtatctttatctacttctctccaactaaacattgttagactttagtaagagatttcatgtgatgtaacaggtaaatatctggttcttgaatttggtgatgattaaattatgaaaaataaaattttatctttcaatttgtaaaatgtatgacaattgtccgtggcactgttggtcagatttaagaattcaaattttgttttgtgtatttcggaggacaaatttgttcggaaacatctcctccttcctctctttactcccgccgccacgcttcaaccaccaccgccatgctcttgttgccgctgaacttttgctccgacaagcgtgtacatatctcgttcatacgatgatcaccgcttctgtgacggcagtttctatggcatacccactccgattccgacgctggcaccaattaaaaacaagtggtgcaaccccaccgccgaggacatcatcttctgttatctctgccccgttcgcaagattggaagcatcatcaaccgccgtgggacatcatgaagcagcttcgcgctgacacgagagccaagagcgtggtttgattcgtgatgacgaggacgagaagaggaaccatgtgactgcaaagcttgctgtcttaccaaattttgaatcatcttggattgaaaatcaccttaggaaattgatggatgttatgttaagaattgcatgttttgaatctgcatcgatgaattcattggtaaattttgaatccgaatgaaagaattgctgattgtttattttgttataaataagaattcatgaagcaagaaagtgaagataactgaatggatctctagggcgacagagagtggcagctgctggtaaaatgccaaatttacaaattagtcgtttcaaattttttatgacaatttagtatatccaaattaacaagcacccctaataaaatgttatctatcaaatacgtccaccaatatatgtaagtttgacgtttcctttaatggtgaaaatgggtggtgtgacaaattcgttacacattttacaaattgagaagcataattttattcttttataatttagagatccaactgttattgtattacaaattcaaaaaataaattg

SEQ ID NO: 5575 - DNA, 1400 bp, Glycine max
  Soy_ogl_6597 Gm19:45490201..45491600 Cluster 25
ttgaaacaacaaggaacctataacaccaagttttttttttttaaatttaaccgaaaaaaaaactcttactattacaaactccaaatgtttaagaacccatgattaacattcactaaaaagcaagccagaaaaagcacccatcagaaatgtacatatgatctaatacatcaaaacggtatttaactactacattaattcacgtatcatatctaagttacttctatcacactaataaacaagcatgctccccgggatcctacacacagaggaaactatgcatcaaagcaccagttctgttttggggtgtaaaagttagccttcaagatatagtcactcatgaaatatatcattcttgaatctaataaaagcccaaatcgagcccatccgccagcccggtctgaatcaaagcctgtggccatgccattatccacaaacccgtcgaccgctgtgaattgaatttgaagcacgatcttggcatgcgttttttgcataaaaggtgttaggagagtgtgggtgagaactacatcctggccgtatattacgctggcggaaacgatgttgtaggtgatgtggagcatgcagttagggtttgtgacaacgagggtgaagttccccgtggcggtgaggaaggggtcaatagcgttgagtaatgtgagggagccttagtcgactcggatacaactgaggaagcgacaaaaggatcaatttcatataaaatgacggtaacgatggcggtgacatgtaaaagatggaataagcagtgggtggcggagggataagacgtgctgtcggtgggtggattctacggaagcgcgttgctcgtggttgtttcgtggtggtcgtggctaagcgttaccatgaagttaagtatattattgttgacttatgcgtagcacgaaaaatttatagcactgtgaatttgaatattattgttattatattcttaaatgaatttctacggatgaaaattttgacttttgaatattaacatactgttataattgtttttacttcttataatttagtgattttgatagatgggtttgatttgaataccataaaagaacaaaaagttatcaagaattgacagagaatatcttgtgaaataataataatattattactattattatttacacttaaatatcttgttaatcattataatatgttaattatttttttagttctcctaaaaaatttattaaacctttcatcctctaaatatttttctctcattttttttcttgcgatgagttgtccattaatcatccgtgtcaaatttgatatatccataacatggaaagtgaatttgaaaggggcaagggcaacatcgagacacacatttaaagcaagtgtataaaagtcaggatttatttggaatctgaatatccttcaagggt

SEQ ID NO: 5576 - DNA, 1552 bp, Glycine max
  Soy_ogl_3798 Gm11:8209249..8210800 Cluster 25
cttaaatacgatatgtgctttaaaataaacgaaagaagaagagcattaaagaaagtcgtttcctagtggtttgattttttggtgtttggtaagaattgaagacaaacggccaaaatctagtggaatctggaggctagaaggtaggtggacctttatctctgtgcacacataacctagtaatttggtacttgaatagtgtgctgttattattttagatacataagttcttgaataaaaaaaaataatacattatttcgtacctccgatcatcttctcttacccagtttgcttattttggtacgtgaaagttttaaaatatttttttaagaaaagtggtagaacatagacaccctactatccaagagtgtaaataataatattagtagaatctcagttatacgattattggacatatttaaattgtaaaatgattgttcagtcatagctatttataaatcagtatatactagcgttaggagattttttgaggatgattatcattaagtgaaattttaacttaaaatatatacaaaggagttacatttgtcttaccttaaaaagatgaatacataagttcgaatttgcaatttgtcccactgattttttttttttttttgcaatttgttaaatataatattttacattgcttcacttaactaattacttgaaggttaggataataactaaccatgtttgaattgtacaagcggaatcaagtcatatccagtggtttaaattaagataaatacaaatactttccaatctctttctctttttcatgtagttttccttttgccaggtgaagagttgagatgtgtaacgaaaaagtatgggagtatcattactttaattttttttattaattttctctgtcaaaacaaataaataacttcctgatgttgcgggtttataagaaattaatctgtcttatattttctatcctaacaatatatattttttgttatctatcctaagatttgataggttccaaaagaacgacataaaagaaaaagaaaccggtaagtatattgtcctttttgttataatcttctcatatcacccttaatttttgttggaatttcttcataattaatgaagtggcacatttaaggaattcttttaaggggactgtaccccaggtcccaagcagcttattaaaattaaaaacagttagcaggtagtatttggatacagttcagtgagtttaagacgtgtgtaagttcgatgctctatatttttgtgtcttttaactcttttatatatttgacgtgaaattaagataaatgcacgtaaaggatgcacacgcttaattatccttttaaaaagtgcaagtgttaaaagctctattcttgtcttgatatttaaaagagtttgaagtttaagtgcactaaacaagtctcttaaataagaaaaacaaaattgcaatcctccaaaggtagagatacactttgagcaataactatcatcttagagaagataaaagagagaaatatttcagaaaacatgtatcattttaaaaaattgtcttaatattttagaaaaaaatgtactt

SEQ ID NO: 5577 - DNA, 1010 bp, Glycine max
  Soy_ogl_4285 Gm13:26753523..26754532 Cluster 25
gtatactaacggtggatatgagtcaatttcgtccttttagtaaactttgtattatttactttttatttaaacgaattgaactggcgtgttacttaaatagactttatttttatttggtctatgtccagttcacttagcctttgggttaatggactggtccacaagttgaatatataacaaaaaaaaattgaaaatttctaaaaataatttaaaaaaaagacaattggaacacccagagaatttttataaaaatgataaaattgaaaatatctaacataatattaacaaaaaattataagaaaatacgcttgaattaatgaaatattaaaatgtaaaagaaaaattatttacattattcaaacatcaaataaaacataaaaaaactcagtatatttaacttttattttaaaaattatgaatattaaaatactaactaaaagatcgatatattctaatcaaacatcaagtaataattattcaaatacttatataatcaaataatatccttaatcactaatgttatattttaaaattttctccttattaatgtaagaagagtgtataattctgttttttcattaacaaaatgatattgatctaatagataaaaaaattgttacatttacaaatataatagttataagtaaatccccttctaaatttgcatgattaagcatgtcaaaaagatgttccctggagatagtgtttcttaagttggtaccctaaaaaagacattgcctattaggtactatattgcttgcctttaggctatgatggatttcataggttctgtgcatctgttgaacacaaagagtgtccaatttccatatcaaactagatgcccaataattactgacacattcaaaatcatgccaccgattcgccatatataagcatatactttggttcccaataggcctcgacctttcttgctatggtcgacacacgaatcttacacaattcccactgtcacatcaggacccatttgctattggaatgttacttccatc

SEQ ID NO: 5578 - DNA, 1331 bp, Glycine max
  Soy_ogl_4456 Gm13:35253670..35255000 Cluster 25
acaagcaagagaaaataaacaaccagttgtgcctacaaaaagcctcaccaataacatcttcggataagtcttcgaccatatcatagctaaaaacttaagtcttcgaccatatcatagctaaaaactccattttttgttaaaacaaaagagaaaggatcaataagtccaagtaaaattgagtccgatctctttttataataaaatttcaaataaaagattctatttaaagttgtcaattaaattctttaacaaaatttaataattattaaagttaataaatacttcttatcaatattaagataattcaaaaacagagaaaaaaaaaagcatataatatatggacatgtgcgtgaacagaaggttgggtagggaaacacggaagcaggaaggaaaaagggggtgttgggtgagagatgcaagtggggccattcattctcaaaaccactggctcctctaatctcttactctcttctcatataaatataaatatattaaaaaattcagttaataatatttaatttaaaaaaatttcttaaaatactctttgaaggtagtagttataaaataaaaataaatgctttaagaaaaataaaattttgttaaataaaaatttatttatggattaataacataaaccttatatatgatttttgaagtagagggttaagtgtaacataaattcattatccatttgttacaaaattgtgcatttttttattcttaaggctgtatccttctattattaacgttggaacatgtttttacttttgttcttttcagccgttttcaaatccttgctatacgaagcttgtggtcggatggtgaacccggttttcggctcgactaggttgctctcgaccgggaattggcatttatgtgaagccgcggtcaaagccgttctaaatggcacgccgtttcagcaggctcctttgggcggcgccgcaagcctgcagctcgaggcttgtgatattcgccacgtggcaaagagtgataaatcgtgcgactctaatacgcttcacaaggtgaagtctcgcaccaccaagttcaagcgccaagccgtgaagtccagagtagagtcagttgtggctgagttggctgaaagcgagttaggtggtcatggttcagtgagttgtgacacgggatctggggtgactcggatgagtgagaacaaattcgttgaaggggaagccgataacggctccgtgcagagtgtggagccggctctagacaatggtggagaaatagagcttcaattgacattggggtggggtccagtgaagagacaaacggctttgatgacgccacgtgtagggcttgatctctctggctag

SEQ ID NO: 5579 - DNA, 1000 bp, Glycine max
  Soy_ogl_5599 Gm17:9075101..9076100 Cluster 25
aacaattcgatacatccaaaagttgatagtgatacttataaactgaaatctctcttccaattttttttcatcccagtcaattgtggtaaatttagtaagtagccttggtgccaatttttaggcttaaactaaaagaattaaaatgaagactaaggcagaactcaggcgcgtgatggatgaaaatttctctcaggagccaggaggttaggcatcaaaatagatgatccactcgttgtctcatgcaaattgcaattgaatggcccaactaaagtcctaatatttttgggctttctaaaagattaatttcgaataacatttctaagatcaaaccagtataatatttaattcatgaattcctggcccgggttgatgttattttaaggtaaattattaaattattatttaaataagaaataaattctatcatttcgaaataacacagaaaagaagtaacacatacaactttaaaacgttgaactattttaattatagttatctctttattattttgattccttttttctataccaatactgatgtgtttttaatcataaaaaagggataaactatggattaatttttgtctactaattagcgtaaaaagttttaaaagtatcactcaccatgttctttttttagaggaatttctcacagtaatatttttatcatttgtcaaaagataatggaataatattgtaaataatttaaattaatcgtgaaccaaggctaaaatttacaattttttatgctcataattgaattttttgaaaaaaattaaataatttttaataaaataattaatagtaacaaattttaatgataaattttaaaaattaatgtaccattttttttatgagggattggacacaaaatgcatcaggagtcgtcgaggcctaagtattttatttttggtccgtccattggacctaaataaatggccgagttaaatgccgtagcccgtaagaggcttcactggcttggagcccataaaatctacagg

SEQ ID NO: 5580 - DNA, 1323 bp, Glycine max
  Soy_ogl_1875 Gm06:8945619..8946941 Cluster 25
tgtcataaatatcctttataccaaaatcagatcccataattcagcacaaaattccatagcgactagcgagcgctgtagaagtggaggggagcggaggagacgaatagattcttcttcaattgattttggaccttgaaacccaaacccaatttcagatttgttgaagcggctgatccataatgagaacaaatcaaaggaggagaatcaataattgtggaacaaataaacaagtggctgctccataacgagaacaaatcgaaatgattcacaactttgaatcctcatctcattagatgaaaaattgaaaagatttccagaggggaattaggagttgcccacaatcaactatttcgcaacaagcattgttgtctacccgtccgtttcaaatccactaaacaattaacatagtctatggcctcgtttattcatttttttaattaactttaaggatctataaaatttcaatttctagtcaattgaataattgtattttgggtctaagtgtctaacgaagattggcatctcctgaagcaatttctggcggcttaagcagtcagaaaatggtttactacatgttaaagctttagccaagtatataattaagcttttgtattgaaagcagagatgcctgggtaattaaaaagtatcccacagttatattatatgaagagtctgattagctgttttataattacaagtagcaagcatgagtaatgtgaaaaacgtatggttgccatttgatttctaaggttgttgtcggtgaatatttatttaatacaaaatttaaatgtaaaattaatttaatatatattgtacggaacatttccgagaatctcccaggcaggatgacacgccgatgaaggggacgtgccaccactgaaactctcaccgcctgctattattttattcacactattatactatgtcactgcctcacaaccaacaaaaaaaaatgacaagttaacgtttagttcaaaaaatataaatgagataattaattttataaggtgtttgataaaaaaatacaaaaaatgttaattgtatatataataacatacatatctttaaaatatatactaaaataatttattttgttcattttatataaaaaagactatacttctctctccttttcttttggaaaggaaaacaaaacatctgaattccacttatttttgcctctttttctttctttctatccattaagtaaacaaacaaaacaaaatattttattttttaatttatttttccttcctttctcatttcttctttcaattttccttcggtatatatcaaacagcataaaagagactcagcctctgg

SEQ ID NO: 5581 - DNA, 1200 bp, Glycine max
  Soy_ogl_3672 Gm11:1272101..1273300 Cluster 25
agatgatgtgacaaacatgaattatgtcaggaaatttagctattgacaaacatgaattattattatcattattatcatcatccaaaaaattcaacaataatacagtgtaaatacatctcaaaaagcattttcagttatttattctaatatctatagtttctatctcttgtatctctgtctctttacgaacatgtatacctattgagatgtgaacggaacattttccaaaagcaaatgacaaactacttgataccaataaactgtcttaggccttcgcatgaaggggtaacgattgagataaactaaggcatacgaataacttgacatgatgaatggaaacaattttttttctctccagttgaataaacttcatttgacaacaatacagatggagtcttaattatagtgtttgatttcatattagattattaagaaccacgttgaaatatcaattaaggttatttttgcatatttagttttacattcatgagaaattaattttgggtcaacaattcatttcgagattaaataattttaggaagcttttgtgtcaaataaattttttttatactaattttataataaaatatttacatataaatcacatctctttataattaattttaatcaaaagtaatttcatttaaaattgattttgtgaaggtttatccaaatacacattacatttaccgcaaacgtaattggatctggaaagaatattaagaccaccacttgaattcgtagttcccatcgggtgctgacgttggcgcgatgggttggtttaaaaatcaaatagagctgaataaaagtataatgaaaaaagataataaataatataacttaattgaaaaggaaaaatgaataaaaacaaaataatcctagaaagaaaatactttcattattcttctagaaatgaaataatagtatttttagtatattttagaaattctcttacgcctcaagtatacagcaaaaggatgtgaaatgatcccttttgtttttcatttgcggtttttctgttctagtagacgatacaaagagagaaagcgcaatgattaatgggggattcaaaattctctggtctgtgctctgaccttcaaatatcaatatcccaggtgagaatgatccctttcccaaactccaaacacaactgaatcaaattattttctgtctccacttgagaatgaatttcatactatg

SEQ ID NO: 5582 - DNA, 2300 bp, Glycine max
  Soy_ogl_175 Gm01:46802301..46804600 Cluster 25
cagactaatttcttctataattaataattggatttggcctttatggtttaatataattaaaatataacatatttgtattcataatctagcatattaataaaataaaaatattaatattaaataagtttatatatgttaattgaaaataatgcgaaactctaacttatatttttaaaatatataatagacaacgattaatagatcacttaatcgcaacactacaaaaacatgtcaaattaaatacttaattcagttgcatttaatttgtagagaaacatagaaaatacaaatttagtatttttcagtcctcacagaatttaagccagatatataactgtgctattatgcttttgtattgttggattttattttgcagttttatactttatcatggatattgaggtggaaacaactcattttggatctggttttatggataattaattgcattagattttaggattgattgatacttaatatttcttgtgtcactaattttaagatctttttttaaaaataatttctccttttttataagattaatatcttatttaattattcacttttcaatcgtattgattaatatgtaattggaatttatttattatttaatttaatgtccagttctttgtttcttgagtgctaattagcgtccacctatattgaactggattgggaatttggggaggactcaaaaaaaaaaggggggagaattttaacaagtattgtgatagaaaagaaagagagaaatggaaagataatgaaggtagaagtgagtagataattataattttttcttctttcttttatgttgagtgcagctatgaacttagagagtgataaacttacatctatggaaatgaagggagtgagggaaaataataaataatgtgacgaaaaagaaattaaaaaggaaatatattgaatagtttatgtttgcgtttaaattggtagtgagatccaaaaaaatcatcatgtcctatcataatttttcatcatactaaaaatagctttaaaactaccataattttatcttggtttactgcgtttccaaacaagcacactatatgacccaacaaaaacaaaaaaacaaacactatatgaacttaatgacccttgacatttcttttgattctgtgtagtaaattgttttggtgatccattgatctctcgagtactcaggtcagtgctaagtaaccaaaattccaagaagggttcattaattcatggccttagagcacactacctttcgcaagaatggaaaaccagccacatgacagtgacagaaaaccttgatgggcgttttgattgcaacatctgcttagattttgcatatgaaccagtggtcaccctttgtggccacctatactgctggccctgcatctacaagtgattccatgtccaaagtgcttctcttgcaccagtgagcacccccagtgccctgtttgcaaggatgacatatgccacaccactatggttcctctatggccctggcaagggcatagctcatagtgaccgtgatggaaaggcatcatcatcctatagaggcatcatcatcaacttattgaatttcaatttctcttattaaatttatagctaactttcctgtaaattgattattggtctagtcacaaagcaccccgattcttaagagttgaaaaattaaagcactctgaaaagacaaagatttagacaacacaaaacattcaggtggctgcagaggccaataaactgctgaagtataatcctaccattggtgtagaagttgtgattggagggacaagacttgctttagaacagaaacggatgcagccaaacccttgccaggtaaattattttctcattgtcaccaaactcttattttatgtattaatatggtttgtatatgaaatttaaataataatacttgctttgttagttgtggcaaatctatagtatacatatcttttacaaaaatagtaatgtagagctctttaaaaaaaagtaatatacagttgtgagaatttaatttccatggcaattaaacatggacagtgtgcgttaaaatctctggcctttgagtccagttcctgcaaataaattagacataacacgagcaacccatttaagctagacaacccatttaattgctggaaacttcatatgtctgtccactttttagtgcttaatagtagaaattttttgttatgcagctgagggcttcaaatcatggttgttggacacatggagtgcttgcactcacaagaagaaagtgatggcatcaacactcatggctttctggaatctatcttctaaaatag

SEQ ID NO: 5583 - DNA, 1600 bp, Glycine max
  Soy_ogl_2712 Gm08:15801101..15802700 Cluster 25
tcaattaacttcatgtttttttttgtaaaaatcaaaagatagatttaaccaatgaattatacttgcttaataattcatcaattaattaattttataaaagataattcaaaaatataaattcaaattattcaaatcttgtaatgccttatggagaatcatcgatttctttagtagaaaaccaatttcttcagcagagaatcaatttttctatatggtaattaattttatttttttttgtaaataaagggagacggagacaccaaagaacactaaaactttcctggaaacacaatagaacttacataaactatcacaacacatgaaataaaattaagaacaatataaaaaaaatagatttgtctatttaaagacaatccataatttgtaagagcatttgccacttggtttccttctctcaacacataaaaccattgcatgaatcctccatccaaaataaattgattaatactctaaaaaaggctaaaacacgaatgataagtataacaaccatgactgagaaggttaatagcaatctgtgaatccgattcaaccacaaactgtctaaaaccacgagctcaagttgtctgaatgctaagtaaaatagcccacaactcagcacaaataactgggcagaagctaatattcatttctatacaaggcaaaacttgattctcatatgggggagttgattctttcccgatgaaatttattgcattttgggagaattgattcctttctccatattcaatttttacgatatttgtattttagaaaaaatgtttttaattttcaaaacaacttttaattattaagttttgcttttagaaactataattttatatttatcactcaattaaaacccttgaagtagactcattgtaaagtcttacacaaaattcttctctttggctcttgtcttcatcaaggtcttcctatcttttaattttgtcttcatcaagactcatacttcaacaacaagagatcatgtttaacgataaacacatacaaaggccatggtttgttgatagtgacttttatttgcaacaggggagggtatatgtaacaaagaggttataagatattttacttggggatagtaaaatattttatagcctttaatagatggtgtagaacttataagttcatgtatatgagtttttggtaccctgttacctttttaatatattcgtcttttgtcgaataaaaaaaacatacaaagatcatgcgagagtttttcttggactagcgattaaaagaagaatatcaacatattttctaatacattcttttgattaaacacacatactttctattattaattaaaattaattaacaatcacaaatttttgtaagtcttatctcttatttaacaaatctctcataaattgttgttatttttaatgaatttttactaataataaaaattacactaaaaatatattgtaatcctttcttttaatgaatacatagtattgaatgcaatgaactaaaaggattacgacttcacgcggaaacatgtgcctaatcagatcagatcgacatatgtaatcttaattcatgcccaaaatactcattggatttgagtaagactcaagagacg

SEQ ID NO: 5584 - DNA, 2118 bp, Glycine max
  Soy_ogl_180 Gm01:47020683..47022800 Cluster 25
attttaaaaaatcttcaaaatgatttctacaattaatgagaaataaaccctttcttttataaatagtattatgattagtattaagtttactagtatttggttccatttgaaaaatgttcccctgcaccctgtaagcccatttacccattacccttctttggacggtaaaactgggcctgtgtcccagtagtcttatagaagttacttaatgtatccaattttttgcatgacgtacccctaaatttgtaaagtcttcatcatatcttttcatttaactcactctcttgttctctccatcttgctcttcaccgcaggcaacacttgtgtggatcctctcaattgggaaagtggtgccgacgatgtagatggtgccataaggatcaccgatgacgactttctaatggctatggcactgctgatgcacatggtggtggtggatggttaggtggcaacatggtggtgagtttgatgtggtgtgatgcagtggtagagaaagtttagggagaggtggtcaaagaggtttgcttgggataggaaggaggggaaagctaagaagggaattgtaggaaatttggaggtacaccaaacaaaaatggaatgctttaaataattgcaaaatactgtatacaatgtacatagtccaagcccgtttctctttctaattcttttgcaagcaattctacttgtatccccttttaaatactaattttctacaacatatttttaaaataggaaaatattctgcaaattgatagatgtatgttccaaaacttagtttctaaaatgtatttatacagtccataaactaattttttaaaatcaaaagcctagttttgcatgttgttgtccacctaaaaaaaaaacactccgccaccttgctttccccctcccaacctgaccattaaagttcgtcatttatcatggatttaattatataattagtttattaattataattaaattaaaagtataattgagttcttcagttattaaaaaagtttaatcaaatattttaattttttaaaacattacaattatgtcattttcgttggcttcattactttgattaacgaaagtaagttttgtaaataaacatatttatatcaattgtattgataatcaatgtaaaaatatttatttacatcggtcataaatttcaataaaaatgttatctttacatcggttaaattgattaatgatgtaaaaatgtctatttgtgttctcaaactaacaaagttgatagaaagaatacaattgtaaatttttttaataattaaagaatttgatttaattttttaattattattaaaaaaatcaattgtatgattaagtctttatcacatgttaataacaaggaccatcatgataatgtatattgtctacacataatttaataaattttcacccataggaagttagtaactaaattgatttacattataactgacctaaagttatttcaatttaattaaagatattagatttaagtttttagtatgttaaatatttagagggaaagttttctaaactctactaggatcgagttttgcctcgagccttggttttgaacttgattcggaaccgcgatgaccatgaagagctacactaataaggtcttgctgagacatctcgcttgccggttttttcgcacccttccgcccaatgtcaacaacaacaggccaattctcttctgcttttttgttttaattaaataaataatcctttgtttatttaatcatctcttcttttaatggttcatgtcaatatactaattaatattgactgtgatggttgctacttgctagtaaggttgattattatttgtaggattttaataaaactaactgcttggtgaatttgttcatcgaactctattcaaattttaaagctccattttgttttttgttagaccagtgaatggtgctaactgcgcagtagaaggataccaaattttggttagaacaaatcatgctcattgcacatacagtcgctgttttggaatgaatgctgcaatgcatataaacccttactatggcaaaacctccttggatggtctggttgctcactacaacactgtgcttttcattagggctgtgcaaaaatttcaaatatataaaa

SEQ ID NO: 5585 - DNA, 1716 bp, Glycine max
  Soy_ogl_3009 Gm09:5257815..5259530 Cluster 25
tgaggaaacaaaccatagttaccaggtatatcatagaggtatgagcatgcaattcgtcattttttacatgcgtattacaagattttctttagagcaaattacactcattcctcctaaaattagtatttattacatttacacttcctctctaaaatcacatttttttttgtctcccctgaattgtcaccgttacaaatgtgtctcaactactgatctggaaaacgcttatgaagaataatataagagaaaaattgtgaatatcacatgcatttgatttcttgtgagaattgcaacatcaaatgggaaatgcaatttagaggatccaagagaagagagattaaatactgcatttgacaacttaacctagatttaaatggacaacgaatgggtgatttatagatcttttagtagaagagagatacaatagaagatataattcctcatacattgacacataaacaaataaactgatggtagcatatgactttgtagctcaggatttatatattataaatagatagaaaaaaaacctgaaaaggaagaagaatatgtattgttttcgttgacatatggttagtaatcttctaatatttttgagttcaaatgtaggcctgatagagtttgccaattttggatttatccaacattaagccttgttaaaggaaacatcttaagtatggaggactagtctcggacccttaaaactgtgaaaaaacccagtatatggaaaaattgtgggtaaattatttcttaaaatggaatgatacaattcttttttttgattttgaaatgatgtgattctttttagatgtttttattataaaaacatgttaggaatctaacttagtaaattatggtacaccctcaacaccacattccttctccttccttcctagatctaaacaacctctagccaccccttgttgttgatcaccgtgcaccgttatcagagacgatttttgaagaccatgtttcattttcttttacttctctctctttttttcccttattcttctcgggcatctcacaccccatgtgtgagcaacatttagtgtcgtttgatcccttcactattgttgtgctggtgtagcagagatcaaggagggaagatcaaaggaagagagattatgagtttggtttgagggtcgataagaaggaggaggagatgagcctctacataacataaaacaaaaacaaaataacagtgttgttgattaaatcaaatacgtcatgctgaacttgttagtacaaaaatttgttcgataaaatgttatcgcaccatcaaaacggcgtagagcacaataaggatgttctcttccatatatgtgttggttcatggggtagagagaaggggagacacaacagctgtttcattaggcctagtggttaagaaaaaaacatgttaggaatctaaactcatatcccatcatttaagctattgagtttaagttaaactcacatcccattattgttatccactcatcaagcaattcaatcgatttgaatccaatttgatgaggaaaaaaatggcaaaattaaacttaacgcaatcaaataattttgattgatttgttttctgttttttttatttaaaaaaaaaaaacaaaatcgatctgttataacacatgtatttatggggagatttgtcatgtactcaaagaaaacgtaaaaacacttgtgaaagataatgaaaaacaattggttttcatactttaa

SEQ ID NO: 5586 - DNA, 1209 bp, Glycine max
  Soy_ogl_5368 Gm16:29532489..29533697 Cluster 25
gaaggataagttatgtaacttagtgaagttaagaataattttttaaaaatctcccatttaataataaaaacttaaatttataatataaaaaaataacttttaaaattttccattacttacttttttatcataagcatcaaattcagttagcaagagtttattttaggtttgagaataatgtgttctcattgatatttttttttcaaaattaatatctctttcctaaaaaaagtgttagggataacgtgactgacatataagaaattgatggaggtcatatgtagttcaactattttgtgattattaaagtttaaaataacagtttttcttagaactttttcttcaaatatataacttctcttgtttagggcaaatataacttctccttggggtttggtgaacaacaaaaaaaaaacttctcctggccgtttctcctttgttgcaatatttttctttaatttacctccaaagtcagattcctttaaaatgagtgaactctctttctgaaattataagttggtattttttcctttgaaaatttatatttttctttgttttgggatattggcttattatgtggccatcgttgtcatcaaaatacgtttgaactcgatcgaatgtaacaagaaaagaatatgcgtgatagcttatgttcatgaatgaggactatagtggatgatgggtggagggtggaaagcgatgacacgagctaaaagcaaaaggcataaaatatatattgccactaggtgaggctccaaacaaaaataataagatattataatttttttcttaaataaaagaccaatatagtattaatcattattcaagtttaatcggtaataaggagtttgaattttagatatataatttcatcaaataaaaaaatagtgtgaggaggctatcataaattcttaaataattcttatttatttatgatagtcctaagtttgaataaaattatgtatgttcacgtgacaaataaagtgtttaagtatttctaaaattttatttcttaagtttaactacacgtttcttgtagtgtatattaatgtgaggagactttttgttgagtttttattttttttgatagatgaagagatcattcatagaaaaagtccatcaacacttacaaagcatataaaagctaaacagagtgttataacagtgtacattattaacgctgacagattagaaacttacgaagtaagg

SEQ ID NO: 5587 - DNA, 1700 bp, Glycine max
  Soy_ogl_6496 Gm19:41797001..41798700 Cluster 25
gcttaggtccccttctggaactcagcttttgtgtgtgctgcaatagcatttgtttgcacttcctaacatgtcggccttggacgtagccaacacctataacaagaaggaacaccatcactactcacctcattccacaaagcctatacactctgacatttttccagttgtgtaatttcagagccgcagcatctacattctacaccaatggtcctaaataggggattacatatatgggggaacaacattaacttaattaacattgtttttggccaaggactgaactactatatactatggtgcaagactaattatgattaaaccaagctaagagtgtgttcggatacacgttctatccatgttcaataggaaaacattccaatgcacaaacagaaaagctaccagcgatgtattgagtttaatgagtttagttggatgcatctgtaatcaaaacacaccctaagtgtaatattcttctacttggttcctgcatccaaaaactgacatttaaccgtaattttcttacaattaatatctaatgaactttagttgaacacacataattctacttaacactcacaactgcaggagattgccatcaacatttgaaattgtatgaaagttaacacttagtagctagctatccgcttcttttggatttgaaccaataattagattctttacaagtttcaaagcgttgtcaatgagttgatttgttatataacggcctcggtctgtcgaacattctccgaggaaacatcattttacatccttgtaaattctttcaagtgtcctatcatttctagctagtaagctttaaaggaaaatcagtaacatctgccccactttggatgcataaggttgatgaaagacaaaaaagaaagagaactcattaaaaataacagaatgctacaaaatgtgatttatgcttgcttcgttcacttctgatattctctacaagtctttatctaagcttcagcgaagatatgtctcttgtgttgtgagagtgagtccttcaaattctcccattctaaagtcttcatttaatacacgaagaacataatacgttattgttttttatgtgtctacttttacgtaggagagagaaaagacatgtaccctttctttttcaaaaaggttctaacactctttgaaacatgttagccttcttttgtcattcctacttcattcttcatgtctcggaccttgatatgagacttgcttttgattaaaagatgtatttatatactaagaaaatcttactttatattaaatacttgaaagagaaatgctacctacatattttttaacatggtgttttgaatatactcttgattaaaatttattaaaaatcataaatatgtgtgaactttatcttcaatttaatgactatttcttaattttataattttgaataagtttcaatatgagagtgtgtattaggaggaacgtattattaacacttctcatactttaaatttaaacgttagtgcatattcgaaaaataaaaaagaatgaaaagtgtaatgttatataggaaagaatataagatcaataaaccttagcatttgaactttataggataaagcttaggcacatgtacatttatgagttgagaaaacttagttagacataaaagataaatgtaagttttctttaataaacgttggacgaaaacaatgcattggacgctggcttttcaa

SEQ ID NO: 5588 - DNA, 1325 bp, Glycine max
  Soy_ogl_2852 Gm08:41530001..41531325 Cluster 25
ttttatgttaaaattacatgtctttaatgaaatcggattttgtattgtaaaaaagaaatcaaagaaaaaataaggataacatatatggtgtgttttgaatctcttggacccaattcctactagtaaaatgcatcccaacaacaataactagtgaatcaacggatgacgggtattcacatatacaaatattatcatactcgtattatatcccttaatgagcatgccaaaaaaaccaatacccacaacttgcgggaaactattcatcttctatccataacaaatcttatccaacaatattcacatacataattttttttgtcatcccttaacccaacctatattagccgaatcttatgagttacaactatgacttgaattgaattatacatgcctcccacagaatacacctgtgaaaattttacaaacttgtaataactgaattttatcaaattataagcatacaatttaaaattaaaagtattgaaacaataataaacaaataattagttctgatatgctgtcaatgaaaaatttaaatcagaaacaattacgtctaatgtattgatatttatatcaataaaaatttattaaaagtttacaaatatataaatcttataaatataaaactaaacaactaatataaactaggatattcttgaaatacattaatcaaaatgttatacatatttctttgactgtgaaaaaaaaacacgagtagaaaattaaatatacacagtccaaaactaagggtgggtatgccctttaaagttgtatcacatgccttaagagaaacagcacactcgcgcagcaggctccagctgtccagcataattatgagaaacagcacaccgcacaggcaatagtggtctgaataatgttgtctttaattgatgtaaagtaattgatgatcgtccggtcgtcctgttgggattttacagctatctggtgttaattaaataagggttgttttgaaatattttaccaaaatggagcactcaactttttattttaaaagaaaataaattgatttattaatgtctcatattgatccctttgatgagaaggaaggaaaataaaagaggaaaaaaaggaaactgggtgagtgctttgtattgtctttctaaatttttaagctctacatgtcttgtattatcagggtgtgaagtgtcttgtaatatatttcaatcatctatataatcaagatgaatctaatttttttaatttataacttaaaaactttacaattaaatatatttgattttaaataattataagatgagtgatattttaagaaattttttaaaagacatgaatgaaaataaaat

SEQ ID NO: 5589 - DNA, 1209 bp, Glycine max
  Soy_ogl_4716 Gm14:6434001..6435209 Cluster 25
agtcaaaacacacttccactctgttttttttttaaaaaaaaaaattatccttttgcaattgcatctttcactatcttttttttaatcttcatgtaaaaaccaaaaacaatcaacaatacctcattctttcctccttttgaggttctgacttggaggatctatagctttgtcagctttggtttctgcacgttcccaacttcttcttttcccttttttatcataatttctttgcttaatcgttttgggttgattgtgaatggcctgaatttgcgaaccccatttcatcacttgtagaaagttgcaattttgttttaacaaccaaggtgtagttcaacatctcccccccccccccccctctttgtgttgtttttttttagattctcatgatattgagcttttgtccattttttctttttatcatcgtacatgacatatgcagccttatcgatttaagttaaatcacgttgacttaccggttaacatgattttatatggatatttaatgtgcgttaagatgaacatgagtaaaattgattttgtaaaattaatttaaaagtaatgtgatttttgtttggatatttttattataaaattaaattaaaagtaaaacttaacataaattttttaatccaatgtaaaaattactcaaagttacttaagtaaaaaaatcttaaataacgtgaaactaaacatgtaaacatagatctaaaatcaattctagatcaattttttaatgtcaaactaaacacatacttacatgtttgtttttacattgaaaaattgattttgggtctgaaattgatttgatttgactttgacgaattgattatgagtccaaaattgattttgaatacattttcacatgtttggcttcacgttggaaagaatttaaaattaattatgggttgaagtaactttgaatagcttttgtgttggatccaaaattttgtattgaattttacttttaacttgattttataataaaatatccaaacataaatcacatcacttcaaaatcaattttaactaaaatcaattttacgaaatcaattccattcaaaattaattttaccaatgctcattcaaacatacactaagttgaagcaattttaagtgatttctacattgaataaaaaaaattatgctaaattttacaaactagtcaaaacattcgaacataaattacttcatctgccaagacccagtcac

SEQ ID NO: 5590 - DNA, 1457 bp, Glycine max
  Soy_ogl_513 Gm02:12153944..12155400 Cluster 25
atatatggagtcctatttcttttcttaaaaatgtaataaattataaacacgtgtagaacaatttaatcatctttgtaatctgtcgttggatagtgtaatcttagtactaagaacattctcaataatgacggaaacagtgaaggatacaagcgggattggagatgaattaattcctgtttcatttacatgcataaggattggtttcccacggtggaagatataccaaggtcttccatcctaatcagatccttgtttcatttacatgtagagcattctggttcttatacttataacacattcttaatttgattcttattgtagagatcagtctaaaaattaataatgtttttttttacaggcaaacaattttgtattatatattaaaggtaccagtagtaccattagcttacatgtaacaaaaaatgatgctcaaggttaatgaatatttatcacacaacaaaaataataaatatcaagtaaccagaatcacttcccctcataacctgcagttgtaaagaagttacagcatactgagcatagttcccaaaagaaaaaaaaatatttatctaattctaacttttcatttcaataaaaaaaaaaaccaccgaaccaccacctttataggaactcttcccatcactttgttacccctccatttatattacttgcccacacctcatttagatatgtaaaatttttaattagtatccatagcatattgattaaagaattaaaaaaattacgatgatcactgcctcccacgtacaacaccatatcggcacctccctatcgagtttcccagagcatgacctctttgctgcataactatgacaaaattaagaatgtgtaattgggttaactatggcaaggatcaaatcggtaatatttacacatgtaaattaaaggattggtttaataaatctttaagtataagaatttgtgacacgggtaagaaccaagttaattgtatgtttaacatttttttttaaagaaaacaatacttttaatctgttcataatatgaaatcaaattatagactagaagtagcaactagtgtttggttcaaattgaaaccagagttattctttttaagtgaattttatgaatggaaaatatgtaattaaattaaaagtaaattttttattaaacatgattcgtcaaattttgtaatagagattatttattaataaaattaataaatattatatatcaatattatgattgaaaaaatagataagaagtatcaaaatttgacaaaaaaattaactaaaaaatcaacatagaatgattattacgttccatacatatatacagagaatgcaggatgagtacaaaatctgaccagcatcatacgagtcccaaataagacaatcacatagtacaaatgatgagtgcgcacccgtgaaatattggaacattcaaaacagcccttgttcagtttatctgttgaatccgtg

SEQ ID NO: 5591 - DNA, 1600 bp, Glycine max
  Soy_ogl_3266 Gm09:43325801..43327400 Cluster 25
ttccagcggaatttctgtttcatccctgtttgtaagtattgtcaggtttatccatatgaatttggaatatatagttttctttttttttttcttaggaaatttgatcgaaggaagattatgagcattttttcccttgtggatctatacatatatatcaaaacatctgtctttaaattagtgaggtgatataaaaatatatattaatggatgaaattatataataattgtaatccaaaacacacaaaagtttggtatgactgccaaatacaaacagtagaatgggaattcaaatcacatttgaagcatatggatgcaccctcaacagaaatgttagacagcaacacataggtttgagtcggaagctgccattctctgtttgtggtggctgcttttcctgaagcacatagcaccccatgaaaaggattccgaatattagaatgtagacatcagagagtgacttagcagatctaatgaccatgagaatggccaaaaacacaaacatagctctcagcaagggagaggaattgaacacttacacatcctaacatcctattcaatcaatgagatcccgttgtaacaaacattgtttcttcacgtgaatatcttactgctaatctatctcatgcaaatatccttccgatttcatactagtgtattatatctcattaattaaatgatgactagctacattgatcagtgatggcaaataacccttccatgtgatgcacttttgtacttctctttgggctcatttagggatttgtttggtgggcttatttgctgctttctgaaggtaggaaactttatgggcttttgttaaacatacttatcccatctttacttatgggcttttgttaaacaaatatacctccattccgtgtccttttcacttcttttttttctttttctaaatataccctttcattttatttccgtaaatcagtgcaccccctctttcttctctcatctctctttccctcgtttctaagtatacttatggtttgaagcaccagatcgaaacccttcttttcggagatgtcataattacatttatccattcaagaaaaagaaaaagaaatactaatggaagcaacaagttaattagtcaaaatgatattcaatcagttttatctagggatgataacgggtcaggtattggaagtagcttcctgcccacctagagaaaatttgtgtcagttaccaatcgggtaatcatttgaaaattagctgtggatttttttatacccactgatgaatacttcaaagttcatatttaaaaaatattttttttaaaaggtgattcttttaaaagatactttatccagtacatcatttattatctaaaattttgaaaatagaattatattatttatagattttgtatgattacatgtctttaacgaaagaaaccaaattttgtattataaaataaaatcaaacaaataagaggaaagataaacacctaagaagtcatttgggtagtggtactcacaatataaatatcatgatactctcccatccgttaataagcaggtaaaaaatcccatacctgttactcacaagtattcatttaaatcatcaatctttcatccatgacaaa

SEQ ID NO: 5592 - DNA, 2329 bp, Glycine max
  Soy_ogl_6153 Gm18:53410833..53413161 Cluster 25
tcgcgacacaaattttaccctaatcacaaatctgcttgtgtcctttgaaatctcttccatttctccctctactttgttgcgctttccctttgactcttcgagtcagccaccaactcagcgccgctcaagcaccactcatggcacggggccgtaacagaaggcgaagcactccactgtgtcgaggtctatcttagggtgcgccgtcatgctgaacgtgagtttttcgtcaaagtcgtgacggccgagcctgtcgatgtcgccgtcaggggttacgttaacggcgtaagggaggtcagattcggcaagcgcgaagagacgattcccgaagaagactaagctagtgttggccaagccaatgccgttagcggggttaaactgccccgttaagacacgtgccacggagagggagccacatgccgcggaggccacgagggagttgaagccggagaacacgttggggatgagagggaaaccagtgtcgttttccattgtgtatttgcaggttttaacgtagcggctgcagagcgtgggtttatttgcaggttttagctccacgtgctgttgcggtgtcgttttggtggtggatgatgggctttgtttggttttagctttttgagtggtggtggtggaggtttagggtttgtgtttggggtttttcttctgttctgaggggtgaaactacgttgagcggtggagagggtccataagttgccggtggtggtgttgtgactaagattggttttgggatcatttttgtggtgagtgcgaacatgagggagagagggttcaggagaagttttgggaccatttttgtggtaatgctgctgattttgttaagcagaatttttggccagagcttgtgcctaatttgcagtctgctattccgatgatagtgaccacgcctgagaaatgggatgccattacacgcaagagcagtgacatgtcattgtccatggtggtaaagctcttaattattgatgaagtccatctactcaatgatgataaagctctagttgccaggaccctacggcaggtaacgcatatgtcttatttcctctttttttttcttgtacaaatttagttaggagatttgcttagatttattttattttcttttgtatatatgaatttccagacattggcttatgacagctagcctgatatctatcttatttgctccacatataaggtgagcttcctatatgattgattttgccttgttgcttcctatatgattgattttgcgttgggtacttgggtctgacaatccctccatactttcgttgtcatttatcattggaactcatgttggatcctgttattgtggcttcaggtcaaacatatgagaggcaatccatccaaaagtggcttgatcatgggctgaatgtttgtccgaaaactcatcagagacttactcatgcaaatgtcattcctaattacactatcaaatctcatgttattagattgattgaagaccttcacatgtatgcttatttcataatgtatattaatcaacatatactcacattttctttcatttcacctttacttcattttctttttagctccttaaatatgctgagtttacaataaaccttgatttttagttcatctagtcaatcagtccccaaccccaggctcaagaaaatcctctcaagcagctgctgcaatggagctgcactgtcgaatcaaaatctcactatccctatgtcctttgcattgcattgtttcagacaccacattcgtccaaaaccaactcaaaaaaagcaaatgactataataatactattattctatgtcactctactgttatagactcctagtagttatgataatattgtaaaatctaaaaagctttggtttttccacttacaagccctatatgctatgctgctgctactacttccctcgagtgcgtggtatttccaaagcaaagcagaaagaaaaaaaccgcaggttctttcttttatctctcttacctatcccattattttattatttcttagctctttttttttctctcaccgtgtgtttgattatgaaccattaaaattagttttatataaatcttgttctaattataaacttccattcaccatttttgatcatatactcacatgtttagtatgggtgagttagttaaatatatatattagttaagtttcttgagttttgtagacttcatattgtcccattgccgttgcagaacctttgtgtgacttgtgaaataaattataatattttttaatttattttcactcatttatctatctcttcatcaaatatctttcatttctattttatttttttgtatctatatataatagta

SEQ ID NO: 5593 - DNA, 1215 bp, Glycine max
  Soy_ogl_3468 Gm10:40312601..40313815 Cluster 25
actaaccatattgaattttgaacaaaatgtccaaaacaccctcatcatccaagtccaatctcagacatccttattcatagaatctacaacacctctagcctccgtcatcttctcccttgacatccatatagtggccacatcctctccgttgcgcccccaacatctctgccaatgagatccattttgccatacccatcatcagcaacatcctcggcaccatgactgaggctgttcgaatatggcagagcaattgctttgcattttatttgttgggggtgggacgaaagttagtatctgcgtaatgtgagtgggtgcacatttataattataacttttgtatctatttgtttgactatgcacatctgggttgaattaattgaattgaggtgaagtgaaaaagttactagaagaattgtataggaatgaataattatagggttttttttttgcctcgtgagggaattttctggaaaagtgaaaattggtccagattgaaatacttacttggatatcccggttgctgatctgggttgtttattatgtgcattaaaactatgtttttcaagtgttcattgtgttatttaatttattgtttaaagctagaacatcaaagtgtgccaatgaaaaatataattaaggatattttgaacaaaaaatttcattaaaactcatgtgcatggcacatgacgtcctggagttaaaggaacagacgatcaagggatctctctgcaacgtgttccaacaatgagaggggttttttgtaaggttcgcacaatgagtgggttcaaagtgtaataagtcttaaaatgttcattgtattcttaaatttatcctggagttaaaggaacatcaaagtgtgcccgtaaaaatgataaaagataaggacagtttggacaatacttttattaatattactcatgtgcatgacacatgtaacgaaacaaaccgtctttgtgcaaccagttgcaacaatgaggagatttgtgtaaggtttcacaatgagtgaattggagtataataagtcttaaacaagtgtaattattatatattatattaaaaataattgattaaaaatgtcagcacgcttgtcttgttacacttgtcttgttttgttttagtacaaaaatgccccgtcttcttttattcaatccaaattaaacttacattaattagtttatatttagacttttgaaattaaaatttaatattaaatgc

SEQ ID NO: 5594 - DNA, 2094 bp, Glycine max
  Soy_ogl_6402 Gm19:36654607..36656700 Cluster 25
tttacaatttttcatcttttaccatttttttttacttaccctcacaaacttaattatttgtcatcaaagaaacctatagcaaaatatatggcttatactaacgaggaatattagttctaacaaaagggggcaatctctagtgagatgacaaacaaagggtcaaatttttgttagaatttttttttttacatttaatatttgatcatgttgaagaatatataattatttaattgcaaaaaaagatatacatgagaaatcatatatataatcttctaaaagtttgagaaataagattgattggtagtttaaaaaaagtaaagaaaaaattgtgggtttaaatctgttcaattgatttttatctaaattaacaaattaatatttgtccttaaaaaaattcgaaaagtataatggattcttttagtcaccttaaaaaagattaatccattacattttttatcattctgaaagaaagaaagaaaaaacctacaaaccaaggaaaatagttcctgcagcatctactgctactttacaaataagagaagctggacaaacttccagtgcaacaaaatgccggttcgagagagaccccatctttgctaaagggtctgcgcatacgttaacttcacggtaagtatgcatgaacttcaaatcccacgagcaagatacaaaaaaccttattcttgaaatgatggaagcataaggatgaaaaggagaacaaccttgttgaatcatttggatggatgtaagagaatcagtttctcaaattatcttccgaatattggcattccaccatggtaaatagctagaagttctgcgtggatgtttgtagtgtgaccacgttaccacagtagccagatatccaatgacggagagagtttctgatgatacctccgaatcttgagcgccccggattacgcatggagcttccattggtgttcaacttgaaaaaaggatcacagggagcattccacttcttttggaactggacacatgtttttagctttaaaagaacgttgagtgagctggagcagagaataaatttggttcaaagtgaaccacaaagaccattcctcctttggaaaaatgtagttattacgacccttccatatcatccagcaagccacctcgaaaacttgacctctattgctggtaacgctggtgcgcagccattcagcttcattgatacatcttaaaatatgatacaaatttctagaataaaaaaaaaatcctaaaaatttataatttaggtagaagttaaatgtattaaaaaaatataaaagtattattaacaatattttaaaaagatttaggacctcatgaggatagtattttagactattatataaagtttaaaaaaatttatctctagaagtgatgccaccaacttggcttgtctataaataggcttacaacatcttaacctaagaagttttgtaaaatcaatataaattcttcctttcattgtctaagagctacacgcccactaagtaatatactaattctaattaatatttctaactagaccttcattctaaacccgacaatcaatcaccatctaacaattaactatctttctctattcctctaaaatactaacaatagagaagaattcattgttgtcatcaaagtgtagctgacaccaaatgactttagctttagggaaatccctaagagtatgggtccgagtttcctccaccccatcgcacctgcaacagaaaggaagagaagaaaaatgtcgcttacagcgaaaagagttagttagcaaagaacctctgtaagtaagcaaataaaagtgtttaaggttttctggcaatggcagcctccagacccaagccaaattttccttgcaggtaaggagaatagtagtctcacggtccaaccacctaaaagcagattttgtcgtatatgcacccgaaggggacaccaaatgtaggcctcctcgatattttcatgaagacaaaaatatgttgggtcttctgtcgcacttcattgggaatatctatagcaagtgttttccttttccaattccaagacccattgtggaaaacatcacaaaggcgtaactggttgtccatagtgtgaacgtaaagaacc

SEQ ID NO: 5595 - DNA, 1200 bp, Glycine max
  Soy_ogl_1881 Gm06:9641701..9642900 Cluster 25
agaacaacatagtttttcgggatcaacattttgatggggtaaaagtcttggaaaatatcaagatgatttcatgacagtggtttttgtacaagagaagaagcaaatcaataactttttttctcttcttggtgtactaaccccttgttttgttttaattcagatagttaaaatctgatgggggtatattttttgggatctttaagccaagtctatgtacagtggatagacactctatttggatgtataattgcagttttactacttgtacatacctgcttattatatagaatataattcttttgccttccaaaggaaaaaaaaaaatacactcacccatcaagaagcccttttgaccttgtagctgcgcttagcttagacatacactcaacaactcactaaaaaaactacaaaacttgactccttaaaaacatgcattgagattaatgaattcttcttccctttcactatacaactaaaataattaagtctttgatgaccaaaccatttttaaaaaatgaacttgaggaaatatattatgtgcccgtattagtaacacactattattttttataggcaaagaaactcttattgaaggtagagaactacactactttagttgggttatcttgtttaaaattacttttaagaaaagtatactttaaaaaattgaatattataattagaaatgtttgactaaatgtaattatgaattttgtttggtttatgttaagaacttaaaggtaaaattacttttgaatgtaaaatcaacaaaataactacaaattattttaaaatattttttttaaaccaaaaaaaaaaattagcaacccaattgttaatgaagataaaagcaaatttgtttagtcaaccatctatcaaaagcagttcctgatgaaggtattgttgctttagatcaattataaaaaaaaataattagcaacccaaattccatgataatgcattctacacgcctctcattttcttcgatcaattctaaagtttcagaccctagaatcttcttctttacactgcgtctttttatttttaaaatatcaatttttaattattttttttttcatgtaactgcacatagggactgattagatacaaatcataagtactttttatattttttctattaaaaatataactatttttcaataaatgaactcttaaaaacacttctagtcttagatctaa

SEQ ID NO: 5596 - DNA, 1259 bp, Glycine max
  Soy_ogl_2711 Gm08:15749142..15750400 Cluster 25
acaaacaacttaaaaagagacaaaaaaaaatcaaattagtaagatatggagtgtgagattacacattacaagggcatggatagcaaactgctggaggttcttgtcctcttctctgacccccattgaatggtttttggatttggccataaatgccatagcggttaaactttaaacatgcaccgtcacgtcaccgtaacattcaattaatactagttcattcaactagtattttcggtcgagacgagggtttccacaccccgaggtcacactctcactcctctcataggatccactcacctgaacataacttctcatgaattccacattctttatcaccaattttgtattgttttttattggctatataacaaggatttggtgattaaggagaaacaaaaatgataaaagtgatggattcgatcctttctattctctaaacaaaaaataatgcttattgataaataaaaaattaacaccaaaaacattataagagcacgtgtacgtgtgtgttgaggagtacttttaataaaatgattaatatatatacatatataatatctcgtatttcttttgaaaataatttaaattacttcataaaatataatactaataagtactgcatttttaactgtcattttaaaataatccttaacgagactcaagtattatctaataatctaacttggtaatggttgagtttctcccctaatataagttttgatatgtacccgaaaaggtttattttttttcgtttcattcacgtgaagacgatcgaatagaatataaaactcgtttaattgaaactgaaagtcattatagttaatcaaaattattgatataaatattgtaaatttacaccatagcacaatatattaacatttaatgtattaaaaacatatattaatttttttatagaggaaacaacatatattaatggtcagcaaaaaaaaaacatatattaattctttgtaacaataagattattatttatataatgtactattaaactgctaatataagcctaaaatgtttattaaaaataatttaatttcttgtaaaccaaatttatactaacaaaaactaatatagttaccaaaccgtttgtaaaaaaaaccgttaacatataacaattttttaaagtggcttaagcacaaattttataggctaaaaaatatcatagggtatagggtagactcaacgacgtcgtcttagtatattcgattttgacgccacgtatcccggatcgtgtcccttggctc

SEQ ID NO: 5597 - DNA, 1000 bp, Glycine max
  Soy_ogl_6465 Gm19:39998001..39999000 Cluster 25
acttgaataagattatttctaataaaatatatgtgtgatctagaaaatatatataaaaattgatatttttaatttcatgataattcattattagatacgaaaatgtgaaaaatctttacagaatctaactaaattcttgttaaaattattatagtttaattttattttgaatttattatcttttgaactttgatatgtaaaattatttattaaagcaccatacgattttgtttaatatttgttttcttaaacaataataaaatcaactaatttaatattaattttaggtatgattttgaaaagagacaagttttttttaattgaaatgacatgcatttaaaaaagagccaacttttttttttatataattggtgcattaattgatgtataatttttctgaaatgaataagggaaaaaaactgatatgaaatgagaatcatactaagatcagatcagacccggttttaatataaaaaaattactttgaaaatattaattactaatacttttttttaagagtgattatattttcacaacaaaaaaatttaaacacataatattcaacaactctcttctatctttatctcttttcttatcacactacattatcaattaaatcaattcaatcacttatctagcatctcttcttttttctcttgtagacaactcatgttttccaataaaaataattatatcactcttttaaaagcctaaaataaggactctggcggcgttacctcccgtttcacccagatctatgaatttatctggacaatagagcctcatgtacgtggaggaattttgttggtggcctttggcgtcatatatagtactagtctccaatcccatggttgtggttcttgagagatgcatcatgcatgaaatggtaattatgatttttgtttttcgttagataattaacctcaaggtatcgagcacctgatagatgcgatcatcatttgatacacaaccaccttactaattattttggcaacataac

SEQ ID NO: 5598 - DNA, 1165 bp, Glycine max
  Soy_ogl_618 Gm02:42982301..42983465 Cluster 25
gcattcatccaaattgttatggtacttactcccacaaacaaacatgctagtaacgtcttgtaaatttagggtaccccttatgggggaatatcaagagtaattcctggaaactgagaaatgaatactcccttggattcctagctagccggtaaagtccaagttcagctgtgtctacgcttcattgtacatggaagcaccaaaatagcccgttaaatagggacaacactaatttccaaaacaaattgaagaacgtacgttaattcttattcctatacaattaatttcatttaaattctatatgttgatcaaataatagttcaaaaaactatatcaaaactactttaagtgtttattgatctgaagtaaaagtgataagatcagttagattaatataaaaaagagatcggaagaagctgaactatatatacagctaaaaaatatatactatgtgacattggttttcttttctgatactaaaaacaaatggagatgattatttgcttctcccagtggggttacgtactgaatcagaaatttgcatgttgattcatcaattcatacgtaacttgaaatgaggggtccatgcatgcatggattttaagcaaataaattaatgtgaagtatttcaatgtatgcccgtgaccgaccacatctcatgcactgcccatacctaaaggataaaatatcaagtgatgttcattttttaatctccccttcaaaatgaccaattaatgtagagaaccttctaagttctatagattttaacacttgtctaattcttaaccatccacatccgtttctcatgtacctttatagtttcaattatttcaacaataacgccaacactgtaaagtttttgccgttaccagttccaaattctaccttttttcttttctgtaacagctggattcactgtactaaaatccaaaaagtgtctgaaaccggagtttgtctatttgcttcaccccaatgatcaataggtcgtttgtatcagatctattttcttttgcaaacgtcgtaatcaaactttgtttgcaagttgagcagaatctcaaaacaggttataaatttaaacttgacaagggtacgtttattcattatgttgtgtattacatttcaatgctggccggcccgtgtttcttatacaaaattgacagagtcgaga

SEQ ID NO: 5599 - DNA, 1169 bp, Glycine max
  Soy_ogl_834 Gm03:3665932..3667100 Cluster 25
cttgattgaaattcatacaaaatctactatatcacaagaatctgtacgggattcatgaaatgaattgagtcctgttattatatcatctcatttacctagaatttctcataaattcttacaaataaaataatactaagttgcataatatcttgttagcattttttcagttcagtacccggaacatcattatgtctttttaactattttttgtagcacatcaactaaaaagaaggaccaagagctggttattgcagcattcccatggcatgaagtgttcatgtttctgaatcaacaattccttggagcccttcaagttgagtatcaaaacaagaccaaatcgcccttcgagacacacccaattcacatgtggactttcctaacttccatatgcttttacagtgtgattcttgcattcaaaatcaaccttaaggcttgcagtaatgaccactttgcttttatcctcaaacatgttcttcttgtcttgggttcactttcctcagcctccttattgtgtatcttccaaccaggccagcatttttggtttctctatgtcatagggatatatatgccactaatgctggctcatcacttgctccaaaatcaagtgttgaaggttttgggaactataatgacttcagcttcccaacttcgagactatctaaatatgttttgtggatgcatagggcagtgacggtactcgtacttcctcaatattagaaatgctctttttgattgttgataaaaatttattagaatttaagaagttacatgtggatgtagcatgagaaattattaggtggtttttttttaattagcattattaggtagtgttgagtcacactacttgattcatgatatggaccaatttatatatgacatgtaataaaatgttattaattatttcttataaaaacttaatcacgtgtcacatacaaattgataggaatcatgaataggtgataatccaaaatcacctgttagtttatcctgattgatgtctttgacacaaaatataaccattgtagaaaaaaagaaccaagtgttaaagaagtatttgccaagggtgtgtttaaattacgattggatatttcgaagcaacaaacagaggaaaactcttttgttggatgggagaaaaggcaacttacattctttgaatatcatgttaatta

SEQ ID NO: 5600 - DNA, 1400 bp, Glycine max
  Soy_ogl_2241 Gm07:6880101..6881500 Cluster 25
agcatctcttactgatctcacaattcatacacttcattttcaattttaaaaaaattattctattttacacaccctacatgtattaaactactgtataaattaaactcatttcaccctaattctcctcttaattacaacaaatttaaccaaaacacacttacacaatcatatagtaacacccttttttctactatgggggcaagctcgggtatagtactagagattacagttctaatgaagttgctgttggtgtcccgtttcggtggaactaccctaacgttatttgaagatttgtattttttattgtttttttaatttcttgaatattgatcaaggaggtgtggaatgtgaagtttaatttcactaatatattgtcacagaggcgaaagcttgttatttgagagaaatcttgtcttgtacgtcaacttcatattttagtaaaacgaagtattaattctaaaccctggcacgcgcgctaaagaaaagaaagtattaacctaaactcgaaggttcgtgtcaataaaattttatattttctattttaataagtatttttcagttgtgtaaatttgatgttttgattttttttcctttaaaatttcattcctagacaaattgagaacttgtaaaaaaaattccctggcctctacgccaaaattattttgttcataggataatgctattcattaaacaaaaataaaaaagcagagcatatttttgaataaaggataaaaataagaaattatagaaaaaaagtaaaataagataattaattttataaaaacaaattataaaaagtatcatataaatatattattaaagagttgcagtaatcacattatttgtctcattaatttttctctcatctttttttttttctctctatatctttcttcccaatacactcattccaacaatacattccaaacatgaagtgtatgttataacttttcgttattaaagtagcatttttcatattcttttactggtttgcatttgttttttgtttttttcccaatctctttccttctctcccatacacctcaaaaagaggtaacacttccctaattttgactttggaaacgaaccattttacaccacgcgtatctagacgagagaggatgagaattcatgcatgcataaactccggtcggtaaggctttcggctgttggctgtcggctgtcggctgtcggctgtcgacagtggctttgtttcttcgttctggccccatgaagaatatcccaataagatttgaacaagttaaaactgaaacaatccaactctggactgttactatcatcacacacactataccctgaattttttcaatatcaaagcaactgaaagataactatttttaatataattaacaatcattaaatttaaaggtttcaacggt

SEQ ID NO: 5601 - DNA, 1100 bp, Glycine max
  Soy_ogl_2495 Gm08:3870901..3872000 Cluster 25
aataataataaaaaaatacattggtcaacttgaccctagggcttcagtttcaattatgtggtgttgtgtgtggcgcctcagtaattgaatttattccttatttttttgtatgatgtatctcaatcagttatattttactatttaaaccattttagctgataagagtgatggaagatgatattgtttttcgaaaaaagggaagaatttaaccatattttcacaattaaattaataagaaatttatttaacactgaatttctcaaattttgtatttttaagtaacaatgagtcgataaagagcatgaataaccatcacctaccattgccttttaaaaaaaaaaaaaaaaaccatcacctgccattgaacttgaaaaaatcgcgatcaattcttgaagatccttcatagtcttttctcttcatctttatttcttctcttttatttttatctccatgagtttatgtgtttcctaagattagaatatatgaaccttggtttgaactttttgtaattgatttttttaaagaaattatgtgaattaagttcttgagatcatttgtaatgttttttttttaatgattggccctcgtcagcaatattgtttagtaatataaacttcaattggaaatttggggtgttcctaaaatcaggttaaattatatatatgcattcatttgaatatcctaaacttaatgtttgttactaattttgcacacataaaatattaaaatttattattacttatgcgatagatacacgtgttcttcaacaactaatattaatttttttaataagtaatttatttattttaatacgttttaattaatcttattttcgatactgaggataaagaaggaaaaaactaaggcaagaaagatgaccaattcctttgatgtccaaatatgacagcccaatcagcagcaaagtttgcttccctataataatgtgaacaagagaattttgccaaccatttatccccaagcatcctcctcatgatatccgcaactaaaggtctcaaattaagaactaggaacattataagttgcctatcttcttttcttttttttatgggataagttgcctttcaaaacaatagaaaata

SEQ ID NO: 5602 - DNA, 1000 bp, Glycine max
  Soy_ogl_3121 Gm09:36054201..360250 Cluster 25
gaatgaagatattataattgatgttaaatttgcataaaagaggatgaaatgtataaactgtgaaaaaccgatgtccatgtaagtgcaattcactgtgtcaaaacaaagttactctcattaaacaacaatagtttctattggttcattcagaaatcgcaacaatagaggaaaagggatgtgtggtgagagaaagaagaatgtagcataaacaggaaaaaaaaatccacaaaagtctcaaagtttttttgagattgtttggtacgtgcgatatttatactttctattaaaaagtcacataaaatacatcaaaagtcatcctaaaaaaatgtattggaatttatatatttttaacatcataagatttttttaaaattgtaaaaaatctcaattgaaaccatcaaattttattatacttcttaaaatattctattaatcttgattgaatattacaatatttttatatatcatttaaaagttttgatggaatatcatcagatttttttataaaaaaaaagttttttaaaatcctttaaaatcttaatccaatacacactaaagtagagtttcattttgaatagattacaatgtgaaacaattttatagtgttaatatattctaataaaattctaattactacatttcaattaaatatttttatgtaatagaaggtacatatccatagcgtaattactattattattacgagttctcgcaagttatatatatgccgcgactagaatagaattggtgtgctattttttctggtcgcaatcaaattcatagaaatggtattaattatacagcatagtgggagacttttttatgtaatgccaaattttatttttgctcttgttacgacaaatattgctttggtctccatttgaggaagtctctaataaatttcttggggcattatcccttattcacaaaaaagaaacgatattaattaattaataattaattgtacacttgcggcctttaaacggtcataacataaaca

SEQ ID NO: 5603 - DNA, 1100 bp, Glycine max
  Soy_ogl_3457 Gm10:39497901..39499000 Cluster 25
agtgaaaaaaaggagatgatttttttcaaaaaatgatatgaatcccagatttctttgtctgtgttttaattcaaatattagttttcaattctttgatcttccacagggaaccaaatgagcccttaggcacctcgaccttggcactggagtgagtagtgactccaccgaataaaaaaggaatgaggatttggttttgtttaggtgttgggctgttaataacaataacagtagcaaggatataattaaagtagtgtttgggtggacacataatcctatgagtaatgagcaccgtacaaacatccccgtaatcgccggtcacatgacacgtgcaaatcctatggtgtccacgaggcgcgtggcatctgtactataaatgtcggcattaggcaacaccatggccatgggcgttctcgtcgtcgattactgagcctcctctccaagccacgtggatcataagatgctcccattttccttcttctgctttccttaactttttccattttggtttagggcacttcaacttcaatcaccaagtattttttatcggctccatgacaatggaatggaccatatctccatgcaaatagtggccacctgctccttatatatatatatatcactattattttagcacctgaaatggataagatgattttttgtttttaaacacttaaaattaaaaaaaaaaacaataggttaagagttttccgataatttataggcattgaactcttgagattataatgattatttttaaatacataaatcatagattaaatagtgtatacgttaatggtaaaaatgatttttacctagtaatctctaaagagttgattgaacagaacaagatacagttttaatatatgatgagttgcaagctcaaaatattaataactcataaaaagactcaaattcaaaagtaacttctgaaaactaagcatgacaaattgacaatgtgctgagataaaaatgagttttgttgataaatgttaaataacataaaaagacatatttagttattgtgtgtaggttttataaaaataaagtttttttttttttgccgagtcttataaaaataaagttattgtgaataggtatca

SEQ ID NO: 5604 - DNA, 1110 bp, Glycine max
  Soy_ogl_836 Gm03:3945901..3947010 Cluster 25
gaaaaggatttttcatcttaacaactatatatttggttttttgagtaaaatgatatgtagttaaacaacgccctcacactcacacatatatatggggttgatatggaggaataaaaattaaactgcagaagctatttataaatctacttgtacaacatttatttagtaaaaaaaatgaattttaaatttattgtccgttgtttatcataaaagacaattgttaataattgatccatgaaaaattgtatgggtcataataaaaaaattacttaaccatctgttggtttaagtagctaataaattatgtttgaaacggatgataaaggggtggtcgataagcttaattcaaatggcgttgatcactatgagttgggcactattctaaatagatgcaggacagttctttttcagaatccaacgggtttgctcatggaacttgttagggttgtcccattatttcctagtctctattctcaacatctaagttatgtcatgtactgaacaattgatattaaatgaaatgatataagtattttttcgtaaaaaaaaaaaagtagttggtaatttgatttttcttaaataagattttaagttatgaaaaaaaaataatattaagttttatattttaaataagtctagcagcttattcgactaaaattagttagctgcctgatatgatttgaagtactgaggagcttagacaaaaactagtgcatatatcgttaaagatcatatttatgtaagtgttcggtacgtgtccatcatatgacagcatgaattaatacttaaaatatttgtaatatttatataagatatttgtttttcttaaaatctatcatcatataaattgtaaaatagatcaaaaatgctaaactgtctttaaattaatacttaatccctacccatgatatggtcacattctttaaggtttcaacatctcattataaaatctaatcatctatcgacctgtacttttaagtttaaataggctcaataagaaatcagtttttaatttttttaaagactaatgttaattgctaatttttagtggaagtgatttaaaccgacttctttctttagggatggatccaaaagcctgttaaaggagac

SEQ ID NO: 5605 - DNA, 1693 bp, Glycine max
  Soy_ogl_4362 Gm13:30439101..30440793 Cluster 25
agaggaaggaatgcgatgcatgtttactcattcttaaaataaaacaaagaaatgggttgtttttagtcactattacattaaattattgttttataatttagacggaaggcagatgttgttacggaaaatgaaagaaaaaattaaaatgaaacttttcataaacataaagaattaaaataagaccttcaaaatttaatgtattaaggtaaaacaacactaaatcataaattcataatgggcaaaaagtaatatttagtaaaaaaaaaaccatctttctctcattaccatttaatcaaaattgtcagcaaatcccttattgttgtcagtaataccatcatcctcctataatgggaaatcattggtcaatgacgcatggtgttcaatggtgggacgtcaacaaggaggtgtgatctagctatggaaatgttgataatttggtgtttcttctctcttttttgtttctattaatgttgtaaggttttatatttttggtgttgatgttgggttttggacatggtggtttggcggatttagaaacacttttgacccttaattttttatttttttgacaaattttgcactcaattttattttttagtgaattttaccttaaacattttactcttttgcaaattttgtccctgatttttaagcttattgatagataaatgataaaaagtaaaatttctaagtttcttaaaaaattgtaggtaaaatatgtcaaattaatttattaaagataaaattcgttaaaaaaaaattgagagtaaaaaatacaattaagtaaaaaaaaaaagacacttgttatttagtgctttatgattagcttacagccaaatcatcaacacccttcatttaaatactattaaatctttatagtcaagaaaagttttgcaaagcttgtagtgtttgatgataaggatgtgttagtgctgtctttggtggtgattgatgggttggcgtgttttctagaaaatgatgcagaaaaaatttctattcagaggtagtgaggctagtaatcaagcaaatgaggaaggccatttagaagcatgccctaacgaagttcgtgcgagcaaaactcatcattcaatgatggattaaagggagaaagtcacattatcatggaggattgccacaaccaaatagtttgaggggatcaaattttgggtactatattggggaactagagtcacaaaaaataagaacttgtgattttttcatgactttcatgatgggtgaaaaatggtgattattgccattgatttatgaacatagagtgaaaataagaaagggacgaggatatgaaagagaaagatggaatcgaaaaatattacgtgattacttttgaatattttaaagtagagagcaattaaagatgtgtttttaaaatgaatttagacatgattttaggtgtaaaagaaagagaaaaaagtgtgttttgtttgatatgccatctgttgtcttgattttaatttatctcttggttagctccttatttgaaaaaatacaaaaaataaaaataaaaaacttataaagctagaaaagggatcgaagctgctctgaattgtgggcttggttttccttgctcatcaacagccgagttgcacttgggcttcttggcctgtaaaagtttttaaatcaaggatataagtatctcaagacattatggcttatggggttatttattttgaga

SEQ ID NO: 5606 - DNA, 1500 bp, Glycine max
  Soy_ogl_160 Gm01:44396801..44398300 Cluster 25
aatgacagacccatctccatctgagtcgcacgcgtgattgctgtggtggcagcctggctgcgcacactcacacatcgcaaaacctgcttcttctttctcggtttccgtttgctttgctttgtatcccccagtattaaaatcatcatctcataatttcaagaaaaattttaatcaatgtattaagagtattaattaaaaaatttaaagtataaacacttttatcagtaaacagaaaattatgttatttatgatttttgtactttttatatgatttatataagatatatttttattattttatttttagttaatattctaagaatattaatcaacaatatcttaattttaaatgtaagatccgctcatttgtaagtctgtcaattttcacatataaaaaaatcaatttatttgaagtgaaaagaaaaaaaaaataagatttacatttttacatcataatttaatttaaaatttttatcttaatttactttcatttcactctactaccaaatatacccttaaattttactactataataatgtaattatttttttagctaatgtattgtaatattccaattttttattgactttaattaagttaaaacaacccgctcatttaaatcacgtgtttgcttgtatgtcccgattttctttaatagtataacgtacagagcatcatcatatgtaataaaattagaggagttatacattctaatatacgtagttttttttttttttggacgagatatatttttcacttgaaataatccaaatttttaacaaagtttcattcttagattttatatcaaatttatcgtgtatatatatatgagtttgttaatagacattgatgactttttaagttggtatgcatcagcaaatgtacaccaaatatttaggataaaataacagttatttctctattttaattaatttattctagagtattagagtaattttatatatttaattaaaaaacaaaaaatgtcatttctctttcctccgtaactctcgtcacgcgtattaatgcatttaaaaccatcatgttgttcaagaatgaagttttgttgttcgaaggataaaattaatggattttcatacttgttctttgaacggagttaaagtggagttgtggcacctagttattgttggaaatgaggcgcttgcagtaaggtatccaaggattttctctaattagtaacttggagcagaaatatagtctaattagtgctcttgtaacatgggatcaagtctattggagttggaatctctcttggcgaagataatggtttgaatgggaaaaaccattagtggagaattttatagaggacattggacaactacaactaaaacaacatcaaaatgactagtgggcttggatgtcaaatggcgaaggaaaattcactgtaaatgaagcgtatagaatcatatgaggatctttagtagtgtgtggaaatcttttgtgccatcaaatgtgactgctttcacgtggagacgtgg

SEQ ID NO: 5607 - DNA, 1559 bp, Glycine max
  Soy_ogl_2242 Gm07:6926801..6928359 Cluster 25
ttatactcatcaattcccatctttttagtagttagcttagataattttcggttgctactcttgaaatttttgaatctttgtatctttttactacttagctttgcatcttatactcatcaattcccatctttgcaatgaaagctttgcatcttatactcatgaacaccttaaaaattttgaataattctttttccgctgtttttctactcttagaatttcttcggttgctattttctgtatgctttaatgtttattcaaattatggataaaaatagatggccgataaagcatgtaagcaatcacctaacattatagctaagccacatgattttgtagcattgtcctcttgtatttctaaatccacacaaacatttagccaacttcttaaagatcaattcaggctacagttagtaaaatgttaagcaagacttttatttttctgtttggattacttagaataataatcaatggaccacctaaaagggcatcataattaatgggtaaagctttcaagttgtagttttaggacaatcccatcaaagtcacctcatacttcacattgacagtttctcaaaggcttctgtagatagggggagctaataatgtctaagatgtagttttctaattccatctaatacatccaaatgttgccatcattgtcttaacataatgtttcaaggatgtggggaatggtggcacccaccaccatgtgttagaaagaaggtggctaagaacaaatcataacacaaggagaaggggactttgggattacaagaatgccaaagaaagggtggtgaggtagctgatccaacatagaaagaaataagcccataagataatgtcctaatgccagcaaaactaaaaaggccaactgccattccctctttctgatagcctttcattttcttgactttattaccttcgtccacacctaatagtattgggatttgatggatcacacctcacgtgtatcctcgttatttatgaatttgcatgcatgaaaactaattaaaagagaaaatgttattcgtatatatatatagttatcatcagctatacatgaatatatacatatatatgaccttggttatcaataagatccaatataattgatagatagtcaaattttttaaacatattattagaaatttgatttctgatcatgtatataattttttttattggaatagaaacaaaatttgcttcaataatttctacccaccaaaagaaattagcccaatataatatgtctaagagatatcttggtggggaaaaaatatatgacctgggttcaatcaattgttggattgagttataaattgcaaagtggggtcctatatatgtaccggtagattaatcataaatggagggaggaaattcattattgtcactttcagcatatcactaactcatatttttagtttattattattagtcctactacatgtatatattaaaatgggtcagattctatatatatatatccagtgacacatgaacaaaaaaggtcctacaattaaacctcatagggagaggaatagaatcaaatatgtttaaag

SEQ ID NO: 5608 - DNA, 1400 bp, Glycine max
  Soy_ogl_4772 Gm14:44278001..44279400 Cluster 25
tcctctcgtactcttcccccaccaaaaataattcaccgtcttttgaatctcatccccagtagattgtggtttttggaaaatgctcatacaataagtagggatagattgcaccattgattttataaggacttctattctcgccattgataacatcctcccactcccagagctgattttttgcaacaccctatctttaataaagttaaagttagcccttttacttctacccaccactgcagggaagcccaagtatcttcctccaccttcttccttaagtattaacaaatagattttttatttttttttacaaatacatgtttaacaagtgtttgatttaatttgttttaaagagagtcatttatagtatgtcaatttttgttataattttttttagatgtcttgaaaaaaaattatagaagtttgtttgcaaacctataattaatgaaacatttccagcatcacgttgaaaggaaaatcccgaggtcgtaaatattgaaacaaatgttaaaaatgtaaatataagtaaaaacattactctcttcatttcaatttgactaatgttttagcattaagtaaaagttttataatgattgatgttttcagttttcaatgagatactaaaatatttagtgattttttccccccttaatctcccttcttcctcactaccaccatctctcctctaacttcgaccattgtcaaggatgaatttacgaagggtagccatgaccttggcatgtggattttgatagactacctttattgcaatttcctttctcaattatattttttttctttcacaatactcaaatttgagactttgtttaaagaatttgagtttaatttcacccgaacaaacgacatattgacatattatgaatagtattataaaaattgtctaatcattgttatgtgtcaactagacaactttttgagtttcttttttactttttgttttgggttgacttctcagttccctaattgcgtcatcttgccatcccaccaccaccgcaccgtgcaatcccaccctcgtccactaccactgcgtgcaaccccacccccatctaccaccaccacatgtgacctcacccccaccctccaacactgtgatgcgaaggtcgcagaggccattgatctggctgcaaaggtcacaaagcaggcgacccctcccccatcctccctttgcacatctctctgtcaacgcccaccacacggcaactagatctatgcctcatcgccatcgactagccatggtttgtgttatgtgtttctttttttgtgtgagaatatggggcgaggagagaataaatttagggagtgagagggacgagaaccaagtagatctaacgaaaataggattttgttgataaaattataaacgaaattgtatttccgttaca

SEQ ID NO: 5609 - DNA, 1000 bp, Glycine max
  Soy_ogl_5045 Gm15:13733801..13734800 Cluster 25
ttcgaggctggaagactcgaatgccgagcatgaaaacggttccatgtgcctcagtcctgatctagttggaactttaaacacatatgacaaacagaaaaccaaactaataatgttgaatgaataaattgtaccatatttattgtagtgaaaaccaaacagaaactatttatactaacgccatggagtgaaagattatttttttgtctttataaaaataacaatgtttaaaatttgtgccggtaaaattttgactatattttttaatttcataaaattaaaatatcatttttttattctaaacataaatttgagtaacctatgataataattttttatattaattatatacataacagataaaatatgacattttttacatacatatgaccaatataaaaaaataatacacataaattcgaatatctaaatcttactttgcaataaaacagaaacatttcaatttactgaagatggaaaatatattaaaaattttatagatataaattttgaataatttcatattatcatatttaccgaaagatatattttaacctataatatatattaaaagggaaaaccgtttaaaagaagcataaaatagtacagccagaagaaactaatccatcgtgtgtgtttgaaacggtggatgaacttgaagtttattttagtacaaaaacctttcataaaagtagttaacaaaaacacactgctttgaggggacaaaataaaatccactgttatatataaaaaaaagaatcgaagttaatctcacgtataattgaaagaactataagagtgaatgctaactctcgtattttaattaatttataataaaagagtagatatttccagcgtaacctaataaaacactaaaaacactaaaaactttttatactttcaccattgcaagtactttataataagggtttttataagtattatcctatttttagagtagacacggagagaatagtcatcatcaaatttgagtgaattagga

SEQ ID NO: 5610 - DNA, 1308 bp, Glycine max
  Soy_ogl_636 Gm02:43725093..43726400 Cluster 25
aagtaaacaaaaaactacaaaccccacacccccacttttaaataattaaacgaattcctcactggcagcaaccaacatggcattcttaatttttcagcttctaggctatggcctcattaggcacatatcttaggcacaacctcactataagaatccttcataattaactcacaggtcaagtactacgcacatgcacacaagttggtcttacgaatacttctagcttgactttaatatgatttaaatgcacaaataactatgagggattctcccaagccgatggggatttatcagacgcattcactttctcccctttggatatttacttcgcaaaaacttcaactactttgtcttttttatgggggattgaaaatctctaacaaaataatattatcttttatgaaaatataaatttgacttaaagagtgaagggagagagtaatagattctgggttcaaatcttcccactagattaacaaactaataactaatatttagcaataaaaataaaatattaacttttatgtatccaacggttatatatgttaagtgtttacctaatcattatgtccaactttaactaactctaccagattagttgattgaagcaagacataattttgcatgtgacatgtaacttgttagaactttattttacttttattttttttagcttctttattaagaaagattaacgttaagttattataaatcttttaatacctgatatcaatttctataaataaaagaaaacaaaatattccttaagccataaatttttcctaaattttcatgtagcaaaaaaattatatatccaatttcctctaatttttatgtaccatgcatccacagaatgaatactgaagatggaaaaataaaaaccggtgtcattcaaaggatgaacatgaattgggatccaaattcgaatttggcatcgtgattgggcaaggacagtgcctaattccctcccacctaatgggtttaacaaaatgaaagagacacaattttaggatctcgtgattatggcatacaaatgaactgtcatcaattaaaaagacattttaactcaagttggctgaacgggaaaattagacaggttatttttttttccagaaattctatttctacaatttatgtgcatatttaagagagataaaaaaaaaaggagagacgtacaaaataaaattaataatataatagacagaaatacttttatttataaaaaggtattttaaaaagaacacataagaataagactctcaagctgattaaagaagtagatgaatagtggaatactacaacgcaaac

SEQ ID NO: 5611 - DNA, 1000 bp, Glycine max
  Soy_ogl_2305 Gm07:9379901..9380900 Cluster 25
aatcccctgacccatttttgctgaaagatgataggatagaccaaaacggatatatatatatatattaggcgcatatataacaacaaattgagatagcttagtggtaagttgttgagtccgtagcttcatggtcactagattgtcatcttgggcagcacacaacatacatcatacaaaagcaggttgagtcagaaaattgactaattttcggtctaattcataccgggtcacacaaggttaataacatatccgatccaacataaggcttggattagttagactaccaatttccggtctgaccaattggttcaaacctatttttaaaactatgtccaaatgttatactcaagacacaagcaaccactcgattttatccaaatcgaataaagttgtaaagagagaattatcaagatacgctaagaaggaaaaaatgttatcctaacaatgaaatcttagtaatagataataaagaatgaaaaatgtagtgtaccaaaaaaatggaaaatgtacctttaaaaaaataatgaaaaatgaacttaaatacaggattttgaactcttaaagaatgaaggaatgttagtaaaattattgctcataaattctttagccgaaagtagcatagattttgtaggaatatttctagttgttggagacaaagtttgttcttcaactttcatgttttttctattacatgttacagtacttcggatctcctatacaaaagttttatttttcctccggcagttacatccttttgtttcttagtttttacgtgtggaaatttctattctaagctagagaatgagacatatttattgaaaattcatcctgttacgtgcttcgttttggataaggacttggtgcttaaggaaatcttctctaataccctttacttagtttatgcaatgtgaaagacaattgtcttatcagattcttcagcattgtcttatcagttatcatacttaattaaacccatatgccatacttattggtcttaaaa

SEQ ID NO: 5612 - DNA, 1269 bp, Glycine max
  Soy_ogl_2533 Gm08:6921732..6923000 Cluster 25
aaagatgtacaacaacaaaaaatgaattttttaaccgaaagacttaaatataaaataaattaattcaaacatatattgaacctgtttagattaatttgtttatttgacatttttgctatcataacttaactgtattgtatttttctatccaacgagaaggcaaccaattaatgcgtcaattcctccggtaaatgtgtggtttgcagatattttctcaaaccatggaaacgtgggttgttgcataaagaaaaaagaggcaaccatttagtgctcattaattagttggaaaaaatgggatcttaaactgttgcaggaaattgtttcaagaaccagctgattgaactcctcctagcttgtctcccttcctgtgtgtgacctttcttagagcttaagagccaagttgtatttttttctcttaattattttttgttttattttccatcacctaccaaaaaaatgcatttttttttattgccatgttaagctaagtttaactgcactgctgttatataaaatacgtatatgatataaaaatcaacttaaaattatccattagtcctctaaaagcgccttaaaataatattcactcgtatttctagtaagaatattattagtttacattacttttcttcacacttggtataaaatgtcaattcattgcacagagaaagagacacatgtacaagtaggcataataataaagagtgacataagataaacaggttcatttaacgatagcattccttccctctttcacccttttgtgcgtcaatggctagttccttaatcgccaagcttccttattcctttgtatattttttcagcttcggtcaattttaaatgattttcttttcaaatcattctagagacgccagagaaaatcctcacgttcattacaaacaatgagcgacaacacaacacccttgatatatcaaagaagcatgtggttgtggtatcagcttggggagggaggaactaatacgaatgggattgtttcattaacgacaacccatcgttatgtattcaacaaagattatcatcgtgtcgacattctttcttcgtttctttccataattgggctaatgcgttttttattggacccaattctaatcttatataaaggtttaggaatataattaataagggctcgccaaggatattcttctcccactatatatggtttgagaactcacttgggaagggaataaaaaaatatataatactaacacgtgaaaatttgataaaagggttcacaaatttatccaccca

SEQ ID NO: 5613 - DNA, 1000 bp, Glycine max
  Soy_ogl_5407 Gm16:32601..32146200 Cluster 25
taataaagccagaaacaatctgaagattatgctcaccatagcaacttcctcaacttcccacatccaaaattaatgaattactctatagcattcatctattaatcccgttaacaatttataaaataaaaatataagagaaatacatgtgaaaaaaataaataatctttaagatatttcaaacaaacattttttcttttcttttcaaaacctctttttaaaaaaatattaaaaatacatcttatgagagaaaatattttaataaaaaaatgattatatttgaatcgtataatcatttatgaaaaattaaaatttaatgtctaaaactcatataattttaataagtgattacatgatattaaattctaattattcatatttgattaattaatgattactttcatataacatttttttctcatatgaggtcaattatccatccctttaataagtttgaaagattatgatattattcaaaaattgaagttaattcatcatgcaaagagttagacggcccttttcaagaaagaaaaaaaaaggcaagaaaatacaaactaaaatgcaaagatcaatgaacaaattattatttattttttccgaagaaacaaagtttggtcacagaaacccagaatagtacactgaacaaacatatccttttggattttagcaacaaatcccaaaggctgaacacgtaattccttgaatcaatggaaaatgggggatgatttgtttggccaccaagtactacacacgattatcaccatcaacagtccaaaagtgtcttctgatccagcataatctgttgtcaacaaattaagtaaaacggtagtagcatgtaacttcaattgctaagcacatgctaaaagataagcaagtcacacactaatggcaaagctacaatttaccattagagcctaatccacaactacagaaaagtaagcaatcagtcacaaagatgatgaaaaaatgtaaggaatgtgagtagcatattttctaatattct

SEQ ID NO: 5614 - DNA, 1030 bp, Glycine max
  Soy_ogl_5972 Gm18:6783901..6784930 Cluster 25
aaggaactggttgatatttgtcttctcacaatctatatcatatatcatactcatgcatgcttactttccagaagttctatcacgtgtcacatatttagtttaaccttaacttaatttcttttggcattaaaaattcaactttttttttataaaacactcgttttaatataagcttttggttgagattatactcaaaattaattctacctaactttaatttcttgtaacatttttcgtcaattagctagcattaagtgggtgtcaattaagaaaataaaagaagaggggggagaaccaatatgacagttgacagatcattattcaacctattaattcgaactccaagagtccaatgccttcattttcttgccgctttcccttaaataaaatagaagtagaggagtacgtagcccttgacaaaaatttaaaatgttagcaatatattacctcttttgaaataaagtttatttaatgcatctagtatacgtatatgtatgttggttgttggatacagattttctgcggctgaaaaaataattatagaagatacagttgtctattctaccatctatatatatttttgttcttttgaagtatatttttctattaatatttatttaagtaaaacataattcaatagctgagatgagatgcattcaaataggaagtgcaagagatcttgatcctgtcatgatattagtataaaagtcctcgcagaaaagatggatccaaagataaaataattaaagttcaaattttagggttcatcaacaaaaaatatttactattaatttgtaaaaatgtctcatgtgttaacaaagtatacctatgttggcaaaaataaaaccctactaaatagctatttcatttaaagtaaagtattttttcttaaaagttatttttgatctcaagccgaccaacctgcttgcaaaactataacatgtcatgtgccagataatataacagatcaacctgttacacacacatctctcgtggcattggcagtcggtgagacaatggataacagatg

SEQ ID NO: 5615 - DNA, 1381 bp, Glycine max
  Soy_ogl_1347 Gm04:42394620..42396000 Cluster 25
aaaaataactaatctcacacaaattttaatgatttttattgtgcagaaaaattgaattacactctatttacattgtaaaaaaatatatcttttgacaacaacaaaaaaaattcagtcgttgttgtggacaacaatttcccaacggtgtttttttttttattggtgtccaacggtacttttttgcactaatatagtcgttgctcaaaaataacattataataataattatatgctatttttattttaattttttaggggtaagcaaagttgtctaaacaactgttacctcgaaagcaccaatccatatgacgaagtatcaggaattgctttgcaagcatcttgcttcctgtgacgcctcgtcttataaatacaatcgacatcagccatttcaagtatgcttgtatcttacatttgcacggttttttttacccaactacacattctttttcctcaactcatgttttttgtgaaaaaatataaaaaggtggattttggaaatattgaggaaagagagtgtgtagttaaataaaaaaaaactcatttgcactgtatcaaaatcaatggtggaagggtagaattaatgtttttataggtatctaactaatctctttcacaacccagttgtgttagagtgaataaccacaatccataaagctcaggcctccattaacgagaaccgtatctcgatcaaagtcgaccttgaaaaccaacattggcactgtctttgagatattttgataaattcaattcccaccctccatcttggctcccatcattggttttgcagtcgacttgctagagcatatatagtcgagaatggtcctgccaaaagcaacctaatatctctcatttgccagccttaagagcagatagtcaaattgcacaatgtcctaaactacctccctattcattaaaccataacccgaagcatcatataaggaagctaaagcacacattaattatctcaaaaccatatatgcccagtcatcaaggttgatccctccacgaaaaatctcgagattcaaagacagtttaaaatggtcgtgaaaaattatagaattatctttgaaagcggtttttgtagtaatgctcataatagtattgcagctcctaaccaatacatgccaattaaggcctcagccttatatgtattaagttcatggtgatgcttcataccccacttaccttgctgaatcaggtttcatccccttccgaaacccttttgctaagcatatcacttcgaccaagataccaaaaaggtaatgagctttcttgccattaatccttaaataggtgagaaagacccttcaagaacttcgattctttttcgaaaaagatgttgttcattgaggctctatagatgtagtgatatgtacgtagc

SEQ ID NO: 5616 - DNA, 1070 bp, Glycine max
  Soy_ogl_999 Gm03:40525974..40527043 Cluster 25
cctatacaaatgagatagtcacacatgttatcaatcatttcatgatcatcttagtattttttgtctaattttgaatgataataatgttctactaaaattgttcaattttaaaaacattaagaactaaacatgcaattaaatttttatagaatcaaaattgtaagtcggtgatactataggactaaaggtgaatttaagtctataattattttagcatgtgggtagttgccctgaaatgtcaacttgcaaccttgttgtattagtatagataaatggtttctaaatggacaaaccttctattcttttcttttgaataattgtttttggtagactaaaaaaaactctaaactctaaccttttttgttcagaaaaaaaaaacatttagcaaggaattctccccgttcctttttaattgtcaaatttttgaaaaaaatttgttcctatttatcttacattcgtaaaattcaagattacattaatttttttttatcaactataccttatatgttttcttatttttaattaatttacacatgcatttatttattttgaagtgaaaagaaaaataagtgaaataagaaactcgacaattattttattagaataaaaaaaattatagtatttcttgatttttacaaaataaccttaaaccaaaaataaaaaaaaatggaggtagtaatggttaataacttcgaaaagtgtggttgacttgttaaacaaataccactaaattaatagcaaaccactctttcgttaaattaattctcataatttagaagcatcttcggttagagtttctaaattaaattaaaatcctggttcccgctaatctttatagtcatagctagagtataagctagggatggaattagagaagcaaggcatgtgaataggaataaagttgacccatcgcatgggttgcacaaagaacctacgcatctccttttatgatatgggatagttttccctgtttctaggtggggttatggtttctttaatttagaagatattcgttagaaatttctttttttttttttactttcatttttaattacacaaatgtccccgtg

SEQ ID NO: 5617 - DNA, 1523 bp, Glycine max
  Soy_ogl_4367 Gm13:30624678..30626200 Cluster 25
ctctaagaagaagaagaaaggtctgatggatacctcatacctgagagaaccttgatagtagaaacaataagatgaagatgaggcaaaagaaaataaccaacattttttggagcattagcatttaaagattttggagtaactcagattctaagcaagttttattgttatttggctggtatgaaacttcaaaatatagtgagggaattaggaaggtaatgtccttagcttatacttttacattattctctttctgaatcttaattaatttgtgtgtcagctcataatatgcttctatttttgatgcttcattgacatggcataaacacataatgttttccatggactcatcagttcagatcagtaaacaactaaaaatctttaatgttttcaactaattaaattaagtgaaagttttaagttgtcttcgctgcaattcgtttttgtgaagtctttcctctcgtcaatgatggtgcttgaattggaagatttcctctttactttagtgtttgttaatgccagagttgttatcaacttatcatttatcatccagccgtggaaactgttctcaactgtgcattttcgaatttctactatcattatagatttcataattcaatggttttctcatcatatgatttgtgatgtttattgttttgttgatgaagttctgtttgatatttctatttattgttcttgttcactttgttaatgacctatattctaatattctattagtactttaatatacaacactatttcctctttgaagttttaaatgttatgtattcgaaagaaacatagcgtggctttaaatttaacttcattttttcagcttttaagtttgcttgtcaaacagtgagttgttgctagctacattattcattttgtctgttagctgcgtaacctctttgttagtgatggttcattcttggagaggttcaagcagttttaacaagagaaggggaagaatgccgaaatagagcaatctaaaccaactaaagttgttaaattcctaatccctccattagtcatggtgctagttaatgatgcaggaaaaactctggttccagtgatgtgatactcaacagaaagatcattttggttgaagagaataggaatgactttggtgtgtccatgaaatggggtaatagaggttttattgttgatgttttgcttcaaatacagtaattaattgcttggaatatgacagctacggttaatttttatttttatttgttggttgaaagatcaatggaacctcaaatgtgaccaacaattgtgagtgcaatgtgatagctaggctcaaagagctctatgctacactactcctaaattctacaactaaaaggaataaacataaaattgatattcttcattgttgattctttacataatgcataccctattaaataggattttacaaagaataccaaccatacaagtggcacaatctattaaaggataatatctaaatcttctagcctatttggacctctctagggctattcctatcacaatgatat

SEQ ID NO: 5618 - DNA, 1200 bp, Glycine max
  Soy_ogl_5367 Gm16:29490801..29492000 Cluster 25
gccaatttccccaaataataaaagatagtgcacatcgaacttgcacattactgtcatgcaagcaaatcgtccatgaaaattctgaagacttctatttgcaccttccttgttttaaggaatattgtaaaaaataaattaaattaaattttagaacaaaagaattatgaatagaaaaaaaagatgcgaatagaattacccaaagtcttatttgcgttctcatatttgaagtttgaaaattcagaccgatagaccgataatataaaagatctgctctgacaaaaaaaaaaaaaaaagaagttctgtatgttcgtatatttggtcccaaaggattgtgcttgatttcacatacaaaaaattatagcaatcttttttttaaatgaattatagcgaattattgatgttcattaaaaatgtttatattactaacatttcagggtatctagcatttttcaagatttttaaacaaccaattgaccaaaacttgcgtgagtcatatttgatataaaattatatttaaaaatatacaataaaatattatcaagacacaaagattgaatttaaataatttgtattgtatgtgttggtataagtttaaatctcattatctattgtagtaaagaaatatgactaagtgacaatacaaaggtaatgataatatcatacctatacggtgtcaataacaatattcataagagttcccatttaaatgttaatgatttaataatgtgtcttattaaagctatattagcaaaaaaaatcgtgggaaaaaaatttagtgaaagaaaaagtacattattcttcaaacatcataaaatactgactcgataagaaaatcttactagctaggagaactcaatatgaaaaaaatatggttaaggaaaagagaatacaatacatattgagagcattaagttaagaaactggtgaacttcttttggtggagataatgttttgaatgggaaaggcatttgatgtagaatatgaagattggtaaggattaagaaagagggatagttggtgttgcttggaagatagctctggttcatagtcggttacgtaagcctataaagctctacttggagttttaacgtgcgggctcgcatcaagaagatattttccagcaaatttggtgcctcaaagtccggccaaagattattttttttctttctgtggagggtgatgtgtaataggctaccaaca

SEQ ID NO: 5619 - DNA, 1542 bp, Glycine max
  Soy_ogl_568 Gm02:15608601..15610142 Cluster 25
caaacttttttttattattattatggagaaagtaaatttcagttaaacatttgttgacacttggtttcattaatattagtccatttcaagtgacatttaacatgtcttaagcatgcaatgggaagttgataaattcaacaagaaaaatggaaagttgataattactcttatttttatgaatgatcaaattattgatttttccagaatatcttttgtaagtgttcaataagtttctaggcatgttttgattccggtgagttttaaaatccaacacatctaatcttttctttataaaaaaatatatatatatattatgaaaaagctcggatgtggaataacattgcattcttaaaattactcccaaattcttccccctttggtttagttttatgagccatttgtttcaagttatacaaatgtatttcctggaatataagttgggaatgtatcatttccatgcttggtatgagtattaaaaattattctcatcagacatgttctattttcaaaaatatatattacacattacttcttcactttctatttccatgtaaatgggtgggaatattaattatattctcacgagaatagtagttattgtctaacataattttctactttcaactttgtttgatttgatttttttattttttaattgaaatgaattttaaaataattcaagaaatgttaattagttcaaagatgttaatgagaataatatttccagaaatattatttcctcgtttatttttattttcaacgaataatttatcaaatttattgattgaattgaaatgattatttaagaaattattgaattattcttataaattgttgaatcttttttcttttccaaaacaaacactaccttagagcataaacaatagaacgcttgaagttgggttcccaatattatttgacatttcgaaaaatgaggaaggtgtaatagctagcatgggaaatggatggggagtgtttggcagtgtgtgaagttggaggagaactttctttctaatgggaggaagaccttctgctaaaacttaaaaccttgttaattacctccttaggacattaaaaaaattgcttcttattaaaaaaaaaaatttagacaacacacaaaaaagcagaaaatatttaattaaaataaaattaaaaactcttaaaaaaaaataataaaaagcttaaacaaattaacaagtcttctgtctcttcaacttttaactttgcttctatcctgtcttgaggtagcttcaatattcgggggcttgatggtaagatgcttaatagaatttggaaatgctctatatccactaagagtatagccagtgaagaatgcaaaagtttcttaaaagattataatcaagaattaaaagagagaaaaaactcaggaaaccttatattagttcatgtcttcttaattcgcataccatcaagttttcactctacaccaaaccaattacaagtgttatttgctccaggtctctttaggcttatacaacagtagtagtatttaacttcccacttcaagtaataaagtaagta

SEQ ID NO: 5620 - DNA, 1400 bp, Glycine max
  Soy_ogl_3449 Gm10:38960901..38962300 Cluster 25
atgcgaaagagttaattttgacctcaagaaaataaacaagttcccaagtcctcgctcaccaaatcttagtgttatgaaagcacttatgcatattgctgataatacatgacctaacatagtattttctataactttattaataaaatatggttctttgcgaagctaacgatattgagatgaaaatgagaacattctttgatattccatcaatagattcgcagttgtgaggttcaattagttacacaattgaaagatacctatagagtcttgtaaagttttgtttttttaaacgagattattgaactcaattaattaagattcaatataaccttcggatattgaaggtctaagactaaaggtatacttatccacataaagcaagatctcgattaagttattctcattttacatatggaaatgcaagtatacagattacatcgacaatgatttataatgatttatagtgtgacaattatcttacttttcaatgtatttcaacatgattgagtcaaaaccatggattgaggttcaactgagttatttattttaattttatgtgagccaacctattaacccgtcttaacttttagacaagctaacacagtttgggactttgggctaagactagttcagatctttaggtaaacgaattctactcttgtataatggtttgagaaaattttgtcattccactcacattgctaatcacttctccatccaaatagttcccgaagctaacaaacaaaacaaaattaaagatacatgaacacgtgtacactacattttgtaaaagtttcccatgtaaacgaacatttttccaataggagccgaatgttgcttctacatttactgcatgataatgagaatgtttatttgaagccctcaaacgacagtccataatcatgtacccctatataaacttctacacattcttacaagttttcctgattaaaataaaataattttcctttcttctattttatctctttcttcctttttttattattacaaaaaatataaataaaaatataatttctctcttttttcaacgatcggatggtacaagaaaaaagaaactgacatgagtaacttttttttataattggcacgtaaaagggtgcatttttatttattttttttatattttccacctaacagaaaccatcactttttgaaaaagaaagaaaaagttaaacatagatgataaactataaagagtaaggaatcagtgtatgtccgataaaaggttaaactaatgagtacattaacattttgagaaaaatatcttacaatttaaaacttatacttgtagttaaattgatttttttttttttttacaaatatcacctttgaaagtaatcttgtttaagacatatttaaatatcaaatgtgataatttc

SEQ ID NO: 5621 - DNA, 1821 bp, Glycine max
  Soy_ogl_2441 Gm08:803480..805300 Cluster 25
tattcttgggtaatgataaaaattaggagaaagattagcacgaaagttgacaatgataactgagacagtaattaagattatttgttcatttcaatttattaagacagtagtatataatatcagatggagggtggtgatagagtgctaattttactctatcactactcctaagaaaaagggaatacatttgtatagtcctagatgttattaatccatggataatatttagccaagcgttaacatcatattattctaagcataaataaaataaaactacaatttataaatatctagctccattttatataatccttgaatcacttaatcatctttcttttgggcctctttggatccattctatcaggtttgttaaccgcaaagtagagaggaaacagagagtggaaaagggaaggtagttgcatatttaaaggagataatggcaccattgcggaagcgctttccgtcattaacgagacagtcattgtagagaaggcgcttgaagattttagggtttatgagacgcgaagaactgaacatgccacaagcaacgtgaatttcagagatgttgcagccactcacgcacgtattcgctatctcaactgtgtatgtgggaatgccacttgggagtcgttccgtcggactttggtttatttgtataacggacttactgcacttttcctctaccctctttcctcttctgctaccttcagcttctgcttcacacattgctgcatcacattatttgatgaaaaatattattactgagaatgtaattctcataaaaacatcaatatttaatggaccctcactaaccacaaatactaaaatccaacataaaataaaaacagatagtttaggtagtaaaactaaaatgaaccataatattaatttaatccttaaaaatatttatgatgcatgctgaacaaataaacagactaaaatacttaattaatttaaacaataagcaaaaaaaacagcataagaacaaaaacagcaatataacaaaacgaccaaactgcaaccgtgcaacataataaaaaatttgcggtaagtttatatgaatctgactaactcacttgcaacaaaagcgaggactccgaggatgaacaaggatgaggtcacggtcgagcgtgagatttccattgaattacaacggaagcactgaaacgcccaaaaagaattactatcgttgaggtagaaaattaaaagaaatccatactatgacattcatatgttactaattgcatgattgatttcacgttaaattcttttaaaatactatacaattaatgtgattttagataaatttttatatatttaattttacgaagaattaagtttgaattcaaaatttcaaaagtaactatgagatgaagtaatttttatatagaattttactaatgatttaattttataataaatataatagaactattaatcaaacataaatcacattttttctgattaattcggtcaacagtgatccaaaaactcaccaaagggataatacagtgaccacagtgcataaaaattaaatcagaaactatgaaagtgaaaagggagaaggagaatgtaggaatggacaaaaactgcatgaagtgaatttttattgggaaaatcagaaacgacaaatcatgacaaaaaggtaaacatgtatgtatatacgagtgctcatatttcatacccatgcagatagaggagaaaagaagcacactcacctttgaaattgaaactatgaaagctagcgaggattttgcagagctgcagcaaggcaaagacagaattgtctctctatatatcctggcatacataaggacaaag

SEQ ID NO: 5622 - DNA, 2200 bp, Glycine max
  Soy_ogl_4259 Gm13:25370401..25372600 Cluster 25
ctgtagctggtgcctgatggtgaggaagaagaaaaattaaggacactgcaaaaaaagtgttcccaaaacacacttactgttcctatttttttttttcctataaattcatcaaccacatcaaacaggagagtggttgttgacgagaggtcacaacataactcagattactggtttacgtgttcctccataacaacagtgtttcctctccatcatgttttgatgcctcgatttgacaccaccgatttcgatatgtcgctgctagctgcacactctttatatatgcttatgtcacaccccaacattatattatatcacccctgttctttgcctccaatctttttgtgctatgctatatatgtcatcccccaacacccatctattaatttaattcttctgcatgcaatgaactatcacgtacacatgtatggtatatacaatcacaaatttataatcattaccatgacaacttcaattctggctagctagctctttgcgaactcgtatgatgtgaatggtattaattaatttctcatttcattctctctctctctctttaatttgtttaggagaggaattgaagcatggttgtgttggaaataggaagaagcatgtgtgtgtctcaaactttttgtgtgccagagagtttcttctgactttgtttgtggtcacattattagatgtgatgtttggtttggattgtactacaattgatatgagcatattgctaatatataaaaagggtgactttattttgtacttgctgctgtagctatatccctccccaaccaggacgagggtgttaggtaaacaaacagtctccttgcttgactttgattcgattcttcttgtccattaattggattcagttcttcaactcacttcgtttttttcggataaaattaattaaacttgttcgttcggactagctagcaagaggttggaaattcgtatcactctttaactttctttttttcatgttaaggaataaaagacaaatattaaaaatttacaacaattcatacttattatttgtccaattaagctaaaactccttggtgtcactgtttaatttgatctctaataatagtgtcatgcaaaagcaaattataggctctaatttgaatatttttaaattattttagtatttaaactaccattggctaaggggattttgtgacacgtacatttggttgagtcttcacattaactgtgatttgaaattgtttatcagatttcttgggttggtatgtgatatataaattcattatactataaattcttgctgaggttggtagtcttccctgctatgcaaaggaatgccttcttaaataaacttttaactaaaaaaaactatcattattggtccttaatattactcttctgaggtctttacatgacaagcaaataagtagtgattatgtttaatatacaaaatttgaagaataatttttttccaccaataaatatgacttatattatcattaggtcactaaatgcatcaattttacatgagtaatgaatgggtgtcatccaacctcattttttatttatgcaaaagtttatcataacatatttcactttcaattaaaaaacattgttttcttttataaggaaaaagattggatccaaattcctgcagttgaaaaagaactatagggagtgcagttaaatcttataccacacacttattttattttattttttattaatattttatttaattattaatgaaaattttgtcgtgagatataaaaataccctcttgcagttatttttttaactgcagggtatccaaatctgaaaagaatatatcaatactgggtgtgctagtggtaaaaagataaaacaaccgatttatacgcacacacaataaaaaaaaaaaaagaagataaaacaaccaattgatatgttacaaaatcaatatgcaaaattcagagtcatccctcccatagctgtcgaccaaaccaatagccttgctttgttccagactctcaaatgacaaaatgacattgaaacttggaatttttagagtttagcctagtttaaaacaccaatgataaaacaacaaaaatataagatttaagtctatcgcaattactattaataattctaaagtaaaaaaagtcacatgtattaacaaaaagatcaaataaattggttgtttaaggtccaacctattagaaaaaaattcagcatattt

SEQ ID NO: 5623 - DNA, 1700 bp, Glycine max
  Soy_ogl_6355 Gm19:2973901..2975600 Cluster 25
gcatgtgttagaaattagaatatgcttatttgcacaaaattttgaaatattctcattgtttcccatcaaatacattaagggctactcttgtaaatcttatgcttaagtgttgtggagaaatgatccatggaagtagtagtaaaaacttcatcaagagaaagtataacaccattaaattaaaatatgcaaaaagaaaaagaaaaaaactagggtgaggatgagccaatggtttaataggacactgaactaatttgtgcttagtaatgggtcctattcatgtcatgtagggcaccttgagaaagggaaaaacatcgtgcctcatggacatgcacctaaaagaaatcttcaactttaccgtgctgcactccaatgcctagatagctcttctcatcatcaaagatgttcccatttctgtctttacatagagaaaactagagcagtttgaggtttcatctgattgaaagatgtacatagtgggcttgttctgctcatgcttggcatgtatttctctttcttaaaatatgaatttatgtttaatttaattttaaaggctaactcataagataaaaattatcttccacttatatattatattttaacattatttttttacttatatattttattttaacactacttttaatcaatgtaaaacttagatttctcttgatactcttttgccatgagtataatgtgtgttttctttgggaaggaccgcgcacaaatttattactcgcggcaagttcaaattatatgtacaaactctggcaataatccttataaatgaccaagtgaaaggacatgacggttaatttcccaaaaaaagtatcagagattcgggtatatcactcatgagtcatcaacacaatcacgttgacaaattgatttgtgcaagagcaatgccattgacatgaatttagtaccttaatttatattaccttaactaattcttcaaaaaaatatattaccttaacaatattaaatcaaatcatatttgttaggagaaatgttgtactcgcttcatttaaagtcttctcaactaaaacagaatctctttagatttaagaggaaggttataaggataggagatttaggctgtgtttgcaattacagtcaatggaattaattttgtggagatgaaaatgaatgatgtttgtttgttataaaaaaataagtttaaatatgatgagactcatttatactactatttcttacctattattatccatacctctctatctctcatcatctcttttcaatcaaacatttttaatataatcattgctttatttttcaattacttttatcctcttatttttctttttatctagtctatttcttttctataaaccaaacactgcacaaccttaaatatatttttttactttaagaaatgaattttgtccattagatataatttttagaataaatagatgattttttttttctctttcccaacttgttcctatgtctctcacctccctcgaccccacccatttgttggcaaccacacttccgctactacctagagttctctacttatcaccctttactaccacctttgcccctctcttcccttgttgctcacttgctcctatggaaactgctatggaaatatacgattattgagagaatatcgagagatagagaaattttgagagacaatcagagtgtatttgtgtattaatgtatgtctttaa

SEQ ID NO: 5624 - DNA, 1090 bp, Glycine max
  Soy_ogl_619 Gm02:43034111..43035200 Cluster 25
taaccgtttatgcggatcatattattgaaaatttatccgagaatataggtcagttgattgagtggagattttaaatcttttaatattgtcttcaattattgtcagataaaaaaatattaatgaaaatttatatttatttcaatataatacaacacttatttatctacgctaaatttactatatttgaatactacattaaatattaataaaataacaaaaatgtagactttattgtactttatctataattgacatcgaaacagcgtcaaccaggaagaaaagaaaagaaagattctttatctatagatgctcaaggttttgcaggcaccatatttatctatagaaagatatggtgtgcctcaccgcggtgcccccactttatttatgccactagtaaatgaatttcaatttaatgtacctgaaaatattttggtttacccattaggtcaatggtacgtgaacaggtgtcaaaaaaatgtgaacatttttattatatattagataaatatggttcggcatctgaaaaaaaaaaagtatatataagacagatgatataatccgacatgaaaagataaatagaaaacaaaatagatgttaatgaaatggttaaaatataggggtgttaatatatatatatatactgagcttcctttttttgctgagatgagtgttaaaatatcatctctcttatataatagtatataggattcagatgtaaatttaaattaaattttgctaatacaaatttaaaaatccacaatatatagcttaattagtaaatgtactttccaaatatataataaacacaatttatttaacattagttagatcgcttgattatggttttaactcttcctgttctgggattcatgcgatatacgatagacactacaaaggacaaagttgttggttttcaagaagcatgaaaatcgcagttcaattactataattaaaaaatgcaaaattattttttgaagtcttagatatttatccagattcacgtaccatactttttagtaatcatgtttattatagccagaagaggaaagtgacacatttccaatttgcagcgtagagaatcatacatgca

SEQ ID NO: 5625 - DNA, 1173 bp, Glycine max
  Soy_ogl_134 Gm01:40962718..40963890 Cluster 25
taacaaataaaaaaaatctggtgggagcaattgcccccacgacagagaacagcttgggcccccacagcacataacctgcatccggccatgctgatgctattgttccatgcagagggattcgtcagggcgaccctctgtggccgtatctttatattatattgtgttgaaagtttgacatctttggtggagaaaatggagaggagggataattttcatggtattaaggtagctcgtggagcaccgattatctcccatttactttttgctgatgattgttttatgttttttagagcatcttcacaggaagctgatcacatgaagttcattcttaacatgtacgagactacctctggccagaccttaaatcttcaaaaatctgaggcgtactttagtgggaatgtggaccaatcaactcgccaggatattctgtcccacattagagttcgggagggctagttgaatgcaagatacttggggctgccatccttgattggaaagaataaaagatcagcgtttaaatatatcatactcgtggaggggtagagccatatcttttccctcattcgctttgtgactagctctaaaagatgatgaattccttttggtggggctcaagacgcagtgatcataaaggtattattaactgtttgtctttggaaacttatatggctttaatctcactcttctagggaagcaagattgggatttgatctccacccgagaaactatgattgctaggattttcagagccaaatattatccaagacggtacttttggatgcgaaggttggtacaacacattcagtaatctgatgcttgagggggaaagatcatggaatgagaatcttgtccagatgttgttgttggatgaaaatgaagccaatgatgtgctgagagcccctatctataattgtattcattcagatatcagaatttggggccatgagtctaatggtaattactgttaggagtgcatataaactatttatgaatagtattgttaattcaaccaatgctcttgtaccgggcaattggaatctcatttgacagctcaaagtgcctcctcgtttgaagcttttgttgtggcgagcttgtaggggacattgttcctacacatgtccggcttagagaaaaccgtgttgactgttcctcggtatgtattctttgcaattc

SEQ ID NO: 5626 - DNA, 1600 bp, Glycine max
  Soy_ogl_5724 Gm17:34959101..34960700 Cluster 25
ctaacattttactcaagaaccttcccttgtcttcagctcctcaccctcactttttctctctcgatttctcttctgagcagcaggtccctcttgctctcccccacaactccttctctgtttcaaccaaatcccccttttgatctcaacccctttttatctcccacactgcatgtggtttccccaaatcctccaccaatctagacggagccctcaccacggtcaatcttcacatcctctcagtcatttccaacctcagtaattaatgtagtatgaatatccattaggccccgtagatggttgctcaatgtcagataaagatcgatggggaagtcacccatctattactcatcccaacgtggtattaagaagtggaaatagaaagaggatttattgtttgtaccaggtttttctattgagagtcctacgaatccatatcccacggttgaacatcatccatcatccacatcccaacacttattagtgtttcctacctttcatcctatatatagtgtacctatttgtaacttccctcaatgtacaaaggattttctaaaagatatttttctccggcatcgttggcaagatatctctgcctttacttgctgagacctcaagccttatggtatagctcaaatttattactaatgttataaagtttgaaagaaaacatttgttttttttttattaaagttgactgagagccatgctataagaaaatagttaactttttttttttttttttttatgttagcttagtgtaaatccttaatcttttttttttattttcctatacaaaatctgaatgtttatatataactccaacttttaaaattatttaacttccttgtaacatagtcaagtttccctaacacttaaaatatttttttacattttattttattattattctttgtttcgttgaatactacataatttgtaccaagttaaattaatgaaattttagttaaaaagtttcatggtaaaataatttcaattaattaataaatcaataagatgtttgaaagaaattttttctcttcagcactggattcctagtgttggccaaatatgcttggctttttaaagccttgaaattgttctcaaactttgcacaaatcaattcaaataattatttttatataaaatctataatctaatagattaatgagtaaattatagcaacacctcctgttcaggttttcactaattatatatgcacctcctcctttttcagatatttctttgacacctctcgtctaaagacaacttttgtaaaaagaaaaaaaattgaattacatttctaagtacccttaacattttttaataaaaaataaaattgtaccaaaattaataacaaataacaactctttctccataaacattctcagtttctttctcccccacacacaaccaacgcaccaccataactacatgaaaccacgacccaaccacctccaaagccctcgaaaccacatccttaccgcccattaccaccgcctattcttccatcttcgatgatgtcatatttgactcaaatatgactccgcaagggtgctagacaaaaacattttaagagtattctaccttgagggcattttag

SEQ ID NO: 5627 - DNA, 1200 bp, Glycine max
  Soy_ogl_10 Gm01:716101..717300 Cluster 25
aggacgctcccgttttcacaaacagatggttggaaggaaacatgaaacatcctctcatcaattggccacattagtactatttagtattttacttaacttgtttctctttctatctgtccttgtcgtgttgagttggtgtggtttactgttattgtcgcttacacgcctcaccgaatgtccatgttccttctgctatgctatattgctatgttatgtgtgcatttgttttgtatcatatcatacgtgtgtgcctcactgagagagggagaggacacacggaatgatcataagggtaatgcatggttggtatagtctagagactagagattagagagtgtgtgaagaagatagaaagtagtatgattattacttctactttttttgtcgtaggaagggaatgcgacacatcaacgatgatatatatggacaccctttgattacatatacccttttttttttttttttacaatatatcatttattacatttaagcttttatttgatgtatgtatataccttttagtattagggtttcaaataaaatgaagtgtacatccatcattatttgttaaaatatgtagactactcatttaataagtatatttcaattatcaacacacattaaatttatgaaaaaaaatataaatttgatttctgcataataatattttttaaaaattaaatataattaaactttgaataaaataattacaattgttgttaataaaaacaatatgtagaatattccacaccacccttcatctgacagcacccagagactcacacttgggaggcaccacttcttctttttgttttctaccataaggggaagctcacccctgtgcacataatgcagtgttgttgtgttgtgcctcattacttcattgtcccactgccccaaaatctcttctccacacttcggacccagcgcctacaaaacgccacgttaactatttaaccacttgtgcctcccaaaattccccaattcaaacatttctgcctcttgggttatcctcttaaaatccttcctttctttctttctttgcatgcttagctaagtttggttagatatttatgccaacaatttagttgcctatagtatatgtggaatcatggggggaaaatgcatgccacttaaacaaagttaccaattcagagttagatatgtcttcaatcatcatgccacttaaacaaagttacc

SEQ ID NO: 5628 - DNA, 1000 bp, Glycine max
  Soy_ogl_455 Gm02:9383001..9384000 Cluster 25
ttttgaaaaaaaaaaaaactcttaataatgtattttatttaatagcatttagtagaataagattattatttttatagctagatcatgccttagaataaggagacctagtccaagagcattcaagtgtaaagtatataaggtctttctaagtaagccattggggtttatatggggtcttccctaattgaacgatctgattgtctcgcaaggatctatcatatctatcttatctatatcacaggcaagttgtaatcgttaaagaactatacaataatcgactaagttataagtaacatacaaggttgttcttttgactagtcataaatacgtaagaactatatttgatagcgtaaagatcctttaagcgttaagtataacatgacaaaataattgaatttggataagatgtcttttgttgtaggtctattgccaaattgaacttgatgtaatatgaaaaaatttagatgttaaaaatatggacgatgatagcatataaatgttcaccctaaggctcttggcgtcatggttggtcttataatacgtactaatgtcgatcatgaggctcttggcttcatggatgatcttactcatgttgatgctgaccatgaggctcttggcttcacaaacagtcttactcatggtgatgctggccatgaggattttggcttcatggatagtcttactcatggtgatgcaaccatgaggctcttggcttcacaaatggtcttactcatggtgatgctgaccatgaggttcctggcttcatggatggtcttctcatatagtttctaaccaaaaggctcttggcttcaaggacagtcttactcatgtggatgcccaccataagacttttcgctttatggaaaatcttaatcatgtagatgtaagtttttttttatttcttcaagtttaccaacataaagaagatgacttgggtgtcggtaagtagtgtaaatgagcaagggttgttaaaattatcacaacatcatataagggtttc

SEQ ID NO: 5629 - DNA, 1000 bp, Glycine max
  Soy_ogl_6184 Gm18:55499301..55500300 Cluster 25
gattgctcccaatgccctagatatatcctatctatcttttttttagatgattgcttgtcgtttactttaacaaaatctttcccaaatttcacttgtcaaagaagtccttgatatcttttgcaatgctttttttgggttgaagattaatattcaggaatcaaaatttatgacatccagaaatgtctcccatgtcaaggaagataagtttgtgtctatttctcatttcaatcgcactctacaaatagggaaatatttaggattccctattcttattgggagagttaaaaatgtgaattttagttacactggacaagattatttgaatgttggcgggttggaaaatgaaattgtgggttcaaatgctcgaagctctagatatttaaaggagagaaccatgattcatgcgtcctcaatacacggggcttcttatatttggaactctatggctaaagctttatatcatatcatgttgggcttcacttatagaattggcaaggggaacatctctttattatggtatgacaaatggctccacaagatgacttcttatgcaaactggtgccttatgttaatatccaagatactcagtatcttcaacttcgtgacatttaagaccaaggcaagtggcattttgagacactatcttcagcatcatcaaagaaactggatctcaggattttcaggtcattgtggcatttctactagtctcaaagtggagctgttggcctatgcttggcgtggaacgacgaccatagatttactgtttatgagaccgattcgaagatggccttggagctagtcaacaacaatttggaagctttgttatcgttatctcccattcatcaggaagattcaagacatgctagccttggactggaacgtcagtttgcaacatactctaaggaagacaaacttttgtgctgattgacttgctaaatataggtccaaccatgttgatggttttatttcttgcttactttttctccttctgatctaattt

SEQ ID NO: 5630 - DNA, 1063 bp, Glycine max
  Soy_ogl_6301 Gm19:166301..167363 Cluster 25
taaagccaaggggtagcggtcaaggagttcaggtagagatcaattaattgcgattttaataattaattaattactcacacaacaccatgatgattgaagaaattgttaccgaaagtggggtttaatcaaatcaaataccacatatattattccattggccgatctgtcttaaacttttgaagactgtgtgaaaagtttagtggggccattttagttaagtcatgtaattggaattattgcttcaaatgggaatataaaaaggacattgtctgcttaatggtcatggagattaaacataaactatgtatatactcctaagtagctaaaggctataagaattttaacaaatcaagtgcaattgtcgataaaaaaaagaaatataaagtgagtgaacggttaatgtgttaaattaaacttgaatcgtttgaatatcatgtgagtttaatccttaacaaaattaatacttaattaattagactttatttatcttttaattaaatttcgaatttgtgacagatttttttcttttgataaattgaaagggtaaaggaaaaaaaaactctaacatgtgtccagctgaaaaggtgtttggtgtcattgaggaatgaaatcccagtcagtggaaaagtatggctcactcgttcgagaaaacgtatctttgcaaataagatagcactatactgcactcatgccattagtcaggactttggagtaaagaattaggacatatatatagttgaagtaatgccagatttatggaaaaaaaaaaaaaactagcaagcaaaaagaaagcacaaataggaattctaattatttttttagtgcacttttttcttcttcgcgtttattactattgagtattgaataagcatgagagagttattcagcaagtaacttcatctacaattacattatttatatcgcaggggcaacattgagagtgtgatgataaaactaaaaaaaaagcggaggcaacatttaataaccaataaagttgataatacatcacatcaataacacaataaattacaataagatttagttgtaatttttatcaatccat

SEQ ID NO: 5631 - DNA, 1800 bp, Glycine max
  Soy_ogl_165 Gm01:44891101..44892900 Cluster 25
cattgcttctctttctgcttcttatgaagagttttgagtgtgataatttctaaactatttctattttatcaggctgggcagatgacaatatactttattaacttgatgcctagatttagctattgtagatggggggttatttggaagcaatggtatgacactaatttcattggaaatgggacttatcaggtttctattcgactaagtctagatatagttggttgattgctaatcgtgggcatagcttgggggtcattagaattggatttggaaaatgtaacttccagagaatgtaaagttctttgtttggaggcttagtcataaagctccccctactaagatttttatggtgcaatgtcgtattcctattccatatactaagagttttatggtgcaatgccatattcatattccatctatttgccctagatgtgggaaatggtaaggaagattcacatcatattttttaggagtgtagcaatattatgcaggtgtggtagttgttgagcattagggtgttgatccctaatagggttaacatgaattggcaaacgtggattcatgctcagatgcaacatgtgggaaggcttcttttgtgggaggtgtggaaggctcgtaatgagtctgttgtcaaggggaagcttattacaaacaactagattgaggccaggattcattccttgttggagtttatggccatggtgtttgatagtgagtttgatggtgtggagtctaatggagttagttagaaaaggtaggcctcttgtatgcttgtgtcagagaattaagtgactattcatgctgataggagttgtcgtgggaaacctggcgttgtggtttttggtggcctaatctgaggcttgagtggtgagtggattaagggctactatgggaacattgaccatgcagatatcttgaaagcacaactgttggggttgcttcatggtttgcaaaaatgcagtaatgttctttgtgtttcagactcgctgcatgcggtccaattgatcaagaagaaagtccatagctacaatgcacattatcatattgttgaacgtattagggactttttgaaggaagattggagattggagttgaagcattctctacatgaaggcaactagtgtgcggatgccttagccaagagcctaagtgaggagtggccatgtccgaggagctttttattttggagcttccgctgccagagatggctgatttacttctggttgatgttgtgcaagtctctttttagaggctttagttttgttcttttttggtttttgcttgtttcatcactttaccaaaagaaaacatttagttaaaattattattttttagttctcgtagaaattaattgttttagtttttattatttttatgtaatatcaaattaatttattttcttctattcatggctttttaaagaaattgtaaaatataaaatcactttttggacatttttatttgaatccctcctttgttgttgttgccgtctttggcgttggcgagatgatcgtgttgtttagcgtgagagtcgtggtggaatccatgaggaagagtgtgagtataaataatctctcgttggataagctccctctcaatgctaccaaccccatcggctacgcctccgtcgacgatgatgctccaatcaacttcggcaatgccaatgaagaaggcactcatggtttgacactcacgagtatgtcaacaaatgcaaaggagaggagatgaacgtttaaaaaataaaaaatgaaagcaccataatgtttccaaaagccacgagactcacaagcattgttataa

SEQ ID NO: 5632 - DNA, 2400 bp, Glycine max
  Soy_ogl_4195 Gm13:21990801..21993200 Cluster 25
caacaatctcataaattaattaagaatcaattggatttatactaggtcagtctttgggagcacatcctctgcccgagacttctaccagccaaacactatcctaacatgttctggttaatgggacgtcggtgagtagcctgatgagcacaactttgtcgtagaccaccttgtcccaaggatttctatttctgtccaagtcatttgaatggcttagggcacgatgtatgtagcttttcagagaaacatgaattttcccaactccttttctgatgtcgtccttgtcaaaaaaccgaaggattcattgtcataactggaagacaaaggtcaaaatacttggggtacatcaatgtggccttggccacctctaactctaagtcagaccaaccactcaacttgcatctccaccctctgtggccataagccctacttgaaagctcctcatttgtttgtcaaatatcgagatcttaatctttgacctgcttgattcaccttagtctaggggatatgatgtcctccaacacagttcctctaaagcaacttttcccaaggttgccaaaatcgcaaccttattagtcaccttggctctacttgaggggcatttcccttaggctttgtttgataggggagaagacatagaggataaagaaataggtaggcgagaaaataaaagaatagaaataggatggaagtatagattgtttggttaaataaaagttgttgagtaaataaaaaaagaaaaagaaaaaattaatatgatttttttaatcctttggtcagtatgtatttaatttctttttatttgttttttgttttaaacttggtgatttttcaaaagctagaacatatggagaactacacgatttggccatttttaccctttgatttgtatgagggaaaataatgaaccaagggtaggcaacaaccacaagaagcaccacaccaaatggaggagatgcacagtagataactgaacgtacaaatgatgtatcacgtcgatatgaggttatttttgtatccttacatgaatagtgtaaaattcttctcatttcacgcattctatcgaggaaagcttcttgactgggctcaattccaaattaaaaaaattcttgcttatttaaactttaacaaaacagggaaattcatgatttttagtgcccttttcttctcttcccctatcttctttgttgtttcacctctatcaaacagagggttaattctggtcgagtgagggcgcacctattgcatttggagccctatgtacgttgggtgaaaaagatatttaatctatcaatttagtcgaatttctgcgcatatgcatcggttcaatgccttttgcaataacactacgttatccttagccattgcgccagaaaccacatctcatggtcgtagtttttcagtaaaccactaacaaaatcaaatagcagtaaaaatggagaaagtaaatggcatgaaaacatgaccgaggagacaaggagatcatcaaaaattgcacagactctcggtcgaggaaggatgtatgaagatgatatcatctaacgtcactagataggattttaaattcaaatttattgcaaatgtttcaagccatgtttaaacgtcagaggtaggtaaaaagctcaccattcatgacatgtcacatatcccacaagaaccagatcaaaaggcgataagatgtcaactcattcatcgattgatgtaaacgtacacggtgtttatttccctgaaactttccaacattttcaagctttaaaccaagtgtcgttttgtttatgaaattatattgacttaggggtaactattttaaattggcctccgaactataagcttgtcgttccatcgccttacaaactggccttggagggtatacccgacatcattcgttgtacattgcgacatcttttcctactcatgacatattctacttagcttaggaagaccgaccaactttgacgtattaccgatatacattatgaacaccttcgttgtgcgatcctctctaagctagttgaatgacttcgacctcatcaagcattttgtgtgactgtaactatcttgccacgtggctcagaaattacagtaaccattaacgacttctcccactaaaagttcctctattttttttaatgttaatttcttagtataagaattcgaatctatgatcttttcttctcttccttttttttaaccaccaagctaaccaatcttaagatgacttggtctaccatgtatgttccttatcttcacttttcactcacctcttgttaatatattgaaatcgatttgcattggagttcatgtaattaattagtgactacttgtttatggtggaaattcatttgaataataaaaaataaatatgttgatcttccattcttgatttccacaaacaacttattt

SEQ ID NO: 5633 - DNA, 1800 bp, Glycine max
  Soy_ogl_4328 Gm13:28481601..28483400 Cluster 25
tgctcacagtctgcgactatgaaataggggtgcggcttttaccaaatgaatttgggccagagcctgggcaattgcccagggtagccgggccttgaaaccgcccatgtgtccatgcatcaatatctcttttattctttttaaatatttaacaagtgttccatagcttctaactcaatcacacacacaattcttcaaaactaaaaaaaaataatcacatattttataaggatttgtataattacttcaaatttacatacattatagtgtttcccttgttttgagaaattattgagttttatttcagaattgattttataattagtcttaaaacattattttgaaagactaaaaaactttaggtaaaacctcttttgttttgtctagatcacaaatgtctcttaatggagacaatcatgcatattttaagacttaaatatgaaacttattaagtttgaacaatcttgcataaactgattcacatgtttgtcggtcaaaatctcttttctttcatttttttcattgatgttatctcttttaacttttatacataggaataatttgcacaactactgagtattaatgaattaagatctaagtgtttgttgtgattcgtagtactatttcatagatttaaatagtcgaaggaaaaaaaaaacataatcctgtacatcctgaaaacctacatcatctaccatccgttataagttattacacattaattaaaaaccatgaccacgcacaaccaagatcacaagtagaaataataaggaagacaatgacaaataataatcgaatacaacaatatgcgatcataaaagaggaagctcgagcacatgtacacgtgcccatcaaccctctctatctatctgtatcttcctacctgtgaaactgaactgatatggttgcttgtttgcataagaaaacatgacatcaaaagcgtttcatttctaaactccccaaacccttattattattcattcccacaaaaccagcctcatcatcctcattatcgttgtgtgatccctaccccatgtgtcacaaaaaccatcctcatccattaggcacatttattgtatagttgcatacacatacaatattgatctcactaattaatccaaagtcccatatcactagccgctactttttctccaaatatcacgaaaacgtacgaaagttaagagcaaaggaagggaaaaagcagaagataaagtaagaaaaggctctaatgaaaaaaacagtttgtactaaaatgatgcacgagacgtacatagaaaattgagcacaaagtagtggtttttgatcatggatagcacagcaccacccacaccttcctccagggtttcggctccaccccaccgatgaagagctcgtggttcactacctcaagagaaaagctgcttcagcaccccttcccgtcgccatcatcgccgatgttgatctatacaagttcgacccttgagagctaccaagtatgctactttatcacaccccatttcatcttttatccatttttcagatatttaggttttaaattgcaagagcaactttagtgcaggatcttggagtaggttcttgcactcaagatccatttttgtgaagattcagcagtacagagagttaggatctccagtgtagcacaatggatcttgcataagaaccctcgagatcccaaaagtagcttaacgggtttgggagggaagcaacaagaaaaagatgcaaaggaagaaaaatacctgaacagatgcatgtcaccgtcgcaccgccgaaggtgcatcaatttggcggcaccgtcgcattgtg

SEQ ID NO: 5634 - DNA, 2100 bp, Glycine max
  Soy_ogl_2739 Gm08:17002401..17004500 Cluster 25
atgagcttgggcttcaatgaatttcttttccaaaaaaagcccttatcgtcggatcagaattctcaaactttgacgcgcgaacgttacaatgacgttcaaatgatttaggttattagattagcacacgcgacaatcaacttcattgttgatgaaacggtccttgtatttcacctggagttgtgtgccgcctctgacacagcggtggagctgttggtagattcgaaagcaaccgtcgctgccaaccccaacatgatgtcgtcgctgccaaattcaaaagcccgatccgaactgaggcatttcatccaacaccacaagaaagctttagcgctccatcaggcacaatgttaagtgccgtagtgttgggccataatgttctgccatgactgggtttgtgaccttgcgggggtgacgctgacgaatcagaagagcagtggtccacgactttcacgcaccgtcattattcgtgtggcgcagtggaactcaggtctttattctgagccattgttgttgtggtttgacgtgtgtgaggaggcggaacttcgacagaggcgcggaggaactcagatcttgatgttgctctcattgtttctcagatctggatttgtctggttcttaaatctgagtcatggttggccacgtttccgatggtggagaggactagttttttattggtcttgacgatggtgaaacaaaggactcatgactttatatgtatatcgcttatgtatttaaccaactgatatatcatcacgttttagacgaagattatcgataagaattttttataaaatttttgaagtttcagaaattttatgagaaataatttttttttttaaatctactgtcaaatatatttcaagaatctctaaagtatttaaatctttttaataacatgctcatagaggagagggaaaaaatgggtaactaaacgagatatagagagcatcattacctgccaaacttgggtagctaaacctctttggaagaagcaatgttgaggtaccaaaaaaggcttcacacgtgagggtaacgtccaaataagcaaccaccacctcattctgatattgtcatcataaccatgaaagaaagttaaactcatatttggagcaaacaaggaaaaaaaaaaatatcgataacccttgaattggactccactcatgtgatttgctatttctcttgtcttcaaatcctaatgtccaagagttgttaaaaaggatatttatatcctgcaccccccattccacatcctacatctctcaaaaactccaatggacaaaaatactcttttactaaacacccttattatgaaactatttcggaatagaatacttttcctagctattaagagttaagagtgtaatgggccttccttcggcccggcttgctcctctgtagtttctttgggcttttgccctccacaatacaaaaaagagagagtagttagttgatataagaaaaacgaaaaaaaggagaagtgatttttcttaaggaaagagagtagtgaattaaaaacataattaatttcatttgataacttaataaaatatcatagaataacaatataaataaatttcacactgaattaaaaaaaaccatgccagattaaacaagtatattaaataaagtagattaaaccagattaaataaagtatataaattatataaattaatatacttttcaaactagaaatttagaaggatgctagctattatttcttttcttcctgctcatcttcattattaaagggggaaagaaatcatgccagattaaaccagtctattggcacataaattgtcatatcatcagacatcggcccaatgttgttgtgcctaaattctgtcatctccgggaacaaaaaaaaacaatcatcatcttctggaatatccatttttcaaccacgatgacttaagatgacactatagcctttagattttcttgtaacactaagggggatactaagaaatttttggtaatcatctttattttttatggataaatgttagttattggtttgttaattttttttaatgaaaaaattcgaatccatgatttttctctccctccctttctccttaggtcaaccttatatctcctaggca

SEQ ID NO: 5635 - DNA, 1261 bp, Glycine max
  Soy_ogl_4336 Gm13:29003401..29004661 Cluster 25
aatatgaaaagcaatcctacaattgtcataacgagattttaaagtgtagtgttgttacagttggtaatcagcaactgataattttaatttatacttaattagcagttatatattcatcattaatttgtaattacaagagtcaatttttccatctgacattaagaaaagtgatttctaacatcccaagttggccgtatcaaaaaattaaaaaagaaaagaaaagaaaggagtgctggaaagagagtatgttcaaaaggagtgtgctattagcatttttctattataattacttatgtcatcactgttggttgatgctgcatgcagtaatttgttatggattggcaacaatggagctgattgaggattgagaaaccgtgaagatggaggaagaaagagagatggtttagagaatgatatggacagattttgatgagagtctacaaactgatgagatgatatttaattaggttttaaagagggtatagcaaaaggtgaaattctttcaataataaaagcaaaaaggtgaaataacagaagtatcccacaagcaaaaatgctatagttgaagaattctagtattctaaatttctgaggtggcaattttatattttctgtctcataaattatagattataaatagattaattattgagggtaaatagttaaatttatcttcaatatcgattcaataataaattggtccctcaaatatagaaaatacaaattcagtttgaatgcacaaaaagtatgataaatttaaaattttcatctttaaagattaatttgtctgcaaacctaggaggaccaatttaactatttatccattaatagattgatcagttaggcaccgaagttgaatattgcaccaaaagtagcttaatagtcaataaagagagtcgaacaaggaagttagtcgttcacatatcacataaccaagctgcacttgcaattttcacaatcctctcttctaaaatttggtcattccctctccggccatggcagcagaatttgttggtggtgctcttctttcttctttccttcaggttgtttttgacaggctggtttctcgtcaggttttggaatactttcgtggaagaaaactcgatgagaagctactgaacaagttgaaggtgaagctacggtccattgatgctctggctgatgatgcagaacaaaagcagttcagggatccaagggtgagagagtggcttgttgctgtcaaagatgctgatattcctataaatagaatgaatgcaacgaa

SEQ ID NO: 5636 - DNA, 1400 bp, Glycine max
  Soy_ogl_4778 Gm14:45199801..45201200 Cluster 25
tccatttatcatcttcaagcaaatgcactagcacatataatcttagttataaaattcatttttttcctccaacaccccaaagaaattattcaaataacttgaaagcaaatttaaagtgcaattgaaatttaagggggacaattgtcgatagaattcgaggcaacaaggacaaaatttctaacttttgtcaattatgaatgaagaacaaaaaaaatgctcacaacagggacaaaagtttctcacaaccttgttctttttcttatttgttcaaatttagcaaccttgtttctcatatgccctcttctagaacatagcttatgtgcccaacacaacattagagaaaaatgtttttgctaaaacttgttcggacttcctaacctgtcgtttatggatattgcctagtcctacgagaaggagaagcaccattgaagacgctaacaatagctccctagaggatgaggattgggttttgggttaggtctgtgttgtgaatagagagagacatttttgggcttacaacaaaagagcatttgttagtttacgatgttagagaggccgaagttatgtaaaaaaagagggtgcatgtgtaatcagtgtaaactttatgggaagttactctagttgactctaaattttttcttatcaataatattttcaaaagaatgccaaagaaaagtgttactaatttaatatattgaggattgatttcacatattatgataaatcatgccttcctaaaatttattggacatgttatttgataggagtcattcaagatcggtagatcacatttgagactaaatcttttgtggatgtggacacaaaagtgatgtgtcaggcacattaataaaacgataacaaattaacgacaccttaaaatattataattatattttaagttataatactaattaaaaaagaaaaaaactctcattgttccatgtccagaatctaaaatatattccaaaaaaaaaaccaaaaaaataatttaaaaagacccattccttcatgattcatgattgacaagttgatttaatgaaagatatgaatgtgttttttttatatgtaaatattaaatattaaattattaatctttattaatagaagaaatttgaatttataattttttttcttcttttcatcattaaattaatcttataattcatgagagggtgtattcctacatggtagggtacgatattgtgacgtaatgggtgaatgttgaaggatggaagtgcgaaagacactaatccgtggtggtgaggcagagattctaatatggtaagttaggttccatgggtcaaaggtgtgggcatagctattaagatgttggagttgatggtggcttggcaaagagcaactttttgaaaaagttctaactcaaagatagtaattaactt

SEQ ID NO: 5637 - DNA, 1818 bp, Glycine max
  Soy_ogl_5052 Gm15:14963101..14964918 Cluster 25
ccatcccctacccctgttaccaaacccattgccacaatcaaattgtttcaacgaaatcaaaaatccctaaacatgttcttcactggtcgatctagcacttgttctccactctatttgataaagcattcacaaacctttgtaccgcaacgccgttgtttgacttaaacccgcccacatcaccaccgttgtactcagcatactcatctgcaatggtatcatgaccaattttacaaagtttctcatcttcgcaaaggtcaaacttaccattacaacactctagatatgcaagcacaccttatccgagctcaagttccatatcgcccgtgtaagagagtttcccatgatccacattcgacatcgtcgttgctactgtcacaaagggatgagaggtctctgctcacgctctgcgcggcatgaccgagtatttgttcacgtgtgcactgcatatcgtgtcgataagatattccaccatggtcgttgatgcattcgacatcactgttgccgtcactgcatggatggttttgcttttaaaagaaaagagcatagagcaacatcaggagggtaattttattgttcattgcaagcatcaccaccaacctagacaggacaagcatttccagaacaaggttgcatgacttggggtggaccaaaacccatttgaattgttgggtgtattggttcaattggaactcagacactaggttttgtggcagagaatccaaaaaagtttaaagttgcaaaacagagttggttcaaatgttactcttcttacagaccatttaagatgatttaagcctcaacttgttgttgttagaaatgaaaccttatttgttgaactaatagaggcctaacataatgttgaacaaaatccctatagagtagggaatcattgaggttgcttgtcacaccaatgcagttaattagtgtagtcacaagaatagtaggttgtgcaggactgaagccaacagttgctatgataaaagcatggacagacatagctttagccaacaaagggacattgattgtgggaggtccttttgttcttcctcctcagcaacataacataaaattagttacaaatgattcagaacattatatcattttccaatgtatccaggggttaccaaagggtgcacttatgcaaataatcttaactgcatctgggggtgctttcggggattggccaattgataaactaaaagctgttaaagttgctaatgcagtaaaacattccaactgcaatatggggaacaagatagctgtggattttgctatactttttaataaaagatctagaagtaattgatgcagattacttgtttggagctgactatgatcatattgagattttcattcatccaaaatcaagcatacataggatttatctgttcttgcacatttggggtgccctgatatgcgtttgccaatcccctttacattctcatggcctggtaggatttgttttttctgaagtcacttaactatgtcttgatctttgcaagcttggttcacttacatttaaatatccatccatgaatcttgcctatgttgttggtcgtgttagaggcataatgacatgagttctaagtgcagcaaatgagaaagttgctgagatgtttattgatgaaaaaattagctatttagatatattgaaagttgtggagctaacatgtgagaagcatcaaaatgaattgttagcctcaccttcccttgaggaaattattcactattatctgtgggagcttactttcttaaacctcattttggtccccctcctacttagtttggtgacatctcttctcattcatatgccaatgg

SEQ ID NO: 5638 - DNA, 1700 bp, Glycine max
  Soy_ogl_5358 Gm16:27070801..27072500 Cluster 25
tgtaatcttactttaaacatctactttaagtttaagtttgtttaaattaaaaagaaaatgttttggggcatatcataaaatattttaaattaagcacttttttaataaaataaacattttttgcttttatgatatgcttaattaatttatttttttttgaaaaaaattatgcttagcaaaagcaactattgtttcttttttttttaaatcactttttaaaaaaaaaattaaaaaataacttttttagtttaaacaaactaaccctgattagacaggagttgcttcctaataaaaacgaagagttacattttaaaaaaaaaaatagtttaaacaaacatattaaaaaatagaaaaaaaggattattttattaaaaaatgccgattctggatgaatgatacatgtcgattctctttaggtaatattctcttcacatcatcaatgttggctttattgtatactgattcaaaaacctccacacacacacttgaaaacctcacaatcccctcaaaagcttgtgggaaacccatctgcagatttttctttgtcattctgtgtgttactccgattgagttttcatgtttggtcttctctttctccacctttgctctcaggtgttccaccttggcgcgcttcttcgtgacacggtccttgggatcagaggattccgacatggaacgcgagccatgcttacactcaattgattgaagctgaacaaccttcttctgaagctctttcagtgcagcatccaacttcttcttctgtttatgctcctccgtttgttgaaccacaatggcatgaatatcttccaacaagctcttaattcctttggacgcgaccttgtccggagtatgatcaagagcaaggttccattgttcacatagggtgtatatctttgactcatcagcagatttatttagagggtttctgctaaagtggtgaaggttgagcctaagccaagctgtgagagattggatataatccctgtgggccttgaagatgttgccgaaggattggtgccattgctgtattccaacttctcgctgaagagttgatttcctatgaatctcagatgtggggttagttgatgggacagtgttgttgaggtcttcaagctgcttaagtatgtgattttgagcttgatggtgcttatgcaatatgcatgcttctccacatgctcttcaatctgcaaaacagatgaagctccctatgctgagacaaattcaatacttccaagtactttattaaacaaacgtattttgttttttttttatgttgaacttgatttttaacatagggtaggggtatccgtccccttttgctttaagtaaaggaaaatgaccctttaagaaaacaaggagttgaattaaaaccgtttgacaaggataaaaaattatagcattagatgttatgttgctagctccaacagagttactaagcagaggaaattagagagtaaatgtacagaaaatgaagtaattaggggacatatatttgagtgtaaattgtgtgtaagtggtgtaacattgctgttgttgcaagttaagtgaacgccaggtttagaaccagtataagcccttgttctaaggaactttatcaaaatgagattctagttgtacagatagtacatcttaaagtcatggtcagcactgtctacaggaaagcaagttaaaaacaaaagcaaagtaagatcaataaacag

SEQ ID NO: 5639 - DNA, 1100 bp, Glycine max
  Soy_ogl_6400 Gm19:36552201..36553300 Cluster 25
tccatagtcgttttgggtcgccggtatgacgatgctcactgtcgccggaaatattgtccctttcgttcctcaaatcgtagcatgcacccaatctcgtttcagagcggctttgtgactaaagatggttcaaaagagttggtcggaggccatgttgaatctgagaccattgcttgaaagtgttcgtcgaggaaggtggagtgattttttattcgcataggtcagtggcttagcgaatagtcgttgccatttcccgtcatagattccggcaatgatggtgcacaatgactcataacgctaaacacaaagatgagtagatgactaccacaaatattcagtgattttaccattcaaactacataattcctccgtggacattgtcctgaataaaaaagtgaccatttttctgttttcataaacaaaactgacaccttcaatcgttcacgaatcttgaaaacgatgagcctcacaacagcaatgtagtttgatttagtagcaggctcagaggatgtgtatcaaacacttggtgtgcaattttggatgtgagactaaaggctcattgtagtgattaacatgggaacaagtgtcttataattattcccatgtttatcagttggactgttcaaaaaactattttgaactgaattaaagagagaactaaattgaacttaactatttaaaaccgaactacttttgtagaaaattgaaccgaactataagtttagttttgtaaaactaatctataaaaaaatagttcagtttagttgttttgtgaatttttttgattgttttaaaaaatgaggatttgttggactaaggcacatggtaagcagttcagtctctctctgtgtaataaaaaagagagtgaggattcagatttcagagatggacacagcaaaaatgggagaaaaaaatagaaggaagcttaaagcaaagaaacaaagatgaacgatgaatacattttttaaaaaagaaagcaaaaatcaaaataggagggctaagaagaagcacgaagatggatgaaagtgtagaaaaatgaaataacacagcgacagggatagagacagagtgtgttgaaagtagagaagagagagaggcatggt

SEQ ID NO: 5640 - DNA, 1100 bp, Glycine max
  Soy_ogl_2578 Gm08:9302701..9303800 Cluster 25
aaaactattataccaaaaatctccgttgtggaagcctggaaggtggtagtatggattagatgaagatgttgtcacagagaaacagcagaggtgtagcagagcagttgcaacttgcaatgatgttggatgcatggggcaaagttccatgtggttcaatctggtttatggttcatcatggcattattttagttaaattaatcaattcctaaaataaccttaccagtccattacgaccaggatgccatgaataagaactctggagtatttcttaagcacaagccgaagcacttaatcaacactcatcatgtctttctatctctcccatcttattacatcatataattaatatatttatatttttttttcttctcctttttcctctctcacctgcggacttgatagctgaaatcataatttattggaaactcaattattgacaatcatgaattctggaaatgtatacaaataagtttggttagtcttaatatatttcttggaaaataaaattctcacgttttattacattataactttcctacgtatataagaatttttatcaaaaaaatgcatcctaatgattaaattaatgttttattttttgttttgtattcatagaatgattgattgttattgttaaaattagtaggacaatagaaaaataaatgcaagtgatctatattgtaatacttaacaatgataatgtaaaatataaaagctttagacaattgagaaacaccaaaaaatatagaaatataaaactcaaaatataccataaatactacttcaaagtagacggaaaagcgggattgtggaggagtaacataatataacaacagtggagactgaagttttggataaacatcagctttagtagattctaatttgtaattgtaaaaaagaataatataattattttgtgtaaataaatattttccttcactcagaaaatttggattcccacctcctcttaaagatgtttttgcaagaaaatagaataaaattgattctcaaccatcataatttttcaatgtaagatttaaaaaaaaataaaaacttttcgactacctatatgttatataacattgactgtccatagatta

SEQ ID NO: 5641 - DNA, 1200 bp, Glycine max
  Soy_ogl_4316 Gm13:27951801..27953000 Cluster 25
aaaggacgccattattggtctaatatagcttgaaacggcttaggctacatttgatttttcatttggggtgttttaaattcagtttggagagtaaactcagtttagtgacatgattagttatcctaaaagataggcttgcatattaaaattttacctaaaacctagtctcgtaaaaacaaaacttgagttactattgcaaacttttatccaaattagcatacatgtacacttaattagtgactttccctatattaatgagatttcatttttttaacacttatcacctacatgtgaatattaattagttatatagcttttatatattactataattttagttttttttacaattggcacaacattctctcatttcttaatggtaagcagagaattgttgtggcatgccaattccttccagcattacttaattattttattacctacccaaatgtcacattgttgtttccccacatttaaaattgagggaggactacctgctgctatatatttctcattggaacggcaaaacacggcttccactatcattatcatgacgttacaattaagatatatgctgaaagactttttatataagcatatgagacttgtatatactaaactaataaattattaattattgttgtcaatgtaaaataactatctgtacgtaaatttgtataatcatttgtaaaagatgataacatgtcatgtatgtgtatttaaatatagaagttggtggccagttggtgactgagaagtcaattcctactgttttatttccacgagaaactatcaaatcttaactaaaaaacagaaacccaacaattatgttatggtaattttcatgggataatgggtatatcttgacttcttcggtcaaaatatgaaataatatatataaaagtagatacaatatatgaaaattgaagtcataggtactttatggctttccaaattggaaaaagcagagatacaaagtaatactacctaattaaaagactggtaaggtttggatttaactactttttagttgtacggctatgtctaattgatatttcatcattttagagaagtatgagtgatgaaaattttgtgctgaaaaagtattactcttacagagaaaatagttctagctagtagctactaacgatgtagtagaagctactgtgggtaccattattttaattcggggtcaagtgg

SEQ ID NO: 5642 - DNA, 1407 bp, Glycine max
  Soy_ogl_2440 Gm08:740994..742400 Cluster 25
aggagttataaagttttttggataataaaaaaaggagaaaaataatgtgggtttaattcctccttctaataaaaaattaataattaataactaacatgataaaaaatcatttattaattttcttgtaaaataactttggactaggaggaaagaagtattatttttcaaagaatcgcaactaattagctcaattgaaagtatataattaatgagtcttacttgtgtaaagttgcacatgatagaaaaattgataagtaataatgacatattaattctaataatctactatagtagtgggtggacgatggtagagtatcgaaaacgcagggagcctccataagcggtggcgaaggtggtggtccgcgacgaatgagaattttaaggtttgtcagttgtggattaatgatgatttttcaggtgaggagtttaaggttgtggcactatcactttatttactatactaaataataataattacttgacagttttttcttataaaaaaatatcagttataaattattaattttttgttagtaaaaataatccaacttaatctcaattaatttagtgtagtggcatgcactttgaagaaagcagacatgagtttggacagggaaacgggaatgacaatctgagtttgaaactcaaatgaaaattttataactttaatctctccaaaatcacacaaattaaacatatttattccattttcatcttcgctaacttgttttttttaaaaaaaaaactaaacacaactagaaagttcctaaaacttgaagtagtaaatgaaaattattatggtcgggattgttggcggagaagaaatgtgtttagtttttttttaaaaaaaaaacaagttagcgaagatgaaaatggaataaatatgtttaatttgtgtgattttggagagattaaagttataaaattttatttttcggagttacaataaaattgattttttttttccataaaaaacaatttttagccaaaagaatggatttttaggttcaaaaaatcaattttttagaaaaaattgatttttctttgtaaaaaaatatcatcctccacttatttttcttaaatcaaataacataaaatatcattttatttctctattttaaaattatttctcttctatttatatctatcatattttttcctctaaatcaaatacactctaagggtgtctcatacatctacaaaaattatattagttcagtaattaattatattatatacatagttaattattgttatacctgattataattagagtcaatttttgttggataaatttgttgaaaaaaaattaattaatgaaattttgtttagatacaataagataataaatttttatatagtaaattggtaaagggcctgaagagggttcgaatatgttggttaaca

SEQ ID NO: 5643 - DNA, 1066 bp, Glycine max
  Soy_ogl_1066 Gm03:43178235..43179300 Cluster 25
acaataggagagaaaagtgaatgccttcaactttttcttcccattatttcagtaaagaactttcaaaaaatgcataatgaattcctataaagttaaactagacaagaaatatccacacattagcaaatatataatatttataatgccatagtgggtttagtatagaactattcactggtttaccaagcataggtgcttggtatagagctattactggcaaattaatttactacgtagtatataaagataaagatacgttgatgtaaagatcacgtcatgtgattaccaattatatataataagaaaggtaagagtaacttttgtatgatcattaatttatatattttgttttatcgataaaaaataaagaggcgtggagtttggaataaaaaccctagcaaggctggaaaacgtacaaaacaacacaaattaagtcaattttggacaaaaattttaagtgaaaagttggaattgcaatataggataagtatttttttaaaaaaaaaaaactatggattgagtttatttgaactttatataaatgacttgtgatcttattaatttttttaagcttattttaacatattttaataaaaatacttgttaaaataaactcacttttttttattttctaaacctcacaatttaaaatttataataaaactctcatatgatcgaccatattaatttattgaataagtaattaagcaacttacataagcattcgcatcatgtctatcatgtctataggatgatcatgtgtgtgaagcttggagtggtaatttcttcaaatcttatacaaaagaaagtttttttttacaagatttcttgacaaaagaaaggcttttacatgtagtggaaaacactaaattaataaaacaccaatatgtcaagaaaataattctactaataggtcacaataacatggaacacaacattctgtttattagttaacaaattaaaattgaaaaaaaaggcgaaaaacatagatatcacatgtgaattgtgtacatttaattttgtccccctatttattattaccatcattatttgagcgttttactat

SEQ ID NO: 5644 - DNA, 1116 bp, Glycine max
  Soy_ogl_12 Gm05:1140301..1141416 Cluster 25
atattgaatccaaacacattgtaatttgcaacctgcttcataagaaatcacatttaacttttgttcaatacctaattaatgcaatgaacttttcaagattgagtcggccaatttgatgttttggacaatggttcaatccaattaatagcttcttatgtatgcgtttgcagcttgcagaggcaagaccagagggactggttgttgtttttaaaagcaatggaatgttttttttgttaggatggaactttttggctgtttttgaacttatattagcagtttcattattttttttgtttgaataaagcagtttcaaaatttgaatataaaaataatattatctatgatgcagtatataattatttttatttcacgtttttatcttctgcgcatatgtgtattttaaaaacaaattctaaaattaaaagaacaattttttattgtctattttcattattcataaaacatttttattatatcatgatttctgtcttttttccattttattttttaaatgaactcctccaccaggagcagaaagattattctttttttgtttaacatttaaagaaaaaggtaaaaaataaaatgtactatcgtgggtatcacgtagccttaatcactttgtttccctttttagttgcctgaatcaaacttagttgaagaaaagctaaagcctaaagcgggtcaatgacagacacgatctcagttcctcactctctaaagtctaaacaactatttttaaagcgtcctacacgttcacgagtcacgacgacaaatttactttgcaacattaacttattgcccaaacaaatgttacttttggttgggtaaaaattaattaaaactcaaaaggaagaaaaatatagataatgatgttttctttatttggttagaaagaaactaaaagtggttagatcatctattgtgcgcaatgagttttaaatttgattcacttgatcatgacactcaattttaatttaaacataaaattacaactaaaaatattattttattctcagtaggtatgtgaaaagaagattaattgagtatcaaataaaagttttacatacctcaattacatcaaaaacaataaaattagagataaaattttgataa

SEQ ID NO: 5645 - DNA, 1455 bp, Glycine max
  Soy_ogl_4607 Gm14:2192001..2193455 Cluster 25
gatgaaaaaatagaatagaaaaattataaaaatatgtgaataataaatttaatgttaaaatttgtttattttgatggaataataggattttatttatgtaattaataagggtcgggttttggtttgaataattattagcaaaaaaaaaaaaagggtatcatacccaacttaccccatccctaaacaaattaacacctataataaaatgtaaacataaaactgcatatttcttatattttataattaatatataatcatttttaaattcatttaaatattatttaatttgaatattaaaaaatatgttaaaaaatatacactaaaactaaaaaagattgttctagccacaaattacttccaaatctagggtttcaggagcatattgcacgtacggttgcctaatattttatactcatttctcttacttttttttttctttcttgcaagagtataaacttaatagaaatgttgatagagtccacacagaaggagtagttttgttttaacaaatatccgagtgttataaatctcttatgatcattgtgctttctatcgataggacaactggttgagcatcaaattgataaactgatcagtatggccttctttctggagcagaaacaacagtgatattgggaatatttatatcacaaggaaagtggaaatgccaagttttataagaaaaagtataattaaaaatcctacccggtttagtagtttgagcagtgcaagctacttactaatcaacaaaatcatgccgtcaaagttggatattcttcctctcggtgattattattttttttttttttgtgaagagagaataggaatatattattataaatcagaggataaaactaaaaggtccaattggtttgggaactcatctacccaaaatatatctcccatattgaaagccaatttggctagttcatgtgccactttattccccttctttttgtaaaaactaaggcactaatactttttattttttatttttatcaaggcactatcactaagatacttgcaatctgcaacaatcagattcaaaaatcacattggtgatcaaacaaaattctgcagcaagcttcgtttcaaaaaccatgtcaagtttcctcgtggcagctcccagtactgctccattatgatcattcatgagcatgttgaaggctctaacatttttttttatatatatataatggtcataccgatgtttaaacctatgacttcaggcatattacttcaaagatccaagcccttcaccactaagccgacaccctagtgattctataggctctaaaaccaaggcgctcaatcttcttctgtttggtcagttttccctaacttaaccaatagacttttctcccttctgtgccatcaccttctctcggagattaatgtgctgctcaaaatttttaatagccatgccacattaaaaaggaatatatatgacatatc

SEQ ID NO: 5646 - DNA, 1000 bp, Glycine max
  Soy_ogl_4903 Gm15:4259101..4260100 Cluster 25
tcagtgttgttaactggggaatcaatgttttaagtagatttaattattttttcttttaatatttcttgtagcaatatggtaatatatattacatatttctccagatgaagcactgtgtaaatgaaatttttatcatggatttgatttgaagctaccctaagaagttcaagagcacaagcattggccactgcagaaacaagttggggaccagagatatatcagggcctaatggtccctgaactatacaatattcaaacattagataatgaccaaaaatcaggaaccatgccatactccactccttttgagaagatattgtttatattaatttattttagcaaacctaccgcacttaaaagaactaatataacaagaaagcataagatgtatagacatgacggaggagcatcataatttcgttaaaaaattcaaaaattacagtaacaaattatattagcccgtgtaatcgcttccattcaaatatttaaatttaaacatgttagattcataattttatttcattctaataagtttatatacccagaaatctagcttaaatgcttgaattgttgtaaatattttgtatttgttttttatttttatgaacaaaaattctaaaataaataaattatatttttgttttgttttacacacgaaactaggttgaaattcaaatttaattcattaaaattaattattcttttaccagtttatattaaggactaattttggtttacaaattaaactagtgtctgtcgggttgatttcccaattacaactcagccaactagtttgtaaaccaaaatatcctcaaacccgacatcatgccatccccacacacactgtcaagtatatgtactgatctacaagaatgcccggccgacactaaattgccttcttgtgtgtccagacacatcttgatctacaataatagtttcatattttgagctcatcacgacaatttttttcaaaaaaggtaacaccctgtacaccaaaaagc

SEQ ID NO: 5647 - DNA, 1235 bp, Glycine max
  Soy_ogl_5458 Gm17:2305101..2306335 Cluster 25
ctcaaaacccatccaagtctacacagatttgaagttttctgaatcttaggttttttaggtgacccattgaaatcaatgacaaaggtttaaaaaaaactgtccataataatgattccagctgtaaaatacgttttttttttttatttctgtgactgcattgtcatggtaattgagttagaatcgatgtatttatctttaagattttgcaataccaaagattgtaatcaaatcgtgatgcaggcataatttaaaaccttgtcaatgacaaacattgaatatttaatttgtagctgtaatataaaatttagagtattatatatatttttttatacgaggaaccataaatatgtttcatgagtgtctcagtgagataatctcttgtttaattaagttggaaaaaaaaaataccatgaatgatagttgcatatccgtacatccagtacacatgaactagatactagttattaagctgaaaaatcttatattagttgatttatgtgtttggtatagtaattatttatgtgctaccttttgttcttaattttgacagtagcaaaatcatttcattaatgatgcaattgtaaatacaataaaaaaaaaactcttaggcttgcagtccaactctaaaagcaccttaacttactaaaaccttgatccgccacccacttcaaagcccgaagaagtccaacagcttcaccctccgaacagatagataaacaaggcttctcccaaatttatgtgctatcttcagtttgtaacttttgaacttttttttatatatataatttcaggctctttttactcatagaacggggaataagagaaggttttgaagaaatagacttcatttgaaagaacttctaatgaataaataaataaaacaaaaatttatataaattaaaattaacttatttatcttaatttttgaaagtttgacttgtttttgtaagcatttataactacaatagaattggcatttttacctcgaaaaaatcttaataacacggtcttataattataaacttttgtaaagtggaagttaatccaaataaattaagtgctactttatgatggcgggatataatattgatgcgaaaatgcggatcatggtactcccttcccggttttgctctctgctggcatacttctttctttctgaagttatatattaggagtggtcaggttgaagagaaaaaattattattcaaaaattaattttccaaaattaggatgga

SEQ ID NO: 5648 - DNA, 1200 bp, Glycine max
  Soy_ogl_3963 Gm12:780101..781300 Cluster 25
cactcatttcactggtggaggcgtgaaaaaaaaaaacatttgaagtttgaattacgtcattttactcctatttttaacctataaattatatttttagcagaaaatactaatacagtaatactgatagacatgtgccatataataatgttattttgaagctttcacgttgtcggcgtaaaaactgatactactattgttttatatatatgcacgtgcctcttaattgaatgtcgcttcgcttctattaacgaagtgtttggtagaggagtttggagatgagtttaaaaaggttcaaatcacagtgtcactcacatgaaaatagaaatcacatataggatcgcattaaaaccggtccaatacacttggtcaattaacataatctattttaagggttttttttttgaaacagattaatctatttgaagttaagaaatgaaaaaatatttaaagttgtgacatgaaaacttaacaggttagaaggtctcttatttaacctttttacccctcaaaattttatattcactacatgtactatcttttactttcttctgatttctcaacctttaaagttataaattatgtttgttttaaagttaaatggaaataattgtagaaaatagaaatagtccctccttgagaaagtgaaaggatgtgtattgttttggaatggtgagatatagtgatagacatgtgttaaattggaataggtagaagacaaacaaaaatccggctgtgtggggactgggtatatatttgtagctgaattcgtgtgtttggacttattgtgtgtggcatgattgaacatgacttcaaacaaaatgtgggaagctctaaagtgtgcatactcccttttatactttaaaagtaattgggacttataggagactgattatcaatacccttatatttttctctcttcatgaaaatcttaactttttcaagtgggaactgcccattcactttcctctataatacacatcactgacttatacttaatggaaaaatagatcaaatgcgtacgaacccctcgttataaaatacaggaccattggtatttacaaacaagacactataattttactctctattaatatatttatgtgaaattaatagttttaaaaatattcactatgttaattttatatatttaactttttaaaaatagtctatgatatccatctaattataataagtcacccg

SEQ ID NO: 5649 - DNA, 1400 bp, Glycine max
  Soy_ogl_1740 Gm06:381701..383100 Cluster 25
actcatgaggtactgttagggtgatttaggtagagtttgtcattaaatgaaatgattggtaagattaatttttcattttttatttatatttaagattaaattttttttatacgaatttattgtcattctatttttgaagtattaaaatgattatttatcttaaaaattttgacatttatattatcataactaagacaaccaaacataatccactattttagcacttcaatgaatgaaatttataccgaatgtgtgtgcattattctctaatattgtctcaaaaaaatttcactggtactgatactagtttataacatcataactaatcactgtacatccaacttaattggttataattgttattttttggttgacaataagtcatatttagattttttttttctaaaaatatattataagaagatcaaattcaaatcttttcttacaaatgtaaggtgtattatgaactgaattacattgatccagctgttatgattttcattttaataaatcaagtcgaaactttgactgagtatgattggagcaaattttattttgcaaccagattaagaatacttcatcgtctactaaaagcagctgctgcaccgcctgaacaaaactgcaccgcttgaaagaaaattgatgcaccgcttgttatgtgtttattatcattcctagcgatagagagtcactctgtgcccgtgtctctctaaaatttataaataaataaaaaacaaaaaaaaaagataaacatagaaatagtgaaaagttattataggttaaaaaaaattgaaagtttaaaaagtagtttataagaaattgtatagattattaagtgcaaattaaggaaaaaatcgaatgtaaaagtgaagactaaagaacaattataacatatataagttttatctattggtatggattattattaatattattagtcttctccggtgtttgagtgtgaagtgctaaattctttttctttctctcgtttcctcgtgcaacgtgtgtgggtttttatttgtatctcactgatatcaattatgaacatattaaaaaaaatataaaaatcagcgcaaccaattactcattatcaatatcggttattgcttattaacgtaccacaaccgattaccaatgataaaagaaggattttttaagaaagcaaaatgtgtggttatttccaggctatcttacatctctacaatgaagaaattctatcgagtaggactagcatttttttttttatttctctctttacttatttaccaataccaaacaattcaaatttttatgatatctctatttctactcttctcaactaattaactaatacagcgttagtttcaatttacgtaaacaactttcaactcacttaatagcatttgaagcaattgaatgag

SEQ ID NO: 5650 - DNA, 1319 bp, Glycine max
  Soy_ogl_3656 Gm10:49675382..49676700 Cluster 25
ttcctctattagtaaattaaaaggtgtaaatacttaaatattgttctaaataaagctaacactcaggcagtcctgtttagcacaactcacttaatcgaattaaagtgacgccaccttctctttgacaacattcacatatttgggcatcctcttctttccatcctagttgcagcttgtggtgacttgagaaatcttgataaagatgtatctaaaaaaaactattaggattttaagacatttaaaatttttaatttaaatccttacacgtgtctataaatattctcaacaatttttttaaagaaaaaaaattgtatttttatagataatattgaataaaaatatggaaagttttgatcttcttaaatcccatcaacaaatatttaacgaaagtcatcaataatgttaatatagactattcttcgtttaatgataaaaaaaaatacttttcttcgtttttctttggttgaaatttagaaataatatatctgaaagaatcttataaaactaaatttaaaattgaattatatatgactgcacaataaattcacctgaaaaatatacactatcatggtacactatatttaagaataaaagggcccactttttagttattaatataattatgttaaaggaaaatactcgttataaaaatggtgatgaaggattgtatgatggctgggaggtttaccgtttacgggcacatcttgtgttctgtttttttcttcttcctgaaataagtttcacttgcttctaaaaaaacacgtaaaaaaagtaatggcattaacatatttttatttaaattcatttactattagaatttaattataatgtatttacaatatagtttttatatatgattttattgtggattattatgtgtaatgataagatatattgctaaattttataatgattatttttaaaattatatctggaataatttttaattagttgacgatatatgtaaaataaactcttactattattgagaaaaaaaattattaaaaaatttaaagtaaattatactctccttccatgaaagatgtgaatatcacgttgtcttccactcttgttttaaaatttacactattttatcttaaacagattaaagtgtatgccattactcatttgacttcatttttcaaatttgttttgttaaaattctgttaactttacattaaacttattactaaaatcctttacattattatttcctcaaagatgcaagcgttgtttcccttcttttattaaaattaaaatgcacattcttcaatggagataaaaaaaaacaacaacaaatagccacataaataatcagc

SEQ ID NO: 5651 - DNA, 1200 bp, Glycine max
  Soy_ogl_3273 Gm10:174501..175700 Cluster 25
tcctatatatctaaatccttcactgactattttaaacatatggatcgattaagtacttcaaatatttaatattttatttagtttttatagttttgcttaatttgtattaaatctctgtaaatggacttatttatttgctagctgtaaggtttggagtatctcttttccatataattttcgtttgttgttaaaataattaattttactataggtatataatttaattagaaacccgtaaaaataattaattattaacttgggtttgtccttgtatatatatagtgtccatttattttaaagtcttatagaatcattttgcacggtaaaatgtaattatatacgtgaattatttaaattttctaatgttgtatttaatttttatcgataaaataataattagatatatgtttaaactaatctcagtaataccaaattttatattaaagtatgtgtattgtgagagagaaattgttgattctaaagataaaacaaacgtgcacatattgaaaccttaaaacggaaccttattattaattaattgatatttatgagaaaatgtgaaggagggcccaaaagaaaatttgtgtacaatcctccctataaagtcaagtaccattttaattgcaaagcttattaattattgttcgatcaggtagctattctttattcatagaaaaaaaaggtagatattgagtgagcaatattagaaaacaaagtcacttatgttttttttttaaaaaaaacttatataagaaggttgtatataagtatcatgcttaatttagatgccgacaacaaagaaaaacaaagccaaatatttcactcaactctttctctgactttaaaagcttaactaagactcagcaaatttattaccacttattgatagagccgtgttgcctatgactattgggtgtttgaattcagttgggggaggagcaggtgtctcgcaaaaatgattgcattttccagaaaaaacgtgtgaaaaattaactttaattagagtatgcaaattaaagcatgtagttaactagcaatcactgttactttacctcaactaactcttatctcacaagtcaccacatacataagcaaaaaatgaaccaaactctttttattcatttgcaattgcaagtggactattaggaagcaccctaatttcactttattaattagaaaccaaaccctttctagtcaatg

SEQ ID NO: 5652 - DNA, 1106 bp, Glycine max
  Soy_ogl_677 Gm02:45339586..45340691 Cluster 25
gtatgattgaaaatattctgtttgttttgttctgcagctcaatccaatggcccaaggtactccatcataattccaagatctgcacctaataaataacctcaacttacacttcactcaaggctttcttgcttgactctcagtgtggattctcttccaaagccacactccattaacacgcatcaccactttccaattgcaccacaatttcacatttcttccactcaacaacaattaaattcaatatgaagctgggtgtgagcttaaatttgatcctaatcctatggctggcatttgggaaactttgaagaccgttcgattagtttgaatggaaataaaaaaatacaacaaactattatttctttcttccgtttcaaactaagtgtcaccttgaggaaaaaaattgtctcaaaataaatgttatgttagttttaaatgttataataattgcttttttcattacctctaataagttttactttagtttttcattgtaatattaatagtattctcttttatctatttaataaggttaattttatagaattgttattttttatttatttattaactttttttatctgtctaaaataaactaaaatgacacttagtttgaaaccgacgaaatacttacctactaggaaaccactaacaagcccgttaaaactaattaaaacatacacaatagatcggctcaagtgtgtgttggcccaagagaaaaaagaaagaaggaaaatgggcttggtgggcttataacttattggatcaagatttttgaataattaagaatttatcaaaaccacaagtaataaaaaataaaatttctcctaaaattaaattacttttgaatttcaaaatacatggaaatagattttttcttcattcctaccattttttgtgtccatttttaactcagcattatttttttatcttaagtttctataatttcaattattaagagcaatttatattggtattattacatatactaattgcaataatgaaaaaaaaacaattccaagagacaggagtattaattaagatacaaaaaatttactttgtgtttaatcataaataaaaatcattaataatttcaaggttaaataagt

SEQ ID NO: 5653 - DNA, 1200 bp, Glycine max
  Soy_ogl_1770 Gm06:2801001..2802200 Cluster 25
ttctttttattagtatgatttgttttcttttgtagtgttgttgtgaggtattgggaacacaatttagacgacagaaaattatatataaaagaacataagtaattttggctttaacggaatagagagttagagacaatagttataaaaataccaatgttatcaaccttaacagttagtttgtttcactagaatagggagggatgcatataggggaaaagaaaaagtcaaaaagtaaaagaaaatcctccttcatctgtatctgcacatgtgcagatgtgttctgtgtagtggaaagaagttcctttgcagatgagtccaattgtactcttacaatcagtccgttagtggatgaaaataaaagaaaaaatcctttaccaacacctgttatgtgacatttaatgagaaaggaaaaaatattattaagtattaatgcattataaacatgtgataagggaaaaaaataaaaaaaaatgatgagtgtttgttagatattttttttaaaaaatagatatttatatatcattactcaaataataaaaactgtgttattttttacccaatgactatttatattatatttttatttatttatctctcaatatatattaactttctatgtaattaaagtggaaagaaaaattttatatttattttccaaacagagactagcgtgaaacatggctaaatgtgatttgtggtggtgaaaacagttgaggaccgttagtttaaaaggttaagatgattagatgactagattgttaccaattatatcatttatttataattaattaatattttgttaaaaacatctcctttagtcctttactcagttgtccttcaaaacaaaggtaatgtacatctaaccaatatgcagtatggcatcatcgtgtgaaaaaaaagatgtttcgatcgaaggcaaggacggagacaaatgttggggttaaaaggggaagaggtaatagaaggcttcgagccattcgaggcgatggtgtaaaggacgatttgggcaatgttagaggacatggttgtaaagatgcaggattttcgataacattaggaggtatggccaatttttgaaaccaaaaccctaaaatggttgtcgttttattttttttatataaaaaaattgcaacttaaaagcaccctaaatagacccttaaaaagtgttcttaaaaaaatgattcttttgcaaaagaaaaa

SEQ ID NO: 5654 - DNA, 1618 bp, Glycine max
  Soy_ogl_3678 Gm11:1460383..1462000 Cluster 25
gcattgatgtttcaatttgataataaaaacaagagttcattacaatgatcacttatatgtgatttgcttttattacattcatcatttttttacattatttttaacctcatttattaattttatgaaactttcgttaataaaagaagaaaaaaagacattcatttatgaaagaaaaaataaagacaaaaggaaaatgatgtttaaatagtgacatgcaaaattttgttgatatccattttaatattcaattacatgcaattttatttgtttaatcaattgaactttaaatcttgattgatcttgttaaaatttaataaattattttatgcacatatacgtatggacaaccactttgatgtggaacaaatgctaagttaaaatgaatggataagaatattttaggcaaataaaattcattaaaaactatgtatttctcatgtgagaagctcaaactaaacgtttctaacatttaaaacatcaaaggatgacttttttttaaaaagaaaacaaagggtgaccaatgaaacaaaaaaccaacgattaagatgttttttataggattaaaaaataggaatgttcaatgtaataaaagtaaattacataagtgtttattataatttactctaaaaataaatataaagatatacaatcacttgtaagagctattaaaataaaaagtagatatattcttttttgaaggtaaattagatatattcttaaatcttatataacaaatccaaatatacatacatgctttcttatcgttttgatcatatgtatgtctgttggtgggtgagtcaagtgttaatacgtgtttgtgcgcatggctattcaatactgccatcattgtgaggggagaattaattgtagttggtggatgggtagtgataaattggccgtgtgataaattaaggcaggggtaatttgatgtaggggttggggtaacgagaatggggggcaatggttaaggcccaatgactatgccatggagtggttatctaatacttatatcctacgttgatacaaatataatataaccctcttttttttttttttatttggtacctctggtacccttctcttttaataatatacttttgctgatttaaaaaaatctctcctcttgtttggtggtttcaaaactggatgtttatagttggaaagggtagtcctaaccaagaaattccacttggacgacgacaagcacgttagagtcactctaataacaaataaagttgtttgttatttaacccatgatctcgtcataattgactgacgtacctatagaggtgggtagttagttaccttatcaaatcaaatgaaacaggatattaaaatagaaaacttcaactcgatcgtatactctatcaaatcacaaagaaaaacttcaactggtgttatacccgtcttggcttcagtcaaagtagaatatatagcagtagttacttttcgtaactgtgggggtcggtaactaatttgcaagcaactgaatacgtggctgggtaagagccgcgcatagtatgattcccattcttgttcgttgctttagcgtaatgtgagggtaaagcagaaaaaataaaaacggagacgatggattggacagcttgtcctaagaata

SEQ ID NO: 5655 - DNA, 1400 bp, Glycine max
  Soy_ogl_4866 Gm15:2239201..2240600 Cluster 25
tactcaagtccagaattggagggattggatccaccagaacctgcaacaagatggcttgttatttcccatcttactttgggagatttggaaaaacatgaatgatagtgtcttccaaaatatttcagtgcagcctcaagtaatcacgtctaagatttccaacttgcttgatgtatgcgttgtacttttgatttacatttaaaggattcttcgagaaccagaaaccaatgtatggtgacttgtgtttgtgttcataacaatcagataactttgcatgttgatggtagttggcaaattaaccctgggccgacaggttatggtggtcttttgagagattctaatgcagttggttgtatgggttttatggtgatattggtgttgctgatattctcaaggcataattgattagcattcttcaaggtttgaatttggcctgtgagaagcatgtcactaatgtgatctgcatttctgattccttgctcgttattaatcttgtgaatatatggtgtcggtgtctgccatcattatgctactattgttgaagacatcattgaaagttggatttttctcactcatcctgtgagggaaattactgtccagattttctcacttggttaacgagtttggaggttcctcctacatgtttatacgggctcttgttagtcatgttttgcttctgcctttccccggagtgtaattttctttttgttatttattcacctaaaaaagtaaagaaaattgtataaagtgatagcagaatattttaatataaatattatattcaattataagtcaatattatacgattatttatgttgttaagaaataaaaagtgaatttattgttaaaagaataaaaaagtgaattagaaaaatggtctacctgtttggctcacaatcataatgcataaaagattaaactgtagtagaaaaggattagcttgtagagttattaatttaaacagtcttgtgacgagtcatcccataacagattatcttgaaattgggtaggactttaccaatttaattgaataatcatgagttaatatttttcttttaatagttctctttaacaatgtatcaatttttatgtaaaaagagtaaatattaatttatcataatgcataattaaaagaaaactaataaagcataacatttattatttatgaatagtttagattttattttaaataaaaatcgaactaaatgaaagtattttataaatttgattcagttgagtttttatgaataaccaaatcaaatcaagttaagaaaaccctaatcaaaacctagtattttactagtttggttaatataatatttttattagtattttgttaatatagtatatttctatgaaagaaaaaaaataatgaagtcatgataattaattatgtcaaaata

SEQ ID NO: 5656 - DNA, 1360 bp, Glycine max
  Soy_ogl_6245 Gm18:58183831..58185190 Cluster 25
caaactcctgattcgaatggattccccttcagaaaagtataaaaggaaaggtgtgtgcgcatgtgctgttagtaagtataaaatgccattgctctgtcccatatatagatgtcatcaataactatatattatactaataacacgtgaaaatgcccctttcatttttctattcaagtttgaagttcagttgacaggctcaactgctatattccaataatttatgcgtgtttttgcacatcagaatctgcataacaagatttgattccttttgttattgaggaaattagtgcaacgcgtcaattattatattgctagaatttggttctcagccaaaaacaaaattgttatctctggtcaatttgattttagccttcaacatttagcaacacatgcagtaaattaaacaaacgacgaggggaaggaaaaaatactagcagatcatcaatttttccttttatactggaggtgaaggatttatgagagagggtaaaaattgttttacgtatggtgattcaatttttctttttctatttcataaatttcacttataaagtttaatgcaaattgcgcaagagaaactcttaaaaataaaaaatattttaataaataaaacaaatcaaaattggcaaaattaaactcgtagattaaagctatttggaagagtctttacttttaaagagaatggaaagaagaaaaaaaaacagactaaccactatctaatttccttcaagtttgaatgaaagtaaaaaaaaatactacatgcatttatcttcttttttttttacacaaaattcatttatcttaatttgcgtaattcaattacatgttttggcttattaatcaccgttaaaattgcaatcataacattttttactttaactgatcaatttttataaggatttagtgacaagaaaactttataatagtataaattgaaaaacgatagacgttagactgtatataagaaaataaagtataatttaccttctctttataaagagggcaaaatcgtattcgactaaaacaacaatattataaatgagataaacactaattaaatcatgagacagaaagtgtgtttgcatacaattgggtagagtgtcaatcaagtataatcccatgtgaagattgagagtatactcacaaatatataactagttggcagcctgacttccctcactgatcagaccgagtgaaattttacagaattgcaaataattataggataaaatcgtggttaatgtttggtattatagtaaacaacaaactcgttttacaagaaagcctctaataagataaatacttatcatatttctaagatcatagtgagatctccgtcaaaaacaagtcacactaatta

SEQ ID NO: 5657 - DNA, 1066 bp, Glycine max
  Soy_ogl_6633 Gm19:49835435..49836500 Cluster 25
aaaaccaatttttttaaaaagttgtcttttgaaaaaaaaggacgttgtgtataaaaaataaaataaaagacagtaatgaagaaattgattcctcacaaattgatttctaagtactagaaaaagcaggtgagaaatcgatttgtttgttacagtaaaatatatgatcaatataaatatttttggaaatatattatttgaataaataattaatttatttgtattttttggtgaaaaattcatgttatgtagcatggaagtgatttttgaaaccgtttttaagtgtttaaaactcttatttgtaattgcaggtttgcaagtctcttgtctaactgatgtttgtgccaaaaggaatgcccaaataagatggtctgtactcctaatgtcattatggtatatcaaggcatgtattcgtaatatggtgtgttttgtttgttatatgacatttttattacgttctcaaataacctctatgctgttatgttatatggcattttcattgctctctcaaataatttcaattgttaagtgtcataaattactttacccaagaaaattgtatttttaattatatttaaaaataataaaaatacaataatagactcacattattattttcatcagtaaatgttaattaatttttattaaaatactaataaaaaagatttgaattcattatctctcttttattttatttttttaatcaacaaatcaattttatatttacatattgataaattcagaatgtgttcccaacacactaccattgagaagcgtagtactgcaccacgccattccaatctgtcatgcagtcaaacaatcttgacgcacatgtcccaccctgatgccatgcttggttcagtaaaaaaaaagaacgtaggcccatcaattcatttgggttcgtgctataccagtggccggactccggagccatgctaaagagctgaggttgccggttatcaatggagataatttagatggaacccaggagcattgaagacaactcaaactaagtagattgaacgagtcaaacctactaaccttaaattttgcatatttgctcggttat

SEQ ID NO: 5658 - DNA, 1317 bp, Glycine max
  Soy_ogl_1071 Gm03:43597284..43598600 Cluster 25
caaaatttagcgtacaattagcatttctcgatctattattagtcctattagatattcataagatcgacgatggtaaccgataattgcggtttttaggacaaatcgtcaacataaccaataaactcaacaaaattgcaaacgcaaattaatacaaagtaaatttaatttctactttaatgcaaaaaatacaaatggttactataatagtatactgacttggttgtttactctttttcttttgtgtgtgtgtgtatgtattaagacaacaatatgaagattgaatttaggacttcgagaaaaccatctcaatccctctgtcactaattaacttacttttatttacttaaaaaaaaggagcagagctagagatagaacgaaaacaaatcacaatgaaaatactagatgaagttatctagaaaagagaagaaatgctggtaatttacatcgaggaagcaagagtagtttcctttttccatgcatgatagcaatcaagaaaaacaatagttgatcatttatttgattgcctctttgttttctgttagttcacacatttaaatccattcaattgatctaccaactgaagtggaaaattttgtatttgacggacgtggatggtcacaaacaatgcgtagacacatggtgtgtgaatatttacgtgccataaactatatgctccatgtccccatcacatgaataattattggcaaatgctaaccttatttttgggattaattaaggaactaaaatgataaaaaaaattataaaaaacacacaaaattatgttatttatgatttttttaaacgttcttttgtcatctttacaaaaaaaatatgatctctttctagtttcttaaatctttatcaatgtcataagaacattagttaagcaaatccaaaattattagtgttagcttggaaggggtttttagttagttagaagtcttttcttttcactggttgaaatcttgttcttgaattgccgggacactactcttgaatcttgatacctaaaaaagttaccatggaagcaagtgtctcctactgagcatgctaactaaaaggaacctgattctccttgctggcccctttacaagcaactcaaaagctacaaatgaaagtgaaacaatctcaatgctgcttgcgtgtgaaggtttctatcttggtgttaatttggtcagtcccttaggactggcacgcatgctggaattttgaagcacccgaaattgtccaacctatgtacattaattgagtcaatgtaaagctgtctccccctttgataaatacaaatcatgacaaactgaaaggcttgttgttcaa

SEQ ID NO: 5659 - DNA, 1090 bp, Glycine max
  Soy_ogl_1787 Gm06:3526644..3527733 Cluster 25
aacttttttcatcgtgttagttcacccatcaccgtaagagtaaaaaactaagcaacaagcttgaacctcgcaaaatattgggcaaatacccagagaaaccccctctgcctttcatccgtggctccaattttccggcttcgtcgacatcgttggttgccccaaattttccgactttcgaatcggagacctgtctgttccttcgccggccttggcttcttttctcagttcaccgtggtgtccactcctcttcggccgtcatggatattgggaagggaaaggttgaaaacggtagggaataaggggtaatttgggaaagaatgagaaaataatagaaaaataaaaaaagaaaaggggaaaaaaatctgagctttaatttaaaactaaataaatctaacggtccaaataccttttttcattatgggagacctgcatgtctttctagtgccaaccgtcacctatgctttacaaaatagaatcctatttctattatatattttataaataaaaatgcatttttttgtgtgagagaaaatgaaaaaaaattgcacaatttgataacaaaatatatgacaaaattaagttttcattatatttcttttttcaatttttcttatagaatgaaaatatattttcattatttagcttcacaatataattacggtttcatgaaaagggcatgttgaaaaataatatttaaagcacgagggggtatgaatagtaatttccgtctctcattcttttcttctcaatacatagattcaaacacctcttaccatgctaaatcaaatttgaataggtgcataaagatgttaaaaaagcaaaagagaagtttaaacaacttgatgctcagtactcaatactccgtacattacgtacaatttttttttttaaacgccaacttgtatcaagtcgttaagaaattaattatctgcctcttaaaaataagatgatttctaaacttttaaattattttatgtatttattttttatttatcaattacaatatattttcagataaaaaattcaaaacttactatgtttaaaaacctgttggagcattattaaaatggccattgtatttgtacaccac

SEQ ID NO: 5660 - DNA, 1000 bp, Glycine max
  Soy_ogl_2135 Gm07:2608901..2609900 Cluster 25
atttaatgatccatttaacctgtgggttaaaactagctctcacagactatttttgtttttaatactatcaattattgtttaatgtttttattagaattaggaaaaaaaaatgaagacttaggaattttctatttgaatattaatccatgcaaaaagagggtcgttactcgttagtctgatccattatccatggtttggatataataggtgaaccgtatgcataattcatacaccatgcatcctcagtatcataaccagaggcgttcactcttgttcgtctttcttgcgcaaccttggccaccttctgaaggttgtgaagcgttgcagtgttttggaaattatagagtcttggagcttcaagatgcagaagaaagatctcttagtggggagagccgcattagcacacactaataactcaccattcaccaacccaaacattgttaaattatctatctatctatatatattccttacaatataaaataacataccaaataaataacatattttctttcatttattctcaaatataagaaaaaaaatattgtatattagtctctcaaatataaatgatttttcaagagaaaaggtgttcaaaaaccataacaataaaatattaggttagcactacttctcttaaaacataacaaaaatttaactattttatcttatttaataataatattcttaaaatgacaattgtaatgatttaacgagactgagcaagtataatagttatttattaattatttatttacatcaacaatttttatttatttcatattaactattaaattaagaatatttctcacgtgccataagccctaacagtaacattttccttctatcctttcactcatggcatcgcaatctgagctcctcgcaattgacgatgagcagaacaaggagaacccccaccattgctcctcgcttgctgtatcaggacgtacattccatggttcttatttctcttgatgcttgcagcttgtacaaaaaaact

SEQ ID NO: 5661 - DNA, 1083 bp, Glycine max
  Soy_ogl_4553 Gm13:38569218..38570300 Cluster 25
gtacaaatgcatcactcattatcatgttgcatcgaatatatttaagaaacaagggttaataatttgacataggacatgtgacatagcactatccatatgacatattgcatcagataccattaaatgaagatcgggctataatttgaaagtcatcaggcaccaagagttaagtgctaattttagtggggatgacttgcaaacactatatactcctatatgggggaaaaatatataataattaattgcttaggtaagatttgcaaatatctagctagttatatgtcacaatattaaatgcattgaagtactaatatctaatgtcgctcaatacatgggaaaacaacatcaccatcctattttttaaagaatattgtggcctgaagtttatcagcaatgtgtttaaaacttgctatccaaatagatggtgtcccaacttgttgcctaaacaaaaggttgattgcaaaaggcggctacaggaataagagtaagagttctaagggcgatgtggtaaaggcctaaatggtctactcatataggagtatatagtgtttgcaagtggtttattttaattatcatattgagccaaaatatctataaactatgtcaataattttagtagaatttttcttttcaataatgatgttttttctattcacaaaatttaaatatgatattttatttacaagatccaaacctaattttgcctataccaatataatattggtaggtaaaaatgtttagtaaacatcgttttaatttatacggaatctatatgatattctaaaccacggaaacacaatttggggtaccatttcaaaatggacgcaatcaagggaacgggtcatatgctacaaataagggggatttgatcggagatgatgggccggttgttccgttcattaggtcaatctttcagttttagttagatctgctttagatgtgttaggttatttaatatggggcacttattcaatacagccacaggactcatatttttaaacgtgtttctcactttctctactccctcttcctataacccccaccaaatgtttaaaattataatcttacttttgattatgatta

SEQ ID NO: 5662 - DNA, 1215 bp, Glycine max
  Soy_ogl_5453 Gm17:1940286..1941500 Cluster 25
ccattaacataaaggcgaagtaaattatgtctgttacgaatataagtgcaaacaaaataaatgcagaaattaaatctaatgttatatttatcaagatttagatattaattaatgatggtcagagtagttaaagattcaaatttccttatattttcacctagattccatacaattagtattagaagttgagatttcactaagataggttaaccttacgttaagcccaattcgttggtacaaaactactttaaattaaccctaatgttctattttttgtaattccattaaaatcaaatcaaacattaagtgtgaaattcacaatcacacatgcatcaagaagtactattcctaaactcatcccagtacgtggtaatcaacttagatcaagaatacatatatacgattcctcatcatacacatattgttaatccatcttaacgtacaatgattagttgatagatggtattaaaaatagaataacaggaacttctattaaaccaaagggttcaaacacagaggaattcaatagggttcatctaacccaaaatacaataaatttaacaaaacagagagaaaatacatatatgaaaacagaatttttgagaaaagtgtcacataattttatatccttattttatatctttaaaaacagaatttttaaggagatagttttttttgttgagccaagagtattgtataacatttgaaacaaaatatttaacatgatatttttgttataaaaaaaaagctttataataaccaggcacttctggtatgacttatttaaaaaaaaaataactatgctaaaaaaatcatttttttctcacatgattcacggtgattgtaaacttatttgaattttacaaatagacaactactgtttacgtcttattttcatatgaaataattgaaaactatttatctaaagtgaataaagagtacactttagatatgaaataatatatccatgatcagaggcgtccttttaataaccgtttttgacttggtccaaacaactgatatatatatatatattactttctgagaaagcttcctgtcctgttagatttcaaactttaacagtggctggtttaggagtcaagaaaagaagaaatgaaaagcagcataaacacgatgggtctttcaccaccgtaaaagctcttccaaaggatatgctggtagagatttttgccaaggtggccactcgctccatct

SEQ ID NO: 5663 - DNA, 1200 bp, Glycine max
  Soy_ogl_4366 Gm13:30606401..30607600 Cluster 25
gtctaacccgtgaaatttatggatttgacaggtttaatccatcagtttgcgggctagcatgtggacttagactgttgttaatttttatgttaaaaatgtgtgtttttggactattgttaatttgttaggttaaaaatataggtatattttagttataaatgttggtatgttttagtgtggattttaacttaaaaaatgaaggaaaaaattcttctaactttatacatttttatttctttaaaaatattttttaaattattatttgagtttatagatcagcttatttatccatgagtttcatgagccatatacgtatcttaaaaaaatatttattttgtgaaccatgcttattcagcccgtctaaaatatggacttcgtgggttggatcttatataggttagaccagtatgtatactcacctctatttgtgtcaataagtttaacaagaaaaatacaagtccatacaaatgagtctttaacaagttgaactgacctatatatttacccaagtctaatgtttacccgaataagtttattagctttttccaacacgagaaaaagaagaagaagaatggttggatctaaaatcccattgaaggaaaatgtgagaggctaagaagagagagagaatgatcttgagaaaaaaagtgactaactcacttctacatattaataaaaagtggataatctactattagagataaagattagtggtttgttggtacctcacttttgagatagtttgccgtaatgagacccttatttgacacatgtcaaataatggacaagcatttaaactccataatcgacaataatctaataacagtctaccacattgatcttataatttgtatttttctcttcattgaacaaacttttctctctctttgtaatggcagtaaaaaaaatgatataattttaaatatttacgcacattttagtgatttattattttttcttacgaatcattgtaacgctagtcatatcaattttatgctacaattaaatgaacattctaaaaattttaaatcattgaaacatgaatgactcatatgttagtactttactaatttattgttcagtataaaaactatgttattagtgttaatatatttttttaattcaaatattgaatgtcattgcacattagaaacctaattctttttgatcatatgttacgagcttgaagtataattaaat

SEQ ID NO: 5664 - DNA, 1260 bp, Glycine max
  Soy_ogl_4416 Gm13:32918141..32919400 Cluster 25
tacatgataatttaaactttgaattgaaaacttcaggcttaatcaatggcattaaacatagcatgtatttacttttttttatgacaaatagcgtgtatttactaaaactaatataaaatactagttgaaatgctcgaagatttagtcaaacaaaattataagctaatcaaataagtcaaaagttaacctatttatcctataaaatatactgataatagaagagaatatcagtctcttatatataaaataatgaaatattgttcaaatttcagttgaaagaagtgtcatttatattctgtgcatcaaataagattacttgatgtaacaaagaaaaaatattacttcctattaatgatgtttctaaaaattaaaaacaaaatcaaacttcaattatgtatttatgtataagtatatttatgaaacaatttaaagttctcagcttccattttgacaacgttacaaatacataaactagactatcttagaaactgatttttattggttgtctttcattaataagttgacaataagtacaattgtaagttatagcaaagacttttggcaagatacgaatttagagttgaattattccttattctaaacttaacatttataagtctgtagcatcattacagactaattttgctatcatatataaagaatagcatccaatgcgaaggaatgagcaattaagcacagagccccctcaaatatcaaatcaaggttatatctgaaaataaaatactaaacattttcacatttctgttgctttatcatttatcatacaactatacaagtcctttcattaattggctactggcttgaaaatccaaccaccacgcgtcgatgtaaaagccatgcagaaagagattgcttggcatgagttactgccctttgctccgactagacaagtgtgtgtcttttcactcttacgtgttataacgccaataatgtccttcaaaaatcaaaataatccaataaatctcgcgatgtaaattaattaatttgatcaattatttctttattttaaacttgaattaaattaattataattgagttagttactgttcgttgattttctttgcaaatatatcaaatcacataaataaatagtataaaaagaaagtttaaatatggtatttatagaaactcacaaaatacttttaaaaaaacaacttttgctaaatacgggtttcgggaatgataattaaaaaagtaaaagaataaggaattctttttgataatttttatgaatatttg

SEQ ID NO: 5665 - DNA, 1762 bp, Glycine max
  Soy_ogl_6156 Gm18:53538305..53540066 Cluster 25
tcttataatttaaaacagagggagtaacttttatgcaaccctgaccgaccgagtctatgtttgaaatttagttgaattcaacgttaattgattttcaaaagaaaattacaacataattgctttgaaatttttgcattgaaacacacaatctatgattacaacactaatccaaacacatcatggatctgcatacaaaaatctgtgtaggattgtctttagtttgtatccaatattttttcaacttgtaattaatttccctggcgtgaagcaaggtcacaggcccaggcactggaccagctatattctcagtttcccagactggaaactgttgagagattcgctgcctcagtaataattacaatgtttcttgctttgaagcaagcaaaatccaaagcctgcaaataccttattcacatttttggtcatgccaagatcgagtggctcagttttccagcatcaacagtggctcatgaactaaattgggtaggcctatcaagaaggtaattcatgcaacatgcatgcatgattcttagtattgattaaactcagcttgacaagtgagacaaatattgcacatatatgatgcagctaaaatacgtgaccactcttggatatgtgtaatagtttcatatgcagaaattgacatttgacaatacacgctacaaaagccgtgtccaatcactttcaaattttaatatttatagtgagtatatatcaaaccttgataaagaaattcacttgaaaatgatttatgctctgtcaagtctttctaaattgatatggctatgacatgctatatcatgaatttcatccaaattatgggggcaaatttgttcccgcaaacatacgacaaatatgggttctgtgccttttaggatttatggacaaacaaagtctgcaaagcttatgggctatggcattggcgtgcgatattttattcaatgtttttgttatattcaaatgattttattttttgttcaaaaaatttctgtctctcaaaatataaatgaaaaaaaaaaaaagtgaataaagtgagttccctgttgaccggggcaaaagcttaccctcgtgaaattaaagccattccctccaggtgggtcgagtgtaccgcgagggaggtcatgttccctccattcatgtttttatttgagtttttatgtaatttattttctctttttatttatttgtcttaatgaggctcctcaaattattattatttttactataacttagctttgttccggattttcttgaaatagaagaacactatatacagttagcaacaagctcatttacatgaaaaatcaacatttcttgcacgcacagttgtttattgggtacagtttttaaaaagctcaagacagtaatcaaatcactaattttaacaaggactttgctgtcttttttagtcattattttaatgtattttgagaatctaattaattgttactaaggagcatggtggtcaagctagaattgttaatgagttctctcaaattcaagttttatatatatatgcacacacaatttatttaataatcaaaaaataattttatcaactataataattttacttaattcatattttatggactataataattttactttactcatgtaacctcataagaacgtaaaaaatctctttcacacacacatttatataacttgtgtttgaagtgtaaatactgagattcctttgcgaaaatatttttcaaaaattcttattaaattcctcatgtttaacatttccaatggtata

SEQ ID NO: 5666 - DNA, 1200 bp, Glycine max
  Soy_ogl_2087 Gm06:46249701..46250900 Cluster 25
cacctcttaatttctttcatcctttttctctgtattgattttttaggtattgataataaacatgttctataatatgtttttgttagttgcatgtttatatgattgttcatgaaaattttacgattcacgaatctctcgaaccaaagacgacgaatattaggccaatcctatcatctgttaattttaggcttaaagtaaaaataccttttggaccctttctactacctttccttacttcgattttgctgtttggtttcttaatttttttaatagggaaaaaatattattataactaaatgagtaacttaaggtagcggtaaaaaaaaaaagcttagcataacatagtctaattaaggagatacaaaagaagtttgtgaatgaagtttttgtttttgtactagtgttttgatttgctgacattccaaggaccatttgtagacataaaaaaaaaccctggcagcatttcctagctactcatttatgcgatactccagccagaattaattccctgacctacgagatataaaaataatactgtacgtactatataatatcacataagtgccaattttttatattcaaacaagtgatgaataaattatgatattgtgttactcaaaaaaaaaattatgatattgtgcattatattacgtaatttctgtcaatgcgctaacagaaaatagagagacatgctgcatacgaaatctgcttatgactaccacttcatgacaatgtggttgccgtagaacatgcccacaggaatcactgcaatctgaaaacataataaaagatagcatctgcaagtgcatcaaattctggggtttgggataactccatccttttaattaaggcaatttttttttaaaaggtgctggataaatagataataatgtttatcagaacataaaatcttttgtaaccagtatcgtttcataaaaatgaacgttctatatagtgtttggtttgatggtaaaaaattatggtgaattaaccgttaaagaaattatttgttgtttctgaaaaaatttcatgataatatcatcttaccaccaattcaaacacacacttaaaagttctgactttgtaaagttgatggttgaagttcttcataatcaaagagaaggacatggtgaattgagctaagtttgtgaatttggtgcttcagaagctataattaattaggagcctacattatctaat

SEQ ID NO: 5667 - DNA, 1244 bp, Glycine max
  Soy_ogl_4349 Gm13:29737501..29738744 Cluster 25
ttatgaaaaataaaaagaagaaaaaacactgaaaaatataagaaaggtaaaaccaaagatgtatttatggtaattgtatgattttctaagataaaaatgtccttaccaattaaaaataaaaataaataaataagtttcaatgaaaagaactgataaatcatattcttttttaatctaaattttatttatgtctcaaatgattcaagaacatatattcaaatgaattttaattgaaagtgagaatgatttgcatatttcaaataactagaacgacggaaactaataagataataactacaaccaaagaaataacaagcacttgaacatgtacttagaaactccctatttgccattagagatgttaacatttttttttatatcaaaagccaaagttataacatcaaatagagaaagacaattccaattagattggcatcaacaaccaaaatagcacacttcactatattaaagatcaaagagaaaataagatcatgggaacaaacaaccaatactcatgtacaatcataagaatctaaaataagaaatgtcatatctattcctaaaaaaattcgaaataaaacatgaaaggaaatcctaccaaactaagctattagtgataataccataaacgacaaatctattcgtacgaaaattatatctcataatagatttgaaaaataaagaaagacaaggaatgaattagatttatacactttaaccatctattcctaagtctctttgaccaatttgaaagcttggatagcaagcacggaatcatattctatcgaaagctttctccaccctttatcaaaagttgtctcaatagctatcataataccaagtaactcaagatgaagagcaaagaaattacccaaattgaaagagaaactaccaataaaagaaggtctataatccctaaaaacttccccgtaggcagcaggagccggagcacccataggcgcccccatctgtgctgcatttgatccagtgacaagatggtgctctcccattaacttggaaaattttaggagctttagaaggatggaccggaatcagaaaagccttcaagatttgaaattccattatagcccaaaacatagaactataacttagcttaccgactaagttaataccagctgatatataatttttgcctgctggaatcgaaacgttgacatattgaacacctagaaataggaacaaaaattagggaaattaatttttcctttacctgtttagatgag

SEQ ID NO: 5668 - DNA, 1000 bp, Glycine max
  Soy_ogl_5009 Gm15:12049901..12050900 Cluster 25
tttacatcggttgaagccacaatttttcacatcacttaacaaatcggcatcgagagttgttcactttctatgtcgaccgatttaacatcaattctagaacgatattaaaggcccactgcaatcaatgttgaaagtgcattatgtaatactgtttggattcattttgtactataaggtaaaattacactacctagtatttcataataagcttcatattcatataaatagtaaccaaagaaatcctatgattttcttgttttaaatcatagctttcaaggatttcatatataaaaaaaattcttatacatgaaatcaaactgcaaaaaaatatatttatgttacaagtaatatattatatgttaaaacaaaatagtctgacaatattaatgagtttaattaagattatatatatatatatataagctttcaagataatagttaaattgatacagtttatttatttaagaagttgttaaaggtataatttgatcttgtttcgtacagttgtccagaatttgaaaattgatgtgtaaatggtgaaaattagagttattgccaaagtttgtattttttgttttcattgtaacattgtgtgcagtatccaaaatagatatatatttagaagttgtttcaaacaagacaagtgcaggtccaaaacacaagagttagtctacttcagcccataatgcacaccagccgaaagcccttgaaaacaattaggtcgaagtctattgcacgacccagatgaaaggtgaatttaatacatcttggaataaagaaccatacctcaaccaagagtaaactaataacatatattacttccaactaagtgaaagcttcccaataaggcgatgcaacataaaccttaactcacctcaaaatatccttataaataggttataatttgcagtgtcaggtaggcagttggcatttactagcattttattaaaattctcaataacttaagttttagagttttaccaccaatcctaataatgta

SEQ ID NO: 5669 - DNA, 1200 bp, Glycine max
  Soy_ogl_5553 Gm17:6619901..6621100 Cluster 25
gggggtccttgagatcgagaaagatacggtattcgtggtttaatgggtgtcgctatcacaaccctccaactatgcccgagacccagtcggttggagtgaacccatctgggccctacgctagccctatcttcttcattccgtcttcctacacactgcaccatgactctactctctacctactcttcatttccttctccatgctatgctctctcactccacccattattgcctgtcccaacttattcttctttattctatttcactatacctctattactttacgtgtctatttagtttcatgttaagaaactaattttcagttaaagtataactcaaaattaattataaattcaaataaatatttatatataaatcacattacttcaaacataaaagaagaagaaaaaattctaactaatttatatcaatctattagggtcatcaggggtttggatagtatatagaagattttaaattctaccaatgaagtttagtagaactaatagaaggattagtttcttataaaatgataaatcaaaatacaaatctgcatggaaaaagttatacatatttagtgttcgactacgtctcaagcaaaattatttttaaagtaggaaaccttttttgaaaaatttgaagttctaagttctaagtctatagttatactcagtaaaaaaaaaacctctatagttatataagactcaaatggaacattgaaaaaattaaatattttataagatttctcaaaagcttacttaataatcttatttttaaatagtaatttaattgaaagtaaaggatttcttttatcaaatacaactaaaaaagattattaagaaactagtgaactaaataagaatcaggttaaacttatatttcaagctttatgtgatagatttattttttaaaatagattgtctccactaatctctacttccaagtttaatttagatttgtcatccattgtttactaataacgacaataatttaattaataacatacacacacagaatttgtaaggataacggattgaataatctcaaaccccaacttaggggatacatcaaaatctcacccaaatatgtagcttcctattaatctgttgtattaattgcatattttagagtataaaaaacatatcagatattccttcattagacaatacttaaattacatcctgcttgctcttttgtctttgt

SEQ ID NO: 5670 - DNA, 1024 bp, Glycine max
  Soy_ogl_6179 Gm18:54931477..54932500 Cluster 25
gtagtttttaaactagtttattttccacacgttacttttcatgcttatcaaataaaatgctaaggattcgtcaaggtgttacatgacttagacagacattcgcagactcaccactccgacgttttactttgccgacgagatctcgattgtacttggcgctcgacaacggaaaggggaagggggaagacgatagagagaggtcaatcgatgggtttgtttgtgtttggcgttgggtttgattttgaactaatctggcattgaagtatgtttgtttgatttgaataatctgttgctgtgattttatttatttatcgagtttaggaaatgaagaattttcttcttacactagggaagcaatttctggcggtgaggtaaaagtagcagcctgcagccctgaggttggagcttggtttttccaaatagctagaggaatcactaatggaaaatagaacggcttggggatagtgagaacaaattgttacgggcatgcagtcctatcattttcctaattaattttacaaattattttatttttctaaataattttaaataaatatcatgatatctttctcagctctatcatgatgttatatgtttctttaaaaaaatcatgatattccacgtcaacattttatttaatattatgtgtcaattagttagcaaatgaacctaaattacataattaaaatatagtaatgaactaacggggaccaaatttgctggggggaaaaatgaaaggacttcacattcaataaatagtaaaggaaccaaatgcaattaacccttcaatatattcattactaaatacttcgtgagaatcacaatattgtatacgtattttgtagtccaattttctttgccttgttaaacgatctaagagtcattaacaaatttctaatataaaaagatattttatatttgaaaactgaaacaaatcaaacttcaattttttaggtattttatatttgtactttcttctgtgataagctaactgaattttattacttaaaaaagagaaaacatt

SEQ ID NO: 5671 - DNA, 1129 bp, Glycine max
  Soy_ogl_2383 Gm07:35735101..35736229 Cluster 25
attgtgtaataagtcattaatatatatgtgtgactgttaagcaaaacaaaaatgaaatagagggatttagggtgtggggaacatatgttaggtggtgggttgaatgctcaaggggcacaacacaaatttcagaaacgtgaaatacttcctcttctatctctgctaatgaaatcatttccagcagtatatccattgattgcgatcaatagttcattaaattttgttacagagataagattgcatcttccgcagagaaaattaagactacacaattctgcaattttaaaattttcaataaatatcagttaataataataaaaatattaattaaattgtatatttctagcttttcccatactatagtaattaattaattactattactacatccactacaactagctaggttcttagaaagggaaaggatagatgttacaaaaaactgtttggttaaaaacatacggtttttctgtcaaagtagattatatttaattctctttgactgtaatttattaatcaaatttcgtttaaaaatagctgtatacgcttgatttcatgctcattgcatgttttcgtactaaacaacataactcttttaaaaaatggatcacaattcacaactgtgatcttaaccgcaacataactctttcatgctcatacacttgatcgtgaccaccacaatgcagtgcatcgtcttatttatgttcagatttctaatctcaaagatcaccccaaaaatgccactatttaagacctgattaccataatattttaacagtacgaaaaagtattgaaccagaaaacacgaaaaccagaaatcaaagcaatcaaccacttctcttgatttctgtcaatttcattgctttttttctttttatttaattttgaaccaacaagaaatacacattcaattgatttcgtttcgtgacatcacatagcatatctcaggtttacgtcacttgtgttgacttgcatcagcaaagtgaaagtactcattagataaggcagaatcattcatgaacattgagtttagatctgcttcttattaaaatcgaatcgatcggctgaattaatctaaaccgtctatcttcctacgtctgagccacatgagaaacctaaggaatttaat

SEQ ID NO: 5672 - DNA, 1169 bp, Glycine max
  Soy_ogl_1635 Gm05:30736632..30737800 Cluster 25
gacaaatccttgatcttgtaccaagcatgatatagatatacaaacatttgctaatcaattatcataattcttcgttttaaattgatttttttaatatagcagtaatagttgtctttcaaattgaaatattaattaaattttcactaaatataccactactattgactagccggcaccatgcgggccagggcaaattctggctttccttctaagggaacgaataaaacgacttttgtcaccttctccaattattaaaacaaaaaacacccaccagaatttcaagcttccacttgtccacaatttgccctttggaaatcctttcaattttttttaggagatagtaatcttcttcgtgttaaatatgattatgattattatggattataaaattttctgttttgagtatttaatgtggttatatatttaagtattaaactaaaaatcaatggttaatctaaaaactaaaatgatctcattctaatttatatttttttaataaatttcaactaataataagaattgtatttaaaaaatgagttgaagaatatgtttccatatcccatcctttagtatttatttatgttttaaaaatagattttgtgattttttttatcttctaaaaaagtattaacatttttatttatttttacctttttattaaaggaacttacatagttattatgatcttttaagacaagttttttttattaaaaatgtttttcataaaaaaaataagacaaatggaccttaatcgtatcccttaatttcctatttttgggtggctaatcactttagttttctacatcatagttggcaaaagttatgcaagaggagcttccttttaaatgaatgaatcaacaataagaattgttaaaattgccccaattattttgtgtaggtgtgattgccaacacacagaagtgaagttaaaaccatgttttaatagtaatcgtgcaatatttgtaaatgacatgtatgcacctgtgattgcatattaatttatttttgttcgcataactagcttccgatcgatacgatattgattaggctaagtgcgggctaataaatattgcatttgcattaattattcatttactagagtgctttgaggaggattaattttctaatatcatgggaattcatatgaacctgggcagtaattaatgcca

SEQ ID NO: 5673 - DNA, 1118 bp, Glycine max
  Soy_ogl_3032 Gm09:6507601..6508718 Cluster 25
tgaaaataaaaatgacaaaaaataaagatatttatttttaaatagattaaaacacaagagctataagacccacatgaaatccaacaatttcttctctatttctttttctcccctcaatcaaacacaacttaaaagtaattttttaaatactacacactatcgccatgatgataaaaagtaaaataaaataaagaaaaccataaactttattttattcaaagagaaacatgaacttttaaagcaatcgatagatgtttgtaacttgtcgtgcatggtgccatcatggttcggtgatatcctttattgtaaagaaacaaacaagtttaattaatgttatcatatatcaatcaattttctctctccaaattttgtaaatcctatataatcttcttcttttatccaaatctattctaaaaaaatcagaaaatgtcaatcaaatgtagatgataaaacatgagatcaacttagattaaatttaaaattataattaaataatatatatttttagaaatgttactaacattattttgaatacactctctttattgattaaaatttattaaaatcacaaaattgtatagatgatacctcttatttgatgactctgtcttttaattgtgtaatttttaataagtttaattcatgaggaaatgtgttattttttatttgaatgtaatagaatcattataaccgattaaacttaaatatatatcttatatctaggacttgaatcaaatatttgtaattaaattaaaataattctaaatcagttaattcacatgctatgatataattaaatcatctaaattctacacttcattttacgatcatatcaaattattactcttttcctaaaattttatcaaaatcaaatcacaaacacccgtatgaataatttctaaccagaaaaaagcggtgaaaaacaaaaacaaaagtaaaaaatagaaactttatccccgtcgttgttgtacgtacaaacagcacacaacacaagcaaagttcgcaaaggcactgtttggagtttggaccacgagaattgtcaatataaaactgaggccgttggatgcgactgtttgggtcgacagtcacacacggtttagtttggattgtatcatggc

SEQ ID NO: 5674 - DNA, 1004 bp, Glycine max
  Soy_ogl_4267 Gm13:25779797..25780800 Cluster 25
gaaattttattttactattatttgagtttgttaggggttataagactcatttaggggtgaaggaaggagagagggggagaagttgtggattagaatcctctccactaataaaaatatctaacaattaataattaatatttgtcaataaaaaaattatatttgagtttgttgttggatattggtacttatgttgtacttttttacattcttttcttgtattttttatttttttttaaaataaggtgagtcagcttgtgaactaaaccacctaactcatgggttgaattggttgtatattttttggttcacaaaaaatgagttaagttgaggttactcacttcttagacaatcgatgatgaaccaactgtaatgattaacctctatgtttgaacatgttaacattttggactgtggtgatttgtttaggtgatggactaataccctatatgcagtttttttttttttttataattttaatattcgcaatgtgcaatgtaactgagactgtaatgacaattatttttctaaggtcttcatacttccccaatataatatataatgggggaggagaggatatgaggtactttttttttataactatatttggatactcttttttaatatacttatttaatacttttcttttctcttcatctctcactttttattgcatcatatttttttttataaactcattatttctcctttttaattggtatttgaaatttggatgtccattaaatattatcttttttcatagtattcattctcaagggattcgacgaggcagattccaataatctcgttaaattttttgtgtgatagtaatctcattaatctgacacaaggccagttcaactttagcattcaaacacctcatgagattcgaaaatggcgtttcccttctaacccttcttcgtttccatcttggggaggctcatttgtggccttgaccaaaaagcatttataaacacgcactaaacaaataaacatgccaaaggtaa

SEQ ID NO: 5675 - DNA, 1200 bp, Glycine max
  Soy_ogl_5412 Gm16:33714201..33715400 Cluster 25
tttttttttttcggaaatgagattaactagcccacttcacaatatttttttaatgcaaatatcaaatgggatcttactattgtcatggctaatggttcctatcaagaggttgacacattttttttctttctaatttttttttcatgaaatacaattttttataccatcgcacaagagaatcgtatttctagtatgtgatagaatgtgaataaatctgagttgggtcctaaattagttgatgcttgtaggaggataatgatccgtaatccaacctttaagatataggttttggtaagagaggcaagctaatgggatacttcatgagttagtcagggtaatttcatttcatttttatcttagtcactatacgtttaatctagttattccatatatgtgttgaacaacttattttaaatgaaataatatgagagtatattctagcaaaagaaatcattatcatccaaattgatggttcttgtcataatcagaataaaattaatactatgatggaaatcgactttttagttcaacattacagttacatgcttgtagcaataccattattaattgatctggttcgagacaagaaagtcccttcatttaaccaacggccaactcctttctaccttctcaacaaccctactaaattcgtgtccttttcaattaatattttcaaaaatattttaatgttcacataaaaaattcttttagtgcagaaatcaagaaaaagtgaataattcatattttaaacaataattaaactaaagtagaagatagtttgtgagaaaaatattatatataaaaataaatgatacaatgatttgttagacttcgtccttatttcttaacatatgaataaaacactatctgacacatctttttctcgtcttttttttatatttaaaagacgagaaaaatagttaaaatataagaagtgcttaaatttttaatatatcaaactatttacttttaattaagtatttctttatttttaactaaaattgaaatactcaattaaggaattaaaatactattataaaattaatatacgtattattttagtgaataagtaaaactatgtttttaattaatgtttttaaaagtaaaataatcattagacgatgtgtgtgtatggcaaggtaataatagaataaagtttgagtttctatgctgcttcgaataatttggagattttgatac

SEQ ID NO: 5676 - DNA, 1000 bp, Glycine max
  Soy_ogl_6307 Gm19:372101..373100 Cluster 25
agacttaatttggagaataaatgatttcaacaatccaaaagaatcaaaagattacacacgttgcttttacatacgaactttaatcaattataaaattttcttttacccctcaataattaatttcggttttggactctttttttataacaaagcaaaatataatattatctatttatgaggaagaatcatcttactccaagagttattaaaaccggtacaagatgtatcatgcatcaagatccaaaacatgtacatggctgttgaacatagcagaatacaaacaaaaccccaacagcaagcaacatgcattctgctataaatacagaaaccgcaatcagaaccagccaacatccttttcttgagttataggataagaggatatggtcttgttagaaattaaatgctttttttcataaactattattaaaccttataattgacgatcaattatgtagtgagtcaacgcgttatagaattgtatctttctctctttaattatatcttattgttataatcaattcttggaaagatcaaatatccatataatttttacatttctcatgaccaaaaccatccaaagagaatagttttaaccatcaataaaaatttgaatatatgacaagaaattatatatcgaagaacttaattgcctattgacaattccattttccagattaaaatttgagatttaccagaaaaaactgaatagatatttagagcaaaaaatggataaaacagggaaaagagattatggcaccaaggaaaaacaagattacgttctcccaagcaatcccaagaacaacgacaacctgcaaatgtaagaaagagacattccataactttaattttctttttccttctcttgtttcatatataagaagagaggcaatgaagttgtggactagaaaaaacgttattaatattgattatatatatatgatcagttgtacaccatctctatcttcatagtttgatttggaagcattacttttattataaa

SEQ ID NO: 5677 - DNA, 1564 bp, Glycine max
  Soy_ogl_2710 Gm08:15724601..15726164 Cluster 25
ttaaacaaataaacttggtcaaacatttagtgaatcaaactcaaatgttcacaaataatttgatccatttacatctctaattgtccctttacagtaactcttttaaagtatcaaatatataccgccaaaaaaattgtcacccccttgacccctcccacgagagaatttatcaggtgatctgaactctaaactacatagtctcttatttattgtttcatgacatacttcttaataattcataaagtcatgtagtaactcattagttctaataaacgaagattggggtagaccctcctcctcctcctcgaacaaacaactaattaattacataaagacttgagcatgcgcaacattggaatagtatcaattcaattcaaacagtttatcatgctgctaattccataaaataatatcctaaaaatatgattcactcatcaagtcatcattaacttatcaaagtttgacaagtattcgtctatagttgtggtgattgactatttggttggcaaagttttggcaaacgctcaacgtatgcctttctcaactcttaagcgaatcaatgcttaatggccacagtctgccagtaatgcttaaaccatgtgcatgttattctacgtaacctcaagactgtagaacaaaaatgcttgatgacaacctttatgattaaactatgagcatcatatggtagaatatatgtatagctagacaatgtgttatgacaaacatttgtcaggtattaataagatcatgtggttaatatacatgacaaagcatttataactaataatacaactaaattgaactagaaaaatggttgtaggaatctatagtgaaattaagacaatagtgaaaataacttccacaatatatgcatgattcatttctttcttttcaatccccatatatcactttctacattaacaaatgtaaataatgctttcatttatctcattccattgctggggaaagaaatataaatgaattacgaagtggggcataattaccatagatgactctgagctagccttgactaaggaaccaacgaagaatcacttgaggcttcacccttcaacacataaagttgttgtttccaatcacatgggtgaatccaaacctttaatctgatctccaaagatgcaaaaaggcattgtcaggatgaacatacatagagaccaacaatgcacacttgtagcaaagaaaacctaattatatcgtgattaattacctgcataatactctttggtcaaataggttacacgcataattaagattatataagttaatcgtttcaccttatttttctttgtttgagcagaaccctgacatctcttttgttgagtaaccacgacaaaaaaaaaaaatgattgggatatatgcatgaattaatatctaagtcacaaatttatattagaatcatattttttcattaaaaagtgtaaaaagcagttttttttttaaactttaaaacaaagaacgtctgcatcttgttaccatgcaaaaagacaatgcaagaactatataaaaactaaaaagaaatctttttgttaagactagaagtattatt

SEQ ID NO: 5678 - DNA, 1000 bp, Glycine max
  Soy_ogl_457 Gm02:9599401..9600400 Cluster 25
attatattgttaagttttgtaagatcattttttaatgtgatatactattcaaggatcaatttgatttgtattttttaagattaaattaacatttaattgtacaatagggttcaagtgaccctcatatttaattttttttacaattttagtctaatttcaacttttaatgataactcaaatgaataaattagttttaagattcaagtgaacttaaataagagaaataatattaattaaaactcagcatttagtggctattttttggcatcataaaattaaaagatgaactaaattcacatatttttaaaagttaaactaaaatcatcaatattaaaatataaggaacaaaaaataaagttacctttaagcacgtgattatctggcatgcaattattcaagcttatccaaagacaccgatggattttggccaaaaattaggagggtggggaattgattaaaaaaatatacttaaaaaataatattaataaatgcatttataaaaaaaaaatctatatttactaaaagggaacaagaaaattgtgggagcaagatgactatcctcattctcaagaagtttagtcacatattagatgttttgaattaaagtccaaaacacataattatattaaatatttaaaaataaaaatttgctgcatacagtaattatattggattccaacataatttcttctgcctaatattcctcaagtggaacaaaaaattcgcaaataaaacacatttttctaaaaaaaaatagcattgtccaccaagaatccgacagattgacataatggttagacaactagcacagacattgtggaaatgatgtatctatctgggtatagtgaattgagaatcgtaggtgtggcacgtgcggcagaaatggaaggttcgaaaagctgagacctgcgccgaaatggaaggttcatcgtgatacgcttggagccaatgaaagggcagttgtgtcagaacattaagaaagccactcccactccaactc

SEQ ID NO: 5679 - DNA, 1034 bp, Glycine max
  Soy_ogl_186 Gm01:47553967..47555000 Cluster 25
ctaaactaagtaagttgatgtttcaacaatacacataaacatttattagtactaaaaagtttatatttacaataaaaaatgaaaaataacttaatttgattttcattttcttaaaagaaatcaaaatgacgttgcattacaaatttttctcattgacttgctacaaacttttttgtctgattttcaatttttttgattggttttctttaggaccattttgtagtttatttgaactggttaggtgattagttcaccagttgttaggtccgactgaccagttcagtataattttcataacacaactaaattaataatgtgttgctaccacttttcttttatgactgggcgcaagactagagccagagcatataattacatttccaaattcatcttgctcctctttgtataaactaacaaaaaaaacccagttatttttttcatctaaatcaagtcgaagtaaaattaatactcacaattttgaattaatatatgatactattagtaattagatgtaaaataataataatgctacaagtgaatgagtggattgaaaatatttgtaaatattgcgcctgtactatcatcttttcttttactaaaaaatatcatattttttttatcgaagaaaaattgttaatcgagccccaaaccatgaccaaaatgtacaaaaggggaatatatgaataaatcaacaaaactccaaactttaataatttcaagttatgaagcttgttctttaactgcttacgggttctatctctgcgatcgacaacaaaaacataatgaaccctaaaccagagaaataatacattaaaactccgtgtgttttatacaagacagcagttcttaaaatttccccccttttgctacaaagcctgaataatgaatagtagtgtcaccgacatagtttatcatattatgttaatttcataatttaatcaaaattacctctatcaaaattatgtgctttattctaattttaccgcgacactaataatacaaaatattttcttcctttctttggaagtggggac

SEQ ID NO: 5680 - DNA, 1400 bp, Glycine max
  Soy_ogl_704 Gm02:47041101..47042500 Cluster 25
caagttgatgcatggaccaagaattggaacagaaagaagggagtatatatgaactttgatagtttgtgggcgcgcgaatctcatcgatcagggggaaaagtttctagaagatcaatgccattgttaaaccttttgctaccaagggagctttgtaatgagctaggatccatatctggaatttgttttatgtgaaaaaggcacttgcacatgcaccacgacattttgatattttgaagaaggctcaaaggaccaagtgccatttctaatgagtacatgcatcaaaattcttctgctaaggcttgcctctttcatactatagagggttcaggttttctgaatgaggatgttttgagggtaggtaggggttgtcagaagtaatgtgaaatgaagatcatgatgatatgaataaggctatatgttgattaattgaaaagagagtattttcaatcaaggaaagcaacaaagacgattgtgtgagtgaagaaagctcgtaggtgatttgtaaatgacattatcatatgaatggtggagatttcatgcatactgaaggattggagtagaagtacagtagtatatatatatgttcttttgttgcactgagttcaggacttcaggtggaggtttgagttgagggagacataatggccgtggattgaaaatgttgttaaagcaaaagttgttggtacgtgccacgtaataaggtttttaaggataccatgcatataaattgttgatcattcatcaaagaatatatggtgcataaatcagatttatatagaaggtattgttacaagctagagttgataatagaaatataaacaatagatcgactatacgagtttgttacaataattcaaaatttgcaatcggataatgaattttaaccacttgatgacttgtgagtcacgtgcctgtgttaataaatcattcaccaccaacatcagaaaataacaacggagaaataatgtttgaaaggtctttaattaagtaaattatccaaatatcatacttttggcataaatagttgagagactttttggttagtacgtactttctaattagtatttatatatctgcttgtccccctaagaattttaattttaagaagattaattgttaatatcatgacaacttttagataagataacattaatttgtgtgtgtttcgacaaaaaggtgtcatagaaataaaatattttcctactaattaaatttattaggattgtcatccccttctttagaattgattatcaatggatcactactaaaaaaaaattaaaattagtaaggaaatgtagtgatggactactaacagtgaggacctttgtgacgaacacaaaattatgtcactttgtacgaatttagtgaagcactatttaatagataaaggaagcaatttt

SEQ ID NO: 5681 - DNA, 1298 bp, Glycine max
  Soy_ogl_1578 Gm05:3494703..3496000 Cluster 25
attaaacttgatatgtatgttttgcttatttaggttcgttgacctatttcaacctacaggcttattgtcctatttatgagttttctataaaataggtcatgtaaataaactttcaaactaagtcaaacatttaaatagatcaaattaatacctaaaaaataatctctaacagttaaatatgttagacttaaatttaataattttgatataggttaaactttgatttttcaaaacttaaacctatttcaacccctacttcatatgaagatatgtttataggtcaatctactaactaataaaggttgtatatagtgcattaaacacaccctttgtatgaagatagtatgtttattgactacattgggatcaacgaccctaccacaatgcaaaatagtatagtttttgaaagttacatgtgacattcagaaccttggaacgtgaagttcttccattcacagttcataaaaaattatgagtggcccaacaaaaaaaagttttatctagtgccatatggtactaattgtccagcgataggaatccaccatctgagggttgtttggttggtgaagtgccaaagcctcgacggaaatcctacctccgattacaatgatgctctccacctcatggcgccttttgctacagcattttttgctacagcattctccaggggtagacaattaatttgtaaagctgaagaacattgtgatgttgattaattagtaaatgtgttgctatatatgtgtagagaggtgttttttttttgtcagaagataattatgagagggataaagagatgaggggagtgtgtttgctgggataattgggggataaaaatgggaaggggaagtgtattagtattaatagggagtggaaatagaaatagcccttgattaattcattacattattggctgtgtgacacatattttgctaggttcaactaaaaacaaataacagcaagaaaaagaaaggctcaatataatgaatgcagttgtaattttgaaagaaaaaagaaaagtgtagcggcaaattaaaagaattagataaacattgaataatataaaccaattttgtaaaattgtaacggtaaaaaagaaattcatccgtaatagcactattcaaatgaaacacctaaaataatcatagaaaaaatggtgtattttttttcccgatcaaaagtgcttattttattcactgattgtaacaatagtatgtacatcagaagagatgatttggtccaattgaggggctggaacctccacttccttaatagttcctatcttcctcaagttggagaac

SEQ ID NO: 5682 - DNA, 1200 bp, Glycine max
  Soy_ogl_6325 Gm19:1902301..1903500 Cluster 25
ttgaatatcttaaactactaatctccctctagaagatatattaatcctccctgaacatatatgtatgcaactttttcgtctccacttaccatcccattttttcaactttattcttatatgatcttgagtgctatatataaacaaaacacagtgcaatcaaaagggcattgaaagagagaaagagaaaatacaataaaggggctgagagagtcttgtcgcaggatagagggcactgggtatggcatgatgatgcatgcaaaaatatattatgtgtgctgaaatcataattaagcatgtatttataaatatagctagtgtccctgtcttgcgacaagattctctgcaacctctatcattgcaatttcttggtacaatggagggtaacaaagttttgattaaagatttcatgcaacttttatcaacgcaattttcttatgcactgtacttagatgcagtagagcattgcgctatttcatgttttttagtttagatgtttgctttgcattatctcacttatgtttctgcatgcaaagaatcagaaaatttgcgcccgggtgtggaaggttggttttgaagtgaagattcaataatcaagaggtaaatgttctttatattaatttttcagtctatatattgtttgattagccacacatgagtacttttagtccatcaatctgctgaatcttatcagaagatttgagcagtggaactcaattattcaaatcatcttaacagaattatgtaggatcgggtcttccaaggggatgatgtgttgaaaattgaaaatgactgctgcatcatgttggtggtgggatggcaactaggtcaaaaatttatctccatttcaattgcagtaggtagtatatatacaatttcattctattttgatgttatggattctacaaagagtcattggggctctcttttttagtagttttttttttaagatcaaggttaatagttaattatttttttttgtaccgagtgtaatgttacactcaatgttatcttcacaattatcttcctacaatactttggtacaatttgtgctatggtgtagttctctaattttattcagtgaaagtttatttgtctataaaaaaattagtgagtgaaaaaatttctttgtaaattgcatctatgtgcataactcaaacttaaaattatttacttaaaataactcatatcaattaatccatg

SEQ ID NO: 5683 - DNA, 1200 bp, Glycine max
  Soy_ogl_1882 Gm06:9645801..9647000 Cluster 25
aaagaaggcaaatagagttgctttctttctctttttttctgaaggaagaatttacaaccgagataagtctcaaaagaaaacccatgtgagtcttacgggtaaaactttaaaaggaaaagaaaaatgacaaaaagataagtctcaaaagaaaacccatgtgagtcttacgggtctcttttttggaggtttaattatattattaacagaaagaagatgatttgccagtactggagtagacgagtcaagcttgtaaaggagttgagggaaagattcgaggagtgatgaatttcacactttctggatacgttttctcaccacttgaacgaattgaagagagcttccgtagtgggacatactcgattatttgcagataacattatttgattcatagaaatgataacattatttgattcagaagaatgaagaaatttaaattttggcctattaaatgtgtcttgcgacaaatttaaaatcaacgacataatctagtttggtcaaacctcaccaacatttgatatagcacaatcttaattaataaaaaagacaacctcccttaactaatttaaaaataatttaaacaatcaaagactgttctcgatgcttatataatgaagttattaattaaagaaaacttgcttttttttttctttctgttaatttctcttgaacaaataagatgatgtctccgacatcattctcttaactagcgtgctgttctcgactgctgctcctcccatcgacttaattaactccttgttgaaaacatggttctagctaggtttcattattgttgaaaatattcataatgatttactaattgtcgatagccacacgtatattgaatggacaatataaacatctggaaaccatttcgctagctagaagttttacgaatcaaggagatctttagtcagaagagttcagtaaaaattttagctcaagtttgtgttatgttttagaaaatagtaacttttttttgaagaggttcttttaagaaataattttaaaaaaatactagtacagtacttctttagaagaaactaattctagtcttcggattcgtgtccatctatagtgagcttgaaacatctgtatatttgatggcatggctgatggcaagtagacttccacggtgacacagtagaacagcaaggagaagcaatttatctgtaataaatacgactggttctaagtaaagga

SEQ ID NO: 5684 - DNA, 1300 bp, Glycine max
  Soy_ogl_441 Gm02:7729601..7730900 Cluster 25
caccagaagaaaattagtaagtctagcactaacataaatatgaaggtgatcggagttgggcacgatgaagtttcttcctatgattgaaccttataacaaatagaaactgtgttttatgaaggatccttcaacacttaataaactcctcttttttgggttaaagagaaaataaatagtatttaagaaagagataaaaaataaataaaaggttaaattattttttctatttattttaaatttactcaattttatttgatattttaaatactttaaccaataataattcaaaagtattaaaaaaaaagctacaatacaaacttgagattcttcaccttcttttacccaaacttcaaagacaaacaatcaatcttcaaaaagaaatgttagcaatatacttatctaatgcatatttttttaacaaaatctttattattaattgaaatttataaaaaaatataaaattttataatgtctaataactaataataaaaggtttattattatactcctcatcttgatattagatgatgggaacaaggtcatacaaaatacattttaaaagaaatgtctgagcccgggttcgaaccggggacctctagtgtgtgagactagcgtgataaccaactacaccacccagacagatggagtcttgtatgcagttgccgtaaaacaattaatatacaaatcatattttcgtatattgtggtcctgaaattttctcttccatgagacccctcctgcttcacaattgggaaaattgttgattgtattgtgagactttagttattggattttcaggcatgtaattgtgtttggttagaatatgctaatctgctactaattaaataaatagctagatatgatgtattgtctaatagtctagtctattgtgaactcgaacaactatggtgtctaaaagcctttgagataacttctgaggaataattcaaaattttctcttactgctatcatcctaaaattgtatattttgaaaatagactattcatattttattgtacgatagattggaaatgatacaagagaagtagctacaaatatattaacaaaatgttacaaactttggatatatttttggatcaattcaagctgcttattggaagtagctagaaattataaattcttaagaataataatttttaattgtgcaaaaatttataatcaactgactactaatgtaaaaaatatttacaatcacatcatattctagttatagtaatttttttaatctactattcaatacaaaaaaacaattgaagggtatacttggattggatatctc

SEQ ID NO: 5685 - DNA, 1000 bp, Glycine max
  Soy_ogl_5046 Gm15:13763501..13764500 Cluster 25
tatttaaggtgaagtaattatgctgacataatggcatgcaaaaattagaggaataatttacaaagtattggtagcaggatttgaactagggatgatagaaggtgattttgtctcttcgtttccatctttgcaaaaggaagggcagtttgtctcaccttacatttcatccttccaaaatctagaatcactatttttatgcttttatagatgataaatcattgcattcttctaatcctttattcatttttaatttctttttgttagtaagatttatgtttatatatatcaattgcttattatggtctatgttggcttgtaattttcaagtctcactgaccatattttctaattaagtgtcccatgtagcatgcaatgattgaaagatggattatatatatagtcttattatccaataaatgtttaatttatatatataacattttattatctgatctgcaacgatcatcatcaactaaatacatgtatcccaaaaaggttttcccttttggaggcaaaaacttagactaacaattgtacctacaataacaattaatatagttggtctctggtatgctaaaacaatatccagttgctcctttgcctgggaacttgattgcacaatcagaattgcattgagtctcattgcagtctcctaaaccattcaaacctacttcacatatttcgcaatcatgataacacaaacaatgattcttggccgaaccattgttctcacaaatcccttgtccacctcgatgaattttagtgcactttgccttacaagcatgttcggcatggcaaacccccaaatcttcattacacctgtcaccaaccaccatagccatcagagctcctgtgacaataaccatgatgcaaattttatagtactatcatatatatatatatatataggtctaaatagtttataatttctaataaatatttgaattttatatatttttttctaataagttttttttggttttgactccatgataaaata

SEQ ID NO: 5686 - DNA, 1000 bp, Glycine max
  Soy_ogl_443 Gm02:8389101..8390100 Cluster 25
gagttactcttcagtgcttttatgattttatcattaagcgcagtaaactttaaattttttttatcatgttaatattaaggcactttctgtcgaaagctgtttatatcagtgtataattattaatagaagaagatgaaaaaaaaataatttgtttatcactgtctccacaacttcgccatctagcatgttaactgttaagtgttgggagcttagaacatgttttgaagtccctcttcagagttcagaagtataactatgccaaaaaatcatattttacagcgttaatttatttataggtaaaacgctgtataaaatagtgcgcaggtattctacagcgctttaaaaatccataatttgtttatcaaagtcccttttcaatgtttttttattctatatgtattttcttacattgatttctcattttaaacccaattacattacaatttgggatagaactgtcaaatgcacctgtttagtcagtgaattaaattgatctagcccaagatatcttgacatctaccggcttggaaagttaaatttatgaccaattgcaatctatcaaaaagggatttatcactggtcagttcctacatatcatatcaaaaagttgatttcctgatacattcaataggattattcatccaatctgtcagaataagtgaatcccttcttttttgccttgagcccttccacgagtgaactttaacctcttccaaattttggagacactgcaactgcatctgctgttacctaaaaatcattgtattactgttccaccagatagttcttacaaccgcataccacaccaccatccagcaatctaaatccactccccttccaccaaataatccttgaaactgttagatctgttcacttatgtccccatgcacttctgtatgcaccccaaaccacctaaaacataaatatccaaacaataaaaagacaagcaatttacaaagttaaatgttttgcaactacatgcatgttcagaactccaaaa

SEQ ID NO: 5687 - DNA, 1100 bp, Glycine max
  Soy_ogl_796 Gm03:1725501..1726600 Cluster 26
gaattaaccaagagtcttttttccttgatgaaataaaggattaaaaaaaataaaagatggttggagtgagttaagtttggttgatccttactattttataattcacactggaactcttaattaagagcctatatatggataaaagtgagttaattaagtgcattattgaaagggaccaaaggtatttcttgactcatgtgtatgttaggcgggctactaggctaaggtcacgacagaaaaagtaaaaaaaaaataacgtagtttgttttgcgtgtgtatgttgcaaagcaaaataagagtaggggacactatggtttgttgcaaaagggttgccattttatgttgttgaaactccagattacgctgccactgccatcaccctcatatcttaccgttgctactaagtaaaagtaataaattgttattattttttgaaattacttttacttttccatttagccttatcaatgttcggaataaagggcatacaattttcttcactcacagtcatataccatatatttccaaatcaatcattgtattttattgggagtaaataaagtatggtgtaaagaatttttatattattatttaattataaattatcatttatatataaattttctaattttaataataattatcttaagaattatttaaatcataatattttattagttaaccgtgtaaactgataatacattgaaatatttgcctgtattgtagttttccagactttttatttaccgtatgaaggttattaagataagttttatctctcttatattaataattttttcataattataaatcaaattataatgtattttagtataaattatttttatgaaaataatcactttttaaaaaaatgaaaaattaaataactagatcgagcttaaagagaactcatctatccaactagatcgagctttgtcaacatggaaagtttatccataattaactagcaggaagctaattaaggaacgtaactttggagtggctaagctatagccgagcaatacagttaaagaagcaaacagaagtgttaggacatattttttaatgtactcttttaaatatacttttcactattaatt

SEQ ID NO: 5688 - DNA, 1100 bp, Glycine max
  Soy_ogl_3628 Gm10:48647201..48648300 Cluster 26
tgtagggatttagacttgtgggtaaaagtggcatttcatcccatttgattgtgaatagacttctgatagtgggaatagtagttcccatgtgaatatagattatgagctacaagcccaaaaaagttatgcaataaaatttagcaactttcagtggattgggtatgtatcatttttttttacttggacactattgcgatatgattcttttctttatttgttgatgtagaaataaaataaaaaattaaaacgacatttgctgaattacaattggcaagaccgaaaaccgaaaagtcaagctagacgaaaacaaaacaggagacaagaaccaacttctttttttttttttttaatgatgttgttattatactgattatttatcaattttatcaataaataatttttatggaagaatttaactgactatttttaataagattttttatttcaatcatgttttttttatttataagaattaattcggagataatcatctgttatttgaatttagttttttcttatttttctttaaataataaatatgaatgatgatgcattttgattatgtaatttgttgatctttatcattcgaataaaaattgatcaataattatttacactaaaaattaatttgaataatatttaaataattcaactttaattttaacacattaattacttaattataaaaaagtataagtctttctaattaatttttatagaaacttaatgttttggaccttcacctacgtctattaaaaaaacatttatttttcaaactgcttgaagcagacaaagacctcgtaattcgtaaaattgggggattgaggcggttgaagtcgttgaactataaaatccaaatcatagagtaaaagatttttgaaaggctagcttgaaaatttgaaggccgttccattgtgcactggtcatgaatatgatcttgcagaagacatatttagtcaagaaatgctaaggcatatttagcaaattgtggttttgtgaaaatctcgtttcattgggttgcaaaattattttttctttatctattcattgcaagaatttagccccgtgttgggataatcatcaactatctgatccaatga

SEQ ID NO: 5689 - DNA, 1412 bp, Glycine max
  Soy_ogl_3954 Gm11:38090489..38091900 Cluster 26
gtaattggatattggaagaaaaggagtatataacaaatgtatattttggttgcgtaatttagggttgaggttgctaacactcatatggccgagagccccatgtcatatcttagggagtgtaagtaaaacataggactgaacaagtattggttccttgaagactctttagttcaaatagatgacgtaggattcagtttaccctaatctaatgttttaagacatcaagaaatcttggattgacttcatactaagatagagtaaggtctttgaatcttatgacccaatataatgtgtatgtgttaaatgttagattcttgaggtaatatattattcattctcatttaatatattgaagtaatatctttcttagagtgagaatttagaggtaatatattcattctctttaatatattagggtgatatcttacttgagtgttagtgattgtataaaatttactactttaatttatgacgaaggacaataaagaataaataagaagatataaaaaaagttactgatataccctcaatcatacataaagacaatatttatttgtcacaatatataaataaaaatagtattatactctagtttttctaattgtaagtgttataaatgcgtctatcacctttttttttattttctctttaagcaaatattaaaaaacttgaaataattttcttcagttgaagagtacgataatctaaaattataaagctacaactacaagcatttagaaattctaaaattaaaaacatatcgatctactagactacatatataaatggtagagataagatgcatttgcccatgaattttgatcctataaacaaactaaagaaaatggattaattagtgtaatatgatagagaaattttagtatcaagattttcttctttggcttctccatttgaagtatatacgttcaagtctcttttaagcgatattttcgtcaccaaaaatgaaaaaatcacaccaaattaacaataatgtccaaaataatcaacaaaaaagaataaacttcgaaagtcccttatggctccactagatcaaattcaaagcattatttcgtcaagagaagttccaagggatacagataattggatattagaaaggggtatatacagacttgcatctaatttttcaccaattaaaagaatttcaggaatttaaaattttcaccagtcattgcgtcatggaattaatttaaatgtgtaagcaaaaataaattcatattgtaagaataagttggaatctaatttttaaaatctaaacttgttagatttaaatgtctaagtataattaaattcactgtagaatacggttggatctaatttctaaaatctaaacttgttaaaattaacttcaggcgagataaattattagaataatataggagatatgctattcc

SEQ ID NO: 5690 - DNA, 1618 bp, Glycine max
  Soy_ogl_3964 Gm12:1184501..1186118 Cluster 26
tatatttatagtataaaaattttatacacggtcgttcaactataaattgtcacataagtgaaagtagtttgagtttttaagcatatgtaagattagatcattaactataatcatatatagattatagagtagtgtatttttcctatattcgtatactgagagcagtagaatttaattttacacgacataaatcaaaatcaatcatctacttagagttgtctattgatttatacacaaatacaacaaattgtgtggcaattcaaggaaattatgtggggggaggtgttaggttctcacttctagatagggggcgaactatctgttccctaaaggggctatggccccataaatttttttgtttactttattttacatgtgacgtttttaaaaaatatattatattataaatattttttaaaaataatgttttactttttaattactgtccatttgattcgtaaaaaatatgatattagacggaacaacattaaacaaacacacctaattatgttttagtaattttaaaaattaatattaagaaaatggtaagcaaatacacctgatgtagattacttatgttaaatcatgggagaactctaaaatctcaatattgcatttaaaacaatttagttctgcccttgcttcttgaacatttatacataaaactattatagaatatagagttgtgttatctatacaataatattttttccatctctccttcatatttgcataacaaagtttacaagagatggagagaaacataatgtataataaataatgtgatgaagagagtttttttaatatgtgaattttttttattaggggaagacattccccttgcaagactagggaatactaccaaacttactaggaaggaatttacagtgaaatttatatttaatttgtctatcaatgggagaaatctgataataaaattcgaccaaatgtatcaacctctattgaaatgtaatgaagacaatagagaaaaaaatgttgtacaaattgttttttttaactgttccacaaattgcttatatgaataacacgtttcataattacatctcatatttttctcttattttagcaacatgaaaatccatttataaaatttaaaagaaagtatgattttaccattttgtactgtaaaaaaacgaaattttaaatgtaaagaaagaaagattaattgtgattcaaacttattagcgctctcgtcttacatggaaaatcaatcctctgaaatattgaagttaaggtaagaacaagggaagggagaaggcgacaaattgaattccagttttcatccatcattcttacggaatatgtcccaaatgaatttaatttgtatgcaaaacgtacgtttacaattaaaagcaggcatgaataaatagttgtccatatttgtcgagtgaagttgtacctaatttttaatgtcacaaattccaatcagttttggtttgccatatccacaagataaacgattgttggttgttagtcagcttcttaccgtccataccaaagttgatcccttggcaacttcacgtgtagtattaaactaatcttctttattgcgccatttgcttaaagcagctattcaaaagacaacaccttgcagaaa

SEQ ID NO: 5691 - DNA, 1761 bp, Glycine max
  Soy_ogl_4387 Gm13:311501..31369361 Cluster 26
aaacttataaccccacattaaatagatcaggatttactagttcaggtcaacttgaataattcaataccctaattaagatgaatgggctaaacttgttttgtttttctagagcaattgcttttgatacccatttttacatctgaaaactgaaaccctccattttttggtcaccctcctacgtccttacttctccatcttaaaccccaactccccatttttttcatctactatcctccacctcacacctccactcaaaattgtaacccttattttttcgagccaccctcctccatggctccaccctatttctctatctttaaagtttaaactccatcccctcccttgttttttttatcaccttcctccaccccactcacctgtctcaaaaccccaaccccaattttttttttatcacctttctccatctcactctctgatctcaaaactcaaaccttcaaatttttttccaccttcctcccacccatttccccatctcaagaccaaccattgttttttagatatttcattttaatttaattaaaataatatgatttgatgtgacgaaattgggaaatttaattggttgcatagtataaaatagttttacactaataatacataatcattaaactcttaccattttaataattttgtaaactatttttggaatagttgcttcaagggaacccaaataatgcatagagtatgactgtatgagtaatgcataagcatctatctctattttttaagtttacgcacccaagttcaacatttctctcttctctcctcggatgttatgcatgtgtgtgttcaattccaaaattgaataacaaatttgtaaatttttgtttccaattacaggaacaagcaagaaacacaagagtactcgtcgcaatcacaaatccctacttgttatacaacaattaacaatgaattaagtatgttttgtaatgcctttctatgcttattctagtgcacaaataagaacatacggtataggcatcttccttaggaaattaaaattagagatagataaaagagatgtttacacatcattcgtgctttgcgcatttggggttccattgaagcatgttttcgtaccgtatttaatacactctgaaaattaattttaaaaatgtttacccttaatcaaaataaattccaaaatttagtttctacaaagacagtattttttatttatagacagaagtggttgtgtaagtaaaaaaaataaagaaattgtaaaagcaattgtctttttcataaattaattgttgttgtactcagagtgcgaaggtatcctaaaaaaactaacttaatcacttattaagatattaaaatcaattattcattatttgtcaaacataataaatgaataattgtatgtaaattatttcagcaaaaaaaaaaaaacttgtacgttaattaaacttggaaagaacggtcgtaaaattgtggttagctcaaagctaataaatgattaaattagttcaataattgtgcacgcgtgtgcttgcggggaagggggtgcgtagaaatgttttttctgcaagaaacatttttctataaagttagactttattattccctctgtctcataatacgtaatgtgttagaaaaaaaaaattcaaaacaaatgtcattctaatttttcaatgtagaattaatttcaaggagaaaagtcttctaaagtaagcatgtttaaggatgtattcactatttgtaatattgactttaaatgtatcatgatcttatctcacg

SEQ ID NO: 5692 - DNA, 1463 bp, Glycine max
  Soy_ogl_5854 Gm18:1046601..1048063 Cluster 26
gatttactcatgaatgaaaaatattagagggggtgatttatttatttattaggaaatatttaaaaagttttggacttagggggcagcagccactgcaggcttatgcttaaatccacccctgaactcagaaaaatgtgagtcaaaatggattaatccaccttttgaacactccatggtggaccgaattgggtggattggaatggcacacatttgcaactagtaggataatttgtgaaagaagtattttggaattgaggaattacttattatagagttgatctttgtttttgtttttttttttttcttgggacgatcttgattgatcctcatatagtcatacatgggtatcatagctttctccgatggatcacaagttagccaagcaaaatatcttgtgaactgtgacgggtgagtaaggatctaagaattttatttctcaaattctcgttagggacgatttgcctagaaaataaaactctggcacattagtttaaatttaatcaaaaattaaaaaaaatgctacattaaaaatctgttacctatattgatttgtattattttgtattttgatctttattaaaaagaatatgttttaattcctacgtaaatgaatttagaattctgttcttatttatttatgaaaattataaatagtttgctaagttaagtcaatagctactgtcatctatcatcggaaggaaattggtgtcgaaacatcaaaagtagtatctttaaatttttctgatttaaactttcatattaaaattaaaaataaatgtcacaacaatacattcatgtattttatatattattaacaatagatagactatagtttgttattaaatcccgagaaatagtcacgggaagcagcctcgcttcaaaaaaatactttttttattttattttaactcaatgactagttaattaaccattgcttctacaggtcgaattagtacgaaccagtgggaatttgtatttgattaggtggtactttaacagtttttttttttttgcacttttaatgcgaaaatttgagcaaatttttttaaaatcaagtacaatattatttcttgagaaggaacaaaacaatgatttggcaagctgaacatcatccatattctatgaatctgttgtagatgccatgatttatgctactcgatgagtcatcatgtactcgggttataatcaataacgaactcagaaattttaaattgtgggacaatatttataagataatatttatattatagattgaattttttatttcatttcaaattataaaaagattttttaattataaatatacattatattaaaaaatgtgaaaacagctgctcctaaacctcacaatttagataagtccgacttatatatgaaattattacatagtgtagttatgatatgtaatatcagaattttataattaaggttgtgttcaggcaaaaagtttaatatacgtttat

SEQ ID NO: 5693 - DNA, 1506 bp, Glycine max
  Soy_ogl_6832 Gm20:38097301..38098806 Cluster 26
tgtataaatttttaaaattaagagaagatgtgtgtaatttttttaaatctcgagaaattttttttgtaaattttaaaaaagaagaaagaatatgtgcaattttaaaatctcatatgagatatgtgtaatttattgaattaaaatttataatttcatatacaaatgatcatataaatacccatttaaatatatgttattttatatgtattagttactttaaatgataattttatcaaagatttatacttcaacatttatagtagcattagaatacttgtatatatataaaagggtattaaatcataactattgttttatcctgagcctataaattttcatggtagcgaccctgctctctaaaatttaaattcaatatttttaatccttgtcatgatatattatctgtgaatgtgtttgtttgtctagtcaaggtcattgtaaatattacctaatacaatatatatgtagtgtcatgtcagtgaaataagtgactcaattttttttttacctctaaacattattatatattatttatctgttctagaatgaatgttaataattaaaaatatagttttaattttttgaaggttgaaaagtaaagaaatatttttacaacaaccaaaaaaatattaaattcaaatttgagaaataaagccaaagagaaaatattttaagaactaaaattaaattttcgctgattttacctgaggtgaaaacattttttttgttgggtggtaacagcaaagacacaatagtaaaaataaactctacttgtccgcaatgtatggaagctaactaacttccctctcacatctgccgtatgaaaaagcgtcaaagaggtaagggttccactttttccaatgaaaaatgttggatgaacgcctacaatattaatcaacaccggaagactccgtggaggcgctgcactggaccaaatcctctaacgacccttggttgcgccacgcccgctcttatctcatgggagagagcgccggggggaatatttcctacaccgcgggtctacctgcagccgcggaggttgatgagatcaaaccactcaaaataaaaggttgatattgattcaaccgtttttcgatgggaacaagaggactccatcagagataaggaatctttgattgcctattggcgttgaccgtgattaggagtattcgaatccaacgatcaagggtggtggaccgtgagactgccccagcacaagggtttgcacgtggttggactattttatgacatcatcctggataccccttctatgtctgtcaaactcttcattgatttatctttttgcgttatttggatcgtgttcacgtgattttatgttctatgcatctaatacacaagtaataaaacaaattaaattatttctatcactgttgtaaaaagtaataaacaggtagtgaagcccctttcactgttgaaagcaacgtggagagaaaacttaagttgaaaaattggttcaaaaaaggtcactacttactctagattctt

SEQ ID NO: 5694 - DNA, 1289 bp, Glycine max
  Soy_ogl_992 Gm03:39906955..39908243 Cluster 26
aatgatttagataatattttttcactgtttaaaatgatatctaaaataatttaagaattatttaaaatgatatctaaagtaatttaagaagtaaaagacaaaataaacataatttataagaattaaaaataactttttttgataaggaaatttttttttataaagaactaaaaagatatttgagcctttataaaatatttatataactgagaattagctatgatcaagtttatatctttaataatgtttcacaagaatactcccgtgtgagatgtaatttggaaaacaatagcttccaatatgaggagtcgttcgcgcaattgggttgtcttcttttcttgagactcgacctggaatttaggcagcacaattgcacaaattgtaaagttagcccagagagaacgagggaggttggctattggtcccactgcccttgttaatggccaagggggttgaatcctttttctttcttctcttcctgaaaatattgtttttctgaaaacaagatggtgttgtacaattatataatgaaattgtattttcattatgtgatggggtgccaaaaaatacataataaaaatataattttgttatatatttatcagtaaaatcatattttctttatattaaatggctgaaaaaaaataaacaagaaaataagattttgttgaaacattatgatagaatcatatcttgattattggacgaaattgtattttagttgttattttaacaagggtggtgtgcagcttggtgttgtagtgtgcgtgatggttggacatgtgttgatgagaacggcacgcgacattgttgggatcgtggttgtgctgcgcgcggctgacgttggtgttgtggggcgacaatgatggatcgttgggttcagatcttggggggtagggaaggtgaaagagaaagaggaggttttgcattgaagggtaagagggttttttctaatatttgtagggagcaataacaaaggctctaggatcaatatcaattcccaataattcatcattcaagccttagacttttggcatatatgggttcaccatgacaagatcaatttgttgtccaaagttaggaaatgttttcaacaaaaaagaaattaaacctatttttcctccaagtttctcccctattcaaagcagtgagattatcactaatgcagtaagatatgtgataattgtccgtttttaaaaaagatctttgacgattgtatgtcaatttgatagaaattcatcccttttctttatcaatttgttgaaaattcaaaacatgtaaactagttt

SEQ ID NO: 5695 - DNA, 1349 bp, Glycine max
  Soy_ogl_4962 Gm15:9865901..9867249 Cluster 26
cagaatcagacccctcacactgacagaatttcaggagtcccactaagcctgaacagaaattgatggcttgttaatgttattctagcttcttcaattcgcttcagaaccacgttcagtccataacaccgcaccaattcagcgacacatatcacagtaccctacacattcatcagaacatgaccatcatgaaccaagaacaacataacacattcgttatagaaaaattctattaagtgttattaggatattagttaagaaattcaaaagaatttttttattaaaatatgaaaaattatattgtttataatatttttatattcttctataattttcgtattaaatacttttttattttaatttcttaaagataccagataacatgcatgacccttattattatttatatttaataataatggtcactttctatgttgccctaacaatgtttctttcttcccaccctctcaaacccctatagtaataatagtacagtgcctgccatcataatatggggagaagaaaacaacgactactgaatgaatgccccatggagactcgccacccatgcagtgaaaagtaaaaatgttcagtcactttacagcaaattacagctattgccgggaagctatccacaagtatatgtccttttcttgggaaattagtagggcttaatttattcgaataaaatagtgaatgtttgttatttaattataaatagtcagtagagtaaaatacataatttgttataatttgtaaatttttataccttaatttgattcttatggatactatttctttttgacataaaatatatttgttattccgtctattttaaaataagtattacactaaaattatctcaaaataaaagttgttagatttttaatatatcagtagcgcgcggtgggtccaaagacttcatatgtctgtctcttccctattagaccctcccgtaactggagatgataatttttttttattttattgttataattaactcatatattattaataggatgaaatttttttttggagatatgattattaaacgtgcaatgtgcaacgttcacacgagagtcatgcagtttttcttttggggtaacttaaaattttcccgcaacgtacctatcaagaaatataaaagcattatattagtagtattcattcatggtcagagcctgattcaattgaaggcatcaactcggtatcgaaaagagagtgggtaaatgggaatagtcagaaaacaacgtgaatcaaatggcaacatctgaggaccacgcaaaattgggagttggactgtgaagaaacaggaacccaacatttttaaagctttagttactcattaaatt

SEQ ID NO: 5696 - DNA, 1500 bp, Glycine max
  Soy_ogl_6794 Gm20:36722601..36724100 Cluster 26
acacaaaaaattcacccttcatttatcctctttcatttttatcaacttctttagaagccgttgtcaatttctctgtcagaaaacatattggccaaaagggcctgccggtttgcagtaggttgcagcaataaatttgttacatttatggtatatgaattctagctggccctgggcaagagaaggaaaagaaaactgcagcagcagcatcatcatcaaaggaatcatggccattgtagtgttcctctggactaggttgtccttatattgaagtggtcgtaagacaaagtagctagagaaggaagaaattgtggcgattaatgtgaaagtaataggaactaacttgaaagacttaaacgtgatgcatcttccgacaattaatttcttcgggcagtaatattcaagtataaaaaaaaagtggtgtctttactgtaccatagcgtgtttggttggaattttgtacgtttatataactttacggttagcacaccaataaagactaacgatatatcaagattcatatatcatattttttttctttcatcagtaaaagtcattgcaagtaataattaaaatagttaaagttaagtatcactttcaaaaagagtaaatgagcattttgtttgttgaatgcaaaaatcaatgagaatttaataatcttttaaaaaaataaaaatattattaatttattcactcaaaaatgtgtaaaaatgtaatatttacatgtataatttaacaacaaattaattcactttaaaaaaataacaatctatgcggtcaaagtgaaagttatgcactatgcttaaatcaaattatcatttgaaatatgtgtactttttttcaacttttattttgtcaaaaaaaaaaatcattcatttatcctcttccttatcattttttagagagactaaaatgttggcattatgtttgatttgctccttcctacctttgcatcgctggtggtgattatgatgacacaataggtagcagatggtggcatttaggttgtgacctttgttttgattcatttctccctatgcattgaagattgacctgatcaatgattggattgtccatgacttatgtaaagtttgtggtggatataatcaattttaaaagatatttttatttggtattggaaaaaggatttgaagatggtttgattcggtttgataataatagggtgtgttaattatgtgtattgaacaaaatttaaagtttattgctaatgtgcttttttatattcacaagattttgcttagttaagcttgttcatactccatactgttatgcagtggatatatggcacctaagtatatgcaatgcatggaatttttttagaaaagtcgaatgtttttagttttggtgtagtgattattcttgaagataagtggccaggaaaatagtggcattcgtcatggagagaatatagaggatttgcttagttttgtaagtcatccttttctttccctttaccttccttgttagaatttaagtgtaaaa

SEQ ID NO: 5697 - DNA, 1600 bp, Glycine max
  Soy_ogl_3743 Gm11:5159201..5160800 Cluster 26
acaccatagaagattcttttattttgtatatggtccctagcagagtaatccaccgtcgtttacctcgtcgcaggtgaatcccttgccagaaacataatgagaagtcaaagccctaaccaatcatagaaagaagaaataatcccattgttgtttgctaacaaaaaaaataattaaattggagagaaagagttatgcggaaggtggagagtgtgtacattttttgaaaaataaattgggggagaaagagacacaggagtgtgttttataggctagtttgggaaaaatattagagaaaggagagtggatatagtaattaccttgtatactctaaatggacaacgttagttgggtttttcaaccaaccaatttttctttttctttgttaatggttattcaacaaacctgatgatcgaattgtgacacttgcaaagctggctcacaaggacgattatactggttcattgaatcagtggaactaagtatgaagctcatgcactcctatagataaatagatagtacctggttcttttaattttattttggcaccactgttttttttttttaaaaaaatggcactgccttattttttaaactgctattacaaaattatctttgttcaattctgaaataattttataaattattttttggaaatttcattctgaaatatacaaaaattctgaaaatttaattttgaaagtgacttaaatatttttcaaaaattgaattctagaatgtattaaattattttgtagaaattcaattccaaaaattatttacaattatttcagacatttaatttccaaaatttaaaaactctttcagaatttaaattctggaaatgatttgtatataatttaaaaaattaaatttccaaaaataattataaactactctgaaattaaaatttgaataatgacatacgcatcttattttaatagatatagttttaaaataatagttaagaaaagaaatgatgccacataaaaaaaaaggaaataaagaaagcagtaccccttacttttgggatacttttcattgcaaattttctggcctcgtgagacggcccatcactgtttcttgggccttagtggaagcagatttatgctcaatgggttttgtaacatggctattgtttttgcggggcccgtagaaaaatctttcttagtcttccgttttgtagtgtaaataattaaaattaaaatagtgtattaagggtacgttattctattctttaatttttttcagcagtaaaagcaaaaatagaaaaggctggatcctatactaaaaggaaaatacgaaagagaaaaagaaaagaacctctctcaacacgaaaaaaaaagagacaaaagggaggatcatatggcatcagccgctttgtattaacccacatagtaatatatgcaccagttcgcaaccagacaagaactagacgacaaaacacgatgcatccttcttaaaaaagttttgttctttttctttctaataatcacgcgcattaaacataatgcaaacaagaaaacagtgatgttaatattaataacacattcgttttaacgtattttttattcattaaaatttattaaaaatcatacaaaat

SEQ ID NO: 5698 - DNA, 1997 bp, Glycine max
  Soy_ogl_1208 Gm04:4023654..4025650 Cluster 26
atacgtcacatgcaagcaaatgtaacttgtgtgtatatatgtatctcttgtgggtgcgatttatattagcggagaaattgagagaagatatcaaaatggaatggggaaaactaaggttgcaatcttgttgctttgggtcttgcttgccttgtgtatcagattgcagttaactgttgaagcaagagcatcatcacctttagaaagacaaatcgaagccaaattgaagcaacccactaaggtttgcaattaatcttttggattacagttgtcattctagattttaccttactaaatgctctcaaaatatttactagtattttatttaatgtaagataaaaaaaattaatagtcacaaggagaaagtgctaattttaaaaataaattttcaagtgaaaagaataaccaataacgaatattaaaattcttttttaacattatacttacgcatatgaaggttttgataaaaaaaaagagtttattttaaaatcttaatttattatgtaaaagttaaacaaaacaaatttttataatgataaataaaaaatatttaattaatcatttgatcgatatacttgtgttaatttttagttttagttcttatacctaaaaattctgttttaattcaattaagcacagaagatgcttctgagtcagtgatatatacatggcaaaaaagtggaagctgcccaaaaggaaccatccctattcgcagaattctaaaggaggacttactcagagctgcttctcttgaccgctttgggcagaaacccccttcttctcttcagaaaatcaattaatacatgtcatgtgaagacacatatatgatctttgatttcgcaagctaacttaatgcagcataaatcataaatgtatataaaatatacaatttatactggtagtagatacaattcaattaatgctatatatggtgatgtgatcatcatgcagtcacattgggatacaattatatgtatatatgttactgttgaagaaattacccttcaactctttcacgtcatccttctcaattctcattacacattaatcattactcttctcaaaccttgatgacacgaccgtcacatccaaacatatctccggcgaagtcatagccatcattgtcaccatctctagtgaaggagattagtctgcaccctagtggagccaccgggttttttgcctactggactgtaagtattcattttattttgttcgttgatcttcttaacttaacttagttcatttaacctcaaatattgccaaggagaaaatcagacattggttttggttacttaattaatttcgtggtatatatgtggtgcagacggattcatacaggtcaacaggttgctttgatgttatttgtccaggatttgtgcaaacaggccaagtagcccttggtggtaccataggacctatataatccattatgggcccacagtatgatcttaacgttggactgttcctggtaattaatgttcacaagtatatttatatttaggcaaatctgtgtctagtgtcatatctcgaattaggacactgtttgaaaaattatgctgctcatattttttttataaataatatattttcattttagttccttcactaatatattaagaaggaaactggttaataatatccttatatttatattatgtgccactattgaattatcttaaacattgatgataaaacattaacatgtgaatttatgttggggtgtgatatgggaaccagactcaggaaattggtatcttaaaattaagaacaacgtcgctgaaatattgggttctttaacgcacagtgccatattggtggaatggggaggacaagtgtgaagcagaaatataaagaagcatgaaacccctcacaagggaacagcaatgggaagaggtcggtttcagaacgcatgcttcatgcgcaatgtgagggggttaaggattattcgcaacagctgaagtatcctgatcaaggatatgctatggctgaagagccct

SEQ ID NO: 5699 - DNA, 1139 bp, Glycine max
  Soy_ogl_1239 Gm04:5591001..5592139 Cluster 26
aactcgaaatggccaacacgttcgccatctttgagggttttgatgacaaaatcattcagtcaacaatggctttccacaaacttatgacttggacgacttgagtttgtttgtgcattcttgtcatatcatatcccgtgcttttacacctcattatgttttggttcattagtttaagttagctactttgcagttttttccttgagaatttgcatttgtatcatattttatatttatataatgaaaataggataaaataattactgtgatgaacaaaataaagagacttactgttatacaaatattatagattgctttttatcatttgttcaaacttgaaattaactaatatattgagcgagttgtttaatagcttatgccattatgtacacgccataaatatttaaaaattcagctgtgcccgcgtatgcgttgctagttgctaccgacacctatggatacccaccaaattattttatacaaaatttaaagataataatacaattaatcaataaataattggttcagtccaactttttttttttttttttgtagaataggaacctcttgttcatctgtccaatatttaagataagtttcaagctcacttcttgattatatgcactaacaacaattgctataaaaaatgaagatttcaatcatttcattgattaaagaaaaccctaagacgcaaacaattattaaggaaagattttgggtatgatacgatcaaataaaaatttaaattttttaattagataaatccaaatatagtcttcacaaaaatattgccatggatagatatgtaaaataattctttcttttcgtttttggattctgactgtgctctaacttacctataccttgaacggaatacattgtgacttgcaatgaacccctataactatccattgttaacaatatttgaacttcgacaaaagtttcaagttctattgtccaaagtctaattttcatatgcaaaaaaaaaaaaaaatcgttttatttgattccgattttttttttttataaaaataagtgtgggaacaaatttgggatgtaactatctgaacctgtctctcaacccatcctacaataatcataaaattatatatgtgcatggttaggcctttttcttctcacgc

SEQ ID NO: 5700 - DNA, 1177 bp, Glycine max
  Soy_ogl_1551 Gm05:2373224..2374400 Cluster 26
caaacactacaattaatattgagagacgttgttattgtgggattcattactttcaaacttaactcatttatttaccataccaaatcgacaagtgttaactctatttccaaaaaaaggtttctattgcggaaacacggcctaaaagagaagattaataatttgtttgttttgatgtaaagcaaaagaacgaatcgtgaagaaaataaaatattcaaatattttaatttgtccctcatttcgcgtaaacaaataccaaaagaaagggaaggtattagtacgtgtttgctaaggaaaacaaacataaaaagaaagcacattagtaagtgtttgctaatacaattatatgttgggtccaaaattagacacaaaaaaaggaagggagaagtttttttttatgcaaagataaaaatatctttatatttatatcacattttatttttttcaggttaaatttgtccacgagttcctatatttttattaaatttttaactgaattttgaatgttatttttttaaaatttggttatctgtttaaatgttgttatgaaaaattaagcacacatccctaattaaaagtgcatataggaagatgatatttttaaagtgtattataagcacaattaaattaataaatataattgattatgagttacaacatatacatattcactatgtttctcttaaattaaacacaccctattttcttcctaaatgtttgacgtgctgtaacgtgctgcttttttttctttttctttttttatagtaagcatgtcaagtagataaaaagaaaaatctgtaaccatctactgtactacttgttctatataaattctacccaatccttgctctcatgtcacattgtattttcactacgaccattgcagcaagaaagaagtgcaacatcggaacctatggctatcctacaccagcagtgaaaaagattgagtcttactatgatgtgccagagggagtggatattcggggaagatataatgcagagtttgcaaaaatcctcacaaaagatgctttgaaattcgttgctgagctgcaacgtgagttcaggaaccatatcaagtatgcattagagtgcagaagagagaagagagacaaagaggaggtataatgaaggggctcttccggggtttgatcctgccacgaggtacataagagaacaggaa

SEQ ID NO: 5701 - DNA, 1026 bp, Glycine max
  Soy_ogl_5782 Gm17:39489401..39490426 Cluster 26
aaattcaaaattgttgttctattatataatttcatgtcttctccatccagtaacattactaagataaggctttgttgatactagatcaggtaattgaaccataattagctcaactggcatatccaaaccaacaagccaaatcaatattataagacaaccccatgtgaagaaaatgcaatttgactaaagcaaattcatgatacaaatcatataccaagcttaagttaaaatctcaaatataggttacgtttgcctgttaaatttagccaactttgtttagtgagaaagtgagagagttgagagaaaatagagagcttaaaactaaaaacgaattttgatattattaaatctcaatggtaattgagaaacctttgagattatatggtttgctttctttttatgaattatgacgataagtgataccgacatgttctctataatatttatgattttatatatagaaatattaatatattttttaaattaagtaaactcttacaagagtttacgatttgattttacagtttacaaaattttcacaggagtaccgatagaattgctctgacaacttgcttgcaacccttggtcttatctatccaattctgaaacgatttcttagagttcctaaaatccaaaaaaaacccatgctcttcgccttgttcatgctatccaacacggcctccattcccaacatagcatccgtaaaccacccatccccaacctcttcaagcttcgtgtgcagcagctgattctccttcacaatctcttcccacactacacccttatccttcatcatctccgacaacctcaaatcctcaccttccaaaaacccatactcctttatcccaaacctctccgccaaaaccttccacacatgctaagcagtgttataacactcccacgtggctttggttccaggaaaccacaaggcaacaacctcatgcttgcaaataccaggataaacacaaagggtcccaaccaagttcatcaagctataaggagaaaaaccaaagataaaatgtggtc

SEQ ID NO: 5702 - DNA, 1042 bp, Glycine max
  Soy_ogl_5834 Gm17:41311159..41312200 Cluster 26
gagaaaattataatcagtaattagtttgcactaaaataatttgtaaagatacgaaaagaataaataattttgagaataaacaacaaatgagataaaagaatatccctatttatttagttacgttgccaatcacctcataggaaattaaactatatatccaataacaaaatgtctactcagtatttttttaatatttcaaaaatttaaatttgattgattttaacttttaaaaagacaaaatttaaacttttttttcataagtaaaattaatttaaattgcagtataattttatagaataaataactaactgagttgacaatatatatttagttgaaagaaaatctgataagattctcataaaatatattattagagaggatgaaaataatttaaatacaaataaatctcaaatcaaagattgatctagcatgatagaatacctcaaaatttatttcacttgaaaatcaaagagtctaatcagggttagcaaaacaaaagttttgtggagtgaagagagtagagagaatataagaagtctttgaataggacatgcatatcgttgatggtcaggacagaagaatgaagacaggtgtgtggaattgcctagggggggaggggaggtggggtccactgttatttcacaatagaagagagtgcacgcagtccaaacaaaaagttagagtgatagaacctaagcaaagcagaaggttggcgtggtctgagggggagcatggaagcagtgcatggtgttcgggtttaaggggacaatgccttctgaaccttttcatgagacctatcttcattttgtcttccacacgccaacaacacacattatcatcataataatcttatcataattcattatttagttattagtatattctctctctctctctatatcttttttcccaataggaccaaccaatcaataggatcagtgtctgagccatgtactaatacactacactactagtatttatcttcggcctcattctgcgagtgagtaaccgctgggcctgtttgtattctgtgtactgtaat

SEQ ID NO: 5703 - DNA, 1100 bp, Glycine max
  Soy_ogl_6962 Gm20:43687701..43688800 Cluster 26
gttggcgtatataaagccatcttaatgtgaagagggagattagttgttacgatggggcatggcgtgtgaggtgggcaatggtcctcttcatggtcaacggagaaaaaccaggcgtgacacttacgaatcttaacaataaatgcattcattaggcaaccaattaaattggattttgttagtgtttatctgactggacctaactttaacctaaaatattgttataacttttgaaattgagtttgagttttttttccggtgtaaaagtaaggatgggaatataatattgtaattactggaccacgtagagatgagaaagcaagccaacctgatttggctagttttatatcatgtcttaagtgggataggttaacctaccagtgatccatagaattgcaaaagaaaaagtatataactttttttaatatagattataatattttttcatgaaaaacaagaattatcatgggtgatagagttcatctcattaatatagctgaatatttaagactcatacttgacatcctgtaatttaattttatgttagttgatttatgtatttgatggtggaaaaagtatataaatacattttgtactttttttgtttttatttgagtattttatacattttttcttttgctgatttatacaaattaatgacatgtacgatgtctccgttacacttttgtttattattaggtgaaattttgctatgagatacttaatttgaataattgaagaattgtacaaattaaaatatatgcacataagctaaaaattaaaacatgcaactgtaactgatgctgcacttgccactattaccaggccaacatggcctagccacagattcaggcatagagcgtgatgaaggatttgttaattaagtccgtgtcatttctggagtcaaacaattgtagcctttcttgaataaagccttcatcttcgttatgattgccttggtctactttaccatttgtcctcatcacgaatatgtattaactatatcacacttgaatgtggtatgtgggacaccttctgttaactgttgaggtaacttgaaatcatcaatttccttccaagacattttcttcaataattaacct

SEQ ID NO: 5704 - DNA, 1200 bp, Glycine max
  Soy_ogl_1403 Gm04:44791001..44792200 Cluster 26
gcgaaaacagtaaactgaatcacactgctttcaccaatgcagtgactaactagatattaaaaatattgaagagtattatcttgacccttgagaactttgttttccccacccagttctttcctaacgattacgaaatgctgctcgcaatgtaggcagcattcttctcgtaggacatttatttgtcaagagccaaaatttccctttattaaatttaattttttttcttgtattaaaagaaaaccatgtcctaaaaaggtgttggtatgactaaaactaaattggattactttaaataagattttaaattcaaatcttatagataaaaaaaatataattaaaaccaagcaatgcggccatggtgaagtgaagagagggagggagcgaagaggagagatccattggaggaagtgatcggagatgatgatgattctcaatgcttttacttttttaatactttttaattattttgtctatttttaacttacaacaccaacttataaaattttaaaactgaaactgaaactgagatgggtttagtttttaataatttcaaaattgttaaccgaaaaccatcccaaacgggttagatattatcttcatggtgttatttagttttattttactaaaaatgttagatgatatcacttgtatgattagtagtgaatccttatttgacatgggtatgtattgtgtaataaatctttatttttagttttcagcttttaattctaaggtaatttttagaaacctgttgcaaattaaaaatgggtaaaatgaatttttcttgtcacttacggtcatacactaattcaatagcaaatgagaactgaatcttatcacttgcgggatttgaataggaaattgccaatcatatgatttttcttcctatttgtattccctcgtctattgcagtaatgcttggtggtttggattttttgttgatgaagccatacacggagcaattgtcatatgttggcgaaggagatgatgttgccatggagagaggaagagaaggtggtgactggtggagggtaaagagccatcgcggaccagtggagaacttacaaaattaaaaacgaaaaagataaacctatttttattgtttctcaagggataaaaactgttttgaaaagatgtggaaaactaactcaactccttttttgccaaatgcatttttgtttcaaaaatatagtttaaaac

SEQ ID NO: 5705 - DNA, 1233 bp, Glycine max
  Soy_ogl_3306 Gm10:1801935..1803167 Cluster 26
cacacacacactggaataggctgtaggcagatattattatatttttatgcaacaaatgcttcacgtttttctccctttcagtatgcaatcacttatcaaaggtctttcctttcaagtatgacgttctgctcgagcttgcgcctcaataaaagtgtgtacaacctgtaccatcatgggttgaagggagtatatcctaccaaattcatcatcatagattactttttctcgaatgagtagtacgagtaacttatgatctgtccaaaaatcattgatgtagtatttttttttccctttctgtctaaagttacatttttttataagagaagatgctattcaaattgtaaatatttatagtaaattgaaattaatttttccagtaagttattttcaatccatagaattcgaattcagattttccttaagaaaaattagacataccatccaaacaaacagttgattgcttaatgtgggttttgcgttaaagtatataattatatttttaagaatgattttttaaaattaaaaatacaatttagcaagaagttaaaagttgaattatgaaataatttttttattcttatgtcattgacatattcaccttttattatcaaaataaaaactaaacaaaataaaagaataatactttatgtgaatcaataatgcatacaaataatttttaaaaatttaattaagaagaaaatattatattttcaaacctacataaaaagtaataaaaaaatcccaaaagaaaatacatctttaatggaagaaaatgagtatttaactaaacatgacttcacacatgctttggagtttagagaagaatccattcacatagtttccaaacatgctataaatatgacaacaaagtgtttcagaaaatacttatgaataaaaaaagaaaagcaaaatattgagaattgaaatgagtggcggagctatatttatattgtatttgaatgaaatagtatatactttaccaattttctgtaatccgtgcttttatcaagaatttagcatatctctaattgaataaaaaatactatatgaatactattaggaaaaaaataccaacagaagactccatggcccaatggataaggcgctggtctacggaaccagagattctgggttcgatccccagtggagtcgagttcttaaaaagtcacaacggttaaaaatcagtattattttttaacttttaaatggaaagtcacgacgtcgtatcagttc

SEQ ID NO: 5706 - DNA, 1229 bp, Glycine max
  Soy_ogl_4461 Gm13:35610701..35611929 Cluster 26
aaatgatatgagttcccttaccgtaaaaagaaaaaagagagtaagttttctcttcattttcttgataatctcttcactttataaatatgtgtcttgatacccatgaaagcaaatcattgagacaattgcttaatttctatgaataataataaaaaatcctattcttattatagcggcacacacatacacacgtgtgtgttagtaatacaattctctattagggccttaaaactttactagtgccctttaattgttttttaaaatatataatagaattattgtttataaaacataattaaatcaattgaatattccttttagttttacttctactcagttatagttttaaattatattcaaacagaacactcagtttggaaatatttctaataaaaaactgtgcaaattataattgttgaacgaaattgaacaagttgaacgaatttgaaccacaaattgtacctaatcacttactgggaagttgtctttccacagatgataggcctgtttccaaattccattaaggcagtaactctattttagggaaaaagtctgcatcagtcttaattgcagccagaggcccacagcttgcacacttcttttttttatagttaagagtacctcctattgagtgtaggatcttatctcttctaattatctaaacataagagtgaaaggtagatctctcaagtctcaactaggtttgttccatttgaatcctaacttatttttaagaggaaagaatttttaccactcacgataacctgaattagtcacagactcatagcttgcttccaactgttttttttaatcctttaaaatattaaattttatttaaagaactgatatttttttaacaaattacaatgattagataattttgatgtaaagttacaagattcaatttggagaaggtaacttctgaaaagaaaaaaaaaactttggagaaggtaaaatacgtactaaacatacacttcataatgatcagtattgaatcataggataaaagtattggttaataagtatttatagtcccttaagaataattgacaactttcaatcttttaataattttctcatagcgttcatagtttttataattttttattttatttttagtctctcatttattttatattagagaccattttgagcaataaaaaaaattaaaaatgaacaattttttttagagaaactaaaaatgttgataaaaaattaatataaaacta

SEQ ID NO: 5707 - DNA, 1338 bp, Glycine max
  Soy_ogl_4009 Gm12:5182763..5184100 Cluster 26
gttgttatatatgataaataggtataaattattgtataaaagttaaaatgaagtactagtaatgcacacccaaaatcatgtagccgttaaaaaattacaaaataattttattaagaaaagagattttttttaaaagtaaaagaatgtcacttaaatactaaacatatccacatgcagaagattccttaaacttgcatcattcacaccacttttaataattaagagtcagagtttgacttaaatacaatctgtcgtgctactatgcattgacaacatttaaaaatgtgggcgtgttttaatgtgtaaaattattatattgttttaatggagtagttcaccaataaatgttaaaaaagttaccattttgcatcttttagatgtgactctcataatcaacaaacaacgtctaatagttttatataacaaaaaaaaaaaaagggtcatgtacgtgtaaaatgagttattgactaattccaccatggcggaagttcatatgaacttgtattaagtatgccttgcctagttcaatatccagaatttttaagtttttattctattttaataaatttaatttatattgcttttaaattttagcgtgtacctacgctggaattttaatttgatatctcttttacgtacgtatcttagatttatacatatataaacaccactctcagatatattttgtaattccattaggtgacattttttttttaaatcccatctcaattgtcaccaggcaaccaaattctgtgaatttgtagtcatactaaaaaaaagctaaagtatgacacatttcatgttttgcttggttagatctcttagacatatatatcgatcaggtttgagtcctaaatgtgtataaaaaatgctttattgaggataaaggcaaagtttatttcaatgttttctaagcttttaaagaaactagtctctagttagaagatatataccttgattcacacacagaaaaaatatcttataaacaattttgaatctcgggccagaaacaaattgcaagttacagaaggtatatattatgaagatccaatacttgaaaattggaaacattcctccacccccaaaaagatggaacctattgtagaagaatattattgtcgtcatcctgatcaagaccaaaatatataatttaaagagctaaatatagttatattagaaatttctgtggcaacacatctaacatctaaattagctcttggatagtgttttgatgaggtgttctttgttgaatttttaaggccaacacttgaagtattaattaaaaggattaatgatcagtattaaatatataaaacattaatgttaattaattgaaag

SEQ ID NO: 5708 - DNA, 1755 bp, Glycine max
  Soy_ogl_3780 Gm11:6949446..6951200 Cluster 26
ttttgttttataaattgtaaacaactaaaaaacaaacctacatttcctccccgttgctaaaacgaacactttttttttttctaaagtgttttccctggtcaccatagcttctgaactgatttttcttatgctggtctcactattggttgcctttgcctgagcttaggtcctgccatctgcatatgcgactgatactacaccagtacacccacacccatgtaatgtttgtagaaatgtcccaaaatggaattgactaccacacctctgcacgaacacaacatattagccacattgtcgacaccaagtgtacatattgtacccaccagggagcgttcgttttcggcaagtttagagattacaagaagctaccttcttccatggattccaagctccaagcttttcgggaaagcttagtgaaacaagcttgcaaatttccagatatgagtttttttttccagatcttagtttttctcccacacagattcccatttgagcttcgaccgctcatcctttgcaactgttggataccgccatgccaccgtcgatctgcaaccgccggacgtcggacgttgttgtgggccacccaatgctccgaacagatcaccactacctttgccaggatgaccaccgaagattccagaaagatcttgttgcctcagtttctgagtcttcttcatttgatgtgttttgcgttgctgttggtgcgttttttgaacgtagaagaagggaaggaatccggcggtgaagacgacaaacaacagtagtggtgagaggaaatgaaggttttttagtggttttaaaataaaataatgtaagtgggaatttttaactgtcaccatattaaattaattattttaaaatttaaatattaactgaaaaataacatttcaaacgaaaagttttaaaaaacctaaaataacataatttaaaatttttaaaatttaatatattagaaacaaaacaattacataaatcaaaaataatatgatgtcttataaaaatataaaacagtcacaccaaatttaggaacaatccaattaactccaacccaattcaactcatttccggccttagttggatccaacggaaagcaacatagttatgtgtttttgtatgtctgtgtccttctcttggtaaataaaatcaggctatgatactggctgctttggtgggttcattatttttggtcataacggttacatagaaactgaaagatactaccgtcaatttgtcacatatacaatggagggaaatatttgtttttcacttttttaaaacaaacagaagataggtaaattttgaaagaaattaatgagtagctgatcgaattatgtcaaagtcatggtgccttccaccatcattcatatgacaacgtctttatctccttccaaaagtccaactaaaaacagcttgtgtcccctacttgtttccattttttttgtgcaactatgctatttgttcaagaaagcgcttcactgcaaatttgaccggagtacgtgggtgtgtctctctctatatataaagggagagaaagaattcaacaagaataaataaataaataatatggaaaaaatgtaatgtcttcttagccatcatttacgaaacttgagcacttgaaaattgcaacatatttattaataccaataatacaagggctttgtgcattacatggccttaaaatatggaactgtttttaagtctacgattgagtatcttcacgacatgtagtactggttataaaatttataattcgca

SEQ ID NO: 5709 - DNA, 1300 bp, Glycine max
  Soy_ogl_4818 Gm14:48380001..48381300 Cluster 26
acccgtgaaacccgcagcctacgtgatatttgtagttatttttttaagcccgtttaaaaagtgaactttttatcctgcctcgtataacccatgagttaaataggttttatcagcgggtattttaatctctattaaaaaaaacaaaaataggatgttgtttaacaaacatgggtgtgttttaataaaactaaaatccctaaaacgcaaacctaatggttaaattcccaattctcgcgaacttagactcttctcctctaatggttaaattctcaattctcacgaacttagactcaccatttattttcttgacttctcaattggaataatttccggtgtaagtttctaaaatcaatgcttcaaaaatcaaaactccttattttgtagattttcttatttttttttttatcttgctaatcattcggctatatagagtaacatagttttttgatttttcatatgtggtaaaaagttacaaataataatcgaatggtattgcgaaaaaaaatgtagataatgttgtcttaatgtgattaaaaaggtaaattacataattaaatttttgtccatccatttttgaagactggtggtatttactggataaaaatccaaggtcaataagtgaaagactcgaccaataaaaaaatctatcaatttctcaattgtgatttgccaaaaccctttattggtatgtccacaaggttgattctgcatgcaatctcaatgaatatccaatcccagcattcataaacaaactttcttcggtctctctgtgcaagaatgaatctgatagctggatatagttcacttgtgttctctgtttaatttacttattattctatacaaaaccatgcatgtcacgtttggtgattcctcttatgctttaaaactagtttttagaaggttttggcttgcgccacttcctttcaacttccaaggcactagctttctcttggctattgatcttggatggctgtctatccaagacttttctcttttgtcttaatgtcattagagtctcaaacgcagtttgtgtaactcacatctgagagagaccatgttttcttcaatgtccagattcttctctatgcttgattgggtgtggagtagttcttaaggtcaagtcagctgaatttattttttggcatataactgtggtccttcagaatcattcttttgacttttttaggttcttgatagtattaaggtttgcttccaggggatggtataaggctaaggtaaaagggtccaacctattttctgattggtattagtatactcctcctatttgatgtgtttgtct

SEQ ID NO: 5710 - DNA, 1000 bp, Glycine max
  Soy_ogl_5298 Gm16:4704901..4705900 Cluster 26
gaaccctaagttgccatttgaatgaagcaatattcaaagccaagtatctttggaataactatttcaaaacaaacccaagtatctcgtgatccttttttatccctggttttatcacacctacgttctctccaatgtccaatcaaactcgaaactctcatcctaacttttcaattccctcttaacgcttgctctatttcccttccacttgtccctccctccttgtatctgcaaactaaccaagcgatttcatcgaacttcaaggacaacaacaacaataatatatatatatatagatagataaacaagaagagcgtgtttgaaacgaccccactcaattctcattagcttctattatgttagggttttctatctttgatcattttaatcgcatgtttggatatctgataaaagtaattttgataaacaattataatctttgtttttattatgatttttgataaaatattattatgattgttctatcatacatattacataaaacatcaatatgccattgatttaaatgaaaatggcccactggcgtcaaggaaaagaatagaacgaaaactcattttaattttatgtaagcttttatatctgagttttgtaaataataaaaaataaattaagaaagaaaattccaccactaaagtaattgataaaattttgaatagagattatttaacgacaagatataattttacataagatagattagaaagaaaagttgaacggacttccaaatgacctagttgaaatgttgttgcttcagaaaactctatcgtgatggcagagaaaagcaaaaccgtctttggttccgtagccaacatagattttagggtccatcttctataattcatgctattaagaacagtttcaaacataatcactggtcacgtgacactatcgtcgctatcttgacgtcaacacgtggctcacatgcaaataaggtaagggatagaaagtgagtgattagagtagcatgcgagagccaagacaa

SEQ ID NO: 5711 - DNA, 1153 bp, Glycine max
  Soy_ogl_6416 Gm19:38399248..38400400 Cluster 26
atatgttataattttatctctccactagtatatatattattgaccgaggattcttaacttcgaaggaaggaaatggagtatatactatagagtgatttgtatccgagagttatatatacgcgggtcaactccttttattgaaattgcgtagcatcggctaccagaaaacattgttaaatattgtgtatatttttttatataacttacttcatttttaataaaattattatttaatttataatatcctttaaaatttcattatctacttttatatatttctttattttttacacctaaaaaatatagttttcatatttggtcctttttgaaataaaagaaaaataactccgccgtctctgatgatttggctctaaacaggatccatatattgcttgtaaattccaccctcagctttataactttgataaacagaattatgtggaaaatgcttaaaatcaattaacgaatatgaaaagtactaaattgtattattatttttataaaaaagttttgcagtgtataaattaaaaaaaaactataataatagaattaataattatatacgtatatattccctcggcgcgcgtgtgttgtattaattaatttatataaatatgtccaattgcaaatacatttaccgattcgttatcttcttcctccatctttttctactttttagttgtacgtctttattttaatgcatgcgattatgacacgaggtccttatattttatcatgacgcaaaagctatgatacatatatggatcgagtctcagtcatattctcataacaacgttgaaggcatgcacatggtagggtccaaaattttagggtttatagggtatatagggccaatatgtttggatgccttccctgagtatatcattatatataccaaattgtttcacaaaacacaacccatttttccagttgcggtatagggcagagatgatccatttataattcgtgcaacacagttattttccccaccaaaatttaactttataccacctcttcttcatgttcattattcctctagtgaacgcatgtttgattttatgtctgaatccagatcctcgcttctatgggccaaatcactctccttgctggttaaactcgcaccttgactacacccttctcggctttgttaccc

SEQ ID NO: 5712 - DNA, 1200 bp, Glycine max
  Soy_ogl_3453 Gm10:39179601..39180800 Cluster 26
aacactaaattataataatttttattagactgatcgtgtatagtaattagatacctaacattgttgatatttgttgtatttataatgagagaaggttgaaatgagttgaatttcctaacccagaactcaacgattctaaagagaaatattattctattttggtgtagtggaaatgtaacttcactccaaaccaatatatacttcttttttttgtttcaaggtttattgtagcatttttgtgcccaagtaagagtgttgagcgaggtcagtatttagcaaattggatcccaagcaaagtttacgataatagtatgagatcatatagttgagcctttggcatctctacaagcatggtgaatcttcaagttgatttgatggtgttgagttttaaaggagattaatcagattatgtacgtaagtatctgtaaatacggaaaaacagtctgcttgacaacactggatgtactttatttataaagtatagcgctcaaatacaagcaaactagctaaatatgacattcaagcacatatctaatttacttgataaagaaaatgttaaatattttctaatgatattaaatacatttttcatttaaaactttattataataatagtacttaaagattaataaaaaggtgttgtaggagaatataatattattttttaattaattgttctcacataaatacttttctatatagaaaaatatatgtacacattttcttatacatactttttatataaaaagtaatagataattttattgtatttttaagtaactcaaattaaatatacaatttttttcattttatatataacttataaatagttggtctaaatattacttaattttattctctaagattttaaatttaaattttgtaagtgaaaaaaatgtgaataagaaaaaaaatacaccaaaagtgatgcgtcagaattttttatgtaaattctatcaaaatctatcactaaaatcactaaatgctctgtattaaaaaaaaagttcagtatataatattatataatagtatagaaaaccaacaacaactagctttccaaatgaatttcctaagcaaccgacacttcctttttctattttgagtataattaattagtgcatactaacgcatcattattcgttaataattacatggaacgcgtgggttttaattgtatatactactttaatattttatgga

SEQ ID NO: 5713 - DNA, 1047 bp, Glycine max
  Soy_ogl_2935 Gm09:1648922..1649968 Cluster 26
caccactatataacaaatagtatatttatccatcttaactcaaataaataggaaaacaatttctttaactaaatgtattttttataaatagaagttatatgataattttataaatatatagggaataaaaatgaaaatatgagtggcattataaatttatgaataaatatattacatttgtaaaagttccatttggattggattgattgatttttaaatttaaatacaaaatttgatccgctctaataattctttttttatttttggtttatacagccgtgttttggatcgatttaggaacatccctaagtatgacatggatcctatgatcagttattgaaatcaaagacatctaattaacctttataggtcaaagaaaatctatctctagataaattaacaagcccggcccacaatgctacaataaaattcagtgattacaataaaaatttagcacgttatttactattactgcttgctcaaatattcaaaaacttcagaacttatatcaaactgagccaaaaacaatttttttttttgtttggataaaattagatgtattcgagactgaaaactagtattgaagtaggctccttaagaatatgattgattgtggagagagaaaaataataaatgaaaaaaaataaagtagaatattaggttgtttagattgagagaaatagatgaaagaaaaatagagagaataaaatagattaactaaaatactatcataccctaagcaatacaaaaggacaaaagggtatactcattaataggagacaaagactatttcgtatgggactcaatgcattcaattttatttctctcacaaaattaaatccattgtccctaacaaacaaagtgtaagagtgataactctaatgtgctcgataagccaagattcaagttcccgaaaagccaaatgatgcttcaatgttttattagagtaacgatgtgtattaaatacttacatactgtactgacattggtggtatatacatgtcacaaattgatttttctactgtctttttttcagctgttttagta

SEQ ID NO: 5714 - DNA, 1312 bp, Glycine max
  Soy_ogl_6618 Gm19:49102189..49103500 Cluster 26
gaactattaaacaaaagcataatgcaatatcacaaccaaggtggaaaccttaccaaagcactagacctctccctcaaaaaatttcataaatccagtcaagaaaatgtaaccataacagggaagttgacaagaataaatcatgataacttcacgatttcatcaacaaaatgtttaagacattaaaagtaaaaaacaatcaagggtgctacaaccaaagaaaaataaatcacctctccagcactggtagttcataccgcaactcttcatcaacttcctgcagatataataaaaatattaaaaacattattttctttatctttttaaaacaagaaatgaaataaaaataagatgatatttgtaattataagaaaaaataaaagatatttctttatattaaacatatccttaaatttatgtttaattgcatgtgtgaaatagaaaaaagataagaaaaattaattaagcatcaaagaatagttaagctatgtaagcattgagaatgtatcaataaaaaaactgaccaaaacaaggtagatagatgtcaaaagcaaaatggaaaactcaccttaattccactatcacttgatgagacaaaggaataaagtgaacttaaactcaagcatgtacatgcactttcaaactatttctttttatgttaatactattagaaatataattaaataaaatataataagattgcagtatagagatttcttaccataatcatatttaccacttgtcaacttcaatatcaactttaaaaatatgaatgacttaatgttaccgtgaaagattaacaagttggattgcaatcaatcagctctgctccccaagtctttactcttcacttgacttgctacctaaaaacaaaattcttcccccaagtataatcacaactcacaagctttcaaaatgaccataaagaagcccagctatatatattcctatccgtaccatgttcttggaaactaaaatgtaataaattcttattgaaataaatggttaagtgatttgtttattgaagcatggcattcgctaacaagtctagagcatttttttgtatgcgaagttgcatttaaaaaattctgttatatataacttatacctgctactagaaattaattttcttttcatcaattcatcacagacatcatgatactacaaaaaagttggaaatacacaattttaggtgacttaaaaattagttgatacttcattagtcgtgctttcagatttgggtctagctagattttgcagcagaagagtactggtgaatctggtaatggtagaaattaaggggtcgaagaaatta

SEQ ID NO: 5715 - DNA, 1282 bp, Glycine max
  Soy_ogl_3770 Gm11:6306690..6307971 Cluster 26
tttttatcattaataggtaagtgctttttatcactttaataattagactttcagtattgaaacacattatttaaatttttaggcattctgaaagtgaaacgccaatagtcagttcattgttcatacaaagcttgaattcgatactttttactgtggcatgacgaaaaaagtacgtaacataattatttttttatattttcgaaatatattcaatatttcctcaaaatatatttgttatttaataaaactttgtgttaactccactaataaaaagagattttgagacattcgacagaatcggcacaaaattttactaagaatttaaaatattaaaaaatatattttttatgatcaataaaatcccctcataatttttttatattatttcttatcacttttattatcaaactttttaatgccatattcattccgatttgttctcacctctaataattaaaagataatcatataaactttcttcttattctgcgattgcaatcaaagtactaatagtacacatgatcaaaccttctgttaatctgcttcatatgtatgatctataacctaacacttatgataattaaatgttttttagtaacattcaataaattatgtattgtcaatttcctctagtttgttagttttaaatcaatcttattaatatttggttatataaattacatgtgtcttttataagagacaatcctaaactctaatatgaacaccaacattatttcttcatatatttaacaaagttatgactcaaatttgagtccatatcttactaaccatacatattgcctgtctttctcacacgcgtttatgagaaaaggggggaaaagtcttgaaggatcaatcactttaactgtaaagttttgctatttcaattcatcagcatgtcttatactgtggcaatttacccttttaattatacattgtacatatggttgttcccacccaaagttaatattcttgtttatgtcccacttgggaaaaatcgctgttggaaaatcagctaaaagggtaagctatgttgaaccctatcatacgcatgttgtagatcgatcgaggctatgcttggctaggagattcgccacttggttagaaaatcaacacccacttggttcgttatttagaatatataaaaaaaaaagtatgaaagatatataaaatgtaagacttaatttaatgaaagtttttttttcctaaagattatactcccgtatgggatggaatgtttaatcatctcatccctaattgacctaattaagacagtgcttcg

SEQ ID NO: 5716 - DNA, 1000 bp, Glycine max
  Soy_ogl_3238 Gm09:40599801..40600800 Cluster 26
cagataagatcaattttatttttaattagatgccatccgcatatgtagctatgatgttgtgaaatacacgaaaatccacctcatcatggcaacctagctaggcttaagtatatttgaatttaactaatttgaaataaagaattataatcagattctaaattattgtagctacacagataaacacagtaagtttttatatgattataaaattaaagcaccaggggtacaataactacatccatggtctccaaaaaccaatttcccacgagaccaattccccaaaccagaagaaaatacaccaaaaaattctcctaattccataatcctatgtatccacctcaataaatgcatacataattaacctaagaccaaagtataaccgaattgggtttcttatttttttttccaaaacttttaataaacaagtaatggaacggacaaatggatcgtcttagtgaaaaatatattgttttatgaaattgaagttataaaacaaaatactttgtggttgatttaactctctttggtagtaaataaatatataaagtaatatatagcctttttttctcaaaagttctcaaaaacacttctgatttttatccaaacaggttcataccactgtaaatttggcaaagcccaaacaacttctatcaacgagaattggcttgggagaacaaaaaagcacgcaaattttatgatgattaatcacaattcttcacaacttaatcatcgcatactttaacgggcatatctgtttatcttgcataactataactccgtcgcactaacattttgaacatggttttgttctcagaatctttcttgtctacttatctctctatttgtttttttcttcttttcattataagggaatcccacgtaatcccttgctacgtaaatatgtagattgctaaaatgaagggagaatcatgcctaatgaaaataccaaaattagtcattacccaatcacataagcaaaataaatctaactgtatttttt

SEQ ID NO: 5717 - DNA, 1473 bp, Glycine max
  Soy_ogl_3787 Gm11:7279301..7280773 Cluster 26
ttttttttatagcgaagttgagaaaataatacatcattggtattttctatttcaaatcacaccataaatgtctttttttaaggattataccataaatgtctaatttgtgcaattcacgacttcatttggtttctacaaattaaaaagttttccttaaggtcatcatgtgtcacaagcataccacatattccgtataaaaaaagcacaccacatattactactccttatgtatatatctcatctcattctcatgtaaaggggaaaccactagtgtgcgaacattgcacgtgtacgaattggagaaaataaattgtttgttggtgcaatctcaaccgttatttcttttgccgcataatataaatgacacaatgatgcgtgaatagtgcatgcgtttgtatcagtacaagactacaagtgttttgaagcacctatcgttcactttatctattaacgtttctaccaaaatcattttcatgccacatctattattttgtttataatatgaatttgacacttatttttggttattacaatggtgaaattataaaaactttttaatgaatcacgtttcaatgaagcaaaatgccatataactattgtttactagagtagttatgtacaaaatagttaatcaagtgatgaggtatagaaggttaaaattaaggttgaattatttgaatatttcttatctttaatagaaataattcttaattaaactttatttatctttcgattgaattttgaattaatttggatttttctttctttctaatgaaccgaaaagttaaagaaaacaaatataaaaaataattatgcttagagaaacatcattgcattaacaaacacctcatatgaatgtaaaattagttttcgggctcgtgattttgacagcaacagattgaagtgagcctaaaagattgatcaaacaagggcatcttattttattgtatttttcatatgcatcttacatttttgttgtaagaaattcccttgataattatttgaacataataaaattagttttttttattactttttaaggaaattaaaatgattatttttacttttaagttgatttctcttattgtgactagttaaacattttacaaaaaattaatggagctgctattttcacacccctaaattgctactgtcactccatttttttcagaaaaatgtaagtggacaaaattatccatcctcacttccctacactctttccatttcccctcctccgcttttggttacaatcaaatcatgatttgagtctgttgtgttgaaaaaatataaagcacttgaggggtgagaataacaaaatgaaggagggtgagaatagcaactcccaaaattcatatctgcatcctttggcttcttttcagccgcctaaagcataaacggtcgctttatttgtcattcactctaaacaaatgtttctatcgctacattatttacagcaaattaaaagggcaatgt

SEQ ID NO: 5718 - DNA, 1500 bp, Glycine max
  Soy_ogl_4796 Gm14:46898501..46900000 Cluster 26
gcattctctttagtatcttcattgaaaggattgtgaacacatgactgacccggtatgcttttttgcatggatgtaataatggagaggaagcatccaatttctcgagaaaacatgttccctcctttctctttcaaatattgaaattttgtccttttctgtttgattaagagtgaagaaaaacttccaaatgagaatgaagtatcttatataatatgtacacgatctgttagtaggactggaaaagcctagaaataaatatcatcataattgggctttgtcaggaaagaaataaacagtaataggaatgtaacccttgtgggttagtaggccgaatgagttgttaataaaaaaaaaaaaataggtacaactcaaggaacagaacttattgtttgatgccaatattaataaaaagttgaatctttttcttttcaatataattatacgatattattaaataataataagagatgatttttttgttttataaaattagagggtcaacaaacgagaaaacagaagtatttcaactatgttggcaccctaatgagaacccaaagcaaatcacttctaatatcattaaaaagaggagaaaacataattaacaaaatgggggaggggactaggctaaggcacatgtgagaaggtacaaaaatctataattagggataacatttctattacggaggaattgtcttgagaaacggattcccaccaagtgaaactagcaaaaaggtcccacgactaccttgagcatctatacaaaaatttccttccatacaaatataagaagaaagcaaaactgcaaggttctatttacaaaaaaataaaaacaaagtattttccattgcgggcaaacaaaccaatagtgtgtttgatttggtgatagaaaatcatgacgagtgcaaaatcatggtgagttcaccacaaaagcaactatttgttgcttcaaaaaatcatgatgagtttaatccaccaccaatccaaacacacaacaaagaaaaatgaatgagtttttcagcacccaaaagactccagccatatcttcttccaattattttggatggcaatttcaagagcaagaatgatcgcaaaattaaacctcaacatacaagggagattgaatcccaatatagaaagaaaagctttccaacaaggcgtccatgtggtcatggaaaatgccaccatgatgtgatgcattgtttttgtaatgctacacaatagaattcccacatccacttgtctaatttaaattaatgataagactaacttaaggtaaacgatttataaatatgggatgaatttagtagaagagttaattcttacgcaatctaactcaagcaattccagtactgtattttttttttccgacttgaatcaatccaataaaataatttttatatgatttttattatcttttaacatttaatttaaagtaattctttttttatcattttttttcaaaaaaatacaaaatatcaactgaaatatttgactcaaacc

SEQ ID NO: 5719 - DNA, 1200 bp, Glycine max
  Soy_ogl_334 Gm02:2828801..2830000 Cluster 26
gaacgaggttttggaaactttgaggtggaagaggctgaaagttataaaaaaaatacaagaatgttttggaagattcttctgttaagaagagaatttcaatttttcaccttttagaagaaaattgaaatttcatatttttagttgtttaaaattttgttttaaaatttcaaaaattaaaatttttcataaaaaaacatttaaacaataaaatttggatgacagaaatttaaattctccaataaattatttttcttaattaatttctttagttgaaattctgtatcgaaacacaccctagattaaaatccaattaattgaattgatttgacaccagttgagttttcacacctctgaacatccttataatcacctcaagtcaccatttgatctatccgatgattttttgttgtccaccataatctaacggatgattatttaagccaaaatctaattatttcacattcagaatacattgatacaaacccgcaattataccacgtacctttttcgttttctcaacagagagagaatctttcggagttcgtttgcgtgtgttgtgtgatcagtcaccgatggcagcagcacctgcgagggcacgtgccgattaccattacctcatcaagcttcttcttattggcgattcattagtttggagacgcttcattttagttatgtttatgttttttaaacctggattgaatgctatttatctggttaattgtctaagatgaggcaatggccacaggatgatatacacggtcaacttgttcaactgtttagggaggaaaagtaataaagtatagcttcacataaatttctcaataaacaattatagagagcttctataaaatagtttaagtttaagtgcataagttgattttaactaatgatagaagcttaattcatttagtggtgtttgaagtgtccaacatcgtttagaaagtttatgtttaagtgcataagcttaaaatttcatattttcattttattttgttgtactgcactatctgtgttattctgaagctgaaaattatattcttacttgtgatcagtattactggacttgaagatcccgattgtagatgattagcgcagcaggtggtgtttgaagatttctgtgtgttttcctttctgttaattaagttcacagcgatgtctagtttaagctatgtatgacaaacatggtgctgtaatcttcgg

SEQ ID NO: 5720 - DNA, 1600 bp, Glycine max
  Soy_ogl_973 Gm03:39579301..39580900 Cluster 26
tttatctgatgatggaggctaacgtacaaatttcttttgagaggaaaagactgagctcatttcattaagaataatggaagcaatacaactttgaacatgattaaaggtgtggcaagaatcataaaatcttgatgctctagttagggagtgggcaacatgatttgcttgccgcttggaaaaactcaccaaagagtttgggaattgggataaataagcgttacagttagagataatagaatgaaaatctaaaaggcctttacattcatgaaaaatagcatccactattcttttgcagtcggcttcgatgttcacatttgataaacgcagatcagaagtccaattcattgcttgccaaagaccccatgcttctgcagttctcgggtcaggtactccagtaaagtgaagggttatcgcaccaatatgttccccatggcgacctcggaaacgagctgttatccttcaagagtgctgcatccacattgcactattccttctgtcaagtgtctgattttccttttcgagcatggcaccattcagtgtaagactgcgttgtgaggttgatggaaacatgttcccgcaagtctatatgattccagatcttgtcgtttctacgtcgccagatacaccaaagtagcatagcaaacttgatgccaattcggtggagagattttgcagcaatttgaacactgtatcagtcaaggttgtagcgttgttgatgtcttgcgagatctgaggcaagccagaatcgttgaacttgttgacaaccaaaaaacacatgccacgaattttctagattggattggcaatactcacataaaatacagcaatgtacccctctagattgaagacgttatcttgttggaaggctgttccttaagagacgcaacataaagtgtttaacttttggcggaactttgagttgccataacaagttccaatcaccagggactttataatcatccttgttaatcaagttctccatcaagtagtgataaccttagtgtgtatactccagtgctgctgaacttccaagtcaatgaatcttgcgaattggtgtttaggggaggtgatgcttggatggtttggatgtctgcgtgattcacaatttgaggaagaatttctgtcatccaacttccagtggaatttctgataacatacaaattaaccatctacaataatattttaaattaaaacaattaaatatagtaattagatatctatacgtgttcttacttatcatgctgtgtagctcagacgaatcagtttctttctgtattataagtaatcaaaattagatgaggaaaacagaaacacataaaggtcttaaattgtggggaaaaccagaatttttttaatggcattaaaccatctaaagaactattttaattagaggaatgttatgtgtgacttggtacttcaacaaaatcaatgtttagcatcaactaaaagttaatgctatgttcgtccgtgttttgatctgataaatctgttaatatttatcgataaaaaaacatgtcctgaaactaacaatggtgcaaagaatcgttctgcagactaattaattcttcaaggatagatcttctctgcagactaattcttt

SEQ ID NO: 5721 - DNA, 1000 bp, Glycine max
  Soy_ogl_1264 Gm04:6833601..6834600 Cluster 26
tccaccaattatgctaccatgtgtaaagggttcaggaaatggagccatcactctgttccactattattctctcccaagtctgacatatttcctacagaaacagacacacattttcagcaatttctgaaacttaaccccaccccacgtgaacctgacacgctcaatttcaggatatttattatatataaactactctttacattgcttattcccttaatttgttccagctcaatatcttcaaaaattgtagcacaactcagcattggacattactcaacattgccctcaatccagatgcatgcttctctggaatctatctcctcaactcaacaaacttttgtgtattaaagtttgccaaaaaaaattatatctaaagagataataattgatatgaaaaatttacgtgattattattaagaaacataaaatattaatatgaactaaagaagccggttctcttgggttttagtgtgtatctagtgagcatttataaaattgattttgattaaattaattttataaaattgatgtttgttaaaattaaatataaaatgaagtaatatatgaatgtttctattctagctaaaagcagtcaataaaaaaaacatatatattcaacataagagttgtctgaaattacaacaagcttagttgggcgtgagtaataatatttgatgcgtgcctcttttgaagtaactttgagcatcttcaatgtaagaattcaaattagatttttaagtctcttcttaattagcatgtgtttggtttccgttggttttaattgacgcatcttgcgcgtcatttttgaagcattcatcaatactagctcctgcatcgttttatactttttgacgtgaatttgcttgtagacgtggatctgaatgttaaaccagacacacgggtagttaatattttaacatgcacgtagttttgaatgttccaacttattcaagttattttctaaaaaagcaaagaacttattcaatttcggttttggaat

SEQ ID NO: 5722 - DNA, 1600 bp, Glycine max
  Soy_ogl_3755 Gm11:5629201..5630800 Cluster 26
aaggttctttcttaccttaatcggagacaactatacatactatccattcacatccctacttccactgcgttattttgcctctttggtcagcattccgcgttccccgcacgtttggcaaagaaagtcaaaattaccctattgtttgtcatgacttagaagttagaatgcaatgtcgtgtaattttagtttgacaatgcatcactaaatccagaatagcaaacccttttattagattttgacctacaaaagcttgccatggctagggatattaatgagcatgttattgcaaagttgcacttgcgaaaacagttcaggtttcaggacaagcaaataggtacagtgtgagaattatttcaggacaagcttgccattcacttgtacttttatattattctattctattaagttttttttagaagattgttttattaaggttaatttagtggtaaatgaataattttatgaattacaagtttaaatttctgccataatatacaaaaaagtatatatattttattagagattttatgtcgaattgtaatatacataaaataaagtatataaattgaaaataacttttatatttagaggtaatttttaagattaagctagaatcaatccgaaattgttggattgtataacaatttatcatagtaattattgtttggctaataaggctcttccccttattggattattattagatcactctcgattgtttaattttataatttcacgctctaaatattttttttccacgtgaaaatagtgtatgagagagctcacattaattagtaatgtgattagagtaaaacatatatgtagaggataatttttacttcctaaagtaacttttgaaattaagatatacctaaactcaaattttaaaaatagtttgcactctgcattcaactctgtggcatcatgtaaagaaaacgtatacccactgtcctcctcaagaagtagcaaatatctttcattaattaagagtggcaagtctcaatcaggacttggtaaggaagttcattgactacaaattggcgataaagtaagggaaaaaggtaatgcgaggagaatcacgcctttttgacaaactagcacaaagcaaaattccttgtcaattgcgaaatttgaaacagaaacattaagaggcatgtctgtgtaacacaagcaacaagagatctaactagtcaattcctaacgcgttgccattgatttgaattggaccctccactgaaccttagaaaactctactcaaacacgaggcaaagctggaacctctcttcattgtaattcaccatgatctttgaaggaggacccttccgctagcctgtgaccatcatgccatctatttgccaatagccattctttctcaatcagaggcccatttttgtgccccatcatatttcatgcctcgagagttcgtgttcaaatgaattatctatccatcactttcagttattgttatcctcggttttcctctatctaattgttgataggaacaaaccaaatcaaatactatgacatttaagagaacgcatcaacgtgtgtttttctagttgaattcgaggctttatcaaatgttttatgaccactttat

SEQ ID NO: 5723 - DNA, 1339 bp, Glycine max
  Soy_ogl_3768 Gm11:6289962..6291300 Cluster 26
ctacattaataagcaacacagatgaagtcaacagttcaatcatacgttaaagatattcaatatccttgaagagccaatttgataggactcacatgttcaaatcttggtagaaataccttaatatagcaacagatatcagatttttatcattgcaagaaaaacaaaaggtgagggtatctcaatatggaccaagcttcttcaaaaaatggacatacaaaagcatttgcccttagcttttatgttgctgctcctagtcttattttctacatcgccctcctctgttagtgtctcactctcctccctcggtatgggatactgggattaaagaatgtgatttgtttattttcttcacttccttctttctctgttgaacaataatcattttcgagtcctgtttgtatgcatgaacacatgaatttgaacatcctagttaaaaggaattttctcttctagtaaaaacaattcagagtatatattttgtaacagattaatcatggtatgcttggaaaaaagttagaaaatgctaaacgtggatcccctacgctattaaatagttgcttttgcatcacttttgatgtgattttgctctaaacatggatctcagatgtggaaccaaacacgcattcagttaattccatatccgaaaaagaagatataatgcagctatcgtgttatttttttaattgcatttatatggatggttgaactcttcacacagggaggaaattttttgtttaaacgggtagtggaaagtataatgcagcaggtttatcacctagaattttttgttgagaaaagtataacacgcatcacaacatcaaacagaaacacacgtttggaaccatttcttgtctaggctacttgtttgaattacaagctggaatataagaccccagagttgcatcctgtatattgaaataaagaatagaataaggataaaggattttataaaataaggatcaattgaaaccacgtttggaacttaagaatgcatagaaaaaaaaaattgaaaactatacactgtcgttgcaaatcaagagtgaactaacccaggaaccattgatccatgctaattgatctgctcgctcaatgatcacactccacatatatgtttaaacatacatcaccttgaaattgtgattaatatcatttaaaaaatcatattatgaaaaaaaaattaaatttgattatatttataaaagttaacacatcattagttgacataagattatttcaactagtgatattgagtttgaattttaaatatataatagaaaaagttttgagtcaagtaggattacatattattgaagatacacatagtttcataaaaaaaaat

SEQ ID NO: 5724 - DNA, 1210 bp, Glycine max
  Soy_ogl_5388 Gm16:31158391..31159600 Cluster 26
tgagaaaagtcatgcgtgatctagttggctgcttgagacaaagggcaggtatcaggaagagcaccatttcatccctggtttagtaatgaatgattagctttccaacaaatacttatcataagcaataaaagatcactattgaacaaataatcattgagttaaagaggtagtagcatttaggggtgaattaggttcgggttggttcaataacctgatcaatttgaatcaaattgaaagagaaaattcaattttaaaattatatatttaataccgatttagcttggattttattttttattgtataattttataattttgtaacccccaaccaaaaaatgatataattactaatttagtccctaaattatttaaaatgactcaatttggcacctaaatttttaaacacttcaatcatgtcatctaatttttaaaaatatttcaatcaggtcacttttgtaaaattccaacggtttttacttatgaaaagtgatggttttcattaaatgtgttggttttaatttgatagaaaggacttggttgaagtattttaaaaagttagagggcctgattagagcgtttagaaatttgagaaacaaactgaatcattttaaatattttaagaaccaaattagtaattaagaaagaaaaaaaaaaccctccaaaatcatacacacgatgttccctcaaccacatacaaaagaatctctaaaaaatacaaaagagaagtaatttaattatcacacacaaaaaaataagcccaattttcacaaaaatacatacaattcgcacacaaaaactgaagcccaattcttcacacgcacacaatcaaaccaatttgcaaaaaaaatgtttttaatttttttttacagaatgtttttaacaagtaattctgatcatttttctaaatttatataaagtttgggatttttaatatatttacagcaaatacccgaattagtaaactacaagagtatctttctctcctttctttttatttttattttggtataattaaagaaagagaacaaaagaaggaattcttgctactactttctttatatattgggttcacatttactttattttgctgattaaaattactatatgtttgaaacactaggattaagcaatgcaaattggaggaagtccacatcactttccaagttagctatatgtttctctgccattgtcatccatgcctctattcctt

SEQ ID NO: 5725 - DNA, 1300 bp, Glycine max
  Soy_ogl_5820 Gm17:40465701..40467000 Cluster 26
ttaagcatagatccccgacccaaatatggttccagaattccacggcatctccatacccaactttccacccacagaggttatcaaacccacattttcaccacaagtaaggcctgaatctcgccaccacattgaatccctatatgatctcctgcaaaactttccacatgattcttttccatagtttgatttcaaaactttgcaccacaagtcctcaccacccgagatcaacctccacctccatttaccaaggagagcttggttgaaatgaacgatattttttattcccaaccccccttgatgtttcgataggcacatagtgtcccacttcaccccataagaagttcctttgcaagcatatcacctttttttggcatcttaaagaacgaaaggtgggaaagtggtaaggatgatagaaccgagttgatgaggcaaatccttcccccaatggatcggataatgtttttttgcctccacaccgacaacttaaggacttcaacttccgcatcaccggttcccacatagcttcattcctaggatttgtccctatgagaaatcctagatagacaaaaggcacttatatcaagccacgattcaagaaagccgccgctcttaacttaaagtccacttccccacaccaattgttgtgaatttacttttatgaaaataatcttcaagccggagaccacctcaaagctcctaagaatacattttatacacctcacatttgccatagttgccatagtcttcttacttgtatatggatgggtatttcttataccctatttaatgataatatattgtttgctgaccaaaaaaaaaattgtacccagcaatgataggttcaattttaagagttggtcgaaagaaatctacaaacgaaatttgagatattctaatcaatttgtatgaggtggagtaatttgacaccatattctaatcaatttgtactctttgaaagagtgaatccatgtcagtaacaaatcacctaaaacaatctaaatacattattattttctcaacttacaatatcacatttcaaaatagtagaaaatgagtgtgctaaacttttacttcaaagtttaccaaattcatatgatcaattaatcattagcataacaaataacaacatcatcaaggtttaccaaattcgtatgatcaattgatcgtcatatatttttttaatgacgttgttggagctattcttaaagaagaatccaagcaaaataataaggaagatacgttgaaaggttcaaagcaaataaaaactccaatgatgacaaaatgcaaatcaatgaaacat

SEQ ID NO: 5726 - DNA, 1260 bp, Glycine max
  Soy_ogl_6222 Gm18:56990301..56991560 Cluster 26
aaattaacacagaatgtaaagtttctttagttctgttggaactgaatcccgttgtttgcaagtgttattcctcccacggccggtaatgattccgcatgctcataattcacatttttttttatttggtcaattggagaataataatctaccaaaacaaaacaattacacgataggaataagaattatactcatatttttcttatgaaagaatgctaatatcattctccctgacatgctttctcaatttttttataattaattaaaatttattaaaaattattaattttgataaattttatttgatataaatcagaagaaaaaatcactaaattgagaaataaaatttaccaaaaataatattttttaataaattctaactaactaattataataaagaaaatgtcagataggatgacattaaaatttcttttttcttctgaatacgtatgccattgacctcttggcagcaagacgtcaagacccacgcgtcgaacccggtttggtaatgtgaaaacagagccgaaccaaaccggtggcgagttttagtttgcgacatgcatgatgcatgcattcatgtcatgacccatgacatgaccccacacgctattgaatgcctcgtgccacccatgttttcgattcgaaacgcggttcgcaatccctgcgttcatgcgcactgccgccaccatgtgacccaatcatttgccgttgatattgttgaccgtcaaaccatctctggccgtttgatcttaatatcttaaaccataggattctgatgctgtcgaaaccgttaagatttgcaatcttacttttttttcgcaaaacagaagtggggcccgcaaaagcaaaagtgtgtgaactgcactactacagaactgtgtctcaaaccgcagccacacctcaccgtggaacccacacatttttttattaataatttaaaattattacttattaacaagttcactgttcaacataaaattttattttattaaaatattaaaaaaatgtaagctaataatatttttaaaattgttatattccacttcaagaatcgctgctctcgttacgacaagtggaggactttgggggtggttcctttcttgaaatgtccagattcaaacttttactattattttatttgtattggatcttatacaaagctgcaaccaactagcaaaaaatgcaaccgggtgcttgttttgtcccgttgtcacgatgtagcattagcatcaactaagtagttgtaacaagaaagtaacaaga

SEQ ID NO: 5727 - DNA, 1734 bp, Glycine max
  Soy_ogl_6273 Gm18:59402601..59404334 Cluster 26
cataaattactgcaaattaaatataacattgaaacatgatatttcctggacttgtcacaaaactatgtgcatccatcagtcctcatctactatgaatccaccacaagagattagtgaaagaattcccatcaacaaaattatattttccaatgctgtttccttataataaattccttgcaaggataggtcattcccttccacccttctctacgtgcagaaggccatgtccattccacaagttccttggcataatcagcacttgaattccaagcctacactctctacactcagcactggcccaccatagcttactatccctcttgtatttcacatgccaccaagtttgtgcggctagaatttccaatgccactagcgttgacccagagtcaacaagacttgagtcaccatatgcaagacccaccaatgctgctgaatagtatgcattcacagcttcacttgtactttcttgattccttccatcctcaaactcggtcaacacaccttagacgtggataaaatctgttatacttttggcccaagttcatgaaatctgtcgcaagtgaataaacttttgtccccatggagggtcaatctttgcaagaaccgcaattccatagaggaagttccccaatggtaatggtgatcattgtaaattccaaaaccaaaatcagcggttgataaaataacatataagagagaatgtgataaaaagaaaatacattattgacaacccaattaattagaattaatgtgatagttataagggagtgtttctaacccttgtagtatttctgaatgcctgttattcaagcaataaagtattcacaccgagaccatttgaaaaggacctcttcaatccagcaatgatgaaaataaattaaaataaaaatgtataagaaggtaaagtgtgagcaactttatttgagttttatctcgatcttagttcttaatttcagcggaaaaaagaattagcttagttattgtccacggtaaatatttttttttcattgtcaacactagttcaaaaattagcagtaaagcaaaacatttagcgttggcaatggcccacagtaaataatttttttttaaaaatatttttataatcagcatcaaccagttgaaacttagttttttaatttgagcgggaaaacaaaaaagttagcgtcaatcatggccaatactaaataataatttttaaagaaatatatattttataattagtgtcatcagaaaaataattttttaatttaaatacgaaaacgaaaacgaaaatgaaaacttcagtcacctctcttctttttaaaaccctttcttctcttaatctctcatcggtctttgatctccctattttcccttttttatattctctgttgctaatgcttttcactgctatttatattggttgtaggttctagttgagaatggttggggtggtgttaacaatagtcgcagcattgatgatgacaagatattcttcttcaaatacttctaatgaacagtgtcaatttttcaatgacacctaccttcttcagttttgattagattttaacatataaaaatgaaatttaacaaaagaagaaacatattaataaatggttgacaattaaaataaatgacttaacactaacttgatagagaaaaaaaaaactatttgtaaaaaagataagttttaacttttaagaaagaattagaataaaattaaagttctaagtgtctattttaaaaaattagtaa

SEQ ID NO: 5728 - DNA, 1400 bp, Glycine max
  Soy_ogl_1391 Gm04:44271101..44272500 Cluster 26
ttgtagaggttgcttggttgtctccatgtgtagtctttgtgagaatggacttctaaccatctattcctttcatgccactttgcttcctcgatctggagctggctgcaatctgccttaataaggttcctctttaatttaccatatgtttcttccattataaagtccatggagaaaccaactcactaatgtgggcacattgaccattattctttcctcttgggccttttggcttgctagaaattagaggtgatttaattatgtcacaatttctctccacgtagctattaatctcatcattttcgtggctaatttggcttgccttttctcaagggccacatggctaattccatgatagaatttcagattctaaagtttttccttgttagcattcaaccttctaaacaacaacatatcaagcaggttcaatggcatgctcccaagtaagggacttaaaaatgtattattgatggttccaccaagggatctccgggatatgttggtagtggagaaattttcagggaccataagtgatttcttaggtggtttctctgtttatgttgggatacaaaatgcatttgttgctaaacttcacgcggttattttggatattgaaattgcccaccagaggggatggcataatttgtggctggaatcagattcacaattggttatagctgctttcgaaaatccaaatattgtgccttgggaaatccgtggcaagtagagaaatcgcttgattctttgtaaggacatgatttttgtttattctcacgaatgtatataggaaaggtaattcttgtgcggataagttagttacttttggagcaaactaacacacttttatttggtgggattttgtcctagcttttgttaggagagattttttcgataataggaatcttttgcctatctataagttttggtctagttgctaccatgaggacatgcattccttacattttactaaaaaaaaataagaatggtaatttatttaagttactaactattcatgaagtatcattgataataattattagaaaaattaacaaattcatcacacataaatatttataatttaaaaatagtattaaagttctttacacttaaaatacatagaacatttacaatttattttacttattctaaacaatttactggggagcactcgttttgatagactatccaatgacttttgctcatttaaccattatttttttatgatcaaaagaggctaaaagcccaagaaacaactgagagataaaccaaatttagcaaaaagatctgctacaacattagtttctcgaaggacagcacaccaagagagatcttgtgcttgacgacccaactccaagatggaagaaataataagagactcctctctagaatcagatgaaccatgc

SEQ ID NO: 5729 - DNA, 1100 bp, Glycine max
  Soy_ogl_1898 Gm06:10739001..10740100 Cluster 26
ctgtagatgatcatatattgtatgatttgtgttggcatctgttgcaactgtctaagctcattatgaagaataaccaaataattcaaccacatactcactagaatgaagaataggaaagtgatggaaaaatgacctcgccggacgatggtgggtccctgcgttgtaacttggcatggacccttccatggtttgtgtgaagggcacaagtgtcacgaccaaacatgaggagatagagaagattaggtgaaatgtggagaaggaccaagaaatatgaccagactaacaatttctaatgctctatttaataaatctcacaattctcatataaaagtttacaatacaataataataatataaagaaaattatatcaagagaaaaactttttctcttaatcgatatcattacaatattttttttagtaatatcattaaaatatatcactactttaaatagataattttttttaactcaaatctcttaatttttttactgacctcttaatttataaacattttctagttgtgctaatatcaatacttaaattattcttccatatttggtaaacttgctctaaaatatgaaacttgtgtataaatatctacaaaatttaaaagatcggtttacttttattaaataattgtcatacttctaaatttatcaaataattattacctaacataaaattttataataaattttaataatatttatgtatttacctcaactaaaataccctatctctgccactgggatcgaatcaagtagaatcaagcagttaaatcaggaactggtttaatgattggtgtctagtccattacctctaagaaaccatcccatctcataatctgttgaaacaatgcagaaaattagttcgaagggatatttttttaaggttaaatcgtaaattcagtcacctataactcctatttcgaataaataattttgattattttacccgttcatcatctaaagttaaattttaatttttttatgtgacacattagtgctaagataaaacttatatacacggttgacattatactaatgtaaaaaataataaatgatgtaaaaaataaaatattttaataaaaattaaatt

SEQ ID NO: 5730 - DNA, 1111 bp, Glycine max
  Soy_ogl_2646 Gm08:13074290..13075400 Cluster 26
tatgtacaatctcaaaaagactatcacatttttagtttctcaaattgaaaatttgtttttattattataaagcttaaattaagtgtttaaaatcacatcattttcaagtgttctgataattggaagtttgctcatggtaaaaagggttatgaacgttggagaagaaaaagattagactcatgtgttcaaaatcacaccatttttaaactcgtaatataactcaaatctgaaaataaaattacaaaagtaaccaaaaggtcacactcaaattcaaatgtcgtgtagaaggcattaaaccacacgattaagtccaatttgcgtcagagagagatataggagacttgactcgatagattaggaacttgaaatcactgcattgagcgagacaaattgagagcgtcacaaggtaaaaagggagaatgttgcaagacagagaatgagatcgtcgcaagatagagagaacaagaatgttgagagggtgatttccacaaggggatgtctatataacgatcttaaaaaaatattgttggtattacgtgatattttatataatgacttaatttttgtcacgactataatgaacttctaatcaagaattaaatatttaaagttagattacaggatatgaacatttacttcatggcatgaacttaggaggtcacctgaggcataaaaataatactagaatgttgaatacaatactaaagaaaagaggatatgatagcatattggcccaaaaaatgccattgagttaagggagttaatatttgcccttaccctgtttgctattgaccttacaaatttgagtgccaaggcaaaccctccccttgccccttcacctttcctgtgcccccaacccaacaacatcgggtgctgctcttgacactagatctgcgtgcgtgaccccttctaccaaggtcaaactaccaccgcactggtgcaaagtcacctctacaactccatccgcacccacacacacttccacctacccaaacaactcagccaaaccccacctgtgcgtgcactatgccaccaagctgcataccgcttgaaatatataaatatttagggtgctgttaacagtactgagtagcctgaattgaataaggtt

SEQ ID NO: 5731 - DNA, 1019 bp, Glycine max
  Soy_ogl_4613 Gm14:2786282..2787300 Cluster 26
taaaataattaatattactaaagatgaaaaaataattattgttatcaaactttggacattttgtatggaggtagatatatgaatatatatatgatagttttaactctttgatgggtagctagctagtgatgtttgaaactagctttggtggtttcttatataagaaagaagaggaagaagggtccgggcggtggtggcataaggaagtgacacgatggtagcagtatgtggcggatgcatttgctgctacatacaaaacatgtaggtgttggtcttcaaactaataaaatattaaataatctttaaactaatcaaattatataactagaagctaaataaagtattaaatatctatcaatttagttttaacttggagttgatatactttactaacattaaggaatgttttcaagaattttttaatacttgaggactatgtagcatgatctttaatattttaggaataacttatataatttcattagttgaagagttgagagagagggtgacgcttaaggaatcgaattgatcgtttatttattatatagttttaaactatcacaccaaaaaaaaaaaaaaatacgcgggccaaacttctaaaagagtccgttcgcttccattgaacaacaatgtggcaacgtagacctaagtggtcatattggatctttgggaaccatcacaagtgtggctggcctatatttatatttcaatctcaatcaatttctatgtgatatgtaattgaattttttaatttagaagaaagaattaataagactcatatccacgaactatgcaaagattagttggtatcataatacactttcttacacatggaattaaattaagaataattataaactacacatataaggactaagttagtagaatgcatttataattaagaatgaactatacgtataaagacaagaatgcttaaaagagttcaaatttaacgtatgatggtaggaaataaatcggttgcggttgctcatatagatatagtgactgatttaattaat

SEQ ID NO: 5732 - DNA, 1734 bp, Glycine max
  Soy_ogl_6647 Gm20:153167..154900 Cluster 26
agaaataaagaaaattaaaagaaagtgatcgaagccatgagtgttgacacaggatctgaatatattcttagtaaaaatcaagaggtctttacttgcgtatcctccttttgcttgttttggtcctgactcagactcacacattacacaacagacttcaatttgatcaggctcagctcattactttttcattcactcacaaacaggacacaacaaagccatacactcactcacacacacttcctaaattacattttcgcagagaaagaacttccattgtgaatgagactcaccctctcagtaaaatgaggctttgtattatatttagcaaaaagatacaaaaagttgcacatggtgtaccgtacactttctatgttggatgaactatatcaaagataatgggggcaattcacgcccacatgaaaaggatatttcagtaccttagaaaaaacttcaatataccaactccactcctaaaaatatccttttcacctcgacattcaagcttcaatataagctccgtttggctttttaatttccaaggcagctgttttaattttaccttaaacattctatgcgtattatattatctctattttatttattttccaaaaagttgagtgaggtttaattggatatgttttatgcgcagagaaggttggaaagtcaatttgcactattcgtgtgttcttcactgttaacattggtatatatggcttgcatgtatatctagtgtgtgtgcgtttgctgtatgtcatgtttgtaattttcattgtttacaattggtggggagttggatctgaaggcattttctttatatatgaagattgaaaaaggtagtggttggttcgagaaaactggatttcaacaattactgatctgttgttgaatcagaagagaaaatgctgtttacagtttgaggatgtagtgtctattttcacgagggtttcaaatagctaggttgtctatatggagcaaaattattattgtgaacattacagattcatttcagtaattacctctctacccttattctttttgtctttatttaaaattccgaaaggagtagctaggacattagccagattacaattgtttttttgttaaattgtgaggagggggagggaaaaaatatcactggttagttgggggaaaatttgttcaccaaaaaagcatagagattaggggtaaaaaatatttctttgtttaatagtgcactgcttgctaaatggaggtgaaacatgtttcatcatagaggagagttatgggagtgggtgcttaattcaaaatatttgagttgacaagggattagggagggagtggtgagatcacacgaatccttatttgcaaggttgtttttaaaacttatttgcaaggttgttcctcaatttggattctttttaaaacttatttttaaggttgttcctcaatttggaacagagaggggatgtggttggaaatatggggagttgggtgcaaggaagatggaattgagagtttagatagagaagataattgtttgagtggaaaagaagcttggtggaagagttttatcacgtaatgaaaaatgcatccattggagactttggagatgactattggttgtggttgaaggattcttcaactatgctcagtgtcaaatccgattattcagtcttgtacaattcaagttttggttctcatgaaattgatattcaaatgctggtgaaaaattaaaatttcaaaaaaggtatattt

SEQ ID NO: 5733 - DNA, 1060 bp, Glycine max
  Soy_ogl_1919 Gm06:13483701..13484760 Cluster 26
aatttataagagatgagaagtttaattttataatatttttaaaacaaaattaaatgcaacaattaattttttttatagctactaggtaggaaacggtcttctgtatatatatatataaaaaaaggtatgaaacagtcattttaaaagaagaagaagatgtgcaacaaccatttttaaaagaaaattgatgtgcaaggatcaattttttttaaaaaaattggatccctaaaccctatcctcctccccattttccttctaagctgtgccccccacactactcctccttcccctttctgttttctctcatgctcccccgccctccgccacgccacacaacctttcctccctccctttcgtgaaccccaccaccaccatctgcttcctctgtgaaccaaacccccaccctctcctccctccaacgtaatccctcacactctcctccctcccctttgcgaccaccatcttagttctcatcaacaatatgcaataatggatcttaagaaaatcaaatattgaaactaaggtctccttctaagaatctaagaatagtgttggagatactatgagtcattcaccctactgggccttacggacttcgatatttttcagctaccatcctacgctacgcctattacatgtgaactactaatatatcttagtttgagtaattcttagtttcgccgtataagctacataactgcttgagacaaatacatctttacacaatttttgtttagtgttgatatttcaatatttctccaccctgttttggggtaaattgggatgaaaaaaagggaaaatatagagaaaaaagtgacagataagtgatggaaaaaatagatagaaataagatagaaagtgatatatatccccccttcccctcttcttttttacggtatactcccttcttaagcattaaatttctacacttcaaaatagattgatttgtaattatcaattaaaggatatatctttctttttttactgcattaaaggatatattttctgagtgtaaaaaaaaataatctgagtataaattatttttcattttattacttaa

SEQ ID NO: 5734 - DNA, 1400 bp, Glycine max
  Soy_ogl_3718 Gm11:4046901..4048300 Cluster 26
gtggtggacaagattaatttttgatttaatgaatcaaagacactgctgtggactcaatgtcaaacaaatttcaagagcaaacatgttatgtatatatttccatttgtgcatatgctaatcggagatgcttacgagtttctattatgggaatgagaagacttctgctcagttttcttaccgattgttagcgccaaaagaaagaggttggtatcttgtcatgcacttatcttggtgagtggcaaaataaaaagcagagggagatgggaacctactttttccaaaagtggcaagatttttgtatggtgaataatgtatcacgaggtttattctcaatttggggttcgatgttgagtgtgatggactttgggggtgcactgtttttcttttatgggaacaagtttggtttccaaacgcaaacttattttaccaatttgtgaaatgcggtgtcggttgtcacgaccatattctttttgctaagctaagcgtaatgagtgtaaggttgaacaactcaattttattttctatgcctttagttaggactatgcatgcttccatggaagatagaaattggagtgagcataggttcaactgattttatacctaattgctgcaagtttgaggaacgcgtttgcagttataggtatagcctcagatgctgaataggtcgactgccaaaattagcaacgaagagaatcaggccctgaagtcagcctaggcccaaaccgcccgtgaagtcaaaacttgggttttccatcagcttcctaggcccattcagtgctctctctctctttacaaacacatgttgtgtttagacccaaaggaaatcaaattcacttgggtcaccagtgcagtggtcatgctatccagataatatgtttcgtagaacaatttcttgaaataaataattttaattaaacttttaatccttaagatattgtaattatacaattttagtttttttaagttcagattgtctaaattggttattccaagtaatgtaatttacaattttagtccctccataaattatttgctagacttttttttatatataaaaattttgttaatgtaacaaaaataaagaaacaataattaacgtgttatctaacatatatgttaacatattattgatactttaaagactacaagtataattaaaccatgtcaatttagtatcaataattaacgtgttatctaacatatatatcaacaatcatattattaatgtgtcatcatctccttataaaaaaatatattataatctaatatcacgtcaataaaatatattaaatacttaatggaaaaattaatgaaatggtgaaaattacacaattatgatatttgtaagatccatttcatggaaattgaaacccagaaaaccaaaaatgcacaactataat

SEQ ID NO: 5735 - DNA, 1194 bp, Glycine max
  Soy_ogl_3996 Gm12:4534601..4535794 Cluster 26
caaacctctatatataaacctaccatcataatcttaaaagaaaaaataaatctcttatttataaaatatatctttaattctaaacaacatcttaaaaataaaataatattattttttaaatctaaaaaatatcctagagatttaaaattacaaatttgaattgttttccaacaacattaagtgatcaattatattgatttaaaaaaaaacataatggacacgaaatagggttaaatgctattgacaatacttaaaatcagttttaagtcgataccagtcaaataagtagcatatttataacttaaagttttgtattgtcaaagttatttccaaatgaaaatttatctgcagtctgcagatgagctggataccccacaaaatacattagtctaggcaaaccagataccacagcatggcgatagtgattaattgcctccgacaaaattagtgttcgtttgtttaaaaaattaaacaaaaataattttaataaatatagtagtaaaacgtgtcttaattaaactcaaatacggaatttgcattgaaacacaggaaatgattttagaagaaaaaacaaacatgcacatgtgtagtgtaactttgtttatttcatcaatagtaaaccagagtagcttttgatctatcaagttctcgaggaattgaaagattatgtctggcaaaaatattcacgagacttcataataacaataatttttcatagactacaagaattgaaagaaaatgccagctccatttaagcaattcatgtcatgcatatttcacaatacgagcaacatccaacagattagtcggcaaacatgcaaacaatcacggggaaaagctttcaggtccaggcaaacttggcaatggtacttaaataagaaagcatcttagctagctacatcaaaagccattggcccattgttaattgaaaaataaataaaaattgtgcaaccaaacatgcagtttataagatccagagaagatatcattttaagcattctaagaaattcaaacttagttttttagtggtggaattaagtcagagagagaaggctaggagaatctggcatttgtcagcatgcgtatctgactattatagtttatatatatgtagcagcaacagataataaatatgaagttctctgatcagtggaaaaaactaccagcaaattctagaaatgctgagaggaaatc

SEQ ID NO: 5736 - DNA, 1300 bp, Glycine max
  Soy_ogl_951 Gm03:38925401..38926700 Cluster 26
ttccatcgataactgcttttgctgttgtttttgtttttcacggttactgaattttcatttctgtttgccctacgctttttttttcttgcagaggatcacgcctacaccatggtgacatgcggtgctattccttctctggggaggtatcttcaagtgccagacactaagagagatgacgtaatcgccgaagaattttaccagctagcatagggtgaagggagggtgtgcgttcgtccttgggcttcttgccttacaagtatctaagttctattgttttctttctttctagatatcttaattacatgaaattgtaattacagtgttggctttagacttatcaatccatagataattgcacatgtttccgtagctgtttaaacttacatgcaaatcagaaaactctaactataaaattaaaaaccctaaataaatattaggaactaacaaggttttaaaaaacgatctgcaaccacaatttgaatcacaacataattgttttaattgactgtgatatcaacaaaaacgacaaaatcataaacaaccatgacgaatatttaaaactttgggaactaataaccggatctattaccccaatacaaaagtgcgtatggaagaaagcatatttcattgaactagaatatgggtaacaaaattgagtttgggagtgaaagtaccattgtcggataattgtggacacttaaaaagtattacgtgcataggtgcaggtatgtgcttttttatcgcctgtgagtatcctaaccatattgtcatcccccgtttgttgctagttgtggaaatcattgattatataacgtttgcttatgttcatgattttctctagtgtttatcctaaaattttcttagggctgatttgaattggaacttatagtgattaatgaagtattttgtcaggtgttttttcaaaatatgagattgattatgctacgtgatttttggccggggcttgttattagggtggcggtggatacgattttatgaaaatgaatagagctttgattctttggctacaatagcttcatagaaattgagattttggaattatttaatctgtattctataaaatgatttgcatttggataattccatgcttgtttgttagtatttttagttattgggtgcttatttgtggaatagaatcttctcttgttttagttattgatatatatcacaaactaaaacaaaaagaacccaaatatgtattttagcctttattcaatagaaaaatataatatggaaattaagtgtttgaaaaggggtaattttggacaaaaaatacaaa

SEQ ID NO: 5737 - DNA, 1175 bp, Glycine max
  Soy_ogl_1465 Gm04:47316901..47318075 Cluster 26
cccagttaacatgcacaaatgctaaatgcatcatttttcacacgagtgatgctatttgatgcgaaaagttcctagtgaatcattaagaaacggtgtaatttacttgaaacgagagaaagacaagatagttatagtggaactggccaactaacgtacctggaacaagaaagcaagcccggcactactctatggtttcaactcaccatgcactctatgagtgacggagatatatataaaggaaagttcaatgaccaagtacgacgacaccttccaaaattataaaccaaattttgaaagttgcccaataactgggacaaatatgaattctgaattcaacgagcaattaacaattgaggaagcgaaggaaataaggaattcatcaactcaagtgttctcttcacggcctaattaggatattatatttatatttttccttttttatctttttctttctcttggtatagatgagaattaggccaagttttaattataaattttggtatgttaggaaattagagttaaaaagaatccaagtgtttagataattaatagaacttgtgaattttaaaacactgaatactacttagtagtggaatctacttgtccactatttacatcaacaaataatttaaaaaaacaacaaatcaaaatttttggtaagaaatatttttaatcgattgtcttttgccattttgaattcataaacacaatcagccaccagcatgaaatgtaatcgtatctcatatcaatgaacacaggtcgaatccaggaacattaacaatttatcatcactcaatacataccattaacatataaccatgttcttattcttaaattggggtagtttctatcccgtgttgttcaatgtatcatatcattgttgagcattattaattaaggcgaatcgggtccaagataattttatcttgtgatagtgacttgtattgaaattggaagtaatcccggtatttgatgcttctgaacaatggtttttcattctgcaatagctccagcacaggtccaatttccttgtctagcacaggtccattcgccaacacaacactcatccttgtgtctgcgttgttcaggattgctcggtgcaacaccctcgcgtacctaccgttactcgcaaccttgtgtaattgcattagatcaaaccaaggttaattagtgaa

SEQ ID NO: 5738 - DNA, 1500 bp, Glycine max
  Soy_ogl_2960 Gm09:3114301..3115800 Cluster 26
tttcttgaaatataataatttatattaatcacttattataactattagatttcaagaagtgaatgacaagatagaaattatctttcttagtctatttcttatatatttatgtatctatctatatttagtatgaaagaatgacttttctggtgaactagtaagttttgataattcagtaagtgcactaactaattaaaaagatagttaaagctagcaagcctcctaaaaaagcgttaataaagataagtgatatttttaatttacagttaacaatcatagagaaagcatgcattatttgctcaagaagcttttgctaagaaaagggtgtataattaccttattctgttattcactacatacaattaatctcaattctaaaaccatattctactaaatcccccgagcagaataggcgtcaaaccaaatatatattaggccgtcctgaaatataaaagtgttgatgacgtataatagaaccgttaccattgccaataagggaagtgtacttttggtcgcagctaatgttaaaagaaaaaggattagcatttgcaggaatatccttgtgttggtagggaagctgatcgagtgcacaatcagaagtacttgtattaggccaccacccttttacttggacatcatcaaacattgacaacaattcacgtttgggatgcttacaaggcttctccaacctccatcaccgctatcactacgaatctttgccacaacagagacaccatgagagcaacacgcggcaacaaaaatagtgcttcacagtgatcatgataggaagctctttgtcgtcatcacgtctccttgcccttaaaatgacaataagaccattttgatcgtcagtgtcacgaccatacaagaaggaggaggacttgatgagaaccccaccaccttgcggaatagggtttttgcgctggggaagacgcagcatagttcttggtccgtttacattgatttttcctaaaagaattgtgatggttaactcttgttcgtggttgtaattattgccacaggttttctttccaaatgagtagtactcggtactccaagtgtccacaacttcacgccctttcccccatcttggttttgcgtggggcaaccacggaagaatggatgtttcccatgatggatggaactggaacctttgtgtctacactcttgttgtcactcaaaaattaatcacagttaatggtgaataatggaacaatgagactcacatgtattcccaagatatgcactaattaattatacaacgccaggaataaacaaatcattgtgtttaattagaaggaagagcgttcatcttccgcaatggttacttttggataaaggttgtttgactaacccttgagggaaatggagaatgtttacttttttaagaggggaatggagaatgttattctctggcatgtggttcgtttaattcttaacatgcacttgtataatgcaaagaatatatcattgcctctaaaccaaagcatcatccttccc

SEQ ID NO: 5739 - DNA, 1280 bp, Glycine max
  Soy_ogl_5002 Gm15:11620021..11621300 Cluster 26
catattaaataaatttgcatttcaaattgaagtgttggctcgtgatgagctcacaaaatgaaaaaagaaataacgggatgaaatgtaattttgggatataggcaatacatgaaatccattccaattatagaccattagagctttagctcaacattcatttatatatttctagtacaacttaacatatagtatatccgatttcccagcatatgccaaatacataaattttaatcagtctaatggctacggtagtagttccttttttagtagtgaaagccaccctcgatgtgtcccctgttgccactaccatgggcaaaataaagcatccaaagatcaaggaggagaagaagaaaatcgatgaagggttggttgctgcaacctcttcgaaggtcgaacctcttcctccatctctatgtggcccctttttcttagtcttgtcggcgggagggacaatatccctaggaaaagggcacggtggtgggaaaggatcagtgggccaagcctctaaggcgttcccagcagtgaggccaacttcttggcacatattggcaaaatcaagagcgtccataccaaatgataggagcatagctacaaataaggaaacaaactaagcaaggtcgttttgttaacttggtatgataaagggaaaagaaaacatacctcttaagtccttaaaaagatccaagaacttgaaaagtgaaacgaggggcttagccagcagcctccaaggtagcttactcaaaagggtcgggttgtgtcgttcctgaatagttaaatattccttagggtagttatcatgcctccttggcacctactaccagtaaaagggaaataagggtattttattcatgttataaaagtgacgattacccaagtcaggaaggataatcaccttgaaaaacccaactttaaaattcttatatgaagaagtaaacggtctaaccaaatgccgactatcaaagacatccatcgtgccttatccatcggactggtcataaaatggtgaaggaatagcctaatctttggttccatgcgaaagaatctacatagtactggaacgcttgcatagtcgcccacccatttgagtccaaatgtgaaggagccacgttcaatattcagaggacactcatagtgaaatcatcaaaagggagctccatgttaagatcgcaaaagatgccatcataaatgtagaaaaagtcccttgtaggtggcatgtcagcaaccaactccttccctaagaacacccaatccagcctcttgtaagcatccatctgaaagca

SEQ ID NO: 5740 - DNA, 1327 bp, Glycine max
  Soy_ogl_5387 Gm16:31151774..31153100 Cluster 26
caacacacattaaaattctttttatatatattttagttaggattcggatggagtaattgagtttacgaggtagcattgtttcatttaacgcaaatcattatagagtatatttttaggtttatgggggggcttttgataaggcaagatgggaagacataattcttcttaatcataaattatgggtattatgattttaaataatgatcaaaatatatttagttacttgcaaatatttttgaagatatttacacatatttttgaaaattaaaaatcttatatttttaaaactttattattcaaaattttaaatatatttcattttttatacagaaagctttattatttaaaacaaattttattatttttgaaacaagaaaaaaaaaataccaaaatgtttttcttaacttgataaagatgttaccttgcctacggttgcatctatagtgaagaagggcataagtgatccaccatgaacctataattttacctactataggaggtaagtgcacatttaattcgagaaaagatcactaagagttgcttatttataataaacgtaaaaataacagggaaaataaacttcctagtgtcttctgagaaattaagaactgtctttcaacaatcaaaaacagatcgtcaattcttaaaattaaagttacccttagatgtctatcagcaccaaacatcctttttttcactcaaaaactatttcctaaaaaataaaaatatattaaattgagtttcaatacttaaaaaaattctactcaacgacttcaacaacgacctaaaacatatttaacacaaacttttatactattgaaattaatctcaaacaaaaaccatattattaagaatatatttaattgggcacaagttttgtggaagcaaaaacacttgaatcacaacgaagtgccggtgccgtcaactgtttcccattgaatcatagaacgccacatagctactgagtgaccgacttcacattgtaacgtccccacacttcagctatagattcagaaaatgttcatcaaaatccaaagccatcgttccgtgcttcactttcactgtgtgtcactattgtcgtgtccaccaaattcttgtcggtgacttctttattgactcgctgccataattttcagaactgtttttcactttttgatttctcatttcattttcatcacctttttcatgccagctttttactattaccacgttttattatgcctcacagttaagtttgtatcgtttcgtccctgtcaaagtggcaacatattattgagattttgtttaatttcttttgttgtttcttgtgtgtgaggctttgcgctga

SEQ ID NO: 5741 - DNA, 1000 bp, Glycine max
  Soy_ogl_6219 Gm18:56934101..56935100 Cluster 26
tattttgttatattttactcattttattttattagaatatctctatttatctatttggtgttcttatatcttatattttaaacatcaattaagttaaaatatgatatcaaagtgtatgctcgatgtgcataatattttaaacatcaactgtgtccaagtgtggatgttcgtgtgttcttgttggtgtcagagtttgtgtttaatgtgcactaacacctcacgaaaataagctcaagagtcaacaagggacgaattttgggtaaattttgtagcacgggaaaaattgcccacttgcttgttttcttcacacaagagaagcgattattttgtctttcttctctgaggaatcctctcttatgcaaatgggtgatcgatcataacatttcctctctttttttaacaaacatagcctgcatgtttatgaatgcgtatatataaaccactactctagagcacaaattataatggctactatttcttgtagaccactttcgtttctttgttgcttgtatcgaataatagtaatatgtgaagccagcttcggaccaagttatgaatactccaaatactgtaataacagtaatggaaactacacagccaattgcatctaccacaccaacctcaacaccctcacttccaacacagtaatctactggctgcttctgtttcgtatcccttagatcaagttctaatgttagatttgatatctaccccttctacaatgaacctacgccaatatcatcattatcagacccagtcgcagtcccagatgtaccacggtcaacaccggtatcactctccccacaaggtacttttcattatactaccactacttcattgataattgtatttaataattcaagttaaggtacataaacatgttaatttttaattttttaattaattaaaaaatttatttgactcatgaataaataagttttttatttaataatttttactgtttttagaaacaacagttgaagttgtatttttttaaatg

SEQ ID NO: 5742 - DNA, 1110 bp, Glycine max
  Soy_ogl_6543 Gm19:43909891..43911000 Cluster 26
aaaaaaaacaaagtttgtgcagaccgccactaataaaaagacagatcattagagttcactatgtcgttgacttgaattcccatgccacacgtcagaacacaatctcatggtaagatgcaagggtcatatatagtgcttcaccatgtgatccatacttcttgtctcttataattttacctcaataatgttcccaccctttatttttaagttcacacttctttttacaaaacaagctttatgcttcttggacttctatatattttctcatttgttcatgattcgtggcccataattaagaggattaattctaagtactcttctaaactaggatataatgtattggttattttcaaacatgacagaccacataaattttacgtgaggatattattattatagttgtttagatcgttacaagctcttaattaggccaaccatgcataggtaggttttagactcaaagttgaatatttaacacttcggccgaccttaagttaaccatagaccaagttgtgtacgggtcgaccttgtattaggctaacctatggatcaattttgtatcctttcgacattaagctaatctatgggttgactttatacccttaagtagaaccctaattttttagcggataaaagctcaagcatattccgccataattctcgatcggttaagggatgacttggaagttggaatgttcacttgaaaaagaagcactagtatgcaggaaaatattttagaattggaacatctcagaaccgataggaatcggataaattggatctcatgtatatttttttgtgtgaattggagggaaaacacccaaacaaggtagcactaaaaatcgcgaggaaagatagagcttacatgcgttaaaaaatagggttacataaaaaatctagggaaaaactcataattaaccattcaagatcaaaccatgattaaccagaggtatgtgaccagatgaaaacaccaccattgaggccaaactccctaatgcaatttggaagcaagggtgagaagcttaaggcagagatccatattattcaacagattaatcgaaatctgtgaatccgaattaaattccgtaaagccacgactacttcatgcta

SEQ ID NO: 5743 - DNA, 1300 bp, Glycine max
  Soy_ogl_6644 Gm19:50200401..50201700 Cluster 26
tctatatatcattaatcgttgttataatcacaaaagccatagatgccaatgcatgcacgtgctacgttgttgcctgctagctcctctcttgataaaagtaaccccagcagtttacaatcttgaaggattccgtgaaagtagctactactactgttgagtttttgtctcttccacctttggtataaaaaggtatatatgctgatagctacataaccatctaaaggaaatggcctcatcagctagaaggccaggcctgaagataagttatagcagctgccaatacttttccctcgatctgttcatgaccacgtacagaagcatcaaagtttgcttttatatatgtgttggttaatttgtagggggctgcaactgcaagtatgggcttgcttgcctctatggtctacgttgtgtcaactgtaggtcttagtagtgcagcaactttagcaattgtttgtataaagtccaacttactttgatgaaaattaagtccactggttccgactgaaccaaatgccccccaccatgttgaaaatgtcagctacttgatatggcaaaagaaagaaacttgtaaactaaactcgttgagcctgatctagccatgtgactgcgtgactaatgtatgtttcactgttccttcatctaaaccacaacaagggcaaattaaccggctccactgctacatgctatgctaggagtagtgtgtttcatgcttgctctcctaatcagatttctagatttcggtgtagttggcagctccatttttttccataagctatcagttgggttgcgtacgttttcaagttgaatcaagagctaacttgcaatttcgtaaccggacttgactgtataattgtcgtcaacagtttgtaagagatttaaatccgatcaatcgctgcaactatttgtgaaaagagctcatttattatcgttaacatttaatataatataactttttatatatcgttaaattaattgcatattattctcattatacttaataaatacattaacatattatggaacttaaactctccaaccaactatactaatactgtccagactccagatgcaagtacatggctaataaagtctcacttgtctatattatggggcgctacagtagaaaataactttgtcttctagaacgaaaaaataccctaaattcaccccaaaaaaaattaactttttttatatctttttataattctctcgttgtcttgttgaatggtatcgttataggataaagtttaatttaaaagcattctatgaatcccatttgcctaattattcattcttttct

SEQ ID NO: 5744 - DNA, 1604 bp, Glycine max
  Soy_ogl_6933 Gm20:42355301..42356904 Cluster 26
ataaattctagaaagtgatacatattaaaaaaataatcataattagtacatatataaattagtgttcctttctttgttcaatccttgtaagctcaaagaaacttacaattaatatataaattctagaaagtgatacatattaaaaaataatcataagcagtttttattattatattttaattaattctaatctagactaggaccgagcccaatatatagggacctaattggttatctacatttgaatattcatttcacagcaaaactgttgttctatttaactactatattgttaattttcagagcaactaaatgcatggatcattactttttccataagcaattagtgttatttttctcagaagtaccgaaatattacatgctgttcacttgtgcttttacaagaaatcaactacaaaagcaattgaagatcagaagaatagtgttgagtagcttggtgtcgtgtgatacaagatgatttgacgaatattacggtgtcttactcttacaagtaaaagattatgttgcttaatcaatgtaaatggtaatcgtagtattcaaaatgttattaccactgtgtcagagtcaaagactctacatgaactttttatttacttatttttgtgttatcagctcagatatcagaattaggcccatgacaagtgattaatgcaatagtaaaagaagaataataaaatctggaaatatggtatagtggataggacattcagtagctattcgatcttataagagacaaagcaatatataagataggtattaagttaaggtagtcgagtatctatttagactcgcacgaggaaatgattgcatttattaataatcacgagactagtctacctaatcctgcttagagaatggattacttcaacggtaatcagtgcacatgcacgagtccaaggcctaataaggtgggtataaacggataaaaatcattgctcattgaatgcatatttgttatccgcatttactgctctaaattaaacccttatttgaacgtcgaagtattttttgtaagtatcccttataaatcactcctctcaaacgaagtgaagaaggaaaaggaacagcaaggacccttcacgcaagaagcagtattcagtcatattgtgacaagaacattttttgtgcccactaggccgtgtaatatagtccctgaccttaaggattatggcaattacatggactgaaacaaacacaacaacaacaaaacaacctgggaatcaacatcataaagaagtgcgcatggaggaccagaccaacctatcctcaatggtgaggaggttgcaggcgcaagtgtcagatatgtgtcgacatctcgccgaagaaaccatggtccttcaaaaggagaatgcacaactacgagaggtaatcggtcctaacgacgtgaaaatgaaatacccattggagcgtaggcgaagtcaacaaccgttaagatgtcaaaggccaccaatgttagtgctcaacaagacatacaccccgagtctgtaaacacgttgcagttagagcagtacaagaatccttttgtccccgacatcatggagactacccatccttccaactggaagaacttgaatattgaaaag

SEQ ID NO: 5745 - DNA, 1600 bp, Glycine max
  Soy_ogl_5 Gm04:1703001..1704600 Cluster 26
aaggtcgcttatattgtcaccacatcaaactattttgtatggtccaacagctcacaattgatctttattgacgatatataaaaaaaataaaatcgacctttatctgcccaaaagtaggaggctaattaaacactgtaaacagtcggtaactagacgccaatgccaatcgggccattgcttcctgcaccctaggaaattaaaaacaagttgaagggacaaaagtaccccttttgccttttttactgactgacgagggtattcaacaatgtttgttaatgcttcggattggtcttggatttacatgattattttcttgaatcatgaacaactcatcctttttgtgcgccactcatattgagcttattacaaattatggcatacacatgattcttcgatctcttgaatcatgaacaactcgatcggtcttgcattgcaaagcaacaaaactctagtttgtggcataagctgtgctacaacaacctagcaaaacaacataggtttagactaaagtgaatcagttgatcactagaagaaaaattaaatggtaacataaaaattaatcaaactactttttgcagaaatgcactaacttttgatattacttttcaagctttctgtttgaaaaattagaagactcatccaacacatttctcttacaaaatacttgaatgaaaatatattttcaagtaaatccacatagtaatctttaataagaagtaaaatttatataaatctataattttcaataaattttaattaataataacaaaatatattaaaaaaatatgtcatcagtagtatatattaccaacctattttctaacacatttttttataaaaatatatttctctgacttttatagacccatatatgtgatgattttgaaagaagaattagaggcaatcagatatatataaagtagctaatgccgtcacagaagtgatctatctgtttctaactttagaccggtcagttgtttgcacaggagaagatcaatccctgggttgagaaagaacaacgagttttacataacgttgcatgaataatcggtccagcttaaattgtggaaaatgacttgctctcagcagcagctggatgttcaccttcattgttaagtgttaacggtgtaccaactgatattatagctagcgtgtccaaaaaagttgggattttaattttattttcatcacataagcttcgtaaacaaataaatgtgctctctctccttacatgccctcttatcgtcatcattattatgatggaattctctcaacagtcgaaatattgattctccaacgccattgagatttgatattgcactcaattaggacattttgttccctattaattaatctgaatcacttatcatcactaccatagatcgcctatgcggttgtgcatacttatcgcaagatcaaatgtggaaaatggaaaatagtggcgcactagaacaattctgatcgatgactcacgcaaaaggatagaagagacagataacaaaaccaaaaaaatataaattgggaatatgcatccaactccatcacttgagatttgagaaaacaaactaataacaccttcagctcctctttatggagaaaa

SEQ ID NO: 5746 - DNA, 1200 bp, Glycine max
  Soy_ogl_2508 Gm08:4856201..4857400 Cluster 26
aagaaaccttcgcgatctaatgccaacaaataatgtacacctgctagcaatcacaccttttataaatcaggtgaccactcaaaaaaaaaaaaaaactgctagttcagttgacttgaatctaaaaaagccaaggggaattaaaccaacatgatatatatgtgtgaagacaaaagacttcaataataaaaagaacttttcatgaaaataatgaacgtgctgctggtaattaattaaaatctttcattccccgggcttcctcatgtttaatttgtcaaactctataatcgtcgttaaagtgtattctttaatcaattcaaaggattaaaacttatagaaatacttctgacgctcagtgaaaagccaaagatgttaattaactaccattaagtctactcttctcttcaataatcaataaaaagaagaagaaaacattgaattttgagtgagaaggatttagaaagtcaaaaacagttgcgtgctatagcaagggacatgtgaatcaatccaattttgcctccgctgtgtttgaagttgaatgtacatgtgccaaggcaaaaatgactcttcaatggtatgaaggccactcactacaagaaaatactgttcatttctaacaactagtaaatgcatggtcatatgtggcccagggaacgtgagaaagggacatttgacccaatataatgtgttttgcttagtgacgttgcaatgcaatggagcaagcagtgatacatatatcaaaatccattttctccgtgatatagttaacgataaactaaaatatggatttcctttcattcgaaacttgtacgtatcatgtaataatttttatgaacaatgacttctttcgcaatagattaatagtgaatgcgttgccaccctaataattagccatttactattaatttatatactccactgaaaagggagtagaaaagctattaagttttgtttcttattattacatcatcaacatattttaatccaagatatattgttcaatagtgaatcaacttatcgatcgataataactccattttggttttcaattttttttccagtgcgcttattttaacagcaatttgattgtcaattagttgtcgcaaatcactaatcaccgacaatttttttgcaaatatcaacggctgaatattgtaaagtttcttgtaatgtatttttttttaaaaaaagtagttataaaaa

SEQ ID NO: 5747 - DNA, 1000 bp, Glycine max
  Soy_ogl_2647 Gm08:13095301..13096300 Cluster 26
gcttaaactagaataacagcgtcaatttattcatacgctcaatggttgcactaacacgaacacctattagaaaaatatctattaattcaagataatgagaaatttatacacaaacagatttcttcaagataatagcattaatagcataggtactagccatgaagaaacaaacaaaccattttagtctgagctttgctgtaaaactaattaattcataccatacactagtcattattgtaattgaaacaactgatacacaattggaaatagaaatagatgaagttaactatgagtttgaccgagagaaatcattgctaatttgtaccatagcactgttccgcctttcaaattgttggggtgatgttcaagtactaagacaacacttggataattgttgctgaagtcaggaaagttctcataataaccatgtatctgtcgagtgaagaagatcggctaagttttaattatacaaagaaccttcactctcttcaatatatctgaataggatttcacttagtattgtcagtgtcatgacttacattatttttcagtataacattatcattcgagagcaggaatcgaccacccaacagcaactgaggtcgagcttcagtctcaacattagctagaggagaaattcttgtagcactgagagaaaatggtggagtttgtagtgtctgcacactcatgggcataaagttttgagccagcagattaggcctctcattgaaatatagaccatgaagttgtggagccattgtgttcgagttggcgtttattacttccctatgagcaatagccgagggttgaactgaattaaaacctcttgaggaagatccttgatggtaaggacgaaatgcacaacttgaggaggggatgaaccttcccaagttgaggccttcttcattccccacaccaacatggaatggaggaatgccaagtctagggataggtttccttgggccttctgtaccaatactttctggtctggatgtagaac

SEQ ID NO: 5748 - DNA, 1020 bp, Glycine max
  Soy_ogl_3337 Gm10:3041801..3042820 Cluster 26
ggagtgagagaaaggaatgattctaatgaaagagagggagaatgttttgttgtcatacaaagagtgcattgttggggggagtgtgcgatcatgtgagggaaagaagagagtttgagataagaaggctatttaagtcatttgggtttaaaaaagaataaggggagtgtacttagaaactaagggagttagatataacaaatgtcaatataaattaagctcttttttttttcttatctaaggcctaattgaatttttaaacaagctgtggacttgtgttggtccaattccagtgaaacaacaaaaacgaaagacaacaaagttattgggtcaatattggcccaatttaacttgattattaaatatacatctctttactttctttttttgttttcaaatgtaaaataaaataaattggaagaattgggtgttcagtgttcactgtcatgatcaaataataaaagagtacttgtaatgataaataaatataaacagaaattttagcttatagaactgattcatccttgtatatacagtgtgcaatttaattatcatatgtaacccaacttctagatgtactttaacttaaatcatgaaattgttttatgatttccctgaagctattaaaatattattggtgaaatccataatattttgatctgtaaaaactaattaactaaacatgcatcatatatataactaattttaagaacgtgaaaattacaaatttggatcatacaaatattgaaacaacattaagatctgctcaagttcttgaaacaaaattatcaaaatccttatgttgtagcaaaaaattactgaaatggggtcctcaatttaactcatcaaccttaagagtttggagacaatgatcagccacatcctttttgcacacccattgatctttcaagttctacaacttgactcattcacctgaaatagtaaactagcccagaccatacaggatctatgaattgggcttaaaccatatgtgaacctcttgcccaacactaggagggctgt

SEQ ID NO: 5749 - DNA, 1400 bp, Glycine max
  Soy_ogl_5588 Gm17:8395501..8396900 Cluster 26
tgcagtgggtatgtacctcctgagtatgtgagaaaaggcatatactcaacgaagtatgatgtttatagttttggagttcttctcttgcaaatcataagcggaaagaggacttcatgttattatggcacgcatgaaaatatgacacttttggaatatttaagttatcttatcacatattttttatatgactattctatccattgtatgatttattggtgctgaaattagtcacgtgggttattatttcaggcatatgagctgtggagggaaggtagatgtgtggagtttgttgacccttcattggatgatacaacctcgccttttaaaatcatgagatgcatggaggtggctctgctgatagaccttccatgttggaagttgattcactgctgaagaatgaaggtgcagccattggtactcccaaaaggcctgcgttttcagttaataaacgtgaagtgggatcaaactttattcaatcaatgatgttacaattccaatacttaactatcaataaagtcatttcaggtttataaggattcctggcgtgggttaactactattattagagaatgtaactaacagttacaatactaaaattaatgcattagtgactaaatttagccacaaattgttttttcgttactaattctgaagtcataaaagttagtgacgattttttaataattatgtttcgtcataatttggtgactaaaggaccataactcatcacatcactatgtgactagaattataaaatataatccatttcaggatgatgttgaaatttaataatccctaaaccaacagaaacttgtaaaattgtaaatacaatttttggcataataaatttctacgttttctctgcatacatgttttcaattttatttttttgaatgtgtgttcgtctatataatgtgttcgtctttcaaacccttccctttgaaaggcacctcaaaacatggattatcaccaaaatttacctactaaacgttgacttaagtgatgacatataaaaaaaattaaaacaacatatcgatctctaatagattttacatccaaaatatcaagaaaaatctctatttaaaaaaaaaataagtttgttaaatctaatctaaacacaaattcggtagtcactatgaactcaaaaacttgtaaacatgtaaaaacacactagggtagggtcaactaagtgttgggaggttagaagcaatatgtatgaggctataggctcaaacatcatattgatcactattacgccaaaaaaagaatttgacatgtttgttggaaacacattttaaatccacatcaagacaacaaagtcacgtcaaactagatgaataatgccaaagttacactttgttgcttcacataacgtgacttattttttttcaaatatgcac

SEQ ID NO: 5750 - DNA, 1138 bp, Glycine max
  Soy_ogl_6539 Gm19:43814901..43816038 Cluster 26
tcttgtacctcttgtttggttggggtaaaataagtgataaaggaagagaagaggaggaaagagatgagaaaatatgtttatttgggtggtttggttggttagaattggaaggaagatttcaaaagaaaattgtggggcttactgtttaaatgtctctcgatcaagtgggtggaatagcaaagaattaaacattgttcacttttttttcccgtctagcccttcctcacaccttgtgtaactcgtgggtgtttttttgtttttaatcagcatgtaacttgtgggtgttgttccagctgcaagtggagactccttccttgctcctcctagtcttctaggaggtgctgcaagatgtgttgctaacagagatcatgttgggggtaatgggagtcgaaaaacaaatttcaatagtgttatttaaaaaaaatacaatacattaaatttattttcattgtgtatggtaaaagaataccctcactcctttcacaacacataatggaaataagttttctttgtgtactatggaaagagatatctcccatttcaactttattaataatataaacttgtttttgttgggtatggtaatacaatatacaatgaacataggtttttttttatgtatttcgaagtgacacccctcaccttcaattactacgcaacgaaaactagtttatatggtatatcgtatcatacaaacatgtttttcatgaaatatatttttataaaaaaaatacaaaaaagattaggataaagagaaaagggtatgagaataacatgggcctcaatttaattacagccctgagccactaatgatgggcttcaattttactcatagtgggccaaagttttgtgcgcatcaaagcttcttttccgttgtcccttgtgcggcttttgtttcctttggtctcactattgcatccttgtacctcccaatacaattgcatttcataatgagattttcggaatgtaatggaagatacaataccgggattgcaggatgtaatagcccccttgtgctctttattgtatgttgacattgagctagcttctgggcttgcaccaattttgttaattgattcgtatcacgggctctctgtggaataaaaaaaacatataattgatctgcttttttttatcc

SEQ ID NO: 5751 - DNA, 1595 bp, Glycine max
  Soy_ogl_6564 Gm19:44553006..44554600 Cluster 26
aaagaaagtattgaatcttgaatatttaagtacaataaatattaaaaaagaaagtattgtcacttataatagttgtacatgcattgagcataattgcttctgatgagaatatttgtgatctaccccaaaaacaaacttctcgcacctaggactttcaaatccttagaaattccaaaaccctcagttatctgtaaggttaatccaaaaggaaaatcatttaacacagcaaaaccatttcatcaaaagatcgattcagaaacgcacctgagttgggcatttccttttattattcgatcaaattttaaatatttgtagtcatgcaactgcgcaacacaagatttaacccaaaaacaaaacatatcagtaaagagctgagaaaacgagtacaatatttgcttgtgaattgttataaaggtaagtggaaatttaaatagtcaaacatcagctctgcttcttaatattgcccttaaaaagaaggtacacctaaatttcccaagcacactcttcaaaaattgtgtcaatacctgatggaaagcacaacaatatcaggtaaggaaaatctactataggatcacaattaatttcagaatgaacagaccatccaaagcaagtgttagtagagtttgttttcctgtttctgtatccatctcatctgacaaaggtataaaacatggaaatgacaaacacaaacggtgattacataaaaactaaagagcacgcataccaactaccaaaaattgaacgaaaaaaaaaatcctaatgtgtgtgtggttatttcagaatgccgcttctcttgcgctctctcaaatctcactggttttatatcccaaccatgggtgtgttcataactgcagacacgtcgaccaagcctcttggaaaatcgtccaaggtgaagcctaaaggagagagtataaatatcatcaggaaaagggaagctgacctccccatccactttaaaccaccatatttgctgcaaatatgctacagtgttgaacctgaaatgaacaaataataaagtgtaatgcaatactcagaaaaacgagttgagcgattaaacaaagcagtttcagcatcaagcttaagggtgctacaatttgcaaaaagaagcacaagtagcatataagcagaaagttggcataattactatttaagtatgaaaagtcattgagaattacaggtgtccaactattcataaactaatactagagtctgcaaaccaaccaaaaccacctatttatattttactcatagaagatagaatgggacagttagtaatcaggttgattagttcatggatcagtagggctcaagactacaaaatgagagcaacccatcaaaactgaaccaaatggccaatagttgaaagtcaaaacatcattccaaggcacaagcaattgagagggaatcacactcctctcctctaagagattaatgtgttatatttagcctatttaaatgtaaagaagcctttaaacaatttttttccctctccatgactctcaacataattgacaggtacttttgaatcctttactatcaactttggcattttagaaaatggtgatttttgggtaaagttccaaaataatagtaag

SEQ ID NO: 5752 - DNA, 1203 bp, Glycine max
  Soy_ogl_6661 Gm20:920782..921984 Cluster 26
gcttgtcatgatcaaccgaattatgggagcaattaaggcgatatgctatccgagatagcaacaacttggtgcaaaatctttgaatagaaattcgacaaagaagaggtcttattcttgatgacaaattaatttgtataaattatctagaataacaccaaaaattaagggatttgaatttctcaaaagccatgatctgaaatccaaattaagagcatccaaatgattgttaaggggaaacaatgagaccatacatttttcccaagctcacataaatgaaaaacatgatcaatatttttaggactacccaaacataaaggacaacttgcattatcaagcatcccccttattctcatagcattggtaacaagagaatcttttgcccctttccaaagaaaaaatctaactctttttggacccttccacctccttataactttgaataaaggttcacctaggagatacgctcaaaaatcaaactgttacaagcttttgcaataaaaaacaaaccatatgaagtatcaacccaaacaattctatcacctactcgaacagggtctgcagttggaatggaacaaataaactcacaagtgaggctaggaagataccttgtacattagctggagattctaggcaccagaattagtaacaaagtaactaactgattcagcttcaaggtcactaagaacaacacatgtcgatttgtgcgccaaaggatcttgagaaggaacccaaagttggttccaaaagttgacagaattcccatcaccaattcgccactccaggtttgcagtaacattttcccaattgtgacaaattcccctccaagtatttgacccaggctgaaggacattaacattaggcacaatagaatcaccacacttatattttttcctaaggatttgcacccataaagaatttcttttgccacacaaggaccaacctaatttcaccataaatgtaacattgaaatctctgaagtccaaatagggagcaacattcctactctatagtcaaaatggcaaaatccaagatgaggtgaattggatcttcagagtttttcaagcccatcaaatacttttttttagaagtttgattggattcttatagatttatagattcaattaatttcacaacgagatgtagaagaaagattagccgaatgtgattttctaatgtaaaacttatatgatcaatgcttgaaca

SEQ ID NO: 5753 - DNA, 1027 bp, Glycine max
  Soy_ogl_3804 Gm11:8894774..8895800 Cluster 26
aatttttttctaaaaaactattgttaaattaatctcttaaaaatatccctcctctccatcttgtttcgatggtatcccatctcctttggaagcagaagctagatagagcccagagcactctccatcttgccttgaactggttatcatctggagatcacagcagcatagcaagtatctcgtggacaccatcactgcaagaaagttcaggaataacgaaggtggagacattattaggagatgtgttgctaaattatcttgttttcaaaactgttatgctcagtttgtgagcagatatataagacaatcaagttgttcattaacaaatcaggacatcaagatcttttgtttgtccgcagttgatcagagtcttacatgtatggactctttgatcctgtttgatttaatataattatccttctttcaaaacaaaacaaaaaaataaaatatccctcctcccatttcaaattgaccaaaaaaatcatattgattgatgttttaagatttgaatagattattaaaattatattccaattttactccctaacaaataatattgtcttgaaatacttaataatatatttataaaaattaaaaaatagagtaaaatgttttagtaaaattggtccctaataaatatattattttagaataattaattttcttaatctaggtaaaaaaaaacattatcatatatatatatttttaaaaaaggaaagatagtgagctttttagtttttactgtagcgttagtcccggcccttgcattgaaatgtcaacacctagtgcttgcatccaaatgaagtggcatgactgaactttcatgtctcaaccctcgcatcttgtggaaaagcaccatatcttgaggaatcaatttgagccccaaatacattatcaacgcctacacacctttatatacctttttatttgacaactacctccctcgctcctcttttcccactacccttttagcatagaaaaatatttttcacctattaagcaagagctatgtgagtcgatatatatgatt

SEQ ID NO: 5754 - DNA, 1235 bp, Glycine max
  Soy_ogl_4918 Gm15:8474666..8475900 Cluster 26
atgtttatcgaaaaatagaaagaaactcaactgctattgcagtagtgccattcggagaattacacgtagatttggatcctcccaaatcccaacaatttggaagtgttgtttctcctgatttttttttttttggtccatgtgacacaaattgaggccccacttttaatcttatgcacacctatcattgcagttgcttttgaatctggcaaaaccgccctcagcacccgaattcttgttcttgcggatgtctttttgggatctagtgccatcctcctccattgcaccaataccacccgcaccccattatcagcccaacttggtgcttcgctcgccatgtttctttcctatgtgccctcaatacaataataaatcattaaacctttgttagatttgtagaggaacctcgattttttcattacaaggaaacaatggcttaactaacgatgaatcagcatcttaaatagtatagtcctaggtacacatagggaagaactacttgccttaaaaaaaagagtaaatcacctattgtgtgcttggaagtcttgagcgttgttactttagtgtctaaaattaagcctggctaaagtgcacctcaatacgaggaatcaaatggtctttaacaatggtttgttggacatggtgcagaaagttcaattttcggcatggacttggctattcgaaatttgtgattagtttgattactcctttgtactgtggagtattaatccaggggcttgcatcttcaatctgccagaattcgtgggataggcaaccaatgagtttggagatcgaaatctgctatagtgttggactattggaggctaacaacctaaatttgcctcgatggaaagatcacgtggtctacaacgtggactcttgtggggattcatttaggagggaattgaattggtcttgtgtgggaattggtcttgtcttggaatcatacatttataattttatgaaaacaaaatatggtcaaattttttatagaaactaaaatggaactttaacatatttacagaaataaaaaatatattttagcatttactataatagcagtcaatcactatattatcatccacatcttttggaggcaaaatagtacacatcaaaatcagttgttaaattaaagagagagcttttgtactttgaggatacactaaatttagcatctgatagtaattaactctggacttctagcatcaacttcgtaatttagtgatggcatttttctg

SEQ ID NO: 5755 - DNA, 1000 bp, Glycine max
  Soy_ogl_4832 Gm14:49007001..49008000 Cluster 26
aattcttttatatttaaaatttaataaatttggttttcttgtcaattttattccacttaaaaccttccatctgtttaaaaaaaatagagattataatatattagatatgaaatagctttaaaacaatagaaataaaaaaaaattagtcaaattgataaaatatgaaggaattaatatgatgtgaaataagggtttaaaagatactaaaaatttgaatatctttattttaagtaaaattttataatttagtggataaggtttaggcaaaagaaaaattaaaataattcaatcaatttaatttatattttgggcttggttgccctgattaaggtttcgcaagagtgtttctgagttcttccagagcaggagtgagtttcactactgaaattttgttttggtctccagttcactggacttattatcaatcgaattggatgcatgtgggctaagcctgatccttttaaatgttgcgattgtggttgatcatacttcattttttttattgatgctttttctaagttcgaattttgtccaatggcttcccagagataaaaaaaaaatgctaatttgtgtaagttaatagtaatagtaatttagaaagcataaagatattgccaagttgggtatatgtaaatgtcaaatgtaatggtgggggctgagattttgtcgtattgttttatattttatttgttcagattgtggtgttaggcttttgaaactagatccgtgttaaaatttgcaaccttatctacttgtgcaagtaacatgaccattgaacatggtgacatgtgattttcagaaacatacacgacattaagatcatagatttcccttccttactgcactctgtatactctgtttgtcaaaaagccatattcactggctcctcctggctgtccttgtccctcattgccgatggcttttatagggcactaaggtttaatttaaaatgccaaaattataacatacgaacaacctaattattttggcatatttgtaa

SEQ ID NO: 5756 - DNA, 1300 bp, Glycine max
  Soy_ogl_2986 Gm09:4235501..4236800 Cluster 26
aagctaagtgttgaccaatgatgcatcccacagtattccatgccctgcattacgccgacttgctatccttcctacattcctattcaatctgccaactacaaacttcaaaaatatgaatccccatgaatcaaaaattaattttagggtgtgtaccttccatgatatgatcaccatatgaactgctttaagtttcaaacgtgctcttagcagctttcgggcacctccttaaagttttcggcacggtcctagtatttttcaactaccttcttgaaggttaactttggcgtcgcataatgaacttctcttactttcttatgtttattctcatgtcttccattatgtttatgtttattttgactgcactaatttgtttataaacctcaaagggtgcgttgtgaatggctaagaccatgtgtggttgcgactgaaactacgcacacaagcagtgaaccattgttcctacactatactgaaaactctcaattagcttggtaacatatgtttcactggaggcttgccacgcggaggaattcagatatatatatcatgtgagattcccttaactcagtaccatgcacgattcaacttagttatcatgtaaccccttagttaactcggtaacctagctaggtccatacccaatttagtaccatggtctggctcaaatttaagcctcttcgctttattaagcttgaggttaaaagattgtgtacctttttaacttggtatctgaggttcatatttgaccttggtatgaggttcatactttaactttgagagttgcttaagtagttttaaggttgcgttaatgtactaagtcaaagcatgaaaacttgcttggataccaccctcacatttgcgttcgttgaaatagccatcgagaattaatcccttttaaagatgtaatttttcacttttgggatttcacattacttatcacgcatctccccctaaattgggaggaaccagtacacacacaattggataaaaattacctccatagagtgtggaaggggttgagaacacaccgtgggcaatataacgaaggcaacacaaccataaaaaatacttttaacatcgtttgtcttaaaaatgatgtaaaaaaaaaaaacacgatgacaagttagttttttaaaaatcgatactgaaattagtttttcaacatctttttattgtaaaagggttgttgagctagattataaaccttttcattttcttcctgtcttttgaatttcttgtggttcggtccattttggagtgacattgctcgctaggcttagattctcgtgtggcatcacga

SEQ ID NO: 5757 - DNA, 1500 bp, Glycine max
  Soy_ogl_1015 Gm03:41476301..41477800 Cluster 26
gggtgttttccttctctcttttttcttcccttagttttctttgatatacttcgggagaatactaacaattaaacttaaaatcttggacgagacgaattaagtgttagtggggtaaattggtttagtattgtctccttcaatggagtttgcacactttggtaggctcaaattgaaacacgttccaacttccaaggcaagtgatcctgaagcgaaaattttataccgtgagaaaacggagttcccaacttgcaaacaaacataccttgactcatcaatgacaacaatttaaatgtagagcatgcatgatgcatcctgagccgtaattcttctaagtcctaccaatttatgaatgtgttcggagagggtagcacggtgtcacaggatgttttggaatggattgtacggtgccagatgattttttcaccgttagattttttattttttaaattgacggtcacaattttttcttttttctttttcttcctttaaacggcgtccgagagaaagatggaaggggagggaacaaaggaagatggaggggtaaattaggaaagagaaaaagaaaaagaataaattgaaaaaaatatcaaccatggattaaaattttaaaacacctaacacttttaaataagtttcgcaccgtggctacctcgcaaaacatttcccccgcaccaccgtgtgtaccagaaaggaggaacgcacgcaagccttggccccaccttacactactctgttttgtttataacgttgataagtactaatgttgttctaaactcgctctatctgatttttataatttattttaaaaataaaaagaaaagtatatttaattgagaacgcttgtcataaatatttttaatttctataaatataattaatttttttcgaaataatttattttattatttaatgatgacataatatatatttaatcatatgttagcaattattctaatatgatatatatgccaaactcaaattattagtgagtggtgataagaattattttaaaaaatatgagaattaacaaatatttggattgttcctatttataagatttaaaattaaaataatggattttcttttttatgagataagttataatatttcttatattaattattattagactaaaattacatctatttaaattaagagggaaaatatcctgataaataattagaagatgaagaaatattaataacaaaaataattttaaatttaagataaatttattattattaattaattaagtaatggagtcttataagggagggagtatgttaaaatgtgtgctagagaaacaaaagtcaaagaatccaactgcatgcaatgcatgacttgactattggggattgtagattgcttggtgcttgcactagtatctatggagaggggggaacctagaagcaaacacgtgcaatcctgacaaggttgaaatgtagggtgttacccaaaagcaatttagagtgcccatctcttgtgtttttctgtaccacc

SEQ ID NO: 5758 - DNA, 1242 bp, Glycine max
  Soy_ogl_1054 Gm03:42852759..42854000 Cluster 26
cttgactacctagtaagcgcggaaactaaccttgtcgtattaccttctgaagtggaattatatataacgaatgtaagggttgtaatttgtatcaacttttatgtacttaattatgtatagttgttccttcaaaaaaatttatgtatagttgttcactgataaataaaaaattatgtagttgttataatttttaatccctttatactaataattcattgtttttagttaatattgaacccgaagatacacatgcagcgtaaattccaataatattaataataaaatatgagccaggacttggcgttggcctacctcaccgttgctatttgatagtattaagctaaagcttgtctgtataatttcatatcgtaacaggttgttccttctatccctttctttttctcttaggtcatatcaatggcaacttcaacctctgcactcaataaaaggtatgtaaaatgcttcagttttgagaatttgatgatgtagtacacaatacaacaggatgtgaattctaatatttgtgttgtatattcaaatatgtatcagtagtatcctaaaatacagctctccatacttattcacatatatgacaatgaaaattttctacgaaatacatatcgtaagcttttagtttggattaaaaaaatatattgaaaataaattatagcttcgtaactacctattgaaaatacatatcgtaagcttttagtttgtattctttttagtatttagatcccgaatttaaatccatctaacagttatcaacggatatcgatggaaatgaagttggctatatgtatttgaattttggttcaaaatactatacacaaattctaagataaatataacagtccacaaattcaattttataaaaagaaaggtttaatttttgcaaacctcattttattccaaaaaatccatttgtaaccataaaacaaacatacacttcattgttatgtttctctctaacttaagaaataggagtctgactcctttagttactagaggtccagtagggcacagacacatgaaacttgtgcgacccacactaagtaggatagagccagatatatcagatttatggtatatgggtagcacagacctcatatatatgtccctgtactactaaaacctctagtaaatagagatgatgatttttcatgaaaatagactgttgtcaacatttaatttaagaacgaagtgttggaattaaggcttaattattgtgaatcattttct

SEQ ID NO: 5759 - DNA, 1492 bp, Glycine max
  Soy_ogl_2528 Gm08:6431609..6433100 Cluster 26
ccataatttattgaattatttcatatacaattcgtggaaaactatgaaatgaggttatgattttgccggccagaatatttgttcacagaaatcaacaaaagaaaagatacgatagagaagctttaataagagccagaaagagatatacaagagagatgaggagggtcagagccacatacatatttacctattgaaaattagaagaaaaaaacgtgttagcaaataattttaaattagtaataaattgaataatgttaattttgggcttaaaaacttttaccgcaaataaaatacctttctataatgcatgcaaatttacatagatgattaataagacctaaatttgcaaaaatattttttttttatatagttttgttgtataataattgtggtaagatgaaatgtaattttttttagagtaaaatatattttttattcttataaaattgataaaatttaaatttaatccttatgaaattattttaatcctctacaaattttaatgtattatcttttgacaccaaattagattgaattatatcagggcctacatgtctgaagtttgaagcacactaaaaattgaacactgtagttatgttgaatctttctctttctcttcttggcagatcctcttcccttctccaccacgatgctgtcaatgacgacgtgtggataatgcggaagaaggttaaggaagcttacccagacttcatccttggtattattaattaaatttttttccactattaaagtagtgagattgaggacacgccattttgatgataaatagttaaataacaagagggaggagaaagaagaggaagaagagaaagatgagtgtgggtggtggcgagactcagaacgtcttcgtttacgatagtctgctagttcatcaagaccgtccctccaaccgccgaaaattgtattcttgcattaacttttttataaattgtgaccattttttaatttacataaatcatattttaaaatttaaaataaaaaaatgtaacgtaagttaaaaacataactgaacctaatttcagattaaaaaaatgataaatttaaatgttaagaggacaaaaaaagaagaagaaatttattggagctaaatctaaactttatcaattttataaggacaaaaagtattttttttaataattatctatatgatggaattataaataatggcctaagatactatgatttagatacatgtttcatttaattataactacaattttttttttactgaattagttaaaactacatggaacactcgaacaacccaaggaggtagattaccataaagtgggagtacatgttcccattgattttaatttttaaatatgattgtagtgttgtgttatcattttatatttttattatctttgtttttgccacgccataatatttttttcatgtgacctgagatattattttgtctctacaaataaaatgtttggtccatctgctataagggatatgatgaaac

SEQ ID NO: 5760 - DNA, 1400 bp, Glycine max
  Soy_ogl_3284 Gm10:709301..710700 Cluster 26
ttattaacatccgttaaattaaaaacacaaataaaagaaagtttgcacataacttaaattatttctcgatctactagttatttattttaaaaaagatgaagaaagcttcgatgctttttagaagaagtctatcaaggtccaaggagttaagaaattagttttaacaaacaaagtgttcattattttaaaagaaaactcttaaactatttacctttggttaaaagaggaacaaatgaagaagcaaatactaaagggcatatatatactgtaacatgaaatcaaaacaaggaacatttaatcaacactaaaaggaacggtgagttttctagatgaaaggtttctattacagaatatgtacataaaaggaaaggaattaaaaggtcatgaaatgttgtgaaacaaaaatcatttaaatggactaaccattagacattaagcttttgaaaatgctttggcatgagagaatatccaattcatgatatgcagtgaatgaatgacagtgtttaagagcaaaagctatatgacaacatatccgaaaaacaaagaaaaggaaaagggtccatgacagcagtggcaaattcattccaaaccaatagatgcacaatgaactctttttttagttaactgacaacaccaaaaaactaaagaatcataagctgaaagcatcttttatactagcctctgcagatacatatctgaattgaataacaataataataaaaaggacagataacaacacaaagtaaacaaaatccaccacttaacaactcatgaaactggttaaaggttgaaattcatttggagatcatgctgaacaagaaaaacacaactttgttgtgatagaacgcagtctatatatgctactgtttaccgtggattttactgcaaatttgcgaactaatatatacactctttcaaaaataacattttgccaaacatgtgtaaactacctttgaattcatgaacgaaaatcatgtttttatctttgagggaaaccttgagtctgatgcatgtagcagagctcgcgtggaagttctttgcgtgtgggagtatctggggccacgaaaatacaccacggattgaaggagggtgtgcgtgtgttgtcgtgacagagggaacctgcagctgctagggtttttgttttttgtctaagatgaatatgaattcggttcaaaacggatttgaattgtgggtgtggattaatgagccaataacttgatttacatgggctttgccagcaattgaaaattagaaatctaccattatatatctagctaccaaacatctaaaatttcattaataatacatattggagcacaaaatttttaacaaatggagctttagagaaaaagcaagaatccaacgtaacttaattgttttgttggtccaaaacagatatc

SEQ ID NO: 5761 - DNA, 1300 bp, Glycine max
  Soy_ogl_3714 Gm11:3910501..3911800 Cluster 26
gccacgtatgtgcctgaattgatagttcaacctcagacaccggaagcgatcccaaaattaatttgttagaataaattgatatcaagctacatacgatatagtatgaacgaaattttcagactggcatttaaaatattttcatatgaacaaaaccgaaaccttactggcatttaaaaaaacctaaacccgaagccagcaaaaaaaatctaaaccttaattggtatactatttgtattctattaggttcagaagaaaaagtaatttgggagaggaaatttttaaatttagattatatataaaatagaaggagaaaaacatattttttattttatttttaattagaaaacatcgttattcatttttttatccttgattttctctcttttcatctatcaaggcactagtgacaaagctaatttgggagtatatatttgcacttagtattgggactgctacgatgtggattgcaatataaaattattatatgttttatatttagtgtaaaaaagaactttacaattattttgattgtcggtgtatcttttatttataagataacataatttttcattcactttaagatttggtatcccctaacatcctatgttgacatacccaatcgattattgatacttagaagattaaaatctatgtctttttcataaaaaaagtgaaatagaatggtgttaaggttccataaaggctccaatacagttccgttgcgactacctagcttgtggatgatgcattacgggctgcggaattttttgtgattaaaaattaaatcacactgcaattacaagttgatgaggttgtgtacaccgcaacaacaatattacggatataattacggttgtggatcacagtttaaaatcatgatatgaaaaatataaagacccaaattattgaaaacaaatactcctagtaatctggtagggggatgttttaattaaatttacaagtttatggatatatatactttagtacactttataagtcagcaccggcatgtttattgattatgtaaggagccgtatgagcctcgggtaaggtaatggtttgcgttttactattatttgttgttgaggttgtctgtgtgcgtgatgagagctcgattggctttttatggtggaaattgtttctctgtccgctttcgaaccgtcaatgatattaagcgtgggggtcaccttgccagctatatcgcaatgccaataatttgtttgcttctgcaattttattattattattcttttgtttggggatttgaagagtggaatagtctgatgataagtgacactga

SEQ ID NO: 5762 - DNA, 1244 bp, Glycine max
  Soy_ogl_3719 Gm11:4099657..4100900 Cluster 26
atttctcactattaaaatgagttagtaataaatttttttaattaaatacttgataaactaattatcacatcattacttatatgacatctaacatttttttttttaaagttgatccaaaagaaggagattctttttgcaccgttctcatgtattttttgttttttttttatacaaaaatactctttcgagatactaatttctagaatatatttttaaaaaaaggtatgacccaatgctgttaattacgttaaagaaaataattttcataatgtattaaaacacaactacattatgaaaactagtttccgtaagatatgaaaaaggaaaaaataaaaagagtaagatggtccaagatggcttggggagagagagagagagagcaaatataaaaaaaaggaggccatggatggggtacagcggagaggttgtagggagggaaggagggtaaaggttaaagagaagagagatttcggcatattaaaaaacatgtggaggaggtgtgaaaagaaaaaaaaggatgcaaaaagaaacgtaaggttctgaatgcatgaaaggggaaataagaagaacaaagaagaaaattcctaatggattcgaggttaatgggcatgtaaatttgccaagttaaggccatcttaaataggcctcatttgtttcacaattttaaattttaaacttgattttttttagggaaatttgctaaacttgattgattatttgtcataaaaaaaattctttgaaatttgatttgaccaattacaaaaattcatccaataataggaaatatataaatatatattcactttttcctctatattatattttttttctttcttttcttcttccttgttattttcctcttccttcaaccacatacacccaaattacactaaattagggtgtacgaataccattacaattaataataaaacttttaaataagttaataaacttacctttagataagccgatcaactagcgggtaaatgaaccaccaagcctacctctaaaagtttctacattatattcggatttttcaaattcatatttaaagtgtagattacttaaggtatatattacttgtttgggtttggtctatgtctccccgatgtacttgttagttttctttttattaatgatatttctgaggtgattgtatttgtttcataattgataggctgtcaacctagttaagattgttccaaccttgtcacacagtatataactttttattcccggtagaa

SEQ ID NO: 5763 - DNA, 1453 bp, Glycine max
  Soy_ogl_3956 Gm12:305848..307300 Cluster 26
taaaattttcatatgtaataaattattattaaattattttactttataatttttctctctctaaaataaaacaaaaaatggaaatggaaagaaacctattaggttatttttgagttgatcgagggactgcattaaatatggaggttgaccgaaaagtgtgaaaattaggagaccattggtcatcaattaacgcaatttccggatttcactttggctggcatttgaccccaaactgaaaccacatagtcacggagaacgatactatagagtaggtgtaagaagactctgtgttgtgacatgccagaaaggaaaacaaacaaaaaaccgtgaagtccctccctcaatccacatacctttctagcaactcaatgccaccacatactcatacttaaaaaacccagatatataaacaccatacctccatatccaacacattcaacaatgcccaattccacagcatcatccgcctcgccacttaacatttctaatactccaaaaatatagtattatttcatttcaacaaggtaatggtaaatgagaaggtaaccatgtccaaatcaaaatagctttgtggaaaatcaaacacacatttataaagaagatacagaattaattcgtcttttttaatcactggtatcaacctacgttagagtgcttcgtgtttaaccaagatgatgaggcaaagtaaaatttattttttaaacattagagtcgtatagaaaaagaattatgggtttgtcgaggatgtttataagtaaaatacttacaagtttgatgctatcttaacttttattggacgagagactttagtatcacaatcataacgattaattatgtatgttacactaattatgtatctcttttacatttaagattgcccactttctattttcttcacttaaatcttaatgttgttgaaggcagcgatgaaaaggtggtgttagcggcgcctgatttttgtgtctttgacctttaagtttttcatacatattaatacgcaactggctacatagtccatactttctaccctgtgactttgttgttattattacaactattcattattacacgcctaggcaatgagctttattcaaccttgtctgctttttctgtcaaaaaagaaaaggatgtatataaaaataagagtacattgtatcattttaatatatatattttttataattttaattaaaaatttattgcttttcttatattatataatatttttatttaacattaaaatatcgaaataaaataaacacaatactttctttctccttcgatttttttttggagaaagttttcttaagtgagtcttatcttttttttctcttctcaaacggtaaaagaataagaaaacataataaggagttgcattatcctagtccttgtgagcttatttatctcaagtgagtcttatcctagtcattgtgagtttattcatctttattga

SEQ ID NO: 5764 - DNA, 1723 bp, Glycine max
  Soy_ogl_5464 Gm17:2629078..2630800 Cluster 26
attaatgtttaaaaaaatattatttcaagtaaagttttaaaaaatactaaaagctacagagtaattactagaaaaaacttatttattaactaattaaatgagtttttaaactaataaaaaattaaaaactaacgggaatgttttgtgtaacactttaatttgtaaacacacactttctgatgaataacaatctgcaattactcccatagaaaattaattactccgtaaaaaaaacattcttcaattataattattcacaactaaataatttgaataaattaattatataaaataaatttaattgtacggttattatttactaattactgtctgccaaagagagactagtattttcttttttgacaaaagtattaaggaactccaaaaccacatataataagtatttctttttaaagaaaaattggttgcaacaaaattaccgaacttgttttcctattggttagttaaaaaaagtcacgagaaacatttgaaaacaaatatgaatgttcattcattaatttaaagtgattattataaaaatgagttaacatttaaactgaaattgataaagaaagaaaagatagaacaaaaaaaaaaagtatgagaaattaataagagtaaataatactttttttttccgcaatggattctggcgactcttccggcgctgaggtaccccacgtttttctctttctacattttacatcttcgcttttggaaaccatattaacggttagcttgtgtagttgacttcacgcaacctagttaattagtgagtaatgaataggaactaaaatgaatgaaaaaagaagttgttgacttcacgcaacaggatagttaaaattgttgttctagaacaacgtgccatcagagccaagttcctatccttgatagagaaccaatgtacaattggtatctacagcgatatccgggccagttccccgccacctcggtgagctctttcctttctccctatattttttatgttagttacattggaaacaatgaaagttttcaagcttaagtttgggcatgatgttctaatttttcattattgcactgcatatttgtttgttccacatagtcaagtctagtttgcatttgcattgacacacatttgataaccctcgccatagttatgatttatgtgcctatttgtttctgaaattttggatatacatggattgaggacctaaacttttgttgattagtcttgatggtagccacttatttatatttcataatgtgagagacttgggtcctcgtaggggttgttctataatatatacaaatctctgtctctttttctttgattcagtgttattttcctatcgattatgctctcccgaacttgtgacttgaagcccacttaacagttaatgaaactgtgtttgcatgtttgaatttgtcatatgctgttcctagttggagttgcccctttcaaggttgaatgcaacatatgatgctttttttttgttcaagtcttgtgtttcttattttcttcttggtttggccttctttgttttattcattgtttcgggatctagtgtgaaatgttaactagtgtatctgacagctagcatgtagtgcaaatgttcttgtttacattcttgtttacatgttaactgtcaagtgctttaattctggttatgtagaatatcaatgcattaatttttagacattttacttttaacgcagagttgaaacaacgggcatgtctggt

SEQ ID NO: 5765 - DNA, 1200 bp, Glycine max
  Soy_ogl_5565 Gm17:7450501..7451700 Cluster 26
cctatacacagggcactgccagatcgtattacgtcaacaaaatcatgaatgaattattaatgcttttaaataatgaatgccggaaggtaaagctacacaattgaggtgtatcttcttaagctttcacttttgtaactaattcaattagatgtgtaaataataattttgtattatgtaaaaagtttgattgagatttatcaaagtaaataaaaaagaaaaaaaatagttttaaaaatcactttaaaatttattaaaataagttaaaaagaatataagaattaaacattgttttttatgagttcttctaaatgtccctataaagtagtatcttcaggtcacaattttaaacgatttccaaaaatgaatagaagtagtatattcttattaatcctttaaatactttataaagtaaatattaaatgaagaaatatctttaatatattaaaaatgtgaaatgtatttaattaatataaagccataaaaatattgttaaaagactaaaatggtcaaatggaatgtgtttaagtttcccctcaccacatggggagcaagaaaacgagagagatcactatctcatgtttcgaagaccgataagacagagaggtttcgtgacattgcatgggaaagaccgagaaaggctcagtgtttatatgaacatcccttgtaagactgatagccacagctacctttgtgccccttgtcttcttttgtagatttttggattgaagtttaaaatgttgtatgagttttaattctttaacaaaattatttttgtcgcaaaattatttttttgaattaaacatgtattttgttttttgttttccacaccaatatcttaaacatgctttggaaggggggttaatacgtatcaatactttgattaagatttggcaattaattccttctgctttatcatattaatacctacttttgtggttatcggataaatataataatccacctatatgactttgatatgtcttcaagtgaagagaaaagaaaggcgatgtttaactattattattatttattatttatatatacaaacacaaataaaaaaagacaactagaggtttacttgaattccaagcttcaactatatttatttccctctttttcttctctcaaatagagacaggttgtagaccaataatatgtccaactgatctttcaatatggcataaaagaaattaaaacttt

SEQ ID NO: 5766 - DNA, 1100 bp, Glycine max
  Soy_ogl_1811 Gm06:6679101..6680200 Cluster 26
gcactgctctgaagaccatcaacaatgattttacaatcaacctcccgaattacattagttaggttcaaatctttaacggcaaggttttgtccatagattgttttgctgagttgcggatgtcttcaacataaatcatggttccttcttttttttgttcttcactatattctttgttaattttttatcatggctcaacatgttcatctatacttttttttttaattaccatgctttttaaagtatttcttaatcatttcaattactatactcacattttatatattttatgtttcaggaatgacttatagttacactagttttcttttttagatcacaattattttttatgagaaaatcttattcaagtcttataaaaataatacgagttataattttttcttcttcaaatatttaacttaattacatattaattcaagatttaaactcatgacaattcatgatacttagattaaaacaactatgtaggaattgaatataaatataaatgtttttataacaccccacacatattactcaattaattgagttagtttgataattgattgacgtacaataatttagtaaaattgtcaaaatttacacagaaaataaaaaagtaattgtacaaagtaaatccgacacgcttccaatcatttttattttgatttcttctggaaaaaagaatttatttttattctatttaatagcccaaggttatagacttatagtaagcgtgaaagaggaggttgaatacaggcacaacaaattggggagacactggaagaagcaatccacaatgggagctaactaactggacaagacaactaagtttgagggtaacgcgtttcgctttcttggctaaattaacgtgatacttgatcaatcccttggacatgcaaatgcaaaggaaaatgtttcttcctcaatcctcagttttagccctttaagcagccaaatgttgtgtcattatgtaaatctcacccctaatttgcttttctttgcttctttcttttttcttttaaaaaaagaatatgaatagggatatctccccaattggaaactggtttattcaaaatgttaaagattacctcgtcgcttct

SEQ ID NO: 5767 - DNA, 1432 bp, Glycine max
  Soy_ogl_5260 Gm16:3012442..3013873 Cluster 26
cgtgtaattaaaattttcttctttattctcatataaaaataatcctgttgttacgtaaactatgcactgttaatttgctccatttttttattgacaaaagtagtttattccagaattagagtccaaattaaatttaacgttaccccattttctcttgtaaattcttaaaaaaaaaggttatcttgtaaaagaaaattaatgaagttattttttcataagcagaaatagttaatgaagaacgttaaacagtgtaggggaagatgagtatacgttaaatatgatagtaagcctattatccgaccctttgaagtaggaattgatttttctctatgatttttttttaatcagaatattctttagttgaaagactaattaatatatttgtttgaggtgtattgagattcacttaacaagtttatattttttaacagataatttttcacatgcatatattatggattaaatttataactatatgtttaagagataaagttatctactaataattatgttacattggtgaaagaaaaggaaaaacaaaatcttggcaaacatgtacacaaaaacaagtgaatatgctggcatggcttaagttataacattgcatttgttatatggctcattaattaacaaagatgtaatacataactcattatgacgacatacaaaacttgtgtggcatggcctatatatatttttgcatatgtgaaattaattattcgcttttggtcgatggagttttgtgattgcttcagctttcataggctgcgacagggacgtgcagaaaaagttataacttatgtatggcctaacttctctcgaacgtatacgatataaacaaaatactaaggttgtcaaggacgtacaagtgacacatgcatgcaccacatcctcacgttttcaacgacaacgttggtggtctagcattgtaacatagtattatgcatgccttgttgagcagtttttccctccagcatgttttcaaagttgatgaatctaattttcttgtacgttttccttctgaaatcgtaggattcaactaatgcgtctaacgtagaggttcctagtaggatatccccagatggatacaaaaaattacaattgtgtactagatatgaaagagatgtatatcttttttcattaatttttgttagtgattaggtttcgaaatagaaaaatgttctttaatcataaacaatttttcacaacctcattaatgaataaggttaaggaccgcataatggacattaaaggaatgacactggctatccatattaaaagccttaaattaaggactaaagtttatggagatacttggagtatcaccaagaaactaaagacttttgattggaaaagggttcaacggtgaggtttgatgaagttgcctgctcagcacttaagggaaaatgtataaaattggataaaaaaaagt

SEQ ID NO: 5768 - DNA, 1100 bp, Glycine max
  Soy_ogl_7 Gm01:552901..554000 Cluster 26
tttaaaatttaaaggaggcctaaaaaggtgatattcagtttctttcactttatggaagattttggatgcttttgcaagggaggatatatggagagaacggtaatagcagtgagtgttagggttagttttcttggtgtgccagagatatggtcccataaagaactcgcaggtgaaatggtggttgtgcaaagaggaatataacaacatggctgttgtccaacttttttggattcttccacatgggcccagctttgggcctgcttccattttcaagaccctaccactttggggttttaatttgatttcactacttccatttccctccaactattgtttattatatatataaacaaatgcacatatttttggaaatgttatatatgaacaatcttattcagcactagcgtagttctcaatagagttctaactcaattggccggttaacagtatgtataaattgttataaactttctaatatttgagttctatttgtatgatgaaaaagtgtagttgccactaaatgccaattgcaccattccatgtaaggttttaaattctccattttcacgatttgattgagaaataaaatgaattggtttagctatatttatttatatacaaacaggtatatatgtaatgacaaactatttaatttcattaaaaagaaataaaataaatgcacacaaaatgataaaattataagtagtatagttaagatgaatctatatataaattgcataactgagacaaattgttagcatgtaaaatttgtcattaaattaataacttttaattgcaaatttatcaataacttctgatatcataaagtagtccaagccatcaatgaataattttttaataatatatattatgagataatggtttttgttttgctagaaaaataagtacctaaatttcgctatatataaaaaaaatggattcaaaccgacttttattttacagtcccatatcagggctacttgtcgcataatacgtacgagcatttcctggccaggcccagataagcaaaatctgaagcatttctgaaacaagtcatagaattggcccaaaaagaagcaatacgtacatatggacaaaaa

SEQ ID NO: 5769 - DNA, 1300 bp, Glycine max
  Soy_ogl_218 Gm01:48984401..48985700 Cluster 26
tgctatagtatcttatctttattcattgtcatctttaaatattaaaatctagaataatcaaaattttgaaacaaaacacaattgggtggtatctgagtttttttatttttagttttggaatgaaatatttaaaacaagtgcgacagaaatatatcttgaatgattttcaaattacaagtgaatgagttgtcaatattattgtctttcagttaattttgctattgataacaaagattaaaactggaaaaaaattacataagacttaaatcaaaataaaaatctttaaagaattaaaattaaaaaaaaatattttataggatcaaaattaaatcttattaaacctaccttaaaagacagcaggcaatacatttttggggaggactcccccttgtaaaaaatataattataatggatgcctcgggactccagaagcgatcactgtgatttaggtattttcaagtgttacataattgaattcaattttatcaattctttctaataaactaaaatttttaaatatttatcatataaaaagattgatagagactatagttagattcagcaaaaaaataaataaagagactatagttaggtaatttctcacagcataaaattaagaatttatcctcccacgagaatagaatagaatataaggagtggaaattgtgacaaaaacacaatcaactcacgttcactccataactatcaatctgcttctcaccatttcccttcttaatctcttttctttccacttagtgcatgaaatgatggtcgaaaggagaaaaaaaacttagtggccgaaagaagtgttttgccctaaatttccaacacgaactccgctagctaaacaattaatccatcgcttgatattttgaagatgatgtcacatagaacggaagttaagggaaatgcaaaagaaaattgtcactatatgtatactttgttagcctcacatacaagcacacacacattcagtcataacataaaatatgaatttagacactatctttgcttttaccttagcttatattctactggtaataacctcatcagagttccctagtgttgctggggacgatgttagcagcgtcatcagtggttctctatttgagcaattgctacaacaccggaacgatatcaagcttgtgaggggaagggattctatagcttcaatgcttttctcaccgcagctagatcctttggtgggtttggcaccacgggtgattttaacactcgtaagagggaggttgctgctttcctagccctaacatctcatgagaccacaagttattacaatata

SEQ ID NO: 5770 - DNA, 1636 bp, Glycine max
  Soy_ogl_264 Gm01:51269701..51271336 Cluster 26
tttttctcttcaaaccaacaatcaagagtcctaaagggtttaggcccctaatccatgtcaacatccttcattaaaattggacaatgactaatatatttctatccaaaattgttgacactagttaacaaagttagtgagtttaattgtgacacatttataaaatgaaactaaaaattgatgatttaaattagatggaataaaaatgatcttttaaatatatttataggaactaaaaatatgttttactttgatatgatatttattgataatatgaaaagcttttaaaaattttagggtgaagaccgtaaatttgaatcgaagtattgacgtggatagctaactcttgtaagtgactcgtttcttccaaagtggtggtgtttcattttcatctttttggtggaagtgaccggtttccaagttgttgctaaaatgttggtggagaggcactgtagtgtatatatgagcatgagtatggtgttggtggacttatttagtagatgcaaagaaattttggggtctaaattttacatgtatttttttaaccttaaaatacgtgtcgttatttttttataatttataaagaaacaactgtacaaatttagttagtcttgaatccatacatatattttttttatatgactaacttaaactggaaaattacgggttcctgcccaaaaactgctaatatgtgtgatatggaatacactcatggaaattagagggggaaaatgattgaaaaaacaacaataattaagcgctgacaaagcataatcaaagggagtccaacattcgaaataataacaacgaaaaatagtactgctagcaatgaaagatcatgactgagtggagtgttttctgcgtgaggcgagtagcacatagtcaaagggtcatacatagtaacaaatgagaaatagaagagacagaaatgtaactacagcaccataaggctcacactccaatttttagataacatgaatgaaaacatttataatagtaataatactgctgcagcagcacaaatatttgtcgaaatagaaaataatgcaatcaagcaataaatgcatccaccaacggtcactgcagtgcaaattggaccttctttgcctgtacgcacggtgatttctgaacccgaccgttgatcacttgtctcttgtctttctctctcccatcattcatgtgaattagagatatattcatatttaatatcggattcttttcaattgaccgatcatgtaggaaataaaaagaaaaatcgtcctcatacccctctctttcaattaattaaatgaatatataaaaaacagtttatcttattattgttaaaaaatatatagaattattcttattgaggtggccccatgtcccttcgattctcataaatgtgtatggtcatagcccttccgtcgtttttgtgtctgaggcactttgaacaaaccccacaaatgcgatcccatgtaggctccacgtaccttctcatttaatcctagccatgcttatgaatacatatttgaaattgaagactagaaaggaaaggagtgatgtgatggagaggtgaccgtggacggtggtggtggtgaagttatcttgtctggcagagagggtgatggtagtggccaccacttcaccccctctcata

SEQ ID NO: 5771 - DNA, 1036 bp, Glycine max
  Soy_ogl_377 Gm02:4535665..4536700 Cluster 26
tgaatcaaaatatttaatatacaacacgtatgtttgagattgagggtatgcccagaattcagacatgtcaaagggagtggcgccaaaaagaaatgaaacgtaacatagcacaaaatggtttatgattatgaaccctctgctgcattacattcccaaggctaaacttataatcaatgaggtattaatttaataattaaaaaaaaattattgccttgggtcggacttacggaggcatagcaaatgccacaaagatgaacgattttgtgagagtactgcaatgtttataggcgtatcaaacatcagtttctcgtgtttataaacataataaaaacataagatacatcaaataataattaaattcacattaaattttacactaaaattatttgagaaaacgtattgacaatcaacaaaaaggaccatgcacagtaactttatttatttttataataataactaccttaaagttatttctagtctaatttctacctagttaataatgtaaaaaattagtctggtttctaattgattgataatgtaaaaaaaaattatactatcaaatatcaatgaaaagaaattacactcaaattgttttaacttttttattgtgttgataatacattagtgttcttgcaaaactactggaaataccaagaggaaacaaagcaagctgtgaagttattttgttgttgacttgatggtacaaatacaggggctaaagtccaaaattggcccaagacgatcgatcctatattgttgcgaaacgattcttcttgttccaatctattagaggctggttgagttaattgatgcaatcaaatgcagaaacgtatggccaaattaatctagacattttcaatataatttgattatcaattagcctcaaacatgtgtgaggagtggggacttatcctagttatctcactcttgtagagatatcaacatgtcaactaataatgttctaaacatacattgctaattcgtttgaacatgctatcttgttgtggatcaagcttattagatgttctctttcact

SEQ ID NO: 5772 - DNA, 1400 bp, Glycine max
  Soy_ogl_1005 Gm03:40745101..40746500 Cluster 26
atccagttatagtactttgagacaatgttactaatgtccatgaaatgaactagtgacaaatcttcattattgacgtatttggtgattcctggaacattatgttgatcagtatggatatttggaagatatgcctcgagtaccagtgccacttgcattattacaggacttcgatgagttatttcaacattaaccatgtttcacaacagtaacaacatcattcaaagacattagtattaacatggatggtccattgaaacgtgagtaaagcatgcatagttctgatagtaacacatatccatgttggtgtagtaaaggttgactacagggagttttgactttcttcgtggaatcatcgtgtggtccatattatgttctcacacgtgacgtgagatttaattactatctcaaattgggggaacagcttatatatgttgactattcccagctcgtaacatcaaccacaacttttattttaattttttattatagaaatgctagttgttttgatactatacatgaatcgagagaaatttctcatgaatgggaggtttggatgagtctaggattcaaacattcacgcgcgcctagttgatttcatactcacagaaagagatgtcttaatttctagctataagatgcatttttggcaaaagattcccgatcgactgacatattattaaactattaacaattcaaattcaaatagaatattatattgttaaaaaccaatgcaggttgattcagagtgggctaaaattaaaataatgagttttcattgcataaaatttttaaactgtatatgcaatatactgtatctgtacgtgttgcatatataatgttacttaatgagtttgacaattctaaaaaaaaaaagattttgacaactcatacatgttatttaactcattaattatatagtaaataatatgtcattttattggatggtagtgtaagtttttttttcaaaggagaatgctaactagtcgctaattaactaaagctttatgtaaaaaaatatttattgattatttaatcagtattctgatagaattagttatcaaaatctttttcaaaaaataaatttgtagtgtcaccaataatgcataaaccctaatgaataatgttatatttttcgataaattttcttaatacttcatgaagaaagtattaaataaaatataattatatttaatatcttaaagatactatacctttttctatatagcttaacttagaggattaaaaagaagattttatgaaaagactaaaattaaattgttcaattctcagggcttaattatatatcagttaccacgctaactagcatgtccagacacgcaaggtctgcactctgcagttgtacgtgtgaatagtagtataccaccatcatacaacagtaa

SEQ ID NO: 5773 - DNA, 1494 bp, Glycine max
  Soy_ogl_1082 Gm03:44255307..44256800 Cluster 26
attttgcagtgtagtttgtgattggtgtaaagcaaagatttccaatggtcgttaattgaagggttaatttaaatcaggaggtttgcaattattcttttaggacatcatgaaatggcctatttaatctggtgaacaaagtcaattatagatggataggaattaggaaattaatgattctaactgcatcgacagcatttgcaattcttgaaagcattttgatggtgcaggagagattgtgaaaacagatttaatgattcaattctctttaactattgctgcaagtgatttagtctacaaagtttgacttaattaagttattctttttgtttttaaatttaagtaaatttagttttgttggttattttcttttacttataatctttaaaatgttattttcggttccgttcaactctcttgcacatgtgatttcctcttgaaacgtcgatatgtcaacttttaaatgtaaatcgaatgcatatcgcatccttggcatctccgcacccaactactctctccattttcatctgcacaaactcattgtcaactggtatatatataggaagcaaatataaaagaaacgtagagattagttagatcacatgatattaaactatgtaataaaagaataaaaattaaaaatacatttgcggtagttttgaagtccttgcaaatggcttcagctctttccattactgaattagccaaatccttaccgtgttgttccatagctaagatagcatgactggaataccctgtaacacatgacatggaatcaccaattaatattaattactggaattagtgaaacacatggaaagaaaagaagccttaaatatatagcaataaatatagacatgattaacaaatatggggagcgggaaaaaagaaagcaaaacatgcatgcaacattgaaggactagtataacgttgggggtgtcggcaataaggttggtgatacaccaagaaaagtccaaacatgctctcctcgctctcatccacacccaccattatctttcgctcttttctctccattcccaaattaaggaacctgctattgtctgcttactaacttctataggaacaaaggctagggcttcgggctttaaaatattctagagaacgggagtacttgagattttgatttagccgtggatttgtagcggtttttcagacaaagttttctcacattttcctaaaaaataaaaaaatgaataaaacaccattcgggtattagtttttctcctttttggtataatgacgttaatatgcatataacgtcggcatctatgattccacctagctgaagtggccgctcaaatgataggaactactaactacttcaaatgcgaaaccatgaatagacgctcttgttcttctattaaaacttgaaatttttacacaaacacataacaaaaaactaatatatacacccaaactttataccttattattatttatataaacatgcttacactctgatttttaatttttttt

SEQ ID NO: 5774 - DNA, 1329 bp, Glycine max
  Soy_ogl_1129 Gm03:47456635..47457963 Cluster 26
agaagttttagtgacttctgcccactctatctcatataacaaaaatgatttgtgtaggtttttatttttattattttagagtttttctcataactctgtctctaatttaccaacactcgggaagaagattaagaaaaaaagacagaaacaatatcaaatttatttttatttgacattttgattttttatttattttattttattagttgtaaaaattttattagttgtgtctaaaaataacgtgttaattttgtgtttacctaagtatttaactgaataccagtactttaaaatattaatcataaaattttgattaagagatatttgtgttaaaaagatgaataagtagctagcaaaaatataatttaaaattatttaagaaataactagttaaaattatttttcaacagtgaatagattaagaaattaaattaccctaaaaacaaaaatatgcatatatatattaaaagaagttactctatattttttttggacaagaacattaaaagcttaatagaattaatggccaagaataggcgcaaagagatgacgaaaaattgaaataactttgatttcaattgttattgaacgcacaacttttatgttccaattgtctgttgtgagagacaaagctctttttccttttcctaatcactcattagtttttgttttacaactcaaagttacttttagcagattctttttcttatgtttcacttgaaagttgaaacaaatgctatccggtaaaatcagtgttcgatttatagaagataagataggagataccataggggcgtaatgatattcttctcaattatatattaatctctcatgtataacgtatttctaattatggaataatttctccatgatgtttacaacaggcttgaacactttttattaaatcaatataagcatataagttaattttaatttataaaaaactcattttttttatatttttcttcaagtgtttattaaaaagtttatccaacatattacttgagtatttgctttatctcttgaggcccatgggcctcaactttaagtcatccaattgaaataggcaacaatgagtggtcatataggggtccatcacttaagatttttttggactaaaaactgacatactaaatgtaccactctcaaaattgctaaacggcccttcttctccatttttggtatcctcacaaaagaatacccctatctgaaaattaatttccgaatggtgcaagtgcaatatgtgaatgctaaggtgttcgacttctccagggccatgctaaacgtgcatgttgacccatggacttcaaagcttacttcaaaatttcg

SEQ ID NO: 5775 - DNA, 1466 bp, Glycine max
  Soy_ogl_1159 Gm04:1196301..1197766 Cluster 26
taaactgagacaatcactctcaagtagctacaacaaattacgcccaagtggaaatgaacataaatgatatcatataagcatgaactaaaaaaacactggaatccaaacagtgacagaagacaagacagcaaaagacataattcaaactcaaggatttgtgcttggaaatgctttagatacttcagggaccttaggaatctcaggcatattagacagctcaagttttgacaattcggggaccttaggcagctcagctcaggtactttaggcatttttgggaccttagaccgctctacttttaacaatttaggaacgttagacaattcaaggactttagacatctctagctttggtaattcaggaacttttggtggaggtggcagctcaggtttgggaagttagggcacttctagctttgacaacgtcaattctagaagattgtgtgctccaacagctattgtgtgactgcttgcagacaataatgttagagccacaaatgaaaaaaacactgtcgacaaactgtaagtagccatggttgaatacaagaactttcaagaggatcaataggagttggagatctttgtaagtgtttagatatgttttgtgaatgtgtactgaagatgttgtatgtgggacttttatagacaaaactgtctaatgaggtacgcatggttagttggtgggatggtgttagtattcttagctcaacttctaagttacccacacagtattccatatagcaaactttaatcagaacagttgttggtcaactaatctatctgcatcagcattaatagaaaggaatgaagacaattttgtcacaaaagtcaatactctccatgagaaagctaccacaaaaccaaggattattagagatatttgccaatgaaaattgttccttgcaagtttactatgccttatcaagtatcaacaaatcagacttaatttcaacgccaacaaactgaaataaactattcttattttcatatttgaaatgggcagaaactgataacagacaaaataactctaagaataataaaattagatgaccaacaaataaccattacggtacaagtttcatatctctaatccttatcaggggaatgtgccactgctacccttgcctaccatcccaaccataccatcattagtccctccattgccaccagcttcatttccaaacattcccgcaatcacaactatgatattccctccattccattcctctctccaaccccttcatccgcaagtccttgattgaaagtgaagaattctaagcattttccagtgtatgaagcttggttttgtctcatgttgctgtgctcatgtcttgctagcagcgattaatatatatatgcatgtgtgtaggataacaaatatccttacatattctctgtgttatttgtgatttgtatcgttgttgtggggtatgatatacatacaagtctggtcagtttagtttctat

SEQ ID NO: 5776 - DNA, 1180 bp, Glycine max
  Soy_ogl_1407 Gm04:44905821..44907000 Cluster 26
aaaattttcttagtttactttttttcaccaatttaaggggacgaattaatattcattgtgtgtgaaaagaatatcgacaagaatttttatgaagttctcctagtcttgtttaggtatatatgatctcttgtgtaagaaatctaaccctaaaagttagtataagaagcagtcttaagaggtaaatatagaattagaatgaaatgcgtatcgtgctccccttttaatatattgttgatttgttggtgtgagagtagtgtcattgtgcatggctaatgccttcaacctgttcatgtgagtgatttcgatcgagtgtttgttcgaatatgagatattttagaaagggatctgatgtggtgcaacaacgtatataatctttcgagtgtttgcttctacatatttgccttaatatctgttttttaaaacaaataaacgtgatcctaattaaaatcttgtacgtgcggacataccatgaattagtttgactagtccttgtagggggccgtgagtattagcaattttgattcttgtggagttgtggtgtgtaatggctttgtcccgggtcacagttgcttatgtagagtacatgcctttaacttgtcttgcggattatttattattgtttcttctctcaaagtctcctcatatttagtttttgttcattattttaggtttggctcatgtccacttaatttaacagaaagatgtcgttgttaatttagggtttagcatttccttattacttaatatgctatagattgcaattttagggtgtgtttttcacattgaactgaaaaattttgtaactataaagtttcgttgaacctgtattgaaaagtaaaaatgttttaaaaacaaacgcttaattattatcttttttggtgttaaccattaggctgaaaatcaaaaattaatttctgaggtactgaaatttatttaataaattaatatttttctaatatatattttttcatacacccaggatcaattttatgatttatatacttaagtaataagattatacatcaattatattagatcatattagtaaatgataagaatattttaccaaggcaagactcctggttagggaagaatttactccagctcaagattgatttgattaagtttttgcctcctttcttggagtagctaggtgcatcaaaccggtcattaggaacga

SEQ ID NO: 5777 - DNA, 1571 bp, Glycine max
  Soy_ogl_1476 Gm04:47767501..47769071 Cluster 26
aatttctccacttagatattgtaaatattttttggggctaggttcataatttttcaaattcttgtgttcttattgattttttactaatgtgttgcatttcatgtcatgttttttatatgaattcatgtaagttttgcatgcattttgagtctattaggattagtttaacccttagtttccttaattttgatagtttagtcacttggaactcttgaggtgtgcttttgtgtgttaaatgattgcagtgagaattataattggaaaatttagatttggaacttaaagtttaaggacttggagtgaattagggtcaaaagatggacgatttggagcttcttggatatacaaatgaaatatcacaaccttggaagcaagagaaacttgaagaaatggaagccaacaagtgccacactcaaggtgtgacaaccatcactagtgtgggtgttccaaggagctcaaaaactacttctatcaaagatcacaccttggatgtggaacccaccacaaatttggccgtctaggagtgctaagaagttagccacaacaaagttcacatttcaggtgtggcacgttttctaagggtgtgatgatcttgtagctcattattttgtgttttaaagttttaaactacacgggcttagaccctaattgtagcctaaataaaaataaacctcttaggattaggaaaaaggttttgaacctttagatttagacgactaagaggaaaagcttggatcattatcctttcactcttcttccgagtttgatgttttctttctgttattttattctcatgactatgcgtgaataattcaccaattctacaaagtagagaaaattcaaacccgatatcaactttagtcaaaaccaattttttcaatcaaagtcaaaagttaaatgaagattaaatttaattgtcatgtctaatcaaatcttttgatgatctaaaatatgttctcatcaatttattcgtgactgtgattatgttcaaaatatttaatcttgaaacttaaaaaagtttgaaaacttcaaatagctaatcttaccattttataagatgtataccaaaatatatggcagtaaaaaaaatcatgtacggatgaaaagtctagctaagaatattatatatgccttaactcctcctgtatttgaatttgatgcttgattattttattttattgtatattaatctgaataactttcgtaagcattataaactcttacatagccgcctgcttgtatacttgcaataatacaacttttgaagtagattttatgtctagccagatttaattagttgcatgtttgaaagactaattggtgattgtgattggtgagtgaatatgggagaggcttgaagagaatgtggttcctccacggttcctctcagagatccaaaatctggcttagtagtaatgtttctgttcagacgcaccaacctggtgcatgcaacatcgctttctcattggacagtgtcttatgaggttgtgctcatcgatctcattgttggtggacacattcaattaattgtcatgtgaaagctgttacacattgttttggctggcatttga

SEQ ID NO: 5778 - DNA, 1343 bp, Glycine max
  Soy_ogl_1483 Gm04:48080258..48081600 Cluster 26
gggtaatttttttctcttaaaaaattataattagaggaggaaataatatacttagataatctaatgtataaggactaattaacgataagaaactttagacatgaactattatatgcaaccatggagaaacccatcaaatgcttcaccggtggtccactaaataaagtggctacaatagtttattttttaattgaaaataaaattcaaatatgaaatgactaatatacccctcttgtaaaatgtaaagtgaccactgagctcccattgccttcttccttccaattccaaaccacgatgttccctccttctccaatgcgaaacccacagcttctatttttctgaaccaattttttatgcaacaaaacgccattttatttctatggcaacaacaaacatatcaacagggttccacaagttgctatcgacgggaagagaaattcatagtggccggaggaacatccaacgcagttgcaattttccaaaacaaattatgaacccttacgtagtcccaaatcgcgattccgctctactactagaccatttatactccatcagtgtaaacagtattttcaagagatcaattattttagaaaattagataaataaaaactgaatctggcaccaacataaatcaaatcctgtgaattcataaacctatttttttgggcaaatttgtttctgatttgtgcttttatcgatttttgttattataaaagttagaggtttgtcgttatcatccgacgcggcaaaggattttcggcacggtgtaggccggtgggccgcagatgctgagcctcgccgccatgttaacaggcctcatgttttcgccttcaaaaatgaggcacacgtctagttgctcttgtgattcaatgagtttgattttgatcctctaactactctacacttagggaccgaagcagaagattaattttatgggagccaagctacattgtaaatatataaaaaaaaaaataatcataacacactatctggagctaaattataaataaataaacaaacataataatattttatgtgataccctaacttaataagtttttattttttattttaaaaacaacaaacaattttaaaaataaaaaataaaatttccttcattaattttcatttctctcctcttggtaggtgaggtatcaggtcacattttcaaacccaaaaccttttctaaacaaagttgaaggactcaaattaaacagaatatgccagtaaaataacgtttaatacaaatttagtcgaaggatgtgcaactttattcgacgatttataaaaattgtgtggcttactttacacaaactctaagaacattccacaaaaggaaactt

SEQ ID NO: 5779 - DNA, 1074 bp, Glycine max
  Soy_ogl_1485 Gm04:48192701..48193774 Cluster 26
tatcctcctcaaggagattccttgaaccctatggactagttatgtaattataattggattgaattacttataattcgagcatgtggagtaatcctataggtaaatctttgctggtaaccctaacatgtcatttgttaaggtgacaaaatgattaaatatcgaccaatttgacataaactcattgctaaaatgtgggaattgagatttcaattctaattatatatgaattaaaactaagtgtttttttaatgaacttagtccataaaatctgatacaaattaagttttcatcagtctattccatcttattatttagtaatgaaggttgaatttaggcaatttgcaaaaaaaattaaacttttttgcctcaactagttatagcttgtgacttacatcaagtttgcaatcaacctcatcacttgataaaatgtagggcgctcaagcttcaaatttgagcacgaattaaagtcaagcatttttatcccccatctaatagtggttcaatccggactagcctgcaaaatgacattgacaaggcatttagtatatgcaagtattgcatcagatctcgggattttagtaaattcaatattataattaagacattcagaaggcttaaaatattatacagacgtgtttcattaatttggtaaaccacgtggagcattatttaggaaatataaaaaacactattgtaaccgttttttttataaaaaaatgcttctaagctctaatttgaatttagtcaaatcttgactaaattcaatatcaatatgaaaaacacacccttaagcatttatttatataataaaagcgtattttaataagatggtgatccccatgcaaaaaatgtttaattcaatatcaatattatctaacaggtggtgcaggccaggagtctttgcttgttgcggtgcagtgaccagtctacgtgtggaggccaatcaaacacatgacaaagtgattttgaagagatgttaggacaaaactgcaactaggcttcagccaatgccaatctatgtacttaatttaatacatatggcccttttttctctccacttcttcaagttcagct

SEQ ID NO: 5780 - DNA, 1100 bp, Glycine max
  Soy_ogl_1491 Gm04:48517401..48518500 Cluster 26
gagaacattgccaggagtgtttttcggatttctgttatcgataaacaagatcaagataagtagttttaggtttagacacaaaatgccctagtttgctagagtaattaaacacagcacatatgattggtggcatggaaatggtgtcggttagtaatcagtgatcacatagttaagtgtgactaaatctagtagttccaaaatactaaagtttatagagataggccagaagtcaaaagtcctaataatgatatggttaaaaaagagtagaaattgagtaagagtgaaaaagtaatagaaagttaaccacctcttactagctagaaaggttaactgaacccaagcaactatacaaaaataaaataactaatacttgattagctttagttaccagatttccgatgggattcaaaatggtacactaggctatcagttatgtttggattggtggtaaagatcaaagcggaaggagtcaaaatataatggagtgaaatgggtttaaaataccatttcattgtttgggtaatttataaaaggatggaacaaatattccattccattgtttgaaaaaggaatgaaacagaataaattataacttttcattttatattatccttattttaaagtgattttttttatgatgccgggtgctgtgtgtatagatatgagaaaatattcagatatcaattttagccactacaacaaatacaagcccgtcattcgcagcaggcgtagttttagcttgcaaactaagcgattataccaaacgtacctaaaatcggtgcgtttgttgaaaaaaatagcaaatatcaattgtccatagaaaaatcagtacacaccaactcattcagaaaaaatatttatattcctacaaaaaagtaagtatgtagtatcttttacgttctatgattaaaagcataaattcaatgtttgcaacttaaaatccgcacgtagggagaacatatattcttacgttttctgttacaacgagactatttgaacattctgaattcatttacttctgtccattctgcttgggagaaggaaaaagagcaacgctcacccggaaatcgtaacccgacatccaccctggaattatattg

SEQ ID NO: 5781 - DNA, 1700 bp, Glycine max
  Soy_ogl_1496 Gm04:48749601..211300 Cluster 26
agaaccgtgacattttctccatttattctacaaccatatgtcacaaattcttcacattagcatttgttatattgccctgggcattacttattacttctgtcgattttaaatttatatatcactatatatcaatattgaagcaaagattctatcaacggagtgattccttgttcagttgttctaatcagaacgatttgttcttttttgtgtgcttcaatttcttgttcaccacacgtaaacaaaaatcatcttctttttggttgataagagcatttctgaccattcgtaatttcgtatgtaaagatagactatggatagtcaatatcagttccacaccttgtcgctttcgatctcatcaataggctagagtcttgaccagttgttaaatactaattaagtttaacttttgtgactgaataaacattaacttgtaagtcctccaatgtttctttattatgatgtatcggttataaagggtcagtgaaatctacgcgggacaatgtgtaattcttttgtcggatggtgaaagacaaaaaaaaaaaaaaataataaaggggaccaaatgttgtctggagttggtttttttttttttcacacaagacatgaaaaaaaattgtccacatttgcaatacttaaaaagggcaacatactcagattgaagtcttcagaggaccctgaattgggcggtctccattgtagacaactttgagaatcactgctttccttacagggttaaaaactagtgcttgctttattaatatttcttccatttgtttttaaatgttcatctttgaaaaaaaagttttttaaaagagacatatattgatcgagaaatggtgtacctgaccttaatctagtgctggctaatatttttaattgatcactcgtagttttttttggtattattagagggaggggttgtgtggatgtcactgatacttttgttgggtcttggattgtccactgatactttgtttgggcaacaatgatatgatttcaaaaagcccaaacactaacaaacacgtgagttaatgtgtcttgaaacttcaaggaaggcctgggatgtagttgggtcctaagcaaagagaatatatggaccctgatcaatcatacgcttcctcatgtatttttaggctcactaaataattgaatctgctcgaggaaactgaagcaaaatggtgttgaatcctgtcatgcaaattaagactctgataataagtgtttaaacaccaatattaaaggtgtagttcttcaaacatgcaatctatattggaagaaaaatttaatagagacagacgtactacaagattcataagctgtattagtctgcctttcaaaacaaaacaaaacaagctgtattagtctatgtatagtcatcttttcagaggacactagttttttgctacttaaaaacagataaatgttaaatcttcttcaaaattaccctaataatttttcaaaggaaagggaaaaaaactataaatcaacttaaaaacaataaaaaagtatatattaaaattacatgctgttttagtcccttttttatcttatggaggattgttgaaaggatacttgaggagaatttattatttctcaatctcaaaaacaaaggagagtaccaataaagaggtttgatggaccattttaaacaattgcatcctagctagaagcttgaggtagtattattattaggaatgaca

SEQ ID NO: 5782 - DNA, 1500 bp, Glycine max
  Soy_ogl_1677 Gm05:34862901..34864400 Cluster 26
tcacaatagcaattaagattccagcttttgaaaagatatactaatgtctgagtttttttttttttttaacgagagacacaccattggctgacagattaaagtgaacttcagttttagatttcttttgccttttgctttatacatatatgtttcccaattgctacacaatctgactcattctgaaaaaatttcactaccttcatgtatcatatgacagagtagcttctatataagcttatcaaaatgctaaccccctggtcccgaataaagtagatgcacaaagataagatctgtttggtcacgtcatcattttaagtgcgagttcaatgacctctatctttaagttggaagtggccactgctacattgttgaatccgatgactctagctctgagaaaaaaggggaggggattgaaatcaaggatgttttgatcaggatacaagacaagttaaaataggtgtaagcaatttgagtacatttgttttaagattccaatatttgtaaaaataggaacacgattgtccatggatatataattagcctgcatgtgataaattgataatgatttatgaaaaattgaatataaataatacatgtaatatgtttaatgggaagtgttacttgtacataacgttggtctcataaaaattaagataaactactatagattaaaaggggaggggattgaaattaagtcaacaatcaatgataattacatgaacaagttttataagtaaaagatttatagtatgttaataataataaaaaaaaagatttagagtatattatcaacatacttttgaataaaaaaaatacacaaacataaatcacattatagtaaattttaattcaaatttatatttaaaaactttatttatctgtatggggatgagaaggtttgttaacttgtttgtgcatgtgcagtgacaaaggtccctttgtaatttattgctagccgtgtgcactcactcaatagttgtatcagtttggcactccttgtgacaaactttatttcctataatataataacaatattttttgcagtgcaaaaaaaaaaaaaaaaagtggacgagactctaatgattatttcaaattaatgtattttgtccctcagacctcaattcgtcagtgccatatacttggatccttctccaggtgatccattatgatagtgtgttgttttgaattggggcttccttcctgtattcttgaatggacctattacgatggttttaatttgtaggcccatatatccaacaatgttgggcttcctgtagcaagagtcctttaacttggttctttgttatatagttaattcttgtccaatttattaatggtatcaaaatgaccaaaaagataaggggggattaagcctaaatctaagttagaaattacaaaatctgtactgaggagaagcccattaaaattgcaggggcaaagtcaaaagagaaaatttgcttaaggtttagtcgaaaacacgattttattttgcaatgctct

SEQ ID NO: 5783 - DNA, 1200 bp, Glycine max
  Soy_ogl_1734 Gm05:38629301..38630500 Cluster 26
gagaatgatggacttagatcagttgggtcaccccacttgcaaaatcaatcggaccactgtgatggcaaatcaaactgaatcgcattagcaattgcggccacgggattttcattgtcgttttattgaagccacggtattgtttcatgagaatatggttccattttcagataacaacatttttcaatgcaatgaatgaagctcctgcattaacatctagttgtgactttgaggttgttactgtgacgagagaatagtaaataatggtcggaagaagaaagagatatggttttagattagtttagtagaatcttctatatgtggaatttgttcttacacccatgacccatgaattgaactctctccttcccttaaaaaagagaaactttacttctttgacactggatgtagttatgctttcaatatcaatctcactatggattgtcattttgtgttttaaaaaggaaaagagcataattaaggacgatgaaagttgtgtggtcattttgtgagagaaaataaaaaggaaaaacctgaaaaaggtacacacaaggactaattcaaggacgcttcatatatgttgtgggtctagtgtgtctactaaactgcagtactttgcagtaggattgtggctcggatataaattatttgcgttgaaattggatattgactggttcattcgtgtacttctatcaagatcatgcggtagtagatgttgacggttaaattaagaaactgtcaagatagagagtcgtatataaattataatttcttaattaaagttggtgttctggaagatgtgaatcctggataagggttcaaaacctcaaattctgcgatttcattgatcaacgttaggttgatatctccaagttataaacgtcctttctcaaattgatccgcagcgaggaataacttttatctaacacaagtctaacaaattaattcacttcgtctacgtgtctgttcaaccaaacaagaaaaatatatgagaaataatgcaatgatagttagagaaaaagaaagaaaattcccttgcagtgctgaccttaatgaaaaaaaaaattaaagtaatcccaacgtgctagctagttgtgttaatatgacagtcctcagcgttggaaaacaggcttactctgaatttctagcaaattacatagaaagcccagatgcagaattaccggagtttgtagaattacatat

SEQ ID NO: 5784 - DNA, 1300 bp, Glycine max
  Soy_ogl_2444 Gm08:879801..881100 Cluster 26
aaaaagcacattaaaatgtgcaaactaaaatgaacgaacaggatgagttaacaattcgaatctacaaagtgtattttgctctccttttttattactttccccatctgcccctctctccctcgccaaaaagtacatatgatatggtcacctattgggaaatttatttaaattagttcgcacataatgccataactggaatactcattgatccaccctcaagccacaactagatcacatagctttaactatactgccttagaagaaaacaaaaacaaagttctccaagctggaaatgatcaaattagcatgtgagatcgaatcttatgcacaggcagtcataaaacctttccatatcgacattttgagtcacagagagactgttccataatctaatatatgctgctatgacatgattacgttatgtgtcaaaactgtttgttggcacaactctcgacaatactactttgaacatcacacacactaaccaaaaggcattgcatgtgcaaatatccgagcaattatgctactagttattagtctttactcatattatttggtctattaaacccatatccgagcaattatgctaccagttatgagtccttactcatattatttggcctattagacccaccaacctgacctacttccacttttactggtagccactttgtcagagctcaagggtcttccttttcttttcttttttcattttctccccttttaaaaaaatgtctttttttaagccattaaattgattgaattcaacttcaaatttcccttttccccttttgcttttcttttccagtttaccagatcacattttaaaaaaagagataggggaaggaaaataattttaatggaggagaaataagggaagaaactttgattatatattttgtttagttaagaggaagagaagatagtgatttcaataaaggaaaaacttttttcttgtttggttcacttgggaataggaaaggttttagaaaataatttattttatattcttataattttgaatttcaaaatatgtaaatatattttactcaatacacttgaaatgttttaaagcatatcatcgatcctttccaagccctctaatattgaataggagaagaatttcaatgaagaggaattttgttttcctccattctcattctcctttctctaaaaattgaataaaaatctatgtacccctctcctctagtttccccgaccaaacactgtatataagtaaacaaatggttattcttataagataaaacaactcagaatctctataaaaaaattaatagaa

SEQ ID NO: 5785 - DNA, 1774 bp, Glycine max
  Soy_ogl_2456 Gm08:1772401..1774174 Cluster 26
catattagttggttcccttaaaaaaacataactagctggttcagataattttatgtattttcattttaaaaaatttgaagagttaattgattttgataaacaccctttttttaaaaaggatgtgcgcaaatccgtcttgtcccagtaactcatctcagctgttcaaagttgattctagctagtaggtttgtgttttagaaatgaagtttgatttattaacccaatctatttcatttctttttttatctgttattagttattaatttactctcttttttttgttattgttagtgatggaaagagattcaaatcaatgactttttttcttttttctcccactcaattttataatttcacctaatccatctcttgactcgatgagttgactcatttgttattcttataatatgaaccttgttcttccacgaaacaaaaacatagttgccttgcatggtgcctctcacattctctctttcagtttggcagctattggttagattttgttttccatcgttttctcctagtgttgcgtggtactcactgattttgactcgtcaacgctagctctctttcaagtcccagttatggtttcctcttgacacattgttgttggtcttttaccatcttgggacttttgagccaatgagtgggtgtgatggtttcgcgtgcctttgaattattttggtttgcaaatgaattattttgattatgagcaatgatatataaatattttatcattttaaacattcttttaatatttttatttttatcttttttttcctatcacattatataatattttgttctacgtattaaataataaaataagtgttcatgcaatattttgttgattattagtcatgaaattaaatgcaattctccttttaaggctaggcctagctgcacgcccttgtccccctggtggattgtacttgccacttgctatcttttgtggggagggattacacgtggcatgtttgtgagagatgaaagggggcccttccaagagtgaatatttgtgcagcattgaacctggaaagaggacctacccttcaactttcttgtttgtctatgagatttgaaggctgagaaaaataaaaataaatataaatcatgttgtgatccatgcatgtgaatgatctaacccgtagtcgtagtccaggctttgtttctgaactttgctgaaaacaggaagcaaattatgacactaggccgtactctttttcttaccataactagcattagcaatattggttgtgtacttttggtgtttctgttcgttcgatactacatgtcttgtattacctccctactatgaatggaatttgcgagttttgaaacatgctaatttgtgtaaaacaacacataaaacgaataagaagtggaagaatcttatcatattttatttgtttttttatccttgattttttttttattcatcccagttgttcatatatttttttaaattatgatctaacggccatcgttattttgtaataactactaaacataaagttaatattatatatgtttgtttagcaaatgagtggctgtggctcacatgcatattcgtatgcaaaatgaaaggctgtgttttcttaattttgacacacatccgtaatagaatgataatactcggagttataaggtcgcagccaggagagagaaaaaaattagtgattcaaatctctttcattaataaaaactaataaactaataaaaaaatgataacttattatgttgatttatctctctctctcacacacacacacac

SEQ ID NO: 5786 - DNA, 1200 bp, Glycine max
  Soy_ogl_2461 Gm08:2058701..2059900 Cluster 26
attagccgaatgccttgtgttttcattgcacacaatcatcatgataggcaaacgtgaatgcatcctttggtgttgctgaaatttatatccgtagtcaaatgagtctgcaaaagcgttgtagctccgattttattcttttgaatgccttatatttaagtgaggcgaatatgattcatgttacttatgaacttgatttattaaataagtttaactgatatatactagtttttttttctttcttcttatgtattatgtagtcttttctgtttttttttcctgacaaaatatgttttattttatttacatgataaggctaatgatacacactttaacacatttctttttacttaaaaaagaaaaacacatttctatttaacatactagtatttctcttgtttatatatttgatccctttaaaagtctcgagtagctttgtttgtttaatctctttaaatataattagtttcatatttggtcctccattattaaatcacaaaatcatgacttttttaagcgattatgtataatactaacttgtaatcttatccctgcatggagtatatatatagatttactcttcacttgatatatggtggactaaaacatgattaaatcttaattaatttcatccgtttaatattatgcctaaattacacttcttgaggctaaatcaaataggccactttacctctgtgatttgtgaaccactgttccctacgcactgatctttgccgcgcgccttcccttattacttgaatgatcagtgatcaccgctgctgccaccatcctcttcacaaatcatctatttgaggagaaagaatatgttgagtcaaaagctggagcttcagaaaatcattcttcataaattattttccatctcacctctcaccaaacaacgggtaaatcaactatttcattcaaggttttattttatattaaaacattgctagttttttttataatttttagagcataataatatttaattgaattaatttcagcattttgtttattatgatgtacttcaaaatttctttattgaaaagagaatgaataggaattcctcctctcctctcctctgtctttaattataaattttttttagagtgcgttttagaggattttaactgatgaaaataatttatcatgaatttctgtaatttagaataatattttttatgaaaaatttaaaattttgga

SEQ ID NO: 5787 - DNA, 1200 bp, Glycine max
  Soy_ogl_2574 Gm08:9239701..9240900 Cluster 26
aataaagctttctcttataacattggtttcatgaatattggatactcatagtcatagccttgactagccatcccaaaacacgaatttttttttcttgggttaaaggcaaaagactcatctaggactatggttagactgcggaaaaagaatggaatcaaatgatactaagttcaattatcaggattgttaaaaaaaaaaagaagatgaaatacatccccttttccttccctccaattcagatagcgataatactgaaatcatctattttcattatagaatattcaaataataaaatagtaaatttattttacttcatcctatttcaatgcattttccttctaccatattccattctgctttaaatttatcattatatacctaaacttgtaaactttatttttattgtccattgtttcttgaggtgaggaaatataggaccagtgtgcttctattttagcggcgcactatgtatatatggaagcaagtgtaactggtaattatacatgaaattgcgaggaacaaataaatcattactacatttttttaaaaaaaaattatggtcgatctatacatgtagttgatgatcgttcaccacatctaggcacaagaatcaagagctcatgccttttatcctatccaagatagctgcaacctgcagttgatggataattttaagttttgatgattttgttttttaactttttgacagagaagttttgatgatgtaaacattaaaaattagcaagtttgttgcaatttaaagcctttttttttccctacattacataataatgcaatggcatactgtcttaacattcctttagtacgtagttgtcgtggtaactcaaccggtttaacaatggtttgacgattcataaattgatgctagcgaaagaaatttaataccaagtagttgaaaattaaatgaaaattttaaaaagatttaaattgtaatttacaaagaaaatgttttaaaaaacttaaatgttttcaaaaggaaaggaaaacttgcaacatagaaaaacatttgcatgttaccaacctaatgtcttcaatcattgatacaattacaagccacatttctgtatttccttttaagaacaattacattgggcatgcaatggaattcctaaacactaccacactaggtttctacaatcgggaagaatcacccttctatgtaaaatgaaacaagttcaa

SEQ ID NO: 5788 - DNA, 1744 bp, Glycine max
  Soy_ogl_2577 Gm08:9273701..9275444 Cluster 26
tacaaattactgttatcctttgggaggaatgaaattaatataagagataaaagtaataatctgttcccccacatctcaaggaaaatttcaaaggtgatgaacactaaagccgtgcagctcgaaatacatatatgcatctcaagacggacgggtaatatatatgatcaattgtaatattcattcatgactattaattaataatattatcaaccagcatatttttatagatgaaacaagctcaatgctgtaagccagtgaccagaaattcacccatatatcaaactattttcaactaaaacgacatacagttctgatgtaattcaagttgcaaaattatttgtccctgaatgaatacatatataggactactgtatgttaagagaaaagactgtgtttggttattcaggtatatattgccaattcataaataataaaatcttaaaatgcaaatgatcaaaatgcgtgggataaagacaataattcatgttattaatttcatcaatctagttaagcatgattaatacttaccaaccaatttggatgctttgttgattactcccccttgaaacaccagtgttgcaaatacacagacactttgtgatcgaagtgttttcatcttctcaatatttttcaatctccaaaagcaagcatagagaagtatcaagtgatcaaaccctttaaagcttgacgcatcatcatcaaatagcataattgggctcacatctaaatcagtttctgagccggagtttgatccactcatgaacaagttcttctcttttctcctacctctttgagcacatagtaccaagaacactaattaagcattataactcccccaacaacagtgacaaacattgcagcccacttgtgatgcctaccaacaactatataagacgctgatgcgaatgcaacggtggtgcatatagacgccaaccacatcatcttgttgattaccttcacaaccctcgtctcagcttcgttcttctctcacaagcgtgatttgaaccaccacaacagccagcgaagtgaaaattaaagcgcaacggcgttgaagacgaagaagatataaaaggggtattgttcctaccatcactgccaccccattatcatagtctccaccgggaacgctgaaaatggcagccaacgcaagcgtggcaaagagaaccgccaccaccgttaccgagtttgtggcgttgttgacaccggctctgttcagcttgcgtagctccatggcgattccgttcacgttcttgttcgttctgcgtgttctagctgtgtgcgaacgtcccttctgatttgtgtcacggtgttcttgatgaactcgtcccttggctggttcagattgttggcattgactgcaccgaaacgaagtagggaaccttttatctctaggatttcttctgatggtggaagggattgagcaataactagagctgttttgtgctcccttgttaatgcattcacgttggtgtacgtctggaaaaagcaatagctcattcaccatctgcatcaaactatggcatcatatacatagagtttaattcttaaaaaacgatccacaatcatgatttagaccataatatcaattttttttataattgttctcaatcacaatcgttattacattagtcagcatttatccgcaatttattgtgatattaacaaatatgataaaattgttacttgaccgcaatcaatatttaagccatcaaatataacaatttttatgtcatcaactaattaa

SEQ ID NO: 5789 - DNA, 1443 bp, Glycine max
  Soy_ogl_2913 Gm09:637401..638843 Cluster 26
gcaattaaagtttttaaaagccaccacccacatcaaattcaaaacagttatacaacaaatatgatcataaaactgcaagatccttagtacaattttaagtcataataaaccaagttatcagatatcccgcagttctgacaatgcagggaaggagtctttaaaagtagtttacatcaaattcaaagaatatacacttccatgaaccagtatttgacaataaaagtgcaaggtcccaggtacaatttgttttgagagtcctacgtaacaaatataatgaaaatattttcaggaagatgcaccaagttctcagataacacaaacctggggtaccaggtaaatctgttaaaactacttgtaatcaccaaccatgtctaaacaaaacactcgagaacattgtgtcttgtacctttgccacttggaacattacgtctatcaaacacggtgtaatgtacaattcattgttccctcttgacaatgagagagaacagaaaaatagcacttagaagtgactttggcaacaacataagaagaattgacttggttttcattatgcaattcaactaattagttatttctcagttgccattgaaacaatttaattttggtacaaaagtctgcgcaaataacatcacttacaccatgaataaaaaaatcaacccagattttacacaatgaatacaaattccagactgcaattcattaattccatctacggtgcacaccaactgaatttttacaccatgatttttaattcacatcgaaaatgcgttcagggccatcatacctaccatccagctggttttccatcatgaatacgcacagtttatattgtagttttcattagggtcatgaaagcattccattccatccagatttgaaatcttggaacaaagatttaaacatgcaacttgatttagggtcattaaggcccaaaattatcatctcttccaatgatgaataaagaattaatccatctcatagggacagctgcacttttccgttttaagggtcagggtcatccttatagggttggtttttatacctttaaacatgcagcttgatttaaaatatgcaacaaagatttaaacatacagcttgatttaggcgaattacggctcaaagttaacatatcttgatgaataaagaatgcatctcctagggacaactgcacttttccaatttcaaggtcagggtcatcggtttataaaccctaaattttcaaatgaataaagaatccatctcatagaagcaatcactcatttctggttacacgttcatggtcagccttatagggtttatataccgaaattttgctgatgatgaataaagaattcatctcatagaggcaaccacacgcgtgtttgcgtgaagcttataaagcacgtccgggttttttttcttccacggacatatgggcctgggccctagccctaaccttaaaca

SEQ ID NO: 5790 - DNA, 1219 bp, Glycine max
  Soy_ogl_2963 Gm09:3279739..3280957 Cluster 26
aaaagtataatatccacccactatatcttttaaatctgttagtttctaatctttataaagtatattgattgtattctatttcagaaaacatgaatgtgtcaacaattccaactatagaaggtatagggaaatgggtcaacaatatccatgaaaacattgtacgagatgaccaagagagtattgtcagctatacaccacacttgggttgagaaattggctagaaaaagaaaggcaagtttatcacgaaaaaagagaaagcctcaagaaacattggtaatttactcatacttagaatacatgttacttgcattattaatcatgcaggaacaatctacagcaacaactgatggtgtacatacatttagtagaagtcatactttaactgagttgttaactgtaaggaacattcatgtgtacaagctgattttcaacctatcttttataaaagtttgtctaactttccttacaataatatgcagcaaccattggattacaattcagtttctgtatctttgggtaatccaatcttgaatgaaagacaatgtgggagtgaaagtcaattttcgattgcaagtacaagtggaagccaagttctgagtataggtgaagctcacaatggaagtcaagttgaaaactatatacactgtagctgcacaacttcaattagtcttgttgatcaaattttttggatatggatttttttgggctgtacacattttttttttttgtgttcttaagtgtagtcaattcataaaaaggatgagaacaaaatctgcaatatgtagtagatcatagaattagtgcaaaggattatgctttgtgttattaactttaaatttagtgttggccaacgattctcagaaacttgcttagcccatgaatccactaagaatcattggtatcagaaaattgagctgccacactcatttgatggacacattaattgttctagttaagcatatggtgagacactgcaacttgtcttgcacatgatcccttatcggttaggtaactaagttatcaataattctagatagcctaccataacattaacctaagaaaaacgtgttgcataaaattttgtatgtaaaaaaagagaaaagaaaaatatgataacatgagtaaaaccaaaaaaaatagaagtgttttaaaaatattttaaataactttatgaataatatatttcttcaccaattaccttcattatctacacgtttat

SEQ ID NO: 5791 - DNA, 1613 bp, Glycine max
  Soy_ogl_3204 Gm09:39770101..39771713 Cluster 26
gaaacaaaagggttcagtcaggggccaaagtgaatgaagaaatataaagacaccaagttggcaaaacccataactccaaattccattagggccgcatataacaatgacttggactgggtcatattcaattagtttttttggctagttgatacattattgttgtactgaaacaaatgatccatgcagacataagaggaaccacctgaactaacagtcttgtaggtcaacgcagccatgagatcattgaccatatcgtccacaactttcctgtcacggacgcacaacccaagtttgaattaacattgcctttcatattacggctatgcataaatgttgccgaatgccgacaaccgatcaatatatacttactattcctggttgattcaacaccacatgctcttgctttcgagggacaacacgttttaaatttgattaccaaattaacacgacaaacaatgcccaaagagccaaaacaatgctatttttttaatatactacaaaagatctacattcataacttctaagaaatcttgaaatattacatgaaaacatatcggattagcaaaatttattttttgttttattattgtcttattagagtctttttataaagcgactaaatttttagtttttatttattttttaggttcgtattgtattctggcccattttaaagtttttaaaataaaattaacttttcattaacgtgatagaaaatgcaaacaacacgtaattttcaaaagttattataagtgtttttatgatattaattaaggaaatgaatatatgtgaagttaatgaaaacctaaatattcaatgcataaaaatatagaaatatttaattattgattgtatatacacctaaataaaagctatcatttctttttattgattgtatatacatgcacctatatttttcactattttaactctgtcttccaagtgtcccttaatattttgggtatatatccaaatccaaatattacacattttcctttagatcattagcacattggttatcacgaagttgcgggtgctctaactatatcgtaacatatatgtttccatttcttaagtgtagaataccatatactgatgtaaatattgaactaccatgcataataattaaataaaggaaaacgttgttccaaatatacagaaggaaactgccacatgacgcaactccaactctcctaatccaaggaattccaaagatgatgtgggtgggcaacactctgcaccaactatgcaccgtactgaaaaattgattatagaagaatccaaatagatacagaaaattccatatgattctgttatttattctggatttcaagtgtgcctggagaggacccatggtgaagacttaaggaaactgcagacgcatctgtgacaacacggaaccttctagatcctcgaacgtgttcagtacgagtgcacgtgctcgaagcgactcacgtgtctccaagaccacagaattcataggaaatgctatgtcggattcagttccctgacagaaactcgagagatcccgacaactgtgcacgttttctatgcctgggatacctgttatggcgcgatccatgtcttattcacctttcaacagtttggattaa

SEQ ID NO: 5792 - DNA, 1100 bp, Glycine max
  Soy_ogl_3227 Gm09:40339211..40340310 Cluster 26
gattgcatgcataattaactatttaaataatctcgaaaaataattccatccaacaaattacaaatagtaaatgcatttacattttgtttgataggatccgggagataacagggaaactaagaaaaggagaaggaaatagaagggatatgcaaacttgagcttatttggtgaaaagggaaacatgatagaaagaaatttaaagttggtggagcctatattaaaaaattagttaaaatctaatttttatcttttctattttatcctatccatattttttgatcttttaactataaaattgagataaattgagataattagttcctatgttttttaaaaaacgggattttggtctctccattaaatttaatggttgaccgttaactttttgctttgattgttaagtgagttgtaatttttgttttattttttttaattaacatattcattggtagaccatttaattttaaaaaaatacgaaagttatgaacagaaccctaaagtctaatcttctccccctcctcttcatcctcccctacggtgttgatgtttttttaagcttcatcttcccctaaactccatcccctaagcttcatcttgctggaattacgagggcagtgatagaggacaaaattacgcaagtagagtagatatttatctttctatggtagtgaacattcgaatatcaaataatgggagtttggattttaccttagatggccttctctaacacccttcttcggcgttattttacatgtttgaagaagtcgaaaggacctggatgtggagccctacaacttgcactcattgtgccagaattcataggcaaagtagacggatgccatggcaatctgagtctcatagtgaagacaacgacaccataattggtgcagcacctgcagataatgacaacaagcaaaatgcaagaaataatggaaggttcttggggatgttaacgtaggaactatgagagaaatattatgttttttataaggaagttcttaacttgatgtactgaattaaataaatttatgccaaaactagtttcatctggtccaatagtgaatcgtgtaagttgttttcgactagctaatcaatcggaa

SEQ ID NO: 5793 - DNA, 1506 bp, Glycine max
  Soy_ogl_3287 Gm10:774195..775700 Cluster 26
catgactcatttccactgaagttggaagtcctaatttacttggacgttagaccagagaaggcaagagggacggcacagacacacgtgacgggaaaggccatcgtgtttgaacaagatgtctatttcagcgcatgaaaccatttcatttagggaacctctctttactaactctagtttatgtatttatttggggatattgacaaattcgatgatcctaatagctctttcatctctttgataaaaatcagatatgcaaagttaactctccaaattacatccacaataggacaccataaatacactgattcgtcctttgatttatgttgattttcagcaaatttgatttatttttgttttactaatcctttcaagtaaactaatataatttacttgatggtcgtgttagtaagtgtacaaaattgctcatgtttgtaaattgtgagttggccaagcaaatgacagctttttccgtgcattttggttattgtttggggggaaacttgaaaatcttttccacctttttattgcaagaaattttcctatcatttgccattacctttttgattgacttggttttgacacatctgtttactcattttgtgagtccaaatggcaccaagatggaatggaaaagatgcaaaagctgaagcattcaaggaacccatgtcaaagattgtatctcaacttcagtcttctctagtccaatcagatacttgtggatttttctctggtaatagtgtacacatagcattgctatttgtatacgaaccagaattaaaattaaggaaagagatgttattccactgctctagttgactgtttgaccatctcattttgactgctccaattcaattcccctaatttcacccttctccaaattcaaatcccttccctaataatggcaaagtgatatataaaagcagaagcagaaaacgagtcctgggtaaaggagaactcaccagaaatgggcaacgacgagttaactttgcatatctgatttttatcaaagagatgaaagagctattaggatcattgaattggtcaatccccaaataaatacataaactagagttagttaagagaggttccctaaatgaaatggtttcttgggctgaagtaaacatcttactataagccatgtagtcaatagcaccgctatttcaaaaaattaaacatgtaatagtttacaaaattgtagtaaattttcaataaactaagactacataaagattgcgtatgcataacgactaaatcaataattaaacaactagacaaactgttacatgaactcttgaaagccattaaaaaatgagcactgttacatgaacagtagagacgggaaggcattaaaaatgccatactgcgcccccacctgcacccccttgttctgctcccccatctcaactacctagtacctactttctgaaaattattagcaaatgatttaactgagcagagtaaattttgagcatattcatttgttttattagtactttttatttaaga

SEQ ID NO: 5794 - DNA, 1100 bp, Glycine max
  Soy_ogl_3600 Gm10:47071201..47072300 Cluster 26
cttaaagacaaaattcaatactgttgccatatttcatttttgcacgtgacattttcatttttttaactggttttttttttcttcctgaaacacggttcatctgctgacggccaaatttattttatgttgtgtcttcaaaaagttgtaaggaaaaagaaaaaacaactgatcgtttgttcaggaaaacatttttttattcattttctatcacacttcttttcttttttttattttgtttcttacttttaaaaaattgtataagaaataatgaaacaactgtttctgttactttttactgttttctatttgggaaaaaagaaaagaaagtgaaaattagataacatctttgtaattgaaagtgaaaacagattttttttttttgtagttatcatttaaaacatttacgttgagagaggaaaaaaaagaagacaaacacaaaccaaaaataacttaattcccagaatttctagattttatatgacctgtacatggttttattttactaataagtacaaaagaagacatgaagtttacagaatgcgaggttatatttttattaggaaaggggtatctcttgaatcttatcgaatgcctgtaggctgcggatttattgaatcgtagagggtgccatctattcaccacttcaaaaatggtgcttccatccaccatgacattttaaaaatgtgtggttctcattaatgacttcaaactcgataaagtggttaggatatataaaatataaaaaatgttatacactaagaatcccaaaaattaatgaaatttattatattttatttgtaattattgaataaaatggtccgtgtagtgtgctcagatatgtgagtgacggtggtgtgcatgcgacaatgtttggtggttgggacgatggatgacatttcgaggggctagcaccaacagtgagctgacccagacccacaaaaaccctagctccaaccccctaaaattattaaatgtgaatttgaactgaaaatagcccagggggggactagaaattcagtggttaaggtgggttcaagcccttaaccttaacccattgacagttatagttttgcactagcttagactcatggtataaggaa

SEQ ID NO: 5795 - DNA, 1664 bp, Glycine max
  Soy_ogl_3647 Gm10:49168301..49169964 Cluster 26
aattagaaataagttttttttttaaatagtaagtaatacgtctccaaacattgtatgggtcactatattagtataatatatgagaatttaatagtaatagctggcaagcatccataatgcggtgcatgaatattgtatggatatttgaaaacgcaggcgaaaaaagttataatagtaaaaatatgaaaatactcaaatgcaaatgattaattttgatataaaaataaaaactaaattaattgatgggatgtgtttacccttatgactaatttattttcattgataaataaacattttaaaagtaaaaaaatcttataattttttttatttgattaggtttaacaatcttactgcgtagggtattaatatactattaaactatattatataacaataataatataaaaaatgctatatcacccctttaattcagtcagagaaagttttagaaataatatagtgaacacttgcttggatattttattcagtcattgaaagtacaagatatatttttttagtcttcatgttatagttaccgatcctggttccagtatgttgacgtcgtagtgcttcagcgataactgagctccaacgtgggatctcgcaaagatgaaggagttccaactcggacactgaattttacggaattaattaattaagagtcactccataaaatatttctcccttttttttttaatttattttatcaaatgccaaacacgtccttaattcttattaactagaagcggtgaccttaattactttttcagggttttgttggctaatgctctaagactggttaaatagtttataataaaacctttttattagaaataaattaaaatcgtcagtttattattctattttttgtttaaccgaagaaaattaataaatgaacgtgcgtggagagtgtcctatgacatgtttggtaatgagttgaaaagtaattttgaatatttggagagtaaagtcattatgatgcagtaacatgtgtgattatcctcaaaaacgtgtttgcaaataaaaattatattgaaattaagttttgccaaagaaaaaatttaattacttttacaaactcaatttataagcttaaatttgaatacttgaaaatctaaacatgtacttggtcattagtgttgtaaataaataataagggttgttaggtgcaagcaagaatcataaattgccatggatcatgttggatcatatctagtcattatttaatactggtactaacacgaccggtattagaagatcacgtgatgcgagcgtgtgtgcaggcagagtgagagtgagagtgagagtaagatattttcacttgtcatgatgacgggtcacgtgactcatggaatggtcttatatatgcacatgatgaaggatgagcagcatagagagtgtggtgtggggtggggaaaaaaggggaatgcatgtgggttacggaagtgaatgagtgagaggtgcttgcttcggtttcccgccaatagcgccgacgtggaacccatctttggcgccaaaaatgtccgcaagacgcgccacacgtgctcagtgatgggacaggtgtccttcgctgctggctgcacccttgtcaacgactcaccaccatgtatatgtatgtctctctactctactacctacgtagttacttgttaggctaaatactc

SEQ ID NO: 5796 - DNA, 1625 bp, Glycine max
  Soy_ogl_3664 Gm11:438501..440125 Cluster 26
cagactttcataagatatatgatcttgacggcttagatcattattaaatcacacaaaatcaaaattagttggttcatggcatgcaaacgaggaatcgatcgtagctgagagggtaattaaactacgcaacaataatgccaaactaataggtaattagtttaggtccttttggaaattaggaccctttggtcagtttggtgagtgggaccaaagcctaatggaatcacatatatttttagatttaagtaatctcaactaggcatctttatcaagttcggttgacagggaaaatctctttggctaagtaaaaattatgaacataataggacacacgaatttaaagtagcatgcatcaagacaaaattacaaaataaattactgtaaaacttgtgaagaaccaatatttatcctcaccacgaagatttgtattctataactggacactgggaatccctcgtgcatattatctttcttatgccttaaatccttatttatatacaaatatgtaaatcacaacacaagactgaaatctataattttctcaaactaagaattttgcttttgtttggaaaatcacttaaggtggaggaacaatggagcgggaaaagaataattatttatttaatgtacgttagaatgctaattaattaatttatacaattttttaatgaacaaatttaatcattttaagaagcttttgaataaaatctctctctcttttagatgcaaaataaattaatttggaattgaatatgcattctaaggtatcacatatatcacgtttaagctcattgtcaacttcattcctcccattttcttttcttcttagcaaacaatcatttaggtacgtacatttaaacatcaaaataatctttgagcagaaactaaccatcaaattttactaaattttgaattcgggttcattttttattttcaaaaatagatatagagattttagcaactaaagtattgagcccatgcaattaagacaaatctcgaagcttttctcgctacaatcacactagtactgcgatgtgctcgatcggttcaaagctggaaatacacacaatacatgaaccatccaataagaacaaaacgcttatgcaaacgagacttttgagcggagagagtttggttttctttattattctggaacatcaagttgaagaagcaaagcattgtccttccatatgaaatgccgcagtatcattttcattccgtccaaagatgttgtctggtaggtttccggcaattctggtgaccacaaaatggtgtgtcctagtaatgtttggggagtataaaaatatgtgaaagtgcgtgcttaaaaatatatttaacctacactgtgtcactccacaaaaggccacgaaagtgggcaaacaccacaatacaatgccaaattactctattaatattcctaaattaaatttattagaaaaaagttgttttttttcaattttttttttgtgcaagttactaacataatcaaactaaaaaagagatctgaggacattagtgtcataaataaatagatagatagagagggagagagagtgaagaagtctgaggacattactctcataaataaatagatagagagaatgagagagtaagagggggattaa

SEQ ID NO: 5797 - DNA, 1588 bp, Glycine max
  Soy_ogl_15 Gm11:1376513..1378100 Cluster 26
aaatctttggaagaataattgggtaataagattttttgaaagattaatataatactaaagtctaaatttttgaagaagattaatttaataactaaattttacattaatgtaatgatacatgtagttttagaaaacagaagtgaaggttttctttttttgtttttttattaataagagtggaagacaaataataaaaaattataataattcagacattgtgtctaagtgcaatgagtggggggttcgaccctacatgcggttgtctaaatctggaacaaggcaatagtagtctttccccttgtacagaatctaacatcacttgatgattatattgatcatttctctaaacacgtacaagatttaactaaagttgtttatcattaattgtcaattagttattatttcagactataagcgatttaagaaaaacaaaatacccgaatttcatcgcgctaatcacctatagtgagtgaaccgttgccacgtttaatagacacacgctatagtgttcaagatttgacaatggaattttgcattgcgttttgcgtgcaaatgtacttaatttaggtaaagtttgatttcctttattctccggggcctagatgtttccaacccatctggaaaagtatcaagagttagtgaagtggatctgtccgttattatcacaaaagtctcgtccagtatcatctgaagatatggaaataaataaatcatcatagtccacttgcgaatctgtgtgtagagtgcactcatccaatactacggaaacaatatgttaggaactagtcaatacaataggtggctctagttgtttttccttctaggagccagagaactgaggaagtgactgaaattggatgttcgtatatcataatgctgcaagggagttttatttgaattgatgtgacaataataacgttatcattatgctcttttctttattagtggagaacatggaaatcatacatatggtctccttatttggtatttaatttctaaactttagtgaatggcattggttatctctcaaatcaatattcaagatgcttccattaaggcatgatccgtatgcaactactagtttgtttatttttcgaaagaaaaataacattttgttcaattcggattcaattaaaaatgttagatatatctggttgctcggtccttcttggtcaagtttttatttgataaagaggaagcaataagaaaagagaacaaaccttcgtggaccatgcaagtttaaacgagggtatgaaatgtgatcaaacctcaaccccacagatcaccaatggactgtttagtggagagagaggatgggaagaaaatataatttttcctaattaatagtgaagatgggatctagataaaagttacagaagatttgatttttttcttgtctccatttttctctataatttttcccttatttttttctcacttatttcaatcttctccatgatatttcccctttactaaacaagggtacatcatgtatcacgttgtgagaaattaatgttgatcttaaaacctttcgagctaaatgttgatcttaagtacaagaatgctaacttttctaaaatttgcttta

SEQ ID NO: 5798 - DNA, 1621 bp, Glycine max
  Soy_ogl_3696 Gm11:2625242..2626862 Cluster 26
gaacaagacccctattttgaggaggtgaggcccaattgtaagagaacttctgattcgggttgggtaccaccaaaaagagatttaaccctatctctagaggaggtcagttacgcaaatcattggaccaaatgagcctaattacaaatgcaaagaaaagctgcgattatatggtgttttgaatcagagtggcccgaaaggaaaaagaaaatctcaattttgtttgcacttagcagtttgctgaagaaatgattaagctaatcataattttgaaagcgttgttggcaggggagatattttcaaactattatacaacatgatcatgttaaaatacggaagatctgcaaagacccagactcgtaacgtcaatcttattgacattctaacagcaacttaagacacagtttgttctaattaggatgacaggaatatgacagaaagcagataaactatcttactcaactcctaagaaaaataccattaaaaacaatatagaaaacaaccaaaaaagataaaaaagaattaatataaatttcattaatttcttattgattcattttctaaaagagaaatacatttatatagatgtaattgatgttaatcaatggctattatctatccatgtgtcaaaatttaattatttatactaaaaataatacacaaatatcaattctaacttatataatcttttaaccactttaaatttatgatatatttgagtcttttaaagtccattttaacagaatagtatgctccattatatgtttgaatatttagttcactttgctttcatgtttactacaattaaattatacccttttttatatatattttatgatctgttctggacggtctttgtcataaaatgcataaaacatataatgaaacgcctgtgtcttatgtctaccaaacgtataattttatagatttaggctcggggaatgccgaaaatttacgtgctaaaatttgagtacaaggctaaccattatgtagaaatataaaaacaagagagaatagaaaataaccatgcatgcatatatattgtgtaaaaatcgtacaggaacagaagcagttaagatatggaatgtatggaaaacagtgttggtgggttaggggacttgaacaaagccttctagcatttgcatgaccatccccattgttgttcccatttcaggttgctcatgtatgcaccttaatgctattttgacccacttttgtaacctgccattgtcagataagacctcctcattattctccaccagagcatctattctcccttccatatggcaatcagaagcccaatctgtcagtattgtcttctcttcttcccctgagtccaccatcaaagcacttcttgtgcagcgaataatttccaacaacattacaccaaagctgcaaacatccactttaaccgtcacagcaatgttcttgaaccatttaggagccacatatcctcgagttcctcggatcaaccggtacaaccttcaagagaacaaacaaagcaaccgtagccaggagaatactgttaaagacaggggagccaataagtgatcctataagaattggcttagctcgatcttctttcattgaatcggcaccagggggaagttcctcgtttggacct

SEQ ID NO: 5799 - DNA, 1144 bp, Glycine max
  Soy_ogl_3723 Gm11:4265357..4266500 Cluster 26
tcactttggaataatgctttttgttcgcagattagtttttcattcacgagaactttgcacataaagatataaaaacattattggtacaagattttattgggtatttagatgttcgtttgagggcaagagacatgcatacataagaacagtcaacgctaacttctgtgtctttttttttttttttttcttttggaatttgacgtgaatttgaggtaaaaaatgtaagtactatttaacaataatccaaacatatgcttgaatgacaataacattgacgtgtatgtcccgaaggaagctaatcaagttgtagttgctctgcaaaaatatggtctcagtgtgcacccatatatcacatatatgctttctgtatttagcgttgtttggttttgggctttgccttttcattaaaaaaaaagaagagagaggcaatttacataaaatatatgtccaaggcataagcgtaaaatgcaatttttgtttgtgctctcgtgatgttaatgcagctaattgtctccaccaaaagtttaccatctccggcacttttttcttctccttacattcataattgcctccaccaaatgtcagcgttttttaacctcgttttttggacaaatttatataaagaaaaaaggaaaagctctcgagatttcatatctggcgtagctccaattgggctattcctgcaggaacaaatggggcagtggcttcctgcactttttctgaaatatatatatttttttaccttcagaattaaccattccagaagccaaaatctgtaattaatctgaaatgtaattttacatttcagattggtcattacagaagtcgaaaaagaatgcaggaagcaattggaggtgcagaaaacaatagcgcagaacaaatggtatcactgcaaaaaggttacatggggctgctagctttgtggaacatgaagttagacattgataaaaaatatgggctaaccggcaaagtttgggtggccacatgagcataagccgattacgatttattagcaaagtttgtaaaagaaactgtccgggcttctactctaacgggagaatagggctctatgtttttggttcagtggagaatatggcttttaggcttattggtaatggaccaagaaaaaatggcccattagctt

SEQ ID NO: 5800 - DNA, 1200 bp, Glycine max
  Soy_ogl_4504 Gm13:37099901..37101100 Cluster 26
gttggtggcattttcttggtgacaagaaaaccacatggtcaagacaagcaacgtaaagtattagaacacagctaaactaaggggcaaaatttgatcactttggcttatacaaatgctttcattgcagatttttgttagagacaaagtaaggaagaagtatgaatatccatggaatgccaaaaaaggcttcaagtagtgtgcccaaatggcagtactcttcttccgtcacaaccaaaatgttgaataacttgaatcctatatgccaagctactcaacaattaactccaaggggaagcttgtgatcacacacaatcatagcaaatcaatatctggaaaattaatttctgttcagatttatagtgggacagaggtggatcccggtaaagttgtctgcaaagagagaaaatataaagaaaaattggaatcgaaatcaagtaagatcgaataactttttgattttgtagacaaggagaaaaccgtcgtcgtagatgggagatcccgtgagcttggccttgttgacgtcgatcggaggaagagatggtgacggtgagatactagccgaggagcatcggcggggagtagtcggagggtcgccggcggtagcggggcgaagacggtgattgaggctcaccgtcgttcacgatttcagagaggtcgacaagaggagggaaggttcgaaagaagaagagaaatcagaatagtagggtttcacaattttattttgtttttgttttagttttagttgtggacttgtggtacagtggtggttgcatttggtaacatttgtccgtaagcaataacaacatttgttataatgaatgttagtaaaaactgtatttaataaacaatggtaacatttttacaaatgttaccggataaatgttgcaaaatgtgttatatgtagtagtgctataataattattcaattaaaatttttctactttatttttgtctttttaaataaaattatattaaaaaaatctgttaatatatagtaaacaccctataattaaaatttgccgaatttgcatgatgttttatatacttaagtcagtgactcacatcacctgttgatatttggtttggttttcggattcaatgatgtaatcatgtaagccaaagaatacccccttccttcttgttttgtaatattaattacgttgaaatttcaatgtcgacagaaaggatggttgtttgtac

SEQ ID NO: 5801 - DNA, 1328 bp, Glycine max
  Soy_ogl_4800 Gm14:47069473..47070800 Cluster 26
aattagctttttaatcacatcatcacgtcacagacattaatcgttccgcaggtccacctggaactaattaagaattctgataacattaattcgctgtcttcaaacactaccatcttctggaacaaaatgggcactaccctgtaaacttatggggtcagttacttacaactcaccacaaaactatataaatgggaatattttaaaattgttagagctatttgataggttcacctagcaatctctagctgaaaattaaaatttaaatcttaatatataaaaatgaacactttttacactgttctagtgttatccaatagaaatcttatatataaaagtgaacaacttagcattcaaagtgtaatgtaatgtgagttgatacaagtgatgatgaagcaatttggagttaattttcatccttttttttatgaatacgaggttgattctcctagctgctactaaaactttatttgatacacaattcttaggatgtgtttgtttgtagtgaaaaagagtaaaaaagaagagtgatcgataaaatgacatgaacctatacttgtacactttactttaatcttaaacttttatttcaattcacttttttttttcattcattctaccgaacaaatcttcagagacaacctcttcatagggttcctctaatatttaggaactattttgaattatttaaggtttaacaataatactatgagtaagccttttgtcgacagggtcaccacgccattgaggtcatgcacaatgtcactcattgccacattgatgcttctatgagtaagcctgaattaggtaatggccacattgatgcttctaaacatgaaggcattgactactttcaatggcttgacaaccaaccctctggctctgtgttgtacattactgaagggagttttctttaggttgaaagagatgtgtggagataagggactagttttgcaatggtgtgatccattgagagtgttgcagcatcattctattggggttttttaggtcttattgtggctggaattccaccagagaaggtgttgttagtggtgttcctttttcggcctttccaatatttatggaccaaccactaaacggtaagttgatagtagaggaatggagggtgaggacaaaggttaaagaggacactttgataacaaaagatgaaattgctaatcttattaagaggtttatgcatttgggtggggatgaagtgaggaatatgaggaaaagaagcagagagatgaagcaattatgtcatcgtgtaattgctagtggtgggtcatcagaaactaatatcaatgcttttctttcccatgtattacagg

SEQ ID NO: 5802 - DNA, 1400 bp, Glycine max
  Soy_ogl_4802 Gm14:47461801..47463200 Cluster 26
tgagtcagtgcatagaatgtagaacacaaattagacgaagaaggaaaatgtgttgctcaaagtggcaaactagtcacatatatgaggttgtcgcagtggcaatcgtaattaatttgagaaagataaaaattgattcactattaatacataaatagtgtgtatatataaatacattttaagtgcggtcagttaactactttttaacatcatgactcgaagtctttatcctaaccacacaaatcaaagcagctaattggaaaaaaagaaaagaataacattcaaaatttgataacgataaaaattatatcctttgttttgagtccactaaaaaaaattcacaaaatataatgtatatataccttttttatatacattatatttttgaaacatttctgataggatcttcttttattacagtattaatatttcagtaaaagctggaatatttatttttgaaacgtttctaataggatcttcttttattacatagtagttgatagtggtagaagtagtaaaaaaagaaaatgactatctattagacccaacagaaacgcttcacacttgtagaaaacacattcatcatgggttgtaaaacttgttgccacacttgcacaaccacctcagtgggtagtacgtaccaccctcattatgcactgagcacagagttggtttgcatggtgtacacttacaacacttggagtgacaagtcggtggcactgacccaggcccacttagaattcccctggacaagcccaagttcattgagaagacctctattttacctttagacaccaagctttgtccaatgtttcccttaagttcctgaccaacaatcataattaaccaataataagtgctaaattaagataactatagtagtaatatcctttcttttcatccagcatcaatcaaattaatattatcaaaaaaaaaattaaaaacaactcaaaataataataaatttttaactattcataaaataaccattaattaaaaataataatcttgaagttgaatccatatgttttctagtatggtttggttgtggtaacatagggtttgtgtttgtgtgtgtacaaaacgaggctaaagttcactcttaagaaaatcattcgaccataatattgtgtttgcggcaaaaacgttgggcattgcacactgactaaaatctaataattatgttcatcaagctaccattggagttagacttaggtaggttaattttaattagttatgtgatgcagtatttttaaaaaaataaataaatgctacatgaaataataagcaccaaggtcatgtaaatataataagaaattaaagcatgtgtataggcagagaatatacaaccaaattatacctcaaaatcaatatcagcattggcaagcatgggacacctagta

SEQ ID NO: 5803 - DNA, 1429 bp, Glycine max
  Soy_ogl_4833 Gm14:49033692..49035120 Cluster 26
tttttgttgattggtaagttggtattaaatgcatgcgtgtcaattttgattgatgctttgccaagtgattcagcaatcttactgccaatacagtaagatgtagactgaatggttaccatgggttcattcagcaatcttactgccaatacagtaagttggtattaaatgcatccatgtcaattttgattgatgccctttcacctcaccaaactcaacactttttccttttgtgctcttctcatttatgtctactttcttcatcaaatcttgtatggtgatttggaggtttctcaactcctgtgcatcacaatgaagtctttctaaaatcttgctttggttccctatttctccattctttgtgaaaggaaaaatctaactatttcatatttctccattaggggtacaaataatttgaaatgtagaagaaactaaagaccttctcttttagtagtgattaagtcaaattgaatacatatattataagtggaaaaattcttgcttaaagtatttaacccacttccatatacttaatacttgaattttaagactattagttactccatacacttgattgataaaaatgtctgtaaataaacctctaaaatgaatagaagttctttgaagtatcaagcacaccaaaatatactatacctcttcctttcttttttgttagtttttccctcactctttggcagactccacatgctcctagagagaggcccaagccaaatacccacccacgttattgtgtctgcatacaagtgctatgaaatgaccacagcatatctggctcatctctgacccacgcattcacacacctcacttccctcctttttctttatgttcttggcaaaaagtttgtctcttttttctccgcttccctaacaccttagacccttcacctttataacgaacattattcagacatgacaaaggctcgacaatacaacacatccttttacatctatttatgccacttgacccgatgggtatataggtgagtttgacattaattatgagaactggattttttttctatctttccttctcatgtattatgtttgccaaatgaaaattttcctctgcaagggttttactttgttattttttcaatgtgctgcgtaaggttgcatatttatgttctcattaattagaagcaaagaacaattgcaacctataaaaaactgcatttttattcatttactccaccctcccccatcatttccactatcatttcccttttttttttcataccaagaatttaatgtgaacaatataaatacatgtacatttttcttttactggaactggtttcacacagcccttgataagtccagaactggtttcttatgtattttaacaactcttatctgtgtcatgcactcagattttgacaccccaaattccaccctttttttcttacgtaatg

SEQ ID NO: 5804 - DNA, 1100 bp, Glycine max
  Soy_ogl_4876 Gm15:2647001..2648100 Cluster 26
cactgacagaataaaaactacttgttaggtttacttctattaatattggaaattgatatacatcattaatttatattgttagcttatactccatgtttatatcattataatttaattttatcaaactgtcgttaaataaatgatgaattcaagtgttttaagttttattggttaatcaataaattaagaaaaaaaacatttggcagaaatcatgctgagataatagtgtaacaaatttcgtcgaattttgtcttatatcgcatttctagctcttttcattaaataaagttcagaccaacaaaaagtatatatctaaccactaacattgtatttcgtcagtaaataacttttttagtgaacaaatcaatgtccttagagggtgaacttagatgcttcatgccttcattggtactgataaaaaaaaatgcttcattggtgaaaaagatgcttcattgatattttgatttcaatgataatttatttattattttctttatcaacaaatatatattaatcgttaatctttgttagaataaatgttagtgaaagattaggagtctaagtcaggatttttcttttccttctcccttcaacctttttttaatcattaaattataatttcatttagagtttattatcgggtgcaaaatgaattgtgcacacttttccattctacatatatacaggctttccgataacttttcacatccaaagttaggcattctaatttcttctaaaaggcttggactaaattcttcctagttattattataccaacagctttcggcaacttcctagttagtatacacacactttactggtgtacatatgaagacataaggagttagagaagaccttcaaagctggcatggctacgagatggaaacaaagtcatcatctcatgcatgtagcttttgttgttgagggctaccgcaagcatatttcaatagtcacctcttgttacttgctaattactaattgctatccaaacacatgcaaacccaataagtgtttgggttatgcatgaaagtgcattcagtgaacaaaaacttgatggagtcagacagaggtagaagacaaaagggtatacatataggtcc

SEQ ID NO: 5805 - DNA, 1500 bp, Glycine max
  Soy_ogl_4880 Gm15:2877801..2879300 Cluster 26
tttacttatataggactctaaagaaaattaatattatatatatatggatggtttatccaacatttcccttaattaaacacatgtcatctaacgagaacttataataattaattaattggtttcatatgcatggacagatacattcagcctaaaggtgaaaccagggaagacatatcttctccgtttgatcaacgctgcaatgaacactgaactgtttttcagcatagcaaaccactccatgactgttgctgaagccgatgttacttacgttaaactccgacatcatcctcattgggccagtacaaacaacaagcgtagtgttgaagacaaaacctgctgagtacacaaacgccactgaattcttcatgctagcgaggccattcttcaatggcaagggcaccttcgacaattccacgttggctggcatcctagaataagataatgataacgatacccctgcttcaaaccatctcatgttgaaaccgacccttccttatatcaacgacacatcctttgtttccaatttcgcagtttgaacagtgcaaagtaccctgcgaatgtgcccgaaacagttgacagaagcttcttcttcttcaccgaaacatgtgaagggcctaataacagaacaaaattgtctgcctccatgaacaacatatctttcgcacttccttcggtggcgattcttcagcaacatttctcagggaagggcaataacggtgtttacaccacggacttcccagctgttcctctgagagcctttaactacacggggactccaccgaagaacaccattgtgaaaagaggaaccaaagtggtggtgataccctttaacacgaggatgcagttggtgtcgcaggacactagcattttaagtgcagagagtcatccgttacatcttcatggtgggtcaaggttttgggaactttgatgctatcaaagacactgcgaaatttaatctagttgaccctgttgagagaaacacctttggtgtgccttctggtggttggtttgctattcgctttctcgctgacaacccaggtgacttcacttcaaagttcaaatgagaaattaaatgtttaatcatattatgttctttaagttttaacttttaatttaattcgaccaaaacaaataaaaaaaaagttgcgatttaattatcgttgagctagttgtgtatctaatttgatagtaaggggttaaaaattaaagaaaatgtttgatagacacttggcaagagaaaaaaatacatgcagacttacgcccattttcggaaggatgatgaaaagcaagttagttatccaacttgaccacccttttcacagtgtatatttattaactacagcatactcaaaacacaattgctcgtggagtattggaccattcccaaaatacaaacgtaatggaaggtaagaacacgaatgaaaataaacaacataagctagaattattgtcaagtatgatcagtttttattagtgaaaaacataaaaacaagattaatt

SEQ ID NO: 5806 - DNA, 1145 bp, Glycine max
  Soy_ogl_4896 Gm15:3842100..3843244 Cluster 26
gcttacaagaagaattacctaaaccgatatcgaaaattggcttttataaaacataaggttcaaatacaatagtacttctgataacccatacaaatttgtggaactttcttattgtccaagaaaactcgggagcatggtaacagtatcgaagattacatactctacttctgaattctgattgaagtcagcttctaagacaagtaaagatgtatgttaatgttggtccataaacttgacccttcaatatttaatgtggctccttaaaggctgtgtaacgttatataaatcttgaatgtagcggtacctgttgtttcttctccttaagcgttcatcttcttctacttctgccaatacatcctctacttggtgcaagtgtgtgcatgtggtgctattgctaagttctacgagctgcctcgccgcctcaatctccgtttgggtgaacatagaagaacccttcctcttccacttcttcttgttttcgcatgccattgtgagaaagaaaaataatggtgaaccaaaacggagcccaacattttgtagggtttatttaaaattgttgttaacagcttactatatatactatacgtcttcccttttctctttaatcttttctttacttttttccttttctgaaaatattgctttattgtaattgttattgttcatgtcaccatcatgcttttttttttagccaatatcaccaattcatcatcatgctttctatatttataacacgtttacgtgttgggttgtaaatatgcttctgcaagttacttaactagtccttcattgataaggattttgatttattctgatccttcctcagaaagaagagcaaattggaggttaagaataggactcagtatgctttcaaccagtaatagaaaaaagaactgcttttctattttcatctataaacgatttcctactatatgattttttttagtcttgaccacatcttttttgggtacgttgtcgtgaatccgtttgacccatcatgagaaagggtgagtctagagcatttagaaaaattgaattaaatattagatagtttgaaatttataaaaattataaaatattttttattaaatcgggtcaaaccaaactaataaagtgtaacaaaacacacgcgcacacacacacac

SEQ ID NO: 5807 - DNA, 1497 bp, Glycine max
  Soy_ogl_4911 Gm15:8338704..8340200 Cluster 26
aaagggcaaaagtttagaaggactaaaatttatttaacccacaaatattttaacaataagtctaacacagtcatgttatcttgaaccacttattaattgtttcttacaagaacattgtgacaagtataatgacattacaagaagcaattacattaaattgaagccaagggaaatacctttgcgaaatactttgcaggattctctgcacattgaactattgtcagaagtgcatgagcataatttcctgatgtttcattctttactgcctgatataaattcagctaggataagcaccgataaaggaccttaggagagactacatacaaaggaaataaaagtgataaagataccttttccaacgagcgtccatacatggtattgaaactttgaatatcttggaagacgtgattagtgtagagactaaaaagaatgaggcagaatttttacatccatcagaaatctaaaacaaccaactgaacaaggtttccctcaagagacatatgcatgaaacagaataaatggatagacctcctggaagtttctttttatcagcagatagaccaaaaacttagtcaacatccaatccatagttgattttagattgaaatcttgcaactgccaacaggcattcaatctttttgtaagtatccaaaatcattttgttggccttgtagctatattcttaacggagtaactagagacagttgcctcaaatgatttggtagaagtcattcatcaataaatttatgagcagaatacagagaccacaagcaatggctttattggaaatatccaccaaacatttcagaaatatcttaatataactttgatgaacatctggagtcttgttgtggttttaatttttttgccattcctgatacttcaaataaacaaccgaaagtgcctcactaatgccgtgctctttaacaggccagcatatagaaaccttaatgtgactaattcgtgatagcaaggatgtctttcatggaagctaaacacagagaagaatcacctttttatgatccccggaggtgcattttgcaatgtcatcctcaagatcaacaccaaatttaaaatggtacatctgccttaaaccttgcagctgggatgaagattgccaacatcatgacttcagtagctgcgtcaagatttttggccccacatagagactccttaaggattattgcatcacgttcggcagggtcatgcatccagagcagaactccagtctaatcaccggaaaaatataaagccaaaccaggtataaattgttaggaaatggaacatatccgcttcacttgtctaaattctgagttacatacagtttggttaattggctagtttcgtaaaaaaattcgatgaataaattactaatttgatccctcttttaataaaaggtccaatataatttcttatttaaaaaaaatgcttcaatgttactttttcatccaattaagaatgatgcattgaagtattttttgaaaaataagagactaa

SEQ ID NO: 5808 - DNA, 1667 bp, Glycine max
  Soy_ogl_4943 Gm15:9301834..9303500 Cluster 26
cgtgctacgaaaaatgtttatgcagattttgtttagaactcaatttttgtcatgcttttaattgatttctagaaatacaggaatgtaaatgtggctcaaggactaccaaacaaacagagacccttgaaatgatattcatggattgacttttgtgttttgtctttacttattatttatcttttctttatttattgattaatttgaatagaaacttttttgttttcaagttattatttggtatctcgagtttttagatcaggcttaactgagattcaattcattatcatatctatttctagcagaaaagtgctagcctacatagaaaaggaaaaagaatcctagctatgatttttcttaaattcttttgtcttggatgtcatgttaatcttaggactattttctttggtctggtagttatagtatgtccaattcttctggacagtgactgtatgcatagcacttttctgcacatggaacaggtttggttttcttttaatagggtattttcagaagccaaaatgagtacttatggttggattttgcatgcttgggtgcttcatattgccttctttgtgaaaagcgggttgttctttaaaacttgaaggacgcccaccccccccccccccgtgttataaacgtaaagaggatggggtttgttatgtttgatctctgtgaagtcgtgtgtgaatttggttagagcaaatgtcaaaatgcttaggattgaatgggtttatggcaattcactaatgttgtattttaatgaaagatgtgttcttacactttactgtcagctatattgttatcttttaatgcaggtgacgataaaatccaattctgcaattaatcccatggttgcttaacatccagttcctgtgctctcttcacatgctatgactagcacaaggctatataacatgggaacacacatctagttcctgcaaaaccaaatggctgaaacaatggagacaaattccagagacaaaaaacgtgcatgcctagtttgttcacactaagtcctgtcacaatccgaaatggcttgtataatagagttaagggagaagtttgtgcgtgggcaagcactcccacatccatggccttgccctagattcctccctggagccgcgcctgcctcaaacggcatggtcgggcaacaagactgccattgccatgggaatggccaagtccctcgagctcgaaaccccctttgccatgatcaccgccagcgaaatcttctccctccagatattgaaaactaaagcgccatcgttgtccacttcaaggaagaaaccaaagtcgtcgaggttcaaatggaccgtcccgcggcatgaattgttgagcattcacatgcctgcatattctgattctattgttaagggggtctctacagtcatggttcaaactccagttggaatggtgtaaggatgcatgcaaatcgtgatctagtcactggtttcctcaagaataccattaagtttaaggtgattggcttctttgtattcttttctcatacattataaatgttgaggtacatttgttctatgcaatggaagcagctaccaaatgcttgttacagtaatgctttaatttgtttgattatcatattatctagaaaaaaaacaaacactttaatttataattttttttaacttttttttgtcctgtaactt

SEQ ID NO: 5809 - DNA, 1078 bp, Glycine max
  Soy_ogl_4989 Gm15:11278001..11279078 Cluster 26
cttggtcaatttatttttctaagtgttataagcttttgcatcttgggaagtttcaggtttattttacgttggagatattattgaaattttgttttttcctattttctaggaatgctatttgactgagtttttattctctatactttattcggtttttatgtaaccgtttgagcacaatgtggctgctggttgatgcaagttagttttttctgtgcgctgcacattgtgactttcagcactatatgtatagatgcttcccattgagaaaaatagagagacccctacagaaaaatactttgatattcctatctcctttttatataaaattgtattactgtttaaaatatgtattggattattgatgttctttggatcggaactctttagttgcacttgattagatcaatgggttgtcttattttagtgagagtattttttctataaaaataatgcaaaactcactttttctgaactctttttattattatatttatttttttattaaatattgttataagaattatttgtgtattgattatacgagaaataattgcactgctatatttgttgttttggattcttaatttttatttaacaataactagcaacattgatccagcaacaatgattcttttcctttttcttttttatgaataagcatatacaagcaccaagcatgaataaaaaaaatgtcaatgactaaatgcagatgctgttaaggaaacctcaatgcagtagaaccaaagaaaacattgtaaagcagtgtgtccgcagcaccaatttttttttttctactttttttacattccttgcagagtctatttacatgcatgataagtgtgtgagatagagaaagataagacctgactcaattctaaagatttctgacatttttccacacaagacgacggattatagacgaccatgttctagaagaaagctgaccagccaaaagctatgtatgagtggaatttggatttgtaaggtaaaatcatctgagtgacaaagcttttagtatttaacaaggaaaatgacaaaacatgataaacatatacatcccattgagaaatatacagac

SEQ ID NO: 5810 - DNA, 1122 bp, Glycine max
  Soy_ogl_5457 Gm17:2299601..2300722 Cluster 26
agttttaaaacagatgaagcacgtattacttgctagacatgggccatttatatttcacactttaagctttcattatgggaattgcgataggcgtcccctaccaaattctctatattttcttcctagtgtgttttgtcgttttatggcaaccaatgatgccccgatagaccatgtttttaattcaaaactcttcaaccacaacaatatgctttggaacaattggtccaggttctgtatatatgtggaccattatttgcaattgcaattgcttcctttaacacaagaagacttgtggagacgaaattgtgctgtgacacgtcctagtacctcaaacattgaggtggtaggagttgcatgtatgtggagggacagcgttgttgctctttgtccttctcgacttcaaagtctcctttcaattaattgctttggacgtaagtggatcttggagtatatgaatctgtatttagcttattcttcaagtcttaagtttgttccatctgccaaagctaaaacctgtgccatacagctatatctaattgtacagcttgatcacacattatataaaatttaattactgatcaaaccttgtaaaccgcactttttttccatgctttttccatttatgttgaggatatattatataaaattataaatgaaagaaagatggaaatgtgaattgtctctccccacgtaattatgattttaataaaatatttatttcaacatgaactaaaagaatataaaaaaaggagtcaacacgaaaattcatttatcattcctttaaccgaactttagcatataatccaaaaatatgatttctacctttttatggctcactttcaaataaatacaaaaataaaattttaccaactgataaaatataataatatcagaaaaataaaatgtgtgaacaatcattttatccaagtaaaaaaaaaatataatataaaagaaagaagagattttaagagaaaaaaggcttaaatgactatttttattattattttgaacaccatgaatgaaatgataatgtcatatgtgttgaactatatttattcatttaaggtattctttgcgacatattggaaatctatgtaaacaaaattgacttctatttgatga

SEQ ID NO: 5811 - DNA, 1400 bp, Glycine max
  Soy_ogl_5549 Gm17:6456401..6457800 Cluster 26
actttgacaaagtatgtctcttattgactgagttttgagttgtaccgatggcgattcttccttccggcattcgagataagttgaccggttgagtatacgtgaaggtactccaaaatttaagttaatggtaattttggcagaatggtgatgagtaaaaaatgtgtattaattgttgatgttggttgaaatttataaggtgtccacaaggcccagcccaagacattttagaggcaatgcatttttgtttttagattatagtatgtgtttgattatgagttttgtttcccttgactcatgtcaggttcaacgctactgtaagtagctttcacgttttttttttttcaattgaatgtaaaaaacagtatttcataggcacatcaacatattgaaccaaacatgctaatagtgttgactccaatcaacatgtacttaataatttgtgcttaccctagtggttgtggttggatggattatgcttcaagcctaatctggaacaattatcccctagcttgggcatatatagttatatactcttgagtttagtatgtatagtttctactttttgtatctaggtcttagcttaattcaaggtgatcgaatgaacatctcgcatcactatgtataagttgtaatgcactagttaacatgacatatgacatcagttattgagtcgtgcatctatcatgacaatttaaattttttggctaatgtatcattttaacttctagttctgatcatgagatgaaaaattaagtcggttttaccttataataaaattgtttataaataacttcttgttcacctttttccttttctctccctctggaaccttcccttcttctttccttcagcaataccatattttattaattgtttttatttttaaatacacttaaataaattgacaaaatagtacgcgtgatggaaatatataaaaacaaaaatcttgttgtaatcataaataaagttcaattttttttttgtgtgattataaataaatggcttttttgatatatatcattctgtagttcaatgagtatattttctctttcaattcgacctttacctcttaatctctcaataagacttacaaaccctttgagagatactatcacgtaatagtatttgttcttaattttatataacatcaactgaattcaaagaatgataatacaacacattgaccataatccatatagagttataatactaaactgtagaaggaaaagcatgagtatataaatctgtgtggctttgtagctatatagtgttgcatgaactttgtaggcgtgcagatgagtacacatttgcctaaagacaaaatatatgggccctgtagtccaatgttacctactgctcttctttcttttgttcccgctcgaaaaagagagagaaaaatg

SEQ ID NO: 5812 - DNA, 1435 bp, Glycine max
  Soy_ogl_5589 Gm17:8596601..8598035 Cluster 26
tgtaactaaaaactttacttaacccaaaaaaagatacagtcctgaaacttgaactttttgtgttaaccatttttggagagactattttctcaagaggcaaaagctcccactagacctcgtttttgtcaagaattttcgtagtacattggtttattttattttagagacaattgccaatttgccatcaacttaaatgcatcttatttttttaaggtccaccgcatctatgcaacagaaatgggccacaagtatacatgaatgatccatcatctaacacgtgagcccacatgttagattgacccttcgttctattgcaattaatgtgtgaaacacaatgggcccaattggttgcttgcggcaagacaatggggccgttattcaattaatactccatatctgctcacttctctgtctacaaggaaggtagcccctacaatggaaatggaccagagatcctagtcagcccctagattgccttcctttatattccctctatttccaatacaagcaacaaaaaattcatatattttgatttcaatgttacatgtatatgtgtgaaaaaataataaccaatatgctaaaatattaacaatttttttttattgataactagaattgcttactttactcttttttttaaaaggctacttactttactctttgacacttaaaaagaccgaaatcatattaaaagttggttaattcaagacaactttcttctgaaatttttaagtttcagactatgcttggtttgagaggaaaaccagtgaaaagaaagaaaatgtgcgaaaagtaaaatgattttttttttaccttttatttagttttgtaaaaagtaagaggatacaaaaactatacatatatgaaatgacataaatactcttagataagaaatgacatgcaataatgaatcttttcataaaaaatatatttagaaaattatttttttacacataaagattttttttatatatcttacaatataaaataatgatatggagaaatatagtgaaaaaacttctacttatttttttattacgccattcccaacaataaaaattaaaatatatatatttttttaaaatagcacaataaacttaatttttcattaagaacattgcctcaaacccaaacaatcatcgtcctttcctctcatataactaaaatcttcttctcataactaaaaccaatgacgctatagccatttctcatcctccataaaaaattaaaaatcaattcaagcctcttgttgacatctcgaacaccaagactagcaatgaaccaccatcaacaaaccatatatgattaaccaccaaacattcattgagaatcacgcttatcccatagcaaaactagttccacgatataaattgtccaccccagaggcatgcatgcactagatcgaaaccagactgcaccatgattcatgcacaca

SEQ ID NO: 5813 - DNA, 1300 bp, Glycine max
  Soy_ogl_5790 Gm17:39618001..39619300 Cluster 26
aggggcagtttctaaggacatatttgttctggcaggacagagcaacatggctggaccaggtggcgttttcggggggaaatgggaaggtaatgccccagcggagtgcaggcccagcccatgggttttgaggcggagcgcgggcctggagtgggaggaggcacgtgagcctctgcatgaggacaacgatgtggccaagacatgtggcgttgggcccggcatggcgttcgcgaacgaggttgtcaaagcccgtggtggatgcgtctaaagccagataaacttcagcttagcaccaagtctcagattcacttgggcattcagttagcacgtgcctatctcgattccaccacccacaatcatcaccaatttaactctatcattaatcacacgcaagttttagcttgttaagaatgcatttttctatatttgttgccaataggcaaagaaagcgtggctcctcttgaaagctacactatgagagaaggctttggttttctcatctatatacactagcctttttttttttattaagcatggctcattaagctaattcggaacatataaaagaatagagttaatttctttctagtttcatctttcggatatctttggaattattataattgttggaaatttcatttagtgaaaaattctacttcatttacaagttacaaccccttataatatgatacaaaaaaaaaacccactagagttcatttaatagtaaaaaatttgtacaaacttaatattcaaatcacattactatcactattgagcgtgcagattaatagacttgagattattttagtttaattagtatttttaagttcgagtcatgaataaataattgtattaaatatttagaaaataaattttgtcactcatacctaatgttttttttttaaaaaaactcttaactaccattattatatatatatattccacatcaaaccaagttacccgtgactcttaacacagcattgaggagttcttggatttacttatttaaaagatataattattttttaaaatatttgaaaactttaaaaatacatttccccaagccgtgaacatatttctttttttttctatcaactctatatgacgagatgcttttcatttctttgttgattgttgtaaaagggaaatgacgatggggcataagagcccactttgggctggaccgtacagtgacttgctatttagggcggtattaatgtaatttggacactagcaaaatttgttcgcataatcataactcagcactgcttggaccatataaaatctctgcttcacataatta

SEQ ID NO: 5814 - DNA, 1300 bp, Glycine max
  Soy_ogl_6283 Gm18:59793801..59795100 Cluster 26
aattttccgttcggccgtgattaatgcaggctatcatatatctggaactcatgttaatccacaaggactgaaatcagatgcacccatggatgttatttgggatataatgcgctgctgggtaagaagttacaagtaattattgctggtgttctgttcataatgtagttgagacttgtttctcccttatttgcttttattcataatgcgcatgcacttgtatatgaaatgccatgttccttctaacaacaatatggctacaagcctgcaacttaatattaaagtggttcagttcattttctaatgtttgaatattttaggaaagacataaggaatatgattagcttttgtcacttctcggtcactgattctgttacattataggtaaaagatcatcctgtgaaagctcaaccagcagatcaaccaggaagtgttatatttgcaaaggaacctgttcttcgggtatattttgcctctcaaattttatgttctcccctaaaatgcttggatttttatattataattcaacattatgccatttatatccatagttgctggttagagtttaatatggtccatgagtagttttggccatgatgaatggcaaggaactgggacatggccagtaaacagtccctttggcctggcctatcctttgatctaaggtagtaatttcattgaaacattgatggctgaaacttctgtttcttgtgtcccctgtaggctaattttgctcgagctgtatcgactcttagcaaggcacaagctaagaaggttgcacgctttcttccaaatcctgaaaggtactggggtcctaaacttagggcaggacgtcaaattaatagcaagcgtgtctctgtattgggttaagcagcagttaatggaattctcaatcaggaagagaatgaagaatctaaattaagaggcaaaaggcataagataatatcacagcttagctcacaaatgtggttctttcttgaaattaatttttctatcttgagagctcttggggctctatattttggtttctaaggcaagcccatttgttgtcactacattttgttaatagaagagggaaagtgagtttcagtgagagagctagacaatatagtagtttttcaattaggtactgtcttatttcgccttgcattgattagatactgagtctaggaatttgtttagttaaacaataatttttttcattgattttgtgtttttcatgtggttgaagtttcaattttttacttggtccccatgaaagaacttgctaattatgtttctctattcctctctcggttcagca

SEQ ID NO: 5815 - DNA, 2200 bp, Glycine max
  Soy_ogl_6725 Gm20:33395601..33397800 Cluster 26
gactattgctgtcttttttagtaaaaaggagaaaattttaaatgttgccgagttaaatagaagcagtacgtgaagcactgcctttagagatcactctgctctaaaaggatggaaaaataatctcctgaaacaccaagttcaagactctgatctcttatctgctacatgttcatattctcaaccaaaatggtacaacttgtttatacaattaatattccatttgatcttctatagttgttgcccattaatttggtcatgttccccgttcctcattctttgtttttcttaatttcatgaaaagataaaattgtagtaagtaattgttgtacaaaagaaaggtgtttcaatgctcatattctgggctaataaagtgaaaagtgcaaatttgttaataactcgtcttcgccaaaatttagggctaatcaagtcaaaattcacttaccctcaacgtaatatctatatcaaattttatatatattattatcattctctatttttatcagttagaaaggcaaagacaaaaactagctcctaacaagcactacatgcacccttccctaaaaaaaaagcactacagccatggcctctgccaataaagagtgattaaagctggagaggacaagttacccacaagactattaagagatatccaaagaagaatcatgcttagttaaccagtttgcacactaatttccttctctcaaagtatgctggaaggagagctgccatgccaatcttttaaaataattatagcatcaaagaaacacatgatggaggtgatcctgattatgaaattcaatcttgcagcattcaggaaaacggaaatcagcctcatctaaaatcctcaaactcaatccaacatcctcattgcttataagatgaagagcagccagcatcaatcaactttgtacagccagcaatgttcagcgcctcaaggtttctgcattgccttaaaatacaactcactgtagaatcagaaatgtttccatacgaatccaaccctaagactttaaggctgctaccacaagcagtagccagcgactttaccgcatcatcggagactagccagcaaccactaatgagtaaagtctccaaattagcacagtatttggccaaggataatatggttccatccccacttgagagaagacgaacaagccctaacaatactagaaatccaaacatcactgattggataggctttatagaggcctaaaaatagatattatgaacatgaaagaatagaaatgacctctagaatatttgaaattgagaaccctaagtaagggaatccattggctatgacagcgagtcggaatcagtggtggcatataggatccacgtaaagtgaacttggagtattccaactcgaccaagcgtgtgaacctatcaaccattcttcgacccgcacgtgcggcgatcttcttggtttccgtctgctctcaaccctccccacaatcaaacgcagcgagtcgtccgtcaaaacgtcgtttatgcacaccctcgaccccgaaacggcgtcgccctccatcgaattcgaagaaaccctaaccccagaatttcgggctaactgcatgtccattggaattattactgccaaaacaacgagccttacttcaagaataagaaattataaccaagttctacaatgactaacgacgtattggtaccaccataggatacaattttttttaggattactttctaattagaattagaattagaactttatttctataatttatttaataaaaaataatttaattatataattttaatctcacaaattttaattatgctacttgagtctcacaagttttctttcatttacgataatgttccttcatcttaattcaatatataacgaaattaattagttgacatgataaattgtgcttgatatggtaattctcgtgctaacaacggtaaatttttatgacaatggtgaagaaataaaggagtcagattctttacttcttgaaaaacttatatcttccaaatttatataattaatgttcttaatacccataaatagtgaaatgttatttactttgactttattctaccatattctttgttatatagatatattctattctatatgatcttcaatcatatatgcaatattttaagtgatctaaagggtttggccttctgctattcttattaagttctacttgaatagtataaattattacaa

SEQ ID NO: 5816 - DNA, 1200 bp, Glycine max
  Soy_ogl_2140 Gm07:2887101..2888300 Cluster 26
attaaaacattttcagtaagtttcactgacatgtaccattcaaaattatactttgcattccctattataagattatcaacaatcacaccatttacagcatcaaatagatgcaccatagtagagaagagctagcaaaattacattaaaaaatgatttttcactctacacattttctctggaatctgccattgttatattcttctgctttggtttgctgtcagtaagccacttcagtcccatctatttacctccaaaatatcttcaatcccatgcgcaacacataattgatataaagtcatttacaatatgtgacccctctcccaaacatatctacaaattcatgccaaaagaggacacccaaaaccgaccacttcaattcacccacaacatttcatcagcacctcatcaacaaatttgataacttttgtaacttcccctagaaggaagaactcctcatggagcctaataacctgaaaagatcaatagaacataatatcattactttaacatcacacattcaagataggatgatggccaatgtatagagaaatctgaattcatgattatctagagaaaacctcaacatttcagaaacataaatccatactaatcccccgtgcccgtatcatacttctcatcaactctattacactcatgagtcgtggcaaaagaaatccccaaaccttcgctaatcacttaaaaaaaaaaaggaaaatgagaaagaaataaaaagattaggcaaaaaataagaatcaaagaggctgattaataaaatttaaatgaaatatgtcaacagcagtctcttctcttctctcatggtctgataaaactcctcactaacatgagagcattttttctaaatgagcatttacttagtactctgaaaatctgagagattcatagaagaagaaaaaacagaatcttgtagttgacttagtttggtctgatcatataaaacaaataactgacatactgaagattctctaaatgggttagctaggttgttgggttacatgattaaaactaccaacctacgtaactcaatccaatacaactcagctatataatggatcaacaacacgctgggttaggttgatcaatcatattaggatttattagttttctttttttttttaattttcaaattaaaatttttggatggtttatcatactagcaatataatttatttgtatttgatt

SEQ ID NO: 5817 - DNA, 1200 bp, Glycine max
  Soy_ogl_2454 Gm08:1686501..1687700 Cluster 26
acaaattaaggaatttgttaccgttagattaagtaaacatttcatattgttcttaaaatgaaattatatacaagcaacacagtaaattaatgaaccgcttaattaactgaatagagcctaataggaggtgtggtacgtggagtcatgtgaaagcttacattgtctgtgacccaaaacgagagaaaaataaacagtaggtgctactctttcagtaagactcttcaaactaacactaagcttgctatccatcttgaaacttgaattatctaattaagtaaagaagaagctcagggcaaaaaataaaaaaataaaaaaaatcaatgctattatagaaacaaaatagtatgtgtgtcatgcttaatgttttggagaggcgagtagtgcttatcagatgctacaatttgatgatgcagctcgtgcacatggtcccctcaataccaatatattaattaattaattaaaggatagcttatgttgttccattgaatcttaatttctgccacacaagtctgtaccaattattcttgcccccaagagtcttcttttcttaggacatccaaaactatgagtagataaacatgtgtcagaaaataaaatgaactaataaagcgaaatgaattaaaaacaatttatggaaacattagttgaagggtttttttttttaaaaaaaaaagggttaaaatcgtgtaagtaaactaataaatgtgatttattttattaacttgaattattttcttctcttataaataattgttgggatttaatttaaactgattctaattgattgactaaatcagaataatcaataactaatccttttgggtcaagcaactaaataaattctaaatttattttgttaattaaaatgtttatttacacattttcacataaatgatattcttttataaaaaaataatattgaggtgcatttactatgctgacatcttacgtccaacatgcagaatgtaatcatgatggatagattgagctctattcctagcctatgcaaacacgattcggtctcggtaataatggagaaatcatgaacaacttcaatgcaaaccaaacttaataaatttatataaggtatgaagatgatcgaaataagttttcaactccacatacatgattagaaatcaaccatttattagtatattaaaactcaactatttattaaatatgtagctcagacatgttgta

SEQ ID NO: 5818 - DNA, 1579 bp, Glycine max
  Soy_ogl_3983 Gm12:2894343..2895921 Cluster 26
tgtgacaaatttggacaactgatacaatgcaactatacaatataaaggagagtgtatttaacagtttctcaacccgtaggaataattgctaaaagaaagtatataaagacaagattttttttttttttaatttaaggcttaaaaaattgttacaaggtcaagatattctcacacacaatgatgcttcaagaatggtttcatgcaatcatgcccgagcgttcaacaattctttcatagtttgggaattaggagccactgataaatcataaatggatgagtggtacatgcttctcaaaagtgttcaattctgtcgtttgtctttgtcaacccctctaatgatagtgacagagagttagtgtccatccataaaaatcttctgtaattggccaatttggcaatttctttacttcgtcttttacatggcagacagattttattctctaagcctaacttcattctgattaagctaataagaagttgaatccaacacatcgagagagagagagagagattatatagttatctagtgcagatacaatctatatatataagtttagacctgtcaagattagtctattttaaataaataattatatttttattttatttttaatagttttttaaaaacattgatcgtgcatgcagcctataaataactcacgtattgttttaattacttgaaaattgttgactgtatatttatgtagttttcctcatatataaatatataaacaaatattctataaaaacgagatagatccacttaataataagtaattatacatgagaaggatcaaaataagacggatgaagaaataatacgtacagttcatgaataattaagattaattttacttaaaattaacgttgactattgatatttttttttttgagtttaccttgggctattaatataaaattaaatagtaacgctgttgttaactcttatgtttttatactctcaaattacacactttatacacaaactccatatgcttgtgtggatgttttaattaaatgaaaaaatcatccgtatgcaatgtgtaaaactcacacacaagttatttaacatatttggataaccaacattgttaaagacataaaaataacaactttattagacacttatttaataaaactaatttacgaacttaattatgaaatttaataaaagaaaataaaaagatcataaattgtttttataaattcaagtaaattcgtacgaacgtttctaatcaattataccccatgcactgttttgtttttttagttatcccactatcttgacatggtggaaacatctcgtaagtgtgaatcatggtcatccaggcaattgaccactattagaccactaatggctaacaagaaaactctgactagagactaattaacatgcatgattcatattgtcaaaatttaaaaccatgttgcaacttgcttgcattacacctttctttggaggtgatgtatgaactgtttcatcatatacgattattaaaggtcaaaagaatgtactaatgactgttagttcgagtagtaaagatttgatcatttttaaacttaatattatgatcacttg

SEQ ID NO: 5819 - DNA, 1000 bp, Glycine max
  Soy_ogl_2714 Gm08:15807501..15808500 Cluster 26
tttcgttcacagattgattgaaacaatatatatgattgatgaaatgagtgctccacaattctctctgaaattttgtaaccaatgtcaattttaccatatatcgatctttctgacgtgatatgtattgattccattattccattgatagaaaaataactaaatttgtcaggttctttacacacaactcacacaagggttaggtgggtcggtgggtagggagtgaatttagccccgacaaacaacgattttaattaaatgagttaaatttaattgatattttaaatatgacaaatattaatgaatatccttttcacattaagaaactaagaaaaaacaaaaattattagaatgtctaaaattatattgttcagaattttttttatattagcttatgatttttataataaatatttttttaaaaaaattctcaatcaatactctaaagagtaagaacactaattaataagaccctttaaatattcatattttaaaaataactaaaatatttaattatatattatacatatttgattcttataatagagtgttattttactttatttttaaaaaatattcatacttgaaatgatgaaaacaagtatttcttttataataaaataaaacacatataacagtttaatagtaatgaacaaaaaatatacaacaaatagcaagtccatcttgagctggatattgagtaaccttggtccactcaagatcataaattgggataaacatttgatgtcccaatgatgtgatgatgccgacaaaagtggcacctgctttgttgtggcagaaactcaacattcccaaaaacagcggcccaagaattccgatctagttacaaaaaaaaaaaatgagcctagtccactgtaacccaattttgagatcgttttgcattcacaccagaaaaggaaactggaaaaggttttgttatcaagggatcttgcaacaatcgtgtgcatgagttacgagttattgtaacttctttggtatttat

SEQ ID NO: 5820 - DNA, 1300 bp, Glycine max
  Soy_ogl_3962 Gm12:778301..779600 Cluster 26
ggagcaaaacaacattttggccaaagttggagacagctcacgtgcaaaggagcgtgcaaggcacttcatactgtattagagattgcccattgctatgtctatgtgtgttaatgtggttttctgtgttctgttctatgctttaattagcctgaattcctgcaccactgccgggaaacaaacgctaaccacccaataaacaacgctgttgtggtggtcgtgagagacacacattatctttgtccaacagtattattttcctcaggatttttagtggaagaactttcctttaaattgttttctcatgttaaatgtataattactttaattataagaagtattgttgctttttactataattatactccctttgctttatattataagaaaaagaaattcattttaataaatattttattttgtcttgttcaattttctttaaaaaaaatagttgatttcattacattgtgttaatctcacaacaaagatgttttttgttctaatattcttcattagaattttatatttcttccgttcttttttaattgtcacattgttgacgaattattatttctatttatttattacttgtcccattttgcatcccattaattatttttttattaattatgctcttaattgtctctttatctttcattaatttacgcatgtatttataataaagtggaaataaaaaggaataaaataggaaatctcatacctatttttataaagtcaacaaaatttattgcatttcttagtttttacaaaacaaccttagaaaataaataaaaagaaaaaagtaatatctagcataaaataaaaactttgatcctattaaattaaaaataattgaaatagagacaagcaattttgagaaaaagacaagcaattgtggggggttttaaataatagagatagagaggatttaaaataccatgatttgaaatactacaaataaaattaatgatgaaaagaaaaattaattaagaatttcttcattttgctcctatgctgtgtgttgtttgattcttccgaaattgagggggtgggggggttgggttttcctttttaataattattaaattaggtgggtacgtgaccatgttctctctcatgttggtagattggcaatttgtcctatgagattgagaggtcatgatgctcaaaatatcattgattcattattatctttgccatttcattctttccgcctattatttaagctgctcggctagtctgctagtttgaatttcattctctagcaaaatggtattaggtcataaacaaatatatattacat

SEQ ID NO: 5821 - DNA, 2058 bp, Glycine max
  Soy_ogl_4449 Gm13:34509743..34511800 Cluster 26
aatttactttcaatatggggtggtcaatttaaaggggaggggacggacggctggtgtggtctttgaagtacttgtcttctttttctgaagaaaaaaaaactgaagtacaatattttacatgttgaagtacaatttttattttaattgaataatagtatcaaaaggcatttaaagtatcgtacctaaattttgtcctcttctaaattcatcaccagatccactgcacagggtgcagcacactaaattgtgtgttattgctgcttcatttttatttctgtggataggtttggttggcaacttggcatgtagtagcatggaaagcttcatctagataattttattacctttatctaccttaaataaatgagctatctaggagttagggaagtgttatgaatatttggtttgtacgaaagcattacttactactgtgctagtacaaaaccactgaaccacctatttgtttttttcttggccgttgaagcaaacccaccttggttgagtgggtttgtgtacgttacatagtaagtgctagatgctgaaattgcagataatgaatatatggttcaattttagcttgagagatgagaaacatctcttccttctaaataaactgtgaattctgtaaccaaaaaataaaaactctggattctatgtctattgtaatattatggcttctcgccttctccagtatgctaacttaagattgagaacgttcttgaagtttaattgtcagggttgatagaaaattgcttcaggaatttttctttgatctccttgtatttttactactatgcatgcttcttttaactcggtggggccctcaaggaggttgttcgatttattatgtcatgttgaacctcctgtatgttgcagaggcaagttgctaatttgtttggtcttaatacatttcagtattccactctgcttctggattaggaactttttttaacctgtaatgtttaactccgttttttcttttagtttctctctctctctctctggaatttatataaaacttttatttattaaaaagttacttttacttttagaattatttttaaaagtttgttcatattgcctttcgtgtttttattggtggtatttggcagggagttagttcaccctccactaagttcgcgaaagagacccttactcgctgagtcactggttacctaatcaatattaatgtaaatctcactgcttgctttattaaggttgctactaagcttgtcagattgtctagttttctttacgttgcttattcagacaccagatttgtttgctcatcacgtacttttttctgttattcagggtgcattttaacacggctaagtttaaaattggttcatgatgaaccattcctgtacgcgaaaaaaaaaaatacacaatgacaaaaggtttctattgtgtagcaaagggtgtgaaaaaatattatacaacgaagcttatttctgttgtatataggcatccaactacacaatggaagcaagttttcgttgtataagtggtagacatatataatggaaactaatttcctttgtgaggggtattttcatgttataaaaaaacaattgaggatgtttaaatagcaacgagagggaagcctatagcaaagccctagaaaatttgtcgtacttcagcccaagacgacttagagcctgtctaagggctgagtcgaagcccaaatatgtcagtcttatatagacaaaaacaaaagtccagagtacgtattaaagatagactatttttaaatgtttatttattttaaaaatctctctcaaagttaaaaaaaaaaatattttttataaagcttactgaaaattattctaacatgttgtcaatctcaaacatccatatcatttttcagttttctattttttattattaaaagaaaataagtttacctttatattataaatttaagtctttatcttcagttataaaatgagaacgacctatgagaatgaaagtaagtgtaaactttttatacttgttttcattctcatgtaaccgtgtagtatttttattttacggactattacatcaaattgaatc

SEQ ID NO: 5822 - DNA, 1025 bp, Glycine max
  Soy_ogl_355 Gm02:3614201..3615225 Cluster 26
tttttaaaataaattaaaaatgtaaaagtagtatgctactactataagatagaaagtgtaagaatttaatatattttataaatgtcttaaatttttaaaagaaaaaagtactagtagtactattttgtagtaatttcttagaaaatactactactattattactccgtttttctattgattaaattttatggaagtggccactggataggtggtgacttgtgcagctaattgcagttcagaaatagttattgccttcggctattcccaagactgtgtgagaaatgatacaattctgggacgatgggggaataaatcgcattgccttttgggtcgtataaacgttatgattggagattttaatgaaactggagtaactaattatagtttccttcccaactctttacgaaatctgaaaaataaaaataatcaaatcaaatactactactattatacacaatccaaaattttcaagcacgaaggtgataaatgataaatgataaagctgcttttcagctagcttttgtttaataaaaaataatttgatgggaattgaagttggaggtgaagtgctgtgatcgattatcattctgaatgattacactggcggcgctcagacgttgttcctcccactttggtttatgcatgcttaggctattatttataactttccagtttccacttattttgcctgttgggtaaggttgattatgcaagtgtcgatacatttgcttattgatcctgcgttacttatgttgtggttgaaattaaaaccaggaatttaaaatcacatggacttgtctgatacacgggggtttaaagattaggtcctgttggcagctagaaactgacataaacattggttgtacgtaccattccactcaggccaagatgacaaatgaaaggtccattgcaagatagagagagacagagaggactctacccacccatcgctcaaatttcgactaaatttcttaaccttaacttggtaacattgtaaaagaaagagatcaaaatgaatgaattc

SEQ ID NO: 5823 - DNA, 1000 bp, Glycine max
  Soy_ogl_927 Gm03:37372701..37373700 Cluster 26
ttattgatatggcctaattgaaaaacaaacacaaatttaagaattcaattttaaaaaaatagagacctaattaattgatttagaatttgactaaaatataaacaaaacctagacaaaaaaaaaatatttttatcataaattatacttaaataatatcctaataattttattttaacttcaacccagtaaccagttattcctaattactttgccaaattgcttgttgatttcacagttgtatcaaatgaaatggtgcactttttattattattattatcatcgaatttccctctcttttcctctttccttcctctccctccatcatccttagctcactgtcatgcctccaacctctctgtcaaaatggcatgctctaagaaagttttcgcctcaagttccctccttaatagctactgcaacacggacttcatctcggaggcgtgcgagctgttcgacagaatgtcacaaaatgatatgagttgttcgatgatgatgtgggttacggtgagtttggtagaaaataattgggaagaaaatagaaaaaaatttaaatttttatgtagctttcacagttttatctctttattttaatttaaatattttttatttttattttctctccgatcaaacgacccctaacatttagagggatttcagttatctaaatagaaaaaagtactttaccgtcaaagaaaaaaaaatgaaaagtaatgaaattaaaaaaaaataaaattgtgctacgacatccatgatgttgtccttgccttttcttaacgaaagttaatgtagggggaaactttgtcaaggaagaatgtgaatttagcaacattgttctaaagtttctttctatatcataacgatgataatgtatagtggtggccacccttctgtcacacagacatgatttggacctacttgtctgaaagatgcctctaatgcttgcccatcttgggccccactcaccatatgaaataattcgatatttggcatacttttttta

SEQ ID NO: 5824 - DNA, 1000 bp, Glycine max
  Soy_ogl_1256 Gm04:6576601..6577600 Cluster 26
agcatgggatgagtgcattaaaaacaatttcattccatacagtatgtatggaattctcctaaatacccacaagtgtgagtgtagtttcatcttaaaattgaggaattttagataataagtttcaaataaatgggatgacataccttcaattccagcaatttaatcaactatcttgtccaatattttacgcttgccaacatatataagtaataatatgcttaaataaaaagaattcgctaccataatagtacagattaaaaaatataagtcgggaatattaaaatagaaaatagtaattgattgatatataaaaagtttgttttctcgtttttaaataattaaagttaattaataaaaatatcgatattcttgatgtggtgcttgagaatttcttatccagattctaaaaagtattttttaaatgtatatttttttatcatgttatttactttgttgttgattaatatttataagagaacctaatttattacctttgatgaattttattctttcaaattaagtttttttcattcaaaagtttttgaatttaaaatctttcttagaatcaattccggtatcactggtaaatgtatacatatgttaacacaggatgagtttgaaatgtagtaactatgtacttactggggtaaatgataccagtgatggcttttggcattggagtagtaggaagcacggtcttccaactacaggaacaggaggtaaggcagcatgggttgtcaccagcgaaagctgcaagttaagtaaaaataaaaatacaaaaagacctgtttttagcatcaatttttgcataattaaacattgaaaatgacaaagagattatgcagtacccttattgttttcaataatatgtaggataaagaggcaaatattaatatgtcgttgtctagttggtcatatatttaatacctagtaatatattttactacttatcaaaatataaatcccataactcttgtggctatatagtgaaaaatccctg

SEQ ID NO: 5825 - DNA, 1100 bp, Glycine max
  Soy_ogl_1413 Gm04:45161501..45162600 Cluster 26
gcatattgcttcagtttttaagattctcataccacctaatgatttctccattttaatgtggtaggcaaaaaattagaagaatgatgcgacggtgcaatgcaagggatctaatattattgttaacagaggaaccaagcatgttagtgttgatatgcctaaagtgcaacagaatatcctgaaatggctgttctcactcacgtacgtggtgcatggccactaccagcatgaaacgcgcatgtgatgtttcgcattaatcatctttttaatatgatcattttccttaattattatttattttgacatggaatgtgagcgagggatgcaaaaatctaaaaccttccccaaatttattagaaaccccttcttatatttctatccggagttcacttggattgactcaagagaatagatcattcaggtttatggatggattgacttgcttattcttccaatgtagttaattagaggtttgatcaacaattaacaactttgaacgaattaaagtatttatttttggatatctcatcacttaaaaactttacagttaaatatgtttgatttggagcaattattagatgagtgactttccgagaaatttttcagaaagcaaatctcaaaaatgaattaactagtgaaatatcaccatgtagtgtcaatgtaaagcacagaaaagttgacaataaaaaatgttacagatttgaagcatgacacatggaattacattgagagaattgtgtaattatgatcaaaattattttggtaacatatcccatatgtcataaaaaagaaaaagaattctctcgcgtatgaaagggatcaacgggaagctagtgtggagaaaatatgattcaattcttcaccaagtacaattattttggtaccaaaaagcttgctgtgattagttttgttttatatataggaatatcggattgtttatttcatgctacaattgttattaggggaagcaagattaaagctttattaagtgatggtggtctatcccttccaaaatctgttgctgatattatttagagcccccagctgattctaaaattggtgcagttgtgtatagcatcgggcctattataaaggctagtagc

SEQ ID NO: 5826 - DNA, 1050 bp, Glycine max
  Soy_ogl_1741 Gm06:384720..385769 Cluster 26
cctcgtacatcagtgacagcatttatatggaagttatcttctgactgctgactcagcagtcaacagttagctacaacctaactatgaacacaactgaaattataatagaataaaacagattataacaaatgcacaaacagcttgtattaacagcaaacatgtttatgattcctacatcgatttatcaaaagatcgactttcttgcattcccctgctatcttcctttggagggctatttgctgccatctctgcttggaattgaacgagtcccaggagacaagagccagtcaatgccaatgatgatcaggttgactggacactggactaactccattgggcactccatcattcagcataccatctaccaaaaatggagttgaagcaaaggaagggtgagattactcctggggttttctggatattctgggaatttaagatgagattttttttctacctagataaatcaacaatggccatcagcatcccatgagggccgtgacaaatccataatgcctcaaagcattcaacgtcaatgattctaatcacagttgtagtggatttaccaaggccattatgtatctttttttatgactgctaagtctttattaatataaatagccttgagaaacactttttaacctaccttttgttttattttataatttccaagagttttggagagaaagaattacactaacaataattgaagttctaatttgtaatgattcaatctcttttacttttaatgtattattatatgttatttgatttttctataatcatgattgattaaatcccttaggctttagattgtaactgtgaacactcattccttatttcaataaaaaaaaattaatattattcatataattgtgtttttctattatatattagtgactatctacttataattaattaaattatagaatgatagagttcataaaatttgtatgcatcaactttctttatacagacttgatattgctcgttgaattcttacaccactcaaaatttgtctttattgaacctgtcgacagatatatcaaaatt

SEQ ID NO: 5827 - DNA, 1302 bp, Glycine max
  Soy_ogl_1792 Gm06:5271801..5273102 Cluster 26
atttaatttttaaaattatcaaacctttattattttaatctattcttatcattttagagagtaaaacaactattatttaataatgtcaataactaacatgacagttatttaatagtttcacggatcaaaacaatttgtatattttcaaagattaaattagtcgatgttcatcattttgaacactaatttgatttgatacattatatcattttttaagtaacaaaatgaatggaagctactggctagccagcatctaatttctgtggcctacatttagcagaagttagcaaggatagacataaagaagaaattgacataaaggaagagatgacacaagtagctggttgcttaataaatgctccatgcatcaaggagcaatctatctagtaagcgtaccgttgtcatcggtaagattttattttatttttatacgtgaaaattatatcaataatttatgaatcttattcaatcaattgagtcaatttttttttttactcattagtagaatataataaactttttaaattttttattatttggggttaaattttaaggcacaaatgagttgatgaacacgacaaaaaagagagagagagagagagttgaagacaccttgaaatcttgaagtcatcatgctataatgtgtattaatgtccttaatttatggttgtggttgtggaaatgaagatacacacgttacctcaacaatgtgttcatgtacttttgtgggggagctcttcttgaagaattaatttcgcacaagtttagtaggtgaccgtacaacaacaccattttggaagcccctttcatttgcaaattgaacagggatgtttgtcaactgaaagtggtggcttttcttctcaagaacccgagctgccaaaccatacacacaggctttcactaattaatctattttcccagaaataagagactactaatcagtgaacgtttgttcatgaattaggcttatgtgtcacccattgttcagtgttgataaattaatttccaatatttttgtttaataaaaaaatgaaagactaatctttgaggatgttataattcattttaagaaattaattttctaaacatatcactttccaaccaaaccatggtcgtgtaaatagttagaccatcaaggattggtcttagatctattgaaaatatgagtatggatgtacatcacaataaagtatttgcattatattttaatattgtaattattaattggtaagataaataaataattgaaagagaaattaaaaagtataacactatgtactgcaataaacacaaatttacacg

SEQ ID NO: 5828 - DNA, 1200 bp, Glycine max
  Soy_ogl_2549 Gm08:7789001..7790200 Cluster 26
aaagattctgatctgatacgtgaactaactgactcagcaaaattcttttttcctttaatcgaaaatcaaatcacgtgttagtgtggtagtgcattggccccacgagactcacacacaacaagcgtaggtagctgttgtgcgcgacacacgtcaacgtccaacaaacacatgcctcgctcgctgcgaagataagttcacaactaacgacggtgtgaaatccacactgccaaatcatctcacgtacgtacatcgtgacatggaatcatggataaagattgtaacgagtaaacaacaccccctctttttcttctacattttcatcttttctttttagtgtttgctcattttttaacagttgatttgctagttgctaggaccgtggcagaatctgctaaggatatttgtccccggttttgagaatggatttgaattttgatactatgtatatcatgacttttgtagcctacgcgcaagtacattttttagaatatataatatatatgataacttgttcttttataacttgatcgtaaaaaatcattttatttgcgaaaataagattccatatctagctatttgatagctacgtgactttggtcttcaaaattaactgtaacatgtagcgctgccaattactcttctctcaatccattctgacattatttcaggcattgtttggatgcagaaatagagaacatatatatttttataagcttttaacatttggtttaatttttttggcgggaagagatagagggagctaaaattttgtctcactcaatttttgagttttaacaccttacaagttacaattaagagatttagaaatgagagaattttgtatgttaattggaatgaattattctgaattatataaatttatctaaccattttaaatatataacactaaattaatttaagttttccttctcttttttgccctgtccccataaactaaataagatatttcaacaagtgaaggatgtgtgtctttttggtaagaggatgagagtgatatttgtaggggcaatatttaactatttgtaacaccagcggtgatgtatgagctggattggtgctagctagttacactacatatatggctcacatgtgacatgccatgtgaaataatacgaattcacttttttttttgggtacataatacgaattctccttgaattgtttataaaataataatgc

SEQ ID NO: 5829 - DNA, 1000 bp, Glycine max
  Soy_ogl_3176 Gm09:38743401..38744400 Cluster 26
atatggaccaataacatggagtgagaaaaataggtttctctaataatgaagtgttgaaaataatataaaagacagaattggaaaatcacattattaatagattagttgataacttataaataaaatcaaatattctttttaaaatgtgatcaatatataagacttgaaggaatatatttattaagtagaattaatcattaatcatattaagaacatgcaggacgggctaacggttaggcctgaattagagtaacaaatgcaacccgtataggttgagatggtctaatttatgttggcccatgttaccagtggcccgttcatggaatattcatatttgaataaaaacaaatttcagacaataaaaaagaaaaaaaaaactagattaaaaatagcaagttcactatttcaaacgagaaaatcataggtatcactaaaatcacaccaagatatgctccgcataaattagaagtttatttaatatcaaataaatgtcacaagaaccaaaaaagttttaagaaaaaaagtacaaagttgcatttctcttactttattgtaaatgaatgccacttaagttgagctaaatcatgctgactcgatgtcttttctgctccttgcgttatttcaggagtaataactgatgataggggcatactttattcttcggataattaatgaaaaacagttttggtgattttttatgggttcggtgaaataatatatatatatatatataccagagggtcagcggagtaggatcaaacggacagataggaagtaagaatgcagtatgattaatgaaatgaaaatataaacttagaaaacagatatcaaggtcacaccggagaccggcttacaaaacctaggttttcataaacaaagaaaccgaagcggcggcagagccgcacaggatcggtgaagggagaagagagaaggatgaaaaatagaaatttattgaatctagaaagaagcgcttacaaaaatcttgtttcagagcacctct

SEQ ID NO: 5830 - DNA, 1900 bp, Glycine max
  Soy_ogl_3528 Gm10:44028501..44030400 Cluster 26
tcagaaattaagttcaaacgcgtaattaaataacaaccacaattagcagctcatgactcaagtgttgtccaaccattggtggaaccataactgaattagtcacctttagaagaaacaatgtgatcccatttgtccttgtaagaagaaccatgttccttggactaacaaacataacatagcacaatagcaatattacaagaaaactggcttccacgcgtcgttgcttagttggacttatttcttgacttgctcacaatcatacacggtttctatctttagtatttttttttacaggtagttttattttttttagttagtgttagctctgcttatttctgaatgtgaagaatatagtacacaacctttaagcaagaaaaagccaaattaagtaggagcaaattaaagactttcgaattaaaggatatggttgtaaagtttggcgtaaagttgaatcaaattagtccagatacagtgcccgaattagaggaaaaatcaatgattggaaaagagctttatatgcctcaaaaaataattaacttgcataaaagaccattaccaattggatatgtacttaaattgtggagtttgtagagaagaccaagttatcttcattgtaactaatcataaaactaaacagaacaattacaaaaaaattgaaaattcagtgtgcaactgtaggtttctcaagcaaatcacacaactcccactaatagaagtgatcgttacacacttacacacacatgcaactagcaatatccgttccatatcctgttccctcattatcagaatatcctaaagtggattatttaatttttcagtttcacaattttttctagtccatgccagaaaagtggtgatagatatatgtgaatgctaggaactatgctgcatatgtcagtcaaattatggttggatagcacttataagttgaggatgacatcccatattgttgccattatctcttatctgctttcatactagagactagaagtttctgccattgtgccaaacagaaaattcgaccttttaccatttagaagcaaatgggttgttgcagtataaagggatttaaactgcagcatgtgaccatataacattgcagctttacttaacagtccttgagatcaaccacaccttgttcattatttctacccacatgaatcattattgttttggtatttttttcatgatcgtgatgccacacgactttattttttcgtagtagtactaccgataaagattatcttgcttaaagtagaaaaaatgattggcttctcatgctttcagcactaggtcaaacaataagacattgtacctcaaaatggttattaaaattaaaaataatgctgagggaatattagtgcagtttccagcaaaggaagtgaaattggatgggggcagagaggtaggcctctaatgttagagcatattggagacactgatgcaaactttaaaattatttagaagctttctgagaaagggtttttcaagtgggagtaatttggcaactaaaacaataaggtaggtgtccccagtttgacaaactctagattctcttggttgagatagtgcatattgttttgattgacaatctctccctgtccacatgaagaaaaaaaaatgataagatcaaaatatcttaccattaaagcttcggtcggacacaaggcagaatctaaaacataatgtcattcattgtgtaggtaattaaacaattctaaagaaggcacacaggaaaaaaagtcatgttaatcattcactttactgcatacttagcctcaaaaaacgtggtggaactgtgattttgtttagaatgccaacaaccaaagtacttttttctgtgttatatgtcaattacagccttccttaatttaccttgtagaactttactccatctaat

SEQ ID NO: 5831 - DNA, 1813 bp, Glycine max
  Soy_ogl_3824 Gm11:10381401..10383213 Cluster 26
gttgaagaaattttcagatttttgaaaattaataatttgacctgaaacttctccatatttgtcaataatctcctttaggatgatgattttcttatcatctgtcctgcaaaacaagaaacagttgttgacaaataaaagatgtaagactagaggagcccctttccacaccttcacacccatgaatctccaccattcacctccttatatgagaagagttgaaagtccctattttcacaaaatgaaaaggtagggggcagtgagtccctctgtctacgatctctgtgtagaaaaatttccccaacatgattactgttaatcacaactgaggattgaacagattgaaggcatagtttcatctaagaaacccatttgcttcaagacactaaaaagataagtccacttaattcggtcaaaagctttactaatgccaattttaagggtaatctctctaaccttacccttgaatttacatctcatatggttgattacttcagagactaagagaacgttgtcaagaatagaacgattttcaacaaaagtttattgttattgggaaatgcatttggtaaggatgtgtttaagcccattggctaggaccttgaaaatgattttatagataacattgcaaaggaataagagcccaaagtttttcatagtagtgggattaatttttttggggataaggacaatggatgttttgccaggagattttcattttccagccaagaaaccccagagtgaaacagttcagggccacaaaggtggcaatttttttaagaaagcaaggttaagaccatctagtccttgtggatttgtcagaatccattgggaagagagcagatttgaattccttcatggtaaaaagaggtagcaagaagtcattgtcatagtgggaaacacaaggggacattttattaataaccgaaaagaaattattataattattctgaggttgaaacaaatcattaaaataagaaataacaacatcacaaattcccttatgatcatgaactgctgtgccatcaccacgagacaatgaagaaatggaatttatttttttccttgcatttgctgaagcatggaagaattttgagttggtgtcctcatccttcatccagaaaattttagctcgttgtctccaataggaatcttcttgggcaatcaaaagaccgagcttgttagagttcttgatattgattagtatcatcaacaatatggccttgatgtatttgatcaaggtctctacggcaagcttcgatttgatccgtgaaattgcgtctaccccaagcattcatttcggcagtacaatttattttggataagcaatctcctaagagtgctttgtcccatattgttcgaacaacatcattaagatcaggctccaataaccaagtatttttgaatctgacaagtctatgaaaaaaatgtgtttcgaactgcatcaagcagtaaatcattgaaatcaccaaagatacaacaaggaagggtagtatctgctgccagagaatgaaaaagactttaggactctcttcttttatttctatcagattaggtgtagaaaccagttaatctccagggtgggtggtcaggatgaagaacctagacattaatgaaattggaagagaagttaagaatatggaaattaaaaggctttctcctgagaagtgccaagccaccacttctgtcattaacatcaactgaaaagcaagaatcatagcgaagatgagattttatttcttccgtacgtctagtatgaacaagtgtttaacacaaaaagatcacatcaacgtgatatgactggacaatatcccgt

SEQ ID NO: 5832 - DNA, 1300 bp, Glycine max
  Soy_ogl_4707 Gm14:6132701..6134000 Cluster 26
ttcattttcatccatactttgcttgttgttttgtgtgtaaaaagtgttacaagtacattcacaacttgacaaaacaaaatgcataaattgcataagtggaaatatatagctttaaaataagagggtggaaaatacactaacactcacgtttcagtttccatttcaatatgaattttataatagaaatttaatttctacatcatagaccacgttctactatatcaataatttatagcaatttgtctttataattttgatacggaagctgatgaaccttacgagtaatgtttatactggtaaactactgttatcttatcgcttctgaatggtcatactccttcattgataagtatttttgaatccatacgtttcgtacagattaactccaatgaaaatagaataacttcaacatgccatgttaattagttagtcgtttaacaagagaggagaagatgatgcatatcattttgaagatcatcagggtgcgagttgcagaagaatcaaaaggtcaagataacatgttggaggtggaaaggccaaaggaaatcgcatgcatagggtgggacaaagtgcgctacatctctcagaatcctaaacgaaagagataatattactaaggttgtggatgggcctagtttgagacagggctgatacggatttgggccaattaacacaacgcaaaagcaattagcggagccagttggggagcaagaggaaggtcgggaactggacattgaagatagcacaaggaaaattgtcaaggagatgaacaagacagaatcttgatgtccaactcggcgggggtgagttacataagagggcctatagaagaagctacatctcatggtagcttgcaagttatgggggcatgcagacgcaaacaaacttctctgggcaagattttaaagaaggaacatcagaaccatcaatattttagtaacactatctccgatactaatgtcaagtcctgcaataaaaatttatggttgaaaaatgacaagatgaaagcaaaaaaggatttggagcgtgggaaaattatgggggttaactttgatggtatggaagatgcaatggtggtccagttggaaggtatggtaaggagggatcaaaaggagatagaaaatattgagaaggtaaaaatagaggagcacaagaaggtaacactatctctcttagaatgttagaggtctgaggaatgaagtgaactggagttatataagggaattagtcatcatagaggatattcaatttttgtgtattcgagaatcaaaaaaagaagaggcaaccaaggaaatgtgtt

SEQ ID NO: 5833 - DNA, 1263 bp, Glycine max
  Soy_ogl_4838 Gm15:377295..378557 Cluster 26
gatctgaatgatatttctattattttggaaccactaacccgatttcttctccctgcacgcacggaaactagagccttgaagttgatttgtttgatggtgaatggtgacgaccttctggcccaaaagtttatacgccaatgtgtttttcctcaatcattgtgatatttctttgaattcatttctaaaaaagtatgatataagttgagtctgcgactgtacattgtcacagatcttcaagtaaggaaaaactaaacaacacgatacccctaattttttatttttttttgtaacatcttacttttttgtaatttttgagatctaattcaaaaattttgtcacaaatccaatatatattttgttaactgagttacatttattagataataatgtccataatttaattttgtataataattaatatatataaataaaaatatataataaaatatataatgtggcaaaaagaaataaaaaaatcagattctaaatgttataaaactatattatataaaagtttaactaaaaaagaaaaaacaaagtgtaagaaacaacttatattatattttttttgtgtcattttttaaagtaaaaatttcgagcgtttcttggctgtattgctagtcaaaaagttgttctatcttctaagacaaaacatgtaaacatcgaaagagattaacctgacaaggacatctagattcctcaacgcatatataattaataatttatacgaggggagccataagttagtggagtttgttgtaaaatgataatgcccttatatatagagattacttgcatgttcttgaactgttattttccattctcagggttgctaaaaagggtttttaaaaccagttgttaaaccgagctgatttttcctctggctacgttcctaatggcatagaataaaaaatgttcgcattttctagggacggaagagttacctcattatttttcccttggaaatagaagtgactaacatttctctgtttcaaaatgtagatggtaacataattaagtggctgcacttataagaaaaattgatacagttgaaagcctggaaaataggtagagcatgcaatgagaatgaaagagatgatcctaagtcctaacagtagaattctcagactcataatataatggctttgattgttcctccttccaactttcttggttgaaccagtctattattactgtaattactataagccaagaataggccgtttggatcaactaaaaaattgacagtttagtgttttgtgg

SEQ ID NO: 5834 - DNA, 1100 bp, Glycine max
  Soy_ogl_4839 Gm15:414701..415800 Cluster 26
cgttcaaagttcctagaagagtgagaaaacgtgtatactaaagacacataagtctacaatggtaagacaaaagggagatttgtttagagggcagaaacaggaaccatatgacaaagacaaagatcaatgtcatagagaagttgaataactcacccagcaaagatccatgcagaaaagagattgacgatgaagaggaacgaggtgattccgctgattgtaaaactcctttgaacagaaggaatcagattatgctacgtcaggattttgacaatcttgcacatgacgtatttgctctgtactgtactggggatcaaatccacttggacactcagacaatacaggaaattaaaagtttcaatttccaacatctgaatcaaatggcatggatggaactatcaagtatcaaccatatgctttttttgttcttaccaaaacatacataaatgcagtttaatggaaggtacagctcaagaaccagatgaaatcgattctgttctttttttcaaaacatactaaaattctataggaagatgagtgcattttttttttttaactcacgtgattttatacatataaattacaccttctgaaacttataattgttttgaaaataaaacttggagattatcttcttcaagtcatgatgagtattgtcttagcctaattattcactctaagtcaacagacagacaaaactatgcaacccaaccccgttgacaatatgttctaagaacatttatcttcattaattttccaacaagtgtgcaatcctccaatactcaaaagtcaaaataagaataatatactgtagatagctttttaagaaacctcactgacgtgatatcatgaataaaaagtcccatattaatgaacggaacagatccaatagccattgccttctttgaagaattaatcattaaaaggaaataaaaaataaataaaaaatgggtaccatctactgaatctcacaaaagtttttttaagaaaaaaagcagttaataaaagctttacaaggatcaacatatgagaaatgatatattagtcataagcataattaaggagtataatgcatatttgactttcattgatgcagaaaccgt

SEQ ID NO: 5835 - DNA, 1100 bp, Glycine max
  Soy_ogl_6272 Gm18:59342801..59343900 Cluster 26
attacatagccactaaagcaagcacattctccccactacaatacacacacaaacaaacaaacttattttacccagaaatacaataccccaatggctcatcttaaacatggttgaataagttttatttagaatgagaagcatgcagaagattgttatagggatggaatcaaatgcatgacttattactaaaataacacttttaaattttaataaatcctctaataaggacccattctcctttactaaatatccattggcttattgcaagttgaccccattagaattgacaaagagcattaagatcaatctagacagtaggaatgggaaatgggaaatgggaactttcaaaattatggacagataaggaatataccaaaaagagagaataaaatttattgtttacaactaaagttacacagacatggaaaagtataaaaaaaaggctgaagagaaagggaaaaggcagtatgatagtaaataacaacaatgagatattaagaaacttactattccaatcccaacttcttattagcctttgacttgttccttttccgcttttttgaacctgaaccatcaccaacagacagttcacgtgacccatcaccaatagacagtgcaccagaaccaatgccaatggacagttcacatgaaacaccagcagtagactgttctgggcctggaaggagattcaaatttggaacttcagtaatggtgatggcttgaacggatgatacatgttcccgcatctgacattcctgattgaaggaaggcacaggaagtgcaacttttgtctcattcccattagcagccacaggaactgcaaccagggatggtacatgtttgacggttgctgaactagcattaatgcattccgatttggtcgatctgactgcaccaaaagtactatatttcgactttattgtctcatatagtagccctgaggtagcaccatctgttttatatattcattcaattcaattagttactgcacaaccaaaaaggaaaaaaatctaaaaacatgtagtaaagaatacctagaattgacgtaatagcgttacgtgctgctaactgttcagcctcttttttgcttctagctgcat

SEQ ID NO: 5836 - DNA, 1300 bp, Glycine max
  Soy_ogl_6484 Gm19:411201..41151900 Cluster 26
taaaaacatcaatgcaattgcaataactataagcaatagcttagatccactctttccgataagcataagaacaaaatcacttgataatggggttttcagtttctaaaaagagacataactaattctttaagctgattgaaccgggtaacagatttaagaattcccacttccctgagtaaaataaaaataaataaatgctagctagtagtatatagaatgccacttgtgtgattcttatgcatatagacatagtccccattttttaaattaaagtacacacctgccattgcttctcccgaaaaagtatagagcagcacccaaacagcaacagactccacccaaaatcatcatagggccttcttgcattgcttacaatcaccaccaacactctgagtcatgaagggaggagggttgtgaaacggtttatgctaagttgaattggctttttgttcaaataggatagtgtaaatgtaatccaatggttccttcaaacaaatccttcattttaaaagtctttttcgcaaaccaattttctaaattatactcccaaagattgtatatatattgaaataattttgtccatcacacataagaagattacaaaatgtacgtaggagtatcacgaaagtacacaagcatatatagaagtataaaatgaaggaacattaggaacattatgaacaagcacacgttctatatcttgcacattgataatgaggtaaggaaaggaagagagaacatgacaatatctcatgaagcttacaggtaaatgaaatctactaatcatacaagcaaataaataggaaaggaaggagctaacagcatacacagtgagacgaagagaaaaaataacaaagagaaccatatttataccaagcgaagcctcctccttcttgcattatgagctcgatcactatacacgtaacaacagaaggagcgcgaaacgatagaaaaaaggacagagcccttaaaatatgactcgtatgggcacaaagaaattaacatacccttacttgagagaaaagaaactcctttcttgattttttccatttgtttgacagatatataaaaccaccattcagattcagcatgcccgttccctaggaatatctgctaagttccttttcataaataaaacaaaataaaaggataatataaaatataaaagatcaaattatatcttaaattttattcgatcaaaacaaaaataaataataatcgaatcctctttttaattatttcattttacttttgattttcttatttcattgttttatctttttaatttttctcatcatct

SEQ ID NO: 5837 - DNA, 1264 bp, Glycine max
  Soy_ogl_3276 Gm10:240937..242200 Cluster 26
aatgaaagataatctttaatgtttaatttagttttttctgttgaattatgtataaattcaaaattttaaaataatattagaacttattctaatatagaatatagttgttgtttaggcctatgttactcactatttgacaaatatggaattatttacatatgtttgatagtgtaatcattatgtttgagatgtctagatgttagtatgagagattttagatttaaatgtgaccataataattggcagcgtaggaggtgttatggtgatttcaattcaacttttttttttcctctcaacttcttcccaacttgcatttgcagatgttgggcctctacattttggagtttgatagttcgagacgatgcgtggccagctgagagccacttcactttgcggtttcaattctattttatccaaaaccattaaattttgtgaaatatatatattagtaacattttttttgtgatgaaattcacatgtgttgtaataaatatgtggtttaaactttaaattctgtttttatgggtctcattctcagactagtaaattccaaataagagacagcgtctttaaaaaagagagaaaatatgaccactataatttcaattagaaaatgtgtcctagcacttctcataattttttgatatgtggggtggagaaataggatcatgataggtacagttaaattcaaatgttataagtccagtcaaattcaatgaggctcattacataaatgtattttttttcttatatgtttacttaaatactaattagttaggattttgtcaaattaaacatatataattcgcgagtccaagcacgcacataaaaatgcaccctccgacttcactgacagatattgtattgaatgtgcatatgaatcaatcaaattaatatacaaataagaagctcctctcttttgggtttatggttatttaaatgataagatctatttcctttcattgtttatttgatactttcattcctagctattgatacatgtatagttttccttttctctgtcttcctactttcttctatgcatttttttttgtttatattctttctacgttgaagttaaatagaaaagaacaaaaaacaaaaggagcagttgcagtctatttaaattttaatggataaaggttaaagaactacatttcagtttaaggaatttgaaatttgctgcagcaagaaagactcttttcatagtatgggggtgaagcccccaggtaaggtagaagggtgatttgataattatgtctcg

SEQ ID NO: 5838 - DNA, 1200 bp, Glycine max
  Soy_ogl_3487 Gm10:40883801..40885000 Cluster 26
taatgttgaaaataattggtcaagaaagtagaaatcgtttgatggtaacatacgaagactttaattaattgtgtgcttaatgaatagacagaatttataacaaacaaaatatcaaaggaggagaaaaatatatcatatcaaggaagaaaaatcgtagcattccaattaagttcctagctatatctcctgatcatgagaaattaaacagtacatattagaatcgtaactggggatagggaatgcatgataatgcaagtcacaatcacggtcggtatcaggtgaagtccaacgaatacaaacagtcgcactacgatattactaattaataatattggaattaatattaacgtgtagtactagtaacttcgatgaaattacaaacaattatattgattctattaagaaatttcacgagggatattaattcaagtaccagcccaatggtatgcagcacataaaataaattctaagagaaatattttattttaaatgaaaaaattatatattaaacatttttgtcaatgataagatgcgaggattgaaattagtgggatacttgtgtgttactatatatgattgtatgaaaactggtaaggtacggatggttattattttgattggatctatgtctacttgttaagtagaaagatatttgttggagattatgatgcaattgctaaatttaaatataatggagaaagtgacctggaaagagtgtgcatttaaaagagtaatttacaggagaaaaaaaatgggagtgtgggtgaaaattgcaattgccaatattttactttaaataaagaaataatatatggggttttcatgtcaatatataagattttttttctaataaatgtggtattttttattttataaaaactatattttttttattgatggcctaaagttaagttttaattagttgttttattttaactttgagactaaatgtatctcaccataaacatgtcttttaaaaaatagatgacaactttagctaggaagcaccaagcaaattcacacacgtaaatataaatattaattaatggaaaagtgtatacaacacaaaagcttttttgtttttttccttgtttcaattccgtctaagaggccaaattggattctttgacaaataaggctaaaatagcagcactttctggtataaagaggcagctccgctcagctcacaagcctttttcc

SEQ ID NO: 5839 - DNA, 1167 bp, Glycine max
  Soy_ogl_16 Gm12:4436120..4437286 Cluster 26
cttactagaagcagtaaacatcatgaataaaaaaaaggccataaataaaactgagatctccaaagaaaaagaaaaactgagaaccgaaagaatttgatggagaaagtgactgttattaaaaaaaaatagaaagagtgcactcgtgagataatggggtgggagagagaaaagagaataaaaaatggatgttttgatcttttaagtagtttgtattgggacaaaaaattgtcccatgaaatcaagtaataaattatcagagttttgtggtgttcatcaacatttaaattgtggtgtcccatgatatattttaaaatcaaacattgaataattagaattgttcaatctcacacttttttgtgaatcaacccgaccttacgtccgacacttttttttcaaaataaaaaaaaaaaagtttatttctcttcttttttcttattttttccgaggtgtagacacccttataagtatgccaagtatattttcccttctaatgataaagggcacatgttttccacaagtgattttgggttttggtgagcatgttgcattgggattatactatttatatacatgaggagtccacatggagacatgtgagttgcaagtaatggtgagggaatgactttggcaccacactcttcagaggccaagtaaagcaataattagccgtgacatacattaaaaaaatatatatttcttttttattaatattttattagtatgaaatatctatcaattacataaaattaacccttctcaaaaaatctaataaaactttacttaaaaatatcaaatttaacaccaattcagatcacctacaacttgttggtacagatacaatacactacattaaattagttaggtgtcctgtttttaattttcttctttctttcttagtttcttgtttttctgttaattttgtggctaatactaattaagatatcttgaggttgagtgtttcagggttgatcgcaccatgtcatgacatattctgtaggatcgacgtttaaatttggcaatgggaaatgtgttctttgaccagtgatcagtgcatggcatcactatataaagcaaagaccataaatatttttttattagttatactctgatttctgatttgtacctccattattgtagtatttctttttcttttagattttcatattt

SEQ ID NO: 5840 - DNA, 1300 bp, Glycine max
  Soy_ogl_5015 Gm15:12512101..12513400 Cluster 26
tacccaaacatgtacttaatctcgttagactaaaaaaagataaaattttctcaattttagaaaaatgaattaaaggtaacttaatttctataagtacaatatactaaattcacaaacttttcaaatcttactaagttaattagtaaggtacctaacttatccttttaatagtctaagctaacctaccttattttattttccattataaggttctaattcctaaagtataatactaattcttttagaaaaactataatcctaataaaaataagtaaaagtaagaacctaatgctattatacaaactataatacaaattattgttattgggtggtaatcaatcttcaaaggctaagttttctttactattccaaatccaacatatccaaactagctaagtctgtcactattaaatatctaaacaagacccaagcaccataagaaaatatacactagtcacttatatataaacatcactcacagaaaatatataagcccaagcaccatcataaaataacagaggattcaaccaactaattccaaccaagacaatcaccaagcaatgaaggagctgtggttagggttatccttacacaaatatgcccactcgcgatggcagcaacccaaaaatgcttgtggtggctacagtaatggtgggacaattttattagaaatgtaatggaaggaaaaaaaagaaagcaatggcgaaatggacaaaaaactcgtacctagctagtacgtaggcgacaactagtggtgacacaatgtggtcatacgaggaaacaacatgcggtacatgcatggtggtggtataggcactatatgattttgaggatttgaggatttgaggagcagaaattaaggcgagaacgagagagagtttaaatatgtaagtatgtagaaaacaattctatattgattattacttgaaccaatatagagtatatatttttacgtaagtttaaataacaatccatgcaatggatattcaacatcgattagttataaatcgatttacaaaatgctgtatagtgtctcattttcataacaatgaaatcatatgtattctttatcggtgatgatattttttgagtcaagtgagctgaatttgttttgaactaattaatttggtattgttttctcatataattatagcccatatacgggggattaatgttttataaccatgtgttcaaggggagaaaaaatggctagattaagatagaattattttttcaccttgattcagtatacgtaggaaggcggggaggtgatcatgattctaaggatgtcgactaattc

SEQ ID NO: 5841 - DNA, 1000 bp, Glycine max
  Soy_ogl_2589 Gm08:10200901..10201900 Cluster 26
tctggatggattttaaaactataatggtggggatctcaatcagaccacaaaatagaagggagacgcgcagcttcttggaggaaaaaattatgatttgtggagatacacgcttaaaagctacttaattaaatgagttgcaggttatctttttgaggattactggttttattttccttttggttagttcaagcaacattgggattgaagctcacaaatttaaatagcaaaattagtgagatttacacgttgcatagtgaagaaaacacgcgcatggagagctcatgcgaacagtgcaaccggtttgttgttgattgttagttacacgcatcttccctctaactcaacatgcaacacatcttgtgttactaagattattattaataaagttacatttgtttataaaaaagccataaaataagttgtttttacactagaaaattatgttcttcattatggatgacaattttttcttttgaatatttgtattaaaagtaatcctacttaaatcttgtagatcgctatcagaatatcaaaaataatttttttttctgcaaatatttaatgctacgtacgtaaaactcaaactcaaaattgctacatataaaacccaaactcaaaattggttaaatggaaataatccgcatgaacaaattcacaccaagcataaatagataatcggtgcatcatatagatgacggaactataaacaggtgaatgctgcctaaggtttatcttaatttattaatagcaaaaaagtggcaaaacgatggaaagggctaattttttttcaaaattatcaaatggaaataaaatataaattaatattcaaaaggaaataagtcatatgttattctacaacttctaattgaaaatcataaattatgttatgattttcttctttttttttctcctttttcattaaagtcttaaaaaaacattacaactttaatttttattttttttccaacacggccttattttatgttttatttatttattt

SEQ ID NO: 5842 - DNA, 1500 bp, Glycine max
  Soy_ogl_6793 Gm20:36624801..36626300 Cluster 26
ttgtaaatgcgcattaacattttttagtacacacttacattatgtgcactccatgttgggcctgcgacttgcttgaattaacaaagattattacaaaactacttttagttcttaaatattatagatattattatcagccgtgaaaaatattatataaaacgtcattaggatgaaaaaaaattaaggactaaaaatacaaattaattttccaagattaaaaactaaaatacattaaattataagcattataaagatatttaagtctatatattataagcaaatttcatttgcattacaataataaaatatacttaaagatgatatgaatataaatgcttggtcagcttccatctaaactttccaactggtgcttgcgttatgcaaatcgtagtcagcatttttgtagttcggtttgggtataaaaaacgttgtagtcagcattttagtgctttcagataaaactgagcaccataccaacgataacaagtggcagagttaattacggggacagttcgtgatgcagcgttgctgtttcctgcacaatatccgaatcctcagtgagacagtactccacggagtaatttagattaatataaaacaccattgttgaaattttgttaccacgtatagacttatagttttaattaacacaagcacttattttggctccatcaagttaaaattaaataattggcgtgcttctgttgaaatcaattaacaaaaatgtgaagagtaccttgtgaagaagtgctattggtggacgaagtattcagtgtggatggtgggtataacattggcgtaggttcgtagaagctgtaattttcgtatctaatactacaactcggagtaagaactctaccacctatcttgccattacaacaatttgggatttgtgagacagccctatctaagcaatcaaagcaatcttgctgagacaaatcaggagtacactgcaccataccatatagtgtttgaaaatttgtagcagttgcattatccgtagcatacttaacgataagagtaacccaatgaagcttcgtctttgaggttactcattaagttcccgagcacttgattgacctggtccacttcagttacatagtttaagtagacgaggaaaacagcagggttaggtttcatgacgccaaatattaaacggcttgagtagcgcaacatgaattggtcataatacatgattccctctttttggtttggacaacgctgtgcgtgagattgcctctggaataattgagacaactaattaaggcactcatgtggcttaagatctcctctgtagagcccaatggcgtttactttgtcttggttttgaccatataagaagttgtacaaaccatagttgatttgtgttggaagatagagtggttaaaagggtgtagagattggtgataggcgctatcgtgtgtagttcccttcgttgttgtcacattatacagtggtggcttggccttggcttgagataggatcacaaggagacaagaa

SEQ ID NO: 5843 - DNA, 1069 bp, Glycine max
  Soy_ogl_256 Gm01:50803128..50804196 Cluster 26
tacaacgagtctcactatttttaaaaaatattttcatcatatttctctcaaaattaacaattcattaattgtttttggttttaccagaaatatttaaaatttcttatttaacacaactaattctctgtcaccaagttaatccattttgggataaaggaaaatatcatattttttgagttgaaagtaaaatctaatgttgtgaaaaggacactcatacttattcttgactctcgaaaatgacttggtgattatctacctgtcactataaattttctgtttatcttgagactatcgtgtacttagattcaactctttaattttagagcttgtaatgacatgttacactattaattctgacatggtcatgtttaaaagaaagcggatcgcaaattaccaaaagtacgtatttgagcaaaatcccttgtcagtcttggtgtttgtttcctttcgccatttacaaagtttgaaggttgagttggaagtattgtgacacgtttacggcatgaataatggtgggggaggtggggagaatcaatagccactgtaattatataaaggacaaatggtagagcccgacatttatagaaagtacccacctgtattatttagtactttaatgaaattaagtcttattaaaaaattaaaccatttttttaaatgtcaactgataagaacattgttttcgataaatataataaaaaagaaaatttggtttctcaaaataatttttctttgcttaaaaacatttctctctccattcgtatatatacactcattcttcttgattaattaaaaataacaattgttacatttcttaaaaaaaaaaaagtcacttgggacggtgtacttaaaaaggaatcactagaaatacataggattagttaatgatcaaagtatcttttgtatctgattggtcatgtgcgcacggtgcattgaatgcaggaatataatgcatggcatcacagatttgttatcgatgggatgttgggggaatggtactcatgttgtactgtccaattgaccattctaaagtctcctatattttgagaggtcaaaatttgggcacgcc

SEQ ID NO: 5844 - DNA, 1386 bp, Glycine max
  Soy_ogl_761 Gm02:50864215..50865600 Cluster 26
ataagttgaatgattaagaaagagaaataggaaaaagtcatgaattgaatctcttttataaaaattaataaattaataattaatgtttgtcaataaaaaagtatcaataacattatattaattttcttaaaaaatattatagacattatttatctttttcttctctttctactactgataaattattttgtgatattattaactactagtcataaaagataatttagttacataatttattttaatttagtaggtctttggaatataattaataaaatctttcgtaaaaaaatatatgcttaacgtaaatagcactttttattaaaaattgatttgggttcttggtgacatgtaaaattggtgattgtcatttgtaatttttggtatttaaaaaatgtttaatttatcttctatgtaaagatattatttatatgttcttgtatcattttaatatatatataattataattatgaatactttgtgtaaattttgatactagtatatttattagatgaatgttaattaagtttcataattggctctccaataggaagtggaatcactaatatattgacttgtgagcaaataagctaacatggcaaataagaatatgctgatgtggcagtgtataatttcctaattcagaatttatatattattaatatttatgcaagagaaggaagtgcaacgcaggaaaccccctgtcctctgcggactcgtgattcataatgtgactaaacaggacctttttctttatagttacacaatttgttaggagtatagtgtaattcatgtataaataatatgatagaagaacatatatattgtagcaattgaatcgttggttagtgacttaagctttcactcacaggcacataaataaaattaatattgattgtggaagaagagtataatgataaaatataagtgctacgtgaggtgtaaataattaagcattatcctgaatcgaaggagcacagcacaagaaacacgtgggatgggagtgaggagtctaaaacattcacgaaatctttaaatggaattttatttatactgtagcaagcaacatgtctgtcaagaacttaacatcacgcatgtatatgtatgtaaatcccacccaagttccttttagatcaaaaaccttaagtcctattatttgatgtgttatgcagaaactttcggttgaagttatttccgatttcttttgttatctccaaaagagcttaattggttcttaaacatcacctcatgatcctacctaagggacacaatatgatagaactatcaaaaatcttattaaaaatgaaaatagataaatcaatattcaatataattattttagtcaattttgtagcaggccagttgttgtaatacgttgattatta

SEQ ID NO: 5845 - DNA, 1400 bp, Glycine max
  Soy_ogl_1135 Gm04:481601..483000 Cluster 26
ctataagtatttataagataataaaataataaaataaattgaatttttcctattagttgaaatcaacttgtgtatttaattagttagtttatctaagtcgagccttaatattaaaattcagtttgcgacgattaattttacttggaagactttagaccaaaatcacaaggactccccatgcacttcacatggacttgtcgtcaaaatatagttgtgacttgtcgtcaagctactgatttcgaatagagtcatcatagaatatttaagcaacggcagcctttgatttcaagctcttagcagccagctaatattcaaacaattactactgccaagagtgtgactagtcaatagaaatggcacttcacatgatatgtatatatagtcatttttccataaatatagcctttcactatacccatataaacagaggtaaagccatcaaataatagaaatcaaatttaccgatgattagaagtcttccattttaaaattttcaagtccagcaacaaaataatgcaagaaattaacaactaataaaacgtgtatttcaaattagtgttgaaattgaaattttatgcacactatttgtcatcgtggatgggacggagatcagtaggctacggtagagctagccatatggaactttcctgtgaatttgaatggcccgttcaaatctcactgtttaaaaattgcagacatacatgataactcatgaatcttattatcctttgcccccaagtttctgaaatcgagcataggcttccccaaataggcaaataaatctaataatgaggcaattcctgtatcctattgtatcttctactcttcatctctgggacatgccttatgatacgtgctagtttttgcattttaaaaaaaaaatatcctagagtttttagtcagaaaaaaaaatgtaattaagattggaagaaagggattcagtttcaagtgaagccgtataaaccagtcaattgtctccaattaataagtccaattctataaaaacagtgtgaatataatttaaatctagctagctaagttttgatggggactaggaaataattaatcacggaattccattcagtggacttgtatttcgattagatcagtatagtcagtacatgttttgtacggcaaaaatttccagatagtttttgaggggtaatgcatgtggatccaaccagcaattacatttccatctcacaaaaagagtggttgatcttgatatatatcaaaatgtaactctaatcacttacgctatcttgtcaagaaatagtagacttgcgttatgattagatcaatggggtttaccttcccatcagtactggacttgtattatatatgattagatgagtacaaggaagtatatgtttttgcatgcgcagcaaataatcagatga

SEQ ID NO: 5846 - DNA, 1223 bp, Glycine max
  Soy_ogl_1162 Gm04:1458739..1459961 Cluster 26
tcccacttaaataaagacaattttaattaatattaaaatttaatttttgttgcatgccaattaattaaaactgtacatgctaagattgggagataaagaaataaagtccattttatgttttaaaattatgcgggtcaatccaaatggattaaactaatatttttcctaattcatctatatcttgtatgttgtgaaagtaagaatgtaaattatatattttaatatcctgataaaaaaaatatttttaatatttatgattgaataatgtttcatgagctcattaactaatttgattcacttttattagtgaagctatgatggaatttcgcttcgtaataataaaatattaaaaaagagaatgacaaataggatatactatgaatcattttttctaaaacaaacgaagtatctttataccgaagcaaagacaagaaaacaaaagtgatggcacgagaaagtttgtcaagaaaattaaagaaagctccaaagcaactttgataaaagaagccacttcaaacatgcatgcaactataagacccaactacttggtctcaaaggtttgctcattatggcaaaccattgaatgtgtagaaaaactagagtagccacatgtttcatgcacggaaagctcaagacacataaaggggacagaagcaagtaggaatgagcaaagttattgagcctttgaagaaatttggtaataaggctttatctaattttatcagcacatcaaaatatgtgatttaaataaataaataaatataattacgaccataatgtgattaatgtccgactcatcacacagcttacgttgggaaactcggaaatttaacaatttgtaaaaaaaaaaatactgactagcgccttaagaaatttaacataaaaatattttattaaaagataaaaaattataccgaccatgattatttttacattttttataatttctatagtaaatattttttattttcttaataagtactctaaaatacttagttaacaagatcaaaaaagaaaatgctaaccatagagtatgtaaattatgtaattctcaggcctatttttttttatatacctttcgttatacacctacttatttgatgggaagaaaataatggagtactattagtttttcggattgtgttattttggctttttagatttcaattgccatatataaatgggtcttttgggttttctataatttataatcggatactcac

SEQ ID NO: 5847 - DNA, 1165 bp, Glycine max
  Soy_ogl_1181 Gm04:2271101..2272265 Cluster 26
ttctaagcattatatgaatatttctttttatgttaaagagtattaatggagcaaatgagtccaaaattgtgaagcatagaagcagtacttccaagcattaacaatatttgtttctgtgttaagagttttagtggatcaaataagtccaaaattatcagcacagaagttcagaagggttggccaactgcgtgcaggtaacgacatgtacagcgtcataaattaattaagtaaatttttggtggaaataataaataatgtgagttaagcatgatttgaataagtgtttcgttcctttctttataaagacaaacactagtctaatcaatcaattggtttgttctcatccaatttaggcagagttggaattcatgagtaattctcacctaggcacatggataattgcacatgaagtttgcaagttgatgaaacattcaggaacaaggaaacagataaagctcccgtggtaggcctaagagacagtgattatggcaggggttgaattccataccacgtaaatcacattacatatcagagagtgtgacaaggggtatgtttgatttaaaattataaaactattttatacgaattacaatataaaattatgtgttttaatgtataaaatgagaagaaaaaacgtgttgcattgaaagtaatggtggagttataatttgaactaaattataactttctcattattttaatcattaagtaaagaaaaaaattacatttactaattaatagtttcacattgaattaacttttattgattgatatagctttcttatcattgaaattaaattattagaattaatattaaacaagtaacaacataatacattgtgttaatagataatttttttttttttgaaggaatatagtacctgcttgcaatggaaaccatgacgttttgtttgtcgttcatggaactactctagcatctctcccatgtgagacacttattttgagcgaaacaaacatttttttgaatataatttaccgaacaaacatttttttgtcaagttgctatactaatatacttcttcacttgactgtcccgagttgcataatggtaaaagcttctcagattatcaaattattaacacataataatatgaatttataagttatatattaatttaaaatatatttgtataaattagttgta

SEQ ID NO: 5848 - DNA, 1491 bp, Glycine max
  Soy_ogl_2134 Gm07:2573201..2574691 Cluster 26
tccaaaacaatattgttcagctttctctcttgtgcatagaatgtaacaataataacttatacagataatgttctggatggattgtctttgtcacaaaccttagattgtttaagcttataattacaagaaatggggagcacaagtcaatgctacataaaataaaataaagatgactaccaaaaatttcttagtacccccttagtgttaaaagaaaatctaaaggctagactgctagagtgccattttaagtttagtaagtgacttatgcaactagtcatcgtgattgaaaaatggacattcaagaagatgacaattttttttggttcccagagatgacaaaatttaggcacaacaatattggccgacctaaaaaaaaatattggcctgttgtctgatgatatgacaatttattcgccaatggactggtttaatctggcatgatctctttacccctttaatgaagatgatgagcatgaagaaaataaataatagatagcatccttctaaatttctagtttgaaaagcaaattaatttacataaaacattttttttaattcagtgtgaaatttatttatactattattctatgatattttatcaagttatcaaatgaaattagtttttaattcaccactctcttttttcatttttcttacagcaattcactactcttttaatagtatatctatccgtgatttaacgataatgtataggggagttaaaaaataattttgttgaataatggttttttttttttgtatgtttatccataccataatagtgtaacgtcctggctagggccgaagagaatggaggagccctgaggatttgaaggcccaaacccggttcgttgttttggtgtttttggtccatcaagtctgaaattgaatattcattcattccacgactttgactttgagacttggtgtgccctagaagaaatcgcagaatctttgtgttggttgctcatgatgaatatgaactcctccacggtgcatttttgttcctctgtttcctatcgataagtttagttaaatttatttattgaaataaatatttattttaataaaataagtatttttttgttattttagtgtgtttatctaaattatttctgctttaaaaaaatatttttgtatttattttaagaaataaatcatatatgctctttaaaaacacaaatataaaaatatttattaaacaaactcactcttatctcatttagttacccattttttttccctctcccttatgagcatgttattaaaactttatatattgtttttggtagtttctactagtgaaatcgtacctaccatttacaatggggccattttccaccaatttgggcctaagcaagggaatatgtgtgagcatcttgatgttcggtggaagagaacatagattcctaagacagtgggccatttgagtagtgggtcagtaccacatattactatgacttgtttttgagttggacagttacaaacgcg

SEQ ID NO: 5849 - DNA, 1560 bp, Glycine max
  Soy_ogl_2905 Gm09:439945..441504 Cluster 26
ctttaaactacaacagaccctaactagagtagcccgaggcccataccaaaaagcggcatatgctcacatagcatttgcactaccacaataggaacccatgacattgtataatgggcctggacttggggcacgtctattttctctttgcatcctatatttatcaacgatgttatgataacccagtttgcttatgcatgcccatacagaaaatgttaagggtgaaacgaaaaaatagaaaatgttaagaaaagaaaaatactaagcgcacagtcagcagtgcctaaatatacttactatttgctaagcatttaaaaataaaaaaataaaaagacagtaccaaaaaatagaaaatgttattgaagtataaagagttccaatcccggcacaagacgtacaattgattggatagaggacagtatacaccaagactagaaaaaagaaaataaaatgaaagaaagtatatgctgcaattagatagactaacaaatcagcagtcttacgacgaggttatttgtaagactttttttttaaaaaaaaaacagaatttgttatttgtaagagtgaattttattaaaagttgttgtatcggaaagaagaactttaagttgtaaaaaaaaagtgatgtaattaatgtagaataataaattaaaatgcataaaaaataataaaagagggaggttgaagatggtcttagtgtccaaatttcccaactctttatagaaaggaaaagtagatagtgataatgatgctcataaattccccttttacagcaacacatgcatatagacattgatatactgagttgtaaaaggttactactattgtttttgacgttctagaaagcagacattacactctagataaaacccatcgcgtccactatatgagataaaggcaaataatcttgaaagaaattgctaggtataatcatagttcataatgcaatgaatatcgaatagaatcagatgttcggagcatcacgagactagggtgattttgatggctcacatgaaagttataaaggcacctagaagtcactcttaatgcctccattcttacggcttgctgcaagtgtctatatgcttttggaataattaaataattaagtgaattatatcctaccctaagtcctaactcatgagctgatgctaccaagttccaagtattgtctgaatccctattcctcattcttcactctggtccgtatgtgtagtactcatcgctttacccctagtttttatgtccttcacttcacatttaataaaagcaatgcgtttggtttgagtcaacataattgcataataattcctgtttttttttttatatagaggaagaagatcatgccatttcattaataatcaatcaactgggaaatacaatttgaaattcctcttattaaaagtaaaccataattcatataatgacgcgtcatagttttattaagtattttagttaattttttttattaagcttacgtaattttttttagtataaatacattttactcgtataaataattgaatcacacatgattaaaaaatcttatcttcaatagtggtt

SEQ ID NO: 5850 - DNA, 1277 bp, Glycine max
  Soy_ogl_2936 Gm09:1702201..1703477 Cluster 26
cctccaacggtcgaagcactgccagtcttcattttgaccatcaaataggacacactttctagtttatgagcatagaagagatcatgaagagtagctgcatatgcatctgttattgttcccattgtcctatacacaccatgaagtttgttagtcaatagtttgatccttgagagaaaaaggaaaatgggaaatcgttgcttcacctaactcatcttcctaatgtctatgaatttcttttgctccctctaaagctcaaaggcttgcaatcattccattcttcaaaaattgatggtaggttgcttcaaaaaagtagcccaacctcctccttctttgaacaaaagcattgcattattctcctattattttacaataaaatattgctctttgaattttgttcatgtcttaaaaggataaattaataatttttttcctttatgttcttcttcctgctagcatattttctctgctttcattatccggtagtcacaccactaacttcaatttcaaccttcacaacaatattcaggactatcattactagcttcttatagaactggtcaaccaaaacatattggtaaatgtggatttctagataaaatgctataaggacagtcaattcgtgtgtatagaaaatatttatcgagataaatcaattttataaatagatctatgtacttgaggggttattctttgattctcaacagtaaaataccctatatttctcaacaacaacaaaaaaaaaaacaattacaagatggaatttcttctaaacttttgtgtttatcatcgaattacacgacgcctttcttgtttctctaaaagcttataatgtgcatatatatacttaaaactcaaaactaacactaacactatcaaagtgtacaaagtaaagaagtaaaaagaaaacattcactgttatttggggtgaagtactccacttaaattaaggaatttctttcaataagtgttagcgaatacttgtgacactttgacattaaaataacacaaacattttgaattgataagttttagcttatgctcaagacatgtcctgactatagaataaaacaaattcccactctctaaacttttctcacctatttgttttatttcgattaattatcatatggtaaaatgactaaactccattctcgaagcagaattaagagggtgttttttgtttgtatatcatttatcacccattgtcacttgtcacttttttcaaagtggaagtgatagaaatctaacacaaacatactatatgtcaatgagaatta

SEQ ID NO: 5851 - DNA, 1100 bp, Glycine max
  Soy_ogl_3694 Gm11:2526301..2527400 Cluster 26
taaaacctttatgggaatagttgaatgaataacttaataccattcaacccatttctgatttctgtatttgtaatccttcactatgctcaacatgaatatgtcttggctttcttgatgggtttgaatgagtctttagcaaaatcaaggctcagattattttaataaaccctatccgtcccattaaaaaagttttttcattgattgttccagagaaaaaaaacaaggtgcaatcgaattacttactacaccatctgaaatgcagttggattttacagctctaagtggtgccaagaaagttgattagaagcctaaaattgctaagaaagatagcctcttgtgtgcctatcgtgtattattaaggcatacgaaagatcagtgccacaaactccacgattttcaacaccattgctaatgctaaaaagtaaaaagcttccattaatcaagtttctgatccttgtattccttcttaattaactgttcaacaatatcagcagttaatgtctctattgcagaatcaattaagttcctagtgcttctatgcctgcacaatcccctagctagtgatcattttaggatcctttggtatggtcctatatccatcaatagttcccatagttggttattggattcagtttcttcttcttatatcagtctctttaaatattttttctttcttacacacctgtctgtcacaaacaaatttgtttcattacccaataacagttattggtactatccagcttaataactccttgttgcttcaagatgttctttttgtgcctcaattttaattcaacatattatctaccagtgaaatataactcttcttgcattgttctttttcatgatcattttgttattcatgagctatccacatccaagttgctgatatgcatatataggtttgaataatcccacagaaatatcataaatacaataacattagggttttgcaattagttcatgacagaaaaccacctaattggataataacctcaacaaaccacaggtttggtttaaccagttaccagtgttctagaggaaaatattgagtttggtaaagcttgatcaagggaaaccttctggtgttctggtggtgg

SEQ ID NO: 5852 - DNA, 1173 bp, Glycine max
  Soy_ogl_3920 Gm11:36044001..36045173 Cluster 26
tattatatatattacacagctcatacacagcccacaattagtgccgttgttgtatgattttgatgctcatctctcggcttataattgggaaaatgaggattccatacatataaagatttgtatcctttaatcatctaatctaaatcattatttttatcaattaagaatatttatcaattttattaataattgatattcatcataaaagttgattaattacttttaataatacttttttcaatcactttttgtcaatcagaatatttaaactcaatatcattcggattaataattcattggtatttaatctaaatcataaccaataggaataaggtcattcttgtttaatgctttaagcatatagaatatttatgttctctcgatgatacgatcccaagcaatagcatcaacattaccttaatggtgaaatcgtataagatccctccccaatttccaaattttccttgaatacatgggtaaaagtcatgcatgtgtagaaattattggcacttgaatggctagcgggaaaaaaaaaataagtattcactatccacccagcagtgcacgtgcaattattttcatttctcaagtctcaacgatcgtaacttctgagaagatgtgtactaaatgaccaaattctggttccaagttacatgccaaccttttggtcagtccccaccagaacagaactgaaacccatcttggccaatagtagtgctgtccaaacgtgtacaactcagcaactcatattttgccaaaacaagtaccatgcctataacaatggcattcagtcccatgaatatcaattgcccatttgtttatttatagttttcttacaaccgtaacaggtttccacgttgcaaaggcttctaggaactgctatagaaagaaaatatgagcttcttttgccttggcacatttaaataagttaatttcttcttcttttttttaactatttttaaattgtttgctaaaatatagttatttaataaaggatagtatttcatggacttctaatttatttttttgaaatattattttatgaaatgtgtaaatttacaagctcctattttattatttttccatattttctctcactattttattaaaatttctcttttactccttttatcttcaacaacctttaatactctcgtgctctcatcaaatatc

SEQ ID NO: 5853 - DNA, 1745 bp, Glycine max
  Soy_ogl_4604 Gm14:1802001..1803745 Cluster 26
ctgcatggaactctcttaccatcacagggtactattgatatggttcggcaacagaaacataatataatgagttgtctctacattagtcaccctatatatgccttataacttctgaggtagcatcctttagtatatatcacatatctgatattaatattgctgcatacttgcaattgtccaggctaaatccacacaccttagcctaacttttttttgtcaccaacacatttggtttcttatgcatttttccaaagcttgctttctggtttccttgtcaatcactgcatgaaactctcttaccatcacagggtatggatatggcccagcaacagaatccataatattatgagttgtctctaaattagccatcctatcccttttaacttctcaggtagttccatgaaggtcttaatacattcaacacatagcaaactaggtttggactctgtacgcactgtcacatcctaaataagaaaacacatttcgaagaaagaccggatattagaagaattaacatttcaaattgttactattgcaacagcaacgtagtcgccaaagagtcccacatcagtcagtcaagaaagcagtagaacatgtaacagaaataaaagcaacaacaatatactgatcaaagcatacctttctcggccttttggctaagatcaagtgtagtatctgttcttatcagtttaatatctgatacgtgagtcattggctcacatgatattaaattaattttttaaagggaagagcccatcatagtagcttgctattggggtttttaagtgtcgcctatttcttgcactacagtataggcctggcacaccctaccaaatagtttaatttatggttgtattctttgtactatcgaaccattagaaatgactcaccatagaacctattggctattagtgaaaaagcttagttcttgtaagacgttttgttaaaactgagttattgagtattttattggattagtattatgttgtgtgcattttattttattgttttacacttaaatacatggatatatatgatccctaggcacatgcattgaattatactatacaaaggagttaagagtttcttggcagaaagtttattgactttggtgttttatgctgattcaactgaagtaatttggctcatttactagttaaattagtactcttgcttagttttttttttttttttatcttttactaactacttaggtatttagctatctaagtcacttgatcctggcctgcatagccttgtgagatacagatgctactgaaaatcagtttaccataacaaaagtagtcttctgtaatccacaatttcgattttattcggtacggtaaaattaatatacaattgagcattatatccaatgtaagataaaaagattagagtttatcagaaggaaaatccaagtgccaatcttattaaaacctaataatggcttaacctcattgtaaaacaattaaatccaagagaagtcaagtccctagctgaatgccttggcagagatttagaaggtatacatgactaattggagccatttcttctaattccgtgagtatagtcgtctcagtcacagcaaattgaaatccttttagttggggttataattggattccttgtgtcattattggatgttacttttgaaggcttataataactttcaatttacttagcattgcacttttcagaagtattgtcgttccagttcatattcctaaaatcatttttatgtttta

SEQ ID NO: 5854 - DNA, 1086 bp, Glycine max
  Soy_ogl_6247 Gm18:58298543..58299628 Cluster 26
gagcgactaaaattaacatttatcttacaaaatatgagtaattttgctcctccaaatgaactttttgagagtaaaatgctagaaaaagctttggtgagaaggcaaaattgattagtggtggttgtgggaagaggttgaggttgaggggcatccataaaaggaagtgaagggttgaaattgaaataatcgtggggggacagagggggcggagtcacgtggggaacacatcggagttcacgtgcaggggcatgccatgttgcgccacgtggtcccatgattgcccccgtgcgtgtcactttgtgtcttcgtaaccagacacgcaatctcccaataatcattggatactgtcgaaactttccatcgcacgctcctcccttgcgcgtgcctttcacttccctcaaacctcctcttctcctccttttattcctttgcctgcccgccccaatgcttattattatgctctctgccaaaaatatctattgaaattttcttttgttgaatttaaattagatacttaaaaataaataactctttaatttgacatcaattcatcgtattcgtatatcttgttatccacaatcatatcatggactgttataaaatacgaacacagataagctggcatgtgtgtaaccacaccctactcaaaaaatccacgtccaaatttgataaaaggtgtgtttggattttctataaaagcatatttgagagtaaagttgattatttctataaaaaatatgtatgaaagtaaagttttttcttgagacttagttttagaaaaaccaaactcgaaataattttttaaattacaatctaaatgtgcacgtagaagttagaactagcagcagtttcaattttgacgtgaaaaattaaatctaggattttataagtataaataaacacatgtgacatgtttttttttaattcgtaaaaattaacttcaaatataatgaaatttaaaacaactcatatatattatttaatcaattaagctggagtttcttattaagcatcgttaagcacatgtaatgtgttgcacacttaattttagtttaaatttataatgaaaaattaaattctaccaaa

SEQ ID NO: 5855 - DNA, 1481 bp, Glycine max
  Soy_ogl_6607 Gm19:47183501..47184981 Cluster 26
atgtgatgaaaaatgaagagaaattataaaaataagattaaagaaaaaatatatgtaggataatcataaataactctatttacagtgtccatatttgatttatgcgtaaatctttttatgtgcatgttaaacttacattcactattagattagagtacgtggccttcaattcatgaatgtcttcaccacacacgccattggcccccttggcaacaactggtcaacgaccttcgcagcctccatataaggacctcatcaaccaccatagaaacatgtgtgcccttcgctttgttctttaatctgttttttccattttctccatataccattttttttttatcaactagtaccttttaaaaaaatataaaatcacactgtattagtatcctaattctttttatccaattagttttcaaaaaaaaaattattcattcaaattatttctttagtctttttatgtagctactttaatcttttgtaaagaaaagtataaagatattttattttttgaaaaactattttaataaaaaatatttaaaaaataattactatagcaacattttttgaaggaaaatataacaacgttaattttaagcttacttagttggtgagtaatttttttttaggaaaatacatcattacttcgtgcagttcgtgctgtttttttctcgtaacaaatagtattgctcattttagatatgtaattcagaatcaaacgctgatgcatgtgacataaaatatttgactatttttatttccattcctcttcattacttcattactaatagactccccttttgattttcttttcctatgatatcctacaaaatacacttccctttagattaagttttcctcttccagattttgaaaccttcgtcctctccctttctctcgttcaaacttcaatctcaccattctttttgttctacctctcaacactgccacattcatcattcagtcctaagaacaattcaagtaatcatcatcctttggcactttgtgattggttcaagtgattatgttcacacaaggacattgatacattctaactttgtcttgtactttcaataattgatttcatagatccaaaaagactcactagacgtctaaaaaactcttgacatatcctgcatgaagtgaagtcaccgtaccagtatactgtatacacatgactttatgtccctttgcaatcttgtttccatcttttacatctggaatatacgaaacattttctctgccaattcccccatataataaggattttattataatctctagagcaatttcttgaatgtaactctgtgacgcggaatgagaacaatttcattaatacaagacttatgcttgtgtgcaaagggaagtgtattttttggtattttaaaaaaaaaaatcaaaagaagagtatactagtaacaggggtcgtaaaaatagcaaaagccttatatttttatcttttggtttctgggccaagtttttcc

SEQ ID NO: 5856 - DNA, 1300 bp, Glycine max
  Soy_ogl_6917 Gm20:41855101..41856400 Cluster 26
tcaaatatcatcctctccaatgcacaacacatgtcaaatttatatcgtatcttataataaaatctactaagctgaaataaatttacatcgacggatcaacatgttgaacttaaggctaaatataattcatttagttttacacttaattgtttaaactaaaatcagttatgcagatttaaattaattaaaattaagctttgtatcgattgacacttaattagtttaccaaacccaaaggcaagatattataaatttaaatttgttggggaaaagaaaagaagttggatcacggagcttttcctagagtagctagggcatataactgttggcaatgcagacgaggagactagttgtttagacccttccactattatataacttgatgatagaactgaatcatctcacacagaatgctaccgggctattattagagaaatatttccattcattaattagatttacttttatttgatttttttatatatatatgagtataaaaagaatattttttttaaatctcttttctcatttcacaaccataattggatgtggaaaaagacatgattcatttgtatttttaagattgatctttaaatgtaattagagattgtttagtaatagccaaaaggaattaaaaattcctatatgtgtggcttttaagaataatgaaatgtgtgaacttatcataaattcataatgtcttcaggcgcatgtagaagtgcgactaggtgtaaggactttgatgtccaggtcaaaatccagagaagtcaagaggtggagaaattaaagagagaacccatattcatttcatgttttttctgtctttatacttttatattgagcttcctctcgtgacccgtgttatttttgctagtaaaagaaacacttgatacatttccccctctttccatgatttgagaaagattgttgcaagcttgcattaaggataatcattagtagttgtcaatttgattatattactttcataaatcaattgattagtttgtttaaaacttgaaattagtggcatttaaataatcatgtttgttttggcagatcaaccacatgagtcagatttgcaaacaagagcagagcagcctagatcaagaacatatgcatgtctcgcgtccgtaaggggaaagtatagtccaatgtgcagtgtgctttttaatgacgagtatctcagtatttctctttataatgttttttcaattaaatatttggttgaatgagtggcaattattagatttgacaactgcaccactagcaattcttattaatgacccggattctatgtttg

SEQ ID NO: 5857 - DNA, 1300 bp, Glycine max
  Soy_ogl_193 Gm01:48101501..48102800 Cluster 26
caacaacaaaaaggccaaacttaaaaatgaaaaggaattcattcagtaaacaactagtagccacgttattagcacaaacagaccctcagctaaaatcatcatttgatttgagcaactttgttttgcttcccacaaatatgttctgatttcgttttctttctgctgttgttctttaacaaccacaatctatacaaatacgtcgggagggaactctattcataaaagacctttcaagttgcaaagtcattgatgttgagtgccactagtattagtattagccacactttcttgtctattttataatcattagttctctcgaaaactactaaaagaaaccaaaaatctttgaggtgggtatcgcttttttcatctcttcttatagtagaatagaaacgttgccaaatgtcaacctagctaacggtacattaaaatcaccccactctgtcatattcacactctgatttcaagaatattatattactgttggaatctgacgcctgcttctaagcaaatttctggaaacctaggtttagctattataatagtatctaaaaattgatatatgaattctttgttagatttcccaacatgtatataagctgtgcgtgaaccacaaatggtgggtgcttgtcgcagcggaagcgaatgagaggtcccagggttagagcctgctctgataacatgttagatttcattttaaaaccaattgacattaagtgaagttacccaacaggtatataagctgcactctaaggattgaggcagccgatgtgggacttgagtatttttctcaatattcttgatgtgatttaagcttttttgaatttctataattcaattatgaaaaatgatggtacataagaggatgagtttaattagctataaataatgttcatacattaatatattttttggtaaatactataatgagaacatttgtctttctatacgatttcaaatatctttataaattttgattttttaatcaattatgaaaattaactcaaatcagtttgggtcctaaatacacttaaaaattttcatccttttctaagaatgttttatataaggattgaacttcagtcgtttcccctacaaatttaatgtgtacgtataccaagtgacacttacatactattagtactgtttgattacatagtaaattttgaacatctttacttaagtgtttttgaaacttttatttatgtatttatgaatttatttttttaggaatagcgtaagcccgaaagctgaaccagaatataatccatgttctataatacgataacatggttctcat

SEQ ID NO: 5858 - DNA, 1387 bp, Glycine max
  Soy_ogl_3799 Gm11:8272114..8273500 Cluster 26
acggtaagaagctgactagcaaccaacaatcctttatcttgtggatatggcaaaactgattggaatttgaggttttaaaaattaggtacaacttgcaagtgaatgaatgaataagtgattccaacttaattcactccacaaatatgtacaactatttattcatgcgtgattttaatgttaaacgtcaacctttgcatacaaattaatttgtgacatattccgtatgaatgatggatgaaaactggaattcaatttgtcgcctacttatccctttccttgttctcaccttaacttcaattcagaggattttccatgcaagaatgtaagatagacgagagcgttaataagttaatctttttttttttttacatttaaaattttgtttttatttagtacaaaatggttaaatcgtacttcttttaaattttacaaatggtttttcatgttgataaaatgagagaaaaatgagatgtaactatgaatttgttattcatataaacgatttgtacaacatttttttttatctctttctcttcattacatttcaatatcggttgatacatttggtcgaattttccgttcacactaactgtgacttgggatcgattatcagatttctcctattgatagacaaaacataaactttattgtaaattccttcctactaaatttagtagtcttgcaagggcatgccttgtcctaatataattttttcacatattaaaaaaaaaactctcttcgtgacattatttattacacgtcttatgtttctctcctcctctcttgtaaatttttttatgcaaatatcattccacttattgtataaatatgaaggagaggtgggaaaaaaaatattattttataaagaacacatgcaactctatattttataataatttcttgatttaaattcaatatattaaaattttagagttcttccatgatttagcataattacatctacatcaggtgtatttctctactattttcttaatattaatttttaaaatctccacaactacagcataatcacaacttaaaaccttgagagtaactaaaaagaaaattaatattaatttttttttaaaaaagtcacatgtaaaataaagtaaacaaaaaaaattatgggccatagccccctttagggaacagatagttccgcccctatctagaagtgagaacctaatacctcccccacataatttccttgaattgccacacaatttgttgtatttgtgtataaaatcaatagacaactctaagcaataagcagatgatagagtttgatttatgtcgtgtgacaaatgcatgcaaaacaaattaaaatctactgctcttagtatatgaataggaaaaatacactactctataatatctatatataatt

SEQ ID NO: 5859 - DNA, 1265 bp, Glycine max
  Soy_ogl_4584 Gm13:39796501..39797765 Cluster 26
gacaagttatatgccttgaaggaattccagttgtcatgaatgcagctgcaaaaaatgtttggttttggtaatggacatcttctactgtctgcgtgtgggtttaaaggtttccttgtaagttcttagcttggaaagatttctggccaggcaaagtgctagctagatcttgcaaatgagtgatgcatagttcaaaggttgcttcatgggtgggttaaaggtgatgaaaaacttgggaggaaaataggttgaccatatgaagtaccaagataacaaacattcagctagtttgccatatataaaaaaattaaatgtgtcacttaagatggtaggaacgttatgttatgatggttgtgattatcagatttttgttttcttgtatataggttttggtatccttattatatccgttcttttatatactacataattactcattacccatcatattaaaataaattaagatatcaagttaaatttattatagaaccaaaaatatttccccaataaattagcgtacgtcagtaacccttttctttaagggggatgattttattattttttttttggacaaaatgatgttaaaaatatctttctatgaaattaaaaaagtggcgggtttgcctgaaaaatgttttctgcagcttttgcatccttaattatttggttcgaaatatgtcattgctacgaagttcagtatatttgctgcctttgtcaactgttcctctttcaattttaatttttatgaaaagataaacgcgagttgtggagaattcatagcatttttgtgtatcagagtttgatggggtcctttcttaatttgccccttgtatcagttgtccaaattttataatgcatttgatgggttttggtgtttttccgtttctataattaattagtggaagaagacctttgtgttttgagggcttgccatggggtcctttcttgcacaattccaaatacgtctggtacgtatacactctatgcattattactcttttctagaaaaagggaaaatagtataacttttacataactagtcatttaaaatttaattatttactaggtaaaatttccattaaaatctgattaaacaaactataacttaaaataaaaaaaattagttaaatagaacttgaagatacgagtggtgattttattttatgtagaacttaaattaaaaacagtagcaatgataattattttagtttaagagaaaggatattacaatttatttaacacaatgctattagataaagatgttggat

SEQ ID NO: 5860 - DNA, 1313 bp, Glycine max
  Soy_ogl_197 Gm01:48286801..48288113 Cluster 26
cactcacatgtaaatgtttgaattgaattgtttctcattggattgcagactctggtggcatctggttcctaagctaactaccgaatctttgttggttacttttgaccaatttcttgtttagtatcatgattaactgaatgctagattgctactcaacatctcttgatgatatcatgattcttccgaggataaaagttacattccttaattttgtttattctttgtagttgtaatttcttgaaactttcggttatggtaaccaacactttggatatgtgcaatgtcctgtaaccatagatagcatcgctcattttgacttctctgtctcagaatgaagcctttctgaggtcccactcacacataaaacgttgaattggatgggttcttattggatttcagcaacttggaaacattgcttaactttggtggtacctggtacctaagccaaatttcgaatcttatttgatttttgaccaatttcttgtttagtatcatgattaactgaatgcaagttaaacgacatcttttgacgatatcatgattcttccgtggataagttacattccgcaattttgtttattcttggtaggtaactagttagtaatgttggaaaataaacagcatattcttcatccatgactcctttttaaattttgtatactgagctgaggtcagtgacattgtacagcatctcttggacctcatcttccaggaagtataaaattcttttggttgttttgaatttgtaacttggggtttgtataatatttaaactgaatccactgtggattatgattatgttcaaaataacgggatgttttaaagcacatgttgtaaccctgtaatttataaatgcaatgattttactttgatgcgctgcacatgggcatgcttttacacaaaataggaaaagcaaataaagagtgattctcagaagtacctacacataggtacacaataatggagatgaaaaggtaaatttggcgtaacatctaactaacaacgagatttacctaggaatagaacttccattatattttcatgtgcctttctttttggagttagagtgggagaaggaagaattcttgcatctgttcaatcacaggtacttgacaattacacataatgcctgcattaagggatttggttggtgatcagaaaatgcctaggcatgattggaacctttcacttctgttgcttgagttaggtggaggccaaattggaccacaaagttatcagattttactgttgctttgctatttctattgctaggcttccattaatatatagttttttgggtcgtggatggcaag

SEQ ID NO: 5861 - DNA, 1200 bp, Glycine max
  Soy_ogl_6483 Gm19:41149101..41150300 Cluster 26
aaatctttcattcacatgactctcccttcggtatcccttttccaggttgagtgatttatattaacttttttaaaagcttatttttaattcatggataaattaatttcaatttataattattttcttatactaaaactgcttttttgtgaaatatactaaaactgattacatatatgtttatatgataaattatattgttacaaatacccatcgatgactgatcagattattggagtctaatagttccatcctccaatcagtcagtaacaacaaaggaagtaattaaaaaactatatatttccctatgacatacctttccaacaacagtcaagaaggtgcctattggaagtatatacccactcagttttgttgacaccaaaaacctgaaaagtgaaaaacatggtttcaattatgtaagtttaattacaaaatgattttgggggcattagggggaagaagatgggagaggatggatggatgaatgagtaacagtcccaccttaatatagcagtgcagaaaatcatacattttacgatcaagtgattgaactatctctttaaatacctcccttcgaacaggtaattcaaaatgcatggcgttccgagctccaatcacatgcacacggctagattcatcttcctaacacaaaaaagttgtcttggtcaaaaaaagaaagaagaaaaagaacagaaaaaaatgaattgaaggagttgtgatcttaagttcttagctatttacttcaggtgaatttggctttgcacaaaaatccttttattatttcattttttctcttattaagtctaataacttgcaaaaatatccttacaataacactaacaattttaaaaagataactagaggaagagaggcagtttcacaccagataccaaggaacttctttactgttggatgatgttgaaacataatctggtgtccagccacgagtaacctttttctgttttgttacatatataagtaatatcctttgccctttttttgatcagtatccttttttttttcctttcttctacataagtagtaaccttttcccttttttcttcgtaaatagtaaccttttcctgtttaagaaaatgttgttctccctagagatgaaaattgtaaaatataatgagttaaatatcaattgtgaaagactgaaacaacatatgaagaatcctcataaaatgagatttgttcatg

SEQ ID NO: 5862 - DNA, 1300 bp, Glycine max
  Soy_ogl_314 Gm02:1511901..1513200 Cluster 26
ttatctgaccaccctatgagcagtaatttcatttcatcactgagataacatatgccatgtgtatatataactctggatgtttaagaactatgaacacattttgcttttcttctgtggacggtgccaatcactactagtttctagtttgaaagtggacactataaattgtacgttcgcttctaagcagtagtttctgaagttgaggacatttagtttcaattcaattttttgagtctcggaatgcaaggtaattcaggcatctgacacgtaacagcggggccatggaggatgagtttgtttgcagtgtaatagtggaaagtttcaatttgcaaggcttgtagtgtaatcgaaaatgatgaaacatgttaatcacctggtacgacaatctagctgtccaaatgcatttcgctgtcaaagaatctttatcaattgtttattttaggcttatagtctgtctggaattaagctcttaaattgtatatgaaaagttttataagaatgtttttattcaaaataaactaacctagatatatacaaccgtcagtgtacagtgtgaaaaagattcaagtactccgtctccaagttcaaaaagacatggtgttacgtgtggaactggaacaactgttttacaccaatgtcttgtgccaacactatttgcaggaaaattcttatgaagaaacaacaccgttacggggtccgaaaccgcagttctggatggagttcaagatgatttcttactgttatgagaaaatatatgtactgttgtaccatttttcttttctttataacattaaaaaagaaaagaaaagagaagtgtggaaaattataattggtgtattagataaagtttccttgaaatggagcttcatcaaggaaactttggaagatttgagttcaccccataattttgtgaatttggtgtggcattgcatctcctcggccaggatgagagttatctcaaagggaatctgtcaaggagatcccctctcaccttaactttttgttttatgcttggaaagactcttccagttgatcaatgtggcagttgattataaactgtgggatccgatgcaaatatccaggaaaggtttttaagttagcttatcttgcctttggggatgatctgctgctgtttgcataggcagaaactactcaaatccaacctattcagaaagttgttcaattattctgcaattcgttgggtcagaagattagctttgagaaatccaaaatctgcttttctaacaatgttccttgggatcttcgaaatcagattggtgaagagccttgctattgcttg

SEQ ID NO: 5863 - DNA, 1329 bp, Glycine max
  Soy_ogl_410 Gm02:5923801..5925129 Cluster 26
gtttaggcaaggagaaagcttgttcaagcaagagctatcttgagcacttcttcttgggatacatgctaataggacaaggaatgcaatgcagcaaagtgccctcaacatggtttccattttcattcttggtgatggttatagtctatctatgcccttagtgctattatgcatgcgtaatatttatatgagaagaaataagaatgaagagcaacaattaactagagagggagaaaaattgatttgaaagtgatagttaattaagagtttggtgatcatacttatagccaactggttgaacgacccttttggcctttgttgtttattttgtggaagcatttgaatgtgtgactcagagttaattaggaagaagccacgggtaatatgacagtaggacaggtgaagctactttcattctcaaaagtccatacattcaaagaaagggggtttggtgaagttttgtcccgtctccatgaagacaatactctataacagatcatttatctttcatctggattacttatttttttttcgtataaactagatgtattatttatgagtgataattttgctcaagtcctgatagtattattatgagaaataaaacttttcatttttaatataattgcatacttaatattttaatttaatttaagaatgtgttacacctataaagattaaattaagaatatatagcacatatgagaattaaattaaaaatatgttatatgtataaatactaaattaaaaatgcttaaatatagtattgtttcatatgactctaatttaataatttttcacttataaaaactatttttttgcaacatatatataaactaaattacatggttaaccttaaataattaatatatcaaacggttgtaataataaagtggtctatcatgaatcacttactttgttactggttcatgctaagtaagccttcaccttttaattatataaaatattagaacagtgaaagtgaagggatctttattccttgcctgcaatttaatcatggtacgtgaggaagtaaagtttattcagagtcaaaaactaagccaatataatacacaaatcttatccatttacttgagcaaattaaagccttattactgaccaggcctctgccaactacacccgaagagtcaaacaccaacccaccaatccctcctccttcaagcattattatctcacaatgacttcaaacttcaccattgaacaaaggctcgagcagctgcaaaaagcaaaagaagaagcacaaccccaaccacccaaaaaggccatgcaaaatccaacgtgtagcacatcatctccgagaccgaaagcatt

SEQ ID NO: 5864 - DNA, 1091 bp, Glycine max
  Soy_ogl_1438 Gm04:429310..46521400 Cluster 26
atgcaaaaaaaaatttcttggtccccttgaagcaaattcctagctccgtgggcaaaatgagtcttttaagaaaataaaggaccaaacacagattttcacaattaaacaaaagactaaaagtgcattttaatgtattattattattattgatgagttaattgctcaaatatataagtgtgtgggatagcttttggtagcgcttacagaaaacatcatgaatgattcatagatgagaacatagacattttcgtaaagtctaaatatatatgcatgcttgataactttcgtccaatattaacacatatataataatgtttgttatcataaaaattgtgagaaagcttgagtgattaaacgtttccttgtctttggtttcaacttaaagataacgaggccaatgtgtgtcttccctcatgagagtggagcataaatcggaaatacaagccaaacgaaatagttcagattcttctcccaattcgtgatctattggatggtgaattaaaaaaaatcaaagttattggatttggattcaatttttttctttaaaactgatctaattcaacctctggacctctatactcataatgtatatatgttagtgtgacctaaaatagtgtaaaggaaatgaatgaattataaggccaactaaagtgggagttgctctctcactttgtacaaattacatgtaaaaatagccttctaatatggccacaagaaatgatgaactgcatccaatatcgtacaatagtcgttagtggaggagaagttccaatattacatgtgggtctggttaagatttaggcattcaaattgttcaacttaaaaggaatggttgtttaagagagggatgaataaacgccttgattgatatttgtatggataggaggttcattaggaattttggagagcatacgtttgacaacttgggagagtcaaggagctttagtttatgaacatggttattgttgaagctgaaatcagtgattagagatacgataactatcacattgattggactacggactttactgggaatgtgaagactagaacaataagaaggcagagacgataatagtatgtagattcaatga

SEQ ID NO: 5865 - DNA, 1000 bp, Glycine max
  Soy_ogl_3336 Gm10:3040301..3041300 Cluster 26
ttacacagctacagttaattattggtgttgagtcatgagtttttttttttttcaaactaactttctcttcttcacactatgaaagttaatactacatgaaaattaaaaaatttcaacgtttgatattgcttcttctcattacaggggaaaaaataatacaagtagaatcatggaagctcgatcgaggataattaatttattcttttatagtaactctgttacttcatttcattcaaaatcaactggtaaatacaagtaagaattcgatccctggaacataatagggactggtatcgataacttgggacatacacagacccatattctctcatcactatcaactgagctatgcagaggggtattcaaacagaacacgacggagcttgcggcagacatcggaggtcacggcagtttcactatttgtaccgatgtcctcatttgttatagctttgattcatacgtggctggtgtttgtaacatgcttatgaatttgttagctgcttgaagtttaccctgcttgtttcactttttttatatatatgattacaattgtttgcatggattttacaaaaaattagggtgtatgcaaaatagcaatgtaaattggtaatgcgtttgggtctcattgtactttgtgttgtttcaacatgttcatttttgcattgatttacacttgtccggccatatttttcaaagcattgtttttactattttgtacgcaaatacagccctttaattgactgaataaatttgttggggttgggtgatgtcacttgtcactactacggtgattgtccgggtaggaaaataaacaaaagaaaaagtaatgaagcaaaagggaaatagaaatttacaaacaaaagaaaattcaaacaaattcaaactactgggcccatgttggcccattgtagtaagaaaaaagtaatgaagcaaaagggaatataaaggcattttttatatccactcctcatttttttctaattacactccccttaccatt

SEQ ID NO: 5866 - DNA, 1082 bp, Glycine max
  Soy_ogl_5021 Gm15:12696639..12697720 Cluster 26
ctaacagaatcctgtatgcaagcctcgagaatagcataatccctacctttgaatcggtcagaaggttccttcaatctgataagaaaactattgattgtatactctcttgtcgacatttccgtggttatgataatgtgccgaaaaatttgagattgttgcttgatgatggagtcaaggactgcaacatcacctatatgttacttagaaggccttccataattgtgtattgtggcatgagggaggtcgtggatgaactctaggaaatgggatttcaaacctcaaagataaattttatgattgcattgttggctaagaggaccctttcgaaaattcggtgggatgcaaaagttgatgccttacaaagctggggttggtctgaagaattggttcttcatgcgtttacgaggtccccccacttgatgtagtcgtccgaggataaaattaataaggtgatgagattttgggttgatcacttaagttgggactctttggcccttgccaagaggccaatgttttttggatatagtttgaagaaaaggatcgttccaagggcttttgttgtctagtatttacttacaaaaggcttccagaaaaagagtgccaacttgcaaatggaaggaatctctgtagggggctgctaacgtttataacagtctggtactggtggcacaaaacaatatcctgggttggggaggttgttgatcagttgatgtatatttataatttattttattacttatctacagttacctggttttgtaatttgctcacttctcatcacaaaagtcaaattgaagcatttttttttttcattttgtatttatttaaaaatttatcaaaattcctcaaaatatacaaatccaaatctagcaaaatgtaaaaagttcaagaaaaatagaatagatataatgtcaaatcatttcattaaaatatatcaaaacttaaatttcaaatccaaattaattattagttttacataaatattcaaatccaatgtccaaacaataaatttaaaaagaaataaggtgtaatatcaataaatttcttatatacaatatattaccagtattcttttctaaata

SEQ ID NO: 5867 - DNA, 1090 bp, Glycine max
  Soy_ogl_5534 Gm17:5571401..5572490 Cluster 26
aattaaacattgctttgggtggttgctgattggcttatgttgtatgaatatgattataatttaaggtgacgtaaatgacaagctcaggtttaataaggattgtttctctagtaaattgttattgcaagtagtagctaatcatagaaaatgaagtggtgactttgtaaatactccaaccctcaagttggatattgttttagtaatagtgtaacagtatatggacaaatatacgtaactgtaagagaaattctagtatagatgatgagatgatggctgttataacctacataaatacatatacagatgttaaattagcaaaacatgctgatgatatgagatgcgagttaagagtttggatgttccaaatctatctagaatcaacgtatttttttaactaataaaaatttagttaaattggatcttagaaactcattggaatcaaagcatgtctatagaaattgatataaacagaaagagtacaaattaaaaacgaaaatccaaaatgttaaatgaaagaattcatttccagactagctagccggcacgcgtcgtgaacaaacctattttaactaagataataatgtgagttagcaagctggcttcacctcccaaacaccaaactttaattgctccctaaagatacagagagagagatacttcattgatcacgtcgctgcagaaacatctctgaagggttgcattacataagagacacatattagacaactgcatgtgctcatttacatgaattgtctatttgtctttgattaacttggtatgtatgcctaagaatatgttacttgtacataggcaattgtacagtgtatggtggaaccctcccttcccaacccagctcattaattctaagctacctttgaatgagctcaatgttatcatcgtagaatcttgttcacccagatggaacttgtctcacgtaaacaatcgaaacaaacaacttatttctatttccataactcaaactttgctcagttgttacttacccaataaaacatttccacgtaagatgtgcaaggttacgtgacaaggctacttaggctcaaaatattggtccacataacttgtcaatttt

SEQ ID NO: 5868 - DNA, 1200 bp, Glycine max
  Soy_ogl_6643 Gm19:50156701..50157900 Cluster 26
ttgttttgattattcgtgtaatctaagaacctgtcatcttaaggggacaaaatgtagatttgctttcgaagaacaaaattcattactagtgtttgacctgtcgattattgcactgttccggggaaatgctgtttacaaggtttgtttgtgaacttgattgatcgaagtggaactttcacatttaagttttatctgttaatgcattattcatttgatttcctttgttgtactcgttgatattcattgtaaaaggaacttaagagttcatccaaatattagacttgtgaaggtattgcgaagtccaaaattcgtctggtagagatgctatgaaaatgagatgggaataataaacgggcttcaaggagctgagtcaagaaactcattcagtcattcttgatgttttgtaaagttactccaaccactctttcagtcaagaaacaaaatataccagataaaaaagagcattttttttctttgtaatttgtaaagatttcacgaatggagtgtcatttggtttgggaaggtgggtctaaaagtattttatgaccacaactgcttattttgcaacacaacatagaaatctattcttgcaggccctagataaagattagcagcatccatttctgatttatttctttaaaataaaacaatcatctgtcattcccccttttaacctgctaaacctagcacaacaacattttcaatccttctctcggctgtccattataacacaagataattgaatttcgagaaaccaaatctcacgtatttgattaaacaccttgcaagcatcattcagacgtctcaattatcagtgcatgcccaacaacgataccccaatgttatgatcggtgctaagtccggatccttccatacactttactgtgcccgtaaccaggtcaacgacggcaataacagtcttgagaagagaagggtaaagggattgctagacatcaaatgttcttttatttaatacttatactctttaattgagaaagtgcttctagtaaacttggaaaaatataaaattgctcttgaataaaatatattagtaagacgtaaagcaaatcgtcgttagtggccacataagtaaaaataaaatacagtatttgctacaatagctgttttgttgtttaaggaaaaataattgttgttcactcacgttttaatttcaaatcaacctaaaagttatatattccc

SEQ ID NO: 5869 - DNA, 1176 bp, Glycine max
  Soy_ogl_4113 Gm12:37191301..37192476 Cluster 26
ctctaactcgatctcttttcttttctccatctcaggctgcatagttggaacaaccaaatcaatgatttaatcttgtcaaacaagtttaccaccaccaccaacatcatatccaacaaaatcacttccaccaagaggtttggatactcctcccaattcagtttttgaggaatccttaactctcttcctcttcttcttctgcttgctgagctgcaacacaaggtctgcttggtcatcaataaccaagtccctcaaactcttataatcatagccacttatgacttttgcatttacataaagaaaatggtttagaactcattaaatgtttaaaaaaaaagaaacaccaccatagaaatacaacaaatactcacgactcaaaatccgatgaggatgatttgaattaggaatgaccaaaataaatttacaggacatttcataaggtcattctcctataatcgtaatatccttaattccctggggtgataatacttgacaaggatgagatttaaatttagatggaaaacatggtcaatagaaatgaaatttgagagtttctccatcctcttattccctttgttgtattacattcttagcatataactaaattatcatttttttttctataagtaaattataattatacaagtaaattacattctttttttaaaatgtaatgttataagtaaattaatgaattgaaaagtaaggataatattaaaaatgatataaatcattgttcagaatatacttaaaattaaaaaaaaaatgtaaatcatgtataattatcttatttatataaaataataaatatatatttcaaattttcaataatgtcatccatggtatagttggagaaatggggatgaaagtaggaacctctataaggaacaatctcggaagcttcttggttagtaaagtgagaacacagttgttcctcttcagttgaaaaagatctctcggagtattaaactcatcgaatatcaaaattaaggaatggttgagatttcatccggtctggacaggatatttttccggaagctgcacccgctgttgacttgttccgctggtctcttgctttttactttcaatttcattatttctgtgtcattctccctcacttccaaatcactcacacacccatacccatctcatcttgggttaattacggaaatcaacaga

SEQ ID NO: 5870 - DNA, 1300 bp, Glycine max
  Soy_ogl_305 Gm02:1030901..1032200 Cluster 26
ttatttttttcctaagaaaaaaaatatcattgaaaccaaaccctactattacagactaacaactaattagcagttgacagaaacatgttaattcaagaaagaaggattgagttgcataccatcttagatcagttgacagaaacatgttaatatctatgaagcacggacactccagtgtcttgtcgtgtccggtgtccgacacgcgtccgtgtcagtgtccgacactgacacgacacacgtattacgttctatattttggacattacaagtgtccacgtgtccgtatccgttcgtgtccggtgtccgtgtcggtgttggtgcttcataggttaatatcaactattacagactaacaactaattagcaatacaacgattgagttgcataccatcttagatcaattgctatcattatacatatattagtttgccaatttttagcattggcgtgggagttaaattttttgcattattaatttaaacaaaaaattaattttagagtattgtatttgttgatttaaataaaaatctaacttttatttaagttttgatttaatagattaaattaactcatttaataaaaaagaattgaaattgattctaaagaaaagaaatacttgaagacacgattactaaaaagaaaaatcaaaatgaactattagatttactcattaaatcctagctgttgaatttttatggaaataattaagctaaaataattaaatgcggagagtcttattagaagtacgtcataaatcatgtttgggatagattattttaaaaaataaacatttttaaaagctcttaaaattttgtaataaaactaaaaatgattatttttttgagaataagctgaatactttttgttcttgctgtttggtaggtattactttatttcatgtttcttttcttttcttctattaaaaagatatgaaaaaagtagattattacaaaaaatggtagggaggaagccgtacctttgggttcgtgttatcggtaacaagttacagcacctccattattggcgggtcataagctgaaaaataaatggttaattgggggcattagtggttgctcaaagcttcatgattcatgtatatttgatacaagatttcttaccccacctaaccgttacttttcatcacacttgacccacttggagtagtgaacttatcctttttcatgaccgaatttaaaaaataatgaaccaaatcttaatgatcatcttttccctctctcaatctgtgggaagactttctagaagattgacataatttaaggcaagaggagctccggcattt

SEQ ID NO: 5871 - DNA, 1200 bp, Glycine max
  Soy_ogl_791 Gm03:1580201..1581400 Cluster 26
atggcttgtccttccttcatttctttctcagtttgttttagctgatttatcaggtgttacttacctcagactcagagtttagttatttacttagtcatcgtttattgtctcatgtaattagaacttatcatattgtgaagaagaaaaaatcattagtgtttctgtttactcttgttgctccattcccagattttacaattaattttatttataaaggaaaatatttcggataaaaaaataaaagtgataatagatatattaaaagagaaaattacactaatctctactgaaatcttttcaaattaaatgacactcatactttctctagttcttctttaaaaaaaaatacccaccttccctaaatagcataaaagaagaggagtgtatgtgccatttttattaaataaaaaacatgtgtgtaactttactaaattaatacatgaagaagtaaatatttgcttgaaaactagaaaaaaaaatgtttttgttatttgagaagacattctaggcaagtgtagtttccggttttcccatgttaaaatgacacctctcagtctctcactcccatgtcataaaaaaatgcaagaagggtagataaaagataaaataaattgagtcagagaaatgggtcaacaagcaccagtggtctagtggtagaatagtaccctgccacggtacagacccgggttcgattcccggctggtgcaaattttaaggaactgtgatgattattgcaagtggttgatgggtcaatcactctcatctcatctaagtagatgaaatctgcatctgagttccctttaattttttctgttttgtatatttcctttgtctttttactctttttgttaatatttcgagttctataaattttgtttatgtcaatttgttgttccagggagctgtgatgaaaaaaatgtctgattgatgagttaatcagtagtcaatcatcttacacaggtgaatcatcattttatgtgctctcttctttctttttttctgcttgcattttactcagttattacttgagattttctatgaaaattcatattttaacaggccaatgatttcttcaattgcttagcagatatagttattgtaataatgacacagagcacatactgcaaagccatgcatacattattgcccttaattctggttgttgtaattaagttcaagcacgggagcaaatgattggaa

SEQ ID NO: 5872 - DNA, 1900 bp, Glycine max
  Soy_ogl_1065 Gm03:43114801..43116700 Cluster 26
ttaaaaagcaagctttttagcctatctcgcataaccagcgagttaaatgggttttacccatgggtattttaatctctattaaaaaaaatagggtgtggtttagcaaaactaaaacccctaaaacacagatctattgactaaatccctaattctcaagcactcagactcctctcctctcctcgcatagttagtgaaactcctctcttctcgtcgcactcgaccatgttgacgtcgccatgactcctccacacgaccacgacatatcatctctctctctcactcgtagtcactcggactccactcctctcctcgcgctccaccatgctagcgttgccatggctcctccacatgaccatggctcgcaatccctttctctctttctctttctctttctcgtactcgcagtcccagtctcacagtagtctcccttgcactcctttattttattttcttgtggatgcgaactacttgcaaaacgcggggcgggggtgggttcaaaataaatgagcccatttagaatgtaagttttgctggactagctttgcggcttgcaggtttcgcaggtgtaggtttcgcgaggcggacttaccctaatgtccaactccaatacccacatcttttggtaaacccataaatgcccatgaataaccatgaatattttagaaaaatactttattatgggtaaaataaagatatttatttcattataccataagaatgagcataagacgtgacatcaagagaaagagaagaaaatataaaaaaaaattcttaaaaaccaatatcatatatatgcacctaacataataccccgtcagaaatatttcacaactcatcgaagcctttcatttatctcgtgaccacgatgtacacaacaacggaggaaaaactcatgcaaccaataaagttatttgaacacacaagtctcttgaaaacccacgcccacatactactatctaggttaaattatttcaaggacatttaggtatgggtacgagtaccatgatactcgtcttcgctccgttaagtcacgggtggagaaaatacatgtatcccttccttgtgggtactttttctttattagggatattaattgttaatatattagtttttgtttgtaagagatatttaaactcacaatgttaattcataagcaaaaatgatcaaaaacagttgattcatgaaccggcattgcaagaatattatatgttctcacatacgttttcacaaatgaatcgtgttttcttcaaacatgtgttggttggttggagatgattaatcaatgttttatatactatccaatgatggcaacagtttcgaagacccaataaaattttactggccccagcagttccagtggggacagtcgttgtgtggtggaatccctttgacgatcacggccaacgtcgttaattccaaatatgtttatgtgccacatggctattcaaaaaacacctttcttgatgccattatgatgagagtaacggcgattactataaggttgttctttaccttcatccacgccttatgtttgaagattggcacacgaactatgctaattacaaatggatgaacaattgagtatggttacatagctcacaaagtcgctcatatagatgtctaaatgttgcttggcctctgtcccataatggagttggttgtcatgtgtacttggatggacaacctcatttgattcgtggagggcatgacatgactttcgagattgatgagtttttgctggtgttgtatgtttggaagatcgagacatttatcactacttgaattccctatccatgggacgatgaaccacaagattcacatagaattattacttctgatgcaatctatacataccactagccttattgaaccgaagcgttgctttaattaatcatgtact

SEQ ID NO: 5873 - DNA, 1100 bp, Glycine max
  Soy_ogl_1475 Gm04:47764801..47765900 Cluster 26
ttggcctaatcatagctagattgaaagttgaagcacaaattcaaattaaagaaaaaaaaaatataaacatgtagaaatcaacgaggtgacgatcatagaggtagaaagaacaatctcgcaaggcacgaaatattctgaatcatataatagatcaatcgtttcttctttggcctaatcattgtttccaagtattaagtcatagtaacaaatatatgccatatttaagatcaattgtgataccattctcgaaagatatcgaagcattattctttccaagcttggaccgctagcttgaataatattgaggaacagttctaccaaggtgaatcacgacgaaggctgaatgcttaacaatctcctcaacgagcctgatctcgatagtgacaatgatgagtttcttcactgttgaaagaaggtggcggcaaagatattgaatcttcctctgtgcaatcgaaaaatgcatcatcacttaatttccgtttaagggaagagatggagatggtaaaatgaattacaatgttcgtattcatagagtgttatgggctagccatgtctaactaatgtcttaaacaattttttttatcagcaaaaaaatttataataatgtattgtacgttcatcacaaccacaatgtgtgccttcaaagcctaagccaaactttcaaagtgtggctacgaaagcaatcctctgccatttagcatggccaaggattattccttggacggctaatttcttgtcaccaataaccaaaccctttcaccacacatcccattcttgaatatcaaagcatgcatgtgctaaatatctcactcgacgacaacttgcacatttcattgcaagtagtcaccaacaatcccgattataggactagattgaaattcatgggtgcgactatagcctgatgcattttcatttatcatccacacgaaacaagttaattgtggtgagcgctgacacaaccggagtagtaaaaggtgcggaatatcgagtgaatattgagattccccttagtgcgtgtgtctctgaacggtgatggtctaggatgtaacgggtcatgctctagcactttgttgttgtgagacttcaataccacaaaggct

SEQ ID NO: 5874 - DNA, 1115 bp, Glycine max
  Soy_ogl_1851 Gm06:8276286..8277400 Cluster 26
caaacccctaacaagaattgtattagtagtgagagagaaattgtactttttgatacatagagaaattgtatgtacactatataactttatatacaaaaatactgtatagtaaagagagtcattgaagaagaactaaattaagaagagagagacagtagtaactattttcttataccgtgaatcttgtagaaagtattgcagaaaattgttagatattctaattctggtaacacatttaaatatatatataagaagaataaaagtagaaaagaatacttaaggaaacagattaactaacagggaaaaagaaaacttgaaactccaatgtcatatccaaaaatgagtccactggatgcagcaacgatgcaagagatgtcaactgagagtgttatcttgccatcgaagccaccggccattttgagccctctccactgctacttggacagttcagtctaactctgtagaagagaccacacaaaccaagagcgtggcaactaattcatttatagacttgcagtttgtgactgttttcttcccaaaagaaaatggccccacatgaaagaaacaaaccaatttctttttttgtttatatcacatctatttttcatttataaatgttttaaccaatcaaacatttgttcaatgataaatttaaaaaaaaaacttcaaagtttaaaaactaataatttaatagcatttatcttatattcaaactatgatggagtaataaaagcatttgctcatttgaatcatttatcttttttacaaaatagataattggtacacatttgaatcatttatctaaatctattaaagaaagcattaacaacggatcaaaactgtgggtcaacgcacttgccttatcaactgaccatagtagtatttgcgtttacttgatcacgtattctcctttttttttcgttctttttttaaaaataagaagctttgccggtacatactagcaattcgatcacaactactcacccgacacttattcatactttattcaaagcatgagagctagttacgagatcagacttacgatatttacgtgaagtgtgaacagtcagtccttatacaattccaatattccagttacctcttgtttacttatg

SEQ ID NO: 5875 - DNA, 1000 bp, Glycine max
  Soy_ogl_2448 Gm08:1162601..1163600 Cluster 26
aattttattgatgaacaataatgcaatccgatcgttttcctagtttattaattaacagtaatagcaacaaccaaaaaaagttcagattaagaagcattgacttctagggtggaccagtctctcaaatgatttttaacccttagatgaatatcccccacacgtccttactctccacattggcgtggcttgctccgtcttctcccgccgccacaaccaccatggccacagccgtcgtgagggtctaccataatagcatatacataagactaataaacaaagagagaccttccaggcttccgctcatagcggtttgaatagtttgattgcttccaatggaattcagatattaggagtttataataattcaatcaactaaaaattgtcttgataaagagaaaaaatgtgatatgccatgtgatagatgagtaatataaaaataaatataagtaccgcaaagttgtataaatataatttattttttctcaatattccgctaaaccaagcgtagcaaaatggcacaagtctccggatgatttgtcaaactcttttattgtatgggtttgaaaattgattaatgttagattggcatgtgatagtgatttcgtcctttacttttaacttttgtttgatttaaagtgtccaaaaatatgagaaagtgtgtatttgggagtatcacgattttttatttattataaatatacacatttgttttatttcttattcttatattaaacggtgagtaattcatattttataaaaatagaaattaactttcacaataactacttattttaactttatttttaattaaataaatttaattttattctaaaattactaaatattaagtaaaatgttcatgataatacataccatttatagacataatattcttaagaataatataacatgctttttttggtgaatataatataccatgctttgaaacatacactcctaaagaaaagtgaaaaacctatattacttaattgcaactcca

SEQ ID NO: 5876 - DNA, 1100 bp, Glycine max
  Soy_ogl_2555 Gm08:8017901..8019000 Cluster 26
aggagatgtggacaatgtttgagtccatagtagagatgagctagatgggcgaataggacgtgtgggtataagattatagcaactcctactctatcctatcatcagcctacgccaaccccatcacatccaaagcagaggctgctactgtgactgtctcgtatttgctttgcatgtcataaacaagatatgcatcttatccgcattttgtctttttattatttttcatcctcctctgccaccaacaaagaaagcttacctctctttctttttatctaacgtatacatatctcaattctccccatgctttcttctgttaacgtcactgctgctggaaacaacaattgaactcaagaaggaataaagaagaaagctatttaccagggaatcgagtaaaagattgcgaataaatggactgtgtcacttggttttcttttttcttttttataaaaaaatgcctcaatccttatagttgtgtttaattttaagtatctgaattgattttacatctatttttatatgtttgattttagttcgtgaaatattttaaaattaattttgagtctaaaattaattttaaattaatataagtttaactaatttttgtgttgagtcaaaaaatatatactaaattttatttttaaattgattctatattaaaaatattcatacttaaatcatatcgctttaaaattgattttaactaaaatcaattttacaaactcaaaattaattttagcaaggcatattcacgcagttcataaccaaatattaatacctaaattaaaatgatttcaaacagattaaatatcccctcattttcaatataaaaaataaataagaaaatctgtgaaattaaatcttactctaattcatgttcaagacctagttttgatcaatttcagcaatttttttacacgtccagacatcatcacctctgaacagtttctatgtaatctcaaccactcataacagaagcaccatactgcaagcaaaaaaaaatgcccactgctctcttcattactgttgcagaaagcgcatttgcaatcataatcatagtttatatcaaatattcctcttttcttttatcaagaaatattctc

SEQ ID NO: 5877 - DNA, 1200 bp, Glycine max
  Soy_ogl_2560 Gm08:8407501..8408700 Cluster 26
ccttcatgtttttcagagataaaacattgaataacatatatatcttatatatttgggctttggcccagtagagttatgctagttgtttttatttgttgataaaggacggccaagcctagaactaaaaacaagaggaaagattaaaaagctaatgaactgaacaaaaaaaacaagcattcctttgtcttatttatttaaaagataaaatcattcctttgtcaaccgtgaatctttatgacgaaaatattatgacaattgaaaagacacgaatattattagtattattttatcatccgacatgaacattaataataaatttttttgggtacaattatagtaattttttttgttacaaacattaaaaataaattatctaccatgattttgaaaaatataggtccaacgttatagtacttttgattaagccacataaagtcaaagtctgttcgaaatatatgcatcttaaattaaatgtattggttcgacgttggaaagcataataatggttaaagttaaattatccacttgtgtgtttgtatagctattcttatttgaagttttagtcttttgcaggcttcagtgtgcataatacaggtttctgttggtgggactttctcccaacatttcattttgggattttctcccaacctttattttgtctgaccttagtcgtaatagttctaaccttccttccttccttcatgtttcattcgtgatcctgttttttggtatttcagggggttgtttgagcctagtagggggccaggtgtcaacctatagttgggatttcaccccttaggctgaaatttcctttcctcacttaagtaaaaaaaaaaacaaaaagttttagtttttgtatgaaaatgcttttttatagcaattttatatgattagaaaattaaactattccccagtgtttgcacagggaacatagaagcaaaactaaaattttatgcatttgtagggacgaaaagtcacaattttgtttttgtaagaacaaacgtaaaatgattacagttatagtgatcaagtgagaatagtctgggcttatggccaaatttatgatagaagtagaaaatttaattaggaggcaaaaaaaatatatttcatggatatatatataataataattaagaacatggttcggtccctcacaatgaatgacgccccatccttgctagaagttggcacattagctta

SEQ ID NO: 5878 - DNA, 1319 bp, Glycine max
  Soy_ogl_3546 Gm10:45266401..45267719 Cluster 26
aatttggacatgaaattagtaagtttgagatgtgattgtcttgttgaaaactgtttgataagactaacaaaattgtaaagagcagaatgcatgagtaccagcatctgaaagccaacctcataacagaatactcagctaacataataaaatattcaactaacttttacattctctaatacaaaggctcaaatcttaacacactcttcactcatgatgagagaaagggagccattagcactactcgcatgtacccccttcagctggtggttctctttgttggctccttaggcgtgctttgatcttctcttgttgttggcatggttccttagccggatcctttactatataattgttccagtatgacccacataataacttgagcatcagtagtaggagcaccagccgaggagccagcaacaaaactacgaccaagtacgggcactgtgggggagagacaccaggttgagtagtaccagccgaggagtcagcaacaatagtatatgagagtagccgagtagggctaacgactctccttctctcatatcatcatcatgagtgaagagtgtgttaatatttggaagggtatgaggcagtggtatatcagctgcttacatcatgtagttggcagggttttggatgctgttagtggtaccgaggacaaaatgctatttgtaattttggtatggtttggtcacaacttgtggacaaaatgctattacttatgatttacaaatgcatgtgttttgcatctaaaaaaaaaagctttttggtcaccctaaaaagggttaattgataaatatgggtaatttttcattcataatactttcaataattttaaatatcatttaactatttcgatcctttaattaaatgtttaatcaattatctcaatgctttaatccttttatagtctataatccttagaatgattcaatccaatccaagggactcagaaccctaaaaaaaaaacagcgaagtacttatctaccttaactaaaaaccaagaacaggatctcattcaataagtgataaaaggttattaattgcttggaggtagggatgtgatacgcgcgttatcgcacgagaggagcttatgatctaatttatatcgaattcaagtcgatttaggaaataaattaggttaattttttaataaagcctcatcttatatttaaaagtttttaatagcatcttatatataaaagttgtcaagtgagttcttaaatgaattagtttatattaaaaagtattattaaataagatataaatattacaaaatttaatatattgtgcacacacagatatagtctcataattta

SEQ ID NO: 5879 - DNA, 1800 bp, Glycine max
  Soy_ogl_3927 Gm11:36776501..36778300 Cluster 26
aagataacatcacttcaggtcaaaggaagattcacaagaatttgcgtagatctcgagttagacaaaccgctacagcccaaagtcattgcacgaggatacctgatcaaccttcagtatgaaggaagggcttcgtgcgatctgtttcaaatgtgggaaatatggtcacaaggagtcgcagtgtggtgcagatccatcgccaagcgtagagaagcagaattcaggggtcaccggagacacagaaacagcgcggcaacaacccgcggtggattccaatattggggggatctccgttgtagcacaataagccccacagaatcagcaaacgacggaatctaagggatccaatattattggacataatgaatatgcagatcatgtgctgctatacgggccttggttactggtgaagaggaatgttcgaaacctattaattcgggaggacatcacgtcgagaatccaaagccaatgtatcctcctcaaaatatcatatccatatgaagattaatcccaggacgaacaaggaatggtcccttactgtaatctatgctagcccacaaccaagtcatcaccaagaactttaggaagagttgattaatatagcagactctatgtctcacccttgggctgtggcgggtgatttcaatactgtgttttttcacaatgagagaattggagggggccctgtaaacgcataagccaacaatcaattactgaactgccttgatcgttgtcaccttgaagatatgtgcttcacctagtctggtggggttttgagggagcagattgatcgcgtagtggccaatgtggcatggtaggaagccttccccaactctgttgtgattcacttgggattattttcttccgaccactgcagcctttggctaaaatctgatgctagtagtcctagccaacacaaaccttgtaaatttttgggcccttggctagacatccagagtttcactaacaggtccatcaatcttggccgataaaggacgattagacaccaaatttggaacgcctcactcattctcttcagatttggaataagatggtctttggaaacattttccagaagaagaaacagactctggcaagattggagggtatcaactcttctctgatgcagcacgtggattcaagcctgcaccatctgcgtcaaaaactatgggaggagtatgtcaacattctctaacaggaagaactttattggtactaactagcccgcaacaaatggatcaatttcggaaatcgcaacagcagatactttcaccaatcattcccactgagacagcgccaaaaatggattgatgccatgcttaattcggacaatgaatggatcacagaagagacaacaatcaaacaattggtaagccatcacttccatcaactcttccattcagaattaattatgcccatggaattacatactactcattgctttcctatgattatgccggaggatatgcttcacttggagagtcctttctcgcttgaggaaacaaagaaagctctctttgcaatggggaatttctagtcacctggtcctgattgctaccacccactgttcttcaagacccactgggagacagtgtgaacatccatctatcaggtgatgaatcaagtgcacaagaatccggcctcagtcaacaacattaatcaaacaacactgaccctgatccccaaatgtgaagacctgtcctcggtctctcagctgcggcccatcgcactatgcaacattgtctataagtactgacaaagatcatagccaacataataaaaaatatatcgtcgtatgtggtg

SEQ ID NO: 5880 - DNA, 1100 bp, Glycine max
  Soy_ogl_4988 Gm15:11268701..11269800 Cluster 26
ttcttaagtttgctagctcataccagtagccgccagctatcaattttgggtactggctcatgagcgttgtgttcacaccaatcaaggaacgggctcactaaataaagccttgctgacaaatttagtttcaatgtcgatcaataacttcatctataaggctatgaacctgtgtagaatctaagtaatggctttcacaacactgcagaaaatcagaatgcatttattacgatttgcccccccataatctttattattttcgcaagtcatgaagaggataaaaaatcttctccatcctccaaatcaattatgatcatgtgttccaatatatcttaatcttatttagaatcaatatctcacaacaaatacaagacgatatttgtaaattggttgttgaacttaccttgcatcaactatagtagagctattgagagtctacttgccctgatttaagttgtatgctgaaacgatataacagtgtaggtcaaatattaggttatttggccttttttttttctattttctaaaatagcattttgatccttcatattttttttagtcttaatttgatctcccatgttaatttatatgattcatttgatctcctaaaatgtttttattagatcaaattgattcttttggcgatgtggcatccacatcaatatttcctgggttcaaactttcgtattcttggttcttttcttatattcattgacggatttcaacaaactatacagtgaaccaatttgccactgtatggagggaattatgtgactatattcttgtcaatgtaatgaaaaaattgaattcgtaataaaaaaaaaaaaatttggaaagaaattaaacgttgacccttttcttatgtttccgagcaaggctagtccaaaaatcaaatgcagaagtcataaggcaaatcgcttccttgtcttgcacaacaaaaacaattaacatggtcattgcaatgagcaaaccccaacaatccttctcctaccctcccatagatctgataaacttgacctgccagctttcaaatagcttgcatatggctccattgacaatagcttcagagtctatctgaatctcatcagtattcaattccttca

SEQ ID NO: 5881 - DNA, 1016 bp, Glycine max
  Soy_ogl_7012 Gm20:46122301..46123316 Cluster 26
gggtggaaaaaggtagttgaggcctgagacataaaagtaagagttatgcacacatgctaatcttttgataatgaattagtttgtttaagctctaaaaaagttattgaaaaaaacaaaagagttttttgaaaatgtgattttttaagaagcaaatcagatttgattttttaaaaaaatatttttgataatggattagtttgtttaaacttttaaaaaaagtttttataaagatatgattctttaataagcaagtaggatttatttaaaaaaacagaaaactattattttaaaaaataattaattcagataaacactttaaaacaatctgagaattgcgtttgataaaaaaaaggtagaattattttaaaaaagggttttttttattaaaaataagtttaaacaaataaacatacctatttgatttcactaatcagaaaagatttttccgcgggtttggttatctgatgcttcaagttcaagggtgttccataggtctgaaatatattttcatcacgaattgtacattataatctcggttacagtagtgttgcatatatatatttcacatttgtagtttgcttgagccttgaaggttaattagtgcttaaaaatcattggaagtagcagcaattttaatttgtgcattactaacctggactttgatgttgaattggcaagggccagaaaatgtgattggcttgagtagatgtataattcttctaaggcaccaaagtacagctcccccagaacaacatgctacttgccaagccttcttgaatcttgagtgcatgaaataacccacatagtcataattaataattcaaacactgtaggaatttgtttagtgctcatgagctgacccaaactccatccatttcgatctgcaacaggggttctaaggttcccaccgattgctttgcggccttactttgtcctacttctaagcaagaggtttggaacgttatttctgttatggataataataaagctcctggaccagatggtttcaatgtttt

SEQ ID NO: 5882 - DNA, 1189 bp, Glycine max
  Soy_ogl_605 Gm02:42257412..42258600 Cluster 26
gttttaatgtgaatactctctctttgatctcctccgtctccgtggccttccatctccataaccaagacaacaattccttcgaccatgacgaccaattcatcttcttcccatcaatgctgtcgcgccagatgacatggccaaacatgccgctcacattacttcaaacttaatttaatcaaaattaattttacaaatacttaactacacacaacaaaacatctaatcaagcctatttttttcattaatatctttaagatgctctgcattttttttcctagattaaattcttgattatatacagccaaaacaaagtgttttcactgtagttggaggtagtattaaataaaatagttggaaattaataacgatattttttacatcttcctaaaacaagttgagattttttcatcagatgcatgaatcgtagaccgaggttttctacttttgtcggatcgtactggtatgatattaataaaagggggaatctcgcgttacgtacgtcaaatcaaaagctaataaatgaacccgtgcccaaataaatatgggtgcaaggcttaatcagaggacattatttatttcttaaagtataaattagactactcttattcattcacggacttacgttctattgaagcaaatttcaactgtgatctttcatcaataaattatgaattgattccttcaccaattcaatggctattttaatttttcaaaaacttagctaaacatttgtgttgctactaaaatggactaataacatgtaccaaaaaatggactaaaagttttttatataaataaaattaactcaaatgtgaacaatatgttattctctcggagaaaataatagattaagtattgaaagataaaaataatactttaaaaattatttctaggtaaatggattttcttgttatttttatttaaatttaagtatgaaagcaacaatactgtatgtgtgggtaagctgtactcagatagaccacgttgtattgggcctcttcttactgggtttgaagtcctgataaggtttctttttgggctttgctaattgctgtcaggggtgtctgctttctttgggcttttgtttacggtgaagtcggattggcttttctagttaatgttttcattatttaataattaatttgataaaaatatggcattgaagtgttccacaaatgaatagctaatg

SEQ ID NO: 5883 - DNA, 1000 bp, Glycine max
  Soy_ogl_2399 Gm07:37693401..37694400 Cluster 26
tatgcaaaagatctgcttcttttttttatgctctgcaaaataaaaaacaaatgtcagcaaaaaaaaaataagcaagaggaaaggagctcccatacacactttgatgtcatgaagatctccctttctctcatatttttttataagtgaagtaaggctctccatacataaaataaagaggtaggaggacaatgggtccccttgtctcagtcctttccctggcctggtaagataggtccaacacctctccatcaaccaacacatgaaactccaccgaattcacacacatcattcaactcacccattttctatgaaaacccattttgtgaagactagcctttaagtacctcccatccaccttgtcaaaagccttgttaatatgaatcttcagagcaaatccaccttcatttcctatcactttacacttcatatggtgaatggtctctatagcaacgagaacattatcaaggatagaacgcccttcaataaaagttggctgctccttagaaatgcaattgagaagaacccttttcaaccggttagcaagcacttttgatacaatcttatacaatacattacaaagagatataggtctcagatcattcatagaggaggggttatcaacttttgggattaaagaaatgttagtgctattaaggctttggggaaagaaaccttgattcagccaaacaactccattttataaaatttcttcacctaacaaatcccaatatcttttataaaaagtacgattaaaaccatttgggccaggtgatttatcagagtgcatttggaaatagcttatctaaactcccgttttttaaaaggtgcaataagaacaacattatcattagatgaaatattagcagggacatgtgcaatagtggcaccaatatcaaccaagccttaacttctccaccatgtgaaatggcctatataggtatgtcaacaagattcacattagaaacaacttctttgaaacccctcattagccaaatagggt

SEQ ID NO: 5884 - DNA, 1077 bp, Glycine max
  Soy_ogl_6396 Gm19:36424901..36425977 Cluster 26
caaccagaccatcgcctcggaccttgatggcaccctccttgtctcccggagtgccttcccctactacttcctcgtcgccctcgaagccggcagcgtctacttcacgtacctcgtcctctccgaaaccctagctatcaaaaccctaatcttcataaccttcacggggcttaaactaaaagacgtcgagctcgtgttccgctccgtgctgccgaagttctaggttctacgccgaggacgtgcaccccgccacgtggcgcgtgttcaacacgttcggggggaggcggtcgcgaagacgtttctcggcgcggatacggcgctcggtacagagctggtggtgacggcgtcggggagggttacggggctcgctaaggaggctggtgtgcttgttggtgttcacaagaaggaggtgatattgaaggagtttgggacttggggacagtgtaacggacatgaacttcttgtcgatttgcaaggttggtataacaggaatatatcatgcatatactccccaaaattattactaaagaaatttataacactggcatatcttacataattgatttatattttttcttaagaatttaaaacaaacctccacatatttgactgagatcactgcatgaacacggagttttttggagtatataataattcttctctctagcattaataaatagataattcttcttctctctaccgctccctgagagaacgtgaacgcggagtacagctaattttaactgtttatattttttttaagaaactgtttaataaccatatatttgtatataaaacttaagaatagagaaaatttaataacagtattataaagtaatgttagtgttgtttttcaattaaattagagtttaatctttctaatctttaaaataaaattgatacagatagtgaaacatgaattttaattaaagaagaatactaaaagcagtacttgtgagaatatatatatatattaattataaagatataatatttaattcaccttattaaatgcttttcattattgtaaggggaatgttcgttattagttgttgtattgtattgagaactctggataag

SEQ ID NO: 5885 - DNA, 1200 bp, Glycine max
  Soy_ogl_1 Gm01:300801..302000 Cluster 26
gttgacggaaagaagagggggtcccaattccaaagggcatgttccctggacaggtgagttgtaggtcccaatgatttgaccatcgactttcaaatgtctgcgtgtcccaattccaagtatttatttatttcctacatcggttccacaggaataattttcttcatgcatgtcaatgtcaatcctctcatgtacgtgggtctcatagctcacatgatccatttcacacaaattattcaatccacattcacctttcccaaagatggtaaaagattatcattttaataaacaacaatttaatttgaatggtgatatttgtccatctactttggagtaaatttgagtggaaattaaataagagaaaaaattagaaaaattgacagaaataatacgtgttgtggaaaaataagagaaaaattaaaaaatagaattaattatataagtaattattgaccatgaatttattaatataaaaatattcattaaaaaaattaattaagttgattaaaattaaggtgatataaattaaattatttatatgaatatcttggaatatgttcttataaatttattttgatacaagttcagtccagaagatttaaatctttgcatgagattaacttgttgtacttaaaaaagatcactcagacatgttcataatttggatcaacttgttgtaaaaaagatcactcaaacatgttcataatttggattaatttaagagtgaatttgatttaaagaaataaaaatgtataaaaatgaattgagatgaaaagagttaaaatatttaaattaaaataaaatataaaaatgtgaaacccatgttaatttttaaaattttcaccttaaatataatcaaatataaatcaaccaaacattgggcaagtattctgattgagtaacttgtttgtttaaatatgcaaaataataatggaaacattatttgatttaaacgtgtataggtttgtgtgcatgagttttggacattcccatgttatttactgacgtggcatgatacaataaataaataaatcttacattaacaacaacttcaaaaatccaaattggagtatttgcatgatttaaattagtttaatttaaagaaagtaagcaaaaaggatgggaggaatagaaggtgggggccggtgagtgtgcaccgtaaagcagccgaaatttaaggctcgtttaacggattaaacttat

SEQ ID NO: 5886 - DNA, 1241 bp, Glycine max
  Soy_ogl_326 Gm02:2461201..2462441 Cluster 26
aagtctatctcaaattatatcatccaataaaatgtaacacctaaattaaataattaattattcaactcattttaatattgagaaaaataaatctttcaacctattattttcggtaggctccgtttggagtcttattattaggcatggaagatgcaagttcgaaaagtaatgaagtgttgttttaaaccaatcaaagatgcacctactattttgtgcaagagttgttttaagcaatgtcaattgccaaacatggtgggttaggttaaaatttcatttccaataaaatgcacattatacttgtgcaattctttcgcactatttagctttttccctcttttgtcttttcattggcctatatatgtacttgaactgatgtggtttggtcaccagctattgcgcatgcgtccagccaattttctggtggtgatcggaatgtacttttactttgaacgtgaaattgcaaacaataaacgtttaacatcatttgcatcattgattgaagttattctagctagagtgcaagcaccctacaataatacaatatacgcgtcaatctctgctgtttagggaaagaacatgaagaggggctggtattttgtttggttcgcgtgctgtttggtcattgtggcaaaatatatagaaataataaattaattaatatatgttgtttgtaatcatgaggtcccatactttgagtgtgtccttgagttgaataaattctgatcttggaatttgttgtgtaataggatgcatgaacaatttgttcttattatgaactgttagtgaataccatggagtgtttgaagggattaattataggaagaaagctttttggtaggaaaccatacaactatatagatagatagttgctatcagcaggaaaagagttgttataatggttctcttatggatgtaggatactgacattaatattggctttctttttgtatatgggtttcatttaatatattttcttttggctgataaataaatacataaacgtgccagtattgttagttttccttccaattacttgttgcttcttccatgaaatttcaataatcaatagtggacacaacacattactacaagaaaaatgaccgtaggtaaaactaacaatgcattggccataaagtatcaggagtcaattatgtgagagacttgcaacttcccaataatacatttctttttgtgagttcaatgttgacctcccaagtcttggcaaaacgtcttctctactt

SEQ ID NO: 5887 - DNA, 1176 bp, Glycine max
  Soy_ogl_352 Gm02:3449701..3450876 Cluster 26
ggttttggacttactgtgaacgtcgtaaccgtaattgtggcaatatcagtcagtcacattcatctgtaatttcctgtaatatcaagcatcactacgaaactgcaactacaatttaaaatcttgactataactatataagcatctactaagtgatatatagtactcatcatttgttaagttataacgaaggttctaaaaattggtttgtgaccgcaaatttggcttgcaatattaaggtttttggactaattgtgactatattatggctgcaattgtgaaaacatcaagtcacattaatcgacaatttctcataatatcaagcatcacggaaaaattgtaaccgcaatttaaaatcttttatataagcatttgctaagtgacaactacccctgtccccttttcttttccattattaaaagcaacataattgcctttgtaggaatgaagattggcaagaaaatgatggaactctaaacacaatatccgtgactcatcctcacttcccaattgaacatcctagctgcttgggtgagcctgattcagactgcgaacccttacaaccaggcatatgcccaatgtttcctatattgcatattaatacaatcgaatctctagttttagaacttgactttagccaatttatattaacttttcaattaacataagtatttgactcttatgaaaaagaaatagtttcatatgtagaaaagttagatgagagaatttttaaaatgtgtataaattgattttagtagatgtgataagtttaacttatctgtttgatttttttttttttgggtatgttaagatatttatttaaagggataaatatgtttttatatttatattttccttatttttttaggttctaaagttacattatgtttaatttagtccatttactttattagagacatatttttagtccctatgcacatattcttcataggtgacattaattattagggaatgaattattattggctcttactttcaacaacaatagtttttccccacatgcacatttctttcgtcctggctgtgaagaacaagttgtggatttcatagatatgctacatgaacttttgaagaatgatgatggaaaccaagacatgaatgaagtagttaaaaattagggtttgatatgtttgggagagacattttaataatttttta

SEQ ID NO: 5888 - DNA, 1078 bp, Glycine max
  Soy_ogl_1522 Gm05:1587903..1588980 Cluster 26
aagcaaaaccgaccgggttgaataatggtgactgaccaaggaactcgagggatacatacccctacagtctcgaatgcgtgagcacaaaatgactaagtgtgaaagtggttgtccatgaaatgactgaggaactaaaggggtacgcatacataatttcatcatgactaactggatcgacttaatttgcagaacatgacacttatatttttgtcatcctcttgttttctactcattatgattctagggttgaagagaagtggcaaaaattgcatattgaggtggatgaattatctgagtcctaatgttaagcgtggagatttctcagaggaagaacaagactttgttgttcggctccacaacatccttggtaataggttctttcttagaccaattcttatatcaataaatactatatacactatattagtatattatatttataatacacttcatcatctctcaaaaaaaaaaaatagtagtacactccatcagtgttttaaaagctatgtcaaaaatatttttgattgacagtattttaaactgatagtgtatatctattaaaatgttataactgtattagtattgtcatcatgacactttatattggtgaatttttcttatggcacttgtgatcaattaaaaaagagtagtagacaatatttttctgtttaggtagtctttgatcgcgagaaggattccggggaggacagacaaccaagtgaagaacttttggaacactcatttaatcaagaagtttagcgttaataagaagaaaaagagcaaagtttgtgcccctccaaaatatattcctatggttgaacttgaacaagagggtaattaattgcaatagcgcatcaaagggtagtacgggggattcattagagttcattggtgaaggtgaaaagcttgtccatgaaagctcgagtggtgatcttatcgacttcgcaagcatgtatgaacggattgttacagatgattttgggtgtaccttttcttttgctaatagtgtgtttgatctattcaggagtgtctttttggcctttgatcgggttgtctgcaaaacattttgacaatcact

SEQ ID NO: 5889 - DNA, 1386 bp, Glycine max
  Soy_ogl_1692 Gm05:37144201..37145586 Cluster 26
ctaaaccaaacaattatttaactattcatctctcttgccattaagcattatatttttttcacaaaattcatcgtagaaaaataaatttttcaaaattctacttttgtgaaactacaccttcaaaattctagcaatcacagaaacacccctatgatcctattcaggctactgggcagcaacattgatgatgatgacctcaaaccatattccctacactggagcagccatcattcacagtgttgataacgaatatgatgatggcctcccaatgaatatgaagtacgaccttactggggtatgcaatggtttgatctgtttgagagcggagactcttaaagatggattttacttaacctgggtccggttttggaaccctgatacgaggttaatatccaaaaaatcaccatgtatacagtttcaaattcagaccccaagacgtggttgtaagatgatgggcttcggttcaagagacacttacaaagtggttacagtggttgtggattgggaatcaatgaaaacgaatgtgagagttctctttctgattatgattattgcaaatcaagtctaaagtttggagttgtagagttttgaacgccgttgctgaatgtgttacatataaccatcatcctgatttcttccgttcattctgtcttggggtggtcttcccattgagcatgtctgaaaatggcgatcttgtgtttctgggaagtaaatgtaaaccaggtcctttaatttttacgtatcaccagagagataacatcgtagagcatagtaagatttaccaccaaagagtttggttggattccactgattatgttcaaagtttggttttgccttatcgtaactgaactcctcctatacaaagctcgcacggcttatctgaatttatgttaaatcaagtaagtgtttttagaaccttgccttgccatgttatatatatatttttgtgattctgcagttttacttgtatcaaaatctttgaattagatgaggctattataaccgatttttccaaaaggaaattcctaggcattctattttggtctacaaaaacagtctttctcttcatttctaggtagttttttttttggtaaaagacatttgtggcctttttatggctgttattttggtttttttgtgaacaatagtatcaacctgatacttcacaactatctgtgtattgataagtacaacattctcacttttaagtaattaagtgcacttatgctgcaccattagggtatattaggatttaggatttctgttatagttgcgtcattattaatgaatttaatattttagatatgtaattgttttatatttcgtataattggtaatagctactacaaaaacagaacactgaaacatgtttaaattaaaatatct

SEQ ID NO: 5890 - DNA, 1134 bp, Glycine max
  Soy_ogl_2109 Gm07:1080979..1082112 Cluster 26
acacaaacatgcaatatattaatttttgtggtgtatatatcttaactttgatggctgcaggaactatgatcgacctctcctcttgcattgtgaaatgtacaagctagctagcttcacttgttttattaggagctagctggagtgccggacagacatatatgcatgatatctattcacatgcagtaacatcttcactcttcagcacctcatcacagcttgctgaaagtgacacaattgataatatttgttgcaacttaattacttgtccttacgtaccctctctctctttctatggagtacttccctagtaatttgctactttatccacccctcgtttagttgtcaacatgcatggtggaatccaacacatgtctgcgattttatggtacaccaccaataatttacgtaccttatttatcgtgataacgatgtagtctgtggataattatatagcatgcaacttgatcatatattaattttacgttgccgtgtaaatagtgaacatttgataagaaacccacgatagttttctttaatattattctctcacctcggtagttttaaagacacgaaattatacgagtaatttctcaaatattaaaaattatgttattggaatataaatatgagatgaaatttcaacacatgttaaatattttaaaaagtatttcaaattagtatctatatattaatattaaaaattatgttattggaatataaatatgagatgaaatttcaacacatgttaaatattttaaaaagtatttcaaattagtatctatatattagtataaaatatatcaatttagggactatttatgacacgagactttttttgtgggtaggtaatatgtttgagatcatatgttttattatcggtacaatcatattgtatactaaaatatcttcaatgggaaggagaaagaaaaaaaaaagattagttcgtagctaaagattatcttagttgagatgccttagtcagttacttaagaaattcgttggtgacaaatgatcatccaatagatacttatcttgattgatcagtccattattataagcagacatatgataagtaccggcgggaaggaattcacacgttacttccttctcatatctacttaagaaatatgtagt

SEQ ID NO: 5891 - DNA, 1196 bp, Glycine max
  Soy_ogl_2503 Gm08:4637805..4639000 Cluster 26
aaagtgtgttctgaacacttctttagaagtttgagaagtttattctcaagcaacgaaagtggttccttacattgtgagggtaggggtgcattaatgcaagcatcctcttcacccttaacctcaaagcttacgacaacttactatttacaggtttggattggcgtttcttggcttctgacgcgcgtcattatgaatgctagcattagctgcttctgcatcaattgataaatttgacgtgaatttttcccaagacgtggcttgcagaagccaaaccaaacacacattatgttgtctgtatctaagctcaacaaccgacttgaccttttggagttaggttggttcaagaggttgacaattggttaagcccaaaaaagattgctaatggttatgtccaaaaagatcaaattaaactaaattcaaaaggatacataatcttctaatctccagtctaaaaggtgaatgaggctaaaagactggtttacattcaaaaagctacaaatttatatatgaaaatattatgattaagtgaacaattaattggaaaaatttaactactggagaaaagtaggagaaccttattgacattagacaagcatacaaaaactcgaaaagagaatataaaaataatggtctttacatcgcacaatcttgtctaccacttttctccagagttcatcctatgcgtgctgggcagcaaagaacagaaattccaaaatgaactgttttgcttacttgcttgtattgtggtaaaaaaaaaaaaaaaaatctacaatccaattcaactcaagtgacaaggtcaataaagaaaaatgtttcgagacacccattatactataatatatctggagagggaaaaatatatgtattataagatttatgatctgatttgaaaaaaaaataaaaaatattaatgaaatacttaaaataagtgaatatttatatatcattatgtgtcaataaaaatgtcttagacatgatcatccattcccgaacttctgcacaatagccaccaaacttaaaaattgacacctcacaaggctttggttcctgaaataaaactgctcaaattttcttaaaataggaaaaagaaatagaaaatatagctgccaaatttcacgggcaccgtaaaatcctacaaattaataagcaaaagaaaaggataatgtcataaaagtaatagagaaacatgacctctt

SEQ ID NO: 5892 - DNA, 1001 bp, Glycine max
  Soy_ogl_2868 Gm08:43283901..43284901 Cluster 26
gtttagatgaattacatcatatcagacatgaagtttgtcgcaaccgtacgttctaattaagagagttacggcaaagaaataaaaataataattaaaagaaggttttacgatgttattaagggaatttaatttaatttgattgaataatattaaattattgtaaatttttttataatcaatttcaatttttaagaattaaaaaatactttaacttatttattaaaagtgtatatgttggtgaattttactcctcaacgagtatggtttacgagataatttaaataaacactcacaagatcaatcaatcacgtcacaatatcaaatagtaaaaactaattaaccgattacatttgacacaaattcttgccattaactcctaatacgtctccctataagactccttttaaataagtttttccataaatattttttgagagataaataggaaagaaaaatgaaataaatttatctcagactaaaattagttcatatataaattaaaatcatttagctttttctaaaatagttgattataattaacatatgcatatatacaccaatttaattaatttataggaaaagtttatctcatttttaatttttttcctcttaaagtgctaataaaaaaaatccaaacataacctaaattaatatcgtcctataaatagcctaagcataacttctcattatttaaattctcttaatataaagggcgaaatgatgcaaaacccaagttttcttgcctttttttcctcacctgagagattataggtatatatatttagggtttactgatattagttcctttcttttcaaacttttaccttccatctcgagcaaagagagagagatatataaagctacatagggagagagggggggaggggcaacaagaagacatgaatgaagttactttgacaatttgatatgagtttagtcctcaagttagtctttgaattagtcactttggcccctaaaatgaagtattagggttgctacaa

SEQ ID NO: 5893 - DNA, 1500 bp, Glycine max
  Soy_ogl_2928 Gm09:1255801..1257300 Cluster 26
tgaaagtcgctctcaaacctaattgtatggtgttgttaaagggtttgggtttaggctgattacgattcacctcataattggtactattacgcatattataatttttgttaaatttgttagagattttagcatcgtgaacttttttttattggaatctttaatgattggagtttgccttcttttttgtcacacaatcacccattcaccatgtaactcttgataagcaataattataggattcatagattgcaataattataggattcatagattgattgctttcactttcatccttcgcaattaatgcattttttcactgttatccttggcaacggttgccccagctgacaattgttggccatgcagattctaggggcaaagatgaattattttgtacaattaattcctagatagatgctcattgagagcttacccttcattcaatttggatgcttccataggtgcaaaggagttattttgggggtaaggattcgacatgtatattaggatgtgcaattgcatgcaagaagggcgtattttggttaacttcttgttgggaactttgcacatttaattgtagattgagaacatgggcatgtcatttaacttgcatcggttggcccggtgtaactggaggttgtccttgcccatacctcattttcttatggttattctaatttttccattaatattgaatgtctttctgaaacctaatcatatggtgttgctaactggccccccgggttcaggctgattattatattctccacatttgtgcatattaccattttagttaactctattagagatttgggtacccgttaactcttttattggaatacttaataaatgtaatttgccttttttcttttttgttgcatagtcatccattcaccatctaacacgtgatcaataataattatgtggttcacagattgtttgctttctcttttatccttcgcaattaatacctttttctattgttgcccttagcggtggttacccccagttggtagttactagccgaattccaatggtgaaagaggattctttgtaccatttctgcctagttgtccattaaatgcttacccttcattcaagttggatatttccaaatgtgcaaatgaggcttgttttgccagcagggtttttggcatgcagattcgagcgtgcgactacatgcaaggaggacgtaacttggttaacttcatgttgggagagttgcacatttaatttcaaattaaataaatgggcatgtgatttaacttacattgattggccaaccaactatacccgaaaatggcccctgctcattctcttttttcttatgcttattctaatttttcaatcctaagtgtatctctcaaaccttatcatgagtttgctatatgaggccctagggttcatgctaattatattttgcctcataatttgtcctattatgcatattatcaataccgttaaatttgtttgagactttggtacaattacctattttat

SEQ ID NO: 5894 - DNA, 1300 bp, Glycine max
  Soy_ogl_4541 Gm13:38237801..38239100 Cluster 26
taacggtattaaattgactttacatctagtgtatcaccaaattgaccaaaatatatagtttcaaaaactaacaaaattaccaatttggataatggttatctatatccatagttttctattctttcaacgatttactataggataatggtttaaagttaactttaatttcattttcattcattattgattgataacctaattgatggattctaacaaacgtcttaaagtctgagttagtatataaggtgtttggaccaactaaaattatagttttttttagggaacacaaattatagttaagtaatacattataatattataatattgttgattgatattttcttgttatttaagttttttattaaggcttaatacttgtttgtgcctacaaagacatcgcgagtggtgtcataggcaaatcaaattgctgacccctttttccaaatattttctcaatatgatttttacgtagttcttcatttatttatttttctcttctagccggtaatgctggtgtagtatacctacgtggactttagtcaaataaaaaattacatatttaatgggtgtaatttaattaacaacacacaattgaatttgaggaaaaaaattgaatttgatagaaatttaatcacacttaaaaattttcagaatcttgtggggatacacaccaggatctcaccaaagaggaaaaaaaaaattccaattacaatggttaaaaaaaaaaaaatagctcacacttcttggggtaattttgatatggttcaaaatgacttattgggatctcttgaattttccattcttagggaatgatgtcctgtattttccttcattgtcgatgcaatgagttgacattgtcattgcatggctatctatagaaaatgacaaagaaagtaaacaaggtcttatttaaatgcatgcaaccctccaaaacaaaccaagttgatcacaatatttacctcttcatcaacctcgcaataattaatttatttatcatcatcatcataaaaagaaattaaataatttaaacagcgatggcaattatgtcaaaggtggtgatgggtcttgttctctgcgttcttttggtgtccgcggttttggtccaagatgctgaggcatcaatggtaggccatggagcaatgcagcgtgacacttttcctggatgcagcaaaagacaccccagtaatgtggcctgtcatctgccaatagctaatgattatagaagagattgtgagccaggacaaagatgtcgtcatcaagaagctccaaaggtgatagcaagataattcaacattaatga

SEQ ID NO: 5895 - DNA, 1034 bp, Glycine max
  Soy_ogl_4841 Gm15:604601..605634 Cluster 26
tagtcccactgagcatgatgtaagtatgtgacgtgagacgttgttgttggcagccgaaactgatagcaaagtccccaattattattcatcctccaaaccatggaccagcccactaagcccattatcattcagcctcagtccactcaggcttcccaaacccatcatcgggtatggtagtcgagcccattgggattcttttcagaatcaaggagctgtaattacaactttcttttaacataaacttttgtacataaattttgctgtaacaacagtaatacacacgttctgttaaatggcaaacgtgccacactgctctaattaaaaatttctttattaggaggagcataaagataaatcgaaggggtggaatatttttttccccttaatttattttccaaaagaaaacaatgtaagaatatcatggtataaaaaataatgtataatatagttatcgtaaaacatcaaatgcaaagtttaatatttttttcagtgttcatgggcctctatcctcttccaatacattttctgattccttctcttctattctgactttgagatgaagtttgaacttccttcactatgccgatattccccaccaggcctccatacaagaaaaccttatctttttggactcttcctgtttgaaatataaaaatgttcattaattataaaaaaaattgactatatataaagggaaactgatttaataaagctgcccgtatatgtatacgtcattaagtattataaaactaatatcaaaatctgatgcttatatatataatcgatagaatttaaaaaaaaaaaaaacaatacaagaattcgataaaggtgtcggcataacatgggccttaaattgatgagtcatttaatatacaatcacagatggcaagagcacaacgtgcatatctcacaagaacagtgacggatctgattcgagactagtgggacaattaatcaatttaataaataaatttaataataattatcatattcatgaacaaatacaaatattaaacatataattaaagtgagaa

SEQ ID NO: 5896 - DNA, 1100 bp, Glycine max
  Soy_ogl_4859 Gm15:1828101..1829200 Cluster 26
tcaagttatttcctaagcaagacaaaggtttaaattagcagaagaagaaactgtgtctatatatagtattctttttaaaataattaatcagcatagtaataatagaaaaatattaattccgttttctaattctaatgtctgtcacaccgaatagataaataaataacttactataaaattgagctggttcgaaaaccacagaacaaacagaagcaaggacacgtgggagtgagaatagacggaaagcgttagtgattgggaacgattcgagggtgaatatggacggagaagggtaacggcgagtgggtccccagtggagtcgtgtggtaccgcaagcactgaataactctgtgctctgctcgttgtttttttgggtttggaagaagattgaatgctaagttgacgtgacggtgcgtttttattaaagtttcaccgcagtggcatttattattttatgacaagaagcttcaaaaagttgattcagattggggattagagatataacaagggacaatattattatgcacactctgcccttcatgtgcagctgcactgcactcaatgctttaacaatttattgccaccacctttcctttctttcaaattcaaagtttaaataatttgttttttgtttctcacttacatttctattttgtattgaagccagtaactgacttgtaaaattagctgcactgcactgccatgagtgtttttggtagagagtggggaaagaatcataagagatcaaaaagaatgtcaagtaaattgatttgatagaaataaaagtaagtataaaaatgattaaatatttaaattaaagtaatttgataggtaaaataaattggataaaaagaataatcaatggtgtatttttgtataattaattaggcatgtgttaaatgtgtcagaaatttccaatattatttatcttaaataaactcaattcaattatatctcacattcacccctttaaatcaaatatctcctaaaaattagttttaaacacgtaaatatttctataaatattttttgaattttaccttctttaaccttcacgagtttccatacttaattcacttaaactttttcttataaacaaa

SEQ ID NO: 5897 - DNA, 1328 bp, Glycine max
  Soy_ogl_5462 Gm17:2507373..2508700 Cluster 26
ggtttcctcgtttgtaatttattgttcctttttcccacacgaaaataataaaattttgattgaaaaataatatataaattgttttgaaagataaaaaaagaataagagaagaggggtcatacgtgcacaatgtaaaattatttgaagtgtaatttaataataactggaatttacatatgtatcacttgtttaaaaggatatgaaatgacaacaacttgcatcataaactttaataaagtagcaccatagtcctctctagaagaagaagcgggtgtaaaataaagttatgtttttttagaggaagaaaacataaagttgttaagaaatactactatgaaattacataattaccattaatctagttaagacgtgtaattaggcattattaaattttcttttaaatgaaaagattaaaaatatataatattaaaattaattgagatcatcattaacaaataatggccataaacacctaataatttctcatttaacacactaattctttgatcttccaatcaaagcatccaatctaatcaattgatcacaataaactatgggaaatactactacttgttcaaacatagaaaagaaaaaaacacaaattaggattatgggcactagttcaaagataaaaaaaggaaaaacacaaattaagactgttaaagaaccaataattgtcattttcatgacattcttgaagatttcactggttttgttttgcttcctgtagagcttcaagacgttcttgtccttgaagattccgctgtttttgtttttggattgcttcatctcgagatccaagtgttcgtccaaacattccaaagaagctccattgagtcgaaacgctcgaagaagcagaggataataaatgtcaatgatcttcaccttgaacacctgagaaacttgtatccgacttagacggacgaggaaagtcagaagagtaatagccaacactcatgcacccattcgcgtactcgttgcaggcctgagagaatccgaaacgctcgctgggagggatccgaagcagaagataggaggttttgcaggtaataagaaacgcgttctcattgtagacatgtgatgccgactcggaggacgcaacaccaggctcgttataatacggtttctcgttcagaaccagtgcttgaatggagaccaacacttggagcatcgtggacctagatgggttccacttctccgtcttttttcctgtcaacgtgtttagaaggctctagtaaaatacttttttgcttaaaaaacatacttcttctaatcaacatgaaactaattttacctaacctccttctccttatgtaaacatatacccg

SEQ ID NO: 5898 - DNA, 1000 bp, Glycine max
  Soy_ogl_6973 Gm20:44095901..44096900 Cluster 26
aatgacatttatcgatctacaaaaaatgtttttattcaaaggttgaagagcgattgaagttgatatgttgatagaaggagctagtatatagaagtattaattaatttaacatataagattattgtttgggcaccgactaatcgccgtccaaggatgttaaacgttccacgtgagagcacgtgacgtcatcggggcggtttatgatgtcagtgagccccagccgttgaaataaccctgggtggtggccaccacgcaccaccacgctttgaatttcctttccaaaaggaaaacgaccactcaataagggacgcgtggaccaaacacttgttaaggtagccctagttgtctaacacctacgtaacctagactatatatgatcatttctattgtcacattggtttttctgtctgggacccactcctaactccttctttgatttttaatatattcttcaaacttggacaatgccaacagtctattactatttatctcactacttatatttcaatatttctaaatattaaatactttattaacaattttaatttttctttctctatctcttatcacattattattatttatcaaagctctaaatattaaatacttcatcaataactctaatttttctttatctatctcctattatacaccatataaaaattcacatattttatttaatctactaaattagattccctccgttctccatttcctattctagtcagggagaaggtgagattgattggagctggtcccattatatgcgtaagctcaagtgtagctcctgaagcaaactgcggtattttgggctcgtttaaggattcggcccagtggacttacgcaacaaatgttaggccctgttttaaccagaaaaataaaatacggaggatttttcagattgcgcaattgctttggtttagtgatttacaattgcattacatggatatacgggcgcgcacgaattgactcaccgcaaacaaaaatggaaatgatcaaa

SEQ ID NO: 5899 - DNA, 1464 bp, Glycine max
  Soy_ogl_249 Gm01:216137..217600 Cluster 26
agcacatgaataatttaatatatgatgatactatcgtaacaaatcctccaactccaagagaaaccgttcatccaccaccagcatcacgttggttcttcaatttttgattcccatttgttttccttttatcacatttaatttttgttctgatatttatcttttatattttttattgcatttttcttcttgtatgtttttccagatctggatttgttttcggatctgcaccggtgacacctactgcagccgcactcaagacttctcctccttcgcccccaaccatgcctttcgcactctgaccttactttccggtttcctctctcccacatcaccgccgccaccaccagcccctttttcccctttcttcaccgacaacaaaaacaaatagacaaccccaaacacaacgcacacccaacaaaatacaaaagaagaggtcgcaaacgttcacaattcccttaatctcaaatctagaaactcatgcacacgaaaccaaagtggaggggcacgacagtcggttagactctagattcagcggcgatgatgaccgtaacgacggtattcacagtctctactatgttgttgtgccttccctatgatgaatgagggagctttggtgccgggaataaatggtggtgagacattggaggaagttaaacgggtttcagattacagtaggaaaaattggataaaagaaaggacttttgtcttttcaatttgagagaataaaaatggttgaatcatggatgccaatgcaaaccgagattcaaatcattaaaaacatgagccgatatagtggaaagaaacacggtcttgaatctacgaatgacaaaaaagatgttaaaaaaaaaagttaaaaagaaaaacacaacctacctacacggtgacaaaacaagattttttttttcccatttttaattttattttttaaatattagttatttatttttcttccgataacaagtctgttattgcaggtaattttgctccctcgtcacaagtgagggagtaagttttggacttcaccttagaattcaccgtctattgtcaggttttttgaagttcatttgtctctatctcaaggatagaattgcttgattttgaatatcttagctagacttgtgcacttgctggtgttaaaagagtgtattcggggactgacattgttcagggaatttccatggtagaatataatgactttgtcatgaagttgacctataactaattttgttaccttttgtcgatgatcgatctttcgtgcagagtaagaatatacgaccaattgatattcagggaacccattttaaggaatatatatattgaagcgcgactttgctattaagttgaccaattgcaaatattgttgcagattcttgggatatttcgtgcggagcaagaacatactatagaagaaagtcataaacttataataatgcttgatacaccgcacctattgcgattggtgaa

SEQ ID NO: 5900 - DNA, 1300 bp, Glycine max
  Soy_ogl_651 Gm02:44726601..44727900 Cluster 26
ttcataaatacatgcatgattcaattgtccattacttagccggctctcatagaccaaccctccttgaataaatgctatcttccacgttctcaatttaatagccttatcctcttcctcttgtgacgtcgcatgcatgttgtcatcaccttagttcccatccgttgtcttcctatggtttttccttttacaaacattgtagacataccagtggattagtatgccattcaaacagcgaaaaattgaagcctttgaccttcgactctagccacagccaggatttaaacttcattgtttccaacacggagtcaaaattcaagctttgaacatcaaagattatcttgtttctatggcaccacaaagaccacaacgttgcacaccatgcataccaccttccaacagttgttagtcaccctccccagccagtcacaatcatgcataaagaaatgttgtgttggttcattatgttgaacaagcacaacccctagccatgcgttgcaagcattctaaactgatgaggcaaacatgcatgtaaacatcacgtggtttaaagactatttccctggccttgttggcaacctatccaaagacaacctccaaataaacaataacacattctttggaatatgaagtttccaaattaagtatttggtataataggctttcaacagaggttggatcaaaagccataatttcatagacctctatgaccgaaaaaatccttgttgaattacttttccacaacaccttatccacctcttcccccctcaggcttacccctcctaactccctcatgaagatctctaccaaagatttctcccattcaaaccactcatgcctccaaatcaacctccatacccatctcccctccccccaacacccacaatcccccacccgagcttctttttgcatagagtttgtaaacaacctctgttatttcaaggccaattaaagcctcatttccaacccaagtgttgttccaaaagctcagtttttttccggttccccactttccacatgatgtttttatcaaatcatgacatctccaccttctcccccacacatgaactatgtccctccaccaaatagagtctgcatttgatacccgttttatacccacaccctcctccccaccatactttgattttaagacaagactccgtaaatcacctttatcttccaaaagcttttatctccatttactgagcacattgaaagacacatttttaatacccaacccccctctctctaggccgacacacatttttgtttccaacaacttaaccgcttcctacatttcaac

SEQ ID NO: 5901 - DNA, 1200 bp, Glycine max
  Soy_ogl_687 Gm02:46124101..46125300 Cluster 26
attggcgaagggggtgttaaagattcagtcaagtaattagtaggtgagtagtcgcatttttgaaatataagaaaatgaagtgctttcttattttattattccatatttgaagaaaaattatttatctgtaattctgttaagagtcttcttctgtagttgaatccaaaccactagaggttcttaggcaacactgccttactcagttgggaattactatatccaaacttttactaaaatactcccttttaattatttttcctaaaaatcccaaaattccactctctttttatcgaatacactcccccttttaacgaaaagattactctatctttacaatatatcaaatatcaagtttgcagtttagttcatcttgattctcttgatggcggatgttgctggcatagtagccctttgtataactaaaaaaaaataaaatgaaattcacatcaaggaggtgatgctgaatcaaaacagtgtttataaaagtagaaagttgctttaaaagatccacgtaacaggcaaatatatgcccgcataagaatcctcagcatagtggacttgcaaaggaatttggcacgaatagagtccctcttctttccaagactgagccctcaaatcatttaattttgtcaaatgttaattgcacccatgattcatgtatgaagcagaaaacaattgaaacatttggccatgtgatagtgacaacatatatggtgtgtttggtagagaagagagaaataatattggagagaaattttgtattttttttttgtgggattcactctttttacactacattaatttaaaattttatcttctaaatcaaacacatctgtagagaatgcctagtcttctttgactagcggtggagattggagaaggccatgggagagacttgtggagtgaaggggagtgtatttttccggaatatttttggaagataaaataaaaggggagtgtgtactattaaaaagggaaggtatatatagcaattccctactcatctttattgaaaagagaaataatattgttttagactagcccataacctaaagtggcccaaagctatcagaagtgaagccagcgcagtaatctcttgcagggcctgcactttcagaatttggcatctcatagaaattacatgactattaataagccagaatctctaaaagtaaatttgaatatgactgtccattcttt

SEQ ID NO: 5902 - DNA, 1322 bp, Glycine max
  Soy_ogl_764 Gm02:51079924..51081245 Cluster 26
ttccctttctgaatgttattgctactcatcaactattgccattcagttaaatactgtatgttcttctgttctggcacggggtgaagcaataatgagaaccaccacatcgatcatgtgctcattctcaagaaccacctccactttatccatcgtttgaacgatctcaataaacgttttccaatgtgggattggcaagaggccatagcagcatatccttatctgtggaatgcttgtgagaagttcagtgagcgctttcaagcttggatgttgaaaactctggcagatatgttgttgttccttggaattgaaagtactgttagtgtcactcctgagagagaaaaggagttccataaactatgcgatgaagctgttcaacttggatttgagaggttatggattgatgaaatgcatgctcatttaactcatgaactacgcagcatacaaaatgaacttaagagtcttaatgactttgttgatggccaaacaaaatgtttcaactttttgtgatttggaagttctagcccctactctttgtttgggtggaatttctgtttctcattagaaaatgcattctggtgttttttgtaattcttctaagaacgagactttgggacgtgtaaagtgagcaatttaagagtgttgagtagcattttctgtggaaattgttattgtttttggacttctgcaatcatggttttccctttatctttttatccatttgccgaaaattgttcaattctttctttttctttatgaaacattagaccaggtcagttcttggctttgttgtgccaaaaaaaaattgttaaattaatcatcttttaacccaattgtttttccagctttaagataattaatttaacaaaactggtagaacattgggaggaattggagcaaatcattattaaggaaatggggcttgggcctacaccactgtcgaaacctcgccattttcttattgggcttgggtcatattattaacagcttgattcctatctgttttgtttttcaaatggggtccggtacaccctacaccatcggtatgaatatatttacagttacctaaaaaattaacctacaaactaaaaattgtctcaatttatattcaaaaacagaaaattttcaataatttttttagtataaatatatattttaaaaaataaattttcttcttttttttaacttttttactttcagaaggatatatattaacaaatttttatttcgtaaaattcgttgatattcgcttaacacgtgcaaacataaaataaatatgactatatgaggcaaaatttcatctaacagaatagggaattaataca

SEQ ID NO: 5903 - DNA, 1368 bp, Glycine max
  Soy_ogl_1031 Gm03:41941201..41942568 Cluster 26
aaacctaaaccaataccccaacacatgatgcaaacatttgtttcttatctaaccacaacctcaaccaattcgacatggagcatcaaatggcaaagacggcgacgacaacaacaacaacacattgtcctgcgacaaattgctaaaggttaaaagttaaaacccgctatgatcgaggagctaggcatggacgtacaccaaattaatccgaaattaatcagtgtaccattgcatcctctttaggtatttcgttaggcctcagacaacgcaacgaaggaacaacaacaacacaagaagaagctgcatcaagtacaacgagtgggtgcaagaggacatccttaacaaaatcccggttttctcaatctcaacaaaaacaacaagtgatgccattaatgaatgctccattagtttggggcaatgggaggatggggatgtggtgagattattgccttcttgtaaccatgcatcgatgcatggttcatggaccatgccaattgccccttttgccactcagcaatcacttgtgattgcgagttgatagaaaatgtgggaaacggacaaagggtctttcatgtgcatggggatgtttcatgtgatcatcaccatacattgatgaatgatgatgatgtcagtggttacaccccaagattacaaaggccacaccccatgttgcttcacacgcactctctctcgtcgcacatgcggagaaagccacgaggtttggtgatgatgggtttgaaaaggtccttgcctttggatcagacatcttcgtatattgccattaccatacaaagagatcaactaggagaggctttcacctcttctaattcttctaccaaaggggtgatcatgacgagtcagtactataactatagatcaagatcgcgtagtaggcaccttgatcacatgtcttcggtgttgatgagatccttctcgcagtttcggaacagtactactgcaagtggtagatacaatgtgattcttccaaattgaatgtacaatgaatcatgaccggtctaattagctagtgtagatggttcttcttctcttcgatcgaacaaataagttcaagcacatatttctcgtaaataatatagattcaaatttaatataacctttcatcatattgatattcaatagtatactcaccatctttcagagttattataattacgaaggaacaccataatcatggagtattttctgacacattcacatgcacatcgatcttttcggtgaccagtttttctgaaacatttattgcgccgtttattgatttcttgctctcatcattatcaacccttgctttggaggaatgatggcatatgtaagttcttaaatttatatatgttcttgaagacatgcagatgc

SEQ ID NO: 5904 - DNA, 1212 bp, Glycine max
  Soy_ogl_1081 Gm03:44165689..44166900 Cluster 26
atgtcagtgcaaattgtgagttattaaacatttgtttagtttctgaagatgtatacagtcaatttgtcttgacgcggtcatcattgttgattaaaatgacaatggtacattgatttgaatttgattggatgattctcaaaattcttgaccaagaagaactctaagaacccttgaatgaggcgcatcagggtcacccttcatggctctttcccgccacatctcagcaggcctcatcagcgtctccatctgctccggcagccacccaaccacaccgacacctcttccagaatccgcggtcttgtcggaggctcgagtagtccgacaagggcgacgccttgtggtgcttattgtgttctctttattccctttgtttgtgtcctctggccacggagttccatcaagaccagcacaactcacctcttcaaattcaatacccttattcgaccctttcatatactataaatactaattcatttatcttatattatgaattatgatcgtaaaggatgtctttgaattttcggtaaaagaatccaatagtatctttgagaagaaaataagtttaacatcatattttatttctctttaaacatatatttgagactaaaattaccatccaaacgtacactaaggctataatcatttttctcttttaagttaaactgttaatatttgatatcctgacataggcgggcttctcactgttgtttggaccatcagaaaaagagagaaaaaaagtattcggcaaaaagagtaaccagttaactacacatctctcttgggctccctatgattatgaactaggaatctaataaactataaactattgcacaacaattgtcactcaacaaattgtccactaacttaattccttccatagaaactttcgaaaacatttttagctattttacaccattagaaaaaatcttgaagcaatattacaatgttccaagttaacagagttagaaaataaccgaggaaagagaccaaaatgtgttaaatttgctactaaatcttatcatttttacgcataaagtcaaaacataactgaaaataaatatatggagcaatttaataattagcttttttatatcatatttaaaaaaaatccaaactttctctttcactaatagaagtaggcaagtagcttaattcactagtgtatttgttttgtcattgatttcaaacaaccctgagttgaaagttatctct

SEQ ID NO: 5905 - DNA, 1000 bp, Glycine max
  Soy_ogl_1097 Gm03:45443701..45444700 Cluster 26
ttttctagatcttgattctcatggtcccctctcatctacattccagtgaaccaaatgaacttcttaaagggtaatgatggtgttgaaagtaatattgcatgtgcatgtaaatttatagttttgcaactaagttcattgttcaacattatttatttgttattgaattaaatcaagagcaaagttttcttatattaccaaaattttcctaattcgtaagtgtaagattaatttttgctactgagattgtccctccctacaaatactttttggcaaatttaatcctctgatatttcaaaaccaaaccttgttttgcttttttttttttttctcttatcggcaatcttgttttgcttaccgctgaaattacctcatgtgagttttatagcaattattttttctttctattataatattaagcaggcaattgcatgattattcttatatagtgtaatcatatacttaaattatctctgcctttgtcgcttttaccacttattatcgcgggtcagatggtctgagtttctaactaaacagtttttttctcacttttttcttcacaacaataaacgcaagaatatatatgatctgaaaaaaacatttcagacaatatctctttgtgggtagtaagttcacttatttcagttatttgcgtcagtatatcaaggaagatatggtggacccaagtccccgagataatcgatatagtcatatgggtcaagcatccctgtcggtacaatttctgtgtctaatcagttttgcttaggtgttgaaatcaaatgagagaaatggcccaaaaaaataataaaaagaaataagagcatgtagtaatgcaacactgttaaaatatacttgactgtttttaactactataatatatagaaaattcaaaataatcattgaataaactgaaatagtgaaacccactcattcattaatcactaatgagattgccattcagtattttcttttctatgaatacacataatttcttttactcgac

SEQ ID NO: 5906 - DNA, 1600 bp, Glycine max
  Soy_ogl_1170 Gm04:2014701..2016300 Cluster 26
cctcaatgtctttaaacatcaagagactgagagagaaaaaaacataaatataataagtaattagagaaaaataaaaaaaagtattgataagttgtttaaaataaataagtaatgtaatatgattgataaattaccttattaaatatgtaatcttaaatttaatctcattaaaaaatatgtattgaaaaatattaacccttaaatgtcattggctttaggtggagataccagttcacataaaaaaataccaactgataagctccgacctggggtataggattccctttatccaacagtagacgcccaaatccagccacatcctggagacatcatactcaaacagtttcagcagatcagtgttagaatgaaagccaatcgctctctggcaactgtatggaaacatttcaaaagtggctttggtaattaacatgccaatgaggaccacctcttgaagattattgcaacacttagcaatcgctaccaaacctttttcacctatacgcttccttccatcgatggtacgaagctctctcaaaagcttgcacccctccgcagctgcaacaagtcctgcgtcagaatttcatacctcgaacattttgaaatcgctttcacaccaacgacggtcattcggaagagtacttcgaggtggagttccactatacacggagcctgatccaccaacagatgaagaatctcgtcccattagccattgcaacgaacaaccttcaagatcgtcaagttcttggcgccgataataggataaaaaattcagtcaatttcaaataaacggctttcagtttcggcgatgacggtgctgctgttgttaatgaacggttatttggcgaggagagttgttccagagcgcggcaatgatgcatcaatgcattcaagcttaagcctttgtatattggaaggagaacttcttcaaacgagccttgtagttcctggagaatgcctccaatgcagcgtctgtgagatcggactcgagattagggcagcgctgagaaatgtggctaaaagcattttctttggagacttctcagaggttgcatttcaacaaggagaaaattgatttccaaaggtgttggttgcatcccctcttgtccacatggtttgaacttcaccgaggatgattggcacactttcgttgattgtgaaaaagcaaagcaattttggtaaggagctggcctatgggcgcatatggaaagcacgatcatggaagctaacagtatcaaagatttactattcagctctctcactcatctaccaaatgacctcaagtgcaaattttcaatgattctatggtccatttggaaaaacagaaatgagaaggtttggaacaatcttgatatttctccagcaacatcaatatctctatccgaccagttttattcagaatggtctcatgctagaagaaagagcaataacattccctccctccccgctcaacaagttcacggaacatgggagccccctccactgggatatatcacctgcaatgtagctatctttcaagacataaatgcttttggtgcagacttgtgtattcgcggtcatgatatgatggaaactttattcgaccaaaaacatgcatctttaa

SEQ ID NO: 5907 - DNA, 1612 bp, Glycine max
  Soy_ogl_1173 Gm04:2075693..2077304 Cluster 26
aaatactacacatttcatttaaatcctctcgtcacatgatgaattaattactgtggtagaatctgaatatctgatatttctctattatttgcttctcttcagctctcttaacatatatatttagttttaatttaaatttgatttttttaaaagaaattaataatatttttttttcttataaaataacaataataatttttttggaaggcaagaaattagtaataattaaaataacaacatatcacaatataaattattatcataaatttaaaataaattttatattaaaaatatttatttattacaaattttaatttaattataatactctaatttatatattttgatttgttaattcattgtaaattataaattacagtttataaaacaaacatttatttcatgcaatcaagctaattccatccaacattattaaattgtatttctggtgagggttgctaccacccacgagaacccttccataacgaaccaaaatcgccgttgagtgtacatcctaggaatactcgatcgacgcgctttgcaaaacaaacctccacctaactgagctccgtttatgatcaaaacgtcgccgttggggagcatcaccctccccatcgggatggtctccaccgtccacgtggcgttcggatccgtaatcttaatcctggcccctgcgggccccaccgcagcctcaacactcgccgcttccaaattcctcaacggaagcaagaccgcggataacacatagggtctccgggtacgatctcacaacggcgtcgcttttgtagtcaaacagaatggcccggttcttggcgaaaataaaaacacaaacggataaagattgttctccgcgcacttatcataggtctaaaaagaaacggtaaatcgtactcagttggttttatcttagggtaaaactcgtaactaaattgtcttcttcctccggttataatttgacatcagtctgatatataatgattggtggaataccaacgcttcaccacgagggcattatttgtttcttgccagtcacgcgtttcgcatggaccgaaggatcttattttgccttcgccatcgttgtagccgccggtttggacgaagagggggcggaaggtgttgcatgcaatgtcgtattcgagggagtgtgcggtgcagtccgttatgttgagaaccttgtcggaggggtcgtggcggcacgtgccgttggggagggttaggttggagaagacgaagtcggtgcggtcgttgttgaggagctgcatgtgcatggcgacttaccgatgcttttgtggaggagctgccactggccgttggaattggaagcttcggtaacagagaggaagaaggtagaagaagaagtgccatgagtttgaatcaaattaatgtgttggttgaagttgaagtgcaatgagaatattatcgccactgctgaaatttgctataaaaataaatttattcgaattctcaatttttaaaaatataaaatttaattcaatgataaaaaccatcaaaaagaattactaaaaaataatcgtaaaccctcttataaaagctttctactaattattctacttgctattagataaattgactgttacttaaagtttccaaa

SEQ ID NO: 5908 - DNA, 1172 bp, Glycine max
  Soy_ogl_1219 Gm04:4392301..4393472 Cluster 26
aaagttgatacgcccgcatgtaagtagagtctggtgtaggacgaatgctaacaacacaaattaaataagatgtgtgacctaatgtttttttaattttcaaaaaaatttagtcaataagagagaatgggttataagagaggagagtgttagaaggtgtattactagtctttctggtttgataatattggtcactcttgcaatcaaatttggcttgttgaaaatgaaaagccattgatagaggtagccgttactggcaattaaacccaactagcgctccattgcagggttcaacaagcaacggccaagaggctccttgattaatactctttgatgattttacagcctccctgtaaatttcttgctcttaaaagacccttcattccccatgtttaaagcctatctttgtctgatccatttgtttttctttttacctttttttcctgtcatttccattttctttaggaacaccagcttttatctttttcaaattcaaacaaggtaaatgctaaatacatgcatgttatttaaaatacagtattaataagaggaaaaaaatatattttaatcattgaatgacatggagtacgtagttttttattttataaaaagcgtttgaatacgacattatgcaatttttaagagaaaattaattatttaactcccttttttcgcaaaatcacggataaatagttataacatttcataatttgttgtagtagttactataaagtattgactaataatacaacgcgtcgaaagaaattaactgaatcagctgtaaattttaataattggtaaatcccacgaaaaaaaaactaattggtaaatcccttttccttggatggtaaaagcaaaacaaattttcttaataaaaccaatttcaaataaatccaagaccaaaacaatgcatccgatatttttttggctgaatatcaaagcatccgatattattcctgttttgcttggatatcgttccaaaattgacccattgggtattttgttcctcaactcaacaaaatacatgtgccatggttgcttaattttatccattgggctaatagcccgtatgcttgaaatatttttaaataaagattatgctaatcgtgtgttaatgatactgattggcaagtgcttttaatatatcatattaaatatttgtaattatttttaaa

SEQ ID NO: 5909 - DNA, 1236 bp, Glycine max
  Soy_ogl_1546 Gm05:2198801..2200036 Cluster 26
ctagtgagcctgacccataattcattctgaggaatagaacacacattaatcttgcatgcgtaagagaatatcactgtcccattgtggtcacgtaaaactcttctacatgcagcttgcccatcttcagaaaccgccccatcacaattcaattttaaagctccatcgttgggaggctcccatctagttgggaagctcgtttattctgcataatgttcaccaccatcccctcaactatggcagaatataaagataacacaacatcatttcggtttatgcacaggtagtagagagtgaccccaaaaacgatgtcccagtcgttatgatcctaccttgcgtgcgaaccaagctttcgatgcatccatgtcttttaaccccttagaaaaagaaagagtgatacgtcctatcccatctgtactaactcacagtataagttgccaaatgaccaaatacaccctatatattcttgcccacatcatggaagtttcaacttctaacatacaccatgaatcaatttttaagtgtattcatgtcttttagataaatttttttaatcatactcaatcatgtgtcatatacatattagtagttggaaaaatatataataattctggctcactcgataatatctcataaatcaagatctccaaacataaatacacagactcaaaacacattttttgggttagtaaatgtcgaactttaaatcaatcccatgcgaaattagaaagatgtttattattattaggtcactttttttattttatatacaatagtcatagtaaaatttaaattcatgaccttatgtattctacctcaatcccatcactaggccaactccaggggattattaggctactcttattaacttatacaacatttaaataagataaattttaagtgaaactaaataaatcatgaaatgtgtccaataaatctcgcagtaatatattcaaatgaatgttttgttttcttaaaacagtaattctaaagccaaacccctaatttaaatttccaccggcaatcatatacatcaaaatcaaatacgtccatgaaaagaagttccacataagaggctcaacccatgtgcatttgtatcttttttcctccatatccacctgctcttagctcaaagttgaatccggcgtgcatggctggttcatccatctacgctattcccccaaactcatggaagggagttgtaactgtcgagaattctgtcgggacactttttttttc

SEQ ID NO: 5910 - DNA, 1086 bp, Glycine max
  Soy_ogl_1668 Gm05:34498701..34499786 Cluster 26
caaagatttagggaggagtatcctccaaccaagtcctttgcagtaaaagctaaactagctaatttgttgttatcacccatgttagcatttctgttcacataggagagagaaatagaaacattgctacgcatattaagaagagacggagaatcctgaaccacttccacaaaattgaagttccccgtccaaacattgacaagacgctggcaatcaatttcaaacacaatccgattgagggacataatgagagaagtgtcaatggcccactgaagggtcagagcttctgctatacgaggaggatatcagataggaagaaatttagttacagccaccaaaactttgccagagtggtccctaaaatcaaccccaaggcccgtgcctgttctagaaataacaaaggcatccaagttgcacggacagggcatgattcaaaattaaccaaatttgggtgctgttgtgattgaatacccagttgtttctacttttccaaattctactcatcagcttttggtctgccacttcaaaacaatccacaaacattcccagaggcgttggcaaaccaagtgctctttacttccaggcattcctcttatctagctggtgtgtaaaaactttgattctagaccgaagagcttgattgccgtggaaatttacttgtcagaatccgaatttgagtttaatttttaaatgtttcatcactttcatggccatgtagtagtttctaaaggcccaaagttgttagagcaagagttctatatttacaagcccgttgaggtaatgatgagacattacttatttcattaagcgataagtttccctattataaagaccttaacttcaagttcgtaaatttatgagtttaactcctcagttgtactgtatattttgtatgacaatagactgaagtgtaatatatgcatgactgtgctatttgttctagtttataaattcatgtcgtgctactatttgtatttatttttaatttgacataaattctcttaaaatatttaggtttgaattttttattaataaaagctaacaattaatattaaccgataaaaaaaatcaaacgataattatctcaac

SEQ ID NO: 5911 - DNA, 1140 bp, Glycine max
  Soy_ogl_1695 Gm05:37247561..37248700 Cluster 26
aaaatgtattcgaaaacacattattctaataaagaggattagaatttaactcacaagattattaaactgctttagtttgtttgcccctaaactgaggcggcattgaacttgaagaaatttatatagctagcatatataatcttctacaaataacaatatttagtgcgtgtttaccaaaaacttcaaattctcacttctcagaaaatatgcattgggacgtgtgtccgtccaattaatcctccaacctaacgtaaatataaacgcatcctttgtaactttaggtgtatattgagtcaaaatttgcgtttaaaaggatctcaaaccctggatttttttccatcagaagtctattgtatgtctgcttatatatttgcaaactatgtcacaatcttctttcccctctaatgacgatattgacttacaacccactgagcccaatatccgcgttcatgatagaacttaggctgataaagtattagagataatttaataaataaacgtacgaactacacatgcacccccgtatttcaatatagttggccatacattttgaatctcacaaagtcgaatgggtagttggcttgagacttcacaggcacaatgacaaagaatttttgcgaatgggaggaatattggaaattggaagtttcccaagtttgacttggcagtgttaggcagtgccgtatggtgcatcaacaccaaattcgacttttgtgggcttaatgtggataccaaattggattttggttaaactggaaatagaacccaaccctgaggtttggtcaaatatcacaataccgctatgccagtacatgtcccctcctcgttgaattttttgcaccactcgttcgtgtctttgggtttttgcgtataaatactactagtagaacacttattactgttcctacatacactagaaccacatggtatatatgctagttagctcacagctagtttttgtttccattctacagccataataagttaaccagtatttcgaaaaataataataatttaaagactattagtctatatcttagaataatattgatataatagtatgtactatagctacaactataataatttttttgtgaatgaatatgataaatggacatgcagaacagatccacgttttct

SEQ ID NO: 5912 - DNA, 1291 bp, Glycine max
  Soy_ogl_1731 Gm05:38440410..38441700 Cluster 26
gggtaccatgtctaaccaaggagagataagaggagtgaatcagtttgtgtctttgggaaatagatgacaaaaaaaaaaagacctgagagactataaacagagaatgtagactgatcaaacaaagagaacaagagaaaatagaaaggaaaaaaagaactcaagagtagaaagcagagattgatgagaataagagaacaatattacaagaaaaaactgagagtgagaacaagagaggagcaaaagaagctggtagatgggttgcggagagtcagcaaagggtctcgtcacacaatggtggttggagggtcggatggggttagtgtagtattcacaaggtaggagtttttacccaaaattacctccataaaatggcctctaatgcgaatattggaggccattctcaggattttgggacgccatggcagtgcatatagcagccaggggccactacgctgctatagcaccgctatagtgcactatcgacagacctgcaagggaagcagggaaaaagtcatgcaagattatacaaaatcaaccagtgacaatgacacagtacatacaagcataaatacataaacagatacacacaattttatatagatattttatccaattcctgacacgagagaagtatatccaaaatggaactaaagtatctgacctcgtttcatcatttactagacgaagtttctctgccttctcagtctcacttctttgttggagagcaccaataattgtttcaaaagttacagcatcagggggggcaatcattgtcatccatttttgaaagcaaggtcatagcttcatcaaaagagctgtctttacaaagggcattgatcataatggtatacgttcggacatttggacgacagccatgtatcaaaagatgtacttacctttttttcttctgcatttcttaatgccgatacaataattgttgaagttacaaatgcagtcacaggaaacagtatgagttttctccttttgtttccatcaacatttgaaccaaacaccacaaataaagagagaagggtagctgttgtttatcccgtggatttttaatgtgagttaaaaaaaatatgaaataaaactgtaaaaaattcatcttaattattaattataatccaacgattattatttgtttaaattgagattttgtaattttgtataaattgagaagatgctttctgcaccgtaatttgcaattactactttaatctgttactccttggtactactattactaaaagagttaaacacgcaactttttttctactattgaaagcaagta

SEQ ID NO: 5913 - DNA, 1100 bp, Glycine max
  Soy_ogl_13 Gm06:615601..616700 Cluster 26
taacttgtatttatatgttccatgtttttggaatacataagggcctgattatgtagacctacttggctatgcatcaattttctggaaacggaagacatgtcttcaagaaggacgtgccatgggtttggagactggttcattgcattcaagttcaaggttgcttcaactcagattgtccaacagacaaaaactgcacaacacaactttggtcattaaccatgctaggcttgaggagaataccttcgaacaggacattgttctcagccaggtagaagaatacctctgcccacaccttttggcctacttcgaatcccatgagaggagagatacaacgtgtcctctaaacaaaatgcataatgtttcaatggttttgttaccgggaacaatgttttggtagagagtttcctcaaagagaatggtagcagagatgtattcaccaagaccaggagatgacttgagaagagtagctgaagcagaggccattgttgaatcaatgtagctgtaagctaggtactgtccaagtgatgtccgtgagggaaagaaagaaagaaagcaagcacgaggttacaattggcctagctattagctactttgttttgttttgattctcattaagcaatggtggagattcaatgacaggatctgctccctatcattccttatcaatccctcccatgcctaaaggcactgaatcatattcattggcctacacttggtttaaatgcattccagaaatacattttttttgtagtgggcctttaggccctttctttcacacacacaaaataatgtcttcctcatcttactcaactattttggcaggagaataacaatcaaacaaggccagagactatttaaaaataattatttacttaaacaaattttttaatagtagttattttaaaaaatatcaaaagatacttaaaaaaaattatttgccgaacagttaaacacatcttttataattttttttgaagccagtgtcttgtcaatcataaccttaattggagttttttttttttgctttttaccaataattataaaaatgtttcaataatatattttggtataaacttttaaatgaaaaagggagtacaaat

SEQ ID NO: 5914 - DNA, 1500 bp, Glycine max
  Soy_ogl_1751 Gm06:777801..779300 Cluster 26
cagaaagcgaaatcaatctggagctatctcaattggccgagagcgatgcttctcatcataataactcaaaagattggattcagaacaacatccaaggagataaaggccttctcttttccataaattgctggtttatctggaggtctaggaataaagatattttcaatgataaagttcaaccggtgtggcactttgctaaccagatttacactctcaatgacattatcggtaaggacgttactcaatcgttgcaacagccttctcctatgcaagtgtgttggattgctcctcccggtgaggtcatgaagcttaatactgatgggagcgcttttggaaatccccgggacaagcaagatttggcggaatcataagggatggtcttgggaattggcacacaagttttatgggatcctgtggctttacaacttcagttcatgcagagttactcgccatctatcatggtttgaagatagctagagacaaaggaattgaaagattgatctgcaaatcatattcgaagcttgattaggacctaatcactggagaaatcaacttgtttcatcaatatttccctaccatcatgctgatccatttgttgaagcagatggattgggaggtgacctttgagcacgtgtaccgtgaagggaacaagtgtgcagactggcttgcaaagacaggaaactcttctcaataggacttgattattcttgatcattgtccctctgccctataccaagcttaccttggtgatgccatgggtgtcacaacccaaaggatttaactgtttcttttgttctttattgcctttttcttttcttacaaataataataaaaaaaagatgaaccaacaataatagtaatatatcatttggttttataatttctggtcatgattgtataagaactaaattaaataaaattgatcttttaaatattatttgctgactgcatggttttatattataagaaaaatacaaaagacaatacaataaactacatttaaatattttattataaaaaagttttttaaaatatgccattgtcgtgttaataaacaatatattttacatcaaaatttaaaataaatagtaaaattaaattcagaaaacttggcaagtttcacaattcagtattttggttgcttagtggacctactagccagagcagggtgtttgagggaagctgaagattttgttaatgcaatgcctattgagcccgacgcagtcctttggaggaccctcatatgggcctgcaaggttcatggggatatcaatagggccgagcggctgatgaagcgccttgagatacaagacacgagggctgatgatagtggaagttacatacttgctagcaatgtttatgcgtccgcggggaagtggtgtaacaaggcagaagtgacggagttgatgaataagaagggactggtgaagccaccgggatctagtaggattgaggttgatggtggtgtgcatgagtttgtgatgggagattacaatcacc

SEQ ID NO: 5915 - DNA, 1000 bp, Glycine max
  Soy_ogl_1862 Gm06:8581301..8582300 Cluster 26
ttgttttgccccactgcaccgaaggtctgtgttgggaaaatacactcaacaacggcagtatggcactattacgtatacatatagaaacaaaaaacaaaaaagcgaagtagccaatacatacatgcgtgtataacaaaaaaggatcactacaccacgccgggcgcacttcattacgaagcaacatagacacacacactaggatatattttcatgtctcagcatttcctttcatctccaattcaaatccgcaatactttacaaatttcttacattaattacattatcgtccatccatccatccaaaatttctcaattggctgccagctatataaatatgacatggagttgtgattttcgtcacacttttcattatgcatgtatcaatgtattaatttcattgacaaacaaaaaattcaaaattcaagatccatggtatgcatgacttttatcgtggctatggtcactgtcctcgccggcgctccaaaccatcatgctgggtgacatgatcggaacggagagcggggactgcatgataacgacgtggaggaattgagagcagaatctgaagaggtagtttcagaaagggaatatagcggcgagggaaggagacagtggtgaggcgtggtcacgagtattccatcaagatgggagactcacgaatcacgatgaggttggcctcggaagaagaatgtggttaccccgatgaagagttggccaaggaagcttccaacgagactgagcgatgtggggatttagatttacgtgagtgcgttacttatgatgggcctgggcctgggccttgggaggtgtttcagcttcaccattcggattcggaccccttcttaaaaggcactggatttggagatcttaatacctacttgggccggcctgcttctgcacctctaaggcccatgactcctgtcatgtgattctcaactaccctaccccagttgttttctgcattttcactattgttttctacaccattgtattatggaaa

SEQ ID NO: 5916 - DNA, 1000 bp, Glycine max
  Soy_ogl_2151 Gm07:3204801..3205800 Cluster 26
ggtgatgcagatttttccaaccaatgttcgaaacctttggaacgagtgggagctccgtgttatggttctggcaagcctcagcttccacagcatcctcatcttgctggggaacaagaggaagtactgcaccagaaccatcctcagaatcacactatggtttgcatacttgttagcagaatggcttgcaacattctcactaggtgttctttctaacaaagtaggagaaaatgaaggtgattttgtggagccgaaatatgtcattatatctctttgggctccaattcttctccttcaccttggtggctcagataccatcattgcttactcaatggaagacaatgaattgtggagtagacggtttctgagtttttgtgtccaggttctgatggcactctatatctcccaaagagcatggacaaacactgatctcaacattttggcaataccaatattcattgctggtattatcaaaatggggggagaggatttgggttttgtggtctgcaagtagccaacaattaaaagagtccttgttccctgaccctgatccagggcctaattatgccaaggacatggaaacatacattgcagcctctcatgaggggttcattgttgatgtgcaaggccttaaaacccactcagttggtgatgatcacactcatgcacctgctgaagccaatatcatcccactgccacaaactcatgactcatatggacctgaaattgtagagattgcacacaaattcttgaagactttcaagcggctttttgcagatcttatcctcgatcagcttccatgatgtcttagaaagcaggtagtctttcgagaatgggaatgggaatggcaagaaagtgtttcaggttattgaagttgagcttggatttatgtatgatctcttctacaccaaagcagctgtgacttattctttcatggggagttttctccgtttggtcacactatcttgccatgttagtgtgttatgtggctactttgtcatac

SEQ ID NO: 5917 - DNA, 1000 bp, Glycine max
  Soy_ogl_2168 Gm07:3695401..3696400 Cluster 26
taaaatatttatattttcttttaaaaaaaataattttccaacttattgtttaaaggtgcacctgctaaaatatgtttatattttattgatgttctcttttttggtgggataaaggaatgcaacaaaaagcccaatatgcctaacttactccttggtcacccattttttgggtgatgcttcttacactccataaaaatcaagcagaattccttttacattatgaaaaaagttatccgaaatgtaaagggggtcggggatacaggaagaaatgcccccatttttaatgaataaattcaagattgttttttcccattttatttgttacttttgaaatatttttttttaaaatttatctgtaacttttgaatattaaaaatgtattaattattttttactttttttaagaatatccttatttattgatatttcaacctctcatatattaattagttcttttattatttacctaatcactattgtactaattaagatggaagtattattctgaattgctgaattggttcagtttgaacctgcagtactccaaactggtggaaggaatggtttggagtagtgtttttggtgttgtgcttgactgcctttggtggaggagaaatgagtactctttccaacaaaaatggataacaaatgcaaaacagtacaacttagtttaaaagcggatggggtctctgatatgtactgtgctagggcaaacaacaagaggtatgggagtgctactcttaaatgtgatgtggctgtgtctagtgaagctgtggtggcttcttgtgatgctgttttgagagattcaaatggtaagttcataagggccgggccttctctaggagattgggtttctgtagtgtgcctgaagctgagctttggggtattatgtatggcctccaaatggcagctgaggctaaaatggaacatttgcatgttgctgctgatagtctccaccccgtgatgcttgttgatgattgtattcaatctgaggatcagt

SEQ ID NO: 5918 - DNA, 1035 bp, Glycine max
  Soy_ogl_2179 Gm07:4222201..4223235 Cluster 26
tacaccctcctctttcacttttctttttcctccccctccgtttccgttcctcttccccatagaccactcaaaacaacccaccctatctcctttctctgtgcgcaaccttcgagctttgtcctcgaccttcctcgtcatcacgcatgtacagagggccttggaggttgaggtcgcatgtggatctaggtgatggtgtttggatcatttgggtcgcaatggtgcttgtggaggcatgccggcagcggcgctgctttagactcgacgacaaggtgaggcaaagcagtgagacttggatctggatggggcggggtggaatggggaagttacaagggaaggggagggatgaggatttggtgagggggcaaaagagggatttcaccaagcttggtagtggtagtgccaatagcactattggagtaggaatagtagtttcaaaaaaaggggaaggcataactgacccagattcaacattatatgaataaaaaaaaaatgaatgatcctcgggattgaatagaggctgctcaaactctgcttagctacgtttttctgctcctctgtggttggattcctttatatacaacaatgaggtgttgtttattttttgaaatattttgtgatttctttattcactgaaaatttttcaacccttaacacaattatgttgctggtatttatagcctgttgggttgcatgaagtgtgcttggtttgactggtactaaaagcacactggttttcatcgtataatttgatgtgaatttgttttagctgactgaatgagagatcaggtacaattacaattttacaagcactgattcagggagagaaagaaggaaatcagtgtaatttgcaagcaaaattggtaaattgatgagggagtatggcttgctttgttacaacaggcgagagaggaaaaaaaaaagtattttgggcctgttttattttagttttcgaaaaccattttatgttttcaaagagaaaaaggaataaaacttgttttgtaaatgtaattattgctaatctaaggagaggagtat

SEQ ID NO: 5919 - DNA, 1200 bp, Glycine max
  Soy_ogl_2221 Gm07:5598601..5599800 Cluster 26
gacttttcatagtttcgctgtcgtatcgcatttagaaaaagttcatacattctcgtttattccagaaagcacaaagaggaaaacaatgaatgatgatgggtttgacaacgagggtgcccaagtttaggttccttttatcatagcttcgtgaagaagtataggagaggcttctctccatgaagggcggttacttccaaattgggatcattattgatgtaatttttgttagtttggatgcttgggtagtcattgggagcttagattgatttgtgaatttcgcaaagtgtagaatagcaccagctcgataagctagagattgagctagcccaccgagcaaaccttcagagttataactagctagctaattaagccagtagcacccctaccaagcgacacattcatagcttctctttaggtttgtattcaacaaaatccatggctaagttagaggctattataaataaactcaggcgagtaaccagaatttattttagagactagctatagcaaggcttgtggctaagccagttaccttcctgagagtgaacttgagaaagtacagaggctagctaaggtaggtattagtctacctaaacctgattatgctgaaagtctatgtttgtttaattgtctttcctccttgtttcctttggatattttttatttgcttggtactttgtgatgttaattattgttgataatggtagcatcatatgtattttctatcatgtgattgttgcatatgcttggaattgtatgttacgatgaaccctgtaaaataaaagatacttaaaattatacctatatctcttataaaaaggtggagagtttccttaaagggtttcagtaaaggtttttcagaaaaaaagttagggtttcaagaaagatttgtattgaaaggatatccccgtagtgacatagggtggaaccttacctagtatcagtcatgtttaagagctgcatgctcggcataccacggtgtgaaaaatggctaaggatcccctaggtcaccaaggtatgatgagttttcaaaaggtttgtgaaaaaggattttcatgaaaaggttttaacaggaggaaatgaaatgtggttacaaaaagcggaaaaagggaataaaggaaatgagacaactccaaggagttgaaagagggctaagaggcctcctagaggtgagtggtggaactaccaccctgattacca

SEQ ID NO: 5920 - DNA, 2100 bp, Glycine max
  Soy_ogl_2465 Gm08:2376901..2379000 Cluster 26
catattacgtgttaacttgcactttattggtcggaaataggttcagatccaccattgctaagcttctctcaacttatgatattaagttatttaggcttgcacaagcattgaatttagttgccattcatactaaatcacttagtcgatattaaggtaatactttaatcacttagttgatatcaaagtaatgcatggttagaaaattcctaacatgtttttttgaattgtcctctcagctctcaatgttagagagaagctggccttcttaattaatgctaaaatgcagcaagctgactcttttaaacaatttgtgttcatgattttacagtctttgaataaagagttgagggccaagcttaaaaaaatgacctagagtaacgctttgttctctctcctctctcttgtggtacctatgacgtccgctatgccgtctagggtttcctcggggggaacgccaacaattagtgatagcaacgatcgtagtcgcaagaaagcgaaaatggagacaacaccaacagaaaatgtgcaacctattcagagcatcaatgacacggtggtctcggaaacacctatgcctggggcccatcctatagggaatacgaatgttcccctattcccgactgttattgcaacaacatggaaatgaagtgtgtctcttacgaagatatatttattggggttaatggtgcagacaaggagaatgaccctactgaccatatggactggatttttgatagtgactttgatgaggaggatagcattgaagaagaaccagttggtatggatgtgagtagtggatctatcctatataactatggtggattttcttatccgctttgctaactcagatgatcttattagggtttttgaagagggcccttggatgatcctaggtcattacctcctaatccagaggtggcaaattaagttttttccacatgaggggcaactgagtaaggtagttgtttggtcagccaatagagtactatgataagaagattttgtggactattggggacaccttggggagaaccttgaaggttgatgctaatacatcaagaagggcgaatgaggagcttggagatgtgtttgttaccgaacggacaaagtttgctcgcctgtgtattgatgtggatttgaacaaaatattgcgttcacagttcgaacttaataataaaacatactctgtggaatacgagggtctacagctggtttgctttatgtgtggtaaatatgggcataactttggatgaggaaagaccgaagaccaaggagaaggtggctaaggagagttcaaggaaggagcccttccttttgggaccaagcacgatggacaaggctcctaatgaaccctttaggccgtggatggtggttcaaagacccactagaaggtgaaacagaaagttggtactgggtctcagtaccatgtgttagctgaggaggagggtgttcggaacagatcaggaggatgtttagatagtgggagaggatgccaatgaagtaggtcagaagagtaagtaggtaaatcctcaagggatgaaggggaaaacaagtagtaaagcatctgctaaacctgtaaagcaggtcagaaaaaaacctactgaggaacataaagggcctaacaaaaatatcccagtggggaccggctacaattcgaaaaattccagagctgcgactaggaacaggggggtggttataaatgatggtaagcaggatatgcatgtcgatttacgataccctagtaagcctcttcaacatcaagtgggggaggcccaacagggacaaccttcaaatagtaaagagggagagggatttatgcaaccttttatggacgcatggttgaatcctgaccctggagacccttcctctacagcgggctaatgagtagcaggggagcccgcagcagggtaatggagcttatgggagtgtcccctaaattactagcatgattcaccaggaggtggttgctccaaattccatgcaggtttgaagaacatgttctattttttctttgggtttttatgaattgcttaacctggaatgtgcgcggggcggggtcttctacctttccccgtatgatgagagatgttattctgcgta

SEQ ID NO: 5921 - DNA, 1062 bp, Glycine max
  Soy_ogl_2593 Gm08:10424839..10425900 Cluster 26
tattttttaaactgtgtaccaaatatatccttcctaaactacaacgcgttaagaattcaagcttggaattcaacatattaatcgtagcacattcatcaataaattattttgcattacaattctcgtaagtcgtagcgcattcgccaatatatttgtctatctagctggatctatccatctttacggtcgccatcgcccatcaggaacacacgcggtcttttatcgtatagcaaatcatgttttcttagaatccaaatccaaatcaaaatgaataaaaatggagtaatgttatattatatgtttttaatatagtttgtatattattgcatgaaacttacatggattattaagtgaaatgattacacacactcctatgttaaattgatgcatacaccgtgcaatgtttttttttttttttttttctgaatccgtgtaatgaaatttcaaatttagaaaaaaaagtatccaaaccaccaccacaaaaatgtgtaaccactttaccattattattggttttgtgaagaaaaaaaaccaccatcacaaaaaaaagtaaagtgttacactttttaaaagttaatggcaacttataatttgattaaaaattaagtttaaactagacaacgtgaaacctgatttctgctctgtaatagtattatattttgaacgaaacctcaatgatcaaaatcaagttgaagactcgctttctcacttccttcttcgaggagatttggtcataacagacggccaacttttgtcttttcttgctcctttactattttttttttcgtttaaacaaatattaggtgcatgtattcatctataagagtgtagatcttttaaagtaaaatggtataatatttggtaaaataactaaattattgataagtttaacactcaaactgttgatctgaccacagcagatcaactcttatactgtacatacctatatttattcaatttcatttacttcattataaacaaatagcttggcatagtacttcaagtataaactatgatcttctgtcaacaaataaaagttaatcttcgtagaataaatttgag

SEQ ID NO: 5922 - DNA, 1000 bp, Glycine max
  Soy_ogl_2738 Gm08:16967501..16968500 Cluster 26
aaagtaaaaagtagtttgataaacatggcacgtggaaggctataagaggcacctcgagtcatgccgttgcattaatgcatgctattttggttactgacaatgtaaggagagtttggtttttttattttttgtttttagttttaataaaaatagaaaatatatttaaaaatgtgtttgttttaaattttaaaaatatttttaataaaaatattcttaaaaaaaggctaaaaataaagatatatcgtttttaatgttttctctaaaaagaaaaaatgtgatggcatgagtgtcgtaattattattaaggtgtccgatgcccaccctttgcatggcagtgagctttctggcacgtgatgtatcggacctctgccttgggaagccgccgctgaggtcgctctccgcctccgccaccgtcgccgacgccttggctgcgctcaagagctccgaccacgagacccacgtcaccttgtggagcttctgcgagaacaagaacgaggttcgttgcgttggaaactgtgcatggttgatgttatttgctacctttgcagagaggacaatctctcgtctccaatactctggacccacccttcccctaccttcttctcctcggcgatacggaggcggtggcggtgtcgccggaaaatgacggccccaccatagaactgccgtcgggcgccgtctacgccgtgtacgacacgaacggcgacgttcagttcatcggtttgtcgcggatcattgccgcgagtgttgcggcgcactggaaatcggtgccggagctgtgcggttccgttaaggttagggtttttctggtttctgaactgtgaaatgtgtgagcaagaactttcaattgtttattctcgttgtttcatttgttcccttctgggtaggttttgcagcgtcctcaaatgcttgttggtggtgaggtggaacgccaacgaacaagagtggttcgatggcacactgaagtgtggtgatggcacagtcttatgtgctagattga

SEQ ID NO: 5923 - DNA, 1000 bp, Glycine max
  Soy_ogl_3000 Gm09:4869201..4870200 Cluster 26
agtcccccccttttatcttctgagtttagcacctcattaatatcaccaagtcatagcccttgtggtttctgactttcaattaaaggccatgttttatgcttgtgttaggcctctaggaaactggtcagaatattaacatgcatcctaatgacttttctcaacaccatcaaccccccttgctctgctagctcctcccaacccttgtaaagtcaatagcaaaaccttgcaatagtccatgcaccaatacccttcacacaacccatctcagcagatccttcttttttgtttccatcaaaatcaccaaatcagggccttctctagtgatgagctcttgcacacctccacctcttcattccacaactgtaatcttcccaaacagtttcctatgctttctgccatcttttttcttccttaacccacctggagatcgtaaaatctgactcaaaaggggtttttgtcaaagatcacctcccttgggttttcttctcttgccaattcattcagatccaccaaggactccctttaataacaaactccatatccccctatgaaagaacctgaacgagtataggttccgccctacctccttgatctcttctcccctcttaaccttccacacttagactatcatggtcatcaacgccttgctattgaaagatccttataacaggaccttccccaccaaccacgcttcgtttgtcttctcttcttggtctccatgtgcttcttctggaatcactatgtcaatcgtgattccgctgtaaactgagtgttcccccaaagtttggatgtgctcaacgtacccagatggcatggggcaaaaactcaagggttgcgtcctaaggaggcaagaaccctgtcttgaggtgctaaaaccctaattgacgcacttaggttaaaaccctaacatagggcaacaaatacatctttgatcaaaatttcaagttgatttttaaggttcatccattttattgaagaaaattagttgaattaaatcatt

SEQ ID NO: 5924 - DNA, 1007 bp, Glycine max
  Soy_ogl_3165 Gm09:37965594..37966600 Cluster 26
taatttcttaacaatttgatcgtaaatattgctaataatttataatttcttagccaatcaataacaatatttgcattgaactcatggttacaagagaactcaatgtttatccaccatttctagtgattaaacccttagttatcttaccttaggcctaggttcaacaacacttttcaatgtagaaaaacccacataacatggttgatgaagccataaatcacattaaagaatgaagataaaataaaaaactgagaaatattagctgctattaaagatcaaagaagatatagaaaagactgagaaatataagctgctattaaagataaaagaagatatagaaggtttagcatcattacattccaaccccaaacattgttgggagcttagctactcatagcaagtacaagcatgaaaagtgaagaagaattgaagacttttcaaaaaatccataaaagtaggaccccaaggtcttcacaaaatcccaaatgcttttgtcacctctgaaaaattagatatgacgcgctcccccttttcttaaatatgagtcccaaaagtctttaaaatgttgccacctgtttgttactcaaactcatgcataagcgagctaaaagccacacttaagcgtggtttgtagatcttagtcatatttcaggaaataaggtagttaagcgtaagctccatcacgcttaagcgagagcaaagttgagctttagctgtttcttggatttgaagcttaagcgtaaaagaagctatgcctaagcgtggctgaagttggtttccaaggattgtagcttcagcgtaaaaggatgacacttaagccaggaccactttccaaaactggggcatactggtgttggcgcttaagcatgtctgcacctacgcttaagcgcccttacttcatcaaatcttttcttttctttcagcactacaagcccatatctttgcaaatattctttttaaatccaaatggagcaaccaaaaataagaagaaaaacaattgaattgaa

SEQ ID NO: 5925 - DNA, 2100 bp, Glycine max
  Soy_ogl_3355 Gm10:3807301..3809400 Cluster 26
tggatttgatagaaaaaaacttgtttacgatagagcacgaggatgaggataggctaaaatctaagtgttttgtggatgatacaatcttgcaagaattgtggaatccatggaaggaggcagtcataattaaactgcttggaaaaaggctaagtttctttgtcatgcacgattggcttagagtgatatggaagttgttgggtggtttcgagatggtggatataggttagggcttctatatggtgaaatttgatctcccaaacgactgagaaaaggtgttagcgggcggaccatggatgttattcgatcactatttagtggtgcgagcctgggtgcctaactttgtctcctcagaggtaaagattgaaagcacaacagtgaggattcgattttcgtgtctgggaatggaatactatgatgagagtctacttctggcattagcaactttagtagggaaaccattgaaagtggacattcgctctgttgacgcgtcaagggagaggtttgcaagggtgtgcatcgagataaacctgaatatgtacctatggttggacgtgtttggtgtcgtgatcactagttcagggtggaatacaaagggttgcatccggtatgtcaaagttgtgggttgtatgggcatacaacgaggaagtgtcccataatagaaacaatggagttggtgtgtaggggagggatcccaggcaacaaactctagctttaatgaggatggcgggaattttggaggagagagaatgtatggggattgtattgtgttaaaaaaggcaacaaaaatcataaactgaagaataaaggggttgcgaaaatcaagggatttggtggattcgataaaaatattgcttcagactaaataatggtagcaaatgcaatgcattgaattctattgacagggggaaacaagaaagtagttcattaggagtagaaggattgagtgtggatggcgctagcccttatacggtggggtctcaagctagagagggacataagggggtaaaagtggtaaaagatataaacaataattaaagtctagtgagggaaaagtgaatcacgtgaaggggaacacacatggtattcttattcaggaggggcaaactcataaaaaagtgcatgaaggtatgtctcaagtctcaaagaaggttccttgtttgtagaccacgactgccattcccatgtcaaaggatggaccaggtacgacgatgcttggaaacatggtggaagcgcttagggaaggtatttcgtccaatttgaagaaaaatttggacccaccagaaccccctgatacaattatgggtacaatggagctgggaagttcgagtggaactgggtatggggtgactgatgcacaagatgctcttgtagtagatatggagaaagagttagtaataggagcaacataggagtgtgtgtctggctaatgttccattcccttatatatttaatgataaggtttggagatttttctatcctggcatggaatgttcgagggtttacgaacaagaggagtcatactcacatgagaaagttgttgactcgttaccagccagatttagtatttttgtttgagactcacgttaggattgaatcgtcagggcaattttggcaaagaatagggtatggagcaataggggtggaggaagtgcaaggacatgaggggggagtttggatactgtcgcataaaggtatctaggctaaggttgatgtgttagaatccatgcctcaaggtgtgactgtgtctataaaacgaggagtccaggcctgatgttgcacaatgatttatgcaagcccaaatttggctaaaaggaggactaagcatgggtcatcaatttggaactttatttagaaggcgctggtagtgctagaggatggattcagaatcaggttgctggaacgtggattggttatttacgagtattctggaggaagcggcataagctgtcaatccaatgatagtggaggatatgaatggtgtgtaggtaagggaaaaggaggtcttgggtatttacactaccaagagcgcatacaactggctatgggggaggtttgtcctcgttgcctgcaacatcaagaagacattttgcattgtctagt

SEQ ID NO: 5926 - DNA, 1000 bp, Glycine max
  Soy_ogl_3361 Gm10:4170901..4171900 Cluster 26
aagtcgtttagaagaaacgccaaattttccaaagtcgcaattatccacagttccacactgcgactgtacttgccatcaaccatacgccaaacaacccttacccctgaggaacgcgcgtttacttgaatccccaggtctcggagtcaggtcaacgatcctttcttttccattccattttccaacaatcaccttcacctccggcgtctccgccctcctcttcaacagcggagatcaaaaccctcaccataacctccgacacccgccccacgatcctctttggagaaattcggcttcatccactccggctccgtggtggcatcaggtgggtcccaactcgatcctgagcgaaaagtccctcctccaagtcctgatcgagaccactgttgcctccaagaacgaaggtgagggttgtttttcacgcgctttgggatgtttgcgttcaagaccactgttgcctatgagtacaagtgggtgtgttttgcattgtcgagaatgatgaatactctctgactttgaccgctgaggagaaggaacaagtcaaggaatatgaatgaactaaacttaagctttgaaacaatttcactgcaggtactgttggttcaccgtgttaaaaatcactccattgggtttctctatatactaggttatagtatactaagtttgaggttgcaactatgttgttccttctttttttaagactattattacacgtagcctttttttgttataaaatagacatatactctggaataaaaaatgtttgataatgttattgctcaaattgtctccccttgaggaacaatatactcagctcttatcgggttactaattattgttatttgatcttagtttttttgtaacatttgttggttggaccgagctcgccttagtttaatctaaccttggtgtgtatatattactctgactagtctcatttctagctcatagctcttcctaacttggaacttggagctggaggtcacgtatcagtattggtccg

SEQ ID NO: 5927 - DNA, 1600 bp, Glycine max
  Soy_ogl_3599 Gm10:47035001..47036600 Cluster 26
ctcctccttttgatgaggctgagcatccaaaaagtaggattccctttggttctttaatagcttctcaacatcttgtgcagacccagggaacgcaagctcctgaacttgtcgttagatcgagctgctcaagtagaaagggttctcctcagtcctcatcctctctcagctgtaatgagacgcaaactgatgctagaaaaacaattccaagcaacaaaggaaaccgcactctcataatagtagctagctacgtactcgctctctcgatggatgatatgatgaaaagacggagtgagattaattaggggtatttatagttatacaagagaaagctaactcttgttaacatgcgtggacatttggccacggcacggcatgcagattgacgtgtgttggtgttctttggttgccttttgtctcaatttcatgaacttggacgtggttttggaaaggatactcaacgttttgctctttacatcggtctctgttctcggctttcgttcgcatgcatgatatatccaaagagactgtatactcttatgcatgctactccatccggtaccatcaataaaacaaaaatacgtacacaaccatttaactatatatatgccggaggatatatagataagtaatggatgcctatcaaaacaagaacgtaaaaatttcaactcttatatatttgtatgtaaaaaggagtggtttggagttacaactttaattaactccactccactttcacaattccgaaaatattttattaataaactcaattactcaaccaaaacatatatatttttcctttaccgaaatagagaaacatatttttattttttccaatgaaagtcgggttggaattacgtccgtacgatttgatttttattttcgttcctaactcaagacaatgcaacaatgtagggcacaggcacctttcattctaacagcagtacaccacacacctcaacatctattccaacaccagtacatctcacgcctcacccccatcttagagacagccccaaagacaaaagacacgagagatgacaacccttcaattgggtttgggtgtaatccaatcacccttcactcttcccaaacaaaagcactaagcattcccaccaccaacaagccattatgattatccaaacaaggataaactactcattgctattagcaacagccaatgattattatctaggtattagataagtagataaccttctccatatagaagtattaataagaaaagaaaataataaaataaaataagttgagtttattctctaagttaaaaagtagtttaaaaacacttttatacaaattaattttaaccgacaacttttagtgaagttagatgataactttataaaagttaaatgtatgagtttttttggtacaaaaatgtatgagttaattataacttatatagagtttttaattatttttgtttttgttttttttttccttctataaatacttgtgaaaaaaaatttatcttgaacaagccaatcagttttgtttttcataataataagttgttaattcaattgaaattatcaaccaaagtattggatttgaataataaaaaaagtgatttaatcatcga

SEQ ID NO: 5928 - DNA, 1301 bp, Glycine max
  Soy_ogl_3652 Gm10:49556100..49557400 Cluster 26
gttgttaccattctcagaaaactttagtgttacaattccataactcatgacagtccaagacacaaggcaagagagcgcctctaggcgttacggtctcccttttcgattacctccattttgtgtttaaccttttgaagtttcaatgactttagttcctcaatttgatctttcaaattgttgtgagaagatccaccaacctgaattgctttttttgcagtatcactgagcgctttgactctcctcatttctacagactcttcccctccacccatcaacaaagcaatagtttttcctatgtcctccctcttcactacctcactcccaaattcattcaagcttttccattcttttgctccaactgaaactccaattctaagcacatctaccagaaacttctcattgaaaaactgctctgcaaaaataggccaagtcaccattggcaaacctgcgatggcactttcaaacagtgagtcaccacagctccagtataagaagttgtgctgcccaaccccatattatgtaccctttgttgcttgcttgtaccctcttctcaaattcctccacaaaacccttagcttcattcaccttaatcagttttcctaaccacccagatgaaatcaaaatcatggcctgaatcttcaagtgcgtgagctatttcaacaagctgtgtggaagggaacttgttcatgctcccaaaactcacgtagagaacagattcctctttcttcgaatcaagccatgtaagtaacccttcttcttcttcttcatttgcatgtccactaccagccttatgaccttatccgaatcatcttggttcacctatgctccaactcttggttcccatgaccgtcttgtaatatgctcctcgtaggcaccctcaaactcataaaagcttttgaacagtgatccgtagctctttttctctgattcttgcatcatcttctttaaacgagtgtatccatttggtgctctaagccaatccggtaaccgagaacctgtggggcaacccaggaagcacagaactctcactatcagcggcagcatcagcaaaccaagggtagaacatgtctgtgactatgaaatcaggttgcatgtcgtagaagagttgttggaattaccatttgagaatggacaaatcctccatgagtttggtccgcacgtgttgaggagtgtctgcgttgatggtctccagtccttctggcaaaccaggtagttgtggaaactcgacaaggtgggttcaaatggcacggccaccgcgagtagaatcgcggtcgatggaggtttggaaaatggcagcgatt

SEQ ID NO: 5929 - DNA, 1200 bp, Glycine max
  Soy_ogl_3670 Gm11:868801..870000 Cluster 26
tcatcaatttgttgcttaatgaatgacattgtcatcacagtaggtgcctcatcccccacctcctttacattggtagtagaaacaacaagtggagtttgctatgattcttgttgtcgttgacggtctagttggcgtcatagacacaaatatgcccaaaggtatgtgtttcagtcgtttttctgctgcatgtcttcttttgtgttggttccatctctcttgtatttttactagagcacaaatgcataggccaaatagaatcagcttctgcttcaaacttggcaactaactcacctactttagttctactagatgtgtcaattttgttgcgtgaaaatcagttggttgaatcgattaaaaggctcagcatgattccaaaataagaatcaagtgattgcgttgagaggaaaaatttgcttctcaactatggattcccaaactattaaagaaaatgtttgatatacgtaaaagagaagaaatgttaaaaaggcaaaaaaaacttaaaggcaataaaacgataaatttagcaagataaaaatgcaagaataagataaaattgatttgaatttcattgaaggtacttttgttttgttgctatgcactaagtatttatagggatcctataaaaaatagctagttgactattgctaccgaacccatcaaattccatgttcttccattatctcgtcaattaacttctaccatctccatgcctcataaatttccaacctccactaactaccattccaccatctatttgatcaagtatttagatgattaaacatgatcgactctggtactacttgtttaaactcaaatagtcatttagatgaaaatcatcataagcccaaaatagcctgttttgctttttctctcaatgatttttgatagtagaattctgctcctattttcattgcagcataatttgaataagaataaaataggtttgcctaaccatagattctctcgatttccctcccatgagtttggttcatcccccatggtcatttgtattttcttcatctttaggaatggatttcttggttggtggttagggatctatactatttggggatgcaaacctagtagggattgcaagctctagggtaaagttagcaaatctttgtttattaaaaaaatcaatcatgttaataattaagaaattgaagcaaaagcatacctaaatttcatgatgaccaataa

SEQ ID NO: 5930 - DNA, 1000 bp, Glycine max
  Soy_ogl_3735 Gm11:4890801..4891800 Cluster 26
tcgtcatgtcgtcgctgatcccgatttaattttatactagttagccagtccaaatttacctctaaagttcctatggaagtcaattaagcacactatatatgtagttcattcacatagaactagaaccgtttaatatattgtttcaattcaaggcttcaagctagtaacaccgggtcattggctaagagagaagaaaggacaaaaagttgggagttcaatattaatattctaacaactaatattaacctattaaaaaacacattgggtcgctggtccacatactatatatccaagaacccgagccacaacaaaacaaaagagccataacgtgagcacaaggaccacgaaacattgcgatgcatcacgcaaagctaaaataaaatagtacaagaaagaaggggtgagaagtcttgtttaattagttgtcttgggatcaaaggacacctgagaaatcaatcaaagtattgatcttctttagccccgagattccatatctgttggatggacaatcggctattttttgtgcccaacgcatgtcccatatatagcatcgtcttttaattaattctttattttttggactagttttaaattgcagtccgcaatgacaattacaacaaaaacatcaaaatattttaacatttcacaatcacataatacgattgcaattgcggtcacattaattttctcatatttgaatgcaatgtaaagattttttggttcactatgatgataataacaatttaaagacatggttatgatgaaagcattgtggattagataacaacaacatcagtggcaaccatgtgcttaacccagtggtagtttacagaatgaaattaaagacagccagcttggaatcccttaaagggtgtgaaatcaattggaatcgaaggacgaagaaacgccacatccccactagtccacctgccaggtttcgtacgtttgctccttctttagtcgcaattaattaagggactaattaaaaaagttaaataat

SEQ ID NO: 5931 - DNA, 1200 bp, Glycine max
  Soy_ogl_3745 Gm11:5190901..5192100 Cluster 26
taggcctattggttaagactgtaggattttcaaaaagagtcgaacaagaagaacaactgttccccttaggaaccacaatacgaaccaggacaaaggacaagtggaatatgagatatgcgatcaaaagtcattcatgggccaccacctaatagctcaaggttttaggagaggtgatcctcacagttttaaccatagatattccttcattttgtcattggcaagttaggcttgttgtataagatgatagtcggtggattaccaatgccaaaacacatactggtaattagtttatccttgagattcttacagtaacatcactgaaattatggagtgtcctgtgttaaagtggtacaacctacaaaataaattgccagctttgctgcgctggcatgaattaggaccggtttttagggaaaatttatggttatctcatttttaaagaatcttgatctaggatatatttgttccaatgagatttgactttatctattaggttggattagtgatatttcttttcaacttgctcttgttatatgccatagtcatatataccttcctgtttaagatccttctttttggagattttattacctagctgcatcaatggaacattagactttgtgttttgcgtgattagtcagctaaatgtgtctatcttccatgtataattggactgttaatttacggaattgtactggcaatcatacttattaaatccttgtctactatgcataattactgcatatccacatgcatgcaaaaggggttgtttctgactttctttcatgctccatttccaagtaattttacacctattctctagcgtccgtttgacagtaaaattgccttgacatgcactcaatgcttgtcggacactctccaggacatgtctaaactctataataaaaattacttttttggtttggactcacgctataaatgcatctttgcatggaactgctgcgttaaatttgttggaaaatagagtaattatgttagtagagtagttattaaacatcattcattcatgtactttgtggttcgtaatatctttttcatgcatgtatttttacattaaaatcactatagcttttaggagttataattcactgtctcagattcagatgtatcatagagtgtcatgtgtacataaaaatacttacgtattagtactgcatatgcatttgcaaccaagccaaa

SEQ ID NO: 5932 - DNA, 1100 bp, Glycine max
  Soy_ogl_3959 Gm12:508701..509800 Cluster 26
tcatgtgagaccaaagattttattgttccatgaatctcacgcacatacaactctcaagttttctttcccttttattttaatatctccttagtcaaccttttaatactaatactaatatttatcctacatatatagtcaacctctgcatgcgttgacctttctcttcataaatgtaacttaaatgcatcaccttccattggcggcaaaatctttgtggagggccatgacccacaagtgtgagctgtggcctgcggatgactcaaaactgtacaatctatacaaacatattttaggcttcaatagagaagcttctctgtggtttggatcctgaatacaatctcataatatatggggattggaaatctaaaatctaagtagctttacaagaaggaaaagttttaaaaaaattatatataaactatataataatttgaaggaaattatgtttgatactgtacgatataaatgtacttgagtcggtgcaccgtcgtcatataccatgattcctgccacgtgaattagatactttctcctagtgtgttagggtatatatgtgacaagaagatgtctagcttgtcaaatccattagtaaatacctgattcttatttgctagcttgatactgtaaatcatttatcgatattgagaatcatctccgactgcttaacctgtcgggcataatctatcttttgtatgttatttttttaaaacttatgttcttgaattgtttaagagtactatgtattagtcccttaatgttcatccatgtgtatttgttgattcctcctcgaatcgattaacgcaatgttattcatataatttttcaatccagttgagagatggaaatcaattgatgtgtcaatatttgttgaatcggatatatggtcgctgatttgaggtgaggttatcatctagtgacgacataatactctagtttctgtgtccatgtttagtcattttcctcccacttttttcacatcaagattcatgttactccatgtcataatataattaatgcttttgagagggtcatttcagtctaaaataccaaatcattttcggacaaataattcacttaaaataaaattcatttaactcatt

SEQ ID NO: 5933 - DNA, 1029 bp, Glycine max
  Soy_ogl_4102 Gm12:35852139..35853167 Cluster 26
tttatctgagttgcagatagtgtttgagagtttcaaagatgaagaaggaaaattcaaggctgaaattagcaacgatgtgaaagaattattaagtctctatgaggcatcatcactacaaatgtaatataagtgtgagataaagtcacatgagaagaaaaccatcaacctatttaggaggataagacattttcaagaacacatgtcgtgaacttaatgaaggaagggatagagagtactgtagtggcagaccgagttaggcttgtgttggaggggcttccctttcaacaaagctttcacagactagatgcacggcgatatttggcaaagctagatttcaacatggttcaatcattatatcaataagaactagaaaaactgtcaaggtacgtatgaggaaatagaaaaggaaaagtataatcacacattattaaaagaaattatctgcaaaaaatcagcacctaatcctgattaagttaacatttattttctaactattaaaattaaagaagttaaatggtacataactttaacaatgttttaaaaaaataaaatcatatactcattgtaatgcttagcgatgtgtgtgcctcaagcaaaagtaaagacgcatgaaaacctatcctagtcatcaagaaacgagaatggatacttctcatttatatcataataataaaaataaacaaaaatatacaattgttcttttaaaattttaaattacaatcatttttaaaattataatataaattgagtgaatagagtaggtaaagttaatatgtttcttaacatgttttattttgttcatataaatacaagtaaaataatgacgtcaataaattattctaacaactcatagctcaacaaaaagccaaattactaagccaataacttataaacacggaccggccaatatttaaacaagtggacgagtggtactaattataggagtttcagcggattgaattgaatcggttttgatgaaaaaattcatccgatcaattatttcggttttgtaaatgtttaattcacatt

SEQ ID NO: 5934 - DNA, 1132 bp, Glycine max
  Soy_ogl_4149 Gm12:38370601..38371732 Cluster 26
ccgaatacgccatgaagcaacaaacacggcaatgctctgttgtcccctcaacttggaaaaagaaaacaattggacctcaatattggggcaggtaagaaccaaccacagatcttctgaacctataaatcatagtattgactagaaccatcaaaataagttaaaatgcatggtcaataaaattgacctaaaaaaataaaataaagcaactgttatttccactattcctccttatttagaaacttcccttctcttttttaaaccctaatttacctttataagcatacactcccccaaactccaattacacgttcactccgttacccccttcaccccttgccattactgcatccaatacaacagatgaattcaattcaccttattcaacttgctaaacaattgattatttttttcaaaagcaaatgaatttgattgatagttcctatcattcccaccacaacccggaaacaaaacattgcataataaccccttaaactacgaaccaacattgataaaaagttaacgaaataaaactctctatcaaagtaactttttttaaaagtgaaaaaacgccatgagacaaagtgtttacttggttgtttctataagtaaaataattgtttccttgtgtgccttttaagttatgattgaacttcatgagacactatctcctatgaaaatgttgatttctatcatgagtgtttccaaaaatttaaagaaggttaaaacatataaaaggatatttgtttcattgcgtgcctccacaactgaccttaccgacgtcttccactaactcgatgactaacaattgttttagatgaataaacattggggttatgatgcaattggaaatttgcaaataaggggagtgcattttttcctgaacaatggaaacgagaaagagattagggggagtgcctatttacaaggctaactttgggagaagaaagaaaaaggaaagtgtacaagtaaagaggagaagtggaaagtctaaaataataaaaatgaaatgcttttatcatttttctaagcttctattaatacaaatttataaccatatgaatactatagatatttgacttgcatttcatgccaagatattttcttgcttgttttttttttatgggcagaatca

SEQ ID NO: 5935 - DNA, 1035 bp, Glycine max
  Soy_ogl_4569 Gm13:39349501..39350535 Cluster 26
attcatttggggcagagttactctgtgttggtaactgctgatcaaccaccccacgactcaccacccaagtgttgactgctacctccattcttcattacagtaactcagctacaagtgtttctggtctatcgaacaagtactactttgattcatattcatgtggtagtcatttgacaagatatctctctagcttcacaaccaaattatatagatattgtatttgaaatctaatcgtttaattcaatggcaaagacctataataagatgacaagattatgtggttgtgaagcaaaatttatctatacgctgccggtgtaaagatttgtataccctcaatcaattagaaatcatcttaaatataacttgtaaagtggttattataaaaatcaactatcttatcatacataatctataattggatgacagtgtaaaaattatttaagttaagttcatattattttaaaaaacctcaaatatctcatacttactatagcatgtaacaaattaaatcaggaggaatctgacagccagtggaccaaggcctaatccccaaggatcataccactatggctcgtacagttaggcttcaaaattctgcaccaattatcaatggcaagcagaaatatgctgtcaatggtgtttccttcatccccgctgatacaccccttaagttcaaccttggaagcatccccgacaaccctactggcagtggcggttacctccagacttctgtcttggcggagaatcctcaagacactgtccagtcatggcaagttgatggccaccacttctatgttgttgggtaagttcatctaattccgcaggaaagtatagaattcattaattttcccttcacaataaaatgtgtcacctgtatgtgtagtagtgtggtgctaatgaagagttctgtcacttttttatgatatctatctatattttcagaatggatggaggccaatggtcagctgcaagcaggtcaaattacaatttgcaagacacaatctctcgttgcactgttcaggtatatgcatattg

SEQ ID NO: 5936 - DNA, 1009 bp, Glycine max
  Soy_ogl_4671 Gm14:5329797..5330805 Cluster 26
gataaataatattgtgacataaggcaattaagaaaattatagatgtccatgtgtgcaagagtacatgtatgtataatgatagacctggataatgattggtttaagatggttgagagatattttaattttatggagtttggccttcctaccctttcaatattttttaattttcagttgatgttattgtttatcattacaccccgtgttgctaccttgatgtctaaagtgaagcatccaccacagttgtcaatgttgatgccaaaagcaaatgtttttattgagcatctcttatttttttcataagagatggtgaaggttgcactctgatcaccaatgaatttgtctatgaacagatatggaaaacaaatatgatctgtttgatattgaccctttactatcaaacagctaaaataaagaaagattaacatagggagagatgtatagtggaatatatcaggaaaacaaaagacattcctcttcatcggcaaccctaacccaagcagtgcaaactaacctttctctaaatagcaacaacgaaattctgtacaacaacacccttctattcctcaccagactggcgatatcaccgagaacatctttaacaacaacgacaacaacttgctcaacggaggggtcagtttcttggtcacaaacaccaatcatctcagcaacgttaggatttttgtggacacctagaaggcaaagcgacgatgtgcaaagtcgtagaagatgcaggcgtggtggtgggagatgtgcatgccgccgccgaggctgaagaggttgacgtcaacgttgatggtggacttcttagagtcatgaccgaggacgatggagtaggtctgcatgtagttctcgaagtccttgctcaggagcttttcgaacacaacttccacgttgcggctcgctgccaccacggttgacatcaccagaggattggtgttagaattgaaattggcgaaaagagagagcagagggtctaggttgatcagagaagaaaggaggtgagtgt

SEQ ID NO: 5937 - DNA, 1065 bp, Glycine max
  Soy_ogl_4817 Gm14:48344411..48345475 Cluster 26
aagggattaacagcgcatcaacatgcaggcattttatttcttgcacctcccattttgcatcctacatctcccaagtggacaaaaacattcctttatcagacatccctattctagaatgactattctggaatacgaaaaactattttttggaataactattctagaattctagaaatgtatcctattctgaaatagttattctatgtagttttttgtattttaaaataattgttatggaatatagtttttcctattttgaatagttgttccaaaaatgtagcctattccaaaatagtcgtttcagaatagtgataagaccccttcccttcttcaaacttgaacctggtaggacccacaagaggacaacaatgtcgcgttcaatgtggagagaaggtaaagagcgatgacttgagccttatcggcaagctgaacgacaactttgccgacagggagcgatgactcgtaggtgtaattgtagctaatgcactcggatcacatgtagtgtgagagaaagcagccgaagcgatgaggccgacgatggcgatgccgatgtgcttgtcgaccttgaagatcttcttctggtgtgatgagagtttgaagttaaccttgttgacacatgcaagaacgatgacagcatcgccttctttgccgcctctaacggcattaaccacgaaaactttgccatctctgatgtcgtgcttgggcagcacaaggaaggagaggacgtattagagctgagggtatttttggccattgaagctttttgagaggtgtatgattcatattagaagatgcaggatacaactcctcaacatgcacatgtcaaatggaggagactccaacatgtggacacccatatgaaaggaatgagccttcaaagcaaggcaatccacaagtgaattaatctgcgtgaacaccttaccattgaaaatcatgtcattctcgaacctccaaatatgacagcatgtatcactaaaccaaattttctattgcacatccacctctgaatctgagtatctgcaatatttaactcaatctaaggacaaagatcatgctagaagaaac

SEQ ID NO: 5938 - DNA, 1131 bp, Glycine max
  Soy_ogl_5189 Gm15:50246670..50247800 Cluster 26
gactttcctctgccaattgcgttttaatccttcttcctatgttgacagcatatgctaactagatctcagagaccaaaactcttgaatgaaccaaagtagacgtagttggagtacctcactgcctaagtgggggtatccaacaacattttgttaccctctctagatgatattcttgaggttagctagcactgctagttacccttgggtgcttgtagagtacaccagactagcttctttcatgttctcactgaatgggaaaggttgggattggctttgtgcacttcctaggcatagtattaccacctgggatcatcagtgcaccaacaaattcatcccgaagtactttttttgtggtgaaaactaatcaaatacagaaagacattgagaattttgctcataagggacaagagagtctagcagaagcgtcggagaggtttcaacaaatgtccaaagttgcccacaccatggttttagacaacaaaggattgttcgtattttctatggaagtgtgtcctctaataacaagacaatcttcgatgtcgcgggtgggggtaacttaattcttaaaccacctttagaagccatatggatcattaaaaacatgtcttttaacccatataacaactctagggatgagagaattttgaggaggcaagtgaatcaggtggagactgatgcatctagttaagacattgggtagcagttccaaatgttgtctaagcaaatggtgaccctaatgagggtacaaacacagattttagccttcacacttccaccctttacttgtgataagtgtggggaagctcatgctgcaggagagttcctggtgagtgatgcacttgcccaagccttggaagatgtaagctatgtaggttgatagaacacgggatattatccttactctagcactttcatccaaggatggaggaatcacccaaccactcttggaaggattagaaggagcaaaggtataatatcctgtgtacattaccaaaaatgatactcaactctcttccatggaagctcttttgtctcaaaagctactgccacacttccttcaattcccaaactgaagccaatgctaagaaggaagaagtgaatgttatgagtactaggaatcgaaggtctgtg

SEQ ID NO: 5939 - DNA, 1111 bp, Glycine max
  Soy_ogl_5416 Gm16:36242590..36243700 Cluster 26
gatggaaagatattatatgacatttaactacgtgacaattgataatatattattttttttggataattgatatatgacgagtgattgatatgatagcccacgataattgattgataaagttattattttattttacaaaatcaaaattcatataagatttaatgactttcttttttttgaatatatttacttaatgaattgatttaattagagtatgtaatatagccattgtaatccatataaaatcaataattctgattttaattatttaagtctaatcatataatacttttttagaagttcaattttattttttttaaaaaaagtaaatatctataacagatttaaataaatcaccctatggaaattttgataagataatacaaaatatattttgctttcagtattcaatttctggatcacaaatcacaatacaattcaaatcgcagaaacctaaatcatgcaggaagtgatgatggtgcccaaacgcaaacctaaatccgaattaccatttagaattcaggtccggtgacaaggtagaccacaacatgtggaagtggaagggtcacgtcagagaattagggtttggaaagtttggtgtgtatttcggggagttgaaggagatgacggtgtttccgaaggaggagcagctcagggacaggatcagtgaattgcatgatagtgttctgctcctcattacgagttttatggacacaaaagatgttcttcttcggaacctttacaaacatctcacgaatctcacctacattaactattatgggtgcaaacgacatgcgtgtgcatgttttaagaaatttgtgtcttgggttctctctattctgtatgattcatattcctcaattaactagtcttagtatccaaagttggacaaaggattacgacctagataggatcatgcaatatgctatgcgtcacaatgtcccacagttgacaataacatgtctaaatcgaacctttaattagacccaactatatgttatttaagtcattttctttgatcttttactctcagtctttgacatctcttaagatttgcttagagttttactattcgatagtgatatatatatacttccaaaatctctgcatt

SEQ ID NO: 5940 - DNA, 1189 bp, Glycine max
  Soy_ogl_5445 Gm17:1323201..1324389 Cluster 26
tctttcattctttttgactttggtagttcgattcggcgcctgctatgtaccctttctgaatcttccgtaccgatagggtgcggtgcacctgcattagacatggtaatgttgtctcttcgtggggtccaatccaatccattgttgtagaccctcagtaatttcactaatatgtgatgggccaattagcctctttatttatgtgaagtagcaacagagtagcattttaggacgtgtttggatacaagttttagaagaagaagaaaaaatccacgtgtttgaatacaaacctgactaattacttatagttgaatttctcctcctacgtttttcatgttcctaaattccaatattggagatcaacaatttcctcttttttttctcctaataattggacgtgagacgagtggatgagagaagcttaagccaacgctacgttgtaaatttgtaattttacgtactccgcagttacgtaagatattgagattggaatatgaatatctgaaattctgaatgtgtgtcccgtgtccgtttcatgagcttgtgttgtgcaatcttaatcaccgtccattcaaccaacgccggaatcaattactagtagagcctattattttgatgaaattgaatgtacaaattcaccaacactttgtatgctaaagctgtcacgtaaaacttctgttaaagaatattacgcatgtagcctgaatttctataaaattgttgacaactgattctacttgttaaatcaattcagttagttactttttcaggtacattgatttgattctgtgagtaactaaactaattacttaatatattcgtatgcctggtgttttacgggggaatcttgaaaaagagacaaaagacgggaaagggttgaaattaaattaatggtgatcataatgtactttaccttctccttgtgtgattccaatcaatttattaattcagagattaattatatttgtattttataggtattataagtttaatttttttttacacaataagaattaattataattttttttgttaaataaatcatttttattttttcaaatagaacgagattttatatcgtcacatttatgaatcgtcaattacaagtatgtactccgcagaaagttgagcattaggggataaactacgttaccttgagtaattttataaatatttctatgttaatatgatt

SEQ ID NO: 5941 - DNA, 1300 bp, Glycine max
  Soy_ogl_5468 Gm17:3092401..3093700 Cluster 26
tttactttagttattacggttagtgtgaagtaatgaggttcacaatgaaaatatcatatgtcatcaacatctattactaaccatcaacaaattttttatattatttaaaaaattgaatttgtcttcttttccttcctcgtttccctcctctccacttccctctttctcttgcaaagatcccttcctccatcacaaaccccctagtcttcctcccaaactacttccaagccctaagaatcggcgaccccgacggagccttccgcttccccggcgtcacccacggcgactacttcttcggggcgggtctcgaggagcacctcgccgagaacaatcctaaccgttacggcaccccaccggtctccaagtccgccgtcgagggcctgcgacttagagaagttgtatcgttttcgtttccaaggttgcgactatgtgcaaggagcggctacacgagatcgtgaatgaagaattggacagcgcgcgcgagaatttggagtggaaactgacgatggagaacagattcgctcgcatggacgaagaggttcatcgccggagccagagcaaccagacttttacctgcaggtgtgagctccagactcctcactgcaacgccgtcgtcagaccggagaaactcgttgtctccaactgcggcgtgaaaactccgttgccaacattgcaagcttccaacaagacatacactacaagtacaaacattatagtaatgatggcataagtagttttggctattatactctcacaacggccatcaaagatgaacgagttgaaacttgaaatgtaattatattattcagctaattagctgtgttggaaagagacaaagaaaaattgtaacaaaagggatatactcaaaagtttgttaagaaattaacaacaagatacttctaattaggccgacgtaccaaccagaaaaaatggttaattttgagttcaaacctcaattgcaaaatgggatggaatttaagcacctgtttttaagagccaaattgcaaaaaagacaagggatttcaaagattaaaaaaagttatatttgtattacttaaatcacaaccacattaacaaatgacactttatttgatgtaaagtgacaacaaactagtaaaacttctcttatagattttaagtattccatcaaagggaatatcacctagtacttatatactcaaccccttaccacccttttctccccctatagcctttcttgctttttacatttccatctctttctcattatcaagatcaacttccacaaagaaacgtacatataagacaagctagctagcac

SEQ ID NO: 5942 - DNA, 1000 bp, Glycine max
  Soy_ogl_5500 Gm17:3994701..3995700 Cluster 26
catttaattggtgcatacgatttattaaaaacataaaattttaatacatattaaaattttataataactccaaaaaaatcataataaaaaaataaggcaaattttaaatatggggtacaacttatttcatgcaaaaaaaaaaaaataacgtgcttaaacataaccattactctagtaggaaaaaaatacccattattatttttgtcacttaagcgttgattccgttgaacgacaaacgacggagaaaaatttataggcgcttggatctttggatgcgttgttgcgcgtgcttacctgtaatgctgtgtggatttgataaaatgaactgggtcgtgtcaacgtactccatgcaatgggaacgcgcgcgaatacccaacattggagttgtctttcttggaccacatcccaattgctcctagcaaaattatggattagtttagtgcccaatttctatgactaattcatcattcaatgcaatttattattttaaaatggtccatatgctaggcctcctcctggctagctccgggtgttaattatgagattttaatagtaattaattaatttttctatgtagtaatttggccagtgctggctggtggtgggggaagaaaagggacccctcttggcaaaatgggatccaccaacattatggtcaatccaatctggtgaactctaattggaagtgaaccaaatatagggaagggttgctgcagaaaaaattaaagtcgacacggttgacgacttaattacttattagtaattactatggttataacatattaggcatattgaaaatgcatggaggcgttgttatgatgatgacagacctaaggagggatcacgtcagattgcaagcaacattgtcaacaataatggagttgctggtaataatatagtatgaaactattaatgaaagagagactctagctagctaccaaaggagggaccctcggcgtacagtatgtgaagtggaaccttcctaataatttttttctac

SEQ ID NO: 5943 - DNA, 1151 bp, Glycine max
  Soy_ogl_5580 Gm17:8164850..8166000 Cluster 26
gaagcagatgctttatacttcttaaaaaaaacaatttcataagaaatacttattttaaaattaaatttaaaaaaattaaccccttattggtatcatgttagctagtagtagtatgatatcatcattgtggagataccattacgaaagacgataaacaaagccatcgagcagtgatatattcattacacattctgcacataatgcatttatggttatctagccgcgatatgattatttagctgcggcatttatgattgcacattgtattatataggtaggtccatttgaatttagctaaagtttggggtgtatgtatgagttgaataaattaaatcaaattaattttgataataaattttatgtacattcaaacatatattaattacagtaacaaaactaattatgaatactaaggcgaaaagagacactttgtgattcactgcctcctcatatttttactaaaataaaagaagaaaaataatgaaagttatacagtagtggatgtttgtgaagataattatagtaacttatagatataattatatgaatgaaataggtacaaaatgcgtacactaaaacattctattgtctttatatatagttctagataagtataaattatgtatttttatctctaaaattagcacaataattaattatatatgctggaattgtcttaatttactctatcaggtccttcagatggtaaattcaactccaaattaaagcttcattctcattgcttctttattattaagagaactgtagaagggtgtgtttgaataattagaacaaacaaaaaaaaaaactaacaaattatgtgttgttggttcttccccttgtgtccggtatataaggtctgtgacactacgtacatgcacatgcaatgagctcagcctcgtgctcaatcacaggccaacctcagatggattcgactgcatgatagcggtgcatttaggatggatccaaaaacataccataaagtcttttaaaaaaaaaaaaaaaaactgtaattggtttgtccggaatgaatgaaaccttgaaccggaattgatgttatggagggttttgttctgtttttactccttgaaactggattgcacaagcaatcatgggcacccgcaaaggtactttgatgctcaatcaacttg

SEQ ID NO: 5944 - DNA, 1036 bp, Glycine max
  Soy_ogl_5851 Gm18:687828..688863 Cluster 26
tgtcttgcagtagctgactctttgaaatcttgcccttaactttttgaaggagatagtgaactgaaaagagctgtattcaaaactgatacagggataccagcctcttaactcatgcatgtgtcgatcccaaattaactgggatgggttaaattttagaaatcaaatttaattagtgtattattttttaatttcctacatatttctttcttctctaatcacctttcttttatttccatcaactttatttctcttctcaaccaaataaaatgttgttaatgtttaaccagacacgcgttacatttgagggaggaaaatgacaacaaagaaattgatgacaaatgtgaaaaataataaaaagtaagaaaatataatattaataatgctttttttagctgtttgaaaaggaaaaggtaaacatccaaaattcccatgcaacacttgggaaagaagagtaaaaaatatagatatgataaaaaaaaatatgttaaaataataaaatattaatgtatcattaattgtttgaaaagtcacccgtcttttgttttttattttattttattagattgtctcaagtgtgggagaaatgtaaaaaaaataaaatttatagcacatttataaaccatccaatttgggcagcatattacaactgggggacatctccattcaactgttttcacgtggaaagggaactctggcgaaggaatcgaggagcaatgtggggcttcacaaatcacactttagtactcactcatctatatgtctctgtttctgcatttcaattcaactgatagatctacctcatgggatcaccatatttgatttatatatctgtctacctcttctttaatctcaatcaaatgagacgggcaacatccatgtgccaccgccatataatcataaaatcaatagtgcaacaagtcttcaaacaagtgcctaagacaatatctggcttggcaattacaaacaaaatggatcagattaaacatattattcagagatagatcagcattactaattttttttaagagttacacta

SEQ ID NO: 5945 - DNA, 1300 bp, Glycine max
  Soy_ogl_6171 Gm18:54437301..54438600 Cluster 26
cgccaattcagccccttcaagcctggcttatacttgcctcttcctttgaaaaatattaccaaacaaatcctgattgaatttggacacgtccctttgaacctcctggaggcttttgagaacatccggagaccccctgccccaagtttgtctaacaaccttttcaaaatccctatgggtagcccaggccacctgaaacctaaacggacgattctggctcctcaatggctggccttcggacataatcaacacctgacaatgatcacaataaaccctacaaaggttttccgcataagcttcaggaaatcgaagttgccaaccttgatccaccaaagctttatcaagctacttcactgtgaaggaccctaaaccacgtatattaatcaccctttgtctccaaatccatgaggtcacatctatctatcacatcttggaacaacatgacccagataaagtaaaactatcacccgaacttcaaaaggtttggcgatttcattgaaatctccagtgaccaaccatgaaggagtcaccatagtacaaaccgcttccaaataatcctaacacgattaaggagtcctgatttgcgaagaagcatacaccactgagcaggtccactgccatccgctatcctcaatactgaaagatatagcttgttggcaagaactaatcacctgggttctaaaggttctcaatctattcacaagatgacaaatttcatagttcaacgtcccctagaactgttccacagccacaaaatagtagtgagtttcctggacagtgaaaaaggaagaacaatgaattcgaacaagcttccaaacccttctctgacccttagcattggtcgtacctctgatgttctagcacgagatattcatatcattaaatggattcataaaactatttaaaaataagaaaaagaaggaaccgaccttaatggctcacaacaacatccctaggcatcgacgaggatccctcttcatcgccaccacctaacgaagcatgacttggtccttgagacgcactcacgacaccctcctacctttaacgcccttgtacctggtcaacgttagtcgtcctcgcaggcccattcccatccttagtctattgcgtctttgtgaagtgtaggtggcctttgtctttttgattggctacgacagcctatttctgattaagaacttccccaaggtgaccactcctaagcctcccccatgatctatacccttttccgtccttggtttcacactccacaccgccacctcattgctgcttggctcggtgggttgtgaatcattcgaaatcccat

SEQ ID NO: 5946 - DNA, 1389 bp, Glycine max
  Soy_ogl_6478 Gm19:40928401..40929789 Cluster 26
aattgtggaggcttaaagcaccttccaaaattctagtctttggttggagggttgcattgtccaaaattccaactatgttccaccttaaacacagagggattatgggtccgagagatgattcaaaatgccccctctgtaaagagggggaggaaacaatctcacatcctttcttggtttgcagggtggcagcaactgtatggtatcagtgtgcggcgtggtgtggagttcaaacggctattaagatggaagactcctattgacaagtttcaagttgggtgcagggaaatgatgcgagattggcgtggtctgatgtatggctagaaacaatttggacaatctggctacagaggaatgatatagtttttaattatggcaatttaagctatggaggatatggtggagctgatcaaagtgaggtcctcgcaatggagcaaggctaagtcgaagggatttcatttttcattctatgtctggtctaataacattagatcaatgttacagcagagttagacaatacctgcaacgaaatacatgtcaagattccctttgtgtgcttcctatcggcatgcaggtatcaaggcagagtttggtgagtatgtcacgtattggaattaatacagtggggggcattgctgtggcaatgagtggtggagagtcatattaaaggctgaggctgtcactgggtccatgtttatggcttaccagaaccaccaaaatattgcgcacagactttggcggtgtcagcaactgattctacaaaattttcttcttgctaatggataaaggtgtcttgatctgggtgttgtgctcttgttggtgttggtggggtgcaataagtgtcggtggaattttggtgcagttattggcaattgatgaaaggcataatggtattaatatatctagtggggatagtatactgttatgattagctgggtaaaaatgtatgactttggttttttggtgtggcaatttctgttgggctttatttatgctctctggagggtgctaataaggtgtaacctttgtgggtgctgcacagagaagactagccactaaaggcatgatcatatatacacccatgccaagttattaaaaaaaattgtgatttggaaaaattattcaagtttttgttattggtatattaaaaaaatgaacaaattaattcatgtatagtgtcttattattttcctaaggacttacattttttcattgctcttaaatgtaattcattctgaaataattataaatagcgtgttgttgagtgcttcttcacttaagcatttcaccaagatccagccatcaactattgacaaattgtcagtaaaaaaaactattagcaaattgtttcagcctcatttaaatttttaacgcaaatttgcatgtaaaaac

SEQ ID NO: 5947 - DNA, 1206 bp, Glycine max
  Soy_ogl_6501 Gm19:42229695..42230900 Cluster 26
gggttatttttggaatgttgttggagaggtgtaacatatggtagaggccttccctatattcccccttgactacaggcaatgttgttttcagatccttcaccaaaaaagtgataaaaaaaattcagcagagatagggttagtttggcataaagaagaaacaaataaaagatttttagatataataggaacatgtagaactttgggaagtgaaagtttgtgagatggtgtgtgaatgaaagttttactattgtggttgattgggagggcagtgccatcacctacaatgggttaattagtgtcttggtaggggtgagtgagatgcaggcgatctaggtcatgggtgatgtggtgtgtggctcttaagtccataatccagtcagttgtgtcctgcatggggggtggtgttgctggcatgatgagaagatagaccagtgcatgtgacacctaggtggataggggtaaccatgaagtttgtagcagaccgtagtagcttgcccatgtttctcatagtacttgcatatgaccttcttggtggcactgggggatgtgggacgagcattggacgtggaggagttgtacttgggtttgaagccccgatgtttgtactaggttgatcctttgtgggcggcgtgtgcaatggtgactgatgtagattcttgatgatgttcatcctatttgaggtatgtctcaaagtcagtgagaaggtcatggagttcagtaaaaccaatagggttttcgcgggagcaaagcgcaacggtgacctctttgtatttggtgacaaggccatcacatctagggagaggaaaggagaaagagctcatcagagagggacttgatgccatgaaggtacgccgagactgattgggtacccttggtttagcgtgaaaacgctccttgagatacatggtgcgagctcttgttttgctcgcaaacatcttttttaggatatcccatgcttgcttcaaggtagtccacaaaggagataatggtgtgtcggaggagttgatcttgatgacgccaatagtgatagttcgcatggcttgtggtggggcacgtggtggtgccatcaacgaacctgagaaggttatggccggcgaagagagcattgagttggaccttccacgcggggtaattagaacacttgtcaaactggtggcatataagcgattgtctttctcgtgataaaagaaaaatcccttaggcctg

SEQ ID NO: 5948 - DNA, 1000 bp, Glycine max
  Soy_ogl_6581 Gm19:44891101..44892100 Cluster 26
ttttattcagccttagattgatgtctttctcacaattacaatatacacccgccacgctggatttacacctcccgaaccctttctctacgacctcccctgtaacacccttcgaccttcactctctccttcaccgtaatcattgtcgtcaacaaccttggttctgcggccaccaccgttgtcttatacagcatcctttacggcaagcgcattttccaccattgatttcctcatcagaatcggaacccctgggagacgtggaagaagaagtaaaggttgtagagcgcatctctcgccaaccgccactagatccggtcggcaacgcgcgcgttcacggcaacaacattgccgcctcgtcggaatcggatgacggagaggtcactgcacgcgagttctttgtcttttgcagcggcgcgtggatgtgatacatcaagctgccatttttgttttgtgtgtcttcgttgtaggattggaaatagtggttcgaacgaagttaagatctattcgagtgtcttccttagccttagagataacttaattgtatctaaatccaatgtgcaacaatttggcaagagaagaaatctaatttttgcacgctcactttaaaattcaaatggaactagtagaaatactaaaatacgtgagtaaaacagcattttcagcgattcttcttctttctgttgcatgacaaatgcatgcttgatgtttcaactttcaacccttagccgcgagaggaagagatgacgatgttgaagaaaaaagaataaaacgccgacaacggcaaaaggtgtcggaggggcgctaagaaatagattcagtgtggtgggtgtatattgtaattataaggaacatatgaatctaatagtgaataatatttgttcaccattaaccacttacaacattggtccactgtaacttggccttgatacataggaaaagttagaggaaagaacgatgagtattattttaagacatcatatttatagatatttctcatgttatt

SEQ ID NO: 5949 - DNA, 1170 bp, Glycine max
  Soy_ogl_6605 Gm19:47086631..47087800 Cluster 26
tggaagataacacgtgtctcttgatattttaggaaaaatcttcatcaataagttgcatatccgagacaaagcaaaaattctaagtgttaaggtagatacacatgaagcaaagaaggagaatgtccaagcaaaggtatggctttcattattcattacattacgtaccctctctatagtactccctgcttaatacagtatatattttctgtaaggtggctattgtcaccggtggagccaccagaataggcgcagaagcagtgaagatatttgtggaaaacggagcatccgcagatcatagcagacatcaaggacgaattgggtcacaacttggctacttcatttggctagagaaagtgagttaccgccactgtgatgcgagagaagaaaaacaagttgaagaaacagtttctttcaccttagagaaatatggtagcttagacatccaaggccctttatcaagcattctagacttcgacaacgccatggccgtgaaccttcgcggtgcaatggcaaccataatttgcacggccagtgtggccggttccttcgagggatgcgccggcaatgcatgattacaccgcatccaaacacggccttattggccttgttcgatatggagcctggtgaagtagaagctatggagtatgctttggcgaacttaattgcatggaatcacgttgaaggctactcatatcgctgaagttgctctctttcttgcatctgatgattaggcttatgttagtggacacaacttggtggtggacggaggcttctccatcgttaatcgtggccttcctagcattaaaaattaataaatgaacccatcatctgatgcaataatgcactgtgtccaatatgagaagccaatattatctataactctatagtctatatttttctttatcttgtttccattgtgttataggatttgtgatcgtaatacacaatgaaaacacatttttttattgtgtattgtgctacattacataatagaaatatgtttgcatttgtgtgttgcaacctcaaagttgtgtatcacaaaggaaacaagtttttgtcaaagatattgctgtttattataagaaaaggtgaacttagaaaaacgggagtgggaataacaaccaaaatctgctgctagcaatggtaaaagaagttcagaaatgcttaacc

SEQ ID NO: 5950 - DNA, 1162 bp, Glycine max
  Soy_ogl_6619 Gm19:49196539..49197700 Cluster 26
gactagactcacaaaattaccttcatatctaaaaccctccctattaaagatactcgaaaaccataaaattttgtccctttgtgacagcagcaaggaggacaaggggctcagattctaattttattctgactcctgctgatcattattatcttaaggatataaattaaagaatattcactaaatatttttaattacttaaactacgggttaaatggttttaatataataattattatattctcaataaaaacattcactttcatttggttaattattaactagtaccgtttacccttttatattattaatttttagttatttactcaaggattttgtttgcaatcttgtcatcattattgattagctagttactactcactacctgagaaatcaattatgtcaaattcgttttatttctaccgaagtgacccttaatgtgttattgggcatcgaaatgggtatcggcagaaggtgccaaaagaatggtgggggcattttccccaaccaagtcacatggtgaagttcagaagtgagccaaaaaactagagtaccgcatataattgcaaagtcatttaaggcaagacaaagagctgttgctccagacctgtggtctctgctcgaagttgcaagtaactaatgcaaaaggcaatgtggtgttgacatttgcatttgcaatttcgccagcaacaccccaaacacgtgaaaccgtgtcatcaacacactcaattatttcttcccaagcaaagacgcactgcatcacattagaggcatcagccagccaataataaaaaagcaagaaaatcaagagtgaattcaaaaagcctagctagctagctagctaaacctaaagactattcactcttcagagataggtcattcttagctatagcatcaacaggttgaggtacacctgattgaagacttgactattgcattaatgttggaagaaatgaaattgactgaatttggtggacaaaattgttggtaacaaggactaaagatgagcactatatgcttacaaatttcgtaccaaaaaatcttacttcttgaaggtgtattcctgttccagatttatgcttctaattttctgccggctcgcttctcaaaatgaatcatctttataactaaaataaaagttcatataaacttgagtgttcaccaa

SEQ ID NO: 5951 - DNA, 1213 bp, Glycine max
  Soy_ogl_6903 Gm20:40878588..40879800 Cluster 26
gcatcattttaaacttaaattttacaaataataatggaggagagagtttagatttcctaaaaaatcttatatttttttttgtcaccaccgtgaactttaaggtaaggtagcggatatgatacgaggaggagttgttactcgatcgacagatatactcatcattgtcttccctagttagtacttagtagaaaaagagtgagcaaattcttctaatgggtctctctctgtgcctgtcattgccggtgttagaagaactgacctcagagattcttcttagggttccggtgaggtcctttctgcgattcagatgcgtatggaatgccctagtctcctcctatcctcaattcttcgcacctcaacctccgatccaaacatgcgattggtctcttccctatactgcgagtcctgccaaatcctatcttactctgtgcaatcagtgttccaaaacccatctcagccccaaacatatatcgttgcttcacaatgaaggccgtttccacgttctaggttcctgcaatggcttaatgtgtttgtatggtatttatagccttgatgtcacattgtgcaacccttccatcagatgtcagattgatcagttccagacgattagcaattagggttaggtcttctgccactgcaagcagtagtaatattacttatcatggctttggctactatcacgtcaatgacatgtacaaattgttactagttgttgaagtggaacatcgtcctcgtcaaacgactggggaacatcttgactactaaaaaaatcgctttttacgaacctttggtggtgcaaatgcaaattaattgttgggcagtgattaaaaatttcccgcgtcatcccgctactttgcaaggcaaatttgtgagtgtggagctcttaactggatagcagctactaatggaccaagaggtgcaagtgatgatgttcaatgggtgattctatcccttgatttggccacgttggaatatgcttaagtgttcctcatggagactgtgatggtcacaagatttgtggccgttctgtgttaggtttctcaagagactgtctttgactctaaggaagctaattttgttgtgtggctcatgaaggagtagggggttcaaagttcttggactaaattgatgatcttccctcccgttattcgagattcattggggattatcaatcacatcgagcaattgtttgaccccttttgcatttcagaaa

SEQ ID NO: 5952 - DNA, 1628 bp, Glycine max
  Soy_ogl_3 Gm01:324173..325800 Cluster 26
tgaaatataacataaagtgttgaataatgactagacctatatcaattctatttctctcactactgttcacacaaaatatatgaagtgctgcagcataatatgcaacttactatcccttaccgtgactaaattttcgcccaataaatcgccagccgtgatagatgcgtcattacatatttacaaaaacattcatagataaaaaaaaagctattgttggaagcaagtgctatttctgaatgagtcctggttttttgtctatgcatctttattctttctgaattgatcattggcttttcctgactttatttatgtgtgtctactgtctataatgcacgatgcacatcaaacatgagaagttattatatattatccttactacagaggcgttttgttttatataaacgaacaaatttaaacaaagattttgagatcataatatagctcgaaattcccataagctgtcacatgcatgtcatcactttctttcttcaaagtagtaatgtgttcctacgtgtgagcagtaccggtcatcaagttaatcaaaatactaaattgatggataactaatcaaatcagtggaaattgaatcgtatgaatgggtgtacataaaataaaatataaataaatacatgtgtcataagttcactaattaatcattggtggtataataaaaaattaatctattaaataatttttaggtcttgaatttaatttttgggtgtgtcatttttattgtatttttattaaaacttgtatcttaaaaaaatattggttaattgattcaaccgatcaatcacatgcatgaatcaaactagtttaatgacatgtttgatctaaatagttgctcaaattgattataccacccgttcatgattgaatgggttagtccaattattttttaaaactatgggtgttggagtgaaattgggtcaagtaacattaataggcattgtttaaatttagaatttttgagtgttgaaaaaaattatttcttgtttttttaggagagaaaagtggtgttttattccataataacagaataaattacatcagattcaactaatggatccaactgacaggggatctcatcaatccaaaatttctctcctaaactaaaagcaagatttgctaattcgtgtgctactatattacatgatcttttggtaaaaagaactggacttgatgcagacttacatgcagtcatctactaatcctccaaaataactcctagcagactcagctcttttccacatctcatttactagctgtagacaatctgattcaaattccacgtttgcaaagcagaaatctgaggataattgtattgcccatctgagacaaagaggttctgcaattcttggctcgaaaacactctcctcaaaacaagttgcagcaccaagcacattaccttcatggtctggagctaccattcccatgccagtacgtaaaaatttgtcgcttgactgaggcatcaatgttgattttaatcctgcacccatcgggtcttctccacctggtgggatgattgggagcaacagcaatttccctttccagcttttgataatatgcctttaatttgcaatgacttgctcaaaagtcatgagtttatttttatgcaggaggttgtt

SEQ ID NO: 5953 - DNA, 1000 bp, Glycine max
  Soy_ogl_258 Gm01:50910801..50911800 Cluster 26
atatgtatttctggtggtgttgacatttctagtcacaatattcaccttattaatattataagatgtttgttgttgaaaaaaaaaaaaaacagtcaaataataccgcattggtctttataaactaaacttcccttccctaattgccacgatgatctcaatctcaatctcatccatctcctgttagcctaagcaacagtaaaatatgataatagaagcattaatgaattgaaatgttacctttctttatgcaatttttttttatactaaggaaaacatctttatgcaaatatttatatgcatgattgaatttccagtaagttatgatattatgataatagaagcaataataatgaattgatgaaactttacttctcttatgcaattatatgcatgattggatttgccctcaactgcacgttaacaatcataaacttgattttgttaaaaaaaagaagaagaagaagaaaagtttaattgctttatttttttaagtcgataaatttatatttaaactacaaaatttaaaacacaaatgatgcattttgaatttaattttaattaaattaagatcgttcaacgacagtctgttggctaaatggtgttggagatttcttcgacaaaagggatgttttgtgggcggggctgcggaaaataaaatatggggacttccagaatgagccttactcacagccaaagtcgactaaatggtcattatggtggcgagacatatggagttttgacaagcgaaatgctgctgcattaggaagagagtgggtgatggacactctacaagcttctgggagcacaaatggattggggaaaagccactaagacaactttttcccatattgtatctgatagatgatggaaaggaggacattattgcagagaaaggcagcttcaacatgggtttgggagtggaagtgacggtgcaacctatttgtctcgaaacagcagcttctacaaagctaactctcaagatgagggttgccctcattag

SEQ ID NO: 5954 - DNA, 1239 bp, Glycine max
  Soy_ogl_375 Gm02:4478662..4479900 Cluster 26
tgcatcgctgtagtcgataatgatgtagaaaattgcgtcacacaaacaaatatgaaactaattttgttatctaatatgaaatatgagataactttaaaacgtatattgaccttataaatgtgcaaaaactgatttcaatgcgtgcaaaaacgtatattgaccttatagatcatgtccaggctatgttcatgtgaatttcctcactcctgggaattcattgaatttcttgtggctaaacaaaaaaacatgagctttaatcgtgagcagaaattgcaaaacaaatgtgaaagtaatcctcattgatttttctgtatgtactaaaaatttgtatggagtgagcactgttgtcagaaattatcactggtgacgacgaacggtggttggtggcagagtagttggggagtataagagcatactttactcatgttttttactctttctgttgtattctagatgctcactatggttagtagtgagttctttttctgttgtatgttaactaactcaagtttgttagaattagttgacagttagcataattgtttatataaacaatcttgtaacaacttttttatctcagatttctcttctctttccttttctctcagctctattagggagaagaagagaggtggtggtaagatgtaaatggtgcaccataataacatggaagaagatcaatctaaaaatcattaatttttatgtaccatacacaaagagatttatttccccactatactctttgtccatagaaaattgctttacgtacgtatacagaagtggctgagacttattttgacaaaggattagtttctatctgaacttacaaaaatttgcctcctttttgggctgcatgatgttccctaaggagatttggtgagacaccttcatcaactagctaaaagatgattggcttacctattaagatgggtgttttgtttcctgattttaactagcttccttcaacaccctataatccagagttttctttgttctataaatagaacctccagggacatcgtttattggatttacgagaatggtcaatgcaatgttcacgaaaggatattgataatttttatagatgcaacatgagattgtaattttttattttattttgtgacatgagtacatgacttactcgatctatgtggcaaagccaaatgaaagttgtcagccgcatcctcatttttgtaacaaacattaaaagcagggactaaaaatggaacatctatacat

SEQ ID NO: 5955 - DNA, 1064 bp, Glycine max
  Soy_ogl_735 Gm02:48388903..48389966 Cluster 26
gggtctccggaataatgcaatgtatcagtcaattcaaatactctagtactacaaagatctcatctaattttccagaagctgatgagtataaattaattttaatttatgaaaaaaactgattcatttcctattagtgctaaacaaaaaaaagtttactgtaatttcagcctgctgttgtctgcatgttaaaatatgatgtggtatgtcgatgttggttcttgagtaatctactgttgctgtctataaagaaggcgaaggaagaaagtctaaaatgtaaaattaatgttcaacaaaaaaaaaatgtaaaattaataataaaaatattattattgatattaaaaggtcaaaatataaaaatatcctggggattaattaaaatgtaaaaagcacatgcatggacgcaccgaatagaagagacggagagcatagtagacaaaatgtcatatgaccaatgctcgaaacatcataccaagacagtgatagaatccgaaaccacaagatgacatcaaagagttgttgctgtcaaagtgatcatgcgaagtagaatatcaatgtatatagttcccaatatgattttttttttttttttatcaatatacgtacactctaattggactcagagcaagaaactatggaacaagaatgaatggtttggaaattggaatctctgtgaggaagaacatggcatgtgacttagagctaaatgacaatttggggttgcaggtggagagagaaaccgacttctgtaacagagctcgtggttgaagcttcaagacacaccaggtggcgcaccacctactctatttgtccacttttaatggaatgtggactttcctcagtgttttttacactctaattgagtcatattgttgaaaatgaaaactgttaaactaggatatgttggaactccttttgttttgatccattaaaaatcttttttttttttaaagaatcatcacacatatttctatagtgatgctatagcaactgcataccctttgtttgaaaaaaaaaaaacacacaaatatatttcatgggaataatcatattcgagtttattaaga

SEQ ID NO: 5956 - DNA, 1074 bp, Glycine max
  Soy_ogl_762 Gm02:50941301..50942374 Cluster 26
cataagcaaggctttttaattacatggttcaatggagctatttgttgggtttaatggcaaaaatacgaagcaaggttggaaactctccaaaaactctaatgctatagtaacacaggtactcaaagctaaatatttccaacatagtggattcttggatgctcctctaggacataatcaaagctatacatgacgtagcatccacgcttcacaggttcttataagagaaggcacgaggtggtccattggcaataatggtcattcggttaatatctggacccaaacatggctaaggaatccagttaagtctttcctctcatcccccccgccccaccaattggtcttgaaaatttaactattggtgccctcattgaacacaatcataactgctagaaactggaaatactagaacaattttttacaaatgatgatcagcaagatatcaagagtattccattgtaacatactgatcaaaaggacaaactggtttggaacatatcatttgtaatgaccacttgaagatcccaggtaattagacgaccatttggagtcttaaaattccatcgaagatcaaacacttcctgtggcgatcactccgttcatgtctccccattcgggttcgactacaatcaaaaggagtcacttgccttgtcttctgcagctactgcaaaagaaatcctgagaatgaatggcatatttttttcgggtgtgagcaggccaagaaggtctgggaaattgcaggtctttgtactcaagtttctaattgcatgcatgaagccgaatctgtattggagctcatctcaaatctactgaacaccctaccattagatcccaaacatacattttcgcttacactttggtgcatctggaagcggcgaaatgaaaaatctaggagaacaaagacccaccgcctacaatatcagtcacacacgcacaataatttctcgaggaatggaacatggtccacaagcatcagaatctgcaaatccataaccaaaatgatgagaattcaactccatttcgatgggtaaggccgacctataactccctcaaagtcaatgtagatgcagttgtatt

SEQ ID NO: 5957 - DNA, 1013 bp, Glycine max
  Soy_ogl_1180 Gm04:2268801..2269813 Cluster 26
tgaaaaaataattaagatggtctgagatggctttgaagagaagtaaagagagagagaaatgagagaggagggtcaagggtgtgatgaaggtgaaagaaagaaaggggggtgtatgtataaagggtaaaccagtgtaaatagcaactcctcacgcagagacatcgtccaccaccttgctaaggaagatgaagcccataattttctcatattatgggcgacattggacatgctgaccttgggcctgtgcatcaagaatcaatttctcatatactttgtacaagttgattttggtacatatgtacaacagtacaagttgatttgaacacatcttaattacattcaataattttaaatcaattctacttaaccttacaacaaacgaacactttgtgatggagtgtccactggtgttaaacaaagcattgaggattttaacttataatgatgatcttgggtcaacttgctactgctccatcattcttagcacaaacacgagataaatcattcccacaacaaaaaaaaaatcgagataaataaattgaatgatataacataatgtattgatgtataatgaataaattaaattttgtctgaataagataactcgtttcacaattacatacatttatctctgattatatgtgtaaattatatttacgatcattttgacattcaaaaaataatgatacaaaaaagcaagagcaaacatcttttaagttttattgatttggtccaggagtgtttttttattggatggtaggtttctatggtccagttgtggcagtcgaagtgaatgggcttcattctaattaaggtcaacattgtccgaagtgtatcactaaaaaaaatgaattgtcttttttaaatatcccattcaaacacagtattaggatccatttggaagtgaaagtaaaagaaaaaaatgcataacaatatcattttctttatttgattgaagaaaaaataaaaataaaaatcagaaaaaattaacctcaagaaacaaaaaaatataa

SEQ ID NO: 5958 - DNA, 1200 bp, Glycine max
  Soy_ogl_1739 Gm05:38756301..38757500 Cluster 26
agcatggaccctcttgtgctcagcattgtcccccaaataaaggctttttgtaccttttgaatctctgcaataatattctgaggaatgatcattatcaacataggataggcagggataggttggatagcagtcttggccaaggtgattcttccaactaaggacaatggagaggctttccatcccgcgagtttggtattcacttctccaaaagataagaaaagtctcctcttttaggatttttgcctaaaagaagtactcccaaatatttacccaatgaagtggcctctttgaatcctaataaattagtgaaggtggctttgagctgggaactaacatttttggaaaaaaatatgttagactactccacactaacttgttggcccgacatgctacaaaattcttccaacactccagtcacagtttgcatttgggaaatggatgcttctccaaatataagcaagtcatcagcagacatcaagtgggagacaagaggcccctctcttccagcccgcatcttggaaccatcatcaacacgcttggaaataatgcgtgaaagtttgtccagagcaagaaccaaaagataaggggacaaagggtccccttgtcttagtcctctttccggtgcaaagaaaggagatctgttaccatttcataacacattgctcttcatgatgacattaatcaaattaggagggaaaccaacttcaactaacacattatggataaatttccagctcatgcgatcatatatgctttggccaaatcaacttttataacaaagaatcctttcctccccctcatccttctcatagaatggagcatctcctgatgacattttcatgaatagacctgatagggataaatctagtctgaaaaggagatatgattctgggcatgatggacttgagtctatcgactataaccttagttagagtcctataggcggcattacataaagaaataggctgaaattgattaacaaattctggtttactagacttggggatcaaacaaatatttgtgagagtctattgaccataaccttagttagagtttcacttttttagctttgtggtagtcatcataaattcatattcgtcttagaattttgtccaccaatcataataattcaatattaacgtgaaactccctttatagcctcattttggaattaaagcaatggttctaccttcatgtaat

SEQ ID NO: 5959 - DNA, 1163 bp, Glycine max
  Soy_ogl_2118 Gm07:1641801..1642963 Cluster 26
caaatttttaaaaataaattacaaacaaaaatttgctattgaccatctaccaaaaaaattcgacacagcccaacactacaggcagttggcaatatttcacttcacgtagcaatattgaagaaccaattgcatacttcaacgaatataactcacatttccaccttttccttatagaagttatagttcataactgatcttactccaacaaatttctagtcccttgatccggaaaaaaaaaaaagaaaagaagaattttagcatactttaaaaaaaaaaagtgtttggttcagccatttataaaaaagattcaatttttatgggttgaggatttaaacagttaagtttatgagttatttcaaataccagaaaatcgtatatgtaaatggggagtaatccttgcctgttatcaaaatcttgacctcccaaatgagtgtccccagcagtggccttcacttggaaaatagcttcctggatggtgaggagggagacatcaaaagttccaccaccgaggtcgaagataaccacattcttttcgccactcctggaagccttcttgtctaatccataggcaatggcaatgtcaatgcccttaccttcagcaacaaggtataaaggcattagtgaatgccaatgcccttaccttctgtcttggaagccattggaatgaatgaatagagagaatccaacaagttaagttgattgcaatgcagaggaatgttgaggaagtaagatataaaggcaacaaaggaaggatcaagactaaaaattggaagaggctgttgttttcactgaaacttcagcaatttgagagaaccaaccataattgatattaattggtaataatattttagcattaaaaaatcgtattaattggtagttttcaatgaaacatgaaaacttttattctaaaatcactcaaaataaattatatcaagcgaataactttgaatattatgcctatcaatttttcaaccaccatcattaatcattcaataattataagtaataataatttttttaataagtaatgtatttattgttattcttaatctatgtaaaaaggttttaaactttagccacttttgaatgaaaagagtatttatttatattacgtacaattatgatcaatgtttatccttggaaagagatattctttgagatac

SEQ ID NO: 5960 - DNA, 1300 bp, Glycine max
  Soy_ogl_2421 Gm07:38367701..38369000 Cluster 26
gaggaacagacttcctgtgaatgtgtgtgaaaggatctgtgggcaaagcactcctccttataatgcatgagcaaatatagtggtatggaaaagaacgaataatggcttatttactcttcgatctgcatgagttcaatgccttcatttctcctcctcggaagctccatgtttttaaggtgatttgggggtggaaaaggtcaaagaggataaaaagccttctatggaaaataggaaaggcgattttgatgacgaaccataggcactgggagatagggataacaacgaatcctctttgtccaatttgccatgtgcaacgagaaacaatcattcatgtattaaaggattattttgtctctaaaagactatggtaacagtatattattggccccagttggaatggttttgatgttgaagatagtgaatactaggttttatataatctacaaggtgggaatagagtggataaagggtggactcaaaagtttggttttttgattaatcaactctgaagaaggaggaatttgcttgtgtttgaacacaagtggagttatgataacaccattcatgcccgtgtgaggaatgctatttgttcttggttgagctccaaggggttcacaaatcatattaggatggtggtgagctcggagggtgtgtcaaatgcttgtggttggaggacaccattgataggatggtataaagtaaatgtggatggagttgtgtggttgaaggataatgaggcagcttgtgggggagccattagagaccataacggtgttttcatggtgggatttatgtggaagattggaattgttcctatcgtccatgctaaattgtgagccatttttcatgggttgaagttggctttggataggggattttgtaatattatgattgagtcgaactctgtggaggtagttgattcaatgtctaaggactggaatggatctcatcctttttcttcctatatcagaaagtttgttcatctccttgagggctttctgattccgcacatcctgaggagagtgaacctggtagctgacttgtttgccaagaatgcttttgcatttagatgttgcaaagactagaggttgagtagttattattgcttttgtttttggtcttttccccttgtttaagcaaaaaaaaaaaaagcttgaagttagttaaatcaatactccttagttatttattaaaatgagaattagcttgtaaatcttaaaaagtaacaaaatcttaatatgaccctaatttatctttataattgcaatactcttttagttttgcatctaaacataaactt

SEQ ID NO: 5961 - DNA, 1600 bp, Glycine max
  Soy_ogl_2877 Gm08:43766701..43768300 Cluster 26
aatacataaagtttgttcttgttggcattggtttatggaagaaatatgaggggactgctttgtgttatttatttttattggtgtattgatctttttgcctgtattgcaattgcttagatgtaaaagtctgctggcttaactgtggggatgacttagttatagtaccatacttctttttaattttagctttgctgtttaaataaacaaataaactttggaaattaatattaagaataattttaaaacatataaatttaaaataaatttaatattactaactaaattaactttttttattaatctttataattaattaatcaaatcttgtaaggggataggaaggagtatatatacgaaagagataataatttatcaaacttcaacgtttgttttgtgaggggacaaacgaactctatcgctgataacttagctagaggagcaattaaattcttatgttggtctccatcacttcgatagtttctcatcctgtgttattgataagattttaaaggaaataatatatgtttgttcctctaaaaaaaactataagtgaaattaatattacaataggtctgaccctaattagcattccattatcaaatatgcacccacccagattatcattcccttcaaatttgaacaggagttacaacaataattcgatctacggtgcaacctagatagaactattaattcttagcaaagcacagcaggtctccatgcatgatgcatgcacgttttaattggtgcctttagcagctttgtaattcataacaatactgcaatttttgtatttagagccattaccgttgccatgaaattgtgcatcagtattaacaatgactctcgctccttgcccagagaacgacttgggtggtgctactgttccctaattttccttcttgttggaagaggatatattgtttccctgtaaactcactctcaagaaatgcattgatagctttcgggggttctccatttacctcgcgctgaatcactggagtagaacgttgtatcatactctccgtgacgaaagccggaaccttgaatttgaaagggcctctaaacatggccgaaagccctgtgactttatgacattcaatgttgacataaaatctaagaagggttttcatacttaactcataggtgtgaaaaacctcccaagtcatatcgctcactacagaaccaaaaaagtttccaaaaaagctttcacctttagacacatgataattacaagacctgcttacacaagaatagctgaaatgtgtatgagcccctaaggcgttaacatctagatcagaaagagtattaaccccctctacaaccactctcaccaaccgagggttgaaatatccgttgtgtctttcagcagtgagctccatgtgaaggcgtacgggatgatcatggcacaaagtgtctgccagtctcagtagcaccttttctggtctcacgctcaaacggaaaatgctaaactttgatttatcactcacaggagtgtatttcagagctgtctcttgaggaaattcctcacttgaccatttgtaacgctcagcctcgagatcactgtatgtaccacccatgttggattgccacactcacg

SEQ ID NO: 5962 - DNA, 1077 bp, Glycine max
  Soy_ogl_3323 Gm10:2527924..2529000 Cluster 26
attaattttcacaagagttcctctcagtgtcaccacaagcacacttgttcttctctcttggactttgatgcgggatacttcaacatgttacaggacctcttttatatagtaataaaatggataaatgtcaatcaaatgcctctcacattttcaatacctttcaaaattttccatctctcctttcagaaaaggatgtaaactttcatgagccaattaaacttttccagcaaatttatatcaccgagacagctccaagttatatatcatagaaaagaagccaatgtttgtgtagctgttatcaactcgtagtttccatctccccaatacacaaaacacaaaagacataattttgttgcttttgcgttccaagtatcggaacgagaaaaatccgttgcaacgtgtgctcaaacatgtccttccatgtttaacataacaagtgaattactatgattacagcaacttcttcaacctttttaagtttcagttcccttacaacatatctactatataattagcaactaattccacttcaaataagagatccaacacacattattgatatcgattgtcatttaagtagctgacagatgtcttaacaaaaatcttgactcggtcaaaataagagatcaaaacacattattgatatcgattacctaattattttttttaatcatgtattctttctttcttttttattcactattagtttctaaacattattcgagtgtccgtgtatgtgaaggtcaaaatatgggccatttgcccattttgtagcttgaagcacgccataagagcattgtttgcccaaaatgggctaaaatgttggcgtataaaataaaagacttttgctgtttccactagtttatttttgctaagttcacttcccttccccttttcttaaattcaaattcacttaaaaagccatgggttcgtgacaaaaaaaaatgcccgaggttaataacagacaaaaaaacaccggtttaataaagacttacatgggtgtcatgatgccaaatttgttagtattttaatgaagactcaatggtaccaataatattatgagaattaatacctagt

SEQ ID NO: 5963 - DNA, 1329 bp, Glycine max
  Soy_ogl_3666 Gm11:485372..486700 Cluster 26
gaacattgtctaagaaaaatattaaatatacatgtaaaaatatataagtatggtgatttttttagttcatcatgttatctatataaaatatatactgtcaattttacttaatcattaatgcctgttaaaaaaacataactaagtcacttttagtggaatgaaagtaataacaattcttaaaaatattcatgttcaagaaaatattatcattaaataataattgttcaatgcccatgcctatctgtaaaaaataattatcgtatgagatatttcaaattagactttataataaggaccaagttacacctttgataagcattggaggagtaataaatcctaattaatattaggttgaaaagttataatatactaattttgaaatttttttaacacgacacttataaagtatttaacattattaatcttaacgacacataagtagttttactagctcactagtggtatcaaaattactacgccccagcccgaacgattcgacaagtgtaggtagggtctgtgggtttcatggtgatatcataatgtgaggcttaagttgttcacgacttatgcgtctgccttatcctcctgctcccaccagtttcctctttccccaatttatagtatttgttgtgttgctcacgtgattgtggagtggtcaagggtatgtatgtcttttccattttccagggaggtgaagttcatgccaatgcgaaaccatagtgttgactatttaagtaatctctcacgtgccatattgctggcaaaacagggcatctccgctacaaactaataatgccgtctttttagataacttaactgacaaatgaaacatattcagcccaaccttagtttctttttacgcatataactgcaacacacgcttttggcttttgagaagagggtgtcggaaatattattattagattttttattttttttaaaaaaacagttgacaaatactattatagatgggggtagtttatttctttaattcttatttcttaatttgtggatgctgtccaaaataaagaccaaaagtttttaattaaaaattaatatatatgagaggaagatcaaatatcaagtaggtacagtttgcgtgtcaactgttggtgacagacaacgcactgataattattctgtttacggtgtcaggaggaatataatccatcagaaaaatcatatttaattaactgaaggcttttattttgtttaatcacttctcattattatttttgggtacttttgtttgacttaatgtacgtttctggaggaaagttcttacatgggcatatgagcgcggccattccaaagagggcatgcgaaatt

SEQ ID NO: 5964 - DNA, 1611 bp, Glycine max
  Soy_ogl_3668 Gm11:537201..538811 Cluster 26
caatgggctgaggccttttctgagttgaaaaacacagtcaacatacacccaacctatttctgtactctacaaagacagtgctaggacaggattgttacaccattcttgggggtgttttttcctgcacttccagaattgtttccagtacttcccttcttccagaatattccagaagcagtatggaaagtgcaggaagcaattaccctttcttggtaatttccccaatgccttgttccacttttctgatgtacagatatttcaaacttgggggctttgctgtattatacagggtggggtgtttttttttccgcacttcccatattactttcggaatggtcatttcggaaacaaatatggggagtgcaggaagcaatttcctacagatgtataggcttcggctagtgggctggcctgcaaagcccatctatgaaatttaataagatatgatgtcctagtgtcaaatagttcatgtttaattctgtttatcacttggttaagtcaaaattctaacatgttgtcattttgcctgtttaaattttgatgtacctcagggtgctagctttgaaaatttgataattgcaagggtgagtaacttgcgagaaaagatttgagtaaaaatcgaaacaaaagttgcaataggaaaatgttctggtgaaaaccaaaaggaaaaatatttttcagtgctgtgggattatgtgctcctattattaaaattgtggcgtttgacattgacagttttttcttcttattattttacattttaaagtaaaaaaattaagtgtaataactgcgatgagagtaagtaagcaaaaaggtacgtcaatccaatgacatgttatttatgttgctggaaattgttgtaaattatgtagccatcttgagttataattataacagcaattatcagcaaaaggagtaaccgatttggatgaagagtaaacactcgacagaagttgatggagcatagcagagttttggtcaatggagcctgcctgctgctaaagtctgatcttcatagctccctagaccaaagacaaattgaagccgaagaaggaaactgaatttctgcaatgataaagaaaagctaagatttattagcattttgatgatgtacacatatacagttattcttaataactttttgcaaaatcaaccattaaattatataatattgttttatatttttggtgtaaaatgttttggtattattcaaatttgatttttaacattaattattattggctagagttttcttatctttcgaccaagcttcaaattaatcaaaaaaaaaaaattcttctctataaactggaaggttaagacaaaaaaatattttcttgatgataattcatatataaaataaattgaatattcacgtcaatagatacgtaatcttatgttcaacgttaacttaattttgaaataaattttgtaaactagatttatttaatgcgaataatcaaatcaacagcttaattaataaaatttaatgtaaaaagtttattaaggatagtaagttaaacatgacttacactatgttttttctttacagacttacaccgtgttagatcatacaaaacatgaatattaacgtaacatatgtatatgaag

SEQ ID NO: 5965 - DNA, 1041 bp, Glycine max
  Soy_ogl_3737 Gm11:4982331..4983371 Cluster 26
taaccaactgctgagggaatattcgtcagctgctggaggcttgctacacgaagtcccggaggtaagtgggtttctttctcttggcccagctatgggtttgtcctgtattgctatcagccatgataaaagatggaagaccaaaatcaattcaattagttgaataggcagacgcatatatacatcgtggccaacgtttttctttcttcatccctttcgatgatacatcacatgcgatccccatgagcactataattaattcatgtagatcgagccttcaccagttagagccttcgttatcaaaaaaattaaaatgtcaattttttattattaattaccgtgtttttactaaaatcgtctctattggctactacagatgatatttatatatattccattaatttcacatgtaaaacacgataattttaataagtggaattaaaacaaactcatgttcgcaaggaaggttctccctatgagcttgtgtttcttgcgtaaatatgcgtcatcggatctggacaaacattcggtcacctagtgcatatgcgaaattaactttcaaataataataattattttagctccaataatatgtgaggtctcttttgctgagcctaccaatatgtgttgcctcgttgaccaatggaaacattatccaaaggttcatctgtttatggtggaatatcgtaagtaccgaggcaggttcttctaaattgtaagtcacactatgcaatatatattatatatgttatttaggaagtgaccaaagaaaacattctctttcccaaagatttagtaattaattaataatttagacttgactctaacctaattctaaaaagtgatttacaagataaagatacactatatcagttatatcatcatggatctctcataataataaatattaacgtaatatttatattatttgtgtacatttttattgtctatattagtagtttaatttttgattaaaaaaagatgatactaatgaaaataatgctaatttttatatttttctactttagtaaatgacaatttaaa

SEQ ID NO: 5966 - DNA, 1316 bp, Glycine max
  Soy_ogl_4544 Gm13:38356485..38357800 Cluster 26
ataaaaaatatgaacaagtattagtttttaatctatcattgagaaataaagaacaagtaagaacacctgataatttctcgcaatgcatggcttttctgcgtttgacaagttgacattgaagttcttcaacgtatattacgaacgtggaagaattgggcagaaggttgaaaagggaacgtaggtgttggaaagggtgcgagaaccattctccataatcaggggaggggaggtcaaatataaaccctaaacctcatcaaacaaatatataataaaatttgatgtggtcaaaagtttggttggcaacgctgtggactatctggaagcagagaaatgatgtggttttcaatggtggccaatgctgtagtgtgaagatgatggaattggtgaaggtgtgaggtcatggcaatggaacaaagcaaagctgaaggggtttcacttctcattataagattggtctaataatgtgagatctgttatgcaaaagagggggtgatacgattgtgcatgcattgtaagaattgtagcaagactttaggtttttgtaggaagctgatatactgaaactctctcttacagtggtacactggttttactgttgaggttgcaagcaaaaggtatgcatgcatgtatctgggagggcactttatcatactgaagtgaggctggaatttccgcattttgctatgtcaattaggaggctaatgcctatatatggtagcatcaatcaatattatgagctcatcaatgactgatgccaagactcaatttgattatgatattaagtgagtagaacgtacggatctggttggcttcattatagtctttcttggtagatagaattcaattcactgaatttttgaatggaaattcaattggggctgtgtcaccgcacggttgccagggagtagttaaaggcaaattactgtggatagtctctatatattcgcattgggtgtaaatggcaactatccataattagcaggggtcttctttcttccttttttttttctttctgttttgtatatgggttatggtatccttgtaccaatattaaaatattatttggctgattaaaaaaaatcatcaataatttgatgaaaaatcttctttagcttccatcatactcccaatttcaaattcaccttcctcaaattcaatcttattacttttcacatcaaacgttgacatagtcctttatatatatatatatatatgctatgatatatgaaaaaatttctagtgagggcaaaattgttcatgatctccaatcacacaacctcagcaacgtgcatcacagtgaaggccaggaatatttt

SEQ ID NO: 5967 - DNA, 1304 bp, Glycine max
  Soy_ogl_4591 Gm14:624401..625704 Cluster 26
aggagtatcaattggatgagttgggacagattaacagttaaaaaagaaaaatggaggaatgggtttctgaaatctccatgctttcaatttatctatgctagagaagcaaggttgtaaatttatttcattccaagatgctattgtttcaaaagttttcaaagccaaatactttctaaatgttgattttctggatgcaaaacttgggcataatcctagttttgtctggcatagtatctttgcttcacagagtgtgataaaagagggtgtcaaatgtagaattggaaatggaaactcaattgctatttggaaacagccatggcttcgaagaaatgatcatccatatgtctctacagctccacccggggattagaagatatgcatgttggttctctaatagatcatcaaagttgttcatggcgggaagacatcatggtggaagtcttcaatgaagttgacttgtaggaaattagaagcataccacttcttcacgtgcaagaggaagacctgtgagtttggaaattcatgccacatgaagaatattttgtccgcactgcataccaccatgcaacatggagctttggagaatgaaagttcctcctaaatttaagcagttaatctggggaattttgaggaattgcctcccttcacggagtagattgagagataaaagagttctttgtccacttccatgtaaattttgtgaaaacaacattgagtcaagttggcacatcttctttggatgggattcagaaattgcaacttagcaagaagcaaaactttggcccattattcagagcaaagttttgtctgcagaaggtattgcccctctcattcttgacatcatcaactctgtacatgaagaggacttatgcaacaaatttgctactggactatggtgtatttggaggcaacaaaatgataaattttggaggaatcaggtccagccaacgcagatcacgattcaacaagcatttcaacaccttgaagaatggaaggatgcaagacagcagcaatcccaatcacatgtgatgcagattctagacaatcaatgtgagtggaagaaaccatcttttggctacttgaagtgtaacgttgatgcaacaattttcaatcaggatcaacagtttgggaatggaatgtgtattagagatcacaatgggcaatttattcaagcaaaaacatggtttcaaggtgtttcagacccaacaatagctgaagcatgcggcttataccaagccatggaatggttaaaggagagctacaacaacaatataatttctgagttggacaacaagtttgtggtt

SEQ ID NO: 5968 - DNA, 1305 bp, Glycine max
  Soy_ogl_5252 Gm16:2303301..2304605 Cluster 26
ggttgagattcataaatatgatagaggttttaaaggtagtatgatagtttttttttcctccatgtcaaacggtcatttctagagatggcgcagcggattgttagttttgcttcgtcaagaaaagcaattttcctatgatttataattacaatttttaggtggtgttatagtttaggctttattaaagtatttttgggacattataggggcaaaagtccaaaaagaaaaagagaattagaaattggtcccgggaacaagtcaataaggacatgcgcccaaacatgaatttcatgtactgtaagaactgacaaaatgtgatcaatattaggtgacaaaaaaagcacgacatagaacgtcatgtttcaagttttcagcttttcctgcccaaatactcttttcatcttgatttggtgaaaatcctctattcatattgtaagatccatattctattctatctagatgataaaggcacatagttttgatatttcattaaaaaaaagaagatcaagacacttgccctaaggaggtagcgaaagtccattacaagggtgagatgtggggactcattcgttcgtctgatacaacacaagggtcaagaatgaataatgccatgtggtgtggtggtcaagcaatgaacaaatcaagcgccaatattccaaatagatatgattaaaggaatggacacacattattacccattaatgttgacaattgagcttatcatacacatcaccttttaattgtgtctagttattgatttaacacacattttggagttaaaaataaaattgtacatgtacatgtgcgtattatattttccccacaacatgatcatttagtgtttttagttggtttaagcacaactgggttcacttgccactgcacaaacgaataagattatggagacattaagcacacaactgggttcacttgccactgcacaaacgaataattgaagtctttacaatatttcttcatccaagactacatcgtaaacataattctcagccaaatttgttcaacctcaaagttccttctttcaaaaagcattgcatttctttgctgccaaatggcccacacaattgcactccaacccgtttgccaccaattaccctgtaaaccatgaccacattgccagaaatgctcctgagccgacctaggtagagttgagttgatatcgaaaatttcgaaccaccttttccatattaaatgaataactctacaagagaacaataaatgtgttgtatcttccagcatctcatgataaaagatacacaaggtgtctcctccatcaataataatacc

SEQ ID NO: 5969 - DNA, 1218 bp, Glycine max
  Soy_ogl_5318 Gm16:5394183..5395400 Cluster 26
aaaaaccaaaggaaaacatagaaatagaaaaagaggaagagacttcacacgaatcaatcctcgtatgttatgatctccacgcttctttgtagccaaaaactctcccacaactctgttctctctccaaaaatgcataaaagagtaaaagataagattctagggcctaaatttataacaattggataagtgacaggcgttgcttattaaccacgattgtggataattatccatgactgtggatccagcttgcttcacaatcttgactaaccataaggacgatattgaatgttgatccacaaccgtgatcgaaaaattgatgttgatcttcaaaacttcacttttcttctggtggtcattatttctcatggttgtgagtaatattcatgacatccatgaccgtgattgtttaaacaatgccagatttctcttcaaaacttccacaatttagtcctttccaagtaaattcttttgggctcttgtctcacaaactaacacccattaatgagttttatcaaataaaatatattaaaatgtatgaatatgacatgaaaattcacacaaagacaacaccaaatttgggttcatctaaatactgtaaattaaattgaacccatttgaatttttcttcaaagtttaactaaaatggcacataacatgacacactataggcctagttagaggattttttgttttgttaaagaggaatactattaatgtattcttttttttttttttactgagtccaattcttgattgctgttagtttcgaattgaggtttgaagtttgatgtgggcatgctccaagtcaaattcttgagtcactcattagtgatataagtcacaatttttattttcggcataattaagtgtatcttgtagtgaattatttgaaatcagaagtcttctttagtagaaatacccttcactctgccaaacatcatatttccagcttcctaggtgtttctgaatgcttgggaactggaaaatacttggagctgccctccatgattggaagaagaaagaagaccattctcatctatctgagggaccgcatctggaaaagaatcatccagtggtcctccaagcatctctcaaaagcaggaagagaagcattcatcaaatttctagctcaagcaattttttcttattgcatgatactttcctcttgccctcttccttgggggatgatacccagaaaatgatcaattctttctagta

SEQ ID NO: 5970 - DNA, 1226 bp, Glycine max
  Soy_ogl_5397 Gm16:31446701..31447926 Cluster 26
ttgtgaaggcccccagaccaaagaaacaattgccaaggcccagttttctttctagctatttgccaatagattagattggagaccactttctgggtagaaaaacaacaaattttttctctataggtcgattagtccatgccacagtttaggtaattgctacctgcatctccttcctgtacctaatctagaacctaaagttacattttgaattaatctaaaatgcaactttaagattaatccgaaatgtaactttacattctagattaccgaaaagactaatctaaaatgtaattttgcattctagattagcttttccggaagcttaaaaagttgcagtctagcatgtccattgaaaaaaaaaggattgggctgttttaaagtacatgctgcactttagaggtaaattatatacattctaactattcataaatatcccttctacaaagcaataccttatttaaccattcctcattacacatgcaaaacaagaaacacaagacatgtactaaaatcatgatattcagaatagaagctcttttactttctcttaccctcttgaccattatattagttgttgccatctctccaggctcaacccttcaggcttcagacacagggtctgcattttcttcaagttcaacccccaacttcttctccttggatcagggacaaacataaagagagaatacttcatcctttatattgtcagaaacatagagaaactacatcctcattcctctcttatggtaattaattgtatgaattttttcgaggcaataattaattgtatgaattgaatctaaataaaatttttgaggactgtttatttggagtaatagggaaaggttgagtaacgcttttagatgaattggttattttagttaatcttaaattgactaactaatttattgatcaatttgctaagctgatttgacaaaattattacaagttactctatgtctatgatttgctggtttgcaacagctggagccaggtgccaagtcctacttgtacattgaatttgaactcgttagaaatggagacgttgacaattaacatggtcacatggacatgattttgaagatttattcacttcgagcaaattacgtattgttcagttaccagtaacacaaagtagaatttggcattagcattttttaccttgggggaagggaattggaaataccagtccacaaatgattgacctttgttttctaaatcatgct

SEQ ID NO: 5971 - DNA, 1272 bp, Glycine max
  Soy_ogl_5460 Gm17:2345401..2346672 Cluster 26
caaaactctataacttgattcattctgcacatacacaagggactaattttacactacgttacaggatgtggtaggtttggggaatcaggttgttgaacttttagcaagaagtgagttttctgaatctgacctgcagatggagggggttccttgtattttatccttgaattaaatctgcgtagtcattaaaaaattgtaacatttgttgaataaagagtgatgtaatgtaagccatatgaatcaacggtggatgaaatggagtaatagcttgagtattatgtgacaaaaaggtactgcttcgaggttgaaggaaaattttactcaaacacatgtgtatgatattgtgtgaaactaagtattattgtattcctactttcaccactcagttgaaaacgtgatattattatagtgtgaaataatgattctgttcctttcgtcaaccttctctgtaactttccatcaatgtcaatactgattctcgattttctttacatgttttgcaatgatttgccagttatgttgctgttttttttgcatatataacatattccatgagtattttagttataacctagctttttatttatttatatccccagtataatataaacctcttaaaatggtttcgtctgggactttgtagttttactaaaactgtacagtaactaaaattcattctcagaaacgtgagacagtcgtcaatggatttgcagttcaattgcattgctctacctgcacaaaaagttacattatttttcctgacataatttaaaataaaaagttaatttctgattacatgtcttatttttcattttatctgcttctatgattttaaaataaaaagttaagttcagatttgaggaaaaaaaggtattgcatatcaagtatcaaccaattatacatgtttttattgattttaatttcctaaaataaaacttgaacgcaaatgtcacactggaatccccgtgttacacgtagcatcttgattaacaagacaacagctagctagtagtaacgaagttacatagttcacattaccaagtctatgcttgaacacgtgttacctgtttcttagataaagttgaagacaaaagaacagagcgatagatagacaagataaagagacaaggagttggtgcgctttcatgaagcaacctgcagcaaagacatgaatataatcaaaccctatttaattatttgaccaaacgcaagtaagagttgtgtttggtactgcagaagaaaatagatagattaaatatcaattttggtctc

SEQ ID NO: 5972 - DNA, 1200 bp, Glycine max
  Soy_ogl_5606 Gm17:9385501..9386700 Cluster 26
cacttttttcaaatgaaagctcaaacggcttgaagcaaactaatacttcaaagcatttcattcaccattcattcattagcatttcattcaccagtcattcattagctattagttggtcacacgtccgaagcagttcaaattcgaaacacgcattttcgcctctcctccgattcgggaagcctttgggatgggaaactttgttggattctaattgtcttgatctagtaagaggagagaatcagatacggaagataaatttcattttgaaagatagagatattccaacaggaattacagatttgtttcgtagtaccaagggaaatcgtgcagcataaaataacgaaccaaactagtttcagtatggatttatttacttttcctgaaactcatttctaccttttccggtagggaaattagtcattactggatgatcaaattcaaagctatgtctactcttccttgggttagttttgttcctcattttcgggctagagcttcggccttttcttgtgtattttgcactgggttttattaaagaaaatgtttcttggaccaattttttgtataaaattctagtgaaaaaaaaagaaaaaggtggaggttgttattggtccctacatcatgggggagatttttttttttcttccaaaaacgtcctttttgcggaatcatgattcctttccgttgttgtacccatgcaacaaaaatatgtttccactatttatatttttttttcagctccaaacaacacaatgaaaaatatattttcgttgttataaaaaaaatcaaaacatatttccgttgtgttatctgaaaccaaaacatgattttattctatattttttaaactatcaatgagactttcattgatagcacaagctgtgcaaaaattacaacgagagtagcaaatacacagaacctacatattcttaacccaaagcaccataaaaataaactgtgcttggtcgaaaataaaaaaaaaagcagagcacttttagagtatccataagtgcatctagctagtggcaagtattctagatattacaacaaagggatcggatctaaaattatacaacagatcattgcaaattaaagatacgaaatctacaaagaggagccacaccaccatgacaattacaattagtttaatcctgccaagcatacaacagaatttgtttgttacaccaccatgatttcgtt

SEQ ID NO: 5973 - DNA, 1000 bp, Glycine max
  Soy_ogl_5890 Gm18:2238301..2239300 Cluster 26
tccttgattgttcaatagtagattgacacttatctttcttaacccaatttcaaggcacacatgtatagataaacagggtagatacctcgttactattgctaaattcatccaaaataactcttcaagatggtgagaagaggatgtaatgtcatgagaataacattagcacctagatgagttctattgtagaaacatgcaccctcttgctgcagatactgattattttcatgaccaccacgggctggccaatttggttggttaatcttgatagtttggggctaaaccaccagagaaaagtatatcagtgtttcgcagtatggaataagcaacaaagttatgcatttattttgaaaattagcattaagaaaatcctaaatagtcacggataatttttcaagtcactgataatttttcaagcatgtgatactgattgttcacaatgaaaaggtaaaggagggaatataagatgctaatgtcatttcattgcttttgcctaaaagtagtatgatctgattgcaattaatgtttcttcttggttgtcactttgatagttgttctctcatattttgattgtttaaaccttctcttactctctagttaggttcaaatatcttgagttccattgatgttcctgtctaatgataaccgaactgtttcccttctgctgaggggtcttcacacttgtcctttccttctccttgatctgaatggggtagtccaagggattacctacaaaaggtactccgacacccaagttaggattcagctgagagcaatgtgtatgcacgattaataaagtatgtaatgcttgagaattgaacagtgtttatacatggggttacctcctttttatacaaaccttcatgggtcttggaccgtgagcctctatgcaagaattatcatctagataatatttgactaatggagattaggtgtcctaagttccctcttttccttaattaaaccgtcttgagtcatcagggttttaacgatcatatct

SEQ ID NO: 5974 - DNA, 1000 bp, Glycine max
  Soy_ogl_6529 Gm19:43421401..43422400 Cluster 26
gcttatttattctcaatcatttaaagatcattctttgtaaaacttataaatgctttgtgagaatttaaatgactatcgtttattgtttatcacatatatatgacagtatccgggtagcagtgactgtgtttgatggggagttctttaactgtctgtgaaggattcggacacctaattcatcgatatcactgccattttatttggcgttcgatgcttgacaggatacctacgaattgaaggtggacttgtggaaaaggggagttgttttacaaggggatgattacaagtgcccctttttctcacaggtagaagaaaccacaacacatgtactgctttcattcttttattttttgaatgacaaaggtgtgaactttcataaaaaggccacgaaatgtggcccccaaaagttaattacaacagctctaacatgatacagacatccttagcctagctatactgtgatatgtctccacagaaagtattgctatatcctaaggcagtccagtgggtcaatacaccaagttgcaaaagccaaacctctattacaaggtcccgaatataagaaccatgtccatgatagatgttgaatatgtgacagaatcgagagagcatgaggttctactccacgaaaaatagctctattccttgccaaccacaagcaccagcaggtgcagtgccataacatataccagagcttagctttgcctttacttttaaacaatcccccgtgttgttgaatagagttgtgctgtacaattgtgaatcccggccatccatacaccagagtccaaacttgatgtgagaattgaccttatagtatggaagaagctgtataaatggatgcaggtccaagttgtgttaccaaacaatatagctatgcacttgtggcatcgtggcaagatgattatgttcttcgagtaggaaaggagcaaacagtgggacgtggcatggggagcagccatgtggagcttgtggaagtgcaggaatgacattatcttta

SEQ ID NO: 5975 - DNA, 1400 bp, Glycine max
  Soy_ogl_6530 Gm19:43422501..43423900 Cluster 26
tgagtggattaattgtcccttgtcgtgtatctctaatattgaggtgtagttttgttgttgctggctattgctgtggtttgatgctgctagttatgcagttttatgattgatcttgtatcaccataatggttgagggtgtatgctgagtttagttgattatataaagggggactgtgatgtgggtttgtaaacgaactttaattagatactgttgctattttattgttcaaatgagggaattccttatgacatttcttgacagtgagatgttcataataaaacttctttgtctatccccaaaaaaaaaaatacattttcgttcaaactttgagaagtttggtgatcctgaaaggacttgtagtaaaaatacttttaaataaacaatgtacacacaagtaggaagataggaagagttgaatcgtgcgtacgtaaactttgaaaaacattttacaaaatttatactggtttcctcttcaatcttcaactaattaagagttacatccaatctctcacctaaaggatttgcactaataaaaaacacttacaacaaatattccttttatactcatgatcacttgatcacacttcaatctttgccgaagtcttccttttatactcatgagagaagtaatcgttggcggagaggttcttcttgttctaattttcatttaatgcatgagaaagccttcacgttactgtaaacatggcttgccttttcggaaggagagaaagaaggtgaaacacgttgaattaacagtttgcctagaagatatatatacaatacattcccatcttaggtaaaaagttctttacgtttttcctcctctttatcatgcaacaaaactctattaacctgttaacaactaataagttaacatggtcttgataaaactaagaggtaaaagcaaagctttgttgctttttttaattaatttggtaattttgataaacttatcgattgtcgaagcactaagccaattttcaaaagcatttcccattgattgatgtataaagatattgcttaagaacacacgttgggcgccttttataacagagctagctatactattttgtacgaaaatatatcacactaatttgcacgagaaatacatgtatacatttcagtggatatttaaaagataaaaaagttaaattattaatttgctgtaaatcaaataataacattcgtacatgacttggtggattgtttttcgtaagaataagcatttctctttataaaatacgtagtattggacagttcaattgacaaacttgtgttttggacacttttgttttatgaccatattttagctagaaaacaagtatgtctttggacgatctctatttcctttttaataaatattttattttaaaagataattgtccaaagtgaaaaacat

SEQ ID NO: 5976 - DNA, 1165 bp, Glycine max
  Soy_ogl_6532 Gm19:43481936..43483100 Cluster 26
aaatatcgagatgggaggagtcaaattctctacaccagcaataaatggcgctagctagttctgtaaataatctggaaccagtgttatttgtgtaataatttcagcaataaatggtgctagttctgtaaataatctgaaacgagtgttattaatttgtgcaataattttttttattttgtattactgctataaaaaattcaatatgatgacggggtatgccacttttctgagttttgttattagattaattaatcacctttaatttttgtggatatatcctttcatttccccttaaccaatcctgtgtgtttattcagtgaagggaagataacacgcattagattactagtaccaatgaaagagatatgacgatgtctagaatcaaaattagggtttgagaattgagagttagttgagacgttggaaaattggaatgttagttgagaagttcacgcgtggggcggtgctttgcctgcacgatcaaaatttcattaccaaacttgattctatagttatgactcacagttgtgtacttgtacagtatgtcccacatactcaaattacatttttatcctcacgttattaatacttctatctgtcatttcatatgaaaaataaacgaatatgctatgtgatttcaactatcagacttttttttatatataaattatccaactttttcattggataattaccaagtatacatatttggcagaattcaaatgatcaccatccagtaaagacctatctcataaatctcaaaagagtagaaatctactttaaaaaagaaaattatgatacattatagtatttttgtttgaatttatgtaaaactataggaacaacctaacctgggctcctaattatatttccaattgtatccatcatttaattatcaatgggaagccataaccctatgttttgtaaaaaaaaaaaaaagaaactaacatgagctcctaactattttttggacaaaacttaaatgcagtatcataggtgctgacatgctgttgatgttattcttctattagattttacgttttatcttgataattaatatgcagtaacatttaatgaaatattttatcatagtgtattaccaatgcgaaactccaattctgatcgaagaacaacattattacgtggctgcatctagggttttttt

SEQ ID NO: 5977 - DNA, 1000 bp, Glycine max
  Soy_ogl_6587 Gm19:45195201..45196200 Cluster 26
aactttgttaccaactagaggggattttgttgaatttggtctttgtggatttctcatagtcttaggttgtcgcctgacgtggcaacgaggtcaggattcgtgtcacctcgtaagggtggttgagcaccaaacgagggtcggaggtgaagttgaacgtgtcgtggttgaagtgatggacaagctcaaccttgttggtgtagtgttccaagtaactaccaatggcaaagcgggggcttttgtcgcggcgcattgaccatgctagagaggatattagccactgagcaacgtggtgtgcacgccttgctttggctctgtatgtatgactttgcatggtaaagttattaacttcaatggaatccatggaaaggccaagtaataacttctgcatggtagattaattggcatgtgcagattacaaattcggttttggttttcgttttaaactatggtttattacattagatatatgatatatattataggattagataactagcttttagtttgtttcaattagaacaataatgattaattatgttgaaaattggttaacaaactaactaattttcaacataaaactaatttttacaattattctaacccaaaccaactattttagttcgatcctaatagtatgatattgcacaatttatgtgtaaattaagtattatttataatcttgctccatatgttaaatcccatgtaatgatcgaaagacctatatataatatatagacatttttataaatcaaacactttattaacacctcttttttctcttacaaacaatattatattgcatatcattcgtacatttctctctttctttctttgagtattgaacaaagtttggtatctataaaacgtttactactccaaattaatgagagcacacaattaattttctggcaaattaagaaacattaatgatgtccttaagtgtgtgtatgtttaataactagactgaaaatagaaacaggaaatcgttaagaaactaaga

SEQ ID NO: 5978 - DNA, 1100 bp, Glycine max
  Soy_ogl_7009 Gm20:45747501..453600 Cluster 26
aaatattgacttaatggagcaaaaaaaaaatgatttagtaaaaaaatgttaaagtcacatgcataacatatgcaataaatttaatatataactaatatttttttataagtaaaagaaatatatcactattaaataatagaggcattggccaagaaatgcaaccaatatataagcaactgctgaccagtagcaaaacaacaaaaagaaactagaaagaaaataataacaacactctcaaaatttaacaaatcaaactagcataatttataaatagttgaacagatctggttaaatgcaaaattgaatccctgtacgtaaaaacttactaaagcagtcctttatctttatatgtgaaaacattatcgattttgtctttgcagttgtgacgttctttatgcattttttatttggtctctatacacatatgtgcaacacattaatccgatccttaattcctaatcatgtaatgcattcttaatttagttacatgtagcgcaatcttaattcttagctagatggaccaaattaacaatgggtaaactgctatctgttgcagtaagattgtagaagttccgctttgagtcgatgcgcgtgctctcgtgtactatctttcctgatttgaatcccttccagctaggagttcatgtgatgtgtatattttgtatgggcatgttattggtgtcgtttagatgtgtctattgtttaatataatccacggcttgcctcctctcttaccttgcacattttaaatttttgcattcaggtaggaatggagactgaaggtttgtcttctcaataaaatgaggtttgtcttctcaataaaattaaacatcacatgactatatttttgtatatctgattatcttttatcagtgaaagtattaatataacgagacaattgtggaatgtcaaggaacaaagaaaatgagaagaatgaggatgtgagtgtgaccacggtaattaattgtaagattccagcagcaactgttggggtgttgtattcataaattgtgctgctggtagcacagtgagtgacagtacctttgatgaatgaagcacgattcaacgttttagatataacttcagtcttcatctgaata

SEQ ID NO: 5979 - DNA, 1149 bp, Glycine max
  Soy_ogl_4573 Gm13:39470952..39472100 Cluster 26
atttaatataggcaattgctatatcaacagaccaaagtcaccaagcagactcaacgacacatttaatataggcaattgctatatcaactcccctattttactaatacactctccattttcattgacttttcccaaactaccctgccaacaaaacacactcccctcttccctgtctcccctaatttaactcttctggaaaagaaaaacaccctcctgacaattaatatataaaaggatagaaatataattaatacagcattcatatgatgatgcatcaccctcggcattttagattacaattaacctagcgacatgctaattgctaaagacagagccgttgtcaatatgaatggaagcaactccgatgacattgagatgaggatcaatgacacaaccttcaaactagtgccatatggtaccgattgttcagttgcagaaatctaacattcaagggtagtccgtttgggcaagggaatacaaaaagggaaaaataatgcaaaactagatgatgatgcaaactcaaagatacataaccctccacattttagatgatagcaatcaagctttcaatttcattttatatgataccgatgaaaaagtaaagcattattgtctcgtctctggctgtctgtacaatgtgatgatactctcttaaaaatttgctaaatcaaatacatggggtcagaaccaaaccgaataacactaccacaagtttcttgcttttaatgccaatcctacctccgattttggtgacaccccccacctaacggagccttctgctgccccattcgccttcatcatttgaaaagcctccacctccgttgatttttgaagaagcaagtctgaggaagccactggagaggggtccaaaaatcatagaaatgctacaatgagcaggcaattaatttgtcaaattaattatatgagagggcgaaagagatgaggggagtgtcttttgcgggatagttaaggaataaaatttgaaaggggagtggattagcaaaaaggggaatgaaaatagtacttgccctaatataacaagggttgaccaagcaacaacttgacagatcaaactcaaaaaaacagggaattgctttgtgcacagtaaattgctagtacacccaagatttgtaattctaatattatcct

SEQ ID NO: 5980 - DNA, 1600 bp, Glycine max
  Soy_ogl_3698 Gm11:2809701..2811300 Cluster 26
attctctatccttcttactacttattttattgtgcaatagggaatgggaagccttttcctggctgaccttatcagagtcattaattaataaatacaaacgtgccaaataaaaccatatttgaggcaaaaaggctaaacacgaaggagataaacacgggaagaaagataaaaagaacttcgagttggattcaatcaggctattgattatcattatatctattatggaaagttatgtttgtaagttttctaaagggtgcttattataaaatctttatgagatttttatatcaccgttcacattcttatcaatctatgactagatagctattagtataaccgtgagcaaggatggtccaacctatagagagtggcattaaaatgaaattgattataaaagttcatggcttttattgtaatttccatctagaattttaatccaattttgtttttatagaatttcatttcaaaattaaaatctgatagtctagaaggactgaaagaaaaccaccccccaatctaattggggttggtgaaatggtgatcatgtgtcaacaacagggatgcccttttgcacaactagcaatctaaaaatggctagaaacttaaagaagagagttagggggagatttagatctgaaaatattgagattaaaaaagaaaaacttggattctaattgtgccaaaaccaaactacgagaataaacatcagtccaggaatcgtaaatgtacaatgattttgtttttgttactatatataaagtgaaatttatacagtttgtttttgtcacccatgggaatcccaagtagcatgttaggcacggatgaaatttataatgcaggaacaacctttgtttcagaaataaagctagtcatgtgcattctgctatccccctgataattgcaaagaccaggatttcaggtaatgccgaattcctccatttctaagtttgtcatcaggaggcaacttgggattagggaccatccaaggaaatctgacaacatcatccccatctattggaatcctccgttgaggggttggattacaaaggggaattccttggctacttctctctctttggggatatctaactctttgattatagcaattgaaaccgccaacaacaaaggctggaatgtaattcctctgttgttgtgaaagcttttgagaactcggacttagtgccctgcttgattaaaaatagatggtgtaattgtatagaattgacttcttttatgagctttttcttaggacatctttagagtgaaaaatacttgtacagatcttcttgccagtaaaaactctgtttctaacggtttccgttggtggaactcggtccctcaaatggtagttttagaattgaataggaatagatatgattttacaaactacagtttagatattgcttaggcttggttttgccccccctgcgtttttgttcctatcttttctatttatatgtatttcaggttggctgtgtatgacttatcagtgttgagggtgtcaatataattgaaattttcaacgttactttgcctcagctaacctcttttcccttaaaaaaaaaataaaaaaagtagcatgttaggcgtagttggtatc

SEQ ID NO: 5981 - DNA, 1423 bp, Glycine max
  Soy_ogl_4454 Gm13:35027301..35028723 Cluster 26
tgttcattctcatatcaaaatttgtctcaaggtgtacaagtctttgtcaataatatattattcaattcgttggttcccataatcaacatgaaacttcttcctcttacttatactccaataatattaaatttgcaaatacataatgactaattaaagagaacagaaaggtacagaacaaacctttgcttttgaaacccgagccaaacctttccttattagtttctctagcttctgtaattcctgaatttttactcctagcagctcttccccattcaacttcctgtcaaggcaaaacaatgcttcagaagtaaacgaataggtaggttagtgcatcacagagacaaagtacaaagtgtgcacacagcgtatatgtaccttggctcacgagtcttgtctgcagtagcacatcacaacattcttgtagatgtcactgtcaggccatagataaatttccatgaaattttcattcatgaattttgaatttattagtatgcatccttttccaatctctggctgctattcttgtctttatagagtccacaatattcttgtcaagattgtgagaaacttgtaaaccttgaactctttgaatagcttcttcagaatccgaatgaacttccaacgccataaaacctcgttcccttgccatgttgataccatgaagaatggcccacaactccaattgagtaattgaacaagatttcaggttgcaagcaaaagctccttgaaactttcctgtatgatctccgataacccctccacacgctccatcgacattcagtcgcataaaacctagatgaagttgtctccaacgtaacatagatgcttccgtgtgatggtaattatagcttccagctttgtacagattgtctccaagcctcaagtgatgctcaagatttatttatctacctaacctcctcactgtctcgaaggcaatgcatcactgattctggctccttattacacaacaggcacaaaaactccaaagtcatcttcctattccagtgagcaaggttggtaggaagagccctcctagcaatcttccacctctcatatccttcccacctccaaaccagaataaagataggaatactctgtctaccatccaaattggcaatcattttgtaagctgatgggatatctaacacacctttattactagctctccaaattaactcatcatcttccacatttccttcacacccagttacaaatttatccctaacagatttgattactgaccacagattagagtcatttctagctttattcacaacaggaaccccaactccccacaattatacttggctctaataacttgtacccacaaagcatcatttttggtacaaagttcccaagccactttcatcgtaaagacatcattaacatgacgagcctgtcgtaatcccaaacctccaatctc

SEQ ID NO: 5982 - DNA, 1000 bp, Glycine max
  Soy_ogl_5 Gm01:469901..470900 Cluster 26
gcataaaaagttatcattatcatccaataacaaaatgtaatatctggcatatgaacgaaagtttatacttagaacgcataaattaaagtttaaaaataccacgtatggtaaaaagtatatttgaagcagcatgatttggcatgatggaaaaggacatgaatatgatgaaagcacttaaggatcatcgaaagtaatgaagagatataattagaagcagatgaacgcgtcttgggtagagaatgtgcagccctattataccttcccgcaggacatggttattttaattatttatatatagtaccaacgacccaatcccttctccaaagagttcaatgatagggctccatagattagaagcaagacatacaatcatcaacaaaagcttctacaaattaaacgcactacagactcagatcgactccatgtaaacactccaaaataccatacacattacatagcaaagtggtagtgttcatccctaataaattattaatgtattaaaatattaacgtgcatgtgatttcttttttattaacaacccttttgttatggattaatatttcgtagatagattcttgcatatttttatgaaattattagattcagaatatgcaacatgacatgtgtaagtatgtccaagaaggtgtacgtttgaaagagtttactgaagataataatctcttatttttttaaaagaactactaagcataagtatttttttttttttaatattgtgttgttctcaaacatcagattcattttttcgtgttttatttttcttttccgaaaaggtaagtgaactctgtgacaagtcaaaaatatccaaggatagagaaacactaaacaacagaccaaacaagtaaaagaggtgaaccgctaatctcactcaagtcttcacaaaacgtccatttcaattaacgtcaacattttccatcatgtgcaaattggtctgtcacagttcccttgtacagtttttacgttttgagaatgttccattttg

SEQ ID NO: 5983 - DNA, 1300 bp, Glycine max
  Soy_ogl_624 Gm02:43112801..43114100 Cluster 26
tagtgtagtatcgcttcagaacagcactagtaaaccttgaacactcctcattcttgtatgttaaagaacacaacgacatctgtaatttctaacctaagactaaaaattttgtgttctgcacatgttggagcaaaaacagtgttccgcaccgtccaacgaagtcgtcgaggccgttgctcccgtgacgacgtcgttttggcctctttcgatcgacgtccaattctccctctggagatttcgctctggcgtcgtcgtctttcacgaaaacaacgacgtcgtccggctcgaccttgtagcggcagagcgggcacgtggagtatgcgtcgagccacgtggaacgcgtgcttgcatttgggcaacagcctcaaaacctcaggatcctcaaacctggcgacacagaccgcgcaatcaagaccgttcttttgccccctcagcgacccaaacctaaaaaccggcaaagattccagaacatcacggtcaatgccggagttcttccgcacgtgcgaaggccgggagttcgtggtaagctttaatgtgttggtgttggtgtcgtagcagtgcttgatgtagatgaggaaaaggaaggtgagacagaacgtggtgattaacacggccaatataacgcccatgcttagattgaaggggtccgaataggaatagggaccggttgagataaccggggatgatgacgtggcggcggtgccgtcgtcaccgaggatgaaaggggtggttatgagaatgaggaatgtgagagcttggaatgggttgaaagaagttgcatcacccatgtagtagtatgtcatatgtggcaattagggaagtgagactgcatgtgttttgttgctatttgtttacttgttttagcaatgtgatgacactgtgttgagatgcctaggcataggtgttttgaacagattattttaatcacacgggcgaggccctttaaaaaaagacgtggacgaggacttcaagagggtgaggctttgttgggagagattctagtcattctatattgtaggaattcacgggaacagaaatggtatttgtgcatccaaattccaaagtgctagttgtagtttgatacctattacctaataagagagacaaaataatgaatgcaattaaaacaaataataagaattaattagatatttaaaaaataggttggtaaaaaatcatttctcttcacaagaaatttgcgtatgcacgctagtaagaaaaaaagacaattgtctttaattaacttctcaactttttctttttttatgaaaggcaggtatcttattgtaaagtcatgaaa

SEQ ID NO: 5984 - DNA, 1161 bp, Glycine max
  Soy_ogl_693 Gm02:46263540..46264700 Cluster 26
tttatcttgcaaagattaaggccgaaggaaaaacccttggggagaaacttgaagtagacaatgagcatttatatcatctacctcctaaaagactccagcggaaaaaaatactcttttatcatacactctcattttgaaacaactattctgaaatatgatactcttccaacataagtattcaaaaatataattttttgtattctagaatgtatgttccggagtacgattccaaggtgcttattctattatggaatatgaaaaacaatattcaaggataactattctggaagagtactctatttcagaatatagttttttgtattctagaatgtatgttttcgtattccgaaaatgtatcttattctagaataggcggcatgactctccttcctttcttcaaattcaaacctccatcgggagtgctccctttggcaatggtgttctcaaagatgcattcatgcgccaatgccagcatgagcttctctagcatcccagcgcactccacaatggtggaacacccaagtcccaatagaggccttcatggaggtgttgtcgggaatgaaggtgaaggatccagccacaacaatgaatgcatgggaggcttagcagcgaccattgacgatgttcgggtcataggacaaactaatctagctataaatgacacccaaattaaagagcatggaggctttctcaagttagatgctctattgtgaggccttttgcttgggcttgaagtcgttgacgtcgaggagatagggaaactcatctcccttaggtagaaggatttgtagtaggtttggaggaggtcatgacacgtcaggagcaacgaaacagagtagtgctccatgtcaaagcggagttgcttcaaggtttgggaggtgtaggatttagattgagaggtgtaagatacaaatgaccaaacaatgatgcaaatgtgatgggacaaatttaaagcatcctttcctttttaatttccttttgaacaattggtagttataattactctttcgtgtttaattcatgtgtgtttagtttatgttctttcaagtttttactatcatttataagctttcattatagaattaggagagggtataaaggctaagatctacggcagccagtaatgtcacaacaaactaggtggctaatagatcttttatt

SEQ ID NO: 5985 - DNA, 1000 bp, Glycine max
  Soy_ogl_1744 Gm06:549801..550800 Cluster 26
ggttgagttttttctggaagtagagatagaggtgttggagatgcaaagattttggcgggaagaaacggtccagggtttgacttgggtgggaaggttgtggagagagaagaaagtgctgttgttgtagggtatggaaagtgaaaggagagagtggtggtggaagccattgatttggtgtgaaatgcgaatggggaagttgagcataacgtaagggattggtgtgatgcaagggagaggaggaggagtcgtgggtgaaccagatgccatcgaggagccgtcgcgattaagaggtgtcttcgttgcggaagggagacgtatctcataaagaaaggagaggtgcatgatacactttaagaagtgtaggattcaaaaccccttcatcaaattttaaaagatcaagatggaatatttgtatcaagatatcaacatacgcgttgtcctttgtgcagttttaaagtctatcctatatcgtctcttggcaagcgggcatttggggctccttctcatatgactaaatgtcaaaacctctctttatcccaagattcatattattaccacagattcccaggcggggatagttcacttattatatcatctattcataatgagcagaggccatattaaagttagggaatgcggactgttattatttacgtaaacaaaaatactttatattttaaagaaattattagattaatcatgaattttctaaaataataaatacattgactagttaacattaatgaattttcattctgttagaatgttaggtttactagaatttcaacaatatgtatatgagaaaatgctcgactcacaagcatacacgcacgtacaagaaggtgaaatggtccatgagcagaatgagagattgaatatctataaagttcatttgttactctcatgcttgatggtagtcatgcacaaaagactcattgagtcaaaaagttattccaagagacagaaaatgcgctcttgagcatcccgagtgttgtcatga

SEQ ID NO: 5986 - DNA, 1235 bp, Glycine max
  Soy_ogl_1843 Gm06:8063650..8064884 Cluster 26
ggtgaactcacaagctgtgaatttagctgtggaggcagaatcaagtgcggtgaaggagtaggatagttacgaggaggtgacaaaccttttgaagacaaagggaacccacataaagggaattgtgaacccctggcagcttccaactagattaacaagggattgtgacgtggaattttcttttgttaattttgtttgtgttgtgcatccatacacatgaatgatgaatcgtattgtgcagactacttgcacatgttagtttgtatttgattcaagtttgagggttgcattgttaccaaaataatataatgtttgtgcttaagaaatgtgcacttgaagttatattttttgcgcttaagaaattcaattaacattttcaatttttatattttggcttcctagaatttcatccctcatcatttcttccataactcatttgtcttgatttgaattttcgtttggcttcagtaacaaccaaccaatcaccgtacagatcaagcttcccattaattacgttcgtcaccaattttgcattagggtttgcatggctaacagtttctttttagtacgcatctccttttgtcttagggttaggtccaacaaccgtcgtcactttttgtgtcgcctcatttcttgcataatttctcacattgtggaaatagaagccacatctctttacaacatatgccaacctttatattccatatcaaaccagtgatttctaaaccatgttttccgcacaacgcacagaatcatcaaggtttttccacatatactctagcaaacctttcccttaatccatccatcgtccttatatatgtctgccattactagtttctcaacagttgtgggcaatgccaaaaggacactttcaccacaatattctgtagttaaacttggagaatgaatccaaaccaaggttgaatcaatctagataaaacaaaatccaagatacataaagaaactgtcattaatataacattttggctttaacctgtcatcctctgcatactcaatcctgaacatatttctaccaattaaatccacgttatcgatctctccttagcaatggtgtctgccactgccaacctagtagcttgtccttgaagaaaactttttgttgactatgtgccctcccctttacatttggtatagtatttaaataagtcaatatacatttttaatattaaatatatattttttagtagaatgtttttaaaaaggacatgtttgtaata

SEQ ID NO: 5987 - DNA, 1033 bp, Glycine max
  Soy_ogl_4292 Gm13:26971868..26972900 Cluster 26
tatcctccaatctacagtaccttcatcttctttaacatgcttatttaactgccctgctgcaaagcattgatatgcccagcttgaaagatgtatctccctctgctgaagaaacattcatttctatgctgcatctgcgacacacaatctccagtagtaccatcccaaaacagtaaatgtcaaattttactgatatcggtgcatccttctgccattcaggtgccaagtacttgcttgtctcatcatcctcagacacaagagttgaaacgcaatacacaaggatagatcctggtgctttacttgttccaaaaactttctggatttccccttctggtaaatttgcatttggtttatatccgcaagggctaggcaatgtctttgtggttgcaatttggttggttagaggggagagcaggacagtggtatggactgcaaggcgagatgatcctccggtcacctcaaatgcaaagatacaactaaccatgaatggtaagctcgtgctaatagatggccaaggaaaagagaagcttattgcagattttattgcaaaagcttccttcgcctccatctttgattctggaaactttgcactatgcgacaataattccaacacatatggcagagtttcaatcacccaactgacactttgttaagggatcaatctcttcctgatggacttaaactggtttctagttcatctaataaaagccactcaagtggacgatatcgtctcacgatgcagaatgatggaaatcttgttctgtatccagtaaacacaactgacacatcaccggatgcttactaggccactatgactttcagtaatggcttccaaacttgtctttatgtcaaccaaacaggttcacagcagattatgaatagtgacatgagccataagaagattgtcaatgacgagtcatctttgcccaatgacgggaaagggatcactatcgtgcaaccttggattttgatgggatattccggctgtatgcgcattttaacaatggcaacaaaatgcatgcggactaaaaggcct

SEQ ID NO: 5988 - DNA, 1600 bp, Glycine max
  Soy_ogl_5406 Gm16:32112101..32113700 Cluster 26
gaaagtacaaggagagaaatatgaaatgatacaagctgaagcaaaagaaggtttgaggacaaatataactaagggaaaagatcaacaatgtttgcaagaagggacaagtagaggaagatatgaagcaaggacaacagcaagagactttcctatgcaaatagtagactcacttgcaacgacaagaaaggaaacaaaggacaaagagatagatgagccagccaaaagaaagagtgaggaaacagatgttgttgagtctacaattgaggaaaaagttcaagtgcctgagagtggaagaatttccatgactttcaaagtaacagaggataaacatccaaaagtattagagattgaatctcctgaaagtgaattgcaatcaactaaaggcccaactacacgtgcaattagtgtggaatttaaggaggttgaacaaacgagtgcaaaggataagacacagaaaacaaagttgttacctccaaatattcaaagcaaggagactcatgaatcaaacgaaggaggtgtgaaacaagacactataaaaccaaagaaagaaaaggaagtagaaggagaacagtgcacttataacattgaaagctctaaagaggttgcaaggttttcatcaactcaacaaaccaaagttgaagaaaaagataaactatatgaaggtggcaaagcaaaagcattcattgaatcaaaaaaggatgaaaaaacaaaagatatgaagaatataattgaaatgaaggatagtcaagaatcaaaacagaggaaaactttgaagccagaaattcctctagaaaaacaaataaagaaaggagaaccaatcacaagaaaagatcagtttgccaaaggacaaaaagtcagggagacaatgcaagaggaaatcgaagggaataaagagaaaattgatgacagtgatcaacatgtgcaaagagatgtcgtcaaaggagttggaaaagtaggcactacaggaaaggagatgcccaaaaaagaatatgtagcagatgttggccttgtggctaaaacgatggaaacgaaaagagacttgaaaacaactcctagtaaagagaaatacacaatagctcaaaatgttaaagatgaaaagccaaggatacaagaagaaaagataaaggctgatgttgaaaaggtggataagaaaggatatcaagcaaaagttgtagaagaagggatgtcaaaaggggaacacggagcagaagtagttcctgagataaaaagggaaaggccaaaggttgcaaagagtgaagaaacaaaagaggcttccaaactaccactcaaaagagagatgggaaaaacaacacaaagtgcagaagataggaagcctaaaatgggggaaataactaacgagtttgaaaagactagtggatccaaacaggctgtagaaaaaatgcttgaaagtctcaacagagaacatcaaaaagactcaaaagaagtcacacctaaaaaggaggtggaacctctaacagtaactccaaagcaaggagttgaaaaatcaaagaaggaagatatgtcacctatgcctaaggcaatccaaagaaaagaacctcataaattatcattgccaagcaagcactataaaattccaaag

SEQ ID NO: 5989 - DNA, 1700 bp, Glycine max
  Soy_ogl_6503 Gm19:42278801..42280500 Cluster 26
aaattaaaaaggagaccaacgtgtctcaacacttcttttttgtcggcaaaaaaggtgcaaattaaataaggtaccagaagtaccaatgtatcaaatcatatcacaactgaagccagaactcgcatctagttaccaagcattaacaccaataaggagtaactacaagataaccaaaagatacccgtggccaaaagcaaaagccaccccactccagcaaatgacatatactcgagcctgtttctcctaaatgggataatatacaaatgatgagatcgagtaggccaaaaccaactggctaggatacaaataaaataccaacaagcaccatagaatttgacaaaatcaataaccccaacacagaaccacgtgcacacttcatcattgtatctatccacctcgaatgcaagcagacgggttgtaggtccattgaacaaaagagaaatcaaaacctgacagcttgccattaagccaactccatgagaacaatttaacctcctccaacaatgattttgagtttacgacagtgtgattgaacatactgttgtttctctgcttccatatgcaatatatcactgcacaccaaattacttgccaaaagagtccttctatatttccatgtagtacaaccgcaagagtaggtgaagtccaagaataacaatgtaaccaaacctgcctagccacttcgcatgaggtaaaaagatgatccgcagattcattgcaagaatggcataagctacagagaaagtctgaattttcctctaagacactgcggctcctcaagttgtcttttgttggcggtcagttcctcaaagctctccaaattacaaaagcaattttatttggaatcttgatttgccacaaccgagaaaaaacgtcccttgagacttcttcaccttcaatttgaactaacatcttatatgtataatttgttgtgtagagaccggtgttgcacccttaatttccaaacccaagaatcccttccctccctgctaatctgaacattgtttaaagaagcaagttttgaataagatcatttcccattcaaaagtacctcttctcccctttaaatctcaacaccacctattctccctccaataccccataccaccaacaacttcctccttttgttctgagattaaaaacaatctaggatacaaagaggccaaactattgtcattcactcactcatctttccaaaatttacatttatcccccactccaaccttccactcaaaaccctcatcaaaacatttcttctcactccttcccctacaaaccttctttatgtccctccaccacaaagactcccaagaacactctcctcccctctcaagaccttgccgaccctcatattttgaaattgatacttctttccacaaaccacccctttgatggaagagattccatctccatttccccaagaaaacatcattaaaagagatcaaatttttcacttctaatcctccctcgtcattacccttacaaatatcactccaactcacctaagttattttactattctcatataaaaaatctcctttggatcccaacaagtttcttccatacttccttaagcattttaaaaaaaataaagataagtagaaaataagaaggaatgacaaaacagaattgattagacaaactctcccccaaatgaaatgtgcttgtgtttccaagagataatttcttagagaattttg

SEQ ID NO: 5990 - DNA, 1000 bp, Glycine max
  Soy_ogl_2972 Gm09:3590101..3591100 Cluster 26
atttttttctcaaacttttcagaggatcatggggaatcaaatatgtggaacatctttagaaaatggggggtgcatggtacgggacttatttatcgcaagaaaaagaacaaaaacaacgttaagatatggatccgtacgttttgagggatttggaagggaagctggaaagcattctgataggcgatagaaaactacgtgtgaatctaccacgctaagcaaagatgagccacttcaacaggaaaacaaacattccactttggaggagaagtagtatctagcggcacaatcaaatcgtagacaagggatgtccttattcttaagtccttcaacagggtagggttggaactacttctagagtgtggaaaggctaaatatagggtcgaggactggaaaagtagggaaatgaaagtcaaagaatcacatctggagtggctgaacaagtgaatggtggggagagagattacaccaaccgcaacttatggtagatgtccaagaagcttttcttctggatacacaactataagggagtattactctctggtgaggaggagtacaatctgatgatggacatctttgaaggagaagatgcatggttagagaagttattcatatcagttgtgccttggtgtcaggaagacgttactgaatgcagatttgcttggctaagattctatgggcttcctgtaaatgtatgaaatgaggaatgtttcaggcacatagaaaagaatgtaggttcgttatatataaacttaagagacaattatcgtcttggcagcataaatacttttcatttggagggagaatatgcttgctaattatgtcggttttatcatccattcccttgttctatctctcattttttaaggctcatcggaaagttattattaacaaaatcatatccttacagaggaatttcttatggggcgcgaaggcggaggaaaggaaaaaggagtgctctcatatatagggaggaaggtggtctgcgtataaaggatgtgga

SEQ ID NO: 5991 - DNA, 1137 bp, Glycine max
  Soy_ogl_3443 Gm10:38097131..38098267 Cluster 26
ggttactatcaataaaacattcgagccatgctattttgtacacgaaaaactattttaaccaatctaagacgcattaccatacatagtaagagcaagaggttgaaaatttatttctaataaaacttttccaactacaattcgtgcaattcgctatctgattgtacaatttaccttttccttttctatgtgctggctggtttagagttatacctcattatgctaattatgaggttggttcagctagagttggtgttttggtattattcaaatgcgttccgtgcagcttatgtggagaactggtctggcaatattaaatttataagcttatgagcaatcatgaagttttgggttgacattaatgtcagactattggactctggtagaagatgatacgtttattagaagccaatttattagagaatttggtgtgcttcccgaaaagttggtatgtttcatttgaagcgaatttattagagaaattatacaagttcaggtaaattcattttaatattactgagcatttctgatacttctatagaactgctcaagtaatctatattttatgttaagaacataatacttaaaaatgaaatcaattatttactctttctttcttcttcttttttttgcattttaatccttagataaatagttaatcctacacaagaacctagctagctcaccaacatacttcttcaccaattcgcacatatccaatgaccaggttgaagatgaacactcattatagtttgagtgagcaacaatgctgttataatgtccctcagctagaaaagtgttgatcttaattcttatttggatcaattcagcgacctcaacatcttccaaattaatttaaaggttcatcaaaatctcacgatcacgggttattcaaaccttaaaatcacgtaatacggtaataccagcaaaataggaaattaaaaggtagatcttcactacccactatttccggttcatatttcaacaccgaacaattctttctatcatttgcttaggctctctatctccaagcaattgctgtacgtgccttgtggaataaattaagaaactaaaatataaatatatgttcagagaattaacatacaaaaagagcatcaataatgcaccgtaacattaaag

SEQ ID NO: 5992 - DNA, 1017 bp, Glycine max
  Soy_ogl_4373 Gm13:30899784..30900800 Cluster 26
taacaatatatcagaaaaatattagagtaatatctggcaaataaatacaaagcagtttggaagaacacatatctaattattatatttataaatcaatgaatttggtcgtgaagagttaacattacccagttctaatctatgacagtgatcttagatggcctaaagtactaacatgataatagttatatggaaaactcaatcatctacttactataagatgattttataatttgttattctgaaatgatggcattcaagtatccaggaaaaccaataatacctttttggtagtagccaactcttcaccaccatactgatcaatccctccacgtcaactctgatatccctccaccccaacgctacatctccaatatccttatctttctctcaccatttgaaccctatattgtgattatctaatcccttttctttctccctgtgatttctttagaacccaacactctccatctagctcgatttctttcagcctagtaaccccaacaagctgacatagctattcaaaactaaacacctctattttcaattcaaggtttatctctcttttagtgtgtggagtagaggaattccacacaattcatctaaccgtaactaaaagaatccggcaaaacctggcgagcataagagcaaacaaggctgatcatacggtcagggaggatggtgaatccattgaattatcaagctcctcttccaagggttgcttcttcaatggcgaaaatgtggagaagatcctacagaattagggtgagtgatgtgattgatctttcaaccattatgacgaatggaccttgcaaaaaggtttaaataacacctggaaattaaaggggacagcttgtggaaaaatccggttacaagtctcaaattaatgtttttttatttaaagctaggaacaaaacaacattgctcaagactcataaatcccaactagattggcatcataaacccaactagattggcaccaggaaacttgagatcctatgccatttaatcccaaattta

SEQ ID NO: 5993 - DNA, 1400 bp, Glycine max
  Soy_ogl_5328 Gm16:5733001..5734400 Cluster 26
gattagggttttcttcctctcaaaggtccataagttctgcctcctccatatggaccacataaggccaaaaatttgtttaaaaagcctatgtcctttttctcaaattagaatgataaccattggttgaaaagggtatgatgagtgccaaacctcaaactcagttggctaacaaactagatctgttgagctttattgcaataaatcaagtagtgctctgtgaacgcacacattggatcaatgttacccatcttcttgtggagattttgcctaactgagatgatgattttacaaattctccaaaccaagttcctacatttaggtgctacatttactttccaaatgtctttcctaaaattacctaatattgcatttgttgttgcttctgtttcagagttttgttccacgactaggatgtttttggcatccgtcaggggggaaatctcctagatgagttgtttcttctaggatctttggtccattgcttataagatcatacacagagagttgctcttcaaactcattcataagagatccatacatttgtccatgctatgacctacaagccatcactaaccatttcaaagctacctttgttcgccatctccttcacacaaaagatattagcccaggtgtagcttggaacataccttttcttcgcattcagagcttttgaaccagggaagtaacaacctttaaaagctgagacataagagtatgtggttgcaagatcaaccgccaccattgcttccctagaagatccttgttgaaagcttgaaccattcaaaagcccatccccctcttcctttgggcttaactagtttatctcatcttatctactagaccttctcgtcttctatgtttcccctccaaaaaaacatggcattcaatgcctcaatttggttgcaaacaaagactagtaaatggaagcaacccataacataggatgaaatagccaacactgcttccaatatagtctctctcctagcttgagttaggaacttctccttcaatcccttcactttcttccacaccctgccaataacaaattaaaagacatgggcttttgacctccatatgacagtaaggagttcaaatttgttgagattgaccttctacccgaacatcttcatatatacttagaatgatagttagatgtgaggcttcttccaaggttaccctagaaaagatgatgttgtcatctgcaaaaaaaaaaaaaaaaggttaaatcataggggctcggggaaaaattttaataccacgaaaaagattattttccacaacatcactgatcatctgaaagagtttcaggacagagtatgaaaaggtagggacaaatatggttgttttcctaaaaaaatcccttcacttctaacatcattatattaatagtatattattat

SEQ ID NO: 5994 - DNA, 1668 bp, Glycine max
  Soy_ogl_5560 Gm17:7290133..7291800 Cluster 26
tctccactgagaattgtgccactagcatatcattatccctttgaacaatggtctcgaagggaacatcatctagtgaaatagcaccacaccctgctccttatattttagctcaatgaatctcttaacctcctccttgatgtgattcaattcctcaacccataaaccattaataaagaccctcttcaaatcatttgctattctctatcagtttactattttatggaaaaattttgaattctcatcctcctctttcagccaccttactctagactttttatatagcaatgactcatgtcttctagaaatattccatagctcctcagttgatattttccacttttgaatttcaggatttgtaagtaaccataactctgccctcctatccaactcccccatctccttaatcaccaatgttttcttgccctccatatccccaaagacatcaacattccatctacgcggttacctgctaaaggaatatccactctaagctcaccaaacgtatatcaattctactgattgttgatcctgctgggctaaaccaagtgaattgcttccctgctaaaggaatatccaactaattcatatcatctatgaacttattgaattcctttatctccattgagtcataaacctgaatcccctttgcttctcttgtctctatctttctctctaacaacattaaaatcgcctataaaacaacgcaaaccatctccaattgatgctttgatcctcaccaacctttcccaaagacgtcttttttctaataaagcacattgtgaatatatattaaaaactgttactggaataggttcacctttaaagcatcctctaatcccaagatagccttcctcggagaatatatcagacaaaacaaaatgatccttcctccataatattattaatcccctacctgtattcctagacggataagccttccactccactaaatgatcaccccaaagtatcatacacaacttatctgagatttgttgccttttttttcctgcaaacatacaaaatctgctttttcagcttgtattactttcctcagctctttccacttaaaccttccccccaaacctctagtattcaaactcagtaacttcataatagaccagcaatatccctactgatttcttctcccttaatcttctgaatttcgttcgtatccctggcctccatttctttggaagtattcacaaatcccttaccgtcacaaccaaataacacacctgctacctgacccttttccacaattctgctcgcttcttgattttcagcatgaatttaaacaatccttctgctttttctacgacccatctctaatttggctcttatagttgagcttcccgatacgctatgtcttctacatcttggatcataatctgacatgtacacctttgtatcctatttagctgtgtatactcccttcatcctgtggtggaggccaaccattgtcatccattaaacttcttgagtcatctgaatctccttcctcccccctccaactgtccaccgatgaagcccttgattctatatcaaaccctccactttctttgcaacaactcctctcttcaaccatttctgtttcctccaatagtcttaaggggaaaatgcggccaataatgcacaacttctcaaatccacttatttccttgctcagcg

SEQ ID NO: 5995 - DNA, 1007 bp, Glycine max
  Soy_ogl_45 Gm01:2124701..2125707 Cluster 26
aggaaaggaaggttgttgttgttctgtggaacgccgttgttcagaggaaggtttgctccgttgggtttcgcgaacgcccagaatgtcgtgcatgaaaagtgagagcgtgtgatgttgttggtcaacgccgttgacttccgctagtggggatgctgcaacaagtggaagtggagagacaacaggggattcggcagcagtgttgggttcttctggtgtttcgatttcatcaaggattcgagttgaagtggtagccgtgattgcaaatgcaaggaatataagtgctattaatatatttgcattcaggggcatggtcgtggaaagagattcacaccgcgccatagagtgttttgctatatagttggatggaagatgtatgtgttgagatgataatgaaagagttatgaggccggagtggtataaatacccaattaatagaagcaagttcaaacaccataattatattatgatggagttgatgtgtgtgagcggagtagttgatcagagtagctagctgatctcattcaaaactccccaatttctcgatgtagtagtttacactaaatcatatgcttacccataattaaaggaatgactggaagctccagagtcttctctggcaccaaccattacaagctttccatgagaggtaagagtggatgaacagcagaaactgtgtcaataataccatccaaagtccccattgcaccccacaaaattatcaacattagttaattgagataaatgtgtgtattttgattactacggatcttttaccaacactttttttttaatatttaataaaaatgtgattaaattttttttgacaatatttaaaaaatatcgttaaatataaataaatattactaatatgttttgtaatattttttaaacattattaaaaaatttaacaacgttttttattaggtgttaggtcaaaatatatatatcgctgaagatcacgagtgatagtagatattttcacaatattccaaatgtatggcattggc

SEQ ID NO: 5996 - DNA, 1376 bp, Glycine max
  Soy_ogl_1126 Gm03:47257925..47259300 Cluster 26
aaaattatattctaaaatgcattctttttttgtttcagaacaaccaattcatcctgggcctggtacatacatagccaccagttagtaaccatgacatgggtcaaaccatgagatgggcttaaaattcatcccgtccattgggacctggtaaatacatgcttcaattagcagtctttctagcaagtttttgttttctttttgtaacaagtcttcttgcaagttgccaatcatgtttgcaaacagaaaactacacgaaatacaaaatcactttgcaaggcctttctatattataattttttaagttgtattaggatgtcagttttataaaaaaaatattaattagagaatgaactattttatacatcacgcactgcaaatatttggcaaacttgaagcaataggcactgatgaagatagcgtgaagacttccctggatggatggtatgaagtgaaagctaattgtgacacttgtgtttgactgggacaaagtattgtatttggcatagaaagcctttcttttgttttgttttgtttagtaggtcgacagctcttcttcctcgtcttgcttctggcaaagctcatcagtccttacgctagatgatagcccaatgggctactgttccactctcagtctaatatatgaccatccttatctttttcttttttttccttccaagaagcttccagcactatatcagctgtaacttatttaagaaggactcatcatcaactattatttagatagaatatgaccgatatgatcaatgatgttgcggcccaaatgcagaaggaggaagtctagcattggcctaagaggagtattaagtcaaactgtgagactgaatatgtctattactgatataggcagagcagaatattctagaggacaattggcttagctattgcctatatatggttgtaattcctttcatccagggatgttgaatattgtctgattcctctcgttattcattcttctttggaggtttttctgtcttctaatacagagaatttatcacacatcactgaccacataggattttcttgtttacgttatctttgatcaattgatccttacagactccaaatctttcatattttgtgattgtccgaagtcccaaatgctccttatgtgggtttaacttggtgtggctattaatcaaggggtaattaaactatgatagtttcttaacgttactaactccttctttcttttttttacgatggttagagtcgtcagagtatattttgaacaaggcctattttaggttggcatactttggggatattgggccttgtaaatgcgcggccccaagttagcgttattattcctacatccaataaatttctattacaccaaacatattttaaaatat

SEQ ID NO: 5997 - DNA, 1310 bp, Glycine max
  Soy_ogl_2576 Gm08:9271985..9273294 Cluster 26
caatcttgaggaatgtcgtgattaggcggataggctcactaatgaattttaacatgcaagattggtttgaactacaaattattttgccatcagaagacaagaagtctaccctgatctataaaatagataagtcaaagaactcaaaacgaagcaaccggaaactatgaactgtaattatcatcatattcatagttcggattctttaagcagaatgatacaagtacaaggaaatggcaattttaacagagtgcaaatcatgatcaaacagtcaaaaagtataattgatcccctcttctttgcctaacaaatctaactatcattttaaagcacccacaccacaatgataggaaacatagtacatagacacaaataagagaaccattttagtttagcttttttgtaaaggccagaaaagtgtcttagtctctaactcaaatacacgacgttcatgtgaacgccacacttgacatatatcgcagaacaggattgtgctgataactctctaccctgttgtcatccattaaagtttaactattagacaagggcagcaggtattggactctcttagccagttcaattccttccaaacgagtttaatggctgacaaatcctaataccttgctgataaaaaaaaaaaaaaatccttctaatacctgcttgagctacagttgtacaggtgcacatccacagtagaagctattgaacccctttaaagaaactaattcatgatattctagaatcatgttttcatcatttcttctaaccaaactccaacaatacccaaataaagcaaatataaagatattgagagttaaaactagcaccaacttacctctcaaaccctttaaagtcatacactagtgagtagtgaccacaaatagcccatccactaccaaaggtccttatgctaacatagtaacattgcacattaatattagaactagtaaaacatcatgcaagcaggaggtattttttggtgtttaattcatcttgagtctgaggtattttttgtcgagtccattaaaaaaagatttttgcataaaagagtagtgtttcatatgaaaaaatgatttaaaatatttttatattagaatttgcgggaggtgttgcatgctagagagatttaaagttctcatacacatgctttacattttgtttaatattaatctaattaatatgcctctacgaacattaatatttttgtctctgtgtctttcccatattattcaatcttaaaatcttggtaattaatgtttctaaaaatgatcgagcctggtgcacttttagcgtctaagctctttgcaatttct

SEQ ID NO: 5998 - DNA, 1400 bp, Glycine max
  Soy_ogl_2888 Gm08:44610101..44611500 Cluster 26
tttgtttattagaaactgacattcactccaaagtccaacccaaccatgtctgaatattggaaactgacattcccacttgaggcaaaaccatgatccattggccacttgaggcaacacaaacataccaattatttaataatctctgtacaataataaataaaaaaaccctgccgcaaatctgaatatactaaaccgctctgtagtggcaatcaacctctcctttcattgctgctttgtctaacataaaataaacagcttcatatcgtcactgcagaaaactatataatattagaaaatgttgtgagaaaaacatttaacatgatctcgatgtaatacacatacataacaactcatacaataatttatatgatattaataatttgtgtttatttctctccatcacattatttaaattttccgtctttctctctcgatcggagggcatgggtcgcatgaatatggaaagggaaatgaggcagcaaaaagattctagcaaccagagagaaaggccataagagtaggggaacagcctttgtggatgaggctaatggcagtcatagaattatactcgactcaattatgttggaagagtagcccttgttccttgcaattaagagaaaagccttggtatagatgatttgctgaatggtagaagacttgttttggaacatcaaatttttcctagcatgccacaaattaaagaatcaagagtcataccaagcaaaatggaccatttaatttctcgtcattgttaggggagagatggatataggtcttaccgtcttacacacagttttactaaattgacagtccctgaaagtgaaagcatgcatgaatgaatgaataatggattcctcacttgtgcaacatcattagaggaggtggacaagtgccttctaaaccgttcgatcagcactagtgatcacggcattataagatattttcattagaatgtttttaactttgctctcccagccaaaccccaaatgtgattgaaaatacttgctctaggatgaagaggaaacagccatcctttgctgggatccaagcacaactgcaatgattgggagagggcaaggcatcaatcttctaaaccagtaacatccacataattttacagtgcacacagtataagttcctaaaggtagggagagattttgtttcaccatctctaacccacctgcacctgtgtagctcctgaattacaagagatacaccaaacagcactgagcataaaagcaaaagctgtaaatattcatctccccaatgaactttagaccaagattatcaaagtaaggagtgtattttcttttcaagcaatgaaacacaaacatcggccaacacctctctgaatcctttttattttttctcttcctattatatcataaatcttgtccatg

SEQ ID NO: 5999 - DNA, 1000 bp, Glycine max
  Soy_ogl_4900 Gm15:4042701..4043700 Cluster 26
gtgtgattgtttaaggaaaacatgtcatggtatattcctctaatttcctatagagcacccaaaccaaaagaagaaaaaaagaagtgtagaacgaacagggaagtgttaccattttttatattttcaagaggctcgaataatgataaaatgttcaaataataaagttatccacgtgcaatatatttaaaagggtgagggttaacaaccgtttcaatgattattgattaacttcatgaggcagggtaagagtctaaggaaagccgatcttacaagtttctactgcagagggcccaaatagagagaaccgtggcatgcgaagaacccaacacaaagggtgaaaatgtcgatagatcaaagaatgatgatgatattgatttagttaggtgggacaataagaatttgttatttttgccttggaagataagacggggcagtggttggatagtgaacctatagtttacaatagttcatttattccttaaattactttttttgaatgaaatttttaggaaattttaaaaaatgatttctttttttgaaaattgtatattatcttggtgattcctcctaaaaaattaactcacccataagcatttacatcataagagtcaatgtttggaggactatacatcgttttgactaattttctcttaaaaaattaacttatttgtgaacattttcaccataagacttaatgcttgaaaaagtgcatatgatcctggttgaatctcccataaatgttgcctcacacttaagcatttatgctagagatatgactacttatttctaatggtcgatcgagtcatgaccaagcctgacaacaaatcaggtggtataccgtaaaacagaaccgaccatacatatataggtatgtgtctctcgagagtcaatgctataaggacacatataaagtattattaggagacctttcatataaaggtaaactttatgatacacttcatgttcatgatcaagacaagttaggagagcaaagtggagc

SEQ ID NO: 6000 - DNA, 1400 bp, Glycine max
  Soy_ogl_5976 Gm18:7269901..7271300 Cluster 26
gggggttatttttcaaaagataatttttcaagcaatgaatatgtcttcttttgttgacagctcaataaatgcattagcatttgtgggaaatgagtgtaaccattaataggtcttacaattaattagggataaaaaggaaatttagcaataaaatatcatatgtttcttataattaggactaagagaatgttgtctttagtttcttatatataggatagaaggtagtattaattattatcataattatctttcaaataaactccctccccaaactataataactcgaaaaggtgcaaagtttttttttatgattgtaattagcatctttgacttatggtataatcctaagatatgtttacactttcggtcctttgagctgaacatgagactaagctcaacttgggattccatcacatttaaaagttcattgccgctccctaaatgtattatgcagaattcaaatacaaactttctcccgtgcaacttgacctcctaagataagattaattcaaggcttcaagtctaagcaagaagactgacaccagcaacttcttctgtcaacataaaattcctgatgaatttaggttcatactgtgtcaattttgctcataccatttccttggttcaacaaatgaaaaatgccactccaatgtttgtcgttaagcaaaaatcaatttgctggtttggaaaattgagctgctttttgttcatgtagctaagcatcaaatagtattagcctagtaaaattgtcaaatagtacaattttagaaacaccattaatagaataatcaatgtctactttcatattcaattgttcacaaatacaccacttgtgactacctacaatgaattccttaaacaagtgacacaaatttatggtcctccatatcctagttcatcatccaaatccctctcttgagagccttctaattcccggaatctcttcctggtatttcaatatcaaccagtgtagcagcatctttcctccggcctgttcattttctttaaagcaaccacagtctccttcatcttttacacttgcacagctttctctccgtaatttttcatacttaaaacaaattaaacatgagatttcagccaggtcaaatcaaatttaaaagtcttaagttcctcccgtatttgaagattatttcaagcatatatattgttcaaatgtttttacctttttagtcttaattaaatgcataatttgacccaaacctgtaaatgctcattcaattaggacttcttctgctagcagtcgatatgtaaaggatgtcaccatctttctttccttcagcagtctaggacgcagagcttgctattgcaaaactcatattaaccttgtcaatctttgaaaaacttaaccttagtcccaagcatttttttttacaaaacaa

SEQ ID NO: 6001 - DNA, 1500 bp, Glycine max
  Soy_ogl_1917 Gm06:13375301..13376800 Cluster 26
atatatataattaaagtattgacctaagagtttgatgtcttcaatagtatattcttaaaaggtttttaacaaaacaagttatataaatctatggtcaaatctttgctcagacgtgtgtttaataaagtcttgtgtttcttttggatctagatcttcttccattcataataattgaaaagtttccaattaaaagaagatagacagtcaaattaaatgtgcattgagattaaattgaaggcttacccataaactcaccctttcacttacatactcttaaactcactgtaggattaaaatgaatgattgagatcgatcaactcatcaaaactcaccgtatcatttgcctcattcttatttcgtttcttttcccttttcacaaacaaatgctggcggcaaagtcgaccaccttttgaaccttcacttccagtgactcaagtatagcatccctaacaacgagatctcaattctgttatggggctttcgattttcctctttttctcagcaaatgaaaatgggtctgggagaacatctattttttgctgctatccctcgacacagatgggattcaaaacgaaatgcagaaaatataatagaataacatgaaccaaattataatttaacagcaagttaaaaaaaatgtgttgtggaggttccttccaacagttggaaattcagatttgctattgtccagtgtgatatcttgtcattttttctggcgacttacaatggagaataggagaaagcaacaaaaaaatagtgctatggaaagacaagttaaaataacatgggatacgtgacaaaatcaaaatcacttatataatccaagggttcggaaaattttaattaaacctcggttgatatctcttattcttcacccaaaaagaagcacatatatagctgaattgatatataattattttaatttaattagtagtcttaactttgagttcgaatatgtaattttattaaatatttttaaaaaaaattgttaatccataataatctcataatgctggaacaaaattatctcaaaattatttcttgtaaaagatgaaatattctttgtctatactaaacaaatatttttttatagaagaaacttgtgtctattatttagaagagcctcgtgcgtatatattttctcattattaaaatttttacagtgtcatttaatgtatctttgactaattttctcttattttctcctcatttttcaactagatgttgatgtagaggaaatttatatgcatataacttttttgctctttttttcttcaaagtttcacaacacagttttttattgagcaaaggtctccagccaattagaaggacaacaaaccaatttttggttgaattaaattccatggatagttctttcgtaatctcttacgatcacgctcatagcatagtttggttaattagtgataagaaggaatcaagttacatgaagtaagtttaaaagaatcatttttttaatctgatattcaaacacaagttact

SEQ ID NO: 6002 - DNA, 1000 bp, Glycine max
  Soy_ogl_3918 Gm11:36016301..36017300 Cluster 26
ccaatccaataaatcattgaatataatccttttaagaaagtgtgtacaaatattaaatttaaaaagtgacgggttgcaacccaagagagaaaagttaagcaaaaaaagcccaaaggaaagggccacggttgaggttgaggacaatattaccaaatataatcacacatagttgtggtgggctcatatacatgagagcattcgataaaatccaagaaaaggtgggaccaaaagcaaagaaagtgtagaagcaagggaaacccgtgggtaaaggaaagaactgggtgggcccagttgctagccgagagaagggcttgccacgtgttgctttctaattggagggtgacattttaccgtcacggaaacagcaagaaattgaccgtgctgttaaacacgaaaacgttgtcagtgtcaggcagagacactcagacataggaagctgcttgctgttgctgacctactctctgtccttttgttttttacaattatcattctaattaaaatattaatattactccaataccatgttagtaattagtaatttgttataaaatactatataataataagtaatcttcatacatacaaacaataaaaaaaaaagttgatccaaaataaactcatatttctcggaatatgagttcaattttcaccgttgatataaaaaatttattaatgaataatttatgaaattttttatatttactctttgaaactttgagaatcatttcttaaaattagtttttaattaagttttatggataataaaaagttaaaaacataaatttaaaaatgagaccttacttttagatttttttgaaaaaattagatatgacaaatttttacttataagttataacataataaaaaaaaaaacataaatattttcatcattagatatttaacattatccaaaattaattacacctaaaaacaagaaatgttaaaaggcttttctttcaaattttgttcatctaacctcacaatttgtataaggataact

SEQ ID NO: 6003 - DNA, 1125 bp, Glycine max
  Soy_ogl_5341 Gm16:7692676..7693800 Cluster 26
atatggctttatgtactatgccatattgtgcatgtgccaaaggctcttgaacataccttagaaccattagagcggtcgatgtgtcaataatctttgaatcattactgagaagcttaagtggtagcatgttcagtccttcccacaatcatggagcaatgtgatccgcataggatgccaacataaattggtcagcaagaccttcttcataaggtggtctagtattccaaagaccgtggtccatccatgctgcatcatcttacgactcgtcaacctcaacaacaacaaaaaaagtggggtcagcaataagaggcttgtcatcctcagccagtgcatttgttagcttttccgcagccgctaaagctctcttgcctatgagaaaaagttgtgggcgacacttattcaacatcatgtgatggacccactttgtcctccctggtacaaaattgctcatgtggtccacattatcgagtatgaaattttaaaaaatacacaccaaaaacttgtttgtgctgtgtatatgtttctagacacagaaaataaaatttcacttgaacaaagaaaaacaaataaggtgagatatgttacctcgtcaacgccgaaagtgacaagtcgggagtggttggacagtcaacgaagatgagaggataagggagacggaagagggagaaatgggaaggtgatcgagagtctgaggtcgacgtttgtttccatgtctcagccacagttcgattcgcgcaacgacaacgtggtttattgcttcaatttgattttgtatgcgtttgtgtcttggggattcttctcttagtactttgattggttatatgagtgtcgttaatgcaatttaattgtgaattttgtgcatcgttaaaaggaacctaaaacctggaattttaattaatggcatttaaacttgtattccctatcagctgtaacttgataagaaagaataagtcatgctttgcttattatattataaatgaaagtcaaaattgaatactttcatttataatatataatatataataaggattgccaacaaaggctttcgggtctaaggcttcttttctttgtagttttcgattatatgaaacttcctctctcaaagattggttaagatcgaatgga

SEQ ID NO: 6004 - DNA, 1314 bp, Glycine max
  Soy_ogl_604 Gm02:42179287..42180600 Cluster 26
aaattcattgtttataaatacttctaagttctaagtaaatatttctatcattaaacgtattgttttaaacttcttaaatttttttatttagaaaattaattataaaaaaactacgcatatgagttttaatataataagtcatggtatataattaaggcaaaaaatttaataataaaacgaattattaagtatataactgtattaaatattaaaaaataaactttatcattgaattttatcccactcgaatagacacaagatacatgtgacaattaaaaaaaactaattattatttatcctgactaattacttaagatacatgtaacaattaaaaaaaactaattttatcccactcataatctacttagtacttacgagaattaaaaaaattactattcagccatgcattaattacacataataaacattagtccaagtaattatttgttcttatgtaatgtcaatatttttataagacctcctgtcctcctccctccacctccaccccctaaaaaaaaaaccactggaaagcgaccgtttgtctcactttaaggtcatataacataatgaatattttattatatgggtggagcctgcaaagtggacacttgttcactccaatgtaatgctccacagtacttgttttccaaattttagcaccaaaaaattagtagtatttgcattagaacgttaaaggcacatgcaacttgtggggttttctcttctttgtgatggtcaccacatgcagtaacgccgacaagtcatgacacgtatctctcatatcagctcatgcttttgtttctatgcttatctgttccatttccatatcatggggctcacagcctctaaacttttaatattatttacaattacatatctcttagagtgatgatcgatatctcatatttcaacctacgttgttcatcattcataattgaatatatagcattaacaattcacaagctatttgatatatctgatatccctattttcccactttacttgcttataacaattatctactctttaggaagtaatggaactgggggaaaatcaagaccaagtaaaaatttgtgggagataaagcaaaaaaaattttgcaaaagaagattttttcaataaattaattaaatatttaataaaactacgggacaaaaagtcattaaacctcaaaccatttctttaccaaagtcaaattctctcatattttaaagaaatacgccccatcaaagatgtattggcgccccaaatagtatgagactttaatttgttccttagctggtaaacttaaacttgagataataccaactatgt

SEQ ID NO: 6005 - DNA, 1200 bp, Glycine max
  Soy_ogl_1013 Gm03:41331701..41332900 Cluster 26
gaaatttcctttgggaaaatgcataccgtcagattagaacagcactacatgcagtttaacatcaagtgtaggggatcaaattccatcttccttcgagtttgaaagtgattttgttaaaaatagatatataattttgtaaagcttgtaatgatgcataatgatgagcgttgaatgagacagggaagttgaatgctgggtcagattcagactcattgaatgcctgtgccgtgacaatgtgctgtggtgccacgcataatcactacttagctgcccagggcacctgacacttggccccgcgcttctcaatataatctttttgtttaacattacaactactacataacataactaaacgccccccacaaaatgcaattacgtggtttgctcaccacaaacaagatgcgacgtttcctggttcccacccacctttcctttcataatttgtcatcttgcatataggaatgggtattagggtttattcaagtttaggtcaaattttaacttaatttgcttattgttaatcaatttgaattgtgttgaattttaaatataaatatatttaataattctaatcgaatcaagttgatcattacaatacttttttaaaatctatattttttgttttaagcataaatatcttttaagtacacaatcgtaaaattattatagataataatttttttaagtatttaacatagttatatacttaaaactcatactaaatatttcttattaaacttaaacaatgattgattcacatgttttttggttttaaaaattatgctagcaatgtatttattgattgaaagtgtaaatttattttatattgtatatgcatgatgattaaactctttaaactatcataaaattttctcttttatttaatttgaattgatcgggtcttgcattgaattcactcttcagagccaaggggttggtttctgtcatcgaaatatcaataatatgtcatgatattttgtttttcaactataattttctttgcctttattttgatgcatggtctcgtaaaggtggagctgatcaagctgagggaaggtccctctcctctgaagttctgcactgtcccgatataaagcaagcatttaggctccaaaagtactctttattgaaattactaacaaaaatgatggctcttgtttaatttgtacgttggtgctttttgaccttgttcctaaccaa

SEQ ID NO: 6006 - DNA, 1224 bp, Glycine max
  Soy_ogl_5600 Gm17:9138777..9140000 Cluster 26
attgctttaaaaactcaagttatttatccattgtcttagagtaattattatttatacttaattcttaaattattttacatactaattatttatcataaacaagagaacaataataagaaaatcatattaggaatttaaaaataattttaatataacaaagatactaattatatttttaatacatgtattgtttctgaaacaaactgataaaaagccagaaagtaacctttttcctttatagaattaagctaaaatgataatcagattttcaacatgaaaagaacccaaaaaattaatcgcactaataaagtgatgtgaaatagttgactacaatgggaaccgacataaataaaaaggaaactaatgagaataatttactcttattaatagccatgctataacaatataggaaactgcatcgtgttggaggcaaacaaacactcctcctgctaggccccctttgcccctgtctctttgtgcaaccttgtctcttgaaaaatggttggacttacatttaaataaactgtattttttatttcaactgggtaggatgaaggtaggatacattgggcagttatttatcatttttaccttgtttctattttaaaaataatatctaaattaaaaaagtataataaatatttttatattaaaattatgacttttcatcctcataaaattaaaaatgttcaaattgcattcatgcaaaaaatttaatatttttcatcctcataaaattataaaattaaaatctgatattttgactcgatttagatgtaaattttaatatatgattttctgggaattaaatattcacaaaatatcaaaaaactgaaacaaaatttttaaaccattctcctttattcatcttcttcaaaccccattaaaccacaaccccaaaatcacaaatcagaaccatagccattgaatgtaatgataaacataagagtcagatgctaagaatcaaacgcaaacaacacaacttggaagcagatcgcaaaaattacaactcaaatatggtaaaaactaatccccaaaatctttgagagaaaactcagatcataggttcgtcgaaggagcgaggttagggatggtgctggacgacaaatcaggagtttgggtcgcgcgggggtggttttgggatggtgatgggtggcagatacgggtatgggtgccaaagatatggtggaggtgaataaaccttcaaattgctcctaggaagag

SEQ ID NO: 6007 - DNA, 1497 bp, Glycine max
  Soy_ogl_1640 Gm05:31460204..31461700 Cluster 26
atgggtcaataaagtcatggttagattgattcttaattagcatagtttaaactcctatgtgaaataaaatagttactattagttaggttaaaatatcatttacaatctgtacttcataatacatacttaaattttggatgaacctacaaaatttgtggtttgagtagcagaacaacattcaagataccaccatgatgttgagatgaagaggaggtaagaggccttggagtaatagcaacacttgactgacataataaactattctaaataggatgaggatttgaaaatatagttcacagaaaaaagtataaatgattgtcttatcaaattctctaaatgactatgtatgtaataagtctcaatggattatcaaagttgttatatatgtcattagttaacgtttttttatcaaagactaaaataaaaaaaattatggggactaaaacaaaaaaaagtttttaaaagactaattaaaaatataatattttatagggtctaaataactatttaagccaaaaaaaaaattgaattatgccagtggaaaaagagaaaatgttaagagtgaataaccaatgctttctcctttctaatttatgcctccctttcaaggaggtttctaattaagaaaaactcacattcaaacactgtaaagattattgatcgatcttgagaagtctggatattcgttgaaagaaaacttgctgagtttctcaatttctctcttttcaatataatcgtgcccattaggatgggaaaaaaatgttactaatgaataactaacactttctactttccacttgaaaaatatttcttaaacaatcttgagttatttataatttaaaaaaaagaaataagtaaagtttgatttataatacagataggaaaaaaagagataaagaaaaaaaatattaaatgagtatttaaaattttgaattatcaaaatatagtcactctttccaatttaagcctccatctacggaagtttctaattaagggtcctatagtgcatatatattcagttggtaatgattcggttctgcgattcaaccattatgtattacacatatatatgtaattaaatatgtatttggaactaatttcaccacacaccggaatcacatgcactatttttttcttctcaactttcatttgtgttgaaatatatatctatgaaccatagacactatatgtgacaatgaaaagacaaatgccgaaatgagatatgaacactatctatatggcttttcttgaacttcaaatacacacacgatccataaataatcccccacatgcatatataaaggccaaagattcactaatctcttgatttcttctaccccttgttgggcgaaaaaagttgtttgtatcacacgggaaaggaccacacgtcccaaagtttttcagttaatatacgcgtatgaggttccagcaaaaatatgcaacaaatcttaatttttgcagctcgcaatgtatgtattttatctgaactattttcct

SEQ ID NO: 6008 - DNA, 1369 bp, Glycine max
  Soy_ogl_2397 Gm07:36493101..36494469 Cluster 26
atggccagagatcttccatgtttcctcccaagtgtggattgtgccaaggagattccctatcgccctacatttttgttttgtatgttgacaagctgtctcacttgatttcaaaggcagtggaggatggtgtttggaaacctgtgaagatgggaaggaatgggtcgttgatatcccatttaatgtttgcagatgatttgatcctttgtgggcaaactaatttggagcagatggaggtagttaaggacattctttataatttctgtgatatgtctggccaaatggtgagtgctgaaaagaccaggatctatttttcgaaaaatgtgaattctcaaactagaagagatttggtgagcaggagtggtttctttgaagtttcaatgttgggttcttatctagggattcctttgctgggaaaatcccctagacagagggacttccaacatttgttgaacaaagttgaagacaagttaacagcttggaaggccaagcaattgtcgttggttggccgcatcattctagctaagtttttgattcaggcgattcctgtccattcaatgataagcccttatatccctgcttcagtcctcaaaaaaattgaaaaagctgaaagatcatttgtttggggggatcaacaaagtaagagggagtttcatgctgtggggtggccaactttaataaagcctaaggatgaggggggtttggctatgcgtaacttacagtccatgaatttggcttgtttaatgaaaataaggtgggctattcggaatggtgagaattgattatggtgtcaggtgagagataaatatgctagacaagattttaattcctataatcttatgcataagcctgctgactctagtttatggaaggccatagtggcattgtggccttatttggtagatggggagtattgggctgtgggaaaaagtgactctgttagtgtgtggtatgataggtggatcagtgctgatattattaagttgagcaatgttatgcaggtcatcccagatcatgtagctaattataaagtgaatgatatggttaagcaggatggtcagtgggattttgaacttttgagtttgttgatccctcaggatattattaaatgcataaaagccattattcctcccagagataatgctgatgatgatagacgcctatggacaggaaataagctgggggagtactttgttgctagtggatataatcaggtgaatggtttccaaaatctcagtcaaagtcatatatggaacaagatctggaagattaaggccccagaaaggatcaaggttttcatttggcaggttactcatgaaaggcttttgacaaatagttgtattgctcataggggaaatggtcaagctagttg

SEQ ID NO: 6009 - DNA, 1041 bp, Glycine max
  Soy_ogl_6001 Gm18:8944401..8945441 Cluster 26
aggttggcagcttctttgccacaagaccctgctgcacatttgtggcaacaaactagaatggaaaggtgtggggtagtttaaggatggggagctttgacaaagcgaaattgcagtaggatattttgtatacatcgtgggcatggctgaagaatggtggaaagagctttgaacattcttttaatcaatggtcaattgacccaggaacctgcttgttagaaaatctttgttgtagcttgatgtatgttgagatgcttcatacaaggactttttatggctatgtgatacatgatctccatggaagtgaggcacgtaaacaaagtccaccaagaaagcatgagtgcagaggtcccttttggggtagtttggtcttcaatgtggtgcttggcatatatgcatggaattggaacgtgtgaatgaggtctttatggtggctgcagggactggttattggtcaatgtttctgtgcaggaatttaatatagcttcggttactctttttgattagttaggattgttttgtggccttgtatatatttcgggctgcttattgcccatatgcatagtccagatgttggcatcgtggttacctccatttattactgttgtgtgtgataaatgtagagtaaccattgttggcattttttttacggtacccctggtgccttgttaatatcacaaggttttagccgatcaagaacaaaaaccgtagtgctccttcattttccccaattgccttttgtaagagataaagagttagtgaccaaagaagagcaatacgaagaggccagatgcatcattgttgtccacaatctcttccttcagctactctagaaccaacatcggagacctgacacactcattacttgtcaaacccaaaaattggccaactgtaaactttgacagtaaaaaaacagctctagaacaagagtgttctattttgattggattgtgtattttagaccagaacccgagcaaagttgattgatgatcaaccctaggtagaatcgaggtttctccttttactgtcgtatcttcatgtaaa

SEQ ID NO: 6010 - DNA, 1161 bp, Glycine max
  Soy_ogl_1280 Gm04:7628947..7630107 Cluster 26
gagcttcctcatggtcgacgtgcggcctctctccagaaccttcttgagcccctcaagcgccgcttcctgctcctttatatccccgtcgatcgccctcatcagcccaccatgctctcttgaaccgaagccattgcctccgccctctttgtctggttcctcgttctaaacaccctctccctctgctctgccgttagctccctaacggcgctgtctactaaacggagaatcagagaggccttgtacgctcagaagctgtttgagcaaattctcttgacgcgcaagtcaccccgaaggatttctcgacattctcttggggcgtgcttgccaacattgacattgtgtttagtgtatccgtggtgtgtttgttgttgggtttgaatgtgccaatttatatactgtggattacgaaagcgtcttgtcttttttttattagggataagctaaggtgatttggagatttgaaagcgtcttgttgttttttttttttaaatgaaaaataatttttcttactaaggtttttgccgttgattttttttttagaggtactaggatgaaagtggtgtaactgtgtagggatgggcgaggaggattgcttggttggtttcgcaatgttggagtcaatggcatgccacgtagttggatgcactttgcaattggcttttttgttgtccggtctgatgctgttttgtgttgtccttttcaaaatcaaaagggcacattgttttgaaggtcgttttgaaagaacaacttcaaaagaaagaacgaaaaagtctgatcctaccgcataaaataaatattactgaaatttcatttaacttttttttttctctccatattaactgttttgacattttataaatacttaaataatataagaaaagaaaacctgaaataatgcataaaggacaaagtttctaataatacgtctagtcatttttataataattattaaatttatcttaatttaattcagtagtaggtgtattgtatttttgtgtgttgtactgatttaattgaatatgaaacttatgatttaaatatgtaaaaatattatacttttaatgatttatagtttattataaatgattcattgcaaataacctttagtcacttttttctgatagcactgattgcattaagcattgtattgttaatgaacaa

SEQ ID NO: 6011 - DNA, 1568 bp, Glycine max
  Soy_ogl_4289 Gm13:26873899..26875466 Cluster 26
cgttacacatttgccacatcattctgcctcacactcttcttctccctcttctccccggtgccgcccaacatggccgctgtcatccctcctttgagtacaatcacgatcccacctcgaccctctagcataccaggtcaatgtgtgtgacagccatcaccaacctcgtttcggacaaattcgattttccttcttcccctttctattcaactaattcacaatcaatccagcaaatttaccaacgaagaaccaatcactatgcacattcactttgtttcggatctatgacatctccaaatctactcgaaaacatttgctttacccgtgctccaattattggttcggtccaacaattccttctcaacgaaaatcgatacttcaaaaattagatctcaacgaaaaccaaatacgactctcaccaaaaaaatggttttacaactggaatgtcttcataaataatggtaagaaatcacagaagaaacataacaacaccaatagatttgcgaagaacaccttggctcaggggcagcacgtcagtctgcatcgtccaccgcgcgcttcaccccctcaaagtcccgctcgtcctccgtgaatgccacctcgatccctgtggcgaggcggatcgcgttgcgcacctcctccagcttctccggcaaccatgcgagaatgaagacgttcgcccttcgccacatcgcggtgcgccagtgccagtccgatgccgctcgatccgcttgtgatgagcacgtgtcggttcttgattgggatcttcacgggtgcagacaaacgaataaggcaaagttcgtgtccgtcattggtgatgatgcaacttcgacacgagaagagggaatgctttccaaatcccagtcgcttttttttaaaaaaattattattagttaataaaatataataattagatttttttaaataataaataatgaaatgattttaatttggccatgtggggagtgattacgctagatgaaaatttgatacttttctctattacatcatcatttaacaaaactagattacggataatatgttgaattataaaattttttcaagtaaataattgatccaaagtaatttaaaaataatttatttatcaaatatgaaaaacatacttagcaaaaaaaatactctattttttaggatcaaaattttatttaatccaaaacaaaataatcatagagggtgtgctagataatctaaattaaagttataaataagttgagttatttatggattatttgaatttcacttcttaaatatttaattgatattatttttttaattaagagtttaagcgtaaaattatgttcaaattatttaaatgagttggtatcaaactttgtaaactataactaacatgatgacctttagcatcgagtctattattatattttaaaattataaagttgtattttaatttatcctaactctattttatcagagatcttaaaagatttctgtaaacattttttttatttgataattattataattaggatattagccttcctgtgataccttactggttatgtgactaatgagttatagctattggatgg

SEQ ID NO: 6012 - DNA, 1100 bp, Glycine max
  Soy_ogl_4297 Gm13:27192601..27193700 Cluster 26
tcccctctttgcttccgttatttgctttttcatttctcactcctcttcaacatcatacccttgatttttttttaagtttcagcaattcctcctcatcctccattcaacttttttctaaagctaaaagaaagagagagaaaaactaggacaaagatattatacatcataaagctctaatatccaataccattgtatttagaccctcagcttagggttgaaggaattaaaaaatagaaagagagaacgtgggatattttgatttggtcttttacttgtatagtatttattgtaaagtagcatagcatagccttttttttaccgactactcccctttcatttcatctattaacagtgagtaatagtttcctccactaacccaataggaaggttacaatttactaatgtctagaatgaacatgattatagcataactctctcttaccaaaaatcatgtgtaatacatgaatctccttcagatacctcattttcttgctaccaatccccacctctggtctagccaccaaccacacaaatattgcagttaatactccttttcccgaccctaataactcccactgctacattttttcctgcccaaaccccaccaattcaccaatccatgcgcattcattacttcccaccctgactaccatgcatcgttttaatggtcatctatccactaatggccacacttggatgaccttattggctgcagaccatgtcgatacagaaccaaacatcccccatcataattctccctcatttaacccactccatgcaagcattctcatggtctattaaaccaagattaccaggagtaaccaaaatcttgcaccttagatgatagccacacccacgaccttgtaataataatgttccatagcttttccaggtccagctcctctttggtaaaaaccattttgttcctatgttgccaaatccgccatgtgattgtgcaccatattgacattgctttgttggagacagcttttgagaatgaccccgcgtagtgttgctgaaagtgttgctttggattgttgtgttgagccatcactaagtccagccacctgtaacatctattccatatctctcctgaaaac

SEQ ID NO: 6013 - DNA, 1652 bp, Glycine max
  Soy_ogl_1806 Gm06:6619249..6620900 Cluster 26
ccctgtgaatgaaaagagaggtaataacggaaatatagctaataaagaaggtagctccataaacctaggagggtttatcagatcccgttttaatgctctgacaatgggtgatcaaacagttaatacaatcaacggtgatacctaaggtaaccaaatatccactaaagatagaccaaattctggaaataatggtgcaaatgcaagtaagcgtggagggcccaacgaaaattctgtgaagaataatcagaaagatatggcaaagaaagttccaggtacctcgaaacaccccacccaggtggctcaaagtgacccgaaacatgcatgtgggcaagaacccgcagggaggaaaatcgggagaagaacgcctgggtgtaaaaactaatttcaaaaagcaaggtcaacctgtgattaaacataaagatcaaattggaaaggaattggttggaaattttgtttcgagtgctcctgcgaagaataaaaaagataaaggttcatatgatgagagtttacacttggtgaaatttcatgctactagtagtaactcaaatgacgtaactatgctttgtgtgccacatggacgaagatgctgctgaatttgcccacaatcaaaagcaaacaaaaacgagcaaaattggaaaacttcatgatgaaagtacaaatgacccagttgtggtcaaggacagtgacgatggtctttgaaagaccaacctcaactaattgtttttatgaatgttttagcctaaaactgtcgtgggacttgttcgaggggttttagagcccttataaaggatatttgtaataaatatgagaattccctaatttttcttatggagactcgactaaaatgattatttccaggtgggggcttgatagccatttcattcaggagggggtgtggccaatccggagggatttggtgtttatggaattcagtggaaagtagatattcttcaaaatgaccatcaatgcgtgcatatgaaagtgggatggaaaaatcaacctgcttggttcctttcggcagtttatggcagtcctaaataagtaccagaatagaaaaatgttgtgggagtctttaatttctattgctgaatctgttagaggaccttggccagtcattggagatttcaatactattctccaataccatgatcaaagtggtggttccagcaatccctcttggaggggtgctcaagactagctttcaggagatgatctcagaaacggagcttattgatgcggggtttcaaggtccaacttacacatggaagagagggaattcactaaaacgtcttgatcgtgttctaataaatttagcttggaggatccggttccagaatgctctcgtcttgcatttgcccttttttaagtatgatcatagggctattctcataaaaaatgacgcacaagaggggagctagaaaataaaagtagacgtcccttccggtttgttgcctcttggatgatgcatgatgatttcaaaccactaattcaaggggtctggaaggatgaagaagagtggaatgcacgcattgttaacctgcaagatacccttcgtaaatggaacaaaaatgtatttggccatatctttaagcgaaaaaagaagcttggtttgatgagatttaatggtgatcacattttggagaagaaacaga

SEQ ID NO: 6014 - DNA, 1400 bp, Glycine max
  Soy_ogl_5422 Gm16:36815501..36816900 Cluster 26
tctttggtagcttaaatgtctgctataatcatagctacgagtctatgcaaaaccacttttctttttttaaaccaaagtttgataatcataacaaccatgacacttttttcttgaagcagagttttcaaatttgagttaccactttcgtctttacccgtggaacagtgaacaatagcaaaatcatcccgcattcttttgtttaacgactgctatgctactgcaccttccttcatggtgctaacaaaatgccaataaaattacatcaaatcaattagtctttctcacccctttgtcctgatttacttcctttctctgtcaatctagtgggttttttttccttttatagtttttgtgccatatgtttttacttttaaggctttattttcttttattattatgttatagagatgatttttatcaacgaattatttcgattctgtcaaaaaatatgtgactgatcttttcggcagtgtaatctctccgtcgaattatattttttggaaggaaattctacacttaccggcagttaaacttttcaataaaaagttagtcaattttaagattccattaacagactattagaatatattaattcttttagaaatgctaaatgtcatgaaaagaattcatatggtacgaatcgacataatccatttattatataccttcttttggaaggataactacacttagttaaatttttcaataaaaattactcatcttaaggttctatttgtcaaactattggaattaatacttttagaaatgctaaatgtcatgaaaagaattcacatgctaccaatcaacctaatccatttattatatacctcgtttattctataatccatcatggttttcgtttcatcaatgccacattttgtatgactctcatcaaatattctttgtactatatattctacggtatttcttttggcggcaacatacattttaataataaaaaattgtgactaaattaatttagatatacatttcatttacgtttagtaattaaaaataattttactaaaacaaataagccctaaacgtgaatatacacttattttcaaatttattcacgttttttttaacctaaggtattcctctgccaagaaacaagaaataattttttgagttattgaaatctattaaaggaatcaatctttatcaaagaatatttttctatacatataaaattaaagatcaaacttcttaatacttaattaagaaaaaaattatttattagtcatatcacatcatattagttacaaaattattcttctcttattagcataatgtatgtctacatacgcatattttctttctctgttttatagtagggaaaggatgattgcagagtaaaatatgtttaaggtgcctgtaaaattgaaaaaaatattaat

SEQ ID NO: 6015 - DNA, 1235 bp, Glycine max
  Soy_ogl_5502 Gm17:4147049..4148283 Cluster 26
gtgtatttaattaaaacattcactaaaaacaataaaatatgaattatcgttcatcttaatgagataaatttaagcattacggttatgagtttaaggtttttcttgctttagagcacagtgtcatctccttcttctaattatttttaataaaaactttagaattaattttgacagacgtgcccaaattattggccaaaagaaacaaaacattactcacgacacggttacttttttcttacaagaaatactagatagtaagaaacaattttaatccattaaggttgatataatagtttgtcttaagttttgatttcattgttattatcgtacccattgaaaaaaaacagaacattttttgtaaaaaaaaaaaatgaacctttttattttcttttaaaatttatcaaaattatgtgacacaaatagttatttaaccttacattttagacccgaaaaatgacataagttacttcgtggcatgcattgacgtcccagcatatcatattgtggtgaactggtgattattataatataaaataacaataataaagagaatatttattttggtgtacatatttattgtacttattttattaattctttaactgttattgtataattgcatattttttaattttttattttctatttaacttttttttcccaagctatttgagatcaactatcttacaaaatagtgaatggatatggattacgtaccatcgacatcgagtgagatgctacaattgcttaattgttgaactttaactaataattttataatttaataagatagaagaataaaaaaaaaactgatatattgtatatttgaatatgattcaaatataaaatttggttaagatctcaaaatttctagacacaatgcttcttcctctcttcctcttttattttatcccatatttcaaaaaataaaaataaaatactataattacaagaaataaagattacagactcacaatgcttaattgttgtaggaggagtactgtagtactaatagtaataataacataaaaaaatgatcaagaaaaggagtcatagacaagttgctcatgtatgcacccgattttggcaacaaaatgccaaaggaatcatatatgtgtactcagggatatatatggctgatatatacgtggttcttggcttaagcgataatgcgatggagctttcacatgcacttgcaatgcttttataatcttcatatagtaggtggcataggt

SEQ ID NO: 6016 - DNA, 1000 bp, Glycine max
  Soy_ogl_6223 Gm18:57030201..57031200 Cluster 26
atttttgattgtttattaagttttttttattttgtcgactaaaatagaaattaggtggcagaaagaatcatatatactgattttttaagtttggctcgagggaaaatccaaattgccatgtggcttaggtagtttatgacaacaaataatatcgacacaagtttttttgctgacaggaaatcaacaccagtggaacctaagatcgtggcaggatgtgcttagctttcattttcaaagaactaataataaaagtgagatattagggaaaaaattgacaaatgtaataaagatggttaaagaatgtaatagttcgagaaagatcgagggaggtggcacaacattgggtctagagttaatgtgttgtgtgagtaacttttggtttctaagcaagaaggcatttaggtttgggcttgtaacattttggcttctttttttttctcccaaacctgaacatgatgactaagtaacccatcctctttttatatcataattatccattatgtccttttttctaaatgggacacatgccttaggacctccttttatctttcaaaaatgtttttctaaataacatataactattttgaaatgcggctatgaaaatatatttttagtagtcataagacataccttaatcaaaccacttaagagtcattgtaacatgtaattattaacgtaactatagattgagaaatgagtgcttatttgaatgtacttaaaggagagaatttattgtcaaaagttctgctttgtaattaaggtgtatatataaatgaattaatgacaaatgtaccttgaaaagtagtaacatattttccttcatgtggtattacttgcaggtgctcaaccattagaatttcgttaaagcttatggtcattgtcgtggaagctgctgctagaatctttcaagtgtcgttcgagaagccctaaaggttcaaggagtatcacaccaaggaaaaaaaaaggtaatgaagagtttgtgtggtgcactaacgatgat

SEQ ID NO: 6017 - DNA, 1336 bp, Glycine max
  Soy_ogl_1099 Gm03:45532001..45533336 Cluster 26
ataaaaaccacggaaaattcttataccgaccttctctacaagcattaaaagagatccactgatgaacattattgatagagaaaaaaacaaccatctaaggataaactccatacgagcttatgctcttccagagaggcttccgcatgaataattgacaagatatccaggatgatataatcaggaatccattgacgaaaaaggtcaacagctcactacccatgaggaaagacataatgagaggacgacttaaaaatctcgacatcaggaatgcccacataaaaatccttaagcacaatcccaaatggcaaccagtaatccttccaaaactacatttttgagccactcccaatcacctatcgactcgcctaaatagtgtgatgccacgtggtttgaatagcccgccaaatctcataacaactcaccttcttctccatcttgggaatgaagaagaaacttgcattatacttattacgcaacaatttgacccaaagagcatcaggtttagagatcaacccctaacctaacgtcataaccatggctttattgaattggtgaagatctttaaagcctaagccacccgatgttgaaacgtacttgcggcgtggagagttggaggagaagagagacttgtgcgttgggacctttgatggttgtgggaagaatacttgagttggagaagaagagaagagccgaaaagcagggtttaaattacgttgtgggaaagaagagaagaacgaaaggagctgcgtctgttgctgttgcaggagaaagaaaaggaaaaagggatacaaaaatcaattgccttttttgtggttcgacctttcccaaattagttgaatttttttattcttctaaatttaaatgaaacaactaaaattataaagggccaaaacaaatctaattgtatttatgtctctgtttttttagtttggcctagtcgagcgagtcagtccagattgaattttcctattttaggctaaagttttttgggttcagtccaacattgtaacataatgggtcaatccattgacctttacctatttagatagctctaacaagttcaaaataaaagacaaacgcaatttaaatttaaaattttgattccatttttcatatgatatttaaatttcaaaatctaaaaaagtagataaataattattttttatttttacatgttaaagtatatatgtaaattgatcagactaaaaaatatgcataaaacataacacacaagaataaatattttgtatgaaaacacattaacgtatgaattattgtataattaatattttaataaatgttttttaacaaatttttatatctgcactcatttgtc

SEQ ID NO: 6018 - DNA, 1000 bp, Glycine max
  Soy_ogl_4672 Gm14:5341901..5342900 Cluster 26
caccagctaattgataaatatttgccttccaataatctgttgactgccaccaacaccaaaggttgctcctatacatggaaatctattataaaggcttttgatgagccaaagacagctttcaagtatcgagttggatgaagggccaatttgcactcaactagattatatcaatatgaatgacacacaactccgtttaaaagacgtccttgtcaatggatgttggaattggagtttgatttagtcttttattcctaaccatataaaacaacaaatgttgtctatcactcttgatggaaacacagaatatatgatcatttggggaccatctccctcaggaacctatatactgccaaatctgcctatgattggttgattaatgagcctgttattcaatttaatacttactgagagctggaactgggtctggaagcttgacataccagaaaatatcaaacatttatcttggctagttcttcacaatagcctaccaactaactcatatgctgcgggattgttttcgggcaaaacaaatttggacatcaattggctttggcaacacatcacgctttttctcgatggatggtggcacttggtataagacccaacttcagcagcatcatggagtcctctttgcgtgtacttgctggttcatatggaaaagccgcaatgtagagctctttgaagatacagcatggagtttgtggttcacgctcattcagatccagtcaacatatcaaattcttatcagtaatcatcatctagcacctactaaggactcgtcgcttggtggcttgctctccttcagagggtgtagtttacattcgtccccagcatctgcaactttctgttttagcagacgcagtgggtgtagtctacatccgttcttagttttttttttttttttttccctttggacggtttgtttcttattttcttcgttgataaagaaaaaaaagtaagatacatttatttaaccttttatctctaaaggtataattca

SEQ ID NO: 6019 - DNA, 1408 bp, Glycine max
  Soy_ogl_1032 Gm03:41984573..41985980 Cluster 26
tcactttttaatgcactttgaacgaaacttcacacccacaaagctttgctattcaacgtgaaaaaatgcgtacacaaacacaccctaaactaaattgatggtttattgggtaaaataagagtaatgatcatggtggaagcatatcatagttgatccctttaggattattgtgagagccccatttaccactttgtaatgctgcagtgcctgttatggcctagcttgttcatctccaatgtcggagccggagaagacacgcgttggaatgatttttattggtatctaatacggactttttattggaatattcctaccaaacgtcacattctttatgcacaaattgcacactatatatatgggggatgtgacaacttaaatattgaacaaaatgcgaagagttggatcgagagaggtctaacggcaaattgtgagggggagggaaatgggaactgcctctctacgtgtaccaaaggttgtatcacaagatgcttttgttaggtccatataataacaagaaactgaaacaaaagaaatgttaattacctactatagcaggtaaggtaataataataaaacagcaagatgcatgaaagcaacaccaccatgcattcatgcatgttgaagaagaatcatagatcacaacctttaatagtagcattgttgaagaatcatgtatcacaaccttaatacaagaaatcaaaacgaaaggcggaaaaaggaatggccttacctatcatgaaaatccctaaggaaaaagaagaataatgttacctacacaatctccctacttgttatagttttgtattacagttaagttctcatttaagtgtcgacacgattcacggaagtaaacaagtacttcctttgttaaggattgtcctaaaagcaacacactttgttaactgactttaattaatttctcttttgcatattaaatatgataaatattatattgttaaacatttttttttttaaaatagtgctttaaagggttcatgttagcattttgtattaattttaaataagtcctttatgaaaaactcaatatagcctattatgccagaggcacgttggagtaataaattccagtttgagaaagaggatttgtaaagtatataaaaaaagttgttttatataaatttgtattttttttataaaagttcatacttattttctacaaattaaaagaaaaatggaagagcaccgtgatgtctgtttttctaaatgttgtagtgatgtgatgtatgtttttatacacatttaaaggatcgtgaacgtacgagagaaaaatagcttttatctttgccacttggtgtctttctatttatactcgacatcagtttatggtcatgcttaactaataactaacctacaatttttgttttcttttcaactatcgaatgtaaaa

SEQ ID NO: 6020 - DNA, 1056 bp, Glycine max
  Soy_ogl_3205 Gm09:39812401..39813456 Cluster 26
atccattgtctttgtcttttaagtattatatattttattgtgacgtaaaattatgaagcgagcaattaattgagtccactacttggccactaagtttgactcgctattatctttaaatatgttgagacaaaaagatttatcgtcatgaatttaattgtgacgcattgacttgtgagaatgctagattgcatgagttgcatgatcttcaactcaggaatttggatttaacttttcaaaacatgacacactatgcttgagctgctgaaacagggtactagtcactacagtaccaaacacctaataattcactgttaagctccaagaggccacccttgcaatccgtagatccagtaacaactgcatccaatattcatgaaccacaatgtacgaacatgcacagtaacaaacaagttcatgggaattcacatggttcttaagaacttattcgtgtgtaatgcaatttaagagaggctcatcccaaaaattatttggagcaacagaaaaaacatgccttttagtaaaaataaccaggaactcacataatgaaaaagcatagaaaagagaaaaaaaatgtgagagttctttaaaaccatatgaaacataaatatttatagtagaaaaaatagagttttaaaactacctaagaccaaggcaaagataaagtgaaacctatagtagtctaacctattttaagtttttcttttttaattaaaacctgctctaacctttttactactttggtttgatttaaaagttcactttacgataaagatttgattggtttttcctctaattttggtgtgatcaacgtaaaattatatattctataaaaaaaacgtaaaagaaaaatattgctacctcccaatgtctctcgtatttcatgcacactcaatcaaaacagttgattatatctcataagttgtgttaagtttgctaacctgaaaaaaagtactaaatccatttttaataggctaacagaccaacttctgaatacgttaatgaacttaaatctttatacatacaatcaaatatataatttctagatgaatagcagta

SEQ ID NO: 6021 - DNA, 1442 bp, Glycine max
  Soy_ogl_3992 Gm12:4299096..4300537 Cluster 26
gaagcaaaaaaattgaatgagttacttaaatatgtaaacgtgaaatattattaaaaattttaatgggtttaatcattgtagacactctaagaagctcaaaggtagtatttcatggttaatattgaaaaaatgactatacatgttaaataattttcccattctattaatataaatttaacacaccatcaattgtataaattaactagcacaagttgttccattttaatccatgatctcgaatttgagtgaaggacacatgttgtcttagaaaataaataaatttaacatgcttaaacaaattaaacatgcttaattttgggtttaaacttattattgttcaaatttaaataaaaataaatgtatataaacttagttcgttatacccctatattcattgttcatagcttcatatggtccctttagtttggcctcaaattaaatgcatttggctgaaataatttttaattagattttatttattttctgactgaatttcaaattagtcggattaagaccaaaaaaaaaaaaagtctatgtgaactatcttcatttgttagtatgagataactccaatttttcagattttcagatttcacaaacaagcttttattgccctgccattatattccgctgaatgtgttacttcattttcggagcatgataaacttatttgacttatgaaatcatagaatatagatagaagtgttgcaattcagacttctgcaaaccatatgtgcggttgcaaagaaattaaaattgcttgtaaaggagagtaaagttgttatgagtgattactgttattctgttataatagacggcagactacgtaccttaccataacttcgtctctttacatatataggtgtacattaattgttactctattattaacattgaaacacagtagcaaactattaactatatatatatatatatatgcgtgtactgatgtatatccaacacgtttctttcttgtttatttgcagctagctagctcctcatgatcaaatcaatatgtccaactggtggtttccaagtggaagacgttcatggctatctttattgtgtttggtacaatcagctatggatcctctggttctttttattgtttcctttttgcatacatatgcaatattgccctaaacaactaccaagtcagcttcatattcaatgcttcaggacggctaaagacgaaaacatagaagactgtgtttgactaaacatcatggaagtggccggtcaagtaccaaacaccaatatatatgaaattaattataaattgattaacgattattactataatgacttcctccatagtttcacattaaattaactaagtcagttttatttcagatttcattttagattattcatctagagaatatagtttgatattttgagaaacactggaaagcattggttgggttcaacttttaatgaga

SEQ ID NO: 6022 - DNA, 1000 bp, Glycine max
  Soy_ogl_6782 Gm20:36137501..36138500 Cluster 26
attttaccggacataattgttgcatttaaaaaaatatattgatgtaatattatactgtttccttaacatattcatgttcatgctgacatgataatgatactctactgcaatattatattaacattctcattgaatgtctttaatctttattggagattaaatattgaatgttaagtcaatggataaataaaattaattaagaatcgcatgcagtgaaatattttctgcttgaaattttgtttagcatttcctgtcgtcaaagggaaagaaaattttctagaaaagaaatactacttttttttttattttacaaaattaataagatataataatgaaaaaatgaattaaaaagaaggtttaagccattaatcatgactgcaagatctactgcgtgaaacttgcctatacatgatatagacaagtcaacttggcatcgttcacgcggttttacttcatgccgttataaaaacgctaatatcctttacctctatttttctttaattgatccttagacagttagacattatcatttttttataagattataatatgtttttatttccgtaaaatattaattttttttttagttctaaataaagtttatctattatttatttttgtaaaataaaaatgtgtgattttttttttttaaggaagtaagggtgttaacagagtttatgtggtggtggattatatgacacgtgtcattgcttcgttggttactctcattgcttcctcatccaacacccgcaggcctccttcccaaaccttcatcttcttcgtaacaccagagtgagattagggatggtggtggtggcagatctggaccagaggtgggtggtggatctttcgggaacaggaagaatttgaagaccttgcttgtagccaatgatcacataaaaaagagatgatgtaaaaatgaggaaaattattctcggaagtaacagcgacagtgagactcagtgaaggtttgtgcaacgacaaattttctggaaggttg

SEQ ID NO: 6023 - DNA, 1000 bp, Glycine max
  Soy_ogl_4490 Gm13:36590401..36591400 Cluster 26
gtcacaaccctttgattgtaattatcatatggacggttcatagtaattttggcaccctagcccacgtcatgtttgaatccctatatataattgtactatgttatattttggtctctgtacgtgcataacttttatgttttagtccctagacttgaaagtagttaatccgttttggtccctatgcataaacatttattttttatgttttggtctttatcggcaccgcttcccttttttcctcttataccaccaaccaattgaccataatcaaagagagtcttgaggttgcagggttcttaagcaattcatggacaagacgacgaggttgtctgttagtagcaatttatgctggcattccttatagtggtgggtgccttcgtacttgttgcattgttttaatttaaatgcataaaatgcttggagatatacgatgcgtcaaactcttattgcattatgttaatcatttgaatcttgttgcatcaaatgattgggtatttgcgccatgtaactccattagctctaatactaccacaaaatcgaaattggcagtgcaaaactatttcaactcacgaatatccacaaagaaaacccacaacgatcgaatacacaatggatatctctgatagatattcgtgggtaaacatgtatgggtattgggttgaggtaaaggttcgaggaatagtgaagcctgtccaaggtgacattaaaggcgatgttatcaggggagatgagatttgagtactgaattagacatatagaggtgggtttcaaaaagagacctaaattaggaaaacacacatattatgctcttataataataacaaatattattagataattaaatatataattgacacaatacaaataaattttacaaaaattcagagtagtattcaaccaataataagagaaaataataatattattatcttatttgtaaaaatcaaagataaaattaaaagatttacaaaaattcatactatctctccgctattttagc

SEQ ID NO: 6024 - DNA, 1047 bp, Glycine max
  Soy_ogl_6531 Gm19:43466575..43467621 Cluster 26
ttacagaaaaggtcaccgaattggtcgaaagacaagttatgaaaactaattctatgatcctacattttgtagcaaattaattaagaaaaatgattattagtacaaattcgtaatagcaccaaatgttttaccaccgctcactatcgttaatttgtgtcaaagactttgattacaaaattgctcatctaaactcaactaatcacatttcagcttttatttccatatagtgttcgtgcataaaactttcgtgctatatggcattgccgattaattaatggtctatggtattttgtaaaaagaataaaaatagaacacactttaattgcatgttagcatttttaggaaattttatattttctatctcaattcttggaatataacttttatatttattgaataattttatttactaacaattattttttaagatgaaatctaatatatataattcatcttgctaaatttcacctattttgacatacatttatagatgagagagtattatgaatcattagagtgcaacttaacttatatatgtatttaacaaattcacttaattttaagatatataaaatctaacaaataagtatattctagcttgggtgtaatttgcctgtgagacagacacttctttatatatgagtaagtaaaagtgtcacgtaaacttacaccactattatgaaaatgattgaatttgatacatgtacaccatatgccgattgagtggagcgtagattccctacccccactatttttgcttcccacgtttacagcgcccttccccactcccacaccacaatgccaacagatccactaactccattgctacacgcccactagatcatcctggccatacatggcaaatgggagagaaaaaaaaaggaaaatgtatatagaatcaatccgaatattaagtaaagtcaagaggatttgactcaattcattaatggtcatataaaaatctgattgtttatttgtatatttgtaacttgtattgatattcttcttactaactactaattaacatccctttaaattaaattaagt

SEQ ID NO: 6025 - DNA, 1008 bp, Glycine max
  Soy_ogl_4977 Gm15:10775293..10776300 Cluster 26
agaatgctaatattcgtcaactatcctagttgatgtgcattaacattcaatattaaaaaatttagactaaaaaatcattgactcttttttttgaattaaataataaaatacaaaaacatccttaaattaaattttagaaaacaatttttttttttttggatttttagtccaaatgctaatgcgtgcatacactcacaaaaaacatccatctcttcacttgcaataaggatacattattaatttaatatcaatgttttaaaaaccataaaaaggatcataaaagtgctcacgactcacttctctcttctctttttctttcttctctcatgttggtaataatcatcgttcataattcaaactctgaaaattcaagtcttttacaggctaacccactttatccatatgaaaatccgaagcaactcaaagtgaatagcaactacaggttgtcttcgaaccaaactataccccttgtttctgcttattgtcggtacagtattatcaccttgtgtgtgtagtgaaaggtttgttcatggcatagttgaacttaaaaaggaacaaattaaggagtgctcttttagaaggacattgcaacttaagtaggaaagacattcaatggctaaaataacaaaaataattaatgctaattccatatacatataactatgtattagttagtttcattgcatcatgattgatgaattctattggtttatctgttagaataccaagctccattacaattgttgccttggctattattattcttgttcaaatgaagaaacaaatatatattcaggcctccaaaaccaaccaaaaaatgcttattaattaatctagttcctttagaaatacaacaatttgacaaagtggcaaccaacaattttgctttaaactcgaaccagcacacccgcaaccaatgaacgaccatcgacaaaaccacaatgccctctgtgaaccacaagccactgttgtctccatgacaacaccgcaccatctatcaccatcttc

SEQ ID NO: 6026 - DNA, 1000 bp, Glycine max
  Soy_ogl_974 Gm03:39584101..39585100 Cluster 26
tggataaaaaaacttgttgaaaattgatgtagtcgatctccttcttccaatgacaactaaacacgagtctctgtttcaggcagattctatttggtcatgcggataaagctaatctctcattgagctaattttggaacgtccacgtcaactatccagagccaatagctctcccgctgctcaagtggtatataacaattgtatattcattgtaggcatgcagggtgcaaattcattaatttctgcatgatattgcttttggaaatctgctatcttgaagttctgattggttggtgatgtcaaggtagacacgggtggggagttttaaatggtagggacaaatttggcaaggagctgaattattgctaaggatatttttgctgaattaatagatatgatcccttctcatgtgtgtatgtgagtgttataagtacaatgttacaatatagggcttggactttttttgtttagttgggttgcaaaatgtaaatagggataacatagaaacattaagaatcctgaaaattatatttgatgaaaatgaataacatttatttagttaattattaaaatcttaagataaattttttaaaaatcaaataattacataatatttttattatactaaataatttaataaagagtaagaagatagtttaataaagaataaaatgatatttttatcaatttttaaggacaaattcctgcaacatacaaacactatatagataatgaatgtgcaacaactttttttcgttcattgttttttgctggtccatttaaagctggcttaattaggtatgaatgcgaaatccacctgatggtggtgcaggagcgtttggaagcgacccaaaaagaagcttgtattccctcgatcactgacgatgtaataataatgaccagcaagctactctggactcaggagaagcaacaaaaatggtgagcatgataagcagaagctgcagaactgtgaagaggaaccttatgtaagagaaagccatgt

SEQ ID NO: 6027 - DNA, 1000 bp, Glycine max
  Soy_ogl_4940 Gm15:9241601..9242600 Cluster 26
tacaaaatatattttctttaaaacgaagcatgaaaaaagtctctataggccagcacctttgaatctttagctataactcatgcagctagaaatgaggagaagggaatccagtttgttctcagtcgaaagggtgtctctttgttctattctgcaaccgagcgaagagacccagttaagctaaatgggaatgtgaggtatcttcctttcgttagggcagcacctggtttgttgcaagtccacatcggtgaatataacaaaaacttaatagaatatatagcccaagcaacgataaaagcatgtcccttcggggacatctgataaaattggaacgatacagagaagattagcatggcccctgcgcaaggatgacacgcacaaatcgagaaatggtccaatttttttttttcccatattccttctttcaatattttcaggcatgggtctggttaagattgctagcctcaaattgaaagccttctttgtctaacagcaattaaggatagacaataaatccttttctgcagcaaaatgtagaatgcgaatacataaattttttttcttgttttagccatacgagtaagcatgaaaagaaggacatgccctttgggctgagttttcagccctcaattagagtccaaactttggttttattgaacatgttttgtgggattttctctgcaaaggtagttgagatatctctgtagtaagtgttcactttgaaaacatatttattcgtttatgtgtctcttcttttgtccatttcatgtaatcgtaaaagaaaaaaaaaagaaaaatctcatcacccattaattaaacaatttcctattgcctatttgatgttttctgcccaattttgaattctcaaaacacagtaattgtatgttctacatatgataggaagttggataatttcattttagtgaatttcaatgatgaaaactgaaaagaacttcataaacaagaaaggaacatgaaagaatagaaaaatagaataaaatgc

SEQ ID NO: 6028 - DNA, 1089 bp, Glycine max
  Soy_ogl_6300 Gm18:60226951..60228039 Cluster 26
cgaataatacctcaagataagtacattacgtgttcatcatacatgctgtatatagtctctcatttggatgcaacaatgtccaacaatttcaaaagtttaggtttataagaaaaattgtgttgagcaaatatcatatcatgaagctacaattctccttattgtgtgggctttgtttgctctcttcagccacacttgtggtgcaattcttatcatatttgtaattttttttattagaattgctacgcacgcttcttatcattcatacgcgcgaattttaaaaaagaatatgcaatacaatatatatttaagtaaactgaatcgtgatctatgtatttgatcaatcatattaatgtttcttttataatgttgcaacacaacagggaatatccggttttgccccaaagatatgacgttggatacatgggctatgtccagtggggagttcaggaagaacctgctttcaagaattccttgcaaaattgcacttgtaaaaacgacgaccgttccaagaataaacgcacatgtacttgtgatgttgtttataaaacatgagataattttgcattagagtgtagtccaaattaaattaatgataaaataataagtgtggactcgatcttatatttttacttattgagaattttaaaaagccattatgtaaactcgatgttcgagttattatttttaattttttttaatgtcctttaaaaaattgatgtttggttcaaatggccatgcatatgcttatgtttgcgtaaacatcggaaagaggtgtaatgtacgcttatgaaaagtaactctttctttagcttttagtaataacaaaacggactaacttgaccggaccctctattgacctgcaataaacaagcgaaacaatcaaacggttgacccgcatgaagaaactagataaaataagttcaatttctgttcttatttaaacaggttttttaaataagtccagtgtgatattcatcaatgaaaactactaaattaatgtacaccccattttgaggtagattgtggtggaaagaaaaaaaaaaaagaaacaaagtgatagatgagtgatgtaacgaagaaaagaaaaag

SEQ ID NO: 6029 - DNA, 1003 bp, Glycine max
  Soy_ogl_1167 Gm04:1833205..1834207 Cluster 26
gaaaacaaaactagtcatttcttgtgcaagaaggatttattctgcaggtctgaagacgcaattctagcccatcattacctactttaatttactggcatgtgtgtcaatcatgcaagcgtgattattcaatatttgctgcaacaacattagatatattatgttattttcgtttattttgggctaaaactctgctcaagaaaaaaatgtgaaaatcattctcaaggcagattggcgggtcttccttttgctgttttttacataattgtttgtgatacaatgttgttgacaattgttgggatttttttaaatgtcaaattgttgtaccttcaaagagaaaaaaaaaatccatgctcatgggaccagccaatttaatctcttgagctgatttttttattccgattatttaattgttcacaacatataacaaatgatcaaatatgaatagatatacataaattaggattccaaggggataacttgcatagaaggaaaacaagacaagcgaagtaggttgcaaattgcattgtctttttttgtggtgccatgacattgccaccctccttacctaccatttattcaggtccgtgttgaaactgaatcaaaagagacagaaatgggcatgggcctgggcccaattatactaaataaggaattattatggaaccctatccttctaaaaagcttaaaagtaagatataaatgcaataagggaaatacttaatgctactaacaaatactgcaatattttgacgaaaagagttttcataacaatcgcataaatttcgtcaaattcattttaatttaaatttatccaatcaaatgtaaacaaatcatttcgtgcttatttcgtacttaatatgatcgtactgtttagcattgttcatgcaataaataggtcttgaagttggatgcataatgttgggataagtggtggcacgaatgactacgtgaccacgccgatgacgaaagcaaccaagccaatagtgtacactgcacaaacact

SEQ ID NO: 6030 - DNA, 1139 bp, Glycine max
  Soy_ogl_2875 Gm08:43718062..43719200 Cluster 26
acaatttttagtctattattatttaaaatatttttctgcacaataaaaaatggaagaagttgagaaattttgagagtgagcatgagaaaaatttgagaagtttcagtcgtgtaaaaaaaaatgaagtgtacccttatttatatacaatggtaaaaaaaaatacaattattaaaaattttaatggttaaatttttttaaatgctttcagccaacgattttttttttctttctcatccaacataggcagcaacgactattctttctttctcatccaatggctatttgttaaaacaataatattaatttgccttttttttttcaattagcagaactagcgttgcttcttcaatcaacccatgcatactgataaatccgtacgttgcttgcgacgccaattgcctttcaagcacattgcttccaaggtttcaattgcttcccaagctagccatgtgggtgctctaagagaaatagccaaatcagagtcttctactttaatccaatttatatttatatgtttcttattagtcaatgagcttattaatccctagaagctttcagattatccaagtattctttctctctttcttttctttggtcaacttcttgggtcttggttattattttagactcaatttggctgtttcggtaaggttaggcaaaaggacagagggctttatgagacaggcctagcaaaagataggacaaattgacacttctttatgaccatatctctcaccatgaaatcctctctgcattattgaagatgctaatccagcaagttgcatactcaacaaagcatagcaatttggttgccagacaattgaatttttaggatttggcaactccttagctattctggaataaaactctagctagctagccttcgaagtcttgctaatatgagatactatatatcccaattcagcaatctcttccaaaattcatttaattgtgatttgagatatcacttcattagcttgatctacttgaatttctctaaaaaagtacatagtatcttaatttttgttctaatttatgaggcaataccttagaaccagacgtaacatacatatgcaaatttatacgtgtattgactgataaaatgcttcatactagctccattatggttccttacattc

SEQ ID NO: 6031 - DNA, 1121 bp, Glycine max
  Soy_ogl_1564 Gm05:2983880..2985000 Cluster 26
aatgccctcatcggatagtaataccatcggggctacaatctgtagtagctcaaaattcttgccttcaaaaggatttttattaactctttcttaagtactatttttaaaactgttttgtgaggtcaaagtaagtagaacttcatttgtcagctagagattgattggtgacaggttatcttgctgccactcttgaatcgttgccagacagtgattgaatccagaagcttcgtaccgggtgaaattggattgttaagacttcattcctgtcgtttttaggcggcacactgttgattctccaaaggttaaacgaaagcttcttttcctacacacatataacgaggctggggtttctggttgcttgttgatctcatcatgtgtttagttgggagagtccaactgcccacatggcttattctgagttagttgatgatttctaactagcaaatctgaaccatttttatgtgaggggcaaaagggaaagagcttaagtaagaattgcagaccataccaatgactgactgatactgttccttatagcacaccatgacttatgaatcttgaaaatcaattcatttaagaaatgcgtcaaaatttgtagatcaggctttattcatttgttagctggttcactcatcgacactactccatgatggaaggccatcttcctgttgttaatttctgttttaacaagttcacttgttctcatagtgacacccaagtatgcaaactctcttcaatgtcctcctgtttatcctgatacaatttttttggactaattttgattttttataacgccagcctttctctatgatgctgtgttttttagtaacgggtggttggttgagtgagatgttggattctcttttaagtaaggtttagcgttagatattgtatatggaacagaaaagaaaaagaaaaaaaagaactgattaggagaattagtcttgtcataaaatgttgatttctggaagaaaaaaaacattaaatgataatgacaagaaatctcaaaattaaatctcaaaaacaataaatgtagatttttgaaaggaaaaaaaaaacattaaatgtggatttaaggtcaacttcatattttatcttttaaaaagtttaatttgatcatt

SEQ ID NO: 6032 - DNA, 1200 bp, Glycine max
  Soy_ogl_4905 Gm15:4438001..4439200 Cluster 26
caaacatgagttgacttatagttcatggaagtttttgatttttgcaaagaaattataaattttcacatttttttacataaatccaaacaagacttttaatattttataatttttaaaattcaattcctgccatttacaagattttaaatgatttgtttttacggaaaaaaaaaagctacaacaaacaaaaccaaccatattggagttaaaaaaaaactatattaacattgccacgtgaccaaaataagtcatgtgaaacagtaaaaaggttcatgttcattagtaacaaggttggttgatcttgtttggaaggggagggggcagtgattgttggatttctcctccttccatgggtctatgtacatgaattcaggtcaagcttccgctgctggggctcttcgaaattattgtggcaatgttctgttatcttatgggcttgtggggtagctcatgctgagctttgggccatctaactgggcttccattacttagcgacgtggatttaaggagctgatgatttcatttgctttccataggctgtgagcatgcctgaaaatctgttataaaattaagtttggaataaaagttattttgtcaacggattaaaattcatgtttttgtgttcattttagttttatctattgaatctatattagaatgtgttatagtattttcaacagtaaaactgcaaactaagcttgcactatataaattctcattcgagcttatgcattggtacaaaatattacttctttcaagagattttttgtttttgtgaagctcttctttcaagagattaagagtaaggtttttgtgggtgtgcataccttgagttttattgcagttgtcaatttcggtcattctttagagagacaaattagaacttgaggttgtttcttgttttgacatatacttcttctaccgagttttattgcagtttttaatcttttcttggagttttctctttttattccatgaagtttttatttttagaaacaatacaaaaagttgtgcctactatcctctttttattactattgggtagaagatagtttttttttttgttaacagatcttgaatgtaattggttttggtttctaagggaaggtaccccttgtacctattatcctctatcttaatgaaaattcactgtttataaaaaaaatacaaaaagttgtgcaatgataaaatcaaagcaat

SEQ ID NO: 6033 - DNA, 1037 bp, Glycine max
  Soy_ogl_3673 Gm11:1317964..1319000 Cluster 26
aaacacttttaatttaacaaccataaacatttatccacgaatcacataaatgtgattatatgagtggtatttatgaaaaataattagaattctttaatttaactcaataatgctaaaaactgcagtgtagtaaacgaaaatctctgcctataatgtttttctctctataactttatataatcaagagaaaaataggtagataaaagatgaagtgtcgaaatatgatgagtaatgtcatcaaaatatatattaagaaatgcgtgtaaaataacaaaactcgtagtaaaaaaaaatattaacaacaacaatgttggaatatttctatctagactttaaactcttaatttttttaaaaaataagcatctcatatgcttaataaaaaactacaatcccatttgttagaatattttttggtaacactatttgttagaatataaaagaacataattaaaaaaaataaaatgaaattatttatttctgtaaatataaatgtatatgaaattaaccggataacatatggtaatgtggtatataaaattgataatatattttataaatatataagaaataaaataaaggcaaatgcaaattaatatcttaataaatgagtaaaattaaaaatattctttaagaaattaaaatattagtcatatattttaattatctattttaaaaaaatatttttactataattcattaatatacctcaacctagtttttaataaatttatttattaatttaattgaactaattacaagttccataaaaatattatacggtactacaaaggtgggactggcgtggcaatagtgaatattgattgagctggacgagacgtgtgacgcggggaccaaatgattctgttggctgttgcacacacttgcacaaaacgaacgaggcccaaaaccgttggattgattacgtgtaaggctgcgattgagcctgtagagtgacgcagaataacatggaatatctctgtatttttgtgattctagattgtgaatccatatttggcattttacggttcttgtgttt

SEQ ID NO: 6034 - DNA, 1226 bp, Glycine max
  Soy_ogl_6276 Gm18:59440074..59441299 Cluster 26
taaaagctctctaaaaataacttaaatattttttagtatctcaaaattagatgaagtttaatttacatcgaattaaaaaaatgatttgtgatgtccacaatttgaaaatagtccattttttattcctaattagtgattatatgagttatctctaaattaaaccaactaattaagaatgtctataatacaagattgtttaaatagattattatttctacaccttaaaatactacatgaatttaagaactttacataaaatatcacttcaatattaagattattaaaataagtttttaacttattttttcttgcattcctcttatactagacctaaaaattacctttttttattgatataaaaacaataaaacgacattatttaacgtcactagcataaaaagcacctcctcaaatgctttagtgacaattttggtaaacaacacgtttaatatctaagtaatttatataagcaacagtgttgtagatgatttataaagtttgtccaaatttgaggtacttaatatacactgtccaaatttcagtaagaaaggtatttacaattagtatttgatcgaacttggaataggattatttccagaaaaaaagagatatatggaaaaaatattcaaaccaaaaagaaaattttctctaccaaaggttcattaatataaattccaaaataaaaaatggaaataataattaagttgtagagcatacttagtgtatttgaatttaaattaaaaatgtagtgcacacagttctatacaaatctaacagataaaagtgagttgaaagtaaaaataaaaataataatgttttggtaaatatatatttgccttaaaaataagtttgtaacttctattcaaatacacacataccaacttaccaagtgggaaaaaaaagaagagagattgtacagaaaagaagggcagcaaagcaagggtgggagggagagaagctgaggcaccccacaattcccaaccaaaccaaccataatgacatatatgtttcactttctcactgattttaaatggcaagttgtgtgacagaaaaatgaggtaccgaaacgtggaccgtacgtatagaacagaatgattgagatcggacggcggaggagagttgtgggacagataaggaatctccggacaacacggcagcagatcatattgaggattatcagcggatcccggtggtggggccaccacagaggagagccaacttgcacc

SEQ ID NO: 6035 - DNA, 1300 bp, Glycine max
  Soy_ogl_363 Gm02:3862501..3863800 Cluster 26
gagttgtgactttggccaagtatctatgctcacgattttgtaatggtttatggtatgttgaaataaggtgcttgaggagaacatgcatgcaatctttgactaaatacctttggttgttgataaattctgtatcaattgtgtttccattttcaattccaaactgaattcttcttacgtgcaataattcatgaactgttaaaggtatggggctgagcaatctgccctgttcaaggtataagatagtctgaggtagggggaaatttcctttattctcataaattttcaagggcctatgattgtgtatatgattcatatatcttataaaaaccggcgattgtttgtgattgaagagggtgaatgatttggattgaaacggggtcagaatagaaaaaaagatgttgcatgttattgttctatttacacctagcaaaatcgttcttgcatgtgggattaaaggggtcagtcaatgtccaaagttaaaaaaaagttgattgatgtgtattcttatgccttgatatgtttttttaaggttaaacatctttttcggataatacattttttgatgtgtattctcatgccttgatctgttgggtttttgagaaaaattgtcttttatggtttagtttgaatttccacttggagatataaggttggttagattgttaagaaataagaaataagggaatgaaagaaaaagcatggtttgatttcttgtgttaaaaaaattaataaattaataattaatatttaccgataaaaaaaaggtgttgtatctttttaaatgttgtaaaattttaaaaaaggaacattgaaccagtttgaagagctagtgttatttaccttttatgacaatcttaaattttgttagcaccttcataggtcttccgaaaacacccatgtcctattaacgtactcgaagatagtcaaggttgtagattagggtgatgtctatagagtcgccacacttacgcgtccattcatgcaattataaaccggaatacaaagtcgtcaagtgtgggtttggttacgacgatgagagagtgacacttacaaggtggtggtggtccttttcgatattaaatcacagtatcgggagctgagagttcactgtttggaacaacaagtttatggacagtttgtgagtgacactcttaactggttagcacttcccaccccgtcgagttatgattatcaatagaaaacttttagtgtcaatcagttggtagcttttcgtatgacctgaagagagagagacatacagatacttgtcaatgcctgatggtctctctaaagtttcttt

SEQ ID NO: 6036 - DNA, 1122 bp, Glycine max
  Soy_ogl_366 Gm02:3961872..3962993 Cluster 26
aattaacttttaaaaggaatatttattttctcacaaaattactcataataagtaatttattcatttacaatcaattaatcatgtagtagaagcaaatataatttgtctctcatccatgtaaaaacgtgacttttaggactactagagtccaacatttaactttttatgtgtagcatgaaatattaattttcaaaatgatttgtaatcatatttatttatttacaaaaacaatagcatttcatatttaaaataatttcaaagtgacttttttttaattccactttttatctatatatttaacacttgagaagaattaacggctcatcacatccacctcccatctttttcacacatgcgcgcgcccattataaggcctaacttcaacatgtttctaattcatttccagcaccactttttattccaacagccaaattatattaatagaaagatgaaaaggattatatttttttatcaataaatattacttgttatttttttacttttcattagataaatggatcaaactctgatatttttttttccttttttcttttttccttcaactgctcttatatctgcatacgaaagaattacacgagtcaggtaagatgtcacatgaagttccatccaccctcaatacatatgacagagtatattaaaacaagataaccactacatcagattcctttcaccccatttactttccccaatgaggattagccatcttacatgatacccttatacctgtaacaccaccatgcacttgtgacagacccgtagggtgtgtaaaaaaaaatggattcagatggaactggattataatcgcttaaatcgaatggtttttatcatcggatccaattttcaggcatatataaagcgagtaattgaatcccttcattttggccttccaccagcagcaccaaaaatattgcagcttccctaccactgcctccatatcccgattagcctagcctagctcttcaaatataattgcgtttcggtattttcaaatagcccaccaaaccaacttcgccttcttccctattatatttccctcatgctgcaagaagtgtccttgagtatcccttggttcacatggtcgatctaccatttgggctcaat

SEQ ID NO: 6037 - DNA, 1516 bp, Glycine max
  Soy_ogl_1078 Gm03:44018485..44020000 Cluster 26
tacaactaaaaagggtcagcacaaaaataacaaatagtcatttgcgaaagcgaaattatatatgactggagaaacaataaaagtaagaattttttttggtgaattacaataaaagtaagaataactccttatacctgaattcgattcaagttcttacctttaaaaaaataataagatcaagaatgaggtaaaaaattcatttccattttacatgccatattcaatcttattcatgcataatgtttttgcactgtttaacttttgtcatatagatattactcctcttgttgaattattaattttcttctagaattgattcaaatgggcatatatttcttttatataatgataataaagtttatctaaatcactatcattgattaactctagtagattcaaatgtatacacatacaattagcgcttatgcaaagtagtgacagatctaggatggtttaatttgaagtaacttcattttgtgcctcagaattttacaaaatttgccaagcaaatctatttattacttgaagtttttttagcacaaatacagtgtgtctatgtaaatgcagaacgaaactcacaatgaattttgttaattaattatatctatagacgccggcctgtcataatccaataaactattttaaggaattatgtgttgaaaagaaaagttgaagccagcagatacttaattggaaaaaaaaaataggggctggaaacccaaagaaaacgtttggtaaacgataattgcctttcccattgatacccaactgtttgaaattgaaacatcgcagacaggaaaaaaagaataatggaaagatggaaagggaaatctaaatttgattgaaatgagagatacaaagtcagaaccgccggttctgcgaactaattgaatattttttaacaaatgctcatcaaactctaatcatagttaagtaaatctatgcagaaaaattaggactgcatgcatacatgttggagcaaatactactactattagacataaagtgaatgataagagctaaaatatagcgtagacttgacttgagtattttattttgttttgtttataaggggcgccaattgttatgtcaatatgtgcagctaggtcacgactcactcaccaggaaagttagcaagttagatccgaagaggttatacacttttgacctagttgagttctaacgcgtaaactctgctatggacacttgtatatagctatttggtgggccatctttgaggcggtgaatggcccacacgtttctcagattctgccaaatttggcaagctgggatcaatgaacaatgagtcagagaagaagactccaaagtcgagcggttaaggcttcactacatgcttgtttgaataaatagacaccccctgctcctgttgtaacctttgcctttcaaattaataatgcaacgcggaaactaaataagttatttaattataaaatattgcatgcagaataatcctcatgtacacattgattttgataactctatttccattgtgcat

SEQ ID NO: 6038 - DNA, 1300 bp, Glycine max
  Soy_ogl_2114 Gm07:1381701..1383000 Cluster 26
taattttcttacaaaaatgtctttaattatgagtcattttttaaattcattaaatagcatatggaatatatattatttgtcttggacatcttgagagtttaattgcgtgtgaagaagagattaagaaaatggaagttaagaataagagtacatctcattaatgtttggggtgatttaaaaatgaaattagtgtaagcagtaaacataagttccttttcctgttccgttaaattagtactacttgattatgagggaccaattttcttttcgttcttaggggtccatagtgaaaccaattaaaagcacacgattaatgaacataaattctactcaggctcaggcccactaagcttcacctggtcccgtggtactacttatgatttgtgctccttgtttaccgctgtcacatttgtttcaaagataagatcaaagttgaagcatgtccacttatgattgccgaatttcaattcagaatttgaataacattactccaatgtgagcaatatgaacatggccatgattcatgaaccccccaacacttcatacacgttattgccaagtgccaaccgtcacgtcccccgtaaacaacactaggccatgcgtgtactttcctctacaatggtacatttggttataacaatcaattgttgcattttagtgtctgagaaatcaattaagaagaacgcaaatatggcatccctttttagcatcctctgcacggcttcgatcgttgtcttcttggctgtcaaatttgctgcggctagggaattcaaaatgggtggtgatttgggttggcatgaacatgccccaacgtcactgcattttataatcattgggatgcaaggaacaggttccaagttggtgactctttggttaagagtaagactagttacatcactcatttatttattgtatgggaatacaacttttcttagtcaccttttgcggtataatttatatatcattttttttcttttgaacagaaaataaaataagacaaaacttaaatacaacttgttagatttcaattagaattggagtttcaatctgataatccacataataaagatttgcattaaaggtgaacataaattattaaggtaaaactccatattagagatcaacaccaaattaaaaagcacaagttttgtacaaaaaaaattgcaactaatatgtgccatttgtttcaaatagtaaggtgatcccattatataaaaacacgttaattgaagtttttgtctgtgcagtttttgtgtaccagaatgactcagttatgagtgtgtagaaatggaactacttt

SEQ ID NO: 6039 - DNA, 1300 bp, Glycine max
  Soy_ogl_2634 Gm08:12422701..12424000 Cluster 26
tttcaaggcttgattaaggtggtcaagcttgtgaaacacatcaaaactattttagccaagagataaatggatgcaaatcaagatagagcaaaaaaaaaaaaattgaatgcaagttaaaaatgaaattataatttatccaaggaaattgaaaagcaagcgaggaaattaatttcaattagaatatttggatagagaaagaatgtatagttcaacccatccaaggatattcaaagataaaatcagaaatgatccaataagatatttaaaagaaaaatcaaaatcaaaatttaatcttatcacaataatatgtggtttatttaaaatttaaaatctttctattatctcctgaggattttcctttttaaaatttttgttatttatattgattctgttgttgagttgtgtgcactgggtagaagaagatgaagagagaggtgactcaccctcagaccctccctgacgaattgatccatgaaattctattgcgtttcaaaagtgtgcataaatcatggctttctctcatatctgaacccgggtttgctaaatcccactttgatctagccgcggcacccaccaccgacttcttctcaagtgcttcaatattgatcctgaagttgataattcttatgttgatatggtctctaacattccacttccattatctgctatgggaagcatgcatggtaaatatttatactattaaccaattctgccatgggaatacagaacacggacaacaatgatttctttgattttgtcataaccggtcagcgtatacaaagacaaactaatcatgtgtgtatccatcctcaaatgtccggcattgggaatgattcattagctgatgactacgtcgtggcgattctacaattgtcactagatcaagatttgccgtcatatcccaaggtcgattttttttcttcgagaaccaattcatggagtcgcatcgagggaacccttccttgttatttttcagggcaaaaaaatgtcaggcataagttcgtgcacaagttcatgcacatgttcttgaatggagctcttcattggatgattgaatcttataatgatcttggtctaattattgagtttgatgtgagggaaaggagattatcagatattccactgtcacgctatttaaccattgaatgggaatataaattacatcatttgactgtgatggaaggacttgtgtgtttgtgtctctctgactatatggatgatctcggcactactgaaatatggacgatgaaagaatacaaagtacaagaatcttggaccaagttatttgttcttcctaata

SEQ ID NO: 6040 - DNA, 1032 bp, Glycine max
  Soy_ogl_6940 Gm20:42592969..42594000 Cluster 26
aaagctattataaaaataagctatttctttatattattgagataaaagctatttgttatgtgtaaatgaaaaggctattataagagaggtccactagtacatagggggtgacaaactagaccgatccactccaccttgacgttgacctgcaaaaaacgggttaaaatggattgacggattcaaaatcttaatataatcgacaaaaaataagagggttaggagattagttcatcggattggacccgttttatcaccctaatataatttttttgttgttgttgtttagatcatagattaatttattagatataatcttattcgtgtaggatatgaacactttcagcaacaaaggttcaccataactttgaattctattctaaacaacctttaattaaaatatcactacaactttcaattcaaataaactataatccaagaaattatctacctcaaattaacttagtaaaagaggccacacatgtatgttgataaaaatgtcatacatttttataaaaatgcttaatatataactctctcgtttaaagtaaaaaaaatattaaaatttacttcagaactcaatcagcgttggactcaccctaggttaatgcatatatctgaacaatccgactgaaacacaatataggtagctatacagtccccggatgcatgatatgtgacttaacgtacaagatttattattaatcataattgaaaggacatttttattgaagttacttgttagcattgttttttcttcaaattcatatgtatataattttatttaaattttaaaaataacggtgtatctagatatttctgcctgtaatcaacttaacacaagggaaagattattgaatgaaatcagaaaactagttgcaccgagatgaggaaagcaaattgtgatgacatcttcaagaagatcgatcaattgaagtctcaagacgatacacaatgtgttgagaataagttaggccgttaggggcaataatatgggctgaattcatactgcaatcattcaaaagtacaacaatg

SEQ ID NO: 6041 - DNA, 1344 bp, Glycine max
  Soy_ogl_187 Gm01:47709757..47711100 Cluster 26
ttgtagatagtcaaagccatatctcctagtcaatttctaccgaagcatgctcaatattttaatcaatcaaatgggaaataaaagtttgctttactgtatcatcagttggaacttattcaagcgattgatgaccaatcagtgcatggtggagtggaaaacacgtgcaattctacacctgaacttacattgactcatcatgtctttatgttgcacaggcaggtgcaactattatgtccttttccttcacagtaaagtagggcacacacaacacaagatatgcaaatacaaaatattaattcagaacttagcagttagcacgtacctttgcgaatcaatcaaattgctgtaacatacgaatttgcagctagcaactccgttttcttttctttaaagggtttggtatacatggacagttttacatcttgtctctgtaaagaggaccaacatgaaaaagaaagtggtttattgaacattttcctctttgtagatcagaagagaatagttcagccacatttttatctttttcttgtgaccctttttttcttttctaatttttcatcctttacagaaaatcctatcctgatatgtagaatcaaaataagctactaacaaatgtgtggattaactagcgtaaagttatttaaatttaaataaatatacaacaatattaaatattctaataaagatatttatgtttataataatctcacttcctcaaataaaattgtgtcaattgaagaattgatgtgttctctaccctagaagaatcaagacaagctgaatattcagattgcccctatttaatttaattgcgtccttacctccaccacaaaacaaatcaacaaatgcatttgtcctctgcatctaatcaaacctctttcctttctttccctatcatcaaatcatgaaaactcgaatcatgctataggctaatatattctcctccttttataaaatcaatctacaaacttctaatgatattaaaacctatcatatcttaataagactctttattccttaatcattacaggggttactttaagaataaggcaaatcctcccaacttggcccttgctttcatgtactactttataggaggccacatagataagactacacataagacctaggaatccacattttggcaaaaccccaagattctttggtttgaatttgcatcatcatgcatatgaaaactgagttagaaagaagttgcatactgcagctagctgcttgagcatgtatacatgtataaataagacgcgtacgggttaggtttaaagcttcaataaacagtatttgcacgagacagcgcacttgtgtctcttcttttaacaaatggta

SEQ ID NO: 6042 - DNA, 1100 bp, Glycine max
  Soy_ogl_325 Gm02:2460001..2461100 Cluster 26
gaattaaaagaatcattacataacaaatgtccccgatattaaagggttaattactggttgtagtccttaagccaatctggtttatgagtctctcgttcgatgatgtagcctgactatcaactcctttatgttattttgagaaagtagtggttaataacaaattttatacgtcccagaaactgtcaatctatatattaaatattaagattaatattggtacaccatacctggtgatatttagtacgaaactcacgaattaatctatacatgcatatattgatatcatttactaaaatacatataaattaagaaatatataaagtatatgatttgaaggaatacttcaatgtttattacagtaaatgatatcaattagcaaatgcatttgtgagtttcgaatgtgaatatatattattctttgcagaaagaagcttacagcatttcatgcaaatattaatttgtactataaataacatccctcttcttataagacttttatccagcataagggtgcataataaacttagacaaacaatatatgcatagtcttttgctaacggattaaaacccaattaatgtaacatgattatatcagaacttaacattcaacaatcttttcttatatatacagaggaggatcaaaggctactaaaaaaacgacacaactaaaacgaaaagagaatgacacgttgccgttgaagttaatgtcggggacaccgcatcggagtaacgagagtcgctgaatggtctcgttgtttaggttgccggtgggttgcagtttgaaatattgctggtaggtcttgatggctgttattgtttcctcgtcaagagaaacgttgaatggcgtagaggattgaaggtaaccgaaatcagaaaagtactctttgatgagagataggcctttgatttgtttcggtggtgcgttaatttggatgtaattgtaggggaaacttttgttcgatattgtccatgtgattctcccatattccttgcttgaacgccttgcccccttttgcccttctcactttggcagtggaagaaggatggaaacggaaattcgccaaaagggattggtcgacaaggagaaggaatgcataagg
